United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 77

SEQ ID NO: 3250835 - DNA, 17 bp, Homo sapiens
tgtgaaaacatatttgt

SEQ ID NO: 3250836 - DNA, 22 bp, Homo sapiens
tgtgaaaagtatcactctaaaa

SEQ ID NO: 3250837 - DNA, 13 bp, Homo sapiens
tgtgaaaataaag

SEQ ID NO: 3250838 - DNA, 18 bp, Homo sapiens
tgtgaaaataaagcagaa

SEQ ID NO: 3250839 - DNA, 18 bp, Homo sapiens
tgtgaaaatatacttgac

SEQ ID NO: 3250840 - DNA, 13 bp, Homo sapiens
tgtgaaaatgggt

SEQ ID NO: 3250841 - DNA, 15 bp, Homo sapiens
tgtgaaacacagctg

SEQ ID NO: 3250842 - DNA, 22 bp, Homo sapiens
tgtgaaagtcagatgcccagag

SEQ ID NO: 3250843 - DNA, 18 bp, Homo sapiens
tgtgaaatcatcaaaaag

SEQ ID NO: 3250844 - DNA, 19 bp, Homo sapiens
tgtgaaatcatcaaaaaga

SEQ ID NO: 3250845 - DNA, 14 bp, Homo sapiens
tgtgaaatgctggc

SEQ ID NO: 3250846 - DNA, 13 bp, Homo sapiens
tgtgaaattgcat

SEQ ID NO: 3250847 - DNA, 23 bp, Homo sapiens
tgtgaacagagagacccttgtgg

SEQ ID NO: 3250848 - DNA, 13 bp, Homo sapiens
tgtgaacagcata

SEQ ID NO: 3250849 - DNA, 16 bp, Homo sapiens
tgtgaaccaagatcta

SEQ ID NO: 3250850 - DNA, 16 bp, Homo sapiens
tgtgaaccaccacacc

SEQ ID NO: 3250851 - DNA, 17 bp, Homo sapiens
tgtgaaccaccacaccc

SEQ ID NO: 3250852 - DNA, 12 bp, Homo sapiens
tgtgaactcatt

SEQ ID NO: 3250853 - DNA, 20 bp, Homo sapiens
tgtgaacttgtagctgtaaa

SEQ ID NO: 3250854 - DNA, 14 bp, Homo sapiens
tgtgaagaatttag

SEQ ID NO: 3250855 - DNA, 22 bp, Homo sapiens
tgtgaagaatttagatcttata

SEQ ID NO: 3250856 - DNA, 15 bp, Homo sapiens
tgtgaagacattttt

SEQ ID NO: 3250857 - DNA, 16 bp, Homo sapiens
tgtgaagaggaacagt

SEQ ID NO: 3250858 - DNA, 20 bp, Homo sapiens
tgtgaagcaaactctaaaat

SEQ ID NO: 3250859 - DNA, 22 bp, Homo sapiens
tgtgaagcatgctttgctgcta

SEQ ID NO: 3250860 - DNA, 13 bp, Homo sapiens
tgtgaaggcccaa

SEQ ID NO: 3250861 - DNA, 18 bp, Homo sapiens
tgtgaagtgaatgaaaca

SEQ ID NO: 3250862 - DNA, 14 bp, Homo sapiens
tgtgaagtttacat

SEQ ID NO: 3250863 - DNA, 11 bp, Homo sapiens
tgtgaatacaa

SEQ ID NO: 3250864 - DNA, 19 bp, Homo sapiens
tgtgaatacaattaaaggt

SEQ ID NO: 3250865 - DNA, 20 bp, Homo sapiens
tgtgaatacaattaaaggtc

SEQ ID NO: 3250866 - DNA, 21 bp, Homo sapiens
tgtgaatacctgctcacgtca

SEQ ID NO: 3250867 - DNA, 14 bp, Homo sapiens
tgtgaatgaacact

SEQ ID NO: 3250868 - DNA, 17 bp, Homo sapiens
tgtgaatgaacactctt

SEQ ID NO: 3250869 - DNA, 23 bp, Homo sapiens
tgtgaatgaacactcttttgctt

SEQ ID NO: 3250870 - DNA, 13 bp, Homo sapiens
tgtgaatgctaag

SEQ ID NO: 3250871 - DNA, 17 bp, Homo sapiens
tgtgaatgcttctcact

SEQ ID NO: 3250872 - DNA, 13 bp, Homo sapiens
tgtgaatggaagc

SEQ ID NO: 3250873 - DNA, 14 bp, Homo sapiens
tgtgaatggaagca

SEQ ID NO: 3250874 - DNA, 16 bp, Homo sapiens
tgtgaatggaggcaga

SEQ ID NO: 3250875 - DNA, 19 bp, Homo sapiens
tgtgaatggattggattat

SEQ ID NO: 3250876 - DNA, 21 bp, Homo sapiens
tgtgaatgttgtgatgtattc

SEQ ID NO: 3250877 - DNA, 23 bp, Homo sapiens
tgtgaattaggctgtaactactt

SEQ ID NO: 3250878 - DNA, 13 bp, Homo sapiens
tgtgaattcagat

SEQ ID NO: 3250879 - DNA, 14 bp, Homo sapiens
tgtgaattcagatt

SEQ ID NO: 3250880 - DNA, 18 bp, Homo sapiens
tgtgacaaaggatgaaga

SEQ ID NO: 3250881 - DNA, 13 bp, Homo sapiens
tgtgacaagccaa

SEQ ID NO: 3250882 - DNA, 19 bp, Homo sapiens
tgtgacaataagtttgaac

SEQ ID NO: 3250883 - DNA, 15 bp, Homo sapiens
tgtgacaattctgtt

SEQ ID NO: 3250884 - DNA, 17 bp, Homo sapiens
tgtgacacatatgcacc

SEQ ID NO: 3250885 - DNA, 13 bp, Homo sapiens
tgtgacacccaca

SEQ ID NO: 3250886 - DNA, 16 bp, Homo sapiens
tgtgacacccacaatc

SEQ ID NO: 3250887 - DNA, 20 bp, Homo sapiens
tgtgacacctaactcttttc

SEQ ID NO: 3250888 - DNA, 19 bp, Homo sapiens
tgtgacaggaaagccctcc

SEQ ID NO: 3250889 - DNA, 23 bp, Homo sapiens
tgtgacagggccagtggggcctg

SEQ ID NO: 3250890 - DNA, 16 bp, Homo sapiens
tgtgacatggtgcctg

SEQ ID NO: 3250891 - DNA, 14 bp, Homo sapiens
tgtgacatgtaaca

SEQ ID NO: 3250892 - DNA, 20 bp, Homo sapiens
tgtgacattccatgacgaca

SEQ ID NO: 3250893 - DNA, 22 bp, Homo sapiens
tgtgacatttacaccacacttt

SEQ ID NO: 3250894 - DNA, 21 bp, Homo sapiens
tgtgaccaactgtgttgtatt

SEQ ID NO: 3250895 - DNA, 14 bp, Homo sapiens
tgtgaccagcactg

SEQ ID NO: 3250896 - DNA, 14 bp, Homo sapiens
tgtgaccatgttca

SEQ ID NO: 3250897 - DNA, 13 bp, Homo sapiens
tgtgacccaccag

SEQ ID NO: 3250898 - DNA, 16 bp, Homo sapiens
tgtgacccaccagtgc

SEQ ID NO: 3250899 - DNA, 14 bp, Homo sapiens
tgtgacctcaggca

SEQ ID NO: 3250900 - DNA, 18 bp, Homo sapiens
tgtgacctgatttcagaa

SEQ ID NO: 3250901 - DNA, 23 bp, Homo sapiens
tgtgacctgatttcagaagagac

SEQ ID NO: 3250902 - DNA, 13 bp, Homo sapiens
tgtgaccttctct

SEQ ID NO: 3250903 - DNA, 14 bp, Homo sapiens
tgtgaccttctcta

SEQ ID NO: 3250904 - DNA, 16 bp, Homo sapiens
tgtgacgcgcaagtct

SEQ ID NO: 3250905 - DNA, 13 bp, Homo sapiens
tgtgactgaaggg

SEQ ID NO: 3250906 - DNA, 15 bp, Homo sapiens
tgtgacttctccagg

SEQ ID NO: 3250907 - DNA, 17 bp, Homo sapiens
tgtgactttttttggta

SEQ ID NO: 3250908 - DNA, 16 bp, Homo sapiens
tgtgagaagtgccttc

SEQ ID NO: 3250909 - DNA, 20 bp, Homo sapiens
tgtgagaagtgccttctcct

SEQ ID NO: 3250910 - DNA, 19 bp, Homo sapiens
tgtgagacccccacacctc

SEQ ID NO: 3250911 - DNA, 15 bp, Homo sapiens
tgtgagatccgtgaa

SEQ ID NO: 3250912 - DNA, 13 bp, Homo sapiens
tgtgagccccagg

SEQ ID NO: 3250913 - DNA, 14 bp, Homo sapiens
tgtgagcccctggt

SEQ ID NO: 3250914 - DNA, 17 bp, Homo sapiens
tgtgagcccctggtcct

SEQ ID NO: 3250915 - DNA, 22 bp, Homo sapiens
tgtgagcccctggtcctgaggg

SEQ ID NO: 3250916 - DNA, 14 bp, Homo sapiens
tgtgaggaggaaaa

SEQ ID NO: 3250917 - DNA, 15 bp, Homo sapiens
tgtgaggaggaaaag

SEQ ID NO: 3250918 - DNA, 21 bp, Homo sapiens
tgtgaggcattcggggaagct

SEQ ID NO: 3250919 - DNA, 13 bp, Homo sapiens
tgtgaggcccctg

SEQ ID NO: 3250920 - DNA, 14 bp, Homo sapiens
tgtgaggcccctgg

SEQ ID NO: 3250921 - DNA, 22 bp, Homo sapiens
tgtgaggcccctggacaagcag

SEQ ID NO: 3250922 - DNA, 14 bp, Homo sapiens
tgtgaggctgtcct

SEQ ID NO: 3250923 - DNA, 17 bp, Homo sapiens
tgtgagggacatgctca

SEQ ID NO: 3250924 - DNA, 15 bp, Homo sapiens
tgtgagtaagagctg

SEQ ID NO: 3250925 - DNA, 19 bp, Homo sapiens
tgtgagtaagagctggtgt

SEQ ID NO: 3250926 - DNA, 17 bp, Homo sapiens
tgtgagtcccagagccc

SEQ ID NO: 3250927 - DNA, 18 bp, Homo sapiens
tgtgagtgcgtctgaggg

SEQ ID NO: 3250928 - DNA, 16 bp, Homo sapiens
tgtgagtggcagccat

SEQ ID NO: 3250929 - DNA, 20 bp, Homo sapiens
tgtgagtgtaagtgtgagta

SEQ ID NO: 3250930 - DNA, 16 bp, Homo sapiens
tgtgagtgtgacaggg

SEQ ID NO: 3250931 - DNA, 17 bp, Homo sapiens
tgtgagtgtttttatct

SEQ ID NO: 3250932 - DNA, 22 bp, Homo sapiens
tgtgagtgtttttatcttttta

SEQ ID NO: 3250933 - DNA, 23 bp, Homo sapiens
tgtgagtttaccttgtatactgt

SEQ ID NO: 3250934 - DNA, 13 bp, Homo sapiens
tgtgataatttaa

SEQ ID NO: 3250935 - DNA, 16 bp, Homo sapiens
tgtgatatataagtgt

SEQ ID NO: 3250936 - DNA, 14 bp, Homo sapiens
tgtgatattctaag

SEQ ID NO: 3250937 - DNA, 18 bp, Homo sapiens
tgtgatcatgtgtggaag

SEQ ID NO: 3250938 - DNA, 18 bp, Homo sapiens
tgtgatgacattccctgc

SEQ ID NO: 3250939 - DNA, 22 bp, Homo sapiens
tgtgatgatgaaatgaggtcag

SEQ ID NO: 3250940 - DNA, 14 bp, Homo sapiens
tgtgatgatgtaat

SEQ ID NO: 3250941 - DNA, 15 bp, Homo sapiens
tgtgatgccacacag

SEQ ID NO: 3250942 - DNA, 17 bp, Homo sapiens
tgtgatgccacacagag

SEQ ID NO: 3250943 - DNA, 17 bp, Homo sapiens
tgtgatgcgccttgctg

SEQ ID NO: 3250944 - DNA, 22 bp, Homo sapiens
tgtgatgtaccagtttgtccat

SEQ ID NO: 3250945 - DNA, 14 bp, Homo sapiens
tgtgatgtattcta

SEQ ID NO: 3250946 - DNA, 16 bp, Homo sapiens
tgtgatgttctaaggc

SEQ ID NO: 3250947 - DNA, 17 bp, Homo sapiens
tgtgatgttctaaggct

SEQ ID NO: 3250948 - DNA, 19 bp, Homo sapiens
tgtgattaatgttttcatt

SEQ ID NO: 3250949 - DNA, 18 bp, Homo sapiens
tgtgattatttcacttta

SEQ ID NO: 3250950 - DNA, 16 bp, Homo sapiens
tgtgattctaatgtct

SEQ ID NO: 3250951 - DNA, 17 bp, Homo sapiens
tgtgattggcctgtaga

SEQ ID NO: 3250952 - DNA, 23 bp, Homo sapiens
tgtgatttagaactgtatgtcag

SEQ ID NO: 3250953 - DNA, 21 bp, Homo sapiens
tgtgatttcctaaacataatt

SEQ ID NO: 3250954 - DNA, 15 bp, Homo sapiens
tgtgatttttgtaat

SEQ ID NO: 3250955 - DNA, 12 bp, Homo sapiens
tgtgcagaataa

SEQ ID NO: 3250956 - DNA, 12 bp, Homo sapiens
tgtgcagcagcc

SEQ ID NO: 3250957 - DNA, 14 bp, Homo sapiens
tgtgcagcagccca

SEQ ID NO: 3250958 - DNA, 16 bp, Homo sapiens
tgtgcagcagcccagc

SEQ ID NO: 3250959 - DNA, 18 bp, Homo sapiens
tgtgcagcagcccagctt

SEQ ID NO: 3250960 - DNA, 19 bp, Homo sapiens
tgtgcagcatggaattcct

SEQ ID NO: 3250961 - DNA, 13 bp, Homo sapiens
tgtgcaggatatt

SEQ ID NO: 3250962 - DNA, 17 bp, Homo sapiens
tgtgcaggtttgttaca

SEQ ID NO: 3250963 - DNA, 19 bp, Homo sapiens
tgtgcagtactttgtgcat

SEQ ID NO: 3250964 - DNA, 17 bp, Homo sapiens
tgtgcagtcactggagg

SEQ ID NO: 3250965 - DNA, 18 bp, Homo sapiens
tgtgcagtcactggaggt

SEQ ID NO: 3250966 - DNA, 13 bp, Homo sapiens
tgtgcataatgct

SEQ ID NO: 3250967 - DNA, 20 bp, Homo sapiens
tgtgcatctccttgactgcc

SEQ ID NO: 3250968 - DNA, 13 bp, Homo sapiens
tgtgcatgggtga

SEQ ID NO: 3250969 - DNA, 16 bp, Homo sapiens
tgtgcatgtgtgtata

SEQ ID NO: 3250970 - DNA, 17 bp, Homo sapiens
tgtgcattctttggtaa

SEQ ID NO: 3250971 - DNA, 19 bp, Homo sapiens
tgtgcattctttggtaatt

SEQ ID NO: 3250972 - DNA, 16 bp, Homo sapiens
tgtgcatttcacctgt

SEQ ID NO: 3250973 - DNA, 14 bp, Homo sapiens
tgtgcatttgtaaa

SEQ ID NO: 3250974 - DNA, 22 bp, Homo sapiens
tgtgcatttttgtgaaatgaaa

SEQ ID NO: 3250975 - DNA, 20 bp, Homo sapiens
tgtgccaagattctactctt

SEQ ID NO: 3250976 - DNA, 18 bp, Homo sapiens
tgtgccaatatgtattgt

SEQ ID NO: 3250977 - DNA, 13 bp, Homo sapiens
tgtgccacacagt

SEQ ID NO: 3250978 - DNA, 20 bp, Homo sapiens
tgtgccacccaccagggcga

SEQ ID NO: 3250979 - DNA, 19 bp, Homo sapiens
tgtgccactttgactcaga

SEQ ID NO: 3250980 - DNA, 22 bp, Homo sapiens
tgtgccagaggaatcctggcag

SEQ ID NO: 3250981 - DNA, 23 bp, Homo sapiens
tgtgccagaggaatcctggcagc

SEQ ID NO: 3250982 - DNA, 23 bp, Homo sapiens
tgtgccaggctgaattacagtga

SEQ ID NO: 3250983 - DNA, 14 bp, Homo sapiens
tgtgccatagaaca

SEQ ID NO: 3250984 - DNA, 18 bp, Homo sapiens
tgtgccatagtcacatgg

SEQ ID NO: 3250985 - DNA, 13 bp, Homo sapiens
tgtgccatcacca

SEQ ID NO: 3250986 - DNA, 17 bp, Homo sapiens
tgtgcccacatcccagg

SEQ ID NO: 3250987 - DNA, 19 bp, Homo sapiens
tgtgcccagggttttgccc

SEQ ID NO: 3250988 - DNA, 14 bp, Homo sapiens
tgtgcccctggccc

SEQ ID NO: 3250989 - DNA, 17 bp, Homo sapiens
tgtgcccctggcccatc

SEQ ID NO: 3250990 - DNA, 15 bp, Homo sapiens
tgtgccctccaaaga

SEQ ID NO: 3250991 - DNA, 13 bp, Homo sapiens
tgtgccctggtgg

SEQ ID NO: 3250992 - DNA, 15 bp, Homo sapiens
tgtgcctaacaccag

SEQ ID NO: 3250993 - DNA, 14 bp, Homo sapiens
tgtgcctctgcctg

SEQ ID NO: 3250994 - DNA, 15 bp, Homo sapiens
tgtgcctctgggact

SEQ ID NO: 3250995 - DNA, 17 bp, Homo sapiens
tgtgcctgcaccaggag

SEQ ID NO: 3250996 - DNA, 18 bp, Homo sapiens
tgtgcctgccatgggcca

SEQ ID NO: 3250997 - DNA, 20 bp, Homo sapiens
tgtgcctgccatgggccagc

SEQ ID NO: 3250998 - DNA, 13 bp, Homo sapiens
tgtgcctgctaga

SEQ ID NO: 3250999 - DNA, 17 bp, Homo sapiens
tgtgcctgctagagcaa

SEQ ID NO: 3251000 - DNA, 22 bp, Homo sapiens
tgtgcctggcttctttctctca

SEQ ID NO: 3251001 - DNA, 23 bp, Homo sapiens
tgtgcctggcttctttctctcag

SEQ ID NO: 3251002 - DNA, 21 bp, Homo sapiens
tgtgcctgggggagttttcct

SEQ ID NO: 3251003 - DNA, 13 bp, Homo sapiens
tgtgcctgtggca

SEQ ID NO: 3251004 - DNA, 15 bp, Homo sapiens
tgtgcctgtggcaga

SEQ ID NO: 3251005 - DNA, 18 bp, Homo sapiens
tgtgccttttatagctat

SEQ ID NO: 3251006 - DNA, 19 bp, Homo sapiens
tgtgcgcctacaggagtga

SEQ ID NO: 3251007 - DNA, 16 bp, Homo sapiens
tgtgcgtcccagctga

SEQ ID NO: 3251008 - DNA, 23 bp, Homo sapiens
tgtgcgtcccagctgaaggcagt

SEQ ID NO: 3251009 - DNA, 16 bp, Homo sapiens
tgtgcgtgaaacacac

SEQ ID NO: 3251010 - DNA, 23 bp, Homo sapiens
tgtgctaaccacgtctgtcttca

SEQ ID NO: 3251011 - DNA, 16 bp, Homo sapiens
tgtgctaagtctttcc

SEQ ID NO: 3251012 - DNA, 17 bp, Homo sapiens
tgtgctacatgacgaca

SEQ ID NO: 3251013 - DNA, 17 bp, Homo sapiens
tgtgctagaaattttca

SEQ ID NO: 3251014 - DNA, 14 bp, Homo sapiens
tgtgctagaagctc

SEQ ID NO: 3251015 - DNA, 17 bp, Homo sapiens
tgtgggcactggcccag

SEQ ID NO: 3251016 - DNA, 13 bp, Homo sapiens
tgtgggcagcacc

SEQ ID NO: 3251017 - DNA, 14 bp, Homo sapiens
tgtgggcagcaccc

SEQ ID NO: 3251018 - DNA, 15 bp, Homo sapiens
tgtgggcagcaccct

SEQ ID NO: 3251019 - DNA, 17 bp, Homo sapiens
tgtgggcagcaccctcc

SEQ ID NO: 3251020 - DNA, 19 bp, Homo sapiens
tgtgggcagcaccctcccc

SEQ ID NO: 3251021 - DNA, 15 bp, Homo sapiens
tgtgggcccctcaac

SEQ ID NO: 3251022 - DNA, 16 bp, Homo sapiens
tgtgggcgctgcttcc

SEQ ID NO: 3251023 - DNA, 20 bp, Homo sapiens
tgtgggctggtgccccacag

SEQ ID NO: 3251024 - DNA, 22 bp, Homo sapiens
tgtgggctggtgccccacagct

SEQ ID NO: 3251025 - DNA, 16 bp, Homo sapiens
tgtggggattttcact

SEQ ID NO: 3251026 - DNA, 12 bp, Homo sapiens
tgtggggccttg

SEQ ID NO: 3251027 - DNA, 12 bp, Homo sapiens
tgtgggtcccgc

SEQ ID NO: 3251028 - DNA, 22 bp, Homo sapiens
tgtgggtggaagggctgggtgt

SEQ ID NO: 3251029 - DNA, 15 bp, Homo sapiens
tgtgggtgtagccag

SEQ ID NO: 3251030 - DNA, 20 bp, Homo sapiens
tgtggtaagcaacatggctt

SEQ ID NO: 3251031 - DNA, 19 bp, Homo sapiens
tgtggtacatggtgtttgt

SEQ ID NO: 3251032 - DNA, 17 bp, Homo sapiens
tgtggtaggccttttaa

SEQ ID NO: 3251033 - DNA, 21 bp, Homo sapiens
tgtggtaggccttttaacatt

SEQ ID NO: 3251034 - DNA, 22 bp, Homo sapiens
tgtggtagggacttaaaaaact

SEQ ID NO: 3251035 - DNA, 23 bp, Homo sapiens
tgtggtcacagcggaggtgtgga

SEQ ID NO: 3251036 - DNA, 16 bp, Homo sapiens
tgtggtgcagtgtgaa

SEQ ID NO: 3251037 - DNA, 18 bp, Homo sapiens
tgtggtgcctctcttggc

SEQ ID NO: 3251038 - DNA, 17 bp, Homo sapiens
tgtggtgtaaagctggc

SEQ ID NO: 3251039 - DNA, 19 bp, Homo sapiens
tgtggtgtaaagctggccc

SEQ ID NO: 3251040 - DNA, 21 bp, Homo sapiens
tgtggtgtaaagctggccctg

SEQ ID NO: 3251041 - DNA, 13 bp, Homo sapiens
tgtggtgtaattt

SEQ ID NO: 3251042 - DNA, 15 bp, Homo sapiens
tgtggtgtagactgt

SEQ ID NO: 3251043 - DNA, 18 bp, Homo sapiens
tgtggtgtcgtctgtgaa

SEQ ID NO: 3251044 - DNA, 23 bp, Homo sapiens
tgtggtgtcgtctgtgaatgcta

SEQ ID NO: 3251045 - DNA, 16 bp, Homo sapiens
tgtggtgtgagcttca

SEQ ID NO: 3251046 - DNA, 15 bp, Homo sapiens
tgtggtgtgtttgct

SEQ ID NO: 3251047 - DNA, 16 bp, Homo sapiens
tgtggttccatgcagc

SEQ ID NO: 3251048 - DNA, 22 bp, Homo sapiens
tgtggtttaaatacataaatag

SEQ ID NO: 3251049 - DNA, 18 bp, Homo sapiens
tgtggtttggttcctctc

SEQ ID NO: 3251050 - DNA, 15 bp, Homo sapiens
tgtgtaaaaaatgga

SEQ ID NO: 3251051 - DNA, 23 bp, Homo sapiens
tgtgtaaaaaatggaaaaaaaca

SEQ ID NO: 3251052 - DNA, 19 bp, Homo sapiens
tgtgtaaaggtttcatgtt

SEQ ID NO: 3251053 - DNA, 21 bp, Homo sapiens
tgtgtaaagtgtaaatccttt

SEQ ID NO: 3251054 - DNA, 15 bp, Homo sapiens
tgtgtaaatatatgt

SEQ ID NO: 3251055 - DNA, 21 bp, Homo sapiens
tgtgtaacaattttaatgcta

SEQ ID NO: 3251056 - DNA, 14 bp, Homo sapiens
tgtgtaagagaatg

SEQ ID NO: 3251057 - DNA, 14 bp, Homo sapiens
tgtgtaataaagtg

SEQ ID NO: 3251058 - DNA, 17 bp, Homo sapiens
tgtgtaataaagtgttt

SEQ ID NO: 3251059 - DNA, 22 bp, Homo sapiens
tgtccaccacttcaggggatgg

SEQ ID NO: 3251060 - DNA, 21 bp, Homo sapiens
tgtccagaagaatattcagga

SEQ ID NO: 3251061 - DNA, 21 bp, Homo sapiens
tgtccagagagcaactctgag

SEQ ID NO: 3251062 - DNA, 22 bp, Homo sapiens
tgtccagcctgggcagccaggc

SEQ ID NO: 3251063 - DNA, 19 bp, Homo sapiens
tgtccaggcactgctgccc

SEQ ID NO: 3251064 - DNA, 16 bp, Homo sapiens
tgtccaggccactgtg

SEQ ID NO: 3251065 - DNA, 19 bp, Homo sapiens
tgtccaggccactgtggcc

SEQ ID NO: 3251066 - DNA, 14 bp, Homo sapiens
tgtccatccctttt

SEQ ID NO: 3251067 - DNA, 19 bp, Homo sapiens
tgtccatcccttttcctgt

SEQ ID NO: 3251068 - DNA, 15 bp, Homo sapiens
tgtccatgcttctca

SEQ ID NO: 3251069 - DNA, 13 bp, Homo sapiens
tgtccatttgtaa

SEQ ID NO: 3251070 - DNA, 16 bp, Homo sapiens
tgtcccaaggagctga

SEQ ID NO: 3251071 - DNA, 23 bp, Homo sapiens
tgtcccaatcttaccagatgcta

SEQ ID NO: 3251072 - DNA, 13 bp, Homo sapiens
tgtcccaccagct

SEQ ID NO: 3251073 - DNA, 12 bp, Homo sapiens
tgtcccacccac

SEQ ID NO: 3251074 - DNA, 22 bp, Homo sapiens
tgtcccaccgggagcctccccc

SEQ ID NO: 3251075 - DNA, 16 bp, Homo sapiens
tgtcccagcctggggc

SEQ ID NO: 3251076 - DNA, 17 bp, Homo sapiens
tgtcccagcctggggct

SEQ ID NO: 3251077 - DNA, 18 bp, Homo sapiens
tgtcccagcctggggctc

SEQ ID NO: 3251078 - DNA, 14 bp, Homo sapiens
tgtcccatgaccca

SEQ ID NO: 3251079 - DNA, 18 bp, Homo sapiens
tgtcccatgacccacccc

SEQ ID NO: 3251080 - DNA, 18 bp, Homo sapiens
tgtcccatgatccctgtg

SEQ ID NO: 3251081 - DNA, 22 bp, Homo sapiens
tgtcccatggacactccagtgc

SEQ ID NO: 3251082 - DNA, 20 bp, Homo sapiens
tgtcccattttccccttcct

SEQ ID NO: 3251083 - DNA, 12 bp, Homo sapiens
tgtccccaaagt

SEQ ID NO: 3251084 - DNA, 21 bp, Homo sapiens
tgtccccaaagtaccacactg

SEQ ID NO: 3251085 - DNA, 17 bp, Homo sapiens
tgtccccagggcccctc

SEQ ID NO: 3251086 - DNA, 15 bp, Homo sapiens
tgtcccccagctctg

SEQ ID NO: 3251087 - DNA, 17 bp, Homo sapiens
tgtgtttggcttggcct

SEQ ID NO: 3251088 - DNA, 20 bp, Homo sapiens
tgtgttttcttgtaaatgtt

SEQ ID NO: 3251089 - DNA, 20 bp, Homo sapiens
tgtgtttttctccagtgctg

SEQ ID NO: 3251090 - DNA, 13 bp, Homo sapiens
tgtgtttttgaaa

SEQ ID NO: 3251091 - DNA, 19 bp, Homo sapiens
tgtgtttttgggatgtctt

SEQ ID NO: 3251092 - DNA, 20 bp, Homo sapiens
tgtgtttttgggatgtctta

SEQ ID NO: 3251093 - DNA, 13 bp, Homo sapiens
tgttaaaataaat

SEQ ID NO: 3251094 - DNA, 17 bp, Homo sapiens
tgttaaaatagacaact

SEQ ID NO: 3251095 - DNA, 20 bp, Homo sapiens
tgttaaactgttagcactgt

SEQ ID NO: 3251096 - DNA, 19 bp, Homo sapiens
tgttaaagctggaacattt

SEQ ID NO: 3251097 - DNA, 23 bp, Homo sapiens
tgttaaataatatggctatgctt

SEQ ID NO: 3251098 - DNA, 13 bp, Homo sapiens
tgttaaatactgt

SEQ ID NO: 3251099 - DNA, 14 bp, Homo sapiens
tgttaaatttgtaa

SEQ ID NO: 3251100 - DNA, 17 bp, Homo sapiens
tgttaacctcagtgtca

SEQ ID NO: 3251101 - DNA, 15 bp, Homo sapiens
tgttaactacatatt

SEQ ID NO: 3251102 - DNA, 19 bp, Homo sapiens
tgttaactcttgtctattt

SEQ ID NO: 3251103 - DNA, 15 bp, Homo sapiens
tgttaactttattac

SEQ ID NO: 3251104 - DNA, 21 bp, Homo sapiens
tgttaagataacttactgtat

SEQ ID NO: 3251105 - DNA, 22 bp, Homo sapiens
tgttaagataacttactgtata

SEQ ID NO: 3251106 - DNA, 20 bp, Homo sapiens
tgttaagcgtgtctgtattt

SEQ ID NO: 3251107 - DNA, 20 bp, Homo sapiens
tgttaaggaaactcttatct

SEQ ID NO: 3251108 - DNA, 21 bp, Homo sapiens
tgttaaggaaactcttatctc

SEQ ID NO: 3251109 - DNA, 16 bp, Homo sapiens
tgttaaggttgaactt

SEQ ID NO: 3251110 - DNA, 23 bp, Homo sapiens
tgttaaggttgaactttgccaaa

SEQ ID NO: 3251111 - DNA, 17 bp, Homo sapiens
tgttaagttatagtgaa

SEQ ID NO: 3251112 - DNA, 21 bp, Homo sapiens
tgttaatacacagtactttat

SEQ ID NO: 3251113 - DNA, 23 bp, Homo sapiens
tgttaatcttaggggagagcttt

SEQ ID NO: 3251114 - DNA, 18 bp, Homo sapiens
tgttaatgtatttgttca

SEQ ID NO: 3251115 - DNA, 15 bp, Homo sapiens
tgttaattacaccat

SEQ ID NO: 3251116 - DNA, 15 bp, Homo sapiens
tgttaattcagcact

SEQ ID NO: 3251117 - DNA, 22 bp, Homo sapiens
tgttaattcagcactgatttca

SEQ ID NO: 3251118 - DNA, 17 bp, Homo sapiens
tgttacacagcccaaga

SEQ ID NO: 3251119 - DNA, 21 bp, Homo sapiens
tgttacaggcaccgagaatgt

SEQ ID NO: 3251120 - DNA, 15 bp, Homo sapiens
tgttacatgtagaaa

SEQ ID NO: 3251121 - DNA, 20 bp, Homo sapiens
tgttaccaaatacacatttc

SEQ ID NO: 3251122 - DNA, 19 bp, Homo sapiens
tgttaccatgtcactgtgg

SEQ ID NO: 3251123 - DNA, 14 bp, Homo sapiens
tgttaccattcaca

SEQ ID NO: 3251124 - DNA, 14 bp, Homo sapiens
tgttactagcctct

SEQ ID NO: 3251125 - DNA, 15 bp, Homo sapiens
tgttactagcctctc

SEQ ID NO: 3251126 - DNA, 22 bp, Homo sapiens
tgttactattttctacaattaa

SEQ ID NO: 3251127 - DNA, 13 bp, Homo sapiens
tgttactctggtt

SEQ ID NO: 3251128 - DNA, 17 bp, Homo sapiens
tgttactctggttcttt

SEQ ID NO: 3251129 - DNA, 20 bp, Homo sapiens
tgttactggataaattgttt

SEQ ID NO: 3251130 - DNA, 15 bp, Homo sapiens
tgttactgtaattcc

SEQ ID NO: 3251131 - DNA, 10 bp, Homo sapiens
tgttactgtt

SEQ ID NO: 3251132 - DNA, 12 bp, Homo sapiens
tgttactgttct

SEQ ID NO: 3251133 - DNA, 18 bp, Homo sapiens
tgttactgttcttgctgc

SEQ ID NO: 3251134 - DNA, 24 bp, Homo sapiens
tgttactgttcttgctgctagaac

SEQ ID NO: 3251135 - DNA, 18 bp, Homo sapiens
tgttacttacctaaacag

SEQ ID NO: 3251136 - DNA, 19 bp, Homo sapiens
tgttacttgcagcattcat

SEQ ID NO: 3251137 - DNA, 22 bp, Homo sapiens
tgttactttctttcagatgttt

SEQ ID NO: 3251138 - DNA, 16 bp, Homo sapiens
tgttactttggaatga

SEQ ID NO: 3251139 - DNA, 20 bp, Homo sapiens
tgttagaaaatgacttattt

SEQ ID NO: 3251140 - DNA, 15 bp, Homo sapiens
tgttagaacactatt

SEQ ID NO: 3251141 - DNA, 18 bp, Homo sapiens
tgttagaacactattttc

SEQ ID NO: 3251142 - DNA, 18 bp, Homo sapiens
tgttagaataattttatt

SEQ ID NO: 3251143 - DNA, 21 bp, Homo sapiens
tgttagaggttttaaagtgat

SEQ ID NO: 3251144 - DNA, 21 bp, Homo sapiens
tgttagatagaatttccaata

SEQ ID NO: 3251145 - DNA, 13 bp, Homo sapiens
tgttagatattgc

SEQ ID NO: 3251146 - DNA, 13 bp, Homo sapiens
tgttagcaaagat

SEQ ID NO: 3251147 - DNA, 12 bp, Homo sapiens
tgttagcactgt

SEQ ID NO: 3251148 - DNA, 22 bp, Homo sapiens
tgttagcactgttgatgtatct

SEQ ID NO: 3251149 - DNA, 19 bp, Homo sapiens
tgttagctacacagtgcag

SEQ ID NO: 3251150 - DNA, 12 bp, Homo sapiens
tgttagggtcag

SEQ ID NO: 3251151 - DNA, 21 bp, Homo sapiens
tgttaggttggggataggttt

SEQ ID NO: 3251152 - DNA, 15 bp, Homo sapiens
tgttagtcatttgct

SEQ ID NO: 3251153 - DNA, 23 bp, Homo sapiens
tgttagttaccttatagttactg

SEQ ID NO: 3251154 - DNA, 23 bp, Homo sapiens
tgttagtttagtgtgtgtgcaga

SEQ ID NO: 3251155 - DNA, 14 bp, Homo sapiens
tgttataactctgc

SEQ ID NO: 3251156 - DNA, 13 bp, Homo sapiens
tgttatacttcaa

SEQ ID NO: 3251157 - DNA, 15 bp, Homo sapiens
tgttatagaatactt

SEQ ID NO: 3251158 - DNA, 14 bp, Homo sapiens
tgttatatcaggga

SEQ ID NO: 3251159 - DNA, 16 bp, Homo sapiens
tgttatatcccctgct

SEQ ID NO: 3251160 - DNA, 20 bp, Homo sapiens
tgttatatttaatgcattaa

SEQ ID NO: 3251161 - DNA, 14 bp, Homo sapiens
tgttatcagctttc

SEQ ID NO: 3251162 - DNA, 16 bp, Homo sapiens
tgttatcttctcaagt

SEQ ID NO: 3251163 - DNA, 17 bp, Homo sapiens
tgcctcagactccgccc

SEQ ID NO: 3251164 - DNA, 21 bp, Homo sapiens
tgcctcagactccgccctcct

SEQ ID NO: 3251165 - DNA, 13 bp, Homo sapiens
tgcctcagcctcc

SEQ ID NO: 3251166 - DNA, 18 bp, Homo sapiens
tgcctcaggaggcaggac

SEQ ID NO: 3251167 - DNA, 21 bp, Homo sapiens
tgcctcaggaggcaggacctt

SEQ ID NO: 3251168 - DNA, 19 bp, Homo sapiens
tgcctcagtggcagcatcc

SEQ ID NO: 3251169 - DNA, 14 bp, Homo sapiens
tgcctcatgccaca

SEQ ID NO: 3251170 - DNA, 23 bp, Homo sapiens
tgcctccaccaccactggccacc

SEQ ID NO: 3251171 - DNA, 19 bp, Homo sapiens
tgcctcccaaagtgctggg

SEQ ID NO: 3251172 - DNA, 22 bp, Homo sapiens
tgcctcccaaggtcctctcagt

SEQ ID NO: 3251173 - DNA, 13 bp, Homo sapiens
tgcctcccacact

SEQ ID NO: 3251174 - DNA, 16 bp, Homo sapiens
tgcctcccatgcctgg

SEQ ID NO: 3251175 - DNA, 20 bp, Homo sapiens
tgcctcccatgcctggtccc

SEQ ID NO: 3251176 - DNA, 21 bp, Homo sapiens
tgcctccccatttcccatctg

SEQ ID NO: 3251177 - DNA, 23 bp, Homo sapiens
tgcctccccatttcccatctgca

SEQ ID NO: 3251178 - DNA, 18 bp, Homo sapiens
tgcctcccctctccttcc

SEQ ID NO: 3251179 - DNA, 14 bp, Homo sapiens
tgcctccctctcca

SEQ ID NO: 3251180 - DNA, 23 bp, Homo sapiens
tgcctccgtcccctgcccatgct

SEQ ID NO: 3251181 - DNA, 11 bp, Homo sapiens
tgcctcctcaa

SEQ ID NO: 3251182 - DNA, 20 bp, Homo sapiens
tgcctcctcaaacccagtct

SEQ ID NO: 3251183 - DNA, 12 bp, Homo sapiens
tgcctcctcacc

SEQ ID NO: 3251184 - DNA, 14 bp, Homo sapiens
tgcctcctcttcaa

SEQ ID NO: 3251185 - DNA, 10 bp, Homo sapiens
tgcctcctgt

SEQ ID NO: 3251186 - DNA, 18 bp, Homo sapiens
tgcctcctgtggggaaag

SEQ ID NO: 3251187 - DNA, 14 bp, Homo sapiens
tgcctcctgtgtac

SEQ ID NO: 3251188 - DNA, 18 bp, Homo sapiens
tgcctcctgtgtactgtg

SEQ ID NO: 3251189 - DNA, 21 bp, Homo sapiens
tgcctcctgtgtactgtgtca

SEQ ID NO: 3251190 - DNA, 17 bp, Homo sapiens
tgcctccttccacctcc

SEQ ID NO: 3251191 - DNA, 23 bp, Homo sapiens
tgcctcgaaacacagaaaccttt

SEQ ID NO: 3251192 - DNA, 19 bp, Homo sapiens
tgcctcgaactggctgcaa

SEQ ID NO: 3251193 - DNA, 14 bp, Homo sapiens
tgcctcgaggcacc

SEQ ID NO: 3251194 - DNA, 17 bp, Homo sapiens
tgcctcgaggcaccggc

SEQ ID NO: 3251195 - DNA, 22 bp, Homo sapiens
tgcctcgaggcaccggcgctgc

SEQ ID NO: 3251196 - DNA, 16 bp, Homo sapiens
tgcctcgctcccttca

SEQ ID NO: 3251197 - DNA, 20 bp, Homo sapiens
tgcctcggcctcccaaagtg

SEQ ID NO: 3251198 - DNA, 19 bp, Homo sapiens
tgcctctcacacacataga

SEQ ID NO: 3251199 - DNA, 12 bp, Homo sapiens
tgcctctctagg

SEQ ID NO: 3251200 - DNA, 15 bp, Homo sapiens
tgcctctctaggacc

SEQ ID NO: 3251201 - DNA, 16 bp, Homo sapiens
tgcctctgacacacag

SEQ ID NO: 3251202 - DNA, 20 bp, Homo sapiens
tgcctctgacacacagctct

SEQ ID NO: 3251203 - DNA, 21 bp, Homo sapiens
tgcctctgacacacagctctg

SEQ ID NO: 3251204 - DNA, 20 bp, Homo sapiens
tgcctctgatatgggactga

SEQ ID NO: 3251205 - DNA, 22 bp, Homo sapiens
tgcctctgccaaaggatgtgat

SEQ ID NO: 3251206 - DNA, 12 bp, Homo sapiens
tgcctctgccac

SEQ ID NO: 3251207 - DNA, 16 bp, Homo sapiens
tgcctctgccacactc

SEQ ID NO: 3251208 - DNA, 17 bp, Homo sapiens
tgcctctgcctcccaaa

SEQ ID NO: 3251209 - DNA, 13 bp, Homo sapiens
tgcctctgcctct

SEQ ID NO: 3251210 - DNA, 17 bp, Homo sapiens
tgcctctgcctctgaca

SEQ ID NO: 3251211 - DNA, 18 bp, Homo sapiens
tgcctctgcctctgacac

SEQ ID NO: 3251212 - DNA, 20 bp, Homo sapiens
tgcctctgcctctgacacac

SEQ ID NO: 3251213 - DNA, 18 bp, Homo sapiens
tgcctctggaggcctctg

SEQ ID NO: 3251214 - DNA, 20 bp, Homo sapiens
tgcctctggaggcctctggc

SEQ ID NO: 3251215 - DNA, 23 bp, Homo sapiens
tgcctctggaggcctctggccct

SEQ ID NO: 3251216 - DNA, 13 bp, Homo sapiens
tgcctctgggact

SEQ ID NO: 3251217 - DNA, 14 bp, Homo sapiens
tgcctctgtgctgt

SEQ ID NO: 3251218 - DNA, 21 bp, Homo sapiens
tgcctcttccagtcttcctga

SEQ ID NO: 3251219 - DNA, 13 bp, Homo sapiens
tgcctcttcctcc

SEQ ID NO: 3251220 - DNA, 12 bp, Homo sapiens
tgcctctttccc

SEQ ID NO: 3251221 - DNA, 17 bp, Homo sapiens
tgcctctttccctagga

SEQ ID NO: 3251222 - DNA, 14 bp, Homo sapiens
tgcctcttttcaca

SEQ ID NO: 3251223 - DNA, 12 bp, Homo sapiens
tgcctgaaacag

SEQ ID NO: 3251224 - DNA, 13 bp, Homo sapiens
tgcctgaaagcaa

SEQ ID NO: 3251225 - DNA, 17 bp, Homo sapiens
tgcctgacactgagccc

SEQ ID NO: 3251226 - DNA, 16 bp, Homo sapiens
tgcctgactaattttt

SEQ ID NO: 3251227 - DNA, 22 bp, Homo sapiens
tgcctgactaatttttgtattt

SEQ ID NO: 3251228 - DNA, 16 bp, Homo sapiens
tgcctgagaggcaggc

SEQ ID NO: 3251229 - DNA, 17 bp, Homo sapiens
tgcctgagaggcaggca

SEQ ID NO: 3251230 - DNA, 18 bp, Homo sapiens
tgcctgagggtggagact

SEQ ID NO: 3251231 - DNA, 15 bp, Homo sapiens
tgcctgcaccaggag

SEQ ID NO: 3251232 - DNA, 16 bp, Homo sapiens
tgcctgcaccaggaga

SEQ ID NO: 3251233 - DNA, 19 bp, Homo sapiens
tgcctgcaccaggagacag

SEQ ID NO: 3251234 - DNA, 20 bp, Homo sapiens
tgcctgcaccaggagacaga

SEQ ID NO: 3251235 - DNA, 15 bp, Homo sapiens
tgcctgcaggggagc

SEQ ID NO: 3251236 - DNA, 13 bp, Homo sapiens
tgcctgcccaggc

SEQ ID NO: 3251237 - DNA, 19 bp, Homo sapiens
tgcctgcccaggcccctgc

SEQ ID NO: 3251238 - DNA, 23 bp, Homo sapiens
tgcctgcccaggcccctgccacc

SEQ ID NO: 3251239 - DNA, 20 bp, Homo sapiens
tgcctgccccaaacaaatat

SEQ ID NO: 3251240 - DNA, 12 bp, Homo sapiens
tgcctgccccgc

SEQ ID NO: 3251241 - DNA, 20 bp, Homo sapiens
tgcctgcccgcacagcagcc

SEQ ID NO: 3251242 - DNA, 16 bp, Homo sapiens
tgcctgccgcccaaag

SEQ ID NO: 3251243 - DNA, 12 bp, Homo sapiens
tgcctgctagag

SEQ ID NO: 3251244 - DNA, 15 bp, Homo sapiens
tgcctgctttttgga

SEQ ID NO: 3251245 - DNA, 16 bp, Homo sapiens
tgcctgctttttggaa

SEQ ID NO: 3251246 - DNA, 22 bp, Homo sapiens
tgcctgctttttggaaagtcag

SEQ ID NO: 3251247 - DNA, 12 bp, Homo sapiens
tggagacagccc

SEQ ID NO: 3251248 - DNA, 19 bp, Homo sapiens
tggagacagccccagagca

SEQ ID NO: 3251249 - DNA, 20 bp, Homo sapiens
tggagacagccccagagcag

SEQ ID NO: 3251250 - DNA, 21 bp, Homo sapiens
tggagacagccccagagcagg

SEQ ID NO: 3251251 - DNA, 22 bp, Homo sapiens
tggagacagccccagagcaggg

SEQ ID NO: 3251252 - DNA, 19 bp, Homo sapiens
tggagaccatgcagagcgc

SEQ ID NO: 3251253 - DNA, 21 bp, Homo sapiens
tggagaccgcttcacccctgc

SEQ ID NO: 3251254 - DNA, 22 bp, Homo sapiens
tggagaccgcttcacccctgca

SEQ ID NO: 3251255 - DNA, 19 bp, Homo sapiens
tggagacctctccttccta

SEQ ID NO: 3251256 - DNA, 18 bp, Homo sapiens
tggagactaagccctgtc

SEQ ID NO: 3251257 - DNA, 13 bp, Homo sapiens
tggagactcctgc

SEQ ID NO: 3251258 - DNA, 14 bp, Homo sapiens
tggagactctgtgg

SEQ ID NO: 3251259 - DNA, 20 bp, Homo sapiens
tggagactgcttcccatcct

SEQ ID NO: 3251260 - DNA, 15 bp, Homo sapiens
tggagactggcaggc

SEQ ID NO: 3251261 - DNA, 20 bp, Homo sapiens
tggagactggggggcttgaa

SEQ ID NO: 3251262 - DNA, 15 bp, Homo sapiens
tggagactggggtgg

SEQ ID NO: 3251263 - DNA, 19 bp, Homo sapiens
tggagactggtcctgtgtg

SEQ ID NO: 3251264 - DNA, 17 bp, Homo sapiens
tggagagaatgtgtgtg

SEQ ID NO: 3251265 - DNA, 13 bp, Homo sapiens
tggagagagggga

SEQ ID NO: 3251266 - DNA, 16 bp, Homo sapiens
tggagagcgaggaggc

SEQ ID NO: 3251267 - DNA, 17 bp, Homo sapiens
tggagagcgaggaggcg

SEQ ID NO: 3251268 - DNA, 11 bp, Homo sapiens
tggagagctgg

SEQ ID NO: 3251269 - DNA, 14 bp, Homo sapiens
tggagagctggtgc

SEQ ID NO: 3251270 - DNA, 16 bp, Homo sapiens
tggagagctggtgccc

SEQ ID NO: 3251271 - DNA, 19 bp, Homo sapiens
tggagagctggtgcccgga

SEQ ID NO: 3251272 - DNA, 23 bp, Homo sapiens
tggagaggagggatgctgcctga

SEQ ID NO: 3251273 - DNA, 15 bp, Homo sapiens
tggagaggcgagagg

SEQ ID NO: 3251274 - DNA, 14 bp, Homo sapiens
tggagagggtctcg

SEQ ID NO: 3251275 - DNA, 22 bp, Homo sapiens
tggagagggtctcgctgtcact

SEQ ID NO: 3251276 - DNA, 21 bp, Homo sapiens
tggagatcctcctgcagacca

SEQ ID NO: 3251277 - DNA, 22 bp, Homo sapiens
tggagatgcatcgggaaagaag

SEQ ID NO: 3251278 - DNA, 21 bp, Homo sapiens
tggagcaaaaggcagctcacc

SEQ ID NO: 3251279 - DNA, 23 bp, Homo sapiens
tggagcaaaaggcagctcacccc

SEQ ID NO: 3251280 - DNA, 15 bp, Homo sapiens
tggagcaaagctgat

SEQ ID NO: 3251281 - DNA, 16 bp, Homo sapiens
tggagcacaaaattca

SEQ ID NO: 3251282 - DNA, 13 bp, Homo sapiens
tggagcagaccac

SEQ ID NO: 3251283 - DNA, 12 bp, Homo sapiens
tggagcaggcaa

SEQ ID NO: 3251284 - DNA, 22 bp, Homo sapiens
tggagcagtacatgggaaagga

SEQ ID NO: 3251285 - DNA, 17 bp, Homo sapiens
tggagccaactgctgct

SEQ ID NO: 3251286 - DNA, 19 bp, Homo sapiens
tggagccactcctgtcccg

SEQ ID NO: 3251287 - DNA, 18 bp, Homo sapiens
tggagcccaggcgggagc

SEQ ID NO: 3251288 - DNA, 21 bp, Homo sapiens
tggagcccataggccaccccc

SEQ ID NO: 3251289 - DNA, 17 bp, Homo sapiens
tggagccccatcggcca

SEQ ID NO: 3251290 - DNA, 23 bp, Homo sapiens
tggagcccctgggtgggtggtgg

SEQ ID NO: 3251291 - DNA, 18 bp, Homo sapiens
tggagcctacattccttg

SEQ ID NO: 3251292 - DNA, 21 bp, Homo sapiens
tggagcctgagtcagggccca

SEQ ID NO: 3251293 - DNA, 22 bp, Homo sapiens
tggagcctgagtcagggcccag

SEQ ID NO: 3251294 - DNA, 18 bp, Homo sapiens
tggagcctggcacaggac

SEQ ID NO: 3251295 - DNA, 21 bp, Homo sapiens
tggagcctggcacaggactga

SEQ ID NO: 3251296 - DNA, 20 bp, Homo sapiens
tggagcgaagccttctgcag

SEQ ID NO: 3251297 - DNA, 23 bp, Homo sapiens
tggagcgaagccttctgcagcag

SEQ ID NO: 3251298 - DNA, 14 bp, Homo sapiens
tggagcgcacctgc

SEQ ID NO: 3251299 - DNA, 21 bp, Homo sapiens
tggagcgcacctgccccctgg

SEQ ID NO: 3251300 - DNA, 14 bp, Homo sapiens
tggagcttttttcc

SEQ ID NO: 3251301 - DNA, 18 bp, Homo sapiens
tggaggaaggattgtaaa

SEQ ID NO: 3251302 - DNA, 16 bp, Homo sapiens
tggaggaaggtgctga

SEQ ID NO: 3251303 - DNA, 20 bp, Homo sapiens
tggaggacctttaggtcaaa

SEQ ID NO: 3251304 - DNA, 14 bp, Homo sapiens
tggaggagagagac

SEQ ID NO: 3251305 - DNA, 15 bp, Homo sapiens
tggaggagagagacc

SEQ ID NO: 3251306 - DNA, 16 bp, Homo sapiens
tggaggagagagaccc

SEQ ID NO: 3251307 - DNA, 20 bp, Homo sapiens
tggaggagcagcttccttct

SEQ ID NO: 3251308 - DNA, 15 bp, Homo sapiens
tggaggaggaaggca

SEQ ID NO: 3251309 - DNA, 15 bp, Homo sapiens
tggatatttttgtac

SEQ ID NO: 3251310 - DNA, 14 bp, Homo sapiens
tggatcacaaagtg

SEQ ID NO: 3251311 - DNA, 15 bp, Homo sapiens
tggatcacaaagtgg

SEQ ID NO: 3251312 - DNA, 16 bp, Homo sapiens
tggatcaccattatat

SEQ ID NO: 3251313 - DNA, 17 bp, Homo sapiens
tggatcaccattatatt

SEQ ID NO: 3251314 - DNA, 12 bp, Homo sapiens
tggatcacctgt

SEQ ID NO: 3251315 - DNA, 20 bp, Homo sapiens
tggatcacgacgctgcagag

SEQ ID NO: 3251316 - DNA, 16 bp, Homo sapiens
tggatcagatgaactc

SEQ ID NO: 3251317 - DNA, 16 bp, Homo sapiens
tggatcagtcctttga

SEQ ID NO: 3251318 - DNA, 20 bp, Homo sapiens
tggatcatgaggtcaggaga

SEQ ID NO: 3251319 - DNA, 16 bp, Homo sapiens
tggatctatccctgcg

SEQ ID NO: 3251320 - DNA, 14 bp, Homo sapiens
tggatctatttcat

SEQ ID NO: 3251321 - DNA, 20 bp, Homo sapiens
tggatctatttcatgttttt

SEQ ID NO: 3251322 - DNA, 15 bp, Homo sapiens
tggatctccccactc

SEQ ID NO: 3251323 - DNA, 15 bp, Homo sapiens
tggatcttcagaact

SEQ ID NO: 3251324 - DNA, 19 bp, Homo sapiens
tggatcttcagaactgccc

SEQ ID NO: 3251325 - DNA, 21 bp, Homo sapiens
tggatcttcagaactgccctt

SEQ ID NO: 3251326 - DNA, 22 bp, Homo sapiens
tggatcttcagaactgcccttg

SEQ ID NO: 3251327 - DNA, 23 bp, Homo sapiens
tggatgaagattctcctgtgcta

SEQ ID NO: 3251328 - DNA, 18 bp, Homo sapiens
tggatgagaaacagctca

SEQ ID NO: 3251329 - DNA, 16 bp, Homo sapiens
tggatgaggagacaga

SEQ ID NO: 3251330 - DNA, 14 bp, Homo sapiens
tggatgattaaatt

SEQ ID NO: 3251331 - DNA, 12 bp, Homo sapiens
tggatgcatttc

SEQ ID NO: 3251332 - DNA, 15 bp, Homo sapiens
tggatgcatttcaaa

SEQ ID NO: 3251333 - DNA, 17 bp, Homo sapiens
tggatgcatttcaaatg

SEQ ID NO: 3251334 - DNA, 18 bp, Homo sapiens
tggatgcatttcaaatgt

SEQ ID NO: 3251335 - DNA, 19 bp, Homo sapiens
tggatgccaaggagcccct

SEQ ID NO: 3251336 - DNA, 16 bp, Homo sapiens
tggatgcctcagccca

SEQ ID NO: 3251337 - DNA, 14 bp, Homo sapiens
tggatgcctggtgg

SEQ ID NO: 3251338 - DNA, 15 bp, Homo sapiens
tggatgcctggtggc

SEQ ID NO: 3251339 - DNA, 15 bp, Homo sapiens
tggatgcgaggacca

SEQ ID NO: 3251340 - DNA, 19 bp, Homo sapiens
tggatgcgaggaccacttt

SEQ ID NO: 3251341 - DNA, 20 bp, Homo sapiens
tggatgcgaggaccactttg

SEQ ID NO: 3251342 - DNA, 14 bp, Homo sapiens
tggatggccccagc

SEQ ID NO: 3251343 - DNA, 16 bp, Homo sapiens
tggatggccccagcac

SEQ ID NO: 3251344 - DNA, 21 bp, Homo sapiens
tggatggccccagcacagctt

SEQ ID NO: 3251345 - DNA, 15 bp, Homo sapiens
tggatgggaatttgt

SEQ ID NO: 3251346 - DNA, 14 bp, Homo sapiens
tggatgggagtggg

SEQ ID NO: 3251347 - DNA, 20 bp, Homo sapiens
tggatgggagtgggcacctc

SEQ ID NO: 3251348 - DNA, 21 bp, Homo sapiens
tggatggggctggcatgtttt

SEQ ID NO: 3251349 - DNA, 15 bp, Homo sapiens
tggatgtcttccttg

SEQ ID NO: 3251350 - DNA, 14 bp, Homo sapiens
tggatgtgtggggc

SEQ ID NO: 3251351 - DNA, 12 bp, Homo sapiens
tggatgttctga

SEQ ID NO: 3251352 - DNA, 15 bp, Homo sapiens
tggatgttgtgtgta

SEQ ID NO: 3251353 - DNA, 14 bp, Homo sapiens
tggattaaattagt

SEQ ID NO: 3251354 - DNA, 21 bp, Homo sapiens
tggattataaaaaatgtaaca

SEQ ID NO: 3251355 - DNA, 15 bp, Homo sapiens
tggattatttaataa

SEQ ID NO: 3251356 - DNA, 20 bp, Homo sapiens
tggattatttaataacatta

SEQ ID NO: 3251357 - DNA, 23 bp, Homo sapiens
tggattatttaataacattacct

SEQ ID NO: 3251358 - DNA, 18 bp, Homo sapiens
tggattcattacagctta

SEQ ID NO: 3251359 - DNA, 20 bp, Homo sapiens
tggattcccccccctttcct

SEQ ID NO: 3251360 - DNA, 23 bp, Homo sapiens
tggattcccccccctttcctaaa

SEQ ID NO: 3251361 - DNA, 14 bp, Homo sapiens
tggattctcagata

SEQ ID NO: 3251362 - DNA, 15 bp, Homo sapiens
tggattctcagatat

SEQ ID NO: 3251363 - DNA, 19 bp, Homo sapiens
tggattctcagatatttat

SEQ ID NO: 3251364 - DNA, 19 bp, Homo sapiens
tggattgcaatatctgaag

SEQ ID NO: 3251365 - DNA, 17 bp, Homo sapiens
tggattgcagactgttc

SEQ ID NO: 3251366 - DNA, 18 bp, Homo sapiens
tggatttaaaagcctgct

SEQ ID NO: 3251367 - DNA, 18 bp, Homo sapiens
tggatttaatccattttt

SEQ ID NO: 3251368 - DNA, 15 bp, Homo sapiens
tggatttagtttcag

SEQ ID NO: 3251369 - DNA, 22 bp, Homo sapiens
tggatttatagtatgtgacttt

SEQ ID NO: 3251370 - DNA, 23 bp, Homo sapiens
tggatttatagtatgtgactttt

SEQ ID NO: 3251371 - DNA, 20 bp, Homo sapiens
tggatttccttctaacatgt

SEQ ID NO: 3251372 - DNA, 19 bp, Homo sapiens
tggatttctggttctgatg

SEQ ID NO: 3251373 - DNA, 11 bp, Homo sapiens
tgatgcatgtg

SEQ ID NO: 3251374 - DNA, 16 bp, Homo sapiens
tgatgccaaggggctg

SEQ ID NO: 3251375 - DNA, 22 bp, Homo sapiens
tgatgccaatactagtcacccc

SEQ ID NO: 3251376 - DNA, 20 bp, Homo sapiens
tgatgccacttcccagaggc

SEQ ID NO: 3251377 - DNA, 20 bp, Homo sapiens
tgatgccctgctccagggag

SEQ ID NO: 3251378 - DNA, 15 bp, Homo sapiens
tgatgccgtgatcct

SEQ ID NO: 3251379 - DNA, 14 bp, Homo sapiens
tgatgcgccttgct

SEQ ID NO: 3251380 - DNA, 11 bp, Homo sapiens
tgatgctaaat

SEQ ID NO: 3251381 - DNA, 17 bp, Homo sapiens
tgatgctccctcccctg

SEQ ID NO: 3251382 - DNA, 21 bp, Homo sapiens
tgatgctccctcccctgccct

SEQ ID NO: 3251383 - DNA, 22 bp, Homo sapiens
tgatgctccctcccctgccctg

SEQ ID NO: 3251384 - DNA, 23 bp, Homo sapiens
tgatgctccctcccctgccctgg

SEQ ID NO: 3251385 - DNA, 22 bp, Homo sapiens
tgatgctgccccgttccctgtc

SEQ ID NO: 3251386 - DNA, 14 bp, Homo sapiens
tgatgctggagagg

SEQ ID NO: 3251387 - DNA, 13 bp, Homo sapiens
tgatggaaaataa

SEQ ID NO: 3251388 - DNA, 18 bp, Homo sapiens
tgatggaaatatttattt

SEQ ID NO: 3251389 - DNA, 15 bp, Homo sapiens
tgatggaggaaaaag

SEQ ID NO: 3251390 - DNA, 15 bp, Homo sapiens
tgatggatcaccatt

SEQ ID NO: 3251391 - DNA, 17 bp, Homo sapiens
tgatggcaattttgtaa

SEQ ID NO: 3251392 - DNA, 14 bp, Homo sapiens
tgatggcagaggag

SEQ ID NO: 3251393 - DNA, 16 bp, Homo sapiens
tgatggccaagagcat

SEQ ID NO: 3251394 - DNA, 17 bp, Homo sapiens
tgatggccaagagcatc

SEQ ID NO: 3251395 - DNA, 18 bp, Homo sapiens
tgatggcgcgggaggcac

SEQ ID NO: 3251396 - DNA, 14 bp, Homo sapiens
tgatggctgctaga

SEQ ID NO: 3251397 - DNA, 22 bp, Homo sapiens
tgatggctgctagattttaatt

SEQ ID NO: 3251398 - DNA, 20 bp, Homo sapiens
tgatgggaaaatatttcctg

SEQ ID NO: 3251399 - DNA, 22 bp, Homo sapiens
tgatgggcaacccccagcctgc

SEQ ID NO: 3251400 - DNA, 16 bp, Homo sapiens
tgatggggtttagcaa

SEQ ID NO: 3251401 - DNA, 21 bp, Homo sapiens
tgatggtcagctcccttctct

SEQ ID NO: 3251402 - DNA, 13 bp, Homo sapiens
tgatggtgagctg

SEQ ID NO: 3251403 - DNA, 18 bp, Homo sapiens
tgatggtgccagagaggg

SEQ ID NO: 3251404 - DNA, 11 bp, Homo sapiens
tgatgtaattg

SEQ ID NO: 3251405 - DNA, 18 bp, Homo sapiens
tgatgtaccatgaaacaa

SEQ ID NO: 3251406 - DNA, 15 bp, Homo sapiens
tgatgtatgtgtgaa

SEQ ID NO: 3251407 - DNA, 19 bp, Homo sapiens
tgatgtcaatttctgtgtt

SEQ ID NO: 3251408 - DNA, 23 bp, Homo sapiens
tgatgtcagtatttcaactgctg

SEQ ID NO: 3251409 - DNA, 17 bp, Homo sapiens
tgatgtgacaataatat

SEQ ID NO: 3251410 - DNA, 16 bp, Homo sapiens
tgatgtgacattccat

SEQ ID NO: 3251411 - DNA, 21 bp, Homo sapiens
tgatgtgacattccatgacga

SEQ ID NO: 3251412 - DNA, 16 bp, Homo sapiens
tgatgtggtgcctgag

SEQ ID NO: 3251413 - DNA, 16 bp, Homo sapiens
tgatgtgttatctctt

SEQ ID NO: 3251414 - DNA, 23 bp, Homo sapiens
tgatgtgttgtgatagctaacat

SEQ ID NO: 3251415 - DNA, 18 bp, Homo sapiens
tgatgtgtttatttatag

SEQ ID NO: 3251416 - DNA, 14 bp, Homo sapiens
tgatgttaaaattc

SEQ ID NO: 3251417 - DNA, 12 bp, Homo sapiens
tgatgttaacaa

SEQ ID NO: 3251418 - DNA, 19 bp, Homo sapiens
tgatgttctaaggctctga

SEQ ID NO: 3251419 - DNA, 20 bp, Homo sapiens
tgatgttctaaggctctgag

SEQ ID NO: 3251420 - DNA, 21 bp, Homo sapiens
tgatgttctaaggctctgaga

SEQ ID NO: 3251421 - DNA, 13 bp, Homo sapiens
tgatgttggaaga

SEQ ID NO: 3251422 - DNA, 13 bp, Homo sapiens
tgatgtttgctct

SEQ ID NO: 3251423 - DNA, 18 bp, Homo sapiens
tgatgttttcctataata

SEQ ID NO: 3251424 - DNA, 23 bp, Homo sapiens
tgattaaaatgcttcctcccagc

SEQ ID NO: 3251425 - DNA, 15 bp, Homo sapiens
tgattaaacagactt

SEQ ID NO: 3251426 - DNA, 13 bp, Homo sapiens
tgattaatcaaag

SEQ ID NO: 3251427 - DNA, 18 bp, Homo sapiens
tgattaatgttttcatta

SEQ ID NO: 3251428 - DNA, 19 bp, Homo sapiens
tgattaatgttttcattat

SEQ ID NO: 3251429 - DNA, 20 bp, Homo sapiens
tgattaatgttttcattatg

SEQ ID NO: 3251430 - DNA, 21 bp, Homo sapiens
tgattaattcaccttccagtg

SEQ ID NO: 3251431 - DNA, 14 bp, Homo sapiens
tgattacacagttg

SEQ ID NO: 3251432 - DNA, 13 bp, Homo sapiens
tgattacctgcca

SEQ ID NO: 3251433 - DNA, 14 bp, Homo sapiens
tgattacctgccaa

SEQ ID NO: 3251434 - DNA, 16 bp, Homo sapiens
tgattactgtcaataa

SEQ ID NO: 3251435 - DNA, 23 bp, Homo sapiens
tgattactgtcaataaacagctt

SEQ ID NO: 3251436 - DNA, 15 bp, Homo sapiens
tgattagcagaagaa

SEQ ID NO: 3251437 - DNA, 13 bp, Homo sapiens
tgattattatgtt

SEQ ID NO: 3251438 - DNA, 18 bp, Homo sapiens
tgattattctgattccac

SEQ ID NO: 3251439 - DNA, 13 bp, Homo sapiens
tgattattgtatt

SEQ ID NO: 3251440 - DNA, 16 bp, Homo sapiens
tgattatttattattt

SEQ ID NO: 3251441 - DNA, 15 bp, Homo sapiens
tgattatttcacttt

SEQ ID NO: 3251442 - DNA, 18 bp, Homo sapiens
tgattattttttttttct

SEQ ID NO: 3251443 - DNA, 13 bp, Homo sapiens
tgattcaaatggg

SEQ ID NO: 3251444 - DNA, 16 bp, Homo sapiens
tgattcaatctgtaaa

SEQ ID NO: 3251445 - DNA, 17 bp, Homo sapiens
tgattcaatctgtaaac

SEQ ID NO: 3251446 - DNA, 21 bp, Homo sapiens
tgattcaatctgtaaactgtg

SEQ ID NO: 3251447 - DNA, 22 bp, Homo sapiens
tgattcaatctgtaaactgtgt

SEQ ID NO: 3251448 - DNA, 23 bp, Homo sapiens
tgattcaatctgtaaactgtgta

SEQ ID NO: 3251449 - DNA, 14 bp, Homo sapiens
tgattcactgtgct

SEQ ID NO: 3251450 - DNA, 19 bp, Homo sapiens
tgattcagaaaatgttctg

SEQ ID NO: 3251451 - DNA, 16 bp, Homo sapiens
tgattcagaaattgga

SEQ ID NO: 3251452 - DNA, 15 bp, Homo sapiens
tgattcagcaaaaat

SEQ ID NO: 3251453 - DNA, 16 bp, Homo sapiens
tgattcataacaatgt

SEQ ID NO: 3251454 - DNA, 23 bp, Homo sapiens
tgattcataacaatgtatgtgaa

SEQ ID NO: 3251455 - DNA, 17 bp, Homo sapiens
tgattcataataaatat

SEQ ID NO: 3251456 - DNA, 18 bp, Homo sapiens
tgattcatagtaacttct

SEQ ID NO: 3251457 - DNA, 19 bp, Homo sapiens
tgattcatagtaacttctt

SEQ ID NO: 3251458 - DNA, 19 bp, Homo sapiens
tgattccactacacctggc

SEQ ID NO: 3251459 - DNA, 20 bp, Homo sapiens
tgattccactacacctggct

SEQ ID NO: 3251460 - DNA, 21 bp, Homo sapiens
tgattccactacacctggctg

SEQ ID NO: 3251461 - DNA, 18 bp, Homo sapiens
tgattcccaagctctgct

SEQ ID NO: 3251462 - DNA, 19 bp, Homo sapiens
tgattcccaagctctgctc

SEQ ID NO: 3251463 - DNA, 15 bp, Homo sapiens
tgattctaatgtctt

SEQ ID NO: 3251464 - DNA, 15 bp, Homo sapiens
tgattctattatata

SEQ ID NO: 3251465 - DNA, 19 bp, Homo sapiens
tgattctcctgcctcagcc

SEQ ID NO: 3251466 - DNA, 20 bp, Homo sapiens
tgattctcctgcctcagcct

SEQ ID NO: 3251467 - DNA, 21 bp, Homo sapiens
tgattctcctgcctcagcctc

SEQ ID NO: 3251468 - DNA, 12 bp, Homo sapiens
tgattctgcctt

SEQ ID NO: 3251469 - DNA, 14 bp, Homo sapiens
tgattctggcttta

SEQ ID NO: 3251470 - DNA, 15 bp, Homo sapiens
tgattctgtgtgttt

SEQ ID NO: 3251471 - DNA, 23 bp, Homo sapiens
tgattctttaatagaagttttat

SEQ ID NO: 3251472 - DNA, 14 bp, Homo sapiens
tgattgaaccagct

SEQ ID NO: 3251473 - DNA, 20 bp, Homo sapiens
tgattgaggagctgcactga

SEQ ID NO: 3251474 - DNA, 15 bp, Homo sapiens
tgattgcacagaatt

SEQ ID NO: 3251475 - DNA, 18 bp, Homo sapiens
tgattgcacagaatttgt

SEQ ID NO: 3251476 - DNA, 17 bp, Homo sapiens
tgattgccaaattgaca

SEQ ID NO: 3251477 - DNA, 20 bp, Homo sapiens
tgattgctgccataattcta

SEQ ID NO: 3251478 - DNA, 22 bp, Homo sapiens
tgattggacaggcatgggtgca

SEQ ID NO: 3251479 - DNA, 17 bp, Homo sapiens
tgattggaccaggccat

SEQ ID NO: 3251480 - DNA, 15 bp, Homo sapiens
tgattggattattca

SEQ ID NO: 3251481 - DNA, 18 bp, Homo sapiens
tgattggattattcattt

SEQ ID NO: 3251482 - DNA, 19 bp, Homo sapiens
tgattggattattcattta

SEQ ID NO: 3251483 - DNA, 21 bp, Homo sapiens
tgattggattattcatttaaa

SEQ ID NO: 3251484 - DNA, 22 bp, Homo sapiens
tgcattgtctccttccacaatg

SEQ ID NO: 3251485 - DNA, 17 bp, Homo sapiens
tgcattgtcttgtggag

SEQ ID NO: 3251486 - DNA, 23 bp, Homo sapiens
tgcattgtgtcagaaacatgaaa

SEQ ID NO: 3251487 - DNA, 14 bp, Homo sapiens
tgcattgttggcta

SEQ ID NO: 3251488 - DNA, 23 bp, Homo sapiens
tgcattgttggctatttgaaata

SEQ ID NO: 3251489 - DNA, 13 bp, Homo sapiens
tgcatttaataaa

SEQ ID NO: 3251490 - DNA, 18 bp, Homo sapiens
tgcatttaataaagatga

SEQ ID NO: 3251491 - DNA, 22 bp, Homo sapiens
tgcatttagcacaaaaaaaatt

SEQ ID NO: 3251492 - DNA, 23 bp, Homo sapiens
tgcatttatttatacagtgcctt

SEQ ID NO: 3251493 - DNA, 13 bp, Homo sapiens
tgcatttcaaatg

SEQ ID NO: 3251494 - DNA, 14 bp, Homo sapiens
tgcatttcaaatgt

SEQ ID NO: 3251495 - DNA, 12 bp, Homo sapiens
tgcatttcaagc

SEQ ID NO: 3251496 - DNA, 19 bp, Homo sapiens
tgcatttcacctgtgacaa

SEQ ID NO: 3251497 - DNA, 13 bp, Homo sapiens
tgcatttcctgac

SEQ ID NO: 3251498 - DNA, 12 bp, Homo sapiens
tgcatttctctt

SEQ ID NO: 3251499 - DNA, 16 bp, Homo sapiens
tgcatttctcttctca

SEQ ID NO: 3251500 - DNA, 17 bp, Homo sapiens
tgcatttgagagaagcc

SEQ ID NO: 3251501 - DNA, 18 bp, Homo sapiens
tgcatttgagagaagcca

SEQ ID NO: 3251502 - DNA, 16 bp, Homo sapiens
tgcatttgatacattt

SEQ ID NO: 3251503 - DNA, 16 bp, Homo sapiens
tgcatttggtcaagat

SEQ ID NO: 3251504 - DNA, 18 bp, Homo sapiens
tgcatttgtaaatgctgt

SEQ ID NO: 3251505 - DNA, 17 bp, Homo sapiens
tgcattttcaccccacc

SEQ ID NO: 3251506 - DNA, 16 bp, Homo sapiens
tgcattttcttgtatg

SEQ ID NO: 3251507 - DNA, 18 bp, Homo sapiens
tgcattttgcagcagtga

SEQ ID NO: 3251508 - DNA, 16 bp, Homo sapiens
tgcatttttgtgaaat

SEQ ID NO: 3251509 - DNA, 17 bp, Homo sapiens
tgccaaaattcatttct

SEQ ID NO: 3251510 - DNA, 17 bp, Homo sapiens
tgccaaacaaaaaggtt

SEQ ID NO: 3251511 - DNA, 13 bp, Homo sapiens
tgccaaacagagt

SEQ ID NO: 3251512 - DNA, 21 bp, Homo sapiens
tgccaaagctagggtggccct

SEQ ID NO: 3251513 - DNA, 17 bp, Homo sapiens
tgccaaaggatgtgata

SEQ ID NO: 3251514 - DNA, 14 bp, Homo sapiens
tgccaaataaacag

SEQ ID NO: 3251515 - DNA, 17 bp, Homo sapiens
tgccaaataaacagcta

SEQ ID NO: 3251516 - DNA, 21 bp, Homo sapiens
tgccaaataaacagctattta

SEQ ID NO: 3251517 - DNA, 16 bp, Homo sapiens
tgccaaataataaaaa

SEQ ID NO: 3251518 - DNA, 14 bp, Homo sapiens
tgccaaatctggct

SEQ ID NO: 3251519 - DNA, 21 bp, Homo sapiens
tgccaagaaaagggctgacat

SEQ ID NO: 3251520 - DNA, 21 bp, Homo sapiens
tgccagccttgagccctggct

SEQ ID NO: 3251521 - DNA, 13 bp, Homo sapiens
tgccagctgcctt

SEQ ID NO: 3251522 - DNA, 15 bp, Homo sapiens
tgccagctgccttcc

SEQ ID NO: 3251523 - DNA, 19 bp, Homo sapiens
tgccagcttttcctccctt

SEQ ID NO: 3251524 - DNA, 20 bp, Homo sapiens
tgccagcttttcctcccttg

SEQ ID NO: 3251525 - DNA, 21 bp, Homo sapiens
tgccaggaacctgtcctaagg

SEQ ID NO: 3251526 - DNA, 20 bp, Homo sapiens
tgccaggcaacttttaaagc

SEQ ID NO: 3251527 - DNA, 15 bp, Homo sapiens
tgccaggcacctggc

SEQ ID NO: 3251528 - DNA, 20 bp, Homo sapiens
tgccaggcacctggcctgct

SEQ ID NO: 3251529 - DNA, 21 bp, Homo sapiens
tgccaggcacctggcctgctg

SEQ ID NO: 3251530 - DNA, 17 bp, Homo sapiens
tgccaggcaggggtggg

SEQ ID NO: 3251531 - DNA, 21 bp, Homo sapiens
tgccaggcccatctcaggtgc

SEQ ID NO: 3251532 - DNA, 22 bp, Homo sapiens
tgccaggcccatctcaggtgcc

SEQ ID NO: 3251533 - DNA, 23 bp, Homo sapiens
tgccaggcccatctcaggtgcca

SEQ ID NO: 3251534 - DNA, 18 bp, Homo sapiens
tgccaggcgttggtgcca

SEQ ID NO: 3251535 - DNA, 20 bp, Homo sapiens
tgccaggcgttggtgccact

SEQ ID NO: 3251536 - DNA, 21 bp, Homo sapiens
tgccaggcgttggtgccactt

SEQ ID NO: 3251537 - DNA, 13 bp, Homo sapiens
tgccagggcttcc

SEQ ID NO: 3251538 - DNA, 18 bp, Homo sapiens
tgccagggcttcctcttc

SEQ ID NO: 3251539 - DNA, 18 bp, Homo sapiens
tgccaggtttttggtctg

SEQ ID NO: 3251540 - DNA, 19 bp, Homo sapiens
tgccaggtttttggtctga

SEQ ID NO: 3251541 - DNA, 18 bp, Homo sapiens
tgccagtaacgcgtcttc

SEQ ID NO: 3251542 - DNA, 22 bp, Homo sapiens
tgccagtaacgcgtcttcctga

SEQ ID NO: 3251543 - DNA, 16 bp, Homo sapiens
tgccagtgacacttcc

SEQ ID NO: 3251544 - DNA, 20 bp, Homo sapiens
tgccagtgacagacaggctc

SEQ ID NO: 3251545 - DNA, 16 bp, Homo sapiens
tgccagtgcagccact

SEQ ID NO: 3251546 - DNA, 16 bp, Homo sapiens
tgccagtgtctttctt

SEQ ID NO: 3251547 - DNA, 23 bp, Homo sapiens
tgccataattctaagttatttac

SEQ ID NO: 3251548 - DNA, 22 bp, Homo sapiens
tgccatacatcagttattcatt

SEQ ID NO: 3251549 - DNA, 23 bp, Homo sapiens
tgccatacatcagttattcattc

SEQ ID NO: 3251550 - DNA, 15 bp, Homo sapiens
tgccatactttgtct

SEQ ID NO: 3251551 - DNA, 18 bp, Homo sapiens
tgccatactttgtctgaa

SEQ ID NO: 3251552 - DNA, 21 bp, Homo sapiens
tgccatagagtttaacacaag

SEQ ID NO: 3251553 - DNA, 16 bp, Homo sapiens
tgccatagtcacatgg

SEQ ID NO: 3251554 - DNA, 17 bp, Homo sapiens
tgccatagtcacatggc

SEQ ID NO: 3251555 - DNA, 21 bp, Homo sapiens
tgccatattctgttggccagt

SEQ ID NO: 3251556 - DNA, 20 bp, Homo sapiens
tgccatccaggttcagcttg

SEQ ID NO: 3251557 - DNA, 20 bp, Homo sapiens
tgccatctgtgtcctggtta

SEQ ID NO: 3251558 - DNA, 14 bp, Homo sapiens
tgccatgccactgc

SEQ ID NO: 3251559 - DNA, 20 bp, Homo sapiens
tgccatgccactgccaggca

SEQ ID NO: 3251560 - DNA, 21 bp, Homo sapiens
tgccatgccactgccaggcac

SEQ ID NO: 3251561 - DNA, 15 bp, Homo sapiens
tgccatgctgggcca

SEQ ID NO: 3251562 - DNA, 19 bp, Homo sapiens
tgccatgctgggccactgg

SEQ ID NO: 3251563 - DNA, 16 bp, Homo sapiens
tgccatgggccagcct

SEQ ID NO: 3251564 - DNA, 17 bp, Homo sapiens
tgccatgggccagccta

SEQ ID NO: 3251565 - DNA, 23 bp, Homo sapiens
tgccatgggcttcactgtataaa

SEQ ID NO: 3251566 - DNA, 13 bp, Homo sapiens
tgccatgtcgctt

SEQ ID NO: 3251567 - DNA, 15 bp, Homo sapiens
tgccatgtgcacctt

SEQ ID NO: 3251568 - DNA, 16 bp, Homo sapiens
tgccatgttggccagg

SEQ ID NO: 3251569 - DNA, 17 bp, Homo sapiens
tgccatgttggccaggc

SEQ ID NO: 3251570 - DNA, 19 bp, Homo sapiens
tgccatgttggccaggctg

SEQ ID NO: 3251571 - DNA, 18 bp, Homo sapiens
tgccatgttttgccaccc

SEQ ID NO: 3251572 - DNA, 22 bp, Homo sapiens
tgccattacagaggtattaaaa

SEQ ID NO: 3251573 - DNA, 19 bp, Homo sapiens
tgccattattttctgtcag

SEQ ID NO: 3251574 - DNA, 16 bp, Homo sapiens
tgccattcacttcata

SEQ ID NO: 3251575 - DNA, 16 bp, Homo sapiens
tgccattcatagagag

SEQ ID NO: 3251576 - DNA, 17 bp, Homo sapiens
tgccattccactccact

SEQ ID NO: 3251577 - DNA, 19 bp, Homo sapiens
tgccattgggaccctccag

SEQ ID NO: 3251578 - DNA, 21 bp, Homo sapiens
tgccattgggaccctccagtg

SEQ ID NO: 3251579 - DNA, 19 bp, Homo sapiens
tgccattggggtagttgtg

SEQ ID NO: 3251580 - DNA, 13 bp, Homo sapiens
tgccattgtcttt

SEQ ID NO: 3251581 - DNA, 17 bp, Homo sapiens
tgccattgtctttatat

SEQ ID NO: 3251582 - DNA, 17 bp, Homo sapiens
tgccatttagcaataaa

SEQ ID NO: 3251583 - DNA, 13 bp, Homo sapiens
tgccatttccctt

SEQ ID NO: 3251584 - DNA, 14 bp, Homo sapiens
tgccatttgatacc

SEQ ID NO: 3251585 - DNA, 20 bp, Homo sapiens
tgccatttgatacccctggg

SEQ ID NO: 3251586 - DNA, 22 bp, Homo sapiens
tgccatttgcttgtactgggac

SEQ ID NO: 3251587 - DNA, 17 bp, Homo sapiens
tgccatttttctataaa

SEQ ID NO: 3251588 - DNA, 21 bp, Homo sapiens
tgccatttttctataaatcag

SEQ ID NO: 3251589 - DNA, 23 bp, Homo sapiens
tgccatttttctataaatcagta

SEQ ID NO: 3251590 - DNA, 18 bp, Homo sapiens
tgcccaaacccttaactg

SEQ ID NO: 3251591 - DNA, 21 bp, Homo sapiens
tgcccaaacccttaactgaca

SEQ ID NO: 3251592 - DNA, 15 bp, Homo sapiens
tgcccaacaccagcc

SEQ ID NO: 3251593 - DNA, 19 bp, Homo sapiens
tgcccaacaccagcccctg

SEQ ID NO: 3251594 - DNA, 21 bp, Homo sapiens
tgcccaacaccagcccctgcc

SEQ ID NO: 3251595 - DNA, 23 bp, Homo sapiens
tgcccaacaccagcccctgcccc

SEQ ID NO: 3251596 - DNA, 18 bp, Homo sapiens
tgcccaacctgctctcct

SEQ ID NO: 3251597 - DNA, 23 bp, Homo sapiens
tgcccaacctgctctcctcttgc

SEQ ID NO: 3251598 - DNA, 23 bp, Homo sapiens
tgcccaagaatagatgctgactg

SEQ ID NO: 3251599 - DNA, 11 bp, Homo sapiens
tgcccaagcca

SEQ ID NO: 3251600 - DNA, 13 bp, Homo sapiens
tgcccaagccaga

SEQ ID NO: 3251601 - DNA, 14 bp, Homo sapiens
tgcccaagccagag

SEQ ID NO: 3251602 - DNA, 18 bp, Homo sapiens
tgcccaagccagaggctg

SEQ ID NO: 3251603 - DNA, 17 bp, Homo sapiens
tgcccaagggcctccca

SEQ ID NO: 3251604 - DNA, 18 bp, Homo sapiens
tgcccaagggcctcccac

SEQ ID NO: 3251605 - DNA, 20 bp, Homo sapiens
tgcccaatgaataatggaaa

SEQ ID NO: 3251606 - DNA, 20 bp, Homo sapiens
tgcccaatgagactctaggg

SEQ ID NO: 3251607 - DNA, 16 bp, Homo sapiens
tgcccacaggatcagt

SEQ ID NO: 3251608 - DNA, 11 bp, Homo sapiens
tgcccaccccc

SEQ ID NO: 3251609 - DNA, 15 bp, Homo sapiens
tgcccaccccctcaa

SEQ ID NO: 3251610 - DNA, 15 bp, Homo sapiens
tgcccacctgcccat

SEQ ID NO: 3251611 - DNA, 19 bp, Homo sapiens
tgcccacctgcccatcaca

SEQ ID NO: 3251612 - DNA, 19 bp, Homo sapiens
tgcccacgatcccctcccc

SEQ ID NO: 3251613 - DNA, 20 bp, Homo sapiens
tgcccacgatcccctccccc

SEQ ID NO: 3251614 - DNA, 23 bp, Homo sapiens
tgcccacgatcccctcccccaag

SEQ ID NO: 3251615 - DNA, 19 bp, Homo sapiens
tgcccacggagtcgtgggg

SEQ ID NO: 3251616 - DNA, 12 bp, Homo sapiens
tgcccactgttt

SEQ ID NO: 3251617 - DNA, 21 bp, Homo sapiens
tgcccactgtttctcttgagc

SEQ ID NO: 3251618 - DNA, 23 bp, Homo sapiens
tgcccacttagccgtccatggca

SEQ ID NO: 3251619 - DNA, 17 bp, Homo sapiens
tgcccagaacttccctg

SEQ ID NO: 3251620 - DNA, 18 bp, Homo sapiens
tgcccagaacttccctga

SEQ ID NO: 3251621 - DNA, 19 bp, Homo sapiens
tgcccagacccctctggcc

SEQ ID NO: 3251622 - DNA, 22 bp, Homo sapiens
tgcccagacccctctggccagg

SEQ ID NO: 3251623 - DNA, 17 bp, Homo sapiens
tgcccagactacagggc

SEQ ID NO: 3251624 - DNA, 23 bp, Homo sapiens
tgcccagagggcccaggcaggcc

SEQ ID NO: 3251625 - DNA, 20 bp, Homo sapiens
tgcccagccccgctcaggcc

SEQ ID NO: 3251626 - DNA, 18 bp, Homo sapiens
tgcccagcctggaaacct

SEQ ID NO: 3251627 - DNA, 14 bp, Homo sapiens
tgcccaggcaggtc

SEQ ID NO: 3251628 - DNA, 15 bp, Homo sapiens
tgcccaggcaggtct

SEQ ID NO: 3251629 - DNA, 17 bp, Homo sapiens
tgcccaggcaggtcttg

SEQ ID NO: 3251630 - DNA, 20 bp, Homo sapiens
tgcccaggcaggtcttgaac

SEQ ID NO: 3251631 - DNA, 11 bp, Homo sapiens
tgcccaggcca

SEQ ID NO: 3251632 - DNA, 13 bp, Homo sapiens
tgcccaggccaca

SEQ ID NO: 3251633 - DNA, 14 bp, Homo sapiens
tgcccaggccacag

SEQ ID NO: 3251634 - DNA, 16 bp, Homo sapiens
tgcccaggccacagcc

SEQ ID NO: 3251635 - DNA, 14 bp, Homo sapiens
tgcccaggcccctg

SEQ ID NO: 3251636 - DNA, 15 bp, Homo sapiens
tgcccaggcccctgc

SEQ ID NO: 3251637 - DNA, 15 bp, Homo sapiens
tgcccaggccggcca

SEQ ID NO: 3251638 - DNA, 21 bp, Homo sapiens
tgcccaggccggccagcctca

SEQ ID NO: 3251639 - DNA, 19 bp, Homo sapiens
tgcccaggctggcgtgcag

SEQ ID NO: 3251640 - DNA, 20 bp, Homo sapiens
tgcccaggctggcgtgcagt

SEQ ID NO: 3251641 - DNA, 23 bp, Homo sapiens
tgcccaggctggcgtgcagtggt

SEQ ID NO: 3251642 - DNA, 14 bp, Homo sapiens
tgcccaggctgtgc

SEQ ID NO: 3251643 - DNA, 21 bp, Homo sapiens
tgcccaggggagcgtgttcct

SEQ ID NO: 3251644 - DNA, 20 bp, Homo sapiens
tgcccaggggtgccccctcc

SEQ ID NO: 3251645 - DNA, 22 bp, Homo sapiens
tgcccaggggtgccccctcctc

SEQ ID NO: 3251646 - DNA, 23 bp, Homo sapiens
tgcccaggggtgccccctcctct

SEQ ID NO: 3251647 - DNA, 17 bp, Homo sapiens
tgcccaggtaccaccct

SEQ ID NO: 3251648 - DNA, 18 bp, Homo sapiens
tgcccaggtaccaccctt

SEQ ID NO: 3251649 - DNA, 19 bp, Homo sapiens
tgcccaggtaccacccttc

SEQ ID NO: 3251650 - DNA, 22 bp, Homo sapiens
tgcccaggtaccacccttcaga

SEQ ID NO: 3251651 - DNA, 18 bp, Homo sapiens
tgcccagtcccccaaccc

SEQ ID NO: 3251652 - DNA, 12 bp, Homo sapiens
tgcccagtgttg

SEQ ID NO: 3251653 - DNA, 19 bp, Homo sapiens
tgcccagtgttgtttgtaa

SEQ ID NO: 3251654 - DNA, 20 bp, Homo sapiens
tgcccagtgttgtttgtaaa

SEQ ID NO: 3251655 - DNA, 22 bp, Homo sapiens
tgcccagtgttgtttgtaaata

SEQ ID NO: 3251656 - DNA, 20 bp, Homo sapiens
tgcccatcacagggttgggc

SEQ ID NO: 3251657 - DNA, 22 bp, Homo sapiens
tgcccatcatgtggccccaccc

SEQ ID NO: 3251658 - DNA, 20 bp, Homo sapiens
tgcccatgctgggagcccac

SEQ ID NO: 3251659 - DNA, 16 bp, Homo sapiens
tgcccatgggagctgg

SEQ ID NO: 3251660 - DNA, 18 bp, Homo sapiens
tgcccatgggatatgtgg

SEQ ID NO: 3251661 - DNA, 19 bp, Homo sapiens
tgcccatgggatatgtggt

SEQ ID NO: 3251662 - DNA, 15 bp, Homo sapiens
tgcccatgtttcaaa

SEQ ID NO: 3251663 - DNA, 18 bp, Homo sapiens
tgcccattcaccaaaatt

SEQ ID NO: 3251664 - DNA, 20 bp, Homo sapiens
tgccccaaacaaatatgcaa

SEQ ID NO: 3251665 - DNA, 21 bp, Homo sapiens
tgccccaaataacttcagtcc

SEQ ID NO: 3251666 - DNA, 18 bp, Homo sapiens
tgccccaagcagccagcc

SEQ ID NO: 3251667 - DNA, 12 bp, Homo sapiens
tgccccacagtt

SEQ ID NO: 3251668 - DNA, 23 bp, Homo sapiens
tgccccacgctgtggccctggag

SEQ ID NO: 3251669 - DNA, 13 bp, Homo sapiens
tgccccagagctg

SEQ ID NO: 3251670 - DNA, 14 bp, Homo sapiens
tgccccagagctgt

SEQ ID NO: 3251671 - DNA, 16 bp, Homo sapiens
tgccccagcccaagtc

SEQ ID NO: 3251672 - DNA, 19 bp, Homo sapiens
tgccccagctctggcttcc

SEQ ID NO: 3251673 - DNA, 20 bp, Homo sapiens
tgccccagctgactgtggcc

SEQ ID NO: 3251674 - DNA, 14 bp, Homo sapiens
tgccccaggcctga

SEQ ID NO: 3251675 - DNA, 21 bp, Homo sapiens
tgccccagtcggccccatctc

SEQ ID NO: 3251676 - DNA, 22 bp, Homo sapiens
tgccccagtcggccccatctct

SEQ ID NO: 3251677 - DNA, 20 bp, Homo sapiens
tgccccagtcgttagaatat

SEQ ID NO: 3251678 - DNA, 12 bp, Homo sapiens
tgccccatgcct

SEQ ID NO: 3251679 - DNA, 15 bp, Homo sapiens
tgccccatgcctgtc

SEQ ID NO: 3251680 - DNA, 19 bp, Homo sapiens
tgcccccaacactccaggc

SEQ ID NO: 3251681 - DNA, 15 bp, Homo sapiens
tgcccccacctctgg

SEQ ID NO: 3251682 - DNA, 18 bp, Homo sapiens
tgcccccacctctggtcc

SEQ ID NO: 3251683 - DNA, 15 bp, Homo sapiens
tgcccccatccctcg

SEQ ID NO: 3251684 - DNA, 19 bp, Homo sapiens
tgcccccatctccccaggc

SEQ ID NO: 3251685 - DNA, 18 bp, Homo sapiens
tgcccttccctgtccctc

SEQ ID NO: 3251686 - DNA, 14 bp, Homo sapiens
tgcccttgccctga

SEQ ID NO: 3251687 - DNA, 17 bp, Homo sapiens
tgcccttgccctgacct

SEQ ID NO: 3251688 - DNA, 15 bp, Homo sapiens
tgcccttgtctgaga

SEQ ID NO: 3251689 - DNA, 22 bp, Homo sapiens
tgccgaccagagccccacacgg

SEQ ID NO: 3251690 - DNA, 16 bp, Homo sapiens
tgccgagcctaatgaa

SEQ ID NO: 3251691 - DNA, 17 bp, Homo sapiens
tgccgcagacgggcaca

SEQ ID NO: 3251692 - DNA, 18 bp, Homo sapiens
tgccgccccctcctgaac

SEQ ID NO: 3251693 - DNA, 19 bp, Homo sapiens
tgccgccccctcctgaacc

SEQ ID NO: 3251694 - DNA, 13 bp, Homo sapiens
tgccgcctcccag

SEQ ID NO: 3251695 - DNA, 16 bp, Homo sapiens
tgccgcctcccagcct

SEQ ID NO: 3251696 - DNA, 18 bp, Homo sapiens
tgccgcctcccagcctgg

SEQ ID NO: 3251697 - DNA, 15 bp, Homo sapiens
tgccgcctgctcctc

SEQ ID NO: 3251698 - DNA, 16 bp, Homo sapiens
tgccgctacctccctc

SEQ ID NO: 3251699 - DNA, 16 bp, Homo sapiens
tgccggcaggatgcag

SEQ ID NO: 3251700 - DNA, 13 bp, Homo sapiens
tgccggggacaga

SEQ ID NO: 3251701 - DNA, 19 bp, Homo sapiens
tgccgtctcatcttctctc

SEQ ID NO: 3251702 - DNA, 22 bp, Homo sapiens
tgccgtggattgcacgtggcct

SEQ ID NO: 3251703 - DNA, 21 bp, Homo sapiens
tgccgtgtgagtgtgacaggg

SEQ ID NO: 3251704 - DNA, 21 bp, Homo sapiens
tgcctaaaattgtatgaaaat

SEQ ID NO: 3251705 - DNA, 15 bp, Homo sapiens
tgcctaacaccagcg

SEQ ID NO: 3251706 - DNA, 17 bp, Homo sapiens
tgcctaaccaggcccag

SEQ ID NO: 3251707 - DNA, 18 bp, Homo sapiens
tgcctaaccaggcccagc

SEQ ID NO: 3251708 - DNA, 19 bp, Homo sapiens
tgcctaaccaggcccagcc

SEQ ID NO: 3251709 - DNA, 21 bp, Homo sapiens
tgcctaaccaggcccagccag

SEQ ID NO: 3251710 - DNA, 22 bp, Homo sapiens
tgcctaaccaggcccagccagt

SEQ ID NO: 3251711 - DNA, 22 bp, Homo sapiens
tgcctaagcattgcctggcctt

SEQ ID NO: 3251712 - DNA, 16 bp, Homo sapiens
tgcctaatggagaaga

SEQ ID NO: 3251713 - DNA, 14 bp, Homo sapiens
tgcctaattggaaa

SEQ ID NO: 3251714 - DNA, 18 bp, Homo sapiens
tgcctacaaccatccctg

SEQ ID NO: 3251715 - DNA, 22 bp, Homo sapiens
tgcctacaaccatccctgccac

SEQ ID NO: 3251716 - DNA, 22 bp, Homo sapiens
tgcctacagaacttcagaaaga

SEQ ID NO: 3251717 - DNA, 15 bp, Homo sapiens
tgcctaccatttcac

SEQ ID NO: 3251718 - DNA, 15 bp, Homo sapiens
tgcctagaatcttta

SEQ ID NO: 3251719 - DNA, 16 bp, Homo sapiens
tgcctagaatctttat

SEQ ID NO: 3251720 - DNA, 19 bp, Homo sapiens
tgcctagactgttactttg

SEQ ID NO: 3251721 - DNA, 13 bp, Homo sapiens
tgcctagagtgta

SEQ ID NO: 3251722 - DNA, 18 bp, Homo sapiens
tgcctagcaagctggcct

SEQ ID NO: 3251723 - DNA, 20 bp, Homo sapiens
tgcctagcaagctggcctct

SEQ ID NO: 3251724 - DNA, 22 bp, Homo sapiens
tgcctaggccaaatgcacaagc

SEQ ID NO: 3251725 - DNA, 19 bp, Homo sapiens
tgcctcacatttttttcta

SEQ ID NO: 3251726 - DNA, 22 bp, Homo sapiens
tgcctcaccgcttccctcctgc

SEQ ID NO: 3251727 - DNA, 15 bp, Homo sapiens
tgcctcactaatttt

SEQ ID NO: 3251728 - DNA, 14 bp, Homo sapiens
tgcctcactggggg

SEQ ID NO: 3251729 - DNA, 19 bp, Homo sapiens
tgatacttgttccagatgg

SEQ ID NO: 3251730 - DNA, 22 bp, Homo sapiens
tgatagaactttgatggatttt

SEQ ID NO: 3251731 - DNA, 21 bp, Homo sapiens
tgatagcactttctacaatgt

SEQ ID NO: 3251732 - DNA, 16 bp, Homo sapiens
tgatagctaacatttt

SEQ ID NO: 3251733 - DNA, 18 bp, Homo sapiens
tgatagctaacattttaa

SEQ ID NO: 3251734 - DNA, 15 bp, Homo sapiens
tgatagctggggctt

SEQ ID NO: 3251735 - DNA, 16 bp, Homo sapiens
tgataggaattcatct

SEQ ID NO: 3251736 - DNA, 15 bp, Homo sapiens
tgatagggaactggg

SEQ ID NO: 3251737 - DNA, 14 bp, Homo sapiens
tgatagttgtgtgt

SEQ ID NO: 3251738 - DNA, 14 bp, Homo sapiens
tgatataaattctg

SEQ ID NO: 3251739 - DNA, 17 bp, Homo sapiens
tgatataaattctgtgg

SEQ ID NO: 3251740 - DNA, 14 bp, Homo sapiens
tgatataatatcat

SEQ ID NO: 3251741 - DNA, 17 bp, Homo sapiens
tgatatacattgtgtga

SEQ ID NO: 3251742 - DNA, 18 bp, Homo sapiens
tgatatacattgtgtgaa

SEQ ID NO: 3251743 - DNA, 15 bp, Homo sapiens
tgatataccaaatta

SEQ ID NO: 3251744 - DNA, 19 bp, Homo sapiens
tgatatataagtgtacata

SEQ ID NO: 3251745 - DNA, 14 bp, Homo sapiens
tgatatatttaaaa

SEQ ID NO: 3251746 - DNA, 15 bp, Homo sapiens
tgatatattttacaa

SEQ ID NO: 3251747 - DNA, 16 bp, Homo sapiens
tgatatcccccagcct

SEQ ID NO: 3251748 - DNA, 12 bp, Homo sapiens
tgatatccctga

SEQ ID NO: 3251749 - DNA, 12 bp, Homo sapiens
tgatatgagtat

SEQ ID NO: 3251750 - DNA, 15 bp, Homo sapiens
tgatatgagtataca

SEQ ID NO: 3251751 - DNA, 19 bp, Homo sapiens
tgatatggcagaagacacc

SEQ ID NO: 3251752 - DNA, 14 bp, Homo sapiens
tgatatgggactga

SEQ ID NO: 3251753 - DNA, 22 bp, Homo sapiens
tgatatgggtttataattttct

SEQ ID NO: 3251754 - DNA, 15 bp, Homo sapiens
tgatatgtaaacata

SEQ ID NO: 3251755 - DNA, 18 bp, Homo sapiens
tgatattccatgaatgta

SEQ ID NO: 3251756 - DNA, 22 bp, Homo sapiens
tgatattccatgaatgtatcag

SEQ ID NO: 3251757 - DNA, 14 bp, Homo sapiens
tgatattgtttaaa

SEQ ID NO: 3251758 - DNA, 15 bp, Homo sapiens
tgatattgtttaaaa

SEQ ID NO: 3251759 - DNA, 17 bp, Homo sapiens
tgatattgtttaaaatt

SEQ ID NO: 3251760 - DNA, 18 bp, Homo sapiens
tgatattgtttaaaattc

SEQ ID NO: 3251761 - DNA, 12 bp, Homo sapiens
tgatatttgcat

SEQ ID NO: 3251762 - DNA, 21 bp, Homo sapiens
tgatatttgcattgaggaaat

SEQ ID NO: 3251763 - DNA, 19 bp, Homo sapiens
tgatattttacctcttatt

SEQ ID NO: 3251764 - DNA, 21 bp, Homo sapiens
tgatattttcaacgcagccct

SEQ ID NO: 3251765 - DNA, 16 bp, Homo sapiens
tgatattttgtacttt

SEQ ID NO: 3251766 - DNA, 13 bp, Homo sapiens
tgatatttttcca

SEQ ID NO: 3251767 - DNA, 20 bp, Homo sapiens
tgatatttttccatttattt

SEQ ID NO: 3251768 - DNA, 16 bp, Homo sapiens
tgatcaaattcatttt

SEQ ID NO: 3251769 - DNA, 17 bp, Homo sapiens
tgatcaaattcattttt

SEQ ID NO: 3251770 - DNA, 22 bp, Homo sapiens
tgatcaaattcatttttttcac

SEQ ID NO: 3251771 - DNA, 19 bp, Homo sapiens
tgatcaacaatttaatgta

SEQ ID NO: 3251772 - DNA, 16 bp, Homo sapiens
tgatcaagatattaaa

SEQ ID NO: 3251773 - DNA, 15 bp, Homo sapiens
tgatcaataaaatgt

SEQ ID NO: 3251774 - DNA, 19 bp, Homo sapiens
tgatcaataaaatgtgatt

SEQ ID NO: 3251775 - DNA, 15 bp, Homo sapiens
tgatcaattaaatgt

SEQ ID NO: 3251776 - DNA, 16 bp, Homo sapiens
tgatcacgcctggcta

SEQ ID NO: 3251777 - DNA, 14 bp, Homo sapiens
tgatcacggctcac

SEQ ID NO: 3251778 - DNA, 15 bp, Homo sapiens
tgatcactcccagca

SEQ ID NO: 3251779 - DNA, 17 bp, Homo sapiens
tgatcactcccagcact

SEQ ID NO: 3251780 - DNA, 20 bp, Homo sapiens
tgatcagaggtgtacactaa

SEQ ID NO: 3251781 - DNA, 18 bp, Homo sapiens
tgatcagctgtttgtcat

SEQ ID NO: 3251782 - DNA, 15 bp, Homo sapiens
tgatcataagtctaa

SEQ ID NO: 3251783 - DNA, 19 bp, Homo sapiens
tgatcataggtatttcaaa

SEQ ID NO: 3251784 - DNA, 17 bp, Homo sapiens
tgatcatcatgtagaat

SEQ ID NO: 3251785 - DNA, 14 bp, Homo sapiens
tgatcatccctttc

SEQ ID NO: 3251786 - DNA, 16 bp, Homo sapiens
tgatcatcgccagagg

SEQ ID NO: 3251787 - DNA, 13 bp, Homo sapiens
tgatcatgcattg

SEQ ID NO: 3251788 - DNA, 14 bp, Homo sapiens
tgatcatgcattgt

SEQ ID NO: 3251789 - DNA, 17 bp, Homo sapiens
tgatcatgcattgttga

SEQ ID NO: 3251790 - DNA, 13 bp, Homo sapiens
tgatcatgggaat

SEQ ID NO: 3251791 - DNA, 15 bp, Homo sapiens
tgatcatgtactttt

SEQ ID NO: 3251792 - DNA, 17 bp, Homo sapiens
tgatcattgaaatactt

SEQ ID NO: 3251793 - DNA, 18 bp, Homo sapiens
tgatcattgaaatacttt

SEQ ID NO: 3251794 - DNA, 23 bp, Homo sapiens
tgatcatttattttaagcactct

SEQ ID NO: 3251795 - DNA, 17 bp, Homo sapiens
tgatcattttcccccca

SEQ ID NO: 3251796 - DNA, 19 bp, Homo sapiens
tgatcattttccccccact

SEQ ID NO: 3251797 - DNA, 17 bp, Homo sapiens
tgatccaagctggtccc

SEQ ID NO: 3251798 - DNA, 15 bp, Homo sapiens
tgatccacccaaccc

SEQ ID NO: 3251799 - DNA, 21 bp, Homo sapiens
tgatccacccaaccctatctc

SEQ ID NO: 3251800 - DNA, 16 bp, Homo sapiens
tgatccatccatctcc

SEQ ID NO: 3251801 - DNA, 21 bp, Homo sapiens
tgatccatgagtttgccctgg

SEQ ID NO: 3251802 - DNA, 19 bp, Homo sapiens
tgatcccaagtgccagtct

SEQ ID NO: 3251803 - DNA, 12 bp, Homo sapiens
tgatcccagcac

SEQ ID NO: 3251804 - DNA, 17 bp, Homo sapiens
tgatccgcctgcctctg

SEQ ID NO: 3251805 - DNA, 21 bp, Homo sapiens
tgatccgcctgcctctgcctc

SEQ ID NO: 3251806 - DNA, 15 bp, Homo sapiens
tgatcctcccacctc

SEQ ID NO: 3251807 - DNA, 19 bp, Homo sapiens
tgatcctcccacctcagcc

SEQ ID NO: 3251808 - DNA, 22 bp, Homo sapiens
tgatcctcccacctcagcctcc

SEQ ID NO: 3251809 - DNA, 17 bp, Homo sapiens
tgatcctctattttgtg

SEQ ID NO: 3251810 - DNA, 18 bp, Homo sapiens
tgatccttttttgtcatt

SEQ ID NO: 3251811 - DNA, 22 bp, Homo sapiens
tgatcgtgctaaattttcagta

SEQ ID NO: 3251812 - DNA, 23 bp, Homo sapiens
tgatctacttcatagctccttgg

SEQ ID NO: 3251813 - DNA, 22 bp, Homo sapiens
tgatctatgtttgtgtgatttc

SEQ ID NO: 3251814 - DNA, 15 bp, Homo sapiens
tgatctatttgtaga

SEQ ID NO: 3251815 - DNA, 16 bp, Homo sapiens
tgatctatttgtagat

SEQ ID NO: 3251816 - DNA, 16 bp, Homo sapiens
tgatctccatatgtta

SEQ ID NO: 3251817 - DNA, 21 bp, Homo sapiens
tgatctccatatgttacacta

SEQ ID NO: 3251818 - DNA, 18 bp, Homo sapiens
tgatctctactaccacaa

SEQ ID NO: 3251819 - DNA, 20 bp, Homo sapiens
tgatctctactaccacaagg

SEQ ID NO: 3251820 - DNA, 22 bp, Homo sapiens
tgatctctactaccacaaggaa

SEQ ID NO: 3251821 - DNA, 12 bp, Homo sapiens
tgatctctccac

SEQ ID NO: 3251822 - DNA, 13 bp, Homo sapiens
tgatctcttcctg

SEQ ID NO: 3251823 - DNA, 14 bp, Homo sapiens
tgatctggacagaa

SEQ ID NO: 3251824 - DNA, 15 bp, Homo sapiens
tgatctggacttcct

SEQ ID NO: 3251825 - DNA, 15 bp, Homo sapiens
tgatctgtatttaat

SEQ ID NO: 3251826 - DNA, 23 bp, Homo sapiens
tgatctgtatttaatggttttta

SEQ ID NO: 3251827 - DNA, 16 bp, Homo sapiens
tgatcttgtgctcagc

SEQ ID NO: 3251828 - DNA, 19 bp, Homo sapiens
tgatcttgtgctcagcatg

SEQ ID NO: 3251829 - DNA, 16 bp, Homo sapiens
tgatctttgcagacag

SEQ ID NO: 3251830 - DNA, 18 bp, Homo sapiens
tgatctttgcagacaggc

SEQ ID NO: 3251831 - DNA, 19 bp, Homo sapiens
tgatctttgcagacaggca

SEQ ID NO: 3251832 - DNA, 19 bp, Homo sapiens
tgatgaaaactaaggattt

SEQ ID NO: 3251833 - DNA, 20 bp, Homo sapiens
tgatgaaactcctgattttg

SEQ ID NO: 3251834 - DNA, 19 bp, Homo sapiens
tgatgaaactgtcataatg

SEQ ID NO: 3251835 - DNA, 13 bp, Homo sapiens
tgatgaaagctga

SEQ ID NO: 3251836 - DNA, 22 bp, Homo sapiens
tgatgaaatgaggtcagagcct

SEQ ID NO: 3251837 - DNA, 14 bp, Homo sapiens
tgatgaactttctc

SEQ ID NO: 3251838 - DNA, 15 bp, Homo sapiens
tgatgaactttctct

SEQ ID NO: 3251839 - DNA, 16 bp, Homo sapiens
tgatgaatcaatgaaa

SEQ ID NO: 3251840 - DNA, 17 bp, Homo sapiens
tgatgaatcaatgaaaa

SEQ ID NO: 3251841 - DNA, 20 bp, Homo sapiens
tgatgaatcaatgaaaaatg

SEQ ID NO: 3251842 - DNA, 21 bp, Homo sapiens
tgagaaatatggacacttaat

SEQ ID NO: 3251843 - DNA, 13 bp, Homo sapiens
tgagaaatgatga

SEQ ID NO: 3251844 - DNA, 14 bp, Homo sapiens
tgagaaatgttaaa

SEQ ID NO: 3251845 - DNA, 16 bp, Homo sapiens
tgagaaatttctgtga

SEQ ID NO: 3251846 - DNA, 19 bp, Homo sapiens
tgagaaatttctgtgaaac

SEQ ID NO: 3251847 - DNA, 19 bp, Homo sapiens
tgagaacaaagctgttaaa

SEQ ID NO: 3251848 - DNA, 22 bp, Homo sapiens
tgagaacaagtcacagctgcag

SEQ ID NO: 3251849 - DNA, 15 bp, Homo sapiens
tgagaactgaatttt

SEQ ID NO: 3251850 - DNA, 20 bp, Homo sapiens
tgagaagagggcctgtggga

SEQ ID NO: 3251851 - DNA, 21 bp, Homo sapiens
tgagaagagggcctgtgggag

SEQ ID NO: 3251852 - DNA, 23 bp, Homo sapiens
tgagaagagggcctgtgggagcc

SEQ ID NO: 3251853 - DNA, 17 bp, Homo sapiens
tgagaagcgtttttaac

SEQ ID NO: 3251854 - DNA, 22 bp, Homo sapiens
tgagaagctgctccaggcctgc

SEQ ID NO: 3251855 - DNA, 13 bp, Homo sapiens
tgagaaggagaga

SEQ ID NO: 3251856 - DNA, 16 bp, Homo sapiens
tgagaaggagagaaag

SEQ ID NO: 3251857 - DNA, 16 bp, Homo sapiens
tgagaaggcgaggaga

SEQ ID NO: 3251858 - DNA, 18 bp, Homo sapiens
tgagaagtgaatgctggg

SEQ ID NO: 3251859 - DNA, 23 bp, Homo sapiens
tgagaatcacggtggtaaagaaa

SEQ ID NO: 3251860 - DNA, 17 bp, Homo sapiens
tgagaatcccttaaaat

SEQ ID NO: 3251861 - DNA, 21 bp, Homo sapiens
tgagaatctacccccagatcc

SEQ ID NO: 3251862 - DNA, 23 bp, Homo sapiens
tgagaatctatatttaacaagat

SEQ ID NO: 3251863 - DNA, 13 bp, Homo sapiens
tgagaattttaaa

SEQ ID NO: 3251864 - DNA, 16 bp, Homo sapiens
tgagacaaaattttag

SEQ ID NO: 3251865 - DNA, 17 bp, Homo sapiens
tgagacaagccctggca

SEQ ID NO: 3251866 - DNA, 18 bp, Homo sapiens
tgagacacgatgccgaga

SEQ ID NO: 3251867 - DNA, 17 bp, Homo sapiens
tgagacacggagcccag

SEQ ID NO: 3251868 - DNA, 14 bp, Homo sapiens
tgagacagaatctc

SEQ ID NO: 3251869 - DNA, 19 bp, Homo sapiens
tgagacagacacacagcct

SEQ ID NO: 3251870 - DNA, 21 bp, Homo sapiens
tgagacagagttttcactctt

SEQ ID NO: 3251871 - DNA, 14 bp, Homo sapiens
tgagacagtttctt

SEQ ID NO: 3251872 - DNA, 15 bp, Homo sapiens
tgagacagtttctta

SEQ ID NO: 3251873 - DNA, 18 bp, Homo sapiens
tgagacagtttcttagct

SEQ ID NO: 3251874 - DNA, 21 bp, Homo sapiens
tgagacataaatgttcacttt

SEQ ID NO: 3251875 - DNA, 18 bp, Homo sapiens
tgagaccactgagtacca

SEQ ID NO: 3251876 - DNA, 12 bp, Homo sapiens
tgagaccagttg

SEQ ID NO: 3251877 - DNA, 14 bp, Homo sapiens
tgagacccccacac

SEQ ID NO: 3251878 - DNA, 16 bp, Homo sapiens
tgagacccccacacct

SEQ ID NO: 3251879 - DNA, 22 bp, Homo sapiens
tgagacccccacacctcagttc

SEQ ID NO: 3251880 - DNA, 15 bp, Homo sapiens
tgagacccctgtctc

SEQ ID NO: 3251881 - DNA, 16 bp, Homo sapiens
tgagacccctgtctcc

SEQ ID NO: 3251882 - DNA, 12 bp, Homo sapiens
tgagaccctgtc

SEQ ID NO: 3251883 - DNA, 20 bp, Homo sapiens
tgagacgccaccattcctgg

SEQ ID NO: 3251884 - DNA, 14 bp, Homo sapiens
tgagactatttaaa

SEQ ID NO: 3251885 - DNA, 17 bp, Homo sapiens
tgagactcacaggaagg

SEQ ID NO: 3251886 - DNA, 21 bp, Homo sapiens
tgagactctagggtccagtgg

SEQ ID NO: 3251887 - DNA, 13 bp, Homo sapiens
tgagactggcact

SEQ ID NO: 3251888 - DNA, 20 bp, Homo sapiens
tgagactttccgactgcttt

SEQ ID NO: 3251889 - DNA, 14 bp, Homo sapiens
tgagactttttggt

SEQ ID NO: 3251890 - DNA, 16 bp, Homo sapiens
tgagagaaagagagaa

SEQ ID NO: 3251891 - DNA, 16 bp, Homo sapiens
tgagagaatggagaca

SEQ ID NO: 3251892 - DNA, 16 bp, Homo sapiens
tgagagaattggctca

SEQ ID NO: 3251893 - DNA, 20 bp, Homo sapiens
tgagagagtagttttgaaca

SEQ ID NO: 3251894 - DNA, 19 bp, Homo sapiens
tgagagcccagaggtaaca

SEQ ID NO: 3251895 - DNA, 12 bp, Homo sapiens
tgagagccccca

SEQ ID NO: 3251896 - DNA, 22 bp, Homo sapiens
tgagagccctgctgtgggagag

SEQ ID NO: 3251897 - DNA, 15 bp, Homo sapiens
tgagaggatgaatgt

SEQ ID NO: 3251898 - DNA, 13 bp, Homo sapiens
tgagaggcctgga

SEQ ID NO: 3251899 - DNA, 15 bp, Homo sapiens
tgagaggcctggagc

SEQ ID NO: 3251900 - DNA, 21 bp, Homo sapiens
tgagaggcgacaggagtattt

SEQ ID NO: 3251901 - DNA, 22 bp, Homo sapiens
tgagagggcaatctttgccttt

SEQ ID NO: 3251902 - DNA, 22 bp, Homo sapiens
tgagagggctcgaggggtgggc

SEQ ID NO: 3251903 - DNA, 16 bp, Homo sapiens
tgagaggggaagcggc

SEQ ID NO: 3251904 - DNA, 22 bp, Homo sapiens
tgagaggtttgactagatgatg

SEQ ID NO: 3251905 - DNA, 19 bp, Homo sapiens
tgagagtatattatgtatt

SEQ ID NO: 3251906 - DNA, 17 bp, Homo sapiens
tgagagtctagattctc

SEQ ID NO: 3251907 - DNA, 19 bp, Homo sapiens
tgagagtctagcactcatt

SEQ ID NO: 3251908 - DNA, 21 bp, Homo sapiens
tgagagtgtctctgataaaag

SEQ ID NO: 3251909 - DNA, 16 bp, Homo sapiens
tgagatattaaattct

SEQ ID NO: 3251910 - DNA, 18 bp, Homo sapiens
tgagatattaaattctca

SEQ ID NO: 3251911 - DNA, 15 bp, Homo sapiens
tgagatatttattgt

SEQ ID NO: 3251912 - DNA, 16 bp, Homo sapiens
tgagatcacagcctcc

SEQ ID NO: 3251913 - DNA, 16 bp, Homo sapiens
tgagatcccctgagcc

SEQ ID NO: 3251914 - DNA, 20 bp, Homo sapiens
tgagatccttcacaggcagt

SEQ ID NO: 3251915 - DNA, 21 bp, Homo sapiens
tgagatcgtgctactgcactc

SEQ ID NO: 3251916 - DNA, 23 bp, Homo sapiens
tgagatctaagcctttccataag

SEQ ID NO: 3251917 - DNA, 16 bp, Homo sapiens
tgagatctaatgtgaa

SEQ ID NO: 3251918 - DNA, 23 bp, Homo sapiens
tgagatctaatgtgaaaatcatc

SEQ ID NO: 3251919 - DNA, 14 bp, Homo sapiens
tgagatgctagaac

SEQ ID NO: 3251920 - DNA, 13 bp, Homo sapiens
tgagatgctggag

SEQ ID NO: 3251921 - DNA, 19 bp, Homo sapiens
tgagatgctggagaagaga

SEQ ID NO: 3251922 - DNA, 13 bp, Homo sapiens
tgagatgctggtt

SEQ ID NO: 3251923 - DNA, 18 bp, Homo sapiens
tgagatgtgttcctcctg

SEQ ID NO: 3251924 - DNA, 20 bp, Homo sapiens
tgagatgtgttcctcctgct

SEQ ID NO: 3251925 - DNA, 22 bp, Homo sapiens
tgagatgtgttcctcctgctgt

SEQ ID NO: 3251926 - DNA, 17 bp, Homo sapiens
tgagatgttgtgtggca

SEQ ID NO: 3251927 - DNA, 19 bp, Homo sapiens
tgagattgccccaggtctg

SEQ ID NO: 3251928 - DNA, 22 bp, Homo sapiens
tgagatttaaatgcaaccagaa

SEQ ID NO: 3251929 - DNA, 15 bp, Homo sapiens
tgagatttcctcctg

SEQ ID NO: 3251930 - DNA, 13 bp, Homo sapiens
tgagatttcttaa

SEQ ID NO: 3251931 - DNA, 15 bp, Homo sapiens
tgagatttgccagca

SEQ ID NO: 3251932 - DNA, 14 bp, Homo sapiens
tgagattttggtat

SEQ ID NO: 3251933 - DNA, 20 bp, Homo sapiens
tgagatttttttgtgtatgt

SEQ ID NO: 3251934 - DNA, 21 bp, Homo sapiens
tgagatttttttgtgtatgtt

SEQ ID NO: 3251935 - DNA, 18 bp, Homo sapiens
tgagcaactcttgattat

SEQ ID NO: 3251936 - DNA, 17 bp, Homo sapiens
tgagcaagggggcccaa

SEQ ID NO: 3251937 - DNA, 20 bp, Homo sapiens
tgagcactaaggtgtgctct

SEQ ID NO: 3251938 - DNA, 16 bp, Homo sapiens
tgagcagccgccagct

SEQ ID NO: 3251939 - DNA, 16 bp, Homo sapiens
tgagcaggaaggcctg

SEQ ID NO: 3251940 - DNA, 19 bp, Homo sapiens
tgagcagggctcagcgggg

SEQ ID NO: 3251941 - DNA, 22 bp, Homo sapiens
tgagcagggctcagcggggaca

SEQ ID NO: 3251942 - DNA, 15 bp, Homo sapiens
tgagcagtgagcaga

SEQ ID NO: 3251943 - DNA, 22 bp, Homo sapiens
tgagcagtggctggtccagggc

SEQ ID NO: 3251944 - DNA, 17 bp, Homo sapiens
tgagcatcctgagcccc

SEQ ID NO: 3251945 - DNA, 23 bp, Homo sapiens
tgagcatcctgagccccgccctc

SEQ ID NO: 3251946 - DNA, 18 bp, Homo sapiens
tgagcatgggtgtgccct

SEQ ID NO: 3251947 - DNA, 13 bp, Homo sapiens
tgagcatttgcac

SEQ ID NO: 3251948 - DNA, 14 bp, Homo sapiens
tgagccaaagagaa

SEQ ID NO: 3251949 - DNA, 17 bp, Homo sapiens
tgagccaaggaggcctg

SEQ ID NO: 3251950 - DNA, 21 bp, Homo sapiens
tgagccactcagtctcttcca

SEQ ID NO: 3251951 - DNA, 17 bp, Homo sapiens
tgagccactgagcctgg

SEQ ID NO: 3251952 - DNA, 14 bp, Homo sapiens
tgagccactgcacc

SEQ ID NO: 3251953 - DNA, 18 bp, Homo sapiens
tgagccactgcaccgggc

SEQ ID NO: 3251954 - DNA, 21 bp, Homo sapiens
tgagccactgcaccgggccac

SEQ ID NO: 3251955 - DNA, 18 bp, Homo sapiens
tgagccaggcctgggtct

SEQ ID NO: 3251956 - DNA, 17 bp, Homo sapiens
tgagccagtaatcttta

SEQ ID NO: 3251957 - DNA, 21 bp, Homo sapiens
tgagccagttgtcctatggac

SEQ ID NO: 3251958 - DNA, 21 bp, Homo sapiens
tgagccatgatcgagccactg

SEQ ID NO: 3251959 - DNA, 23 bp, Homo sapiens
tgagccatgatcgagccactgca

SEQ ID NO: 3251960 - DNA, 21 bp, Homo sapiens
tgagcccactgcccaccccct

SEQ ID NO: 3251961 - DNA, 15 bp, Homo sapiens
tgagcccagagaaca

SEQ ID NO: 3251962 - DNA, 17 bp, Homo sapiens
tgagcccagctgcctgg

SEQ ID NO: 3251963 - DNA, 18 bp, Homo sapiens
tgagcccagctgcctgga

SEQ ID NO: 3251964 - DNA, 16 bp, Homo sapiens
tgaggtgctatgttct

SEQ ID NO: 3251965 - DNA, 14 bp, Homo sapiens
tgaggtggcacttt

SEQ ID NO: 3251966 - DNA, 23 bp, Homo sapiens
tgaggtggcactttttcatttgc

SEQ ID NO: 3251967 - DNA, 20 bp, Homo sapiens
tgaggtgggcagatcacgag

SEQ ID NO: 3251968 - DNA, 23 bp, Homo sapiens
tgaggtgggctggggctgctccc

SEQ ID NO: 3251969 - DNA, 18 bp, Homo sapiens
tgaggtggtctgaatgtt

SEQ ID NO: 3251970 - DNA, 19 bp, Homo sapiens
tgaggtggtctgaatgttc

SEQ ID NO: 3251971 - DNA, 15 bp, Homo sapiens
tgaggtgtccaactg

SEQ ID NO: 3251972 - DNA, 18 bp, Homo sapiens
tgaggtgtgggggctgca

SEQ ID NO: 3251973 - DNA, 15 bp, Homo sapiens
tgaggtgtgtcacaa

SEQ ID NO: 3251974 - DNA, 21 bp, Homo sapiens
tgaggttaggtcatgaggaca

SEQ ID NO: 3251975 - DNA, 16 bp, Homo sapiens
tgaggttcctctgcct

SEQ ID NO: 3251976 - DNA, 17 bp, Homo sapiens
tgaggttcctctgcctg

SEQ ID NO: 3251977 - DNA, 20 bp, Homo sapiens
tgaggttcctctgcctgccc

SEQ ID NO: 3251978 - DNA, 20 bp, Homo sapiens
tgagtaaaaagtttctaaag

SEQ ID NO: 3251979 - DNA, 17 bp, Homo sapiens
tgagtaacatttgctgt

SEQ ID NO: 3251980 - DNA, 14 bp, Homo sapiens
tgagtaagaacatc

SEQ ID NO: 3251981 - DNA, 13 bp, Homo sapiens
tgagtaagagctg

SEQ ID NO: 3251982 - DNA, 14 bp, Homo sapiens
tgagtaagagctgg

SEQ ID NO: 3251983 - DNA, 17 bp, Homo sapiens
tgagtaagagctggtgt

SEQ ID NO: 3251984 - DNA, 18 bp, Homo sapiens
tgagtaagagctggtgtc

SEQ ID NO: 3251985 - DNA, 21 bp, Homo sapiens
tgagtaagagctggtgtctga

SEQ ID NO: 3251986 - DNA, 23 bp, Homo sapiens
tgagtacagagtgtggactctgg

SEQ ID NO: 3251987 - DNA, 18 bp, Homo sapiens
tgagtacagtgaggaggg

SEQ ID NO: 3251988 - DNA, 19 bp, Homo sapiens
tgagtacagtgaggagggt

SEQ ID NO: 3251989 - DNA, 16 bp, Homo sapiens
tgagtaccaggggctg

SEQ ID NO: 3251990 - DNA, 20 bp, Homo sapiens
tgagtagatattactttatc

SEQ ID NO: 3251991 - DNA, 21 bp, Homo sapiens
tgagtagatccatttccattg

SEQ ID NO: 3251992 - DNA, 23 bp, Homo sapiens
tgagtatggagcagcctggagac

SEQ ID NO: 3251993 - DNA, 12 bp, Homo sapiens
tgagtattgttt

SEQ ID NO: 3251994 - DNA, 15 bp, Homo sapiens
tgagtattgtttaaa

SEQ ID NO: 3251995 - DNA, 15 bp, Homo sapiens
tgagtatttggtcca

SEQ ID NO: 3251996 - DNA, 13 bp, Homo sapiens
tgagtcaatgtgc

SEQ ID NO: 3251997 - DNA, 15 bp, Homo sapiens
tgagtcaatgtgcag

SEQ ID NO: 3251998 - DNA, 16 bp, Homo sapiens
tgagtcaccaagccca

SEQ ID NO: 3251999 - DNA, 20 bp, Homo sapiens
tgagtcaccctacctgtgcc

SEQ ID NO: 3252000 - DNA, 17 bp, Homo sapiens
tgagtcacgctggggct

SEQ ID NO: 3252001 - DNA, 14 bp, Homo sapiens
tgagtcacttgtgt

SEQ ID NO: 3252002 - DNA, 14 bp, Homo sapiens
tgagtcagaaaaca

SEQ ID NO: 3252003 - DNA, 18 bp, Homo sapiens
tgagtcagggcccagagg

SEQ ID NO: 3252004 - DNA, 17 bp, Homo sapiens
tgagtcattgacttcat

SEQ ID NO: 3252005 - DNA, 23 bp, Homo sapiens
tgagtcccagagcccgcttttgt

SEQ ID NO: 3252006 - DNA, 12 bp, Homo sapiens
tgagtccctgct

SEQ ID NO: 3252007 - DNA, 15 bp, Homo sapiens
tgagtcctggtccct

SEQ ID NO: 3252008 - DNA, 18 bp, Homo sapiens
tgagtcctggtccctctg

SEQ ID NO: 3252009 - DNA, 20 bp, Homo sapiens
tgagtcctggtccctctgag

SEQ ID NO: 3252010 - DNA, 21 bp, Homo sapiens
tgagtcctggtccctctgagg

SEQ ID NO: 3252011 - DNA, 22 bp, Homo sapiens
tgagtcctggtccctctgaggc

SEQ ID NO: 3252012 - DNA, 23 bp, Homo sapiens
tgagtcctggtccctctgaggca

SEQ ID NO: 3252013 - DNA, 14 bp, Homo sapiens
tgagtcctgtctct

SEQ ID NO: 3252014 - DNA, 19 bp, Homo sapiens
tgagtcctgtctctgcctg

SEQ ID NO: 3252015 - DNA, 15 bp, Homo sapiens
tgagtccttgaaaat

SEQ ID NO: 3252016 - DNA, 16 bp, Homo sapiens
tgagtccttgaaaata

SEQ ID NO: 3252017 - DNA, 23 bp, Homo sapiens
tgagtcggccccacatgggaacc

SEQ ID NO: 3252018 - DNA, 17 bp, Homo sapiens
tgagtcgtacagaaagc

SEQ ID NO: 3252019 - DNA, 18 bp, Homo sapiens
tgagtcgtcatcactttt

SEQ ID NO: 3252020 - DNA, 17 bp, Homo sapiens
tgagtctttggttctaa

SEQ ID NO: 3252021 - DNA, 20 bp, Homo sapiens
tgagtctttggttctaagga

SEQ ID NO: 3252022 - DNA, 15 bp, Homo sapiens
tgagtgaataaatgt

SEQ ID NO: 3252023 - DNA, 14 bp, Homo sapiens
tgagtgagcctggc

SEQ ID NO: 3252024 - DNA, 19 bp, Homo sapiens
tgagtgagttcaactacat

SEQ ID NO: 3252025 - DNA, 17 bp, Homo sapiens
tgagtgccttttgcaga

SEQ ID NO: 3252026 - DNA, 19 bp, Homo sapiens
tgagtgccttttgcagaag

SEQ ID NO: 3252027 - DNA, 20 bp, Homo sapiens
tgagtggcagccatgcctca

SEQ ID NO: 3252028 - DNA, 20 bp, Homo sapiens
tgagtggccagccagtgcca

SEQ ID NO: 3252029 - DNA, 14 bp, Homo sapiens
tgagtggccaggga

SEQ ID NO: 3252030 - DNA, 12 bp, Homo sapiens
tgagtggcctgc

SEQ ID NO: 3252031 - DNA, 16 bp, Homo sapiens
tgagtggcgcaaggcc

SEQ ID NO: 3252032 - DNA, 12 bp, Homo sapiens
tgagtgggagaa

SEQ ID NO: 3252033 - DNA, 15 bp, Homo sapiens
tgagtgggagaaggc

SEQ ID NO: 3252034 - DNA, 17 bp, Homo sapiens
tgagtgggagaaggcag

SEQ ID NO: 3252035 - DNA, 21 bp, Homo sapiens
tgagtggggttatctctgtgt

SEQ ID NO: 3252036 - DNA, 22 bp, Homo sapiens
tgagtggggttatctctgtgtt

SEQ ID NO: 3252037 - DNA, 17 bp, Homo sapiens
tgagtgtaaataatttt

SEQ ID NO: 3252038 - DNA, 15 bp, Homo sapiens
tgagtgtggaagccg

SEQ ID NO: 3252039 - DNA, 13 bp, Homo sapiens
tgagtgtggactt

SEQ ID NO: 3252040 - DNA, 24 bp, Homo sapiens
tgagtgttcctttttaaatgtgaa

SEQ ID NO: 3252041 - DNA, 13 bp, Homo sapiens
tgagttaactgtg

SEQ ID NO: 3252042 - DNA, 19 bp, Homo sapiens
tgagttacattaaaataaa

SEQ ID NO: 3252043 - DNA, 23 bp, Homo sapiens
tgagttacattaaaataaaccaa

SEQ ID NO: 3252044 - DNA, 20 bp, Homo sapiens
tgagttatcatgaattttaa

SEQ ID NO: 3252045 - DNA, 23 bp, Homo sapiens
tgagttatcatgaattttaaagt

SEQ ID NO: 3252046 - DNA, 22 bp, Homo sapiens
tgagttattccttgatcatttt

SEQ ID NO: 3252047 - DNA, 17 bp, Homo sapiens
tgagttattttaattat

SEQ ID NO: 3252048 - DNA, 20 bp, Homo sapiens
tgagttctatcagttatcct

SEQ ID NO: 3252049 - DNA, 13 bp, Homo sapiens
tgagttctcaggg

SEQ ID NO: 3252050 - DNA, 16 bp, Homo sapiens
tgagttctcagggctc

SEQ ID NO: 3252051 - DNA, 18 bp, Homo sapiens
tgagttctcagggctcct

SEQ ID NO: 3252052 - DNA, 15 bp, Homo sapiens
tgagttctccctgta

SEQ ID NO: 3252053 - DNA, 23 bp, Homo sapiens
tgagttgccaagacaaatcaaca

SEQ ID NO: 3252054 - DNA, 19 bp, Homo sapiens
tgagttggacttcagtctt

SEQ ID NO: 3252055 - DNA, 20 bp, Homo sapiens
tgagtttaccatttgtaata

SEQ ID NO: 3252056 - DNA, 23 bp, Homo sapiens
tgagtttaccttgtatactgtag

SEQ ID NO: 3252057 - DNA, 19 bp, Homo sapiens
tgagtttcattctcctgcc

SEQ ID NO: 3252058 - DNA, 19 bp, Homo sapiens
tgagtttgagctgccttcc

SEQ ID NO: 3252059 - DNA, 21 bp, Homo sapiens
tgagtttgagctgccttccct

SEQ ID NO: 3252060 - DNA, 18 bp, Homo sapiens
tgagtttgtaggtaaaat

SEQ ID NO: 3252061 - DNA, 23 bp, Homo sapiens
tgagttttctctttgtggggctt

SEQ ID NO: 3252062 - DNA, 18 bp, Homo sapiens
tgagttttttaaattttt

SEQ ID NO: 3252063 - DNA, 20 bp, Homo sapiens
tgataaaagttttgatattt

SEQ ID NO: 3252064 - DNA, 19 bp, Homo sapiens
tgataaacctgccaagagt

SEQ ID NO: 3252065 - DNA, 20 bp, Homo sapiens
tgataaagcctcaaggtttt

SEQ ID NO: 3252066 - DNA, 15 bp, Homo sapiens
tgataaatatatatg

SEQ ID NO: 3252067 - DNA, 18 bp, Homo sapiens
tgataaatatatatgatc

SEQ ID NO: 3252068 - DNA, 19 bp, Homo sapiens
tgataaattccactggact

SEQ ID NO: 3252069 - DNA, 17 bp, Homo sapiens
tgataacttggggaggc

SEQ ID NO: 3252070 - DNA, 19 bp, Homo sapiens
tgataacttggggaggcaa

SEQ ID NO: 3252071 - DNA, 16 bp, Homo sapiens
tgataaggatcagaac

SEQ ID NO: 3252072 - DNA, 19 bp, Homo sapiens
tgataagttcctttccttt

SEQ ID NO: 3252073 - DNA, 15 bp, Homo sapiens
tgataatagattctc

SEQ ID NO: 3252074 - DNA, 21 bp, Homo sapiens
tgataatatattgtgttgact

SEQ ID NO: 3252075 - DNA, 23 bp, Homo sapiens
tgataatattagtgattctgatt

SEQ ID NO: 3252076 - DNA, 13 bp, Homo sapiens
tgataatgttaaa

SEQ ID NO: 3252077 - DNA, 14 bp, Homo sapiens
tgataatgttaaat

SEQ ID NO: 3252078 - DNA, 17 bp, Homo sapiens
tgatacaagattagaag

SEQ ID NO: 3252079 - DNA, 23 bp, Homo sapiens
tgatacactatgaagatgtttca

SEQ ID NO: 3252080 - DNA, 16 bp, Homo sapiens
tgatacataactaaat

SEQ ID NO: 3252081 - DNA, 18 bp, Homo sapiens
tgatacattttttaagct

SEQ ID NO: 3252082 - DNA, 13 bp, Homo sapiens
tgaaaagttattt

SEQ ID NO: 3252083 - DNA, 20 bp, Homo sapiens
tgaaaagttatttatgctat

SEQ ID NO: 3252084 - DNA, 21 bp, Homo sapiens
tgaaaagttatttatgctata

SEQ ID NO: 3252085 - DNA, 15 bp, Homo sapiens
tgaaaagtttttgtt

SEQ ID NO: 3252086 - DNA, 19 bp, Homo sapiens
tgaaaataaagcagaagca

SEQ ID NO: 3252087 - DNA, 13 bp, Homo sapiens
tgaaaataactga

SEQ ID NO: 3252088 - DNA, 19 bp, Homo sapiens
tgaaaataactgaaccaaa

SEQ ID NO: 3252089 - DNA, 18 bp, Homo sapiens
tgaaaataactgaatttg

SEQ ID NO: 3252090 - DNA, 22 bp, Homo sapiens
tgaaaatatacttgactctaat

SEQ ID NO: 3252091 - DNA, 17 bp, Homo sapiens
tgaaaatatatgatggc

SEQ ID NO: 3252092 - DNA, 20 bp, Homo sapiens
tgaaaatatctcttgtgctt

SEQ ID NO: 3252093 - DNA, 20 bp, Homo sapiens
tgaaaatatgatgtttcaca

SEQ ID NO: 3252094 - DNA, 15 bp, Homo sapiens
tgaaaatatttctct

SEQ ID NO: 3252095 - DNA, 16 bp, Homo sapiens
tgaaaatatttctcta

SEQ ID NO: 3252096 - DNA, 20 bp, Homo sapiens
tgaaaatatttctctagtgt

SEQ ID NO: 3252097 - DNA, 21 bp, Homo sapiens
tgaaaatattttttatatata

SEQ ID NO: 3252098 - DNA, 23 bp, Homo sapiens
tgaaaatattttttatatataca

SEQ ID NO: 3252099 - DNA, 21 bp, Homo sapiens
tgaaaatctaatattaaaaat

SEQ ID NO: 3252100 - DNA, 19 bp, Homo sapiens
tgaaaatgattcctggaca

SEQ ID NO: 3252101 - DNA, 18 bp, Homo sapiens
tgaaaatgcaaagctgaa

SEQ ID NO: 3252102 - DNA, 19 bp, Homo sapiens
tgaaaatgcaaagctgaag

SEQ ID NO: 3252103 - DNA, 19 bp, Homo sapiens
tgaaaatgtaagctgttta

SEQ ID NO: 3252104 - DNA, 14 bp, Homo sapiens
tgaaaatgtcagaa

SEQ ID NO: 3252105 - DNA, 17 bp, Homo sapiens
tgaaaatgtgctatact

SEQ ID NO: 3252106 - DNA, 13 bp, Homo sapiens
tgaaaatgttcat

SEQ ID NO: 3252107 - DNA, 12 bp, Homo sapiens
tgaaaatgttta

SEQ ID NO: 3252108 - DNA, 20 bp, Homo sapiens
tgaaaattaggatttcatga

SEQ ID NO: 3252109 - DNA, 16 bp, Homo sapiens
tgaaaattattttaaa

SEQ ID NO: 3252110 - DNA, 17 bp, Homo sapiens
tgaaaattcaaaaagtg

SEQ ID NO: 3252111 - DNA, 18 bp, Homo sapiens
tgaaaattcaaaaagtgt

SEQ ID NO: 3252112 - DNA, 18 bp, Homo sapiens
tgaaaattccagaaagga

SEQ ID NO: 3252113 - DNA, 20 bp, Homo sapiens
tgaaaattccagaaaggata

SEQ ID NO: 3252114 - DNA, 17 bp, Homo sapiens
tgaaaattgaaaagtac

SEQ ID NO: 3252115 - DNA, 14 bp, Homo sapiens
tgaaacaaagctgc

SEQ ID NO: 3252116 - DNA, 19 bp, Homo sapiens
tgaaacaactttctcttgt

SEQ ID NO: 3252117 - DNA, 17 bp, Homo sapiens
tgaaacaagaagccaca

SEQ ID NO: 3252118 - DNA, 21 bp, Homo sapiens
tgaaacaatgttgtccaacaa

SEQ ID NO: 3252119 - DNA, 16 bp, Homo sapiens
tgaaacacaccaggct

SEQ ID NO: 3252120 - DNA, 17 bp, Homo sapiens
tgaaacacaccaggctg

SEQ ID NO: 3252121 - DNA, 19 bp, Homo sapiens
tgaaacacaccaggctgtg

SEQ ID NO: 3252122 - DNA, 14 bp, Homo sapiens
tgaaacacagctgt

SEQ ID NO: 3252123 - DNA, 19 bp, Homo sapiens
tgaaacacgaaacttgtta

SEQ ID NO: 3252124 - DNA, 17 bp, Homo sapiens
tgaaacagaaaaataag

SEQ ID NO: 3252125 - DNA, 22 bp, Homo sapiens
tgaaacagaaaaataagtcaaa

SEQ ID NO: 3252126 - DNA, 13 bp, Homo sapiens
tgaaacagaaaca

SEQ ID NO: 3252127 - DNA, 23 bp, Homo sapiens
tgaaacagattcaggccagccca

SEQ ID NO: 3252128 - DNA, 14 bp, Homo sapiens
tgaaacagatttca

SEQ ID NO: 3252129 - DNA, 13 bp, Homo sapiens
tgaaacagttcca

SEQ ID NO: 3252130 - DNA, 23 bp, Homo sapiens
tgaaaccaaaacataaaaaccaa

SEQ ID NO: 3252131 - DNA, 20 bp, Homo sapiens
tgaaaccaattaagcagctt

SEQ ID NO: 3252132 - DNA, 19 bp, Homo sapiens
tgaaacccaaagccctggt

SEQ ID NO: 3252133 - DNA, 12 bp, Homo sapiens
tgaaacccacag

SEQ ID NO: 3252134 - DNA, 22 bp, Homo sapiens
tgaaacccacagatgtctctgg

SEQ ID NO: 3252135 - DNA, 13 bp, Homo sapiens
tgaaacccacagt

SEQ ID NO: 3252136 - DNA, 14 bp, Homo sapiens
tgaaacccacagtt

SEQ ID NO: 3252137 - DNA, 16 bp, Homo sapiens
tgaaacctacacactg

SEQ ID NO: 3252138 - DNA, 18 bp, Homo sapiens
tgaaacctttagggcagc

SEQ ID NO: 3252139 - DNA, 17 bp, Homo sapiens
tgaaaccttttttaaga

SEQ ID NO: 3252140 - DNA, 20 bp, Homo sapiens
tgaaacgcaattttacctag

SEQ ID NO: 3252141 - DNA, 21 bp, Homo sapiens
tgaaacgcaattttacctagt

SEQ ID NO: 3252142 - DNA, 18 bp, Homo sapiens
tgaaactcatagacactg

SEQ ID NO: 3252143 - DNA, 19 bp, Homo sapiens
tgaaactcatagacactga

SEQ ID NO: 3252144 - DNA, 21 bp, Homo sapiens
tgaaactttgggaaaacatgt

SEQ ID NO: 3252145 - DNA, 13 bp, Homo sapiens
tgaaagaaaattg

SEQ ID NO: 3252146 - DNA, 22 bp, Homo sapiens
tgaaagaaaattgagttgcact

SEQ ID NO: 3252147 - DNA, 20 bp, Homo sapiens
tgaaagaacatggacttgta

SEQ ID NO: 3252148 - DNA, 11 bp, Homo sapiens
tgaaagaagca

SEQ ID NO: 3252149 - DNA, 13 bp, Homo sapiens
tgaaagaagcaag

SEQ ID NO: 3252150 - DNA, 23 bp, Homo sapiens
tgaaagaagcaagacacgtggcc

SEQ ID NO: 3252151 - DNA, 18 bp, Homo sapiens
tgaaagaatatatttatt

SEQ ID NO: 3252152 - DNA, 11 bp, Homo sapiens
tgaaagacaaa

SEQ ID NO: 3252153 - DNA, 13 bp, Homo sapiens
tgaaagacaccat

SEQ ID NO: 3252154 - DNA, 21 bp, Homo sapiens
tgaaagacctgaataccactt

SEQ ID NO: 3252155 - DNA, 16 bp, Homo sapiens
tgaaagagaaccagtt

SEQ ID NO: 3252156 - DNA, 21 bp, Homo sapiens
tgaaagaggctgaggcctgga

SEQ ID NO: 3252157 - DNA, 19 bp, Homo sapiens
tgaaagatggctgtgcctc

SEQ ID NO: 3252158 - DNA, 15 bp, Homo sapiens
tgaaagattaaacag

SEQ ID NO: 3252159 - DNA, 14 bp, Homo sapiens
tgaaagattgtggg

SEQ ID NO: 3252160 - DNA, 21 bp, Homo sapiens
tgaaagcagcagctaggactg

SEQ ID NO: 3252161 - DNA, 22 bp, Homo sapiens
tgaaagctgagaactcctgact

SEQ ID NO: 3252162 - DNA, 22 bp, Homo sapiens
tgaaagctgattactgtcaata

SEQ ID NO: 3252163 - DNA, 20 bp, Homo sapiens
tgaaagggagctatcaggaa

SEQ ID NO: 3252164 - DNA, 14 bp, Homo sapiens
tgaaagtacatttg

SEQ ID NO: 3252165 - DNA, 23 bp, Homo sapiens
tgaaagtacatttggagacacaa

SEQ ID NO: 3252166 - DNA, 18 bp, Homo sapiens
tgaaagtcagatgcccag

SEQ ID NO: 3252167 - DNA, 14 bp, Homo sapiens
tgaaagtgtcgtct

SEQ ID NO: 3252168 - DNA, 15 bp, Homo sapiens
tgaaagtgtcgtctc

SEQ ID NO: 3252169 - DNA, 15 bp, Homo sapiens
tgaaagttacccact

SEQ ID NO: 3252170 - DNA, 17 bp, Homo sapiens
tgaaagtttgcactgta

SEQ ID NO: 3252171 - DNA, 20 bp, Homo sapiens
tgaaagttttcagaacctct

SEQ ID NO: 3252172 - DNA, 14 bp, Homo sapiens
tgaaagttttccag

SEQ ID NO: 3252173 - DNA, 20 bp, Homo sapiens
tgaaagttttccagtattga

SEQ ID NO: 3252174 - DNA, 23 bp, Homo sapiens
tgaaagttttccagtattgaaaa

SEQ ID NO: 3252175 - DNA, 11 bp, Homo sapiens
tgaaataaaca

SEQ ID NO: 3252176 - DNA, 22 bp, Homo sapiens
tgaaataaacactggtgccaac

SEQ ID NO: 3252177 - DNA, 21 bp, Homo sapiens
tgaaataaattggtgataagt

SEQ ID NO: 3252178 - DNA, 14 bp, Homo sapiens
tgaaataactcctt

SEQ ID NO: 3252179 - DNA, 13 bp, Homo sapiens
tgaaataattaaa

SEQ ID NO: 3252180 - DNA, 19 bp, Homo sapiens
tgaaatacacaagtaaaca

SEQ ID NO: 3252181 - DNA, 21 bp, Homo sapiens
tgaaatacctttgtagttact

SEQ ID NO: 3252182 - DNA, 22 bp, Homo sapiens
tgaaatactaaaagcaaatcta

SEQ ID NO: 3252183 - DNA, 13 bp, Homo sapiens
tgaaatagtctgt

SEQ ID NO: 3252184 - DNA, 11 bp, Homo sapiens
tgaaatatttt

SEQ ID NO: 3252185 - DNA, 21 bp, Homo sapiens
tgaaatattttttaatttaaa

SEQ ID NO: 3252186 - DNA, 19 bp, Homo sapiens
tgaaatcatcaaaaagaaa

SEQ ID NO: 3252187 - DNA, 14 bp, Homo sapiens
tgaaatcctgcttc

SEQ ID NO: 3252188 - DNA, 17 bp, Homo sapiens
tgaaatccttgactgga

SEQ ID NO: 3252189 - DNA, 22 bp, Homo sapiens
tgaaatcttcccatgcattctg

SEQ ID NO: 3252190 - DNA, 20 bp, Homo sapiens
tgaaatgaaaacatgtaata

SEQ ID NO: 3252191 - DNA, 13 bp, Homo sapiens
tgaaatgaaattt

SEQ ID NO: 3252192 - DNA, 23 bp, Homo sapiens
tgaaatgaaatttaaacattaaa

SEQ ID NO: 3252193 - DNA, 17 bp, Homo sapiens
tgaaatgacctctgtcc

SEQ ID NO: 3252194 - DNA, 20 bp, Homo sapiens
tgaaatgccctcctaaatgt

SEQ ID NO: 3252195 - DNA, 15 bp, Homo sapiens
tgaaattattttctc

SEQ ID NO: 3252196 - DNA, 18 bp, Homo sapiens
tgaaattattttctccaa

SEQ ID NO: 3252197 - DNA, 14 bp, Homo sapiens
tgaaattccaaagt

SEQ ID NO: 3252198 - DNA, 15 bp, Homo sapiens
tgaaattccaaagtc

SEQ ID NO: 3252199 - DNA, 23 bp, Homo sapiens
tgaaattctaaagagcacttact

SEQ ID NO: 3252200 - DNA, 16 bp, Homo sapiens
tgaaattctcctggag

SEQ ID NO: 3252201 - DNA, 22 bp, Homo sapiens
tgaaattgataatgctttcaca

SEQ ID NO: 3252202 - DNA, 16 bp, Homo sapiens
tgaaattgcatacttt

SEQ ID NO: 3252203 - DNA, 12 bp, Homo sapiens
tgaaattgtaaa

SEQ ID NO: 3252204 - DNA, 19 bp, Homo sapiens
tgaaattgtatctcagtct

SEQ ID NO: 3252205 - DNA, 22 bp, Homo sapiens
tgaaattgtgaactcattgctc

SEQ ID NO: 3252206 - DNA, 16 bp, Homo sapiens
tgaaatttaaacatta

SEQ ID NO: 3252207 - DNA, 13 bp, Homo sapiens
tgaaatttacaaa

SEQ ID NO: 3252208 - DNA, 21 bp, Homo sapiens
tgaaatttattagttaatata

SEQ ID NO: 3252209 - DNA, 12 bp, Homo sapiens
tgaaatttcaga

SEQ ID NO: 3252210 - DNA, 20 bp, Homo sapiens
tgaaatttgttatacttcaa

SEQ ID NO: 3252211 - DNA, 19 bp, Homo sapiens
tgaaattttaaaaattgtt

SEQ ID NO: 3252212 - DNA, 17 bp, Homo sapiens
tgaaattttaaactata

SEQ ID NO: 3252213 - DNA, 20 bp, Homo sapiens
tgaaattttaacctatgata

SEQ ID NO: 3252214 - DNA, 18 bp, Homo sapiens
tgaaattttatatgctta

SEQ ID NO: 3252215 - DNA, 17 bp, Homo sapiens
tgaaattttctagactt

SEQ ID NO: 3252216 - DNA, 16 bp, Homo sapiens
tgaaattttgcaaata

SEQ ID NO: 3252217 - DNA, 19 bp, Homo sapiens
tgaaattttgcaaatataa

SEQ ID NO: 3252218 - DNA, 15 bp, Homo sapiens
tgaaatttttattaa

SEQ ID NO: 3252219 - DNA, 13 bp, Homo sapiens
tgaacaaaattat

SEQ ID NO: 3252220 - DNA, 19 bp, Homo sapiens
tgaacaaatcaaattgctt

SEQ ID NO: 3252221 - DNA, 14 bp, Homo sapiens
tgaacaagaattgg

SEQ ID NO: 3252222 - DNA, 21 bp, Homo sapiens
tgaacaattgtcgaaaagagt

SEQ ID NO: 3252223 - DNA, 18 bp, Homo sapiens
tgaacacaaactgtaaat

SEQ ID NO: 3252224 - DNA, 16 bp, Homo sapiens
tgaacacaggcagctt

SEQ ID NO: 3252225 - DNA, 23 bp, Homo sapiens
tgaacacaggcagctttctagaa

SEQ ID NO: 3252226 - DNA, 12 bp, Homo sapiens
tgaacacagtat

SEQ ID NO: 3252227 - DNA, 15 bp, Homo sapiens
tgaacacagtatttt

SEQ ID NO: 3252228 - DNA, 19 bp, Homo sapiens
tgaacacagtattttccca

SEQ ID NO: 3252229 - DNA, 15 bp, Homo sapiens
tgaacacagtttagt

SEQ ID NO: 3252230 - DNA, 17 bp, Homo sapiens
tgaacaccattgaaggc

SEQ ID NO: 3252231 - DNA, 20 bp, Homo sapiens
tgaacaccattgaaggctta

SEQ ID NO: 3252232 - DNA, 22 bp, Homo sapiens
tgaacatccccactaggttctt

SEQ ID NO: 3252233 - DNA, 22 bp, Homo sapiens
tgaacatgcagttcattatttt

SEQ ID NO: 3252234 - DNA, 14 bp, Homo sapiens
tgaacatgtttaca

SEQ ID NO: 3252235 - DNA, 14 bp, Homo sapiens
tgaaccaaagcctc

SEQ ID NO: 3252236 - DNA, 15 bp, Homo sapiens
tgaaccaaattgcac

SEQ ID NO: 3252237 - DNA, 21 bp, Homo sapiens
tgaaccaaattgcactgaagt

SEQ ID NO: 3252238 - DNA, 22 bp, Homo sapiens
tgaaccaaattgcactgaagtt

SEQ ID NO: 3252239 - DNA, 23 bp, Homo sapiens
tgaaccaaattgcactgaagttt

SEQ ID NO: 3252240 - DNA, 14 bp, Homo sapiens
tgaaccacaacttt

SEQ ID NO: 3252241 - DNA, 15 bp, Homo sapiens
tgaaccacaggtttt

SEQ ID NO: 3252242 - DNA, 21 bp, Homo sapiens
tgaaccaccacacccagccca

SEQ ID NO: 3252243 - DNA, 20 bp, Homo sapiens
tgaaccagctcatctccaag

SEQ ID NO: 3252244 - DNA, 21 bp, Homo sapiens
tgaaccataaattcaactttg

SEQ ID NO: 3252245 - DNA, 19 bp, Homo sapiens
tgaaccattatactttata

SEQ ID NO: 3252246 - DNA, 21 bp, Homo sapiens
tgaaccattatactttatatc

SEQ ID NO: 3252247 - DNA, 15 bp, Homo sapiens
tgaaccccatgggct

SEQ ID NO: 3252248 - DNA, 16 bp, Homo sapiens
tgaaccccatgggctt

SEQ ID NO: 3252249 - DNA, 22 bp, Homo sapiens
tgaacccgggacgcaggggttg

SEQ ID NO: 3252250 - DNA, 14 bp, Homo sapiens
tgaaccctgtgctg

SEQ ID NO: 3252251 - DNA, 16 bp, Homo sapiens
tgaacctattttcatt

SEQ ID NO: 3252252 - DNA, 18 bp, Homo sapiens
tgaacctattttcatttg

SEQ ID NO: 3252253 - DNA, 19 bp, Homo sapiens
tgaacctattttcatttgt

SEQ ID NO: 3252254 - DNA, 21 bp, Homo sapiens
tgaacctattttcatttgtac

SEQ ID NO: 3252255 - DNA, 12 bp, Homo sapiens
tgaacctgccct

SEQ ID NO: 3252256 - DNA, 14 bp, Homo sapiens
tgaacctgtgcaat

SEQ ID NO: 3252257 - DNA, 23 bp, Homo sapiens
tgaacctttttttttgaaacagc

SEQ ID NO: 3252258 - DNA, 18 bp, Homo sapiens
tgaactaagaaacttttg

SEQ ID NO: 3252259 - DNA, 18 bp, Homo sapiens
tgaactaggctgagcaat

SEQ ID NO: 3252260 - DNA, 17 bp, Homo sapiens
tgaactatttctacaca

SEQ ID NO: 3252261 - DNA, 20 bp, Homo sapiens
tgaactatttctacacagtg

SEQ ID NO: 3252262 - DNA, 14 bp, Homo sapiens
tgaactcaaactga

SEQ ID NO: 3252263 - DNA, 17 bp, Homo sapiens
tgaactcaactttgaca

SEQ ID NO: 3252264 - DNA, 15 bp, Homo sapiens
tgaactcaccctggg

SEQ ID NO: 3252265 - DNA, 20 bp, Homo sapiens
tgaactcactttcctcctga

SEQ ID NO: 3252266 - DNA, 15 bp, Homo sapiens
tgaactcctggcctc

SEQ ID NO: 3252267 - DNA, 11 bp, Homo sapiens
tgaactctcaa

SEQ ID NO: 3252268 - DNA, 15 bp, Homo sapiens
tgaactcttcaatct

SEQ ID NO: 3252269 - DNA, 18 bp, Homo sapiens
tgaactcttcaatctctt

SEQ ID NO: 3252270 - DNA, 14 bp, Homo sapiens
tgaactcttcagaa

SEQ ID NO: 3252271 - DNA, 22 bp, Homo sapiens
tgaactcttcagaacacacaga

SEQ ID NO: 3252272 - DNA, 14 bp, Homo sapiens
tgaactctttctgg

SEQ ID NO: 3252273 - DNA, 12 bp, Homo sapiens
tgaactgaacac

SEQ ID NO: 3252274 - DNA, 22 bp, Homo sapiens
tgaactgaacaccattgaaggc

SEQ ID NO: 3252275 - DNA, 12 bp, Homo sapiens
tgaactgaagtt

SEQ ID NO: 3252276 - DNA, 13 bp, Homo sapiens
tgaactgaagttt

SEQ ID NO: 3252277 - DNA, 23 bp, Homo sapiens
tgaactgctggagtctggcttta

SEQ ID NO: 3252278 - DNA, 15 bp, Homo sapiens
tgaactgctttcaag

SEQ ID NO: 3252279 - DNA, 19 bp, Homo sapiens
tgaactgggtacttgtgga

SEQ ID NO: 3252280 - DNA, 11 bp, Homo sapiens
tgaactgttac

SEQ ID NO: 3252281 - DNA, 13 bp, Homo sapiens
tgaactgttacaa

SEQ ID NO: 3252282 - DNA, 23 bp, Homo sapiens
tgaacttacacttggagcccgtg

SEQ ID NO: 3252283 - DNA, 24 bp, Homo sapiens
tgaacttcccacacgattagcttt

SEQ ID NO: 3252284 - DNA, 17 bp, Homo sapiens
tgaacttgactgggtga

SEQ ID NO: 3252285 - DNA, 17 bp, Homo sapiens
tgaacttgcattgtgat

SEQ ID NO: 3252286 - DNA, 14 bp, Homo sapiens
tgaacttgtagctg

SEQ ID NO: 3252287 - DNA, 15 bp, Homo sapiens
tgaacttgtagctgt

SEQ ID NO: 3252288 - DNA, 19 bp, Homo sapiens
tgaacttgtagctgtaaaa

SEQ ID NO: 3252289 - DNA, 20 bp, Homo sapiens
tgaacttgttacttgcagca

SEQ ID NO: 3252290 - DNA, 11 bp, Homo sapiens
tgaactttctc

SEQ ID NO: 3252291 - DNA, 21 bp, Homo sapiens
tgaactttctcttcatacttt

SEQ ID NO: 3252292 - DNA, 14 bp, Homo sapiens
tgaactttgccaaa

SEQ ID NO: 3252293 - DNA, 23 bp, Homo sapiens
tgaactttgccaaaaaaaaaaga

SEQ ID NO: 3252294 - DNA, 13 bp, Homo sapiens
tgaactttttgta

SEQ ID NO: 3252295 - DNA, 13 bp, Homo sapiens
tgaagaaaaaagc

SEQ ID NO: 3252296 - DNA, 13 bp, Homo sapiens
tgaagaaaaaatc

SEQ ID NO: 3252297 - DNA, 15 bp, Homo sapiens
tgaagaaaaagtaca

SEQ ID NO: 3252298 - DNA, 22 bp, Homo sapiens
tgaagaaagtcagctcttgtca

SEQ ID NO: 3252299 - DNA, 17 bp, Homo sapiens
tgaagaaatctttccag

SEQ ID NO: 3252300 - DNA, 19 bp, Homo sapiens
tgaagaacacagcatgtgc

SEQ ID NO: 3252301 - DNA, 21 bp, Homo sapiens
tgaagaacacagcatgtgcca

SEQ ID NO: 3252302 - DNA, 18 bp, Homo sapiens
tgaagaactgcaggccct

SEQ ID NO: 3252303 - DNA, 22 bp, Homo sapiens
tgaagaagctaaatcctttact

SEQ ID NO: 3252304 - DNA, 13 bp, Homo sapiens
tgaagaaggaagc

SEQ ID NO: 3252305 - DNA, 16 bp, Homo sapiens
tgaagaatgtctgtac

SEQ ID NO: 3252306 - DNA, 11 bp, Homo sapiens
tgaagaattaa

SEQ ID NO: 3252307 - DNA, 17 bp, Homo sapiens
tgaagaattaagataca

SEQ ID NO: 3252308 - DNA, 17 bp, Homo sapiens
tgaagaattatgtaata

SEQ ID NO: 3252309 - DNA, 14 bp, Homo sapiens
tgaagacaggatgg

SEQ ID NO: 3252310 - DNA, 24 bp, Homo sapiens
tgaagagaaccgagcaaagatcaa

SEQ ID NO: 3252311 - DNA, 19 bp, Homo sapiens
tgaagagaagcaattttgg

SEQ ID NO: 3252312 - DNA, 18 bp, Homo sapiens
tgaagaggggcagccctt

SEQ ID NO: 3252313 - DNA, 13 bp, Homo sapiens
tgaagagtagttt

SEQ ID NO: 3252314 - DNA, 17 bp, Homo sapiens
tgaagagtatccttcct

SEQ ID NO: 3252315 - DNA, 18 bp, Homo sapiens
tgaagagtcgattatttc

SEQ ID NO: 3252316 - DNA, 17 bp, Homo sapiens
tgaagagtgagagggca

SEQ ID NO: 3252317 - DNA, 18 bp, Homo sapiens
tgaagagtgagagggcat

SEQ ID NO: 3252318 - DNA, 16 bp, Homo sapiens
tgaagataatttgcat

SEQ ID NO: 3252319 - DNA, 16 bp, Homo sapiens
tgaagatatatttcac

SEQ ID NO: 3252320 - DNA, 19 bp, Homo sapiens
tgaagatcgttagtatcta

SEQ ID NO: 3252321 - DNA, 15 bp, Homo sapiens
tgaagatggtttcaa

SEQ ID NO: 3252322 - DNA, 14 bp, Homo sapiens
tgaagcaaggaaga

SEQ ID NO: 3252323 - DNA, 13 bp, Homo sapiens
tgaagcagcctct

SEQ ID NO: 3252324 - DNA, 19 bp, Homo sapiens
tgaagcagctttaaacaaa

SEQ ID NO: 3252325 - DNA, 14 bp, Homo sapiens
tgaagcagtatttt

SEQ ID NO: 3252326 - DNA, 15 bp, Homo sapiens
tgaagcagtattttg

SEQ ID NO: 3252327 - DNA, 13 bp, Homo sapiens
tgaagcagtgcct

SEQ ID NO: 3252328 - DNA, 18 bp, Homo sapiens
tgaagcatgctttgctgc

SEQ ID NO: 3252329 - DNA, 14 bp, Homo sapiens
tgaagccaaatgaa

SEQ ID NO: 3252330 - DNA, 14 bp, Homo sapiens
tgaagccaagtggg

SEQ ID NO: 3252331 - DNA, 22 bp, Homo sapiens
tgaagccaagtggggtgctggg

SEQ ID NO: 3252332 - DNA, 19 bp, Homo sapiens
tgaagccactgaagctggg

SEQ ID NO: 3252333 - DNA, 12 bp, Homo sapiens
tgaagccagcct

SEQ ID NO: 3252334 - DNA, 23 bp, Homo sapiens
tgaagccagctcacagtgctgtg

SEQ ID NO: 3252335 - DNA, 21 bp, Homo sapiens
tgaagccatagcctccacgga

SEQ ID NO: 3252336 - DNA, 15 bp, Homo sapiens
tgaagcccaataaac

SEQ ID NO: 3252337 - DNA, 19 bp, Homo sapiens
tgaagcccaggctgatgct

SEQ ID NO: 3252338 - DNA, 16 bp, Homo sapiens
tgaagccgactctggc

SEQ ID NO: 3252339 - DNA, 19 bp, Homo sapiens
tgaagccgactctggccct

SEQ ID NO: 3252340 - DNA, 20 bp, Homo sapiens
tgaagccgactctggccctg

SEQ ID NO: 3252341 - DNA, 23 bp, Homo sapiens
tgaagcctgcgttggtccagagc

SEQ ID NO: 3252342 - DNA, 13 bp, Homo sapiens
tgaagctgaaaat

SEQ ID NO: 3252343 - DNA, 14 bp, Homo sapiens
tgaagctgaaaata

SEQ ID NO: 3252344 - DNA, 18 bp, Homo sapiens
tgaagcttgactcccaag

SEQ ID NO: 3252345 - DNA, 23 bp, Homo sapiens
tgaagctttatacgtgtagctat

SEQ ID NO: 3252346 - DNA, 15 bp, Homo sapiens
tgaaggaaaatgata

SEQ ID NO: 3252347 - DNA, 12 bp, Homo sapiens
tgaaggaaacag

SEQ ID NO: 3252348 - DNA, 14 bp, Homo sapiens
tgaaggaaacagtt

SEQ ID NO: 3252349 - DNA, 16 bp, Homo sapiens
tgaaggaaacagttaa

SEQ ID NO: 3252350 - DNA, 21 bp, Homo sapiens
tgaaggaaataaaaaagtctc

SEQ ID NO: 3252351 - DNA, 17 bp, Homo sapiens
tgaaggaaatccttcgg

SEQ ID NO: 3252352 - DNA, 16 bp, Homo sapiens
tgaaggaagagaagac

SEQ ID NO: 3252353 - DNA, 12 bp, Homo sapiens
tgaaggaagagg

SEQ ID NO: 3252354 - DNA, 21 bp, Homo sapiens
tgaaggaatcattccagtgct

SEQ ID NO: 3252355 - DNA, 18 bp, Homo sapiens
tgaaggagccacgtgaat

SEQ ID NO: 3252356 - DNA, 17 bp, Homo sapiens
tgaaggaggtcaggccc

SEQ ID NO: 3252357 - DNA, 21 bp, Homo sapiens
tgaaggattctgggaatcatg

SEQ ID NO: 3252358 - DNA, 14 bp, Homo sapiens
tgaaggcaaaattg

SEQ ID NO: 3252359 - DNA, 17 bp, Homo sapiens
tgaaggcaaaattgcaa

SEQ ID NO: 3252360 - DNA, 16 bp, Homo sapiens
tgaaggcagtctgaac

SEQ ID NO: 3252361 - DNA, 19 bp, Homo sapiens
tgaagggaaacaaagaagt

SEQ ID NO: 3252362 - DNA, 17 bp, Homo sapiens
tgaagggagaagacact

SEQ ID NO: 3252363 - DNA, 16 bp, Homo sapiens
tgaagggagagccagc

SEQ ID NO: 3252364 - DNA, 19 bp, Homo sapiens
tgaaggggcacaccactgc

SEQ ID NO: 3252365 - DNA, 22 bp, Homo sapiens
tgaaggtctttgttatgacagt

SEQ ID NO: 3252366 - DNA, 16 bp, Homo sapiens
tgaaggttaggattta

SEQ ID NO: 3252367 - DNA, 20 bp, Homo sapiens
tgaaggttaggatttaacag

SEQ ID NO: 3252368 - DNA, 22 bp, Homo sapiens
tgaagtaaactttttgttctgg

SEQ ID NO: 3252369 - DNA, 19 bp, Homo sapiens
tgaagtaaagccattaaat

SEQ ID NO: 3252370 - DNA, 20 bp, Homo sapiens
tgaagtaatgaatttttatg

SEQ ID NO: 3252371 - DNA, 13 bp, Homo sapiens
tgaagtacatatt

SEQ ID NO: 3252372 - DNA, 20 bp, Homo sapiens
tgaagtacttaaacttccac

SEQ ID NO: 3252373 - DNA, 15 bp, Homo sapiens
tgaagtagtttgtat

SEQ ID NO: 3252374 - DNA, 21 bp, Homo sapiens
tgaagtatattcttattggaa

SEQ ID NO: 3252375 - DNA, 13 bp, Homo sapiens
tgaagtcacacag

SEQ ID NO: 3252376 - DNA, 17 bp, Homo sapiens
tgaagtgagcacagcct

SEQ ID NO: 3252377 - DNA, 18 bp, Homo sapiens
tgaagtgagcacagccta

SEQ ID NO: 3252378 - DNA, 16 bp, Homo sapiens
tgaagtgcgtgaatgt

SEQ ID NO: 3252379 - DNA, 18 bp, Homo sapiens
tgaagtgctgtttattaa

SEQ ID NO: 3252380 - DNA, 22 bp, Homo sapiens
tgaagtgtacctgtgtacataa

SEQ ID NO: 3252381 - DNA, 18 bp, Homo sapiens
tgaagttgctctgtaccc

SEQ ID NO: 3252382 - DNA, 12 bp, Homo sapiens
tgaagttgctgt

SEQ ID NO: 3252383 - DNA, 15 bp, Homo sapiens
tgaagttgctgttta

SEQ ID NO: 3252384 - DNA, 17 bp, Homo sapiens
tgaagttgctgtttatt

SEQ ID NO: 3252385 - DNA, 14 bp, Homo sapiens
tgaagtttacattg

SEQ ID NO: 3252386 - DNA, 20 bp, Homo sapiens
tgaagtttacattgtaaata

SEQ ID NO: 3252387 - DNA, 23 bp, Homo sapiens
tgaagtttcaagttttaaagttc

SEQ ID NO: 3252388 - DNA, 18 bp, Homo sapiens
tgaagtttgaacttcata

SEQ ID NO: 3252389 - DNA, 17 bp, Homo sapiens
tgaagttttacattgtt

SEQ ID NO: 3252390 - DNA, 14 bp, Homo sapiens
tgaagtttttgaaa

SEQ ID NO: 3252391 - DNA, 15 bp, Homo sapiens
tgaagtttttgaaat

SEQ ID NO: 3252392 - DNA, 17 bp, Homo sapiens
tgaagtttttgaaatac

SEQ ID NO: 3252393 - DNA, 19 bp, Homo sapiens
tgaataaaaatatgtacaa

SEQ ID NO: 3252394 - DNA, 11 bp, Homo sapiens
tgaataaaata

SEQ ID NO: 3252395 - DNA, 15 bp, Homo sapiens
tgaataaaattattt

SEQ ID NO: 3252396 - DNA, 12 bp, Homo sapiens
tgaataaactga

SEQ ID NO: 3252397 - DNA, 17 bp, Homo sapiens
tgaataaactgaatatt

SEQ ID NO: 3252398 - DNA, 12 bp, Homo sapiens
tgaataaagtgt

SEQ ID NO: 3252399 - DNA, 17 bp, Homo sapiens
tgaataaagtgtaacaa

SEQ ID NO: 3252400 - DNA, 15 bp, Homo sapiens
tgaataaccacttaa

SEQ ID NO: 3252401 - DNA, 14 bp, Homo sapiens
tgaataatggaaaa

SEQ ID NO: 3252402 - DNA, 19 bp, Homo sapiens
tgaataatggaaaatgcca

SEQ ID NO: 3252403 - DNA, 14 bp, Homo sapiens
tgaataatttccca

SEQ ID NO: 3252404 - DNA, 22 bp, Homo sapiens
tgaataatttcccaattaggaa

SEQ ID NO: 3252405 - DNA, 13 bp, Homo sapiens
tgaataatttctt

SEQ ID NO: 3252406 - DNA, 19 bp, Homo sapiens
tgaatacagggcatgcatt

SEQ ID NO: 3252407 - DNA, 16 bp, Homo sapiens
tgaatacttattttca

SEQ ID NO: 3252408 - DNA, 14 bp, Homo sapiens
tgaatactttctta

SEQ ID NO: 3252409 - DNA, 15 bp, Homo sapiens
tgaatagaaatggga

SEQ ID NO: 3252410 - DNA, 21 bp, Homo sapiens
tgaatagatatgaaagctgat

SEQ ID NO: 3252411 - DNA, 13 bp, Homo sapiens
tgaatagatgtga

SEQ ID NO: 3252412 - DNA, 14 bp, Homo sapiens
tgaatatagcctgc

SEQ ID NO: 3252413 - DNA, 15 bp, Homo sapiens
tgaatatagcctgcc

SEQ ID NO: 3252414 - DNA, 18 bp, Homo sapiens
tgaatatattataatctt

SEQ ID NO: 3252415 - DNA, 14 bp, Homo sapiens
tgaatatcattgat

SEQ ID NO: 3252416 - DNA, 18 bp, Homo sapiens
tgaatatcattgatttta

SEQ ID NO: 3252417 - DNA, 22 bp, Homo sapiens
tgaatattactcctatttttgt

SEQ ID NO: 3252418 - DNA, 15 bp, Homo sapiens
tgaatattactctca

SEQ ID NO: 3252419 - DNA, 16 bp, Homo sapiens
tgaatattactctcaa

SEQ ID NO: 3252420 - DNA, 15 bp, Homo sapiens
tgaatattgatgtta

SEQ ID NO: 3252421 - DNA, 19 bp, Homo sapiens
tgaatattgatgttaacaa

SEQ ID NO: 3252422 - DNA, 19 bp, Homo sapiens
tgaatatttatatttcact

SEQ ID NO: 3252423 - DNA, 20 bp, Homo sapiens
tgaatatttatatttcacta

SEQ ID NO: 3252424 - DNA, 15 bp, Homo sapiens
tgaatattttggaaa

SEQ ID NO: 3252425 - DNA, 16 bp, Homo sapiens
tgaatattttggaaac

SEQ ID NO: 3252426 - DNA, 19 bp, Homo sapiens
tgaatattttttatttcta

SEQ ID NO: 3252427 - DNA, 15 bp, Homo sapiens
tgaatcaatgaaaaa

SEQ ID NO: 3252428 - DNA, 22 bp, Homo sapiens
tgaatcactgtttttagacacc

SEQ ID NO: 3252429 - DNA, 16 bp, Homo sapiens
tgaatcagtataaaca

SEQ ID NO: 3252430 - DNA, 19 bp, Homo sapiens
tgaatcatgtaggatcttg

SEQ ID NO: 3252431 - DNA, 15 bp, Homo sapiens
tgaatccaaactaat

SEQ ID NO: 3252432 - DNA, 18 bp, Homo sapiens
tgaatccaactgcttaaa

SEQ ID NO: 3252433 - DNA, 22 bp, Homo sapiens
tgactttttttggtataatgtt

SEQ ID NO: 3252434 - DNA, 17 bp, Homo sapiens
tgagaaaaagctcctgt

SEQ ID NO: 3252435 - DNA, 12 bp, Homo sapiens
tgagaaaacatg

SEQ ID NO: 3252436 - DNA, 19 bp, Homo sapiens
tgagaaacagctcagccag

SEQ ID NO: 3252437 - DNA, 23 bp, Homo sapiens
tgagaaaccttattgtacctctc

SEQ ID NO: 3252438 - DNA, 22 bp, Homo sapiens
tgaatcctaagggctggtctct

SEQ ID NO: 3252439 - DNA, 14 bp, Homo sapiens
tgaatctaaggata

SEQ ID NO: 3252440 - DNA, 19 bp, Homo sapiens
tgaatctcataattggaat

SEQ ID NO: 3252441 - DNA, 11 bp, Homo sapiens
tgaatgaaaaa

SEQ ID NO: 3252442 - DNA, 17 bp, Homo sapiens
tgaatgaaaaatttaag

SEQ ID NO: 3252443 - DNA, 19 bp, Homo sapiens
tgaatgaaaaatttaagca

SEQ ID NO: 3252444 - DNA, 13 bp, Homo sapiens
tgaatgaaaacat

SEQ ID NO: 3252445 - DNA, 17 bp, Homo sapiens
tgaatgaaaataactga

SEQ ID NO: 3252446 - DNA, 11 bp, Homo sapiens
tgaatgaacac

SEQ ID NO: 3252447 - DNA, 16 bp, Homo sapiens
tgaatgaagcagtatt

SEQ ID NO: 3252448 - DNA, 13 bp, Homo sapiens
tgaatgaagctga

SEQ ID NO: 3252449 - DNA, 15 bp, Homo sapiens
tgaatgacaacagaa

SEQ ID NO: 3252450 - DNA, 19 bp, Homo sapiens
tgaatgactccactgtttt

SEQ ID NO: 3252451 - DNA, 22 bp, Homo sapiens
tgaatgactccactgtttttct

SEQ ID NO: 3252452 - DNA, 19 bp, Homo sapiens
tgaatgaggattattataa

SEQ ID NO: 3252453 - DNA, 18 bp, Homo sapiens
tgaatgatttgtgtttct

SEQ ID NO: 3252454 - DNA, 23 bp, Homo sapiens
tgaatgcaaaattgttttcactt

SEQ ID NO: 3252455 - DNA, 23 bp, Homo sapiens
tgaatgcccacaggcaaatgcat

SEQ ID NO: 3252456 - DNA, 20 bp, Homo sapiens
tgaatgcccagtgagactgt

SEQ ID NO: 3252457 - DNA, 20 bp, Homo sapiens
tgaatgctaagaatgcatta

SEQ ID NO: 3252458 - DNA, 13 bp, Homo sapiens
tgaatgctgccac

SEQ ID NO: 3252459 - DNA, 15 bp, Homo sapiens
tgaatgctgggactc

SEQ ID NO: 3252460 - DNA, 14 bp, Homo sapiens
tgaatgcttttagt

SEQ ID NO: 3252461 - DNA, 23 bp, Homo sapiens
tgaatgcttttagtgtgtgcata

SEQ ID NO: 3252462 - DNA, 19 bp, Homo sapiens
tgaatgctttttgaatgtt

SEQ ID NO: 3252463 - DNA, 20 bp, Homo sapiens
tgaatggattggattattta

SEQ ID NO: 3252464 - DNA, 21 bp, Homo sapiens
tgaatggtgttgtatgccttt

SEQ ID NO: 3252465 - DNA, 19 bp, Homo sapiens
tgaatggttccatgcctga

SEQ ID NO: 3252466 - DNA, 16 bp, Homo sapiens
tgaatgtaaaagaaaa

SEQ ID NO: 3252467 - DNA, 19 bp, Homo sapiens
tgaatgtagcagccccggg

SEQ ID NO: 3252468 - DNA, 22 bp, Homo sapiens
tgaatgtatgtaatgtgtggtg

SEQ ID NO: 3252469 - DNA, 15 bp, Homo sapiens
tgaatgtatgtgcac

SEQ ID NO: 3252470 - DNA, 14 bp, Homo sapiens
tgaatgtatttatg

SEQ ID NO: 3252471 - DNA, 19 bp, Homo sapiens
tgaatgtatttatttggga

SEQ ID NO: 3252472 - DNA, 21 bp, Homo sapiens
tgaatgtgggcactggcccag

SEQ ID NO: 3252473 - DNA, 15 bp, Homo sapiens
tgaatgtggtctcag

SEQ ID NO: 3252474 - DNA, 16 bp, Homo sapiens
tgaatgtggtctcagg

SEQ ID NO: 3252475 - DNA, 17 bp, Homo sapiens
tgaatgtggttacttcc

SEQ ID NO: 3252476 - DNA, 12 bp, Homo sapiens
tgaatgtgtcag

SEQ ID NO: 3252477 - DNA, 21 bp, Homo sapiens
tgaatgttaaagggatatttt

SEQ ID NO: 3252478 - DNA, 14 bp, Homo sapiens
tgaatgttaagaat

SEQ ID NO: 3252479 - DNA, 14 bp, Homo sapiens
tgaatgttatttgt

SEQ ID NO: 3252480 - DNA, 17 bp, Homo sapiens
tgaatgttctgacatta

SEQ ID NO: 3252481 - DNA, 23 bp, Homo sapiens
tgaatgttctgacattaacagtt

SEQ ID NO: 3252482 - DNA, 20 bp, Homo sapiens
tgaatgttgcaatgtgaaaa

SEQ ID NO: 3252483 - DNA, 13 bp, Homo sapiens
tgaatgtttacat

SEQ ID NO: 3252484 - DNA, 19 bp, Homo sapiens
tgaatgtttattccttgat

SEQ ID NO: 3252485 - DNA, 17 bp, Homo sapiens
tgaattaaataaaccct

SEQ ID NO: 3252486 - DNA, 15 bp, Homo sapiens
tgaattaaataaata

SEQ ID NO: 3252487 - DNA, 22 bp, Homo sapiens
tgaattaatatccctacatgta

SEQ ID NO: 3252488 - DNA, 14 bp, Homo sapiens
tgaattacagtgaa

SEQ ID NO: 3252489 - DNA, 20 bp, Homo sapiens
tgaattactgtatataaact

SEQ ID NO: 3252490 - DNA, 13 bp, Homo sapiens
tgaattaggctaa

SEQ ID NO: 3252491 - DNA, 18 bp, Homo sapiens
tgaattagtgagtatagt

SEQ ID NO: 3252492 - DNA, 13 bp, Homo sapiens
tgaattataacag

SEQ ID NO: 3252493 - DNA, 15 bp, Homo sapiens
tgaattatcagcaaa

SEQ ID NO: 3252494 - DNA, 12 bp, Homo sapiens
tgaattcaaagc

SEQ ID NO: 3252495 - DNA, 21 bp, Homo sapiens
tgaattcaaagcttgtgaaaa

SEQ ID NO: 3252496 - DNA, 17 bp, Homo sapiens
tgaattcaagaaaggaa

SEQ ID NO: 3252497 - DNA, 15 bp, Homo sapiens
tgaattcccttttaa

SEQ ID NO: 3252498 - DNA, 18 bp, Homo sapiens
tgaattcctgtcttccaa

SEQ ID NO: 3252499 - DNA, 16 bp, Homo sapiens
tgaattgaagtttcaa

SEQ ID NO: 3252500 - DNA, 12 bp, Homo sapiens
tgaattgtacag

SEQ ID NO: 3252501 - DNA, 13 bp, Homo sapiens
tgaattgtctttt

SEQ ID NO: 3252502 - DNA, 17 bp, Homo sapiens
tgaattgtgaccaagtt

SEQ ID NO: 3252503 - DNA, 19 bp, Homo sapiens
tgaatttaaatataattct

SEQ ID NO: 3252504 - DNA, 17 bp, Homo sapiens
tgaatttataaagtacc

SEQ ID NO: 3252505 - DNA, 13 bp, Homo sapiens
tgaatttcactgt

SEQ ID NO: 3252506 - DNA, 16 bp, Homo sapiens
tgaatttgaatgaaaa

SEQ ID NO: 3252507 - DNA, 17 bp, Homo sapiens
tgaatttgaatgaaaaa

SEQ ID NO: 3252508 - DNA, 17 bp, Homo sapiens
tgaatttggagactctg

SEQ ID NO: 3252509 - DNA, 13 bp, Homo sapiens
tgaattttaaagt

SEQ ID NO: 3252510 - DNA, 20 bp, Homo sapiens
tgaattttaaattaaagcaa

SEQ ID NO: 3252511 - DNA, 11 bp, Homo sapiens
tgaattttcta

SEQ ID NO: 3252512 - DNA, 15 bp, Homo sapiens
tgaattttgggactt

SEQ ID NO: 3252513 - DNA, 13 bp, Homo sapiens
tgaatttttctaa

SEQ ID NO: 3252514 - DNA, 15 bp, Homo sapiens
tgaatttttctaaac

SEQ ID NO: 3252515 - DNA, 17 bp, Homo sapiens
tgaattttttaaatgaa

SEQ ID NO: 3252516 - DNA, 19 bp, Homo sapiens
tgaatttttttttcctagc

SEQ ID NO: 3252517 - DNA, 21 bp, Homo sapiens
tgacaaaaaatgttttaaaga

SEQ ID NO: 3252518 - DNA, 21 bp, Homo sapiens
tgacaaagactcctctgggcc

SEQ ID NO: 3252519 - DNA, 22 bp, Homo sapiens
tgacaaagactcctctgggcct

SEQ ID NO: 3252520 - DNA, 14 bp, Homo sapiens
tgacaaaggatgaa

SEQ ID NO: 3252521 - DNA, 15 bp, Homo sapiens
tgacaaaggatgaag

SEQ ID NO: 3252522 - DNA, 15 bp, Homo sapiens
tgacaaatattttca

SEQ ID NO: 3252523 - DNA, 22 bp, Homo sapiens
tgacaaatattttcatgtattt

SEQ ID NO: 3252524 - DNA, 14 bp, Homo sapiens
tgacaaatgtgtat

SEQ ID NO: 3252525 - DNA, 23 bp, Homo sapiens
tgacaaatgtgtatgtgtggttt

SEQ ID NO: 3252526 - DNA, 15 bp, Homo sapiens
tgacaacacttaata

SEQ ID NO: 3252527 - DNA, 17 bp, Homo sapiens
tgacaacagaaaaacaa

SEQ ID NO: 3252528 - DNA, 13 bp, Homo sapiens
tgacaacagaagc

SEQ ID NO: 3252529 - DNA, 16 bp, Homo sapiens
tgacaaccactggtct

SEQ ID NO: 3252530 - DNA, 16 bp, Homo sapiens
tgacaaccattaaagt

SEQ ID NO: 3252531 - DNA, 21 bp, Homo sapiens
tgacaactgtctaactttaga

SEQ ID NO: 3252532 - DNA, 22 bp, Homo sapiens
tgacaactgtctaactttagaa

SEQ ID NO: 3252533 - DNA, 19 bp, Homo sapiens
tgacaactttgccagcttt

SEQ ID NO: 3252534 - DNA, 22 bp, Homo sapiens
tgacaagagcctgatctcttcc

SEQ ID NO: 3252535 - DNA, 21 bp, Homo sapiens
tgacaagagttggggacagaa

SEQ ID NO: 3252536 - DNA, 23 bp, Homo sapiens
tgacaaggattgctactgtccta

SEQ ID NO: 3252537 - DNA, 16 bp, Homo sapiens
tgacaagggctgacct

SEQ ID NO: 3252538 - DNA, 16 bp, Homo sapiens
tgacaagtgaagaaca

SEQ ID NO: 3252539 - DNA, 18 bp, Homo sapiens
tgacaataatattgttgt

SEQ ID NO: 3252540 - DNA, 15 bp, Homo sapiens
tgacaatcaactcta

SEQ ID NO: 3252541 - DNA, 14 bp, Homo sapiens
tgacaatggcagct

SEQ ID NO: 3252542 - DNA, 16 bp, Homo sapiens
tgacaatggcagctag

SEQ ID NO: 3252543 - DNA, 13 bp, Homo sapiens
tgacacaaaggaa

SEQ ID NO: 3252544 - DNA, 17 bp, Homo sapiens
tgacacaagtggacctt

SEQ ID NO: 3252545 - DNA, 19 bp, Homo sapiens
tgacacaagtggaccttag

SEQ ID NO: 3252546 - DNA, 15 bp, Homo sapiens
tgacacacagctctg

SEQ ID NO: 3252547 - DNA, 16 bp, Homo sapiens
tgacacacagctctgt

SEQ ID NO: 3252548 - DNA, 20 bp, Homo sapiens
tgacacacgtatttatattt

SEQ ID NO: 3252549 - DNA, 15 bp, Homo sapiens
tgacacagtcagcat

SEQ ID NO: 3252550 - DNA, 22 bp, Homo sapiens
tgacacatccgccttttgtata

SEQ ID NO: 3252551 - DNA, 22 bp, Homo sapiens
tgacacatggcccctccccctg

SEQ ID NO: 3252552 - DNA, 16 bp, Homo sapiens
tgacacccaccctgtg

SEQ ID NO: 3252553 - DNA, 18 bp, Homo sapiens
tgacaccgtgggtcatta

SEQ ID NO: 3252554 - DNA, 17 bp, Homo sapiens
tgacacctaccatgctg

SEQ ID NO: 3252555 - DNA, 20 bp, Homo sapiens
tgacacctaccatgctgctt

SEQ ID NO: 3252556 - DNA, 17 bp, Homo sapiens
tgacacctcttttttcg

SEQ ID NO: 3252557 - DNA, 15 bp, Homo sapiens
tgacacctgctgaga

SEQ ID NO: 3252558 - DNA, 16 bp, Homo sapiens
tgacacgcgctctcca

SEQ ID NO: 3252559 - DNA, 19 bp, Homo sapiens
tgacacgcgctctccacca

SEQ ID NO: 3252560 - DNA, 19 bp, Homo sapiens
tgacactagcccaatgaaa

SEQ ID NO: 3252561 - DNA, 18 bp, Homo sapiens
tgacactatagtttaaaa

SEQ ID NO: 3252562 - DNA, 15 bp, Homo sapiens
tgacacttcaaggtg

SEQ ID NO: 3252563 - DNA, 24 bp, Homo sapiens
tgacacttcagagagctggtagtt

SEQ ID NO: 3252564 - DNA, 22 bp, Homo sapiens
tgacactttaattaccaacctg

SEQ ID NO: 3252565 - DNA, 20 bp, Homo sapiens
tgacagaaggtgccacttta

SEQ ID NO: 3252566 - DNA, 14 bp, Homo sapiens
tgacagacacaggc

SEQ ID NO: 3252567 - DNA, 17 bp, Homo sapiens
tgacagaccacatcttt

SEQ ID NO: 3252568 - DNA, 18 bp, Homo sapiens
tgacagagcaagactctg

SEQ ID NO: 3252569 - DNA, 22 bp, Homo sapiens
tgacagagtgagactctgtctc

SEQ ID NO: 3252570 - DNA, 19 bp, Homo sapiens
tgacagatggtgaagtaac

SEQ ID NO: 3252571 - DNA, 19 bp, Homo sapiens
tgacaggaaagccctcccc

SEQ ID NO: 3252572 - DNA, 17 bp, Homo sapiens
tgacaggcaatgctggc

SEQ ID NO: 3252573 - DNA, 20 bp, Homo sapiens
tgacaggcaatgctggctgt

SEQ ID NO: 3252574 - DNA, 16 bp, Homo sapiens
tgacagggcacaccgg

SEQ ID NO: 3252575 - DNA, 20 bp, Homo sapiens
tgacagggccagtggggcct

SEQ ID NO: 3252576 - DNA, 22 bp, Homo sapiens
tgacagggccagtggggcctgt

SEQ ID NO: 3252577 - DNA, 17 bp, Homo sapiens
tgacaggtaaattaaga

SEQ ID NO: 3252578 - DNA, 22 bp, Homo sapiens
tgacagtattatacgctggcaa

SEQ ID NO: 3252579 - DNA, 11 bp, Homo sapiens
tgacagtcatc

SEQ ID NO: 3252580 - DNA, 18 bp, Homo sapiens
tgacagtcatcatcaggg

SEQ ID NO: 3252581 - DNA, 23 bp, Homo sapiens
tgacagtcatcatcagggcctgg

SEQ ID NO: 3252582 - DNA, 20 bp, Homo sapiens
tgacagtgcctgggaatgta

SEQ ID NO: 3252583 - DNA, 16 bp, Homo sapiens
tgacagtgttgaaaat

SEQ ID NO: 3252584 - DNA, 19 bp, Homo sapiens
tgacagtgttgaaaatgtt

SEQ ID NO: 3252585 - DNA, 17 bp, Homo sapiens
tgacagtttttctgttt

SEQ ID NO: 3252586 - DNA, 21 bp, Homo sapiens
tgacataacactataaaggtt

SEQ ID NO: 3252587 - DNA, 21 bp, Homo sapiens
tgacataagatggttgaccaa

SEQ ID NO: 3252588 - DNA, 13 bp, Homo sapiens
tgacatacatatt

SEQ ID NO: 3252589 - DNA, 12 bp, Homo sapiens
tgacatattatg

SEQ ID NO: 3252590 - DNA, 17 bp, Homo sapiens
tgacatcacttgtacaa

SEQ ID NO: 3252591 - DNA, 19 bp, Homo sapiens
tgacatcacttgtacaaaa

SEQ ID NO: 3252592 - DNA, 20 bp, Homo sapiens
tgacatcacttgtacaaaat

SEQ ID NO: 3252593 - DNA, 22 bp, Homo sapiens
tgacatcacttgtacaaaataa

SEQ ID NO: 3252594 - DNA, 23 bp, Homo sapiens
tgacatcacttgtacaaaataaa

SEQ ID NO: 3252595 - DNA, 16 bp, Homo sapiens
tgacatccaaatctag

SEQ ID NO: 3252596 - DNA, 18 bp, Homo sapiens
tgacatcccttcctggaa

SEQ ID NO: 3252597 - DNA, 20 bp, Homo sapiens
tgacatcccttcctggaaac

SEQ ID NO: 3252598 - DNA, 21 bp, Homo sapiens
tgacatcccttcctggaaaca

SEQ ID NO: 3252599 - DNA, 15 bp, Homo sapiens
tgacatctcaggggc

SEQ ID NO: 3252600 - DNA, 16 bp, Homo sapiens
tgacatcttcaaagct

SEQ ID NO: 3252601 - DNA, 11 bp, Homo sapiens
tgacatgcact

SEQ ID NO: 3252602 - DNA, 15 bp, Homo sapiens
tgacatgcactgacc

SEQ ID NO: 3252603 - DNA, 12 bp, Homo sapiens
tgacatgcattg

SEQ ID NO: 3252604 - DNA, 16 bp, Homo sapiens
tgacatggaaatgaag

SEQ ID NO: 3252605 - DNA, 15 bp, Homo sapiens
tgacatgggccttta

SEQ ID NO: 3252606 - DNA, 12 bp, Homo sapiens
tgacatgtgaaa

SEQ ID NO: 3252607 - DNA, 17 bp, Homo sapiens
tgacatgtggggccagg

SEQ ID NO: 3252608 - DNA, 18 bp, Homo sapiens
tgacatgtggggccaggt

SEQ ID NO: 3252609 - DNA, 19 bp, Homo sapiens
tgacattaacagttttcca

SEQ ID NO: 3252610 - DNA, 21 bp, Homo sapiens
tgacattaacagttttccatg

SEQ ID NO: 3252611 - DNA, 13 bp, Homo sapiens
tgacattcccctc

SEQ ID NO: 3252612 - DNA, 13 bp, Homo sapiens
tgacattccctgc

SEQ ID NO: 3252613 - DNA, 19 bp, Homo sapiens
tgacattgcgtttgacctt

SEQ ID NO: 3252614 - DNA, 22 bp, Homo sapiens
tgacattgtagagcttctggca

SEQ ID NO: 3252615 - DNA, 20 bp, Homo sapiens
tgacattgttggccaaagcc

SEQ ID NO: 3252616 - DNA, 23 bp, Homo sapiens
tgacatttacaccacactttcaa

SEQ ID NO: 3252617 - DNA, 16 bp, Homo sapiens
tgacatttatatattg

SEQ ID NO: 3252618 - DNA, 18 bp, Homo sapiens
tgacatttatatttgtgt

SEQ ID NO: 3252619 - DNA, 21 bp, Homo sapiens
tgacatttatatttgtgtatt

SEQ ID NO: 3252620 - DNA, 23 bp, Homo sapiens
tgacatttcccaagtcagacaga

SEQ ID NO: 3252621 - DNA, 21 bp, Homo sapiens
tgacatttgggagacatgtga

SEQ ID NO: 3252622 - DNA, 16 bp, Homo sapiens
tgacatttgtagttgg

SEQ ID NO: 3252623 - DNA, 14 bp, Homo sapiens
tgaccaaaccagcc

SEQ ID NO: 3252624 - DNA, 14 bp, Homo sapiens
tgaccaaagtcctt

SEQ ID NO: 3252625 - DNA, 16 bp, Homo sapiens
tgaccaaagtcctttt

SEQ ID NO: 3252626 - DNA, 18 bp, Homo sapiens
tgaccaacaggctgttct

SEQ ID NO: 3252627 - DNA, 18 bp, Homo sapiens
tgaccaactagacattct

SEQ ID NO: 3252628 - DNA, 20 bp, Homo sapiens
tgaccaactagacattctgt

SEQ ID NO: 3252629 - DNA, 22 bp, Homo sapiens
tgaccaactagacattctgtcg

SEQ ID NO: 3252630 - DNA, 15 bp, Homo sapiens
tgaccaactgtgttg

SEQ ID NO: 3252631 - DNA, 18 bp, Homo sapiens
tgaccaactgtgttgtat

SEQ ID NO: 3252632 - DNA, 23 bp, Homo sapiens
tgaccaactgtgttgtattaaca

SEQ ID NO: 3252633 - DNA, 17 bp, Homo sapiens
tgaccaagagagaaaga

SEQ ID NO: 3252634 - DNA, 18 bp, Homo sapiens
tgaccaagagagaaagaa

SEQ ID NO: 3252635 - DNA, 20 bp, Homo sapiens
tgaccaagttataaatcaat

SEQ ID NO: 3252636 - DNA, 18 bp, Homo sapiens
tgaccaatgatggtcacc

SEQ ID NO: 3252637 - DNA, 16 bp, Homo sapiens
tgaccaattgagtaag

SEQ ID NO: 3252638 - DNA, 19 bp, Homo sapiens
tgaccaattgagtaagaac

SEQ ID NO: 3252639 - DNA, 23 bp, Homo sapiens
tgaccaccaccccaacaaaccat

SEQ ID NO: 3252640 - DNA, 15 bp, Homo sapiens
tgaccaccctcccct

SEQ ID NO: 3252641 - DNA, 16 bp, Homo sapiens
tgaccacttattctgt

SEQ ID NO: 3252642 - DNA, 19 bp, Homo sapiens
tgaccagggatgctgggct

SEQ ID NO: 3252643 - DNA, 21 bp, Homo sapiens
tgaccagggatgctgggctgg

SEQ ID NO: 3252644 - DNA, 18 bp, Homo sapiens
tgaccatcatttcccagg

SEQ ID NO: 3252645 - DNA, 19 bp, Homo sapiens
tgaccatcatttcccaggc

SEQ ID NO: 3252646 - DNA, 19 bp, Homo sapiens
tgaccatccactctaccct

SEQ ID NO: 3252647 - DNA, 12 bp, Homo sapiens
tgaccatgctca

SEQ ID NO: 3252648 - DNA, 18 bp, Homo sapiens
tgaccatgctcatctgct

SEQ ID NO: 3252649 - DNA, 18 bp, Homo sapiens
tgacccacccctgtgctc

SEQ ID NO: 3252650 - DNA, 22 bp, Homo sapiens
tgacccactggttccttcttcc

SEQ ID NO: 3252651 - DNA, 21 bp, Homo sapiens
tgacccagacccaactcgcct

SEQ ID NO: 3252652 - DNA, 18 bp, Homo sapiens
tgacccagagtggagtct

SEQ ID NO: 3252653 - DNA, 18 bp, Homo sapiens
tgacccagcatctcccag

SEQ ID NO: 3252654 - DNA, 19 bp, Homo sapiens
tgacccaggccgcagctct

SEQ ID NO: 3252655 - DNA, 15 bp, Homo sapiens
tgacccatctgtagt

SEQ ID NO: 3252656 - DNA, 21 bp, Homo sapiens
tgaccccaaacaccttccagc

SEQ ID NO: 3252657 - DNA, 18 bp, Homo sapiens
tgaccccacgatttgtct

SEQ ID NO: 3252658 - DNA, 15 bp, Homo sapiens
tgacccctcctcact

SEQ ID NO: 3252659 - DNA, 22 bp, Homo sapiens
tgacccctcctcactggccatc

SEQ ID NO: 3252660 - DNA, 22 bp, Homo sapiens
tgacccggctgggtcggccctg

SEQ ID NO: 3252661 - DNA, 16 bp, Homo sapiens
tgaccctactcccttg

SEQ ID NO: 3252662 - DNA, 17 bp, Homo sapiens
tgaccctactcccttgc

SEQ ID NO: 3252663 - DNA, 18 bp, Homo sapiens
tgaccctagctctttcct

SEQ ID NO: 3252664 - DNA, 12 bp, Homo sapiens
tgacccttcagg

SEQ ID NO: 3252665 - DNA, 13 bp, Homo sapiens
tgacccttcaggg

SEQ ID NO: 3252666 - DNA, 20 bp, Homo sapiens
tgacccttctacatttgagg

SEQ ID NO: 3252667 - DNA, 21 bp, Homo sapiens
tgaccgcacgttctctgcccc

SEQ ID NO: 3252668 - DNA, 19 bp, Homo sapiens
tgaccgcgactaatttcaa

SEQ ID NO: 3252669 - DNA, 19 bp, Homo sapiens
tgaccggacttttctgcaa

SEQ ID NO: 3252670 - DNA, 19 bp, Homo sapiens
tgacctaggcaagtttgtt

SEQ ID NO: 3252671 - DNA, 13 bp, Homo sapiens
tgacctattcacc

SEQ ID NO: 3252672 - DNA, 15 bp, Homo sapiens
tgacctcacagtgac

SEQ ID NO: 3252673 - DNA, 18 bp, Homo sapiens
tgacctcacagtgaccct

SEQ ID NO: 3252674 - DNA, 13 bp, Homo sapiens
tgacctccctcta

SEQ ID NO: 3252675 - DNA, 18 bp, Homo sapiens
tgacctccgcccctgccc

SEQ ID NO: 3252676 - DNA, 23 bp, Homo sapiens
tgacctccgcccctgcccccgct

SEQ ID NO: 3252677 - DNA, 18 bp, Homo sapiens
tgacctcgtgatccaccc

SEQ ID NO: 3252678 - DNA, 18 bp, Homo sapiens
tgacctcgtgatccgcct

SEQ ID NO: 3252679 - DNA, 16 bp, Homo sapiens
tgacctctcagggcct

SEQ ID NO: 3252680 - DNA, 23 bp, Homo sapiens
tgacctctcagggcctggcaggc

SEQ ID NO: 3252681 - DNA, 21 bp, Homo sapiens
tgacctctctaggtgtgtcca

SEQ ID NO: 3252682 - DNA, 17 bp, Homo sapiens
tgacctctgtcctccct

SEQ ID NO: 3252683 - DNA, 12 bp, Homo sapiens
tgacctcttgct

SEQ ID NO: 3252684 - DNA, 17 bp, Homo sapiens
tgacctcttgctgtctc

SEQ ID NO: 3252685 - DNA, 23 bp, Homo sapiens
tgacctcttgctgtctctgctcg

SEQ ID NO: 3252686 - DNA, 17 bp, Homo sapiens
tgacctgaggagacatc

SEQ ID NO: 3252687 - DNA, 12 bp, Homo sapiens
tgacctgaggct

SEQ ID NO: 3252688 - DNA, 18 bp, Homo sapiens
tgacctgctccgctgctc

SEQ ID NO: 3252689 - DNA, 19 bp, Homo sapiens
tgacctgctccgctgctcc

SEQ ID NO: 3252690 - DNA, 23 bp, Homo sapiens
tgacctgctccgctgctccttgg

SEQ ID NO: 3252691 - DNA, 14 bp, Homo sapiens
tctgtccttcagat

SEQ ID NO: 3252692 - DNA, 19 bp, Homo sapiens
tctgtccttttggcactga

SEQ ID NO: 3252693 - DNA, 21 bp, Homo sapiens
tctgtccttttggcactgaga

SEQ ID NO: 3252694 - DNA, 17 bp, Homo sapiens
tctgtcgcccagtctgg

SEQ ID NO: 3252695 - DNA, 18 bp, Homo sapiens
tctgtcgccttagcatgt

SEQ ID NO: 3252696 - DNA, 22 bp, Homo sapiens
tctgtcgccttagcatgtttgc

SEQ ID NO: 3252697 - DNA, 14 bp, Homo sapiens
tctgtctacatttc

SEQ ID NO: 3252698 - DNA, 15 bp, Homo sapiens
tctgtctacatttct

SEQ ID NO: 3252699 - DNA, 19 bp, Homo sapiens
tctgtctcagacttttgta

SEQ ID NO: 3252700 - DNA, 18 bp, Homo sapiens
tctgtctcatcctcctgg

SEQ ID NO: 3252701 - DNA, 22 bp, Homo sapiens
tctgtcttaaatgagaagtact

SEQ ID NO: 3252702 - DNA, 15 bp, Homo sapiens
tctgtcttcacagct

SEQ ID NO: 3252703 - DNA, 14 bp, Homo sapiens
tctgtgaaatataa

SEQ ID NO: 3252704 - DNA, 20 bp, Homo sapiens
tctgtgaagaggaacagtgt

SEQ ID NO: 3252705 - DNA, 13 bp, Homo sapiens
tctgtgaatacaa

SEQ ID NO: 3252706 - DNA, 16 bp, Homo sapiens
tctgtgaatacaatta

SEQ ID NO: 3252707 - DNA, 22 bp, Homo sapiens
tctgtgaattaaaaaagctcaa

SEQ ID NO: 3252708 - DNA, 20 bp, Homo sapiens
tctgtgaccaaaataccttg

SEQ ID NO: 3252709 - DNA, 16 bp, Homo sapiens
tctgtgacccatctgt

SEQ ID NO: 3252710 - DNA, 16 bp, Homo sapiens
tctgtgacctcaggca

SEQ ID NO: 3252711 - DNA, 22 bp, Homo sapiens
tctgtgagatgctagaactccc

SEQ ID NO: 3252712 - DNA, 21 bp, Homo sapiens
tctgtgagggtgctgactggc

SEQ ID NO: 3252713 - DNA, 19 bp, Homo sapiens
tctgtgagtgcgtctgagg

SEQ ID NO: 3252714 - DNA, 22 bp, Homo sapiens
tctgtgatcaccctctcggcct

SEQ ID NO: 3252715 - DNA, 16 bp, Homo sapiens
tctgtgatgatcctca

SEQ ID NO: 3252716 - DNA, 22 bp, Homo sapiens
tctgtgccagaaacagtgggag

SEQ ID NO: 3252717 - DNA, 15 bp, Homo sapiens
tctgtgccatggatt

SEQ ID NO: 3252718 - DNA, 16 bp, Homo sapiens
tctgtgccatggattt

SEQ ID NO: 3252719 - DNA, 15 bp, Homo sapiens
tctgtgccccatgcc

SEQ ID NO: 3252720 - DNA, 17 bp, Homo sapiens
tctgtgccctccaaaga

SEQ ID NO: 3252721 - DNA, 18 bp, Homo sapiens
tctgtgccttcttttgat

SEQ ID NO: 3252722 - DNA, 22 bp, Homo sapiens
tctgtgccttcttttgattatg

SEQ ID NO: 3252723 - DNA, 12 bp, Homo sapiens
tctgtgctgtgt

SEQ ID NO: 3252724 - DNA, 12 bp, Homo sapiens
tctgtgcttgga

SEQ ID NO: 3252725 - DNA, 17 bp, Homo sapiens
tctgtggagctgccaca

SEQ ID NO: 3252726 - DNA, 22 bp, Homo sapiens
tctgtggcctgtgtccagcagc

SEQ ID NO: 3252727 - DNA, 15 bp, Homo sapiens
tctgtgggcccctca

SEQ ID NO: 3252728 - DNA, 17 bp, Homo sapiens
tctgtgggcccctcaac

SEQ ID NO: 3252729 - DNA, 18 bp, Homo sapiens
tctgtgggcccctcaaca

SEQ ID NO: 3252730 - DNA, 20 bp, Homo sapiens
tctgtgggctacatgctggg

SEQ ID NO: 3252731 - DNA, 22 bp, Homo sapiens
tctgtgggtccgataatatctt

SEQ ID NO: 3252732 - DNA, 14 bp, Homo sapiens
tctgtgtaaacaga

SEQ ID NO: 3252733 - DNA, 18 bp, Homo sapiens
tctgtgtaagaaaacaaa

SEQ ID NO: 3252734 - DNA, 13 bp, Homo sapiens
tctgtgtacattt

SEQ ID NO: 3252735 - DNA, 13 bp, Homo sapiens
tctgtgtatatct

SEQ ID NO: 3252736 - DNA, 14 bp, Homo sapiens
tctgtgtatattat

SEQ ID NO: 3252737 - DNA, 17 bp, Homo sapiens
tctgtgtcaggtggggc

SEQ ID NO: 3252738 - DNA, 20 bp, Homo sapiens
tctgtgtcaggtggggcagc

SEQ ID NO: 3252739 - DNA, 17 bp, Homo sapiens
tctgtgtccttccctgc

SEQ ID NO: 3252740 - DNA, 22 bp, Homo sapiens
tctgtgtctaagattctagatc

SEQ ID NO: 3252741 - DNA, 12 bp, Homo sapiens
tctgtgtctctt

SEQ ID NO: 3252742 - DNA, 21 bp, Homo sapiens
tctgtgtctttcacagctcct

SEQ ID NO: 3252743 - DNA, 14 bp, Homo sapiens
tctgtgtgaatgtg

SEQ ID NO: 3252744 - DNA, 15 bp, Homo sapiens
tctgtgtgaatgtgg

SEQ ID NO: 3252745 - DNA, 22 bp, Homo sapiens
tctgtgtgaatgtgggcactgg

SEQ ID NO: 3252746 - DNA, 18 bp, Homo sapiens
tctgtgtgatgaactttc

SEQ ID NO: 3252747 - DNA, 18 bp, Homo sapiens
tctgtgtgcaccttacca

SEQ ID NO: 3252748 - DNA, 22 bp, Homo sapiens
tctgtgtgcaccttaccaactt

SEQ ID NO: 3252749 - DNA, 19 bp, Homo sapiens
tctgtgtggcaaattaaac

SEQ ID NO: 3252750 - DNA, 20 bp, Homo sapiens
tctgtgtgggactgtacaca

SEQ ID NO: 3252751 - DNA, 21 bp, Homo sapiens
tctgtgtgtatattgagaatc

SEQ ID NO: 3252752 - DNA, 15 bp, Homo sapiens
tctgtgtgtgttctt

SEQ ID NO: 3252753 - DNA, 15 bp, Homo sapiens
tctgtgttcccagag

SEQ ID NO: 3252754 - DNA, 21 bp, Homo sapiens
tctgtgttcccagaggcaggc

SEQ ID NO: 3252755 - DNA, 16 bp, Homo sapiens
tctgtgtttttgaaat

SEQ ID NO: 3252756 - DNA, 17 bp, Homo sapiens
tctgttaaggttgaact

SEQ ID NO: 3252757 - DNA, 17 bp, Homo sapiens
tctgttatgctgtgaca

SEQ ID NO: 3252758 - DNA, 21 bp, Homo sapiens
tctgttatgggcttttgggga

SEQ ID NO: 3252759 - DNA, 14 bp, Homo sapiens
tctgttatgtactg

SEQ ID NO: 3252760 - DNA, 22 bp, Homo sapiens
tctgttatgtactgtactaatt

SEQ ID NO: 3252761 - DNA, 18 bp, Homo sapiens
tctgttatttagactcat

SEQ ID NO: 3252762 - DNA, 22 bp, Homo sapiens
tctgttcacttttcctccctca

SEQ ID NO: 3252763 - DNA, 17 bp, Homo sapiens
tctgttcagatgtgcat

SEQ ID NO: 3252764 - DNA, 19 bp, Homo sapiens
tctgttccaaattcagttt

SEQ ID NO: 3252765 - DNA, 23 bp, Homo sapiens
tctgttccacacccaatgctgct

SEQ ID NO: 3252766 - DNA, 18 bp, Homo sapiens
tctgttcccccaccctcc

SEQ ID NO: 3252767 - DNA, 13 bp, Homo sapiens
tctgttctggggg

SEQ ID NO: 3252768 - DNA, 12 bp, Homo sapiens
tctgttgaagtt

SEQ ID NO: 3252769 - DNA, 18 bp, Homo sapiens
tctgttgccacaaccctg

SEQ ID NO: 3252770 - DNA, 12 bp, Homo sapiens
tctgttggccag

SEQ ID NO: 3252771 - DNA, 17 bp, Homo sapiens
tctgttggccagtgtga

SEQ ID NO: 3252772 - DNA, 13 bp, Homo sapiens
tctgttgtaactt

SEQ ID NO: 3252773 - DNA, 15 bp, Homo sapiens
tctgttgtaacttat

SEQ ID NO: 3252774 - DNA, 15 bp, Homo sapiens
tctgttgtaagaata

SEQ ID NO: 3252775 - DNA, 18 bp, Homo sapiens
tctgtttaaaatttgtgc

SEQ ID NO: 3252776 - DNA, 14 bp, Homo sapiens
tctgtttagaacac

SEQ ID NO: 3252777 - DNA, 15 bp, Homo sapiens
tctgtttaggaagaa

SEQ ID NO: 3252778 - DNA, 12 bp, Homo sapiens
tctgtttcaagg

SEQ ID NO: 3252779 - DNA, 23 bp, Homo sapiens
tctgtttcaaggcactctagatt

SEQ ID NO: 3252780 - DNA, 11 bp, Homo sapiens
tctgattccac

SEQ ID NO: 3252781 - DNA, 13 bp, Homo sapiens
tctgattccactt

SEQ ID NO: 3252782 - DNA, 18 bp, Homo sapiens
tctgattcccaagctctg

SEQ ID NO: 3252783 - DNA, 23 bp, Homo sapiens
tctgattcccaagctctgctcct

SEQ ID NO: 3252784 - DNA, 23 bp, Homo sapiens
tctgattctggctttaagccttc

SEQ ID NO: 3252785 - DNA, 15 bp, Homo sapiens
tctgattggacattt

SEQ ID NO: 3252786 - DNA, 20 bp, Homo sapiens
tctgattggacattttcttc

SEQ ID NO: 3252787 - DNA, 23 bp, Homo sapiens
tctgattggacattttcttcaga

SEQ ID NO: 3252788 - DNA, 21 bp, Homo sapiens
tctgattggcttgtagaattg

SEQ ID NO: 3252789 - DNA, 23 bp, Homo sapiens
tctgattggcttgtagaattgtt

SEQ ID NO: 3252790 - DNA, 14 bp, Homo sapiens
tctgatttcagttt

SEQ ID NO: 3252791 - DNA, 21 bp, Homo sapiens
tctgatttcagtttttcattt

SEQ ID NO: 3252792 - DNA, 22 bp, Homo sapiens
tctgatttcagtttttcatttg

SEQ ID NO: 3252793 - DNA, 17 bp, Homo sapiens
tctgatttttaaagtac

SEQ ID NO: 3252794 - DNA, 14 bp, Homo sapiens
tctgatttttatga

SEQ ID NO: 3252795 - DNA, 14 bp, Homo sapiens
tctgcaaaaatatt

SEQ ID NO: 3252796 - DNA, 19 bp, Homo sapiens
tctgcaaacaatgaagaat

SEQ ID NO: 3252797 - DNA, 18 bp, Homo sapiens
tctgcaaaggcctgggct

SEQ ID NO: 3252798 - DNA, 19 bp, Homo sapiens
tctgcaaaggtggcaatgc

SEQ ID NO: 3252799 - DNA, 16 bp, Homo sapiens
tctgcaacaagcatgc

SEQ ID NO: 3252800 - DNA, 22 bp, Homo sapiens
tctgcaagtatactagggagcc

SEQ ID NO: 3252801 - DNA, 23 bp, Homo sapiens
tctgcaagtatactagggagcca

SEQ ID NO: 3252802 - DNA, 12 bp, Homo sapiens
tctgcaagtcag

SEQ ID NO: 3252803 - DNA, 13 bp, Homo sapiens
tctgcaagtcaga

SEQ ID NO: 3252804 - DNA, 23 bp, Homo sapiens
tctgcaagtcagaggatggccag

SEQ ID NO: 3252805 - DNA, 18 bp, Homo sapiens
tctgcaagtgtctggagc

SEQ ID NO: 3252806 - DNA, 11 bp, Homo sapiens
tctgcaatgct

SEQ ID NO: 3252807 - DNA, 16 bp, Homo sapiens
tctgcaatgggcactg

SEQ ID NO: 3252808 - DNA, 14 bp, Homo sapiens
tctgcaattcaaaa

SEQ ID NO: 3252809 - DNA, 21 bp, Homo sapiens
tctgcaattcaaaagttccaa

SEQ ID NO: 3252810 - DNA, 18 bp, Homo sapiens
tctgcaattcccctctgc

SEQ ID NO: 3252811 - DNA, 23 bp, Homo sapiens
tctgcacacacctccgagacagt

SEQ ID NO: 3252812 - DNA, 13 bp, Homo sapiens
tctgcacagatgg

SEQ ID NO: 3252813 - DNA, 23 bp, Homo sapiens
tctgcacatgaatcccacccaca

SEQ ID NO: 3252814 - DNA, 12 bp, Homo sapiens
tctgcacatgtc

SEQ ID NO: 3252815 - DNA, 18 bp, Homo sapiens
tctgcaccccttctctcc

SEQ ID NO: 3252816 - DNA, 22 bp, Homo sapiens
tctgcaccccttctctcctccc

SEQ ID NO: 3252817 - DNA, 16 bp, Homo sapiens
tctgcaccctccaccc

SEQ ID NO: 3252818 - DNA, 20 bp, Homo sapiens
tctgcactactcctctgcag

SEQ ID NO: 3252819 - DNA, 21 bp, Homo sapiens
tctgcactactcctctgcagt

SEQ ID NO: 3252820 - DNA, 23 bp, Homo sapiens
tctgcactctccaccctggctgg

SEQ ID NO: 3252821 - DNA, 12 bp, Homo sapiens
tctgcactgaaa

SEQ ID NO: 3252822 - DNA, 15 bp, Homo sapiens
tctgcagaacagtga

SEQ ID NO: 3252823 - DNA, 20 bp, Homo sapiens
tctgcagaacatatcaaaat

SEQ ID NO: 3252824 - DNA, 16 bp, Homo sapiens
tctgcagacttcccag

SEQ ID NO: 3252825 - DNA, 18 bp, Homo sapiens
tctgcagacttcccagct

SEQ ID NO: 3252826 - DNA, 12 bp, Homo sapiens
tctgcagagcag

SEQ ID NO: 3252827 - DNA, 16 bp, Homo sapiens
tctgcagcatgacctg

SEQ ID NO: 3252828 - DNA, 20 bp, Homo sapiens
tctgcagcatgacctgtgac

SEQ ID NO: 3252829 - DNA, 23 bp, Homo sapiens
tctgcagcccggcgccaccatcc

SEQ ID NO: 3252830 - DNA, 20 bp, Homo sapiens
tctgcagcccttgggcagtt

SEQ ID NO: 3252831 - DNA, 21 bp, Homo sapiens
tctgcagcccttgggcagttc

SEQ ID NO: 3252832 - DNA, 19 bp, Homo sapiens
tctgcagggggtgtgtctg

SEQ ID NO: 3252833 - DNA, 18 bp, Homo sapiens
tctgcagtaaaacacatt

SEQ ID NO: 3252834 - DNA, 15 bp, Homo sapiens
tctgcagtaaatctt

SEQ ID NO: 3252835 - DNA, 16 bp, Homo sapiens
tctgcagtaaatcttt

SEQ ID NO: 3252836 - DNA, 15 bp, Homo sapiens
tctgcagtgccttgg

SEQ ID NO: 3252837 - DNA, 20 bp, Homo sapiens
tctgcagttctttttgtaca

SEQ ID NO: 3252838 - DNA, 18 bp, Homo sapiens
tctgcatcccagcacctg

SEQ ID NO: 3252839 - DNA, 18 bp, Homo sapiens
tctgcatctcctgtcttt

SEQ ID NO: 3252840 - DNA, 18 bp, Homo sapiens
tctgcatctgactctctt

SEQ ID NO: 3252841 - DNA, 13 bp, Homo sapiens
tctgcattcctga

SEQ ID NO: 3252842 - DNA, 14 bp, Homo sapiens
tctgcattcctgat

SEQ ID NO: 3252843 - DNA, 16 bp, Homo sapiens
tctgcattctagtact

SEQ ID NO: 3252844 - DNA, 21 bp, Homo sapiens
tctgcattgttattgtggaag

SEQ ID NO: 3252845 - DNA, 10 bp, Homo sapiens
tctgcattta

SEQ ID NO: 3252846 - DNA, 13 bp, Homo sapiens
tctgcatttagca

SEQ ID NO: 3252847 - DNA, 15 bp, Homo sapiens
tctgcatttagcaca

SEQ ID NO: 3252848 - DNA, 17 bp, Homo sapiens
tctgcattttcacccca

SEQ ID NO: 3252849 - DNA, 17 bp, Homo sapiens
tctggaaggctggctga

SEQ ID NO: 3252850 - DNA, 16 bp, Homo sapiens
tctggaagtttctggt

SEQ ID NO: 3252851 - DNA, 19 bp, Homo sapiens
tctggaataaagttgcaga

SEQ ID NO: 3252852 - DNA, 15 bp, Homo sapiens
tctggaatgcagtgg

SEQ ID NO: 3252853 - DNA, 18 bp, Homo sapiens
tctggaatgtaatcaatg

SEQ ID NO: 3252854 - DNA, 23 bp, Homo sapiens
tctggacaagccaacttgtaaat

SEQ ID NO: 3252855 - DNA, 17 bp, Homo sapiens
tctggacccctgggcct

SEQ ID NO: 3252856 - DNA, 14 bp, Homo sapiens
tctggacggcaggc

SEQ ID NO: 3252857 - DNA, 17 bp, Homo sapiens
tctggacggcaggctca

SEQ ID NO: 3252858 - DNA, 13 bp, Homo sapiens
tctggactgaagc

SEQ ID NO: 3252859 - DNA, 17 bp, Homo sapiens
tctggactgaagcctgc

SEQ ID NO: 3252860 - DNA, 19 bp, Homo sapiens
tctggactgaagcctgcag

SEQ ID NO: 3252861 - DNA, 19 bp, Homo sapiens
tctggactgccccagaaaa

SEQ ID NO: 3252862 - DNA, 15 bp, Homo sapiens
tctggactggctaga

SEQ ID NO: 3252863 - DNA, 16 bp, Homo sapiens
tctggagacagcccca

SEQ ID NO: 3252864 - DNA, 18 bp, Homo sapiens
tctggagacagccccaga

SEQ ID NO: 3252865 - DNA, 22 bp, Homo sapiens
tctggagacagccccagagcag

SEQ ID NO: 3252866 - DNA, 24 bp, Homo sapiens
tctggagacagccccagagcaggg

SEQ ID NO: 3252867 - DNA, 15 bp, Homo sapiens
tctggagaccaggga

SEQ ID NO: 3252868 - DNA, 19 bp, Homo sapiens
tctggagaccagggagcct

SEQ ID NO: 3252869 - DNA, 12 bp, Homo sapiens
tctggagagaaa

SEQ ID NO: 3252870 - DNA, 16 bp, Homo sapiens
tctggagccctaaccc

SEQ ID NO: 3252871 - DNA, 21 bp, Homo sapiens
tctggagctggcactgtggag

SEQ ID NO: 3252872 - DNA, 19 bp, Homo sapiens
tctggaggaaagggaggag

SEQ ID NO: 3252873 - DNA, 19 bp, Homo sapiens
tctggaggcctctggccct

SEQ ID NO: 3252874 - DNA, 17 bp, Homo sapiens
tctggaggctgcagagc

SEQ ID NO: 3252875 - DNA, 17 bp, Homo sapiens
tctggaggggcccctgc

SEQ ID NO: 3252876 - DNA, 13 bp, Homo sapiens
tctggagtgggca

SEQ ID NO: 3252877 - DNA, 20 bp, Homo sapiens
tctggagtggtaacagctct

SEQ ID NO: 3252878 - DNA, 23 bp, Homo sapiens
tctggatatttgcacttatgtac

SEQ ID NO: 3252879 - DNA, 16 bp, Homo sapiens
tctggcaacatcttta

SEQ ID NO: 3252880 - DNA, 23 bp, Homo sapiens
tctggcagggatgggtttgcttt

SEQ ID NO: 3252881 - DNA, 14 bp, Homo sapiens
tctggccctgtgta

SEQ ID NO: 3252882 - DNA, 10 bp, Homo sapiens
tctggccctt

SEQ ID NO: 3252883 - DNA, 22 bp, Homo sapiens
tctggcccttgcctttgtggcc

SEQ ID NO: 3252884 - DNA, 17 bp, Homo sapiens
tctggcccttggaataa

SEQ ID NO: 3252885 - DNA, 18 bp, Homo sapiens
tctggcccttggaataaa

SEQ ID NO: 3252886 - DNA, 13 bp, Homo sapiens
tctggcctcccac

SEQ ID NO: 3252887 - DNA, 16 bp, Homo sapiens
tctggcctcccacccg

SEQ ID NO: 3252888 - DNA, 18 bp, Homo sapiens
tctggcctggcctggccc

SEQ ID NO: 3252889 - DNA, 17 bp, Homo sapiens
tctggccttcggcctcc

SEQ ID NO: 3252890 - DNA, 21 bp, Homo sapiens
tctggcggcttcctgtccact

SEQ ID NO: 3252891 - DNA, 21 bp, Homo sapiens
tctggctagaggccagcccca

SEQ ID NO: 3252892 - DNA, 10 bp, Homo sapiens
tctggctcca

SEQ ID NO: 3252893 - DNA, 12 bp, Homo sapiens
tctggctctaat

SEQ ID NO: 3252894 - DNA, 22 bp, Homo sapiens
tctggctctaattcacagtgct

SEQ ID NO: 3252895 - DNA, 13 bp, Homo sapiens
tctggctgaaccc

SEQ ID NO: 3252896 - DNA, 16 bp, Homo sapiens
tctggcttagtgccac

SEQ ID NO: 3252897 - DNA, 12 bp, Homo sapiens
tctcctgtgaat

SEQ ID NO: 3252898 - DNA, 15 bp, Homo sapiens
tctcctgtgcccaca

SEQ ID NO: 3252899 - DNA, 16 bp, Homo sapiens
tctcctgtgcccacat

SEQ ID NO: 3252900 - DNA, 19 bp, Homo sapiens
tctcctgtttattcccatc

SEQ ID NO: 3252901 - DNA, 20 bp, Homo sapiens
tctcctgtttattcccatct

SEQ ID NO: 3252902 - DNA, 17 bp, Homo sapiens
tctcctgttttatatat

SEQ ID NO: 3252903 - DNA, 21 bp, Homo sapiens
tctcctgttttatatattatg

SEQ ID NO: 3252904 - DNA, 14 bp, Homo sapiens
tctcctgtttttct

SEQ ID NO: 3252905 - DNA, 19 bp, Homo sapiens
tctcctgtttttctgggtg

SEQ ID NO: 3252906 - DNA, 16 bp, Homo sapiens
tctccttactctgagc

SEQ ID NO: 3252907 - DNA, 22 bp, Homo sapiens
tctccttactctgagcccaggc

SEQ ID NO: 3252908 - DNA, 22 bp, Homo sapiens
tctccttccacaatgactgctt

SEQ ID NO: 3252909 - DNA, 14 bp, Homo sapiens
tctccttccccagg

SEQ ID NO: 3252910 - DNA, 15 bp, Homo sapiens
tctccttccccagga

SEQ ID NO: 3252911 - DNA, 16 bp, Homo sapiens
tctccttccccaggat

SEQ ID NO: 3252912 - DNA, 16 bp, Homo sapiens
tctccttcctgtgtgt

SEQ ID NO: 3252913 - DNA, 19 bp, Homo sapiens
tctccttcgtgtctctccc

SEQ ID NO: 3252914 - DNA, 20 bp, Homo sapiens
tctccttcgtgtctctccca

SEQ ID NO: 3252915 - DNA, 13 bp, Homo sapiens
tctccttctcctt

SEQ ID NO: 3252916 - DNA, 20 bp, Homo sapiens
tctccttgggctcctggctg

SEQ ID NO: 3252917 - DNA, 21 bp, Homo sapiens
tctccttgggctcctggctgc

SEQ ID NO: 3252918 - DNA, 16 bp, Homo sapiens
tctcctttcacaacct

SEQ ID NO: 3252919 - DNA, 20 bp, Homo sapiens
tctcctttctttttcttctt

SEQ ID NO: 3252920 - DNA, 13 bp, Homo sapiens
tctcctttgcaat

SEQ ID NO: 3252921 - DNA, 19 bp, Homo sapiens
tctcctttgcactgagggc

SEQ ID NO: 3252922 - DNA, 12 bp, Homo sapiens
tctcctttgctc

SEQ ID NO: 3252923 - DNA, 22 bp, Homo sapiens
tctccttttatctggtgcctcc

SEQ ID NO: 3252924 - DNA, 20 bp, Homo sapiens
tctccttttcttttgttact

SEQ ID NO: 3252925 - DNA, 22 bp, Homo sapiens
tctcgaccttctggtatcttgt

SEQ ID NO: 3252926 - DNA, 14 bp, Homo sapiens
tctcgattttatct

SEQ ID NO: 3252927 - DNA, 16 bp, Homo sapiens
tctcgcataggacctt

SEQ ID NO: 3252928 - DNA, 23 bp, Homo sapiens
tctcgcataggacctttccacca

SEQ ID NO: 3252929 - DNA, 13 bp, Homo sapiens
tctcgctgtcact

SEQ ID NO: 3252930 - DNA, 20 bp, Homo sapiens
tctcggagcatcccggagga

SEQ ID NO: 3252931 - DNA, 12 bp, Homo sapiens
tctcggctcagg

SEQ ID NO: 3252932 - DNA, 14 bp, Homo sapiens
tctcggggcccttg

SEQ ID NO: 3252933 - DNA, 22 bp, Homo sapiens
tctcggggcccttggggcctgg

SEQ ID NO: 3252934 - DNA, 18 bp, Homo sapiens
tctcgtgggagagccatc

SEQ ID NO: 3252935 - DNA, 18 bp, Homo sapiens
tctcgtgtacagctccct

SEQ ID NO: 3252936 - DNA, 16 bp, Homo sapiens
tctctaaactggtaca

SEQ ID NO: 3252937 - DNA, 13 bp, Homo sapiens
tctctaaagcact

SEQ ID NO: 3252938 - DNA, 16 bp, Homo sapiens
tctctaactcctgcca

SEQ ID NO: 3252939 - DNA, 13 bp, Homo sapiens
tctctaacttatt

SEQ ID NO: 3252940 - DNA, 17 bp, Homo sapiens
tctctaacttctcaagt

SEQ ID NO: 3252941 - DNA, 17 bp, Homo sapiens
tctctaaggtttacaat

SEQ ID NO: 3252942 - DNA, 17 bp, Homo sapiens
tctctaagtgtaaaagt

SEQ ID NO: 3252943 - DNA, 17 bp, Homo sapiens
tctctaatgcttgattt

SEQ ID NO: 3252944 - DNA, 19 bp, Homo sapiens
tctctaattttggataata

SEQ ID NO: 3252945 - DNA, 17 bp, Homo sapiens
tctctacaaaaaataaa

SEQ ID NO: 3252946 - DNA, 20 bp, Homo sapiens
tctctacagacttctccaga

SEQ ID NO: 3252947 - DNA, 19 bp, Homo sapiens
tctctactaccacaaggaa

SEQ ID NO: 3252948 - DNA, 20 bp, Homo sapiens
tctctactaccacaaggaaa

SEQ ID NO: 3252949 - DNA, 19 bp, Homo sapiens
tctctactcctacctcagc

SEQ ID NO: 3252950 - DNA, 15 bp, Homo sapiens
tctctagaaccttct

SEQ ID NO: 3252951 - DNA, 23 bp, Homo sapiens
tctctagctggtggtttcacggt

SEQ ID NO: 3252952 - DNA, 17 bp, Homo sapiens
tctctattggaggtgag

SEQ ID NO: 3252953 - DNA, 17 bp, Homo sapiens
tctctatttaatattta

SEQ ID NO: 3252954 - DNA, 18 bp, Homo sapiens
tctctatttgaattattt

SEQ ID NO: 3252955 - DNA, 13 bp, Homo sapiens
tctctatttgaga

SEQ ID NO: 3252956 - DNA, 16 bp, Homo sapiens
tctctcaatatgctta

SEQ ID NO: 3252957 - DNA, 18 bp, Homo sapiens
tctctcagagcatctggc

SEQ ID NO: 3252958 - DNA, 17 bp, Homo sapiens
tctctcagccttacatt

SEQ ID NO: 3252959 - DNA, 13 bp, Homo sapiens
tctctcaggagca

SEQ ID NO: 3252960 - DNA, 19 bp, Homo sapiens
tctctcaggagcacaggca

SEQ ID NO: 3252961 - DNA, 17 bp, Homo sapiens
tctctcaggagtatctt

SEQ ID NO: 3252962 - DNA, 16 bp, Homo sapiens
tctctccagatgtttc

SEQ ID NO: 3252963 - DNA, 15 bp, Homo sapiens
tctctccagctgact

SEQ ID NO: 3252964 - DNA, 22 bp, Homo sapiens
tctctcccaccccggcctccac

SEQ ID NO: 3252965 - DNA, 22 bp, Homo sapiens
tctgaacacagtttagtgcttt

SEQ ID NO: 3252966 - DNA, 15 bp, Homo sapiens
tctgaactagttgag

SEQ ID NO: 3252967 - DNA, 12 bp, Homo sapiens
tctgaactcaaa

SEQ ID NO: 3252968 - DNA, 16 bp, Homo sapiens
tctgaactcaaactga

SEQ ID NO: 3252969 - DNA, 14 bp, Homo sapiens
tctgaactgttaca

SEQ ID NO: 3252970 - DNA, 18 bp, Homo sapiens
tctgaactgttacaactt

SEQ ID NO: 3252971 - DNA, 19 bp, Homo sapiens
tctgaacttgcattgtgat

SEQ ID NO: 3252972 - DNA, 17 bp, Homo sapiens
tctgaactttggagagt

SEQ ID NO: 3252973 - DNA, 19 bp, Homo sapiens
tctgaagactgagaacttt

SEQ ID NO: 3252974 - DNA, 19 bp, Homo sapiens
tctgaagaggcttctcctg

SEQ ID NO: 3252975 - DNA, 20 bp, Homo sapiens
tctgaagaggcttctcctgt

SEQ ID NO: 3252976 - DNA, 13 bp, Homo sapiens
tctgaagatcaga

SEQ ID NO: 3252977 - DNA, 15 bp, Homo sapiens
tctgaagcatgtttc

SEQ ID NO: 3252978 - DNA, 20 bp, Homo sapiens
tctgaagcttcactcactgt

SEQ ID NO: 3252979 - DNA, 14 bp, Homo sapiens
tctgaagcttgact

SEQ ID NO: 3252980 - DNA, 18 bp, Homo sapiens
tctgaagcttgactccca

SEQ ID NO: 3252981 - DNA, 22 bp, Homo sapiens
tctgaagcttgactcccaagtt

SEQ ID NO: 3252982 - DNA, 21 bp, Homo sapiens
tctgaaggaatagccagagag

SEQ ID NO: 3252983 - DNA, 21 bp, Homo sapiens
tctgaaggacattgcggacag

SEQ ID NO: 3252984 - DNA, 18 bp, Homo sapiens
tctgaaggtccaaagagt

SEQ ID NO: 3252985 - DNA, 16 bp, Homo sapiens
tctgaagtcactgcac

SEQ ID NO: 3252986 - DNA, 17 bp, Homo sapiens
tctgaataaagtgtaac

SEQ ID NO: 3252987 - DNA, 16 bp, Homo sapiens
tctgaatagaaatggg

SEQ ID NO: 3252988 - DNA, 17 bp, Homo sapiens
tctgaatgaaaataact

SEQ ID NO: 3252989 - DNA, 16 bp, Homo sapiens
tctgaatgctgctact

SEQ ID NO: 3252990 - DNA, 14 bp, Homo sapiens
tctgaatgtaattt

SEQ ID NO: 3252991 - DNA, 23 bp, Homo sapiens
tctgaatgtaatttgtgtaataa

SEQ ID NO: 3252992 - DNA, 20 bp, Homo sapiens
tctgaatgtatttatgtgta

SEQ ID NO: 3252993 - DNA, 13 bp, Homo sapiens
tctgaatgttaca

SEQ ID NO: 3252994 - DNA, 12 bp, Homo sapiens
tctgaatgttct

SEQ ID NO: 3252995 - DNA, 22 bp, Homo sapiens
tctgaatgttctgacattaaca

SEQ ID NO: 3252996 - DNA, 21 bp, Homo sapiens
tctgaattaattaatttggag

SEQ ID NO: 3252997 - DNA, 12 bp, Homo sapiens
tctgacacacag

SEQ ID NO: 3252998 - DNA, 15 bp, Homo sapiens
tctgacacacagctc

SEQ ID NO: 3252999 - DNA, 17 bp, Homo sapiens
tctgacacacagctctg

SEQ ID NO: 3253000 - DNA, 19 bp, Homo sapiens
tctgacacacagctctgtc

SEQ ID NO: 3253001 - DNA, 22 bp, Homo sapiens
tctgacaggcaatgctggctgt

SEQ ID NO: 3253002 - DNA, 17 bp, Homo sapiens
tctgacagtttttctgt

SEQ ID NO: 3253003 - DNA, 13 bp, Homo sapiens
tctgacatattat

SEQ ID NO: 3253004 - DNA, 17 bp, Homo sapiens
tctgacatattatgcct

SEQ ID NO: 3253005 - DNA, 16 bp, Homo sapiens
tctgacatcccttcct

SEQ ID NO: 3253006 - DNA, 18 bp, Homo sapiens
tctgacatcccttcctgg

SEQ ID NO: 3253007 - DNA, 21 bp, Homo sapiens
tctgacatgcattgttggcta

SEQ ID NO: 3253008 - DNA, 23 bp, Homo sapiens
tctgacattatgtggttttagat

SEQ ID NO: 3253009 - DNA, 13 bp, Homo sapiens
tctgacccactgc

SEQ ID NO: 3253010 - DNA, 21 bp, Homo sapiens
tctgacccagtgagattacag

SEQ ID NO: 3253011 - DNA, 16 bp, Homo sapiens
tctgacccctcctcac

SEQ ID NO: 3253012 - DNA, 21 bp, Homo sapiens
tctgaccctagctctttcctt

SEQ ID NO: 3253013 - DNA, 17 bp, Homo sapiens
tctgacccttctacatt

SEQ ID NO: 3253014 - DNA, 15 bp, Homo sapiens
tctgacctgcaggcc

SEQ ID NO: 3253015 - DNA, 21 bp, Homo sapiens
tctgacctgcaggccaagagc

SEQ ID NO: 3253016 - DNA, 23 bp, Homo sapiens
tctgacgtgccttttgcacccct

SEQ ID NO: 3253017 - DNA, 13 bp, Homo sapiens
tctgactaattag

SEQ ID NO: 3253018 - DNA, 15 bp, Homo sapiens
tctgactaattaggc

SEQ ID NO: 3253019 - DNA, 18 bp, Homo sapiens
tctgactagtagatttct

SEQ ID NO: 3253020 - DNA, 15 bp, Homo sapiens
tctgactccagagtc

SEQ ID NO: 3253021 - DNA, 16 bp, Homo sapiens
tctgactcggtttctc

SEQ ID NO: 3253022 - DNA, 18 bp, Homo sapiens
tctgactcggtttctcca

SEQ ID NO: 3253023 - DNA, 20 bp, Homo sapiens
tctgactcggtttctccaaa

SEQ ID NO: 3253024 - DNA, 14 bp, Homo sapiens
tctgactctgagct

SEQ ID NO: 3253025 - DNA, 17 bp, Homo sapiens
tctgactgccaagccag

SEQ ID NO: 3253026 - DNA, 19 bp, Homo sapiens
tctgacttaagcaaaagaa

SEQ ID NO: 3253027 - DNA, 22 bp, Homo sapiens
tctgacttccccaaacccagaa

SEQ ID NO: 3253028 - DNA, 15 bp, Homo sapiens
tctgacttctgcctg

SEQ ID NO: 3253029 - DNA, 16 bp, Homo sapiens
tctgacttctgcctgg

SEQ ID NO: 3253030 - DNA, 17 bp, Homo sapiens
tctgacttctgcctgga

SEQ ID NO: 3253031 - DNA, 15 bp, Homo sapiens
tctacctggtctggt

SEQ ID NO: 3253032 - DNA, 18 bp, Homo sapiens
tctactaattccacacct

SEQ ID NO: 3253033 - DNA, 15 bp, Homo sapiens
tctactatgagggcc

SEQ ID NO: 3253034 - DNA, 19 bp, Homo sapiens
tctactcctacctcagcct

SEQ ID NO: 3253035 - DNA, 19 bp, Homo sapiens
tctactccttgtaaagact

SEQ ID NO: 3253036 - DNA, 20 bp, Homo sapiens
tctactggtcttgtggaatt

SEQ ID NO: 3253037 - DNA, 23 bp, Homo sapiens
tctactggtcttgtggaattggg

SEQ ID NO: 3253038 - DNA, 22 bp, Homo sapiens
tctacttgcttattacatttaa

SEQ ID NO: 3253039 - DNA, 14 bp, Homo sapiens
tctactttattaat

SEQ ID NO: 3253040 - DNA, 18 bp, Homo sapiens
tctactttttttttaatt

SEQ ID NO: 3253041 - DNA, 12 bp, Homo sapiens
tctagaaaacca

SEQ ID NO: 3253042 - DNA, 20 bp, Homo sapiens
tctagaaagaaaagaccctg

SEQ ID NO: 3253043 - DNA, 23 bp, Homo sapiens
tctagaaagaaaagaccctgaga

SEQ ID NO: 3253044 - DNA, 19 bp, Homo sapiens
tctagaaagagaaacagtt

SEQ ID NO: 3253045 - DNA, 13 bp, Homo sapiens
tctagaaatacac

SEQ ID NO: 3253046 - DNA, 13 bp, Homo sapiens
tctagaacacagg

SEQ ID NO: 3253047 - DNA, 15 bp, Homo sapiens
tctagaacacaggca

SEQ ID NO: 3253048 - DNA, 19 bp, Homo sapiens
tctagaaccacttcctgct

SEQ ID NO: 3253049 - DNA, 17 bp, Homo sapiens
tctagaacctgggctgt

SEQ ID NO: 3253050 - DNA, 17 bp, Homo sapiens
tctagaagataacattt

SEQ ID NO: 3253051 - DNA, 21 bp, Homo sapiens
tctagaatattatgttcctca

SEQ ID NO: 3253052 - DNA, 23 bp, Homo sapiens
tctagaattataagtcacaaaga

SEQ ID NO: 3253053 - DNA, 21 bp, Homo sapiens
tctagagcttaatgctacatg

SEQ ID NO: 3253054 - DNA, 14 bp, Homo sapiens
tctagatcactgtg

SEQ ID NO: 3253055 - DNA, 22 bp, Homo sapiens
tctagatcactgtgcttatttt

SEQ ID NO: 3253056 - DNA, 18 bp, Homo sapiens
tctagatcagatgctcca

SEQ ID NO: 3253057 - DNA, 22 bp, Homo sapiens
tctagatcagatgctccaagat

SEQ ID NO: 3253058 - DNA, 22 bp, Homo sapiens
tctagatgattaaataagattc

SEQ ID NO: 3253059 - DNA, 21 bp, Homo sapiens
tctagatgattttttgaaagt

SEQ ID NO: 3253060 - DNA, 23 bp, Homo sapiens
tctagattaccccctcattgttt

SEQ ID NO: 3253061 - DNA, 20 bp, Homo sapiens
tctagattcaaaggttctag

SEQ ID NO: 3253062 - DNA, 11 bp, Homo sapiens
tctagattctc

SEQ ID NO: 3253063 - DNA, 15 bp, Homo sapiens
tctagattgagagaa

SEQ ID NO: 3253064 - DNA, 22 bp, Homo sapiens
tctagcaattttctttgtttct

SEQ ID NO: 3253065 - DNA, 21 bp, Homo sapiens
tctagccagcccctcttcccc

SEQ ID NO: 3253066 - DNA, 17 bp, Homo sapiens
tctagcctgggccagag

SEQ ID NO: 3253067 - DNA, 20 bp, Homo sapiens
tctagctgcagatgcctctg

SEQ ID NO: 3253068 - DNA, 15 bp, Homo sapiens
tctagctggcaggac

SEQ ID NO: 3253069 - DNA, 17 bp, Homo sapiens
tctagctggcaggacac

SEQ ID NO: 3253070 - DNA, 13 bp, Homo sapiens
tctagctgtatga

SEQ ID NO: 3253071 - DNA, 11 bp, Homo sapiens
tctagctgttg

SEQ ID NO: 3253072 - DNA, 22 bp, Homo sapiens
tctagctttttaattaagcaaa

SEQ ID NO: 3253073 - DNA, 22 bp, Homo sapiens
tctaggaagaagacaaatgaca

SEQ ID NO: 3253074 - DNA, 23 bp, Homo sapiens
tctaggaccatggttaagagtcc

SEQ ID NO: 3253075 - DNA, 20 bp, Homo sapiens
tctaggatagttgatgcatg

SEQ ID NO: 3253076 - DNA, 16 bp, Homo sapiens
tctaggattgggcctc

SEQ ID NO: 3253077 - DNA, 15 bp, Homo sapiens
tctaggcactgtagt

SEQ ID NO: 3253078 - DNA, 18 bp, Homo sapiens
tctaggcatcccagggga

SEQ ID NO: 3253079 - DNA, 19 bp, Homo sapiens
tctaggggtcaggctccat

SEQ ID NO: 3253080 - DNA, 17 bp, Homo sapiens
tctagggttgctggagc

SEQ ID NO: 3253081 - DNA, 21 bp, Homo sapiens
tctaggtacgatgacagtgtt

SEQ ID NO: 3253082 - DNA, 17 bp, Homo sapiens
tctaggtctcctcaggg

SEQ ID NO: 3253083 - DNA, 17 bp, Homo sapiens
tctaggtggagttgaaa

SEQ ID NO: 3253084 - DNA, 15 bp, Homo sapiens
tctaggtttcaaaga

SEQ ID NO: 3253085 - DNA, 12 bp, Homo sapiens
tctagtcattgt

SEQ ID NO: 3253086 - DNA, 16 bp, Homo sapiens
tctagtcctattctat

SEQ ID NO: 3253087 - DNA, 20 bp, Homo sapiens
tctagtctcctttgcactga

SEQ ID NO: 3253088 - DNA, 12 bp, Homo sapiens
tctagtgatgat

SEQ ID NO: 3253089 - DNA, 23 bp, Homo sapiens
tctagtgcagctgattttaacaa

SEQ ID NO: 3253090 - DNA, 15 bp, Homo sapiens
tctagtggtctttgt

SEQ ID NO: 3253091 - DNA, 17 bp, Homo sapiens
tctagtggtctttgtaa

SEQ ID NO: 3253092 - DNA, 21 bp, Homo sapiens
tctagtggtctttgtaagagt

SEQ ID NO: 3253093 - DNA, 21 bp, Homo sapiens
tctagttctttcctccccctg

SEQ ID NO: 3253094 - DNA, 20 bp, Homo sapiens
tctagttgaggagtttccta

SEQ ID NO: 3253095 - DNA, 21 bp, Homo sapiens
tctagttgccaaatctggctc

SEQ ID NO: 3253096 - DNA, 14 bp, Homo sapiens
tctagtttacagaa

SEQ ID NO: 3253097 - DNA, 15 bp, Homo sapiens
tctagtttacagaaa

SEQ ID NO: 3253098 - DNA, 21 bp, Homo sapiens
tctagtttacagaaaaatctt

SEQ ID NO: 3253099 - DNA, 14 bp, Homo sapiens
tctagtttcttgtg

SEQ ID NO: 3253100 - DNA, 12 bp, Homo sapiens
tctataaaactc

SEQ ID NO: 3253101 - DNA, 14 bp, Homo sapiens
tctataaactataa

SEQ ID NO: 3253102 - DNA, 13 bp, Homo sapiens
tctataaataacc

SEQ ID NO: 3253103 - DNA, 13 bp, Homo sapiens
tctataacagata

SEQ ID NO: 3253104 - DNA, 19 bp, Homo sapiens
tctataacagatcctttca

SEQ ID NO: 3253105 - DNA, 13 bp, Homo sapiens
tctataaggccat

SEQ ID NO: 3253106 - DNA, 14 bp, Homo sapiens
tctataaggccata

SEQ ID NO: 3253107 - DNA, 16 bp, Homo sapiens
tctataatttacctaa

SEQ ID NO: 3253108 - DNA, 16 bp, Homo sapiens
tcctccactcgaccca

SEQ ID NO: 3253109 - DNA, 18 bp, Homo sapiens
tcctccagaagcctctgg

SEQ ID NO: 3253110 - DNA, 20 bp, Homo sapiens
tcctccagaagcctctggct

SEQ ID NO: 3253111 - DNA, 22 bp, Homo sapiens
tcctccagaagcctctggctag

SEQ ID NO: 3253112 - DNA, 12 bp, Homo sapiens
tcctccagcccc

SEQ ID NO: 3253113 - DNA, 15 bp, Homo sapiens
tcctccagcccctgt

SEQ ID NO: 3253114 - DNA, 13 bp, Homo sapiens
tcctccagctgca

SEQ ID NO: 3253115 - DNA, 14 bp, Homo sapiens
tcctccagctgcac

SEQ ID NO: 3253116 - DNA, 15 bp, Homo sapiens
tcctccagctgcacc

SEQ ID NO: 3253117 - DNA, 21 bp, Homo sapiens
tcctccagctgcaccagagca

SEQ ID NO: 3253118 - DNA, 14 bp, Homo sapiens
tcctccagcttctg

SEQ ID NO: 3253119 - DNA, 22 bp, Homo sapiens
tcctccagtgtgggcttgacca

SEQ ID NO: 3253120 - DNA, 16 bp, Homo sapiens
tcctccatactcagga

SEQ ID NO: 3253121 - DNA, 17 bp, Homo sapiens
tcctccatctttctaca

SEQ ID NO: 3253122 - DNA, 21 bp, Homo sapiens
tcctcccacccggctgcagag

SEQ ID NO: 3253123 - DNA, 12 bp, Homo sapiens
tcctcccacctc

SEQ ID NO: 3253124 - DNA, 13 bp, Homo sapiens
tcctcccacctca

SEQ ID NO: 3253125 - DNA, 19 bp, Homo sapiens
tcctcccagcgtgtgtatc

SEQ ID NO: 3253126 - DNA, 22 bp, Homo sapiens
tcctcccagcttgtaggagctg

SEQ ID NO: 3253127 - DNA, 19 bp, Homo sapiens
tcctcccaggcgccccttc

SEQ ID NO: 3253128 - DNA, 21 bp, Homo sapiens
tcctcccaggcgccccttccc

SEQ ID NO: 3253129 - DNA, 15 bp, Homo sapiens
tcctcccatcccctg

SEQ ID NO: 3253130 - DNA, 18 bp, Homo sapiens
tcctcccatcccctggac

SEQ ID NO: 3253131 - DNA, 21 bp, Homo sapiens
tcctccccaaatcaatacact

SEQ ID NO: 3253132 - DNA, 21 bp, Homo sapiens
tcctccccacttgtccgctgg

SEQ ID NO: 3253133 - DNA, 20 bp, Homo sapiens
tcctcccccaccccttaggc

SEQ ID NO: 3253134 - DNA, 14 bp, Homo sapiens
tcctccccctgttc

SEQ ID NO: 3253135 - DNA, 16 bp, Homo sapiens
tcctccccctgttctg

SEQ ID NO: 3253136 - DNA, 14 bp, Homo sapiens
tcctcccctcacag

SEQ ID NO: 3253137 - DNA, 17 bp, Homo sapiens
tcctcccctcacagcct

SEQ ID NO: 3253138 - DNA, 19 bp, Homo sapiens
tcctcccctcacagcctct

SEQ ID NO: 3253139 - DNA, 16 bp, Homo sapiens
tcctccccttcctctt

SEQ ID NO: 3253140 - DNA, 13 bp, Homo sapiens
tcctccctatcaa

SEQ ID NO: 3253141 - DNA, 15 bp, Homo sapiens
tcctccctcagtgcc

SEQ ID NO: 3253142 - DNA, 20 bp, Homo sapiens
tcctccctcatggctctggc

SEQ ID NO: 3253143 - DNA, 13 bp, Homo sapiens
tcctccctgcccc

SEQ ID NO: 3253144 - DNA, 12 bp, Homo sapiens
tcctccctggct

SEQ ID NO: 3253145 - DNA, 17 bp, Homo sapiens
tcctccctggctgccct

SEQ ID NO: 3253146 - DNA, 17 bp, Homo sapiens
tcctcccttccttttcc

SEQ ID NO: 3253147 - DNA, 19 bp, Homo sapiens
tcctcccttccttttccct

SEQ ID NO: 3253148 - DNA, 20 bp, Homo sapiens
tcctcccttgggttctgata

SEQ ID NO: 3253149 - DNA, 19 bp, Homo sapiens
tcctccctttccttcctaa

SEQ ID NO: 3253150 - DNA, 23 bp, Homo sapiens
tcctccgagccggggagtttctt

SEQ ID NO: 3253151 - DNA, 23 bp, Homo sapiens
tcctccgtccacccaggctgcac

SEQ ID NO: 3253152 - DNA, 16 bp, Homo sapiens
tcctcctcacctcatg

SEQ ID NO: 3253153 - DNA, 12 bp, Homo sapiens
tcctcctcaggc

SEQ ID NO: 3253154 - DNA, 15 bp, Homo sapiens
tcctcctcccccaga

SEQ ID NO: 3253155 - DNA, 13 bp, Homo sapiens
tcctcctgatggc

SEQ ID NO: 3253156 - DNA, 20 bp, Homo sapiens
tcctcctgatggccaagagc

SEQ ID NO: 3253157 - DNA, 22 bp, Homo sapiens
tcctcctgcagacacctggact

SEQ ID NO: 3253158 - DNA, 12 bp, Homo sapiens
tcctcctgccct

SEQ ID NO: 3253159 - DNA, 19 bp, Homo sapiens
tcctcctgccctgtccctg

SEQ ID NO: 3253160 - DNA, 12 bp, Homo sapiens
tcctcctgctca

SEQ ID NO: 3253161 - DNA, 12 bp, Homo sapiens
tcctcctgctgt

SEQ ID NO: 3253162 - DNA, 23 bp, Homo sapiens
tcctcctgctgtagtcctttctg

SEQ ID NO: 3253163 - DNA, 11 bp, Homo sapiens
tcctcctggaa

SEQ ID NO: 3253164 - DNA, 18 bp, Homo sapiens
tcctcctggaaccttgct

SEQ ID NO: 3253165 - DNA, 20 bp, Homo sapiens
tcctcctggaaccttgctgt

SEQ ID NO: 3253166 - DNA, 13 bp, Homo sapiens
tcctcctgggagc

SEQ ID NO: 3253167 - DNA, 16 bp, Homo sapiens
tcctccttcactgttt

SEQ ID NO: 3253168 - DNA, 14 bp, Homo sapiens
tcctcggaaccgct

SEQ ID NO: 3253169 - DNA, 19 bp, Homo sapiens
tcctcggagagcagcagca

SEQ ID NO: 3253170 - DNA, 15 bp, Homo sapiens
tcctcggccccctcc

SEQ ID NO: 3253171 - DNA, 18 bp, Homo sapiens
tcctcgggccgaggccca

SEQ ID NO: 3253172 - DNA, 17 bp, Homo sapiens
tcctcggggctccaggc

SEQ ID NO: 3253173 - DNA, 21 bp, Homo sapiens
tcctcgttcaaaacattccaa

SEQ ID NO: 3253174 - DNA, 22 bp, Homo sapiens
tcctctagaagccaagggaaag

SEQ ID NO: 3253175 - DNA, 22 bp, Homo sapiens
tcctctaggcaagcaggacctg

SEQ ID NO: 3253176 - DNA, 21 bp, Homo sapiens
tcctctatacatctctcccca

SEQ ID NO: 3253177 - DNA, 14 bp, Homo sapiens
tcctctattttgtg

SEQ ID NO: 3253178 - DNA, 13 bp, Homo sapiens
tcctctcactcct

SEQ ID NO: 3253179 - DNA, 17 bp, Homo sapiens
tcctctcactcctgcct

SEQ ID NO: 3253180 - DNA, 15 bp, Homo sapiens
tcctctcaggctctt

SEQ ID NO: 3253181 - DNA, 14 bp, Homo sapiens
tcctctcagtgttt

SEQ ID NO: 3253182 - DNA, 14 bp, Homo sapiens
tcctctccactgcc

SEQ ID NO: 3253183 - DNA, 12 bp, Homo sapiens
tcctctccaggc

SEQ ID NO: 3253184 - DNA, 15 bp, Homo sapiens
tcctctccaggcacc

SEQ ID NO: 3253185 - DNA, 22 bp, Homo sapiens
tcctctcccacagagtgctgga

SEQ ID NO: 3253186 - DNA, 15 bp, Homo sapiens
tcctctcccatcccc

SEQ ID NO: 3253187 - DNA, 23 bp, Homo sapiens
tcctctcccatccccctgccctc

SEQ ID NO: 3253188 - DNA, 13 bp, Homo sapiens
tcctctcccctcc

SEQ ID NO: 3253189 - DNA, 14 bp, Homo sapiens
tcctctcccctcca

SEQ ID NO: 3253190 - DNA, 14 bp, Homo sapiens
tcctctccctcaca

SEQ ID NO: 3253191 - DNA, 16 bp, Homo sapiens
tcctctccctgccaag

SEQ ID NO: 3253192 - DNA, 18 bp, Homo sapiens
tcctctccctgccaagtc

SEQ ID NO: 3253193 - DNA, 16 bp, Homo sapiens
tcctctccttgggctc

SEQ ID NO: 3253194 - DNA, 20 bp, Homo sapiens
tcctctccttgggctcctgg

SEQ ID NO: 3253195 - DNA, 22 bp, Homo sapiens
tcctctccttgggctcctggct

SEQ ID NO: 3253196 - DNA, 23 bp, Homo sapiens
tcctctcctttgaaacctgctct

SEQ ID NO: 3253197 - DNA, 22 bp, Homo sapiens
tcctctcgagcccagatggaaa

SEQ ID NO: 3253198 - DNA, 14 bp, Homo sapiens
tcctctctccagat

SEQ ID NO: 3253199 - DNA, 12 bp, Homo sapiens
tcctctctgggc

SEQ ID NO: 3253200 - DNA, 14 bp, Homo sapiens
tcctctcttggcaa

SEQ ID NO: 3253201 - DNA, 23 bp, Homo sapiens
tcctctctttgttctcagctccc

SEQ ID NO: 3253202 - DNA, 13 bp, Homo sapiens
tcctctgcagtgc

SEQ ID NO: 3253203 - DNA, 18 bp, Homo sapiens
tcctctgcagtgccttgg

SEQ ID NO: 3253204 - DNA, 20 bp, Homo sapiens
tcctctgctcaccgcccatc

SEQ ID NO: 3253205 - DNA, 22 bp, Homo sapiens
tcctctggacggcaggctcact

SEQ ID NO: 3253206 - DNA, 12 bp, Homo sapiens
tcctctgggcct

SEQ ID NO: 3253207 - DNA, 13 bp, Homo sapiens
tcctctgggcctg

SEQ ID NO: 3253208 - DNA, 20 bp, Homo sapiens
tcctctgggcctggggtgca

SEQ ID NO: 3253209 - DNA, 19 bp, Homo sapiens
tcctctgtcctgcttctga

SEQ ID NO: 3253210 - DNA, 19 bp, Homo sapiens
tcctcttaccgtagcctcc

SEQ ID NO: 3253211 - DNA, 18 bp, Homo sapiens
tcctcttccctctctgca

SEQ ID NO: 3253212 - DNA, 23 bp, Homo sapiens
tcctcttctgcttaggagagacc

SEQ ID NO: 3253213 - DNA, 18 bp, Homo sapiens
tcctcttgcctctctcag

SEQ ID NO: 3253214 - DNA, 14 bp, Homo sapiens
tcctcttgctcaaa

SEQ ID NO: 3253215 - DNA, 15 bp, Homo sapiens
tccgttggccactcc

SEQ ID NO: 3253216 - DNA, 16 bp, Homo sapiens
tccgtttatgggcctt

SEQ ID NO: 3253217 - DNA, 15 bp, Homo sapiens
tcctaaaacaaatag

SEQ ID NO: 3253218 - DNA, 11 bp, Homo sapiens
tcctaaacata

SEQ ID NO: 3253219 - DNA, 15 bp, Homo sapiens
tcctaaacataattg

SEQ ID NO: 3253220 - DNA, 23 bp, Homo sapiens
tcctaaagaaaaatatcttggcc

SEQ ID NO: 3253221 - DNA, 17 bp, Homo sapiens
tcctaaagccatcatgc

SEQ ID NO: 3253222 - DNA, 13 bp, Homo sapiens
tcctaaatatcca

SEQ ID NO: 3253223 - DNA, 20 bp, Homo sapiens
tcctaacaaaagatgaaagc

SEQ ID NO: 3253224 - DNA, 16 bp, Homo sapiens
tcctaacacagcatgt

SEQ ID NO: 3253225 - DNA, 12 bp, Homo sapiens
tcctaactagaa

SEQ ID NO: 3253226 - DNA, 15 bp, Homo sapiens
tcctaactagaatta

SEQ ID NO: 3253227 - DNA, 18 bp, Homo sapiens
tcctaactgaagagacag

SEQ ID NO: 3253228 - DNA, 20 bp, Homo sapiens
tcctaagatgtgttcttatt

SEQ ID NO: 3253229 - DNA, 23 bp, Homo sapiens
tcctaagatgtgttcttattttt

SEQ ID NO: 3253230 - DNA, 15 bp, Homo sapiens
tcctaagcatctaag

SEQ ID NO: 3253231 - DNA, 16 bp, Homo sapiens
tcctaagcatctaagt

SEQ ID NO: 3253232 - DNA, 13 bp, Homo sapiens
tcctaaggaacct

SEQ ID NO: 3253233 - DNA, 17 bp, Homo sapiens
tcctaaggacacactaa

SEQ ID NO: 3253234 - DNA, 21 bp, Homo sapiens
tcctaaggcacccacaaataa

SEQ ID NO: 3253235 - DNA, 18 bp, Homo sapiens
tcctaagtttttttcatt

SEQ ID NO: 3253236 - DNA, 14 bp, Homo sapiens
tcctaatactgtca

SEQ ID NO: 3253237 - DNA, 14 bp, Homo sapiens
tcctaatttccctt

SEQ ID NO: 3253238 - DNA, 19 bp, Homo sapiens
tcctaatttcccttcttgc

SEQ ID NO: 3253239 - DNA, 16 bp, Homo sapiens
tcctaatttctcctcc

SEQ ID NO: 3253240 - DNA, 13 bp, Homo sapiens
tcctaatttgttt

SEQ ID NO: 3253241 - DNA, 14 bp, Homo sapiens
tcctacaaagatgt

SEQ ID NO: 3253242 - DNA, 19 bp, Homo sapiens
tcctacaacttaatggaaa

SEQ ID NO: 3253243 - DNA, 20 bp, Homo sapiens
tcctacaagagcagcctgtg

SEQ ID NO: 3253244 - DNA, 19 bp, Homo sapiens
tcctacaatattttattct

SEQ ID NO: 3253245 - DNA, 21 bp, Homo sapiens
tcctacagagccaaaatgcca

SEQ ID NO: 3253246 - DNA, 22 bp, Homo sapiens
tcctaccagttgccctagccca

SEQ ID NO: 3253247 - DNA, 24 bp, Homo sapiens
tcctaccagttgccctagcccaga

SEQ ID NO: 3253248 - DNA, 14 bp, Homo sapiens
tcctaccccatctc

SEQ ID NO: 3253249 - DNA, 19 bp, Homo sapiens
tcctaccccatctccaaga

SEQ ID NO: 3253250 - DNA, 17 bp, Homo sapiens
tcctaccctcgggccca

SEQ ID NO: 3253251 - DNA, 21 bp, Homo sapiens
tcctaccctcgggcccacctg

SEQ ID NO: 3253252 - DNA, 20 bp, Homo sapiens
tcctaccgaaaccttgcctt

SEQ ID NO: 3253253 - DNA, 12 bp, Homo sapiens
tcctacctcagc

SEQ ID NO: 3253254 - DNA, 13 bp, Homo sapiens
tcctacctcagcc

SEQ ID NO: 3253255 - DNA, 16 bp, Homo sapiens
tcctacctcagcctag

SEQ ID NO: 3253256 - DNA, 17 bp, Homo sapiens
tcctactccctcttcca

SEQ ID NO: 3253257 - DNA, 13 bp, Homo sapiens
tcctactcctgac

SEQ ID NO: 3253258 - DNA, 14 bp, Homo sapiens
tcctactcctgact

SEQ ID NO: 3253259 - DNA, 13 bp, Homo sapiens
tcctactctgtgt

SEQ ID NO: 3253260 - DNA, 14 bp, Homo sapiens
tcctactctgtgtc

SEQ ID NO: 3253261 - DNA, 18 bp, Homo sapiens
tcctagacttgaaagttt

SEQ ID NO: 3253262 - DNA, 19 bp, Homo sapiens
tcctagacttgaaagtttt

SEQ ID NO: 3253263 - DNA, 19 bp, Homo sapiens
tcctagagacagaagcagg

SEQ ID NO: 3253264 - DNA, 20 bp, Homo sapiens
tcctagaggtgggcagctgg

SEQ ID NO: 3253265 - DNA, 23 bp, Homo sapiens
tcctagaggtgggcagctgggcc

SEQ ID NO: 3253266 - DNA, 23 bp, Homo sapiens
tcctagatcctaagggtcgaaag

SEQ ID NO: 3253267 - DNA, 17 bp, Homo sapiens
tcctagcctgtttcttc

SEQ ID NO: 3253268 - DNA, 23 bp, Homo sapiens
tcctaggagagccaacctcggct

SEQ ID NO: 3253269 - DNA, 13 bp, Homo sapiens
tcctaggccacac

SEQ ID NO: 3253270 - DNA, 20 bp, Homo sapiens
tcctaggcccaggcctgggt

SEQ ID NO: 3253271 - DNA, 22 bp, Homo sapiens
tcctaggctccaccccatccag

SEQ ID NO: 3253272 - DNA, 20 bp, Homo sapiens
tcctagggaaaagttcatag

SEQ ID NO: 3253273 - DNA, 18 bp, Homo sapiens
tcctaggggaacagacca

SEQ ID NO: 3253274 - DNA, 22 bp, Homo sapiens
tcctaggggaacagaccagtga

SEQ ID NO: 3253275 - DNA, 23 bp, Homo sapiens
tcctaggggaacagaccagtgac

SEQ ID NO: 3253276 - DNA, 15 bp, Homo sapiens
tcctaggtccaagcc

SEQ ID NO: 3253277 - DNA, 22 bp, Homo sapiens
tcctaggtccaagccccccaca

SEQ ID NO: 3253278 - DNA, 17 bp, Homo sapiens
tcctagtcattcttccc

SEQ ID NO: 3253279 - DNA, 21 bp, Homo sapiens
tcctagtgaaccacaggtttt

SEQ ID NO: 3253280 - DNA, 17 bp, Homo sapiens
tcctagtggatgactgt

SEQ ID NO: 3253281 - DNA, 16 bp, Homo sapiens
tcctagtttgacctca

SEQ ID NO: 3253282 - DNA, 18 bp, Homo sapiens
tcctagtttgacctcaca

SEQ ID NO: 3253283 - DNA, 17 bp, Homo sapiens
tcctataacttcttcct

SEQ ID NO: 3253284 - DNA, 23 bp, Homo sapiens
tcctataacttcttcctgctgga

SEQ ID NO: 3253285 - DNA, 13 bp, Homo sapiens
tcctataacttga

SEQ ID NO: 3253286 - DNA, 20 bp, Homo sapiens
tcctataacttgatgcatgt

SEQ ID NO: 3253287 - DNA, 21 bp, Homo sapiens
tcctataagcttaaataggaa

SEQ ID NO: 3253288 - DNA, 20 bp, Homo sapiens
tcctataatacaaatacaca

SEQ ID NO: 3253289 - DNA, 17 bp, Homo sapiens
tcctataatctgtcaaa

SEQ ID NO: 3253290 - DNA, 16 bp, Homo sapiens
tcctatatacctaata

SEQ ID NO: 3253291 - DNA, 17 bp, Homo sapiens
tcctatatatttctatt

SEQ ID NO: 3253292 - DNA, 18 bp, Homo sapiens
tcctatattgttttcagt

SEQ ID NO: 3253293 - DNA, 19 bp, Homo sapiens
tcctatcacctatttccat

SEQ ID NO: 3253294 - DNA, 18 bp, Homo sapiens
tcctatctggggagctcc

SEQ ID NO: 3253295 - DNA, 13 bp, Homo sapiens
tcctatgatggat

SEQ ID NO: 3253296 - DNA, 17 bp, Homo sapiens
tcctatgatggatggca

SEQ ID NO: 3253297 - DNA, 19 bp, Homo sapiens
tcctatgatggatggcaga

SEQ ID NO: 3253298 - DNA, 21 bp, Homo sapiens
tcctatgcccaggtaccaccc

SEQ ID NO: 3253299 - DNA, 19 bp, Homo sapiens
tcctatggacaacttattt

SEQ ID NO: 3253300 - DNA, 18 bp, Homo sapiens
tcctattctataaaactc

SEQ ID NO: 3253301 - DNA, 14 bp, Homo sapiens
tcctattgcaaagg

SEQ ID NO: 3253302 - DNA, 18 bp, Homo sapiens
tcctatttgccatgggct

SEQ ID NO: 3253303 - DNA, 16 bp, Homo sapiens
tcctatttgttttcat

SEQ ID NO: 3253304 - DNA, 13 bp, Homo sapiens
tcctatttttgta

SEQ ID NO: 3253305 - DNA, 16 bp, Homo sapiens
tcctcaaacccagtct

SEQ ID NO: 3253306 - DNA, 23 bp, Homo sapiens
tcctcaagcaataattgtttcca

SEQ ID NO: 3253307 - DNA, 13 bp, Homo sapiens
tcctcacccccag

SEQ ID NO: 3253308 - DNA, 12 bp, Homo sapiens
tcctcacccctg

SEQ ID NO: 3253309 - DNA, 13 bp, Homo sapiens
tcctcacctctgg

SEQ ID NO: 3253310 - DNA, 16 bp, Homo sapiens
tcctcacctctggact

SEQ ID NO: 3253311 - DNA, 20 bp, Homo sapiens
tcctcacctctggactggct

SEQ ID NO: 3253312 - DNA, 21 bp, Homo sapiens
tcctcacctctggactggcta

SEQ ID NO: 3253313 - DNA, 14 bp, Homo sapiens
tcctcactcccagt

SEQ ID NO: 3253314 - DNA, 23 bp, Homo sapiens
tcctcactgctccctgaagccag

SEQ ID NO: 3253315 - DNA, 13 bp, Homo sapiens
tcctcactggcca

SEQ ID NO: 3253316 - DNA, 17 bp, Homo sapiens
tcctcactggccatccc

SEQ ID NO: 3253317 - DNA, 18 bp, Homo sapiens
tcctcactggccatccct

SEQ ID NO: 3253318 - DNA, 13 bp, Homo sapiens
tcctcactgggtg

SEQ ID NO: 3253319 - DNA, 21 bp, Homo sapiens
tcctcacttccatacagctct

SEQ ID NO: 3253320 - DNA, 20 bp, Homo sapiens
tcctcagagaatttctacca

SEQ ID NO: 3253321 - DNA, 19 bp, Homo sapiens
tcctcagaggcgtgctggt

SEQ ID NO: 3253322 - DNA, 19 bp, Homo sapiens
tcctcagatcatccagaag

SEQ ID NO: 3253323 - DNA, 18 bp, Homo sapiens
tcctcagatggggcacca

SEQ ID NO: 3253324 - DNA, 12 bp, Homo sapiens
tcctcagctggt

SEQ ID NO: 3253325 - DNA, 22 bp, Homo sapiens
tcctcagctggttactcagggt

SEQ ID NO: 3253326 - DNA, 23 bp, Homo sapiens
tcctcagctggttactcagggtt

SEQ ID NO: 3253327 - DNA, 22 bp, Homo sapiens
tcctggtttcataacttcctgt

SEQ ID NO: 3253328 - DNA, 23 bp, Homo sapiens
tcctggtttcataacttcctgta

SEQ ID NO: 3253329 - DNA, 22 bp, Homo sapiens
tcctggttttgtacactgctgt

SEQ ID NO: 3253330 - DNA, 19 bp, Homo sapiens
tcctgtaaatggtgtacat

SEQ ID NO: 3253331 - DNA, 20 bp, Homo sapiens
tcctgtaaatggtgtacata

SEQ ID NO: 3253332 - DNA, 17 bp, Homo sapiens
tcctgtaagccaaagaa

SEQ ID NO: 3253333 - DNA, 14 bp, Homo sapiens
tcctgtacaatcat

SEQ ID NO: 3253334 - DNA, 16 bp, Homo sapiens
tcctgtacactgaata

SEQ ID NO: 3253335 - DNA, 20 bp, Homo sapiens
tcctgtagacctagggagga

SEQ ID NO: 3253336 - DNA, 18 bp, Homo sapiens
tcctgtatgttgtacaat

SEQ ID NO: 3253337 - DNA, 16 bp, Homo sapiens
tcctgtcagtgttttt

SEQ ID NO: 3253338 - DNA, 19 bp, Homo sapiens
tcctgtccacacccagctc

SEQ ID NO: 3253339 - DNA, 21 bp, Homo sapiens
tcctgtcccttctcttaattt

SEQ ID NO: 3253340 - DNA, 13 bp, Homo sapiens
tcctgtctctgcc

SEQ ID NO: 3253341 - DNA, 14 bp, Homo sapiens
tcctgtctctgcct

SEQ ID NO: 3253342 - DNA, 15 bp, Homo sapiens
tcctgtctttctgag

SEQ ID NO: 3253343 - DNA, 22 bp, Homo sapiens
tcctgtctttctgagcacactt

SEQ ID NO: 3253344 - DNA, 20 bp, Homo sapiens
tcctgtgaatgccactgcct

SEQ ID NO: 3253345 - DNA, 16 bp, Homo sapiens
tcctgtgaatggaggc

SEQ ID NO: 3253346 - DNA, 19 bp, Homo sapiens
tcctgtgaatggaggcaga

SEQ ID NO: 3253347 - DNA, 15 bp, Homo sapiens
tcctgtgacatgtaa

SEQ ID NO: 3253348 - DNA, 18 bp, Homo sapiens
tcctgtgacatgtaacag

SEQ ID NO: 3253349 - DNA, 18 bp, Homo sapiens
tcctgtgacttcagctct

SEQ ID NO: 3253350 - DNA, 20 bp, Homo sapiens
tcctgtgcatgggtgaaggg

SEQ ID NO: 3253351 - DNA, 14 bp, Homo sapiens
tcctgtgccgtaag

SEQ ID NO: 3253352 - DNA, 19 bp, Homo sapiens
tcctgtgctaagtctttcc

SEQ ID NO: 3253353 - DNA, 13 bp, Homo sapiens
tcctgtgctctgg

SEQ ID NO: 3253354 - DNA, 14 bp, Homo sapiens
tcctgtgctggggg

SEQ ID NO: 3253355 - DNA, 18 bp, Homo sapiens
tcctgtggaacccagcag

SEQ ID NO: 3253356 - DNA, 22 bp, Homo sapiens
tcctgtggaacccagcagttct

SEQ ID NO: 3253357 - DNA, 21 bp, Homo sapiens
tcctgtggaaggcagagaaat

SEQ ID NO: 3253358 - DNA, 22 bp, Homo sapiens
tcctgtggaaggcagagaaatc

SEQ ID NO: 3253359 - DNA, 16 bp, Homo sapiens
tcctgtggcaggcagc

SEQ ID NO: 3253360 - DNA, 16 bp, Homo sapiens
tcctgtggcataaatt

SEQ ID NO: 3253361 - DNA, 12 bp, Homo sapiens
tcctgtggcccc

SEQ ID NO: 3253362 - DNA, 22 bp, Homo sapiens
tcctgtggccccaccctgggcc

SEQ ID NO: 3253363 - DNA, 13 bp, Homo sapiens
tcctgtggggaaa

SEQ ID NO: 3253364 - DNA, 13 bp, Homo sapiens
tcctgtgtactgt

SEQ ID NO: 3253365 - DNA, 15 bp, Homo sapiens
tcctgtgtactgtgt

SEQ ID NO: 3253366 - DNA, 20 bp, Homo sapiens
tcctgtgtcagaaaccctgg

SEQ ID NO: 3253367 - DNA, 23 bp, Homo sapiens
tcctgtgtcttgcaatggcagcc

SEQ ID NO: 3253368 - DNA, 22 bp, Homo sapiens
tcctgtgtgtccaaaactgcct

SEQ ID NO: 3253369 - DNA, 14 bp, Homo sapiens
tcctgtgtgtgcgc

SEQ ID NO: 3253370 - DNA, 22 bp, Homo sapiens
tcctgttaggtattagaaagtg

SEQ ID NO: 3253371 - DNA, 14 bp, Homo sapiens
tcctgttcagcatt

SEQ ID NO: 3253372 - DNA, 18 bp, Homo sapiens
tcctgttcagtaataaaa

SEQ ID NO: 3253373 - DNA, 13 bp, Homo sapiens
tcctgttccctac

SEQ ID NO: 3253374 - DNA, 19 bp, Homo sapiens
tcctgtttataatctgaag

SEQ ID NO: 3253375 - DNA, 22 bp, Homo sapiens
tcctgtttataatctgaagata

SEQ ID NO: 3253376 - DNA, 17 bp, Homo sapiens
tcctgtttccagggtct

SEQ ID NO: 3253377 - DNA, 21 bp, Homo sapiens
tcctgtttcccttcccttcca

SEQ ID NO: 3253378 - DNA, 15 bp, Homo sapiens
tcctgttttatatat

SEQ ID NO: 3253379 - DNA, 14 bp, Homo sapiens
tcctgtttttcaca

SEQ ID NO: 3253380 - DNA, 17 bp, Homo sapiens
tcctgtttttctgggtg

SEQ ID NO: 3253381 - DNA, 18 bp, Homo sapiens
tccttaaaaatcacactg

SEQ ID NO: 3253382 - DNA, 15 bp, Homo sapiens
tccttaaactgtgtg

SEQ ID NO: 3253383 - DNA, 23 bp, Homo sapiens
tccttaaaggcaccatctaatag

SEQ ID NO: 3253384 - DNA, 17 bp, Homo sapiens
tccttaagctgcagaga

SEQ ID NO: 3253385 - DNA, 20 bp, Homo sapiens
tccttaagctgcagagattt

SEQ ID NO: 3253386 - DNA, 20 bp, Homo sapiens
tccttacgctttgtcacaca

SEQ ID NO: 3253387 - DNA, 14 bp, Homo sapiens
tccttactctgagc

SEQ ID NO: 3253388 - DNA, 17 bp, Homo sapiens
tccttactctgagccca

SEQ ID NO: 3253389 - DNA, 19 bp, Homo sapiens
tccttactctgagcccagg

SEQ ID NO: 3253390 - DNA, 22 bp, Homo sapiens
tccttactctgagcccaggccg

SEQ ID NO: 3253391 - DNA, 20 bp, Homo sapiens
tccttagaggtcctctggag

SEQ ID NO: 3253392 - DNA, 15 bp, Homo sapiens
tccttagctttccct

SEQ ID NO: 3253393 - DNA, 16 bp, Homo sapiens
tccttagtcttctcat

SEQ ID NO: 3253394 - DNA, 22 bp, Homo sapiens
tccttagtcttctcatagcatt

SEQ ID NO: 3253395 - DNA, 15 bp, Homo sapiens
tccttattcttctca

SEQ ID NO: 3253396 - DNA, 19 bp, Homo sapiens
tccttcaagttagctcagg

SEQ ID NO: 3253397 - DNA, 14 bp, Homo sapiens
tccttcactgttcc

SEQ ID NO: 3253398 - DNA, 20 bp, Homo sapiens
tccttcactgttccctctgg

SEQ ID NO: 3253399 - DNA, 21 bp, Homo sapiens
tccttcactgttccctctggc

SEQ ID NO: 3253400 - DNA, 22 bp, Homo sapiens
tccttcactgttccctctggct

SEQ ID NO: 3253401 - DNA, 13 bp, Homo sapiens
tccttcagacacc

SEQ ID NO: 3253402 - DNA, 23 bp, Homo sapiens
tccttcagacaccctcaacctct

SEQ ID NO: 3253403 - DNA, 23 bp, Homo sapiens
tccttcagagctcttcaagctgt

SEQ ID NO: 3253404 - DNA, 11 bp, Homo sapiens
tccttcagcac

SEQ ID NO: 3253405 - DNA, 18 bp, Homo sapiens
tccttccaaaaattatta

SEQ ID NO: 3253406 - DNA, 19 bp, Homo sapiens
tccttccaaaaattattat

SEQ ID NO: 3253407 - DNA, 15 bp, Homo sapiens
tccttccacatgtac

SEQ ID NO: 3253408 - DNA, 17 bp, Homo sapiens
tccttccacatgtacat

SEQ ID NO: 3253409 - DNA, 15 bp, Homo sapiens
tccttccatcaaata

SEQ ID NO: 3253410 - DNA, 16 bp, Homo sapiens
tccttccatccctacc

SEQ ID NO: 3253411 - DNA, 17 bp, Homo sapiens
tccttccccaacttccc

SEQ ID NO: 3253412 - DNA, 23 bp, Homo sapiens
tccttccccaacttccctagtcc

SEQ ID NO: 3253413 - DNA, 14 bp, Homo sapiens
tccttccccaggat

SEQ ID NO: 3253414 - DNA, 14 bp, Homo sapiens
tccttccctgggaa

SEQ ID NO: 3253415 - DNA, 14 bp, Homo sapiens
tccttccctgttct

SEQ ID NO: 3253416 - DNA, 19 bp, Homo sapiens
tccttccctgttctccctt

SEQ ID NO: 3253417 - DNA, 17 bp, Homo sapiens
tccttcccttttctgtt

SEQ ID NO: 3253418 - DNA, 12 bp, Homo sapiens
tccttcctatgc

SEQ ID NO: 3253419 - DNA, 20 bp, Homo sapiens
tccttcctgattgtttacag

SEQ ID NO: 3253420 - DNA, 17 bp, Homo sapiens
tccctagagggttcctg

SEQ ID NO: 3253421 - DNA, 20 bp, Homo sapiens
tccctagagggttcctgtag

SEQ ID NO: 3253422 - DNA, 15 bp, Homo sapiens
tccctagcagtgaac

SEQ ID NO: 3253423 - DNA, 16 bp, Homo sapiens
tccctagcagtgaact

SEQ ID NO: 3253424 - DNA, 17 bp, Homo sapiens
tccctagccagcacttg

SEQ ID NO: 3253425 - DNA, 20 bp, Homo sapiens
tccctagctttagaccctgg

SEQ ID NO: 3253426 - DNA, 22 bp, Homo sapiens
tccctaggagagtttactgatg

SEQ ID NO: 3253427 - DNA, 20 bp, Homo sapiens
tccctcaaatgcgcgtgtgc

SEQ ID NO: 3253428 - DNA, 18 bp, Homo sapiens
tccctcaacaagggagag

SEQ ID NO: 3253429 - DNA, 22 bp, Homo sapiens
tccctcacaagcgctcccagcc

SEQ ID NO: 3253430 - DNA, 15 bp, Homo sapiens
tccctcaccttctga

SEQ ID NO: 3253431 - DNA, 13 bp, Homo sapiens
tccctcagcctca

SEQ ID NO: 3253432 - DNA, 14 bp, Homo sapiens
tccctcagcctcag

SEQ ID NO: 3253433 - DNA, 19 bp, Homo sapiens
tccctcagcctcagaggag

SEQ ID NO: 3253434 - DNA, 18 bp, Homo sapiens
tccctcagctctctggga

SEQ ID NO: 3253435 - DNA, 16 bp, Homo sapiens
tccctcaggcctatgc

SEQ ID NO: 3253436 - DNA, 19 bp, Homo sapiens
tccctcaggttctattttc

SEQ ID NO: 3253437 - DNA, 21 bp, Homo sapiens
tccctcaggttctattttctt

SEQ ID NO: 3253438 - DNA, 23 bp, Homo sapiens
tccctcattccaccttcccatgc

SEQ ID NO: 3253439 - DNA, 21 bp, Homo sapiens
tccctccaccccacagaacct

SEQ ID NO: 3253440 - DNA, 18 bp, Homo sapiens
tccctccactccatccct

SEQ ID NO: 3253441 - DNA, 16 bp, Homo sapiens
tccctccagtaccata

SEQ ID NO: 3253442 - DNA, 16 bp, Homo sapiens
tccctcccacctctgt

SEQ ID NO: 3253443 - DNA, 21 bp, Homo sapiens
tccctcccacctctgtgacct

SEQ ID NO: 3253444 - DNA, 15 bp, Homo sapiens
tccctccccagctcc

SEQ ID NO: 3253445 - DNA, 14 bp, Homo sapiens
tccctcccctgccc

SEQ ID NO: 3253446 - DNA, 16 bp, Homo sapiens
tccctcccctgccctg

SEQ ID NO: 3253447 - DNA, 17 bp, Homo sapiens
tccctcccctgccctgg

SEQ ID NO: 3253448 - DNA, 15 bp, Homo sapiens
tccctccgccttctc

SEQ ID NO: 3253449 - DNA, 22 bp, Homo sapiens
tccctccgccttctcccacatg

SEQ ID NO: 3253450 - DNA, 14 bp, Homo sapiens
tccctcctccaggc

SEQ ID NO: 3253451 - DNA, 16 bp, Homo sapiens
tccctcctccaggcct

SEQ ID NO: 3253452 - DNA, 23 bp, Homo sapiens
tccctccttgggtcattgacctc

SEQ ID NO: 3253453 - DNA, 15 bp, Homo sapiens
tccctcggacccacc

SEQ ID NO: 3253454 - DNA, 16 bp, Homo sapiens
tccctcggacccacca

SEQ ID NO: 3253455 - DNA, 22 bp, Homo sapiens
tccctcggggaccgttcagtgt

SEQ ID NO: 3253456 - DNA, 20 bp, Homo sapiens
tccctcgtccacaggggcag

SEQ ID NO: 3253457 - DNA, 17 bp, Homo sapiens
tccctctaatgagactg

SEQ ID NO: 3253458 - DNA, 19 bp, Homo sapiens
tccctctcagaggcctgct

SEQ ID NO: 3253459 - DNA, 14 bp, Homo sapiens
tccctctccctgtc

SEQ ID NO: 3253460 - DNA, 14 bp, Homo sapiens
tccctctcctaact

SEQ ID NO: 3253461 - DNA, 22 bp, Homo sapiens
tccctctcggaaggctggctgg

SEQ ID NO: 3253462 - DNA, 23 bp, Homo sapiens
tccctctcggaaggctggctggg

SEQ ID NO: 3253463 - DNA, 21 bp, Homo sapiens
tccctctctcttctgctccac

SEQ ID NO: 3253464 - DNA, 13 bp, Homo sapiens
tccctctgacctg

SEQ ID NO: 3253465 - DNA, 17 bp, Homo sapiens
tccctctgacctgcagg

SEQ ID NO: 3253466 - DNA, 21 bp, Homo sapiens
tccctctgccccaagcagcca

SEQ ID NO: 3253467 - DNA, 22 bp, Homo sapiens
tccctctgccccaagcagccag

SEQ ID NO: 3253468 - DNA, 16 bp, Homo sapiens
tccctctgctcagcca

SEQ ID NO: 3253469 - DNA, 18 bp, Homo sapiens
tccctctgctcctggagc

SEQ ID NO: 3253470 - DNA, 18 bp, Homo sapiens
tccctctgtccaccagcc

SEQ ID NO: 3253471 - DNA, 18 bp, Homo sapiens
tccctcttcactgtggcc

SEQ ID NO: 3253472 - DNA, 21 bp, Homo sapiens
tccctcttcactgtggccaca

SEQ ID NO: 3253473 - DNA, 14 bp, Homo sapiens
tccctcttctcaag

SEQ ID NO: 3253474 - DNA, 12 bp, Homo sapiens
tccctcttgtaa

SEQ ID NO: 3253475 - DNA, 17 bp, Homo sapiens
tccctcttgttttgttt

SEQ ID NO: 3253476 - DNA, 15 bp, Homo sapiens
tccctgaagccagcc

SEQ ID NO: 3253477 - DNA, 16 bp, Homo sapiens
tccctgactccctgtg

SEQ ID NO: 3253478 - DNA, 17 bp, Homo sapiens
tccctgactccctgtgg

SEQ ID NO: 3253479 - DNA, 19 bp, Homo sapiens
tccctgactccctgtgggg

SEQ ID NO: 3253480 - DNA, 18 bp, Homo sapiens
tccctgactctctgtgac

SEQ ID NO: 3253481 - DNA, 20 bp, Homo sapiens
tccctgagagtgtctctgat

SEQ ID NO: 3253482 - DNA, 15 bp, Homo sapiens
tccctgaggactgat

SEQ ID NO: 3253483 - DNA, 20 bp, Homo sapiens
tccctgaggactgatttcag

SEQ ID NO: 3253484 - DNA, 19 bp, Homo sapiens
tccctgatgacacccaccc

SEQ ID NO: 3253485 - DNA, 16 bp, Homo sapiens
tccctgattatttatc

SEQ ID NO: 3253486 - DNA, 19 bp, Homo sapiens
tccctgattgacctgctcc

SEQ ID NO: 3253487 - DNA, 16 bp, Homo sapiens
tccctgcagatgccac

SEQ ID NO: 3253488 - DNA, 22 bp, Homo sapiens
tccctgcagatgccaccctagc

SEQ ID NO: 3253489 - DNA, 23 bp, Homo sapiens
tccctgcagatgccaccctagcc

SEQ ID NO: 3253490 - DNA, 14 bp, Homo sapiens
tccctgcatttctg

SEQ ID NO: 3253491 - DNA, 22 bp, Homo sapiens
tccctgccaagtctcagaagag

SEQ ID NO: 3253492 - DNA, 12 bp, Homo sapiens
tccctgccacat

SEQ ID NO: 3253493 - DNA, 16 bp, Homo sapiens
tccctgcccaaaccct

SEQ ID NO: 3253494 - DNA, 19 bp, Homo sapiens
tccctgcccaggccggcca

SEQ ID NO: 3253495 - DNA, 17 bp, Homo sapiens
tccctgcctctcatcaa

SEQ ID NO: 3253496 - DNA, 23 bp, Homo sapiens
tccctgcgagacgcacacagctg

SEQ ID NO: 3253497 - DNA, 16 bp, Homo sapiens
tccctgcgcctgtgat

SEQ ID NO: 3253498 - DNA, 16 bp, Homo sapiens
tccctgctcagtgctt

SEQ ID NO: 3253499 - DNA, 15 bp, Homo sapiens
tccctgctgaatgcc

SEQ ID NO: 3253500 - DNA, 14 bp, Homo sapiens
tccctgctgtgcca

SEQ ID NO: 3253501 - DNA, 20 bp, Homo sapiens
tccctgctgtgccatgctgg

SEQ ID NO: 3253502 - DNA, 21 bp, Homo sapiens
tccctgctgtgccatgctggg

SEQ ID NO: 3253503 - DNA, 22 bp, Homo sapiens
tccctgctgtgccatgctgggc

SEQ ID NO: 3253504 - DNA, 12 bp, Homo sapiens
tccctgcttcca

SEQ ID NO: 3253505 - DNA, 10 bp, Homo sapiens
tccctggaca

SEQ ID NO: 3253506 - DNA, 11 bp, Homo sapiens
tccctggacac

SEQ ID NO: 3253507 - DNA, 16 bp, Homo sapiens
tccctggacacagctc

SEQ ID NO: 3253508 - DNA, 17 bp, Homo sapiens
tccctggacacagctct

SEQ ID NO: 3253509 - DNA, 21 bp, Homo sapiens
tccctggacacagctcttcat

SEQ ID NO: 3253510 - DNA, 23 bp, Homo sapiens
tccctggagaaaaaaattgctct

SEQ ID NO: 3253511 - DNA, 12 bp, Homo sapiens
tccctggagccc

SEQ ID NO: 3253512 - DNA, 13 bp, Homo sapiens
tccctggagccct

SEQ ID NO: 3253513 - DNA, 14 bp, Homo sapiens
tccctggagccctg

SEQ ID NO: 3253514 - DNA, 15 bp, Homo sapiens
tccctggagccctgt

SEQ ID NO: 3253515 - DNA, 20 bp, Homo sapiens
tccctggatgacattaaaga

SEQ ID NO: 3253516 - DNA, 21 bp, Homo sapiens
tccctggatgtgtggggcatg

SEQ ID NO: 3253517 - DNA, 16 bp, Homo sapiens
tccctggctctcagaa

SEQ ID NO: 3253518 - DNA, 14 bp, Homo sapiens
tccctggctgccct

SEQ ID NO: 3253519 - DNA, 15 bp, Homo sapiens
tccctggctgccctg

SEQ ID NO: 3253520 - DNA, 19 bp, Homo sapiens
tccctggctgccctggccc

SEQ ID NO: 3253521 - DNA, 20 bp, Homo sapiens
tccctggctgccctggccct

SEQ ID NO: 3253522 - DNA, 22 bp, Homo sapiens
tccctggctgccctggccctga

SEQ ID NO: 3253523 - DNA, 18 bp, Homo sapiens
tccctgggcattgctttc

SEQ ID NO: 3253524 - DNA, 17 bp, Homo sapiens
tccctgggcccctccac

SEQ ID NO: 3253525 - DNA, 14 bp, Homo sapiens
tccctggtcccttg

SEQ ID NO: 3253526 - DNA, 16 bp, Homo sapiens
tccctgtagctctgcc

SEQ ID NO: 3253527 - DNA, 20 bp, Homo sapiens
tccctgtatgtctacctctg

SEQ ID NO: 3253528 - DNA, 15 bp, Homo sapiens
tccctgtcagaggct

SEQ ID NO: 3253529 - DNA, 17 bp, Homo sapiens
tccctgtccttccctgt

SEQ ID NO: 3253530 - DNA, 21 bp, Homo sapiens
tccctgtccttccctgttctc

SEQ ID NO: 3253531 - DNA, 13 bp, Homo sapiens
tccctgtctctgc

SEQ ID NO: 3253532 - DNA, 18 bp, Homo sapiens
tccctgtctctgcatctg

SEQ ID NO: 3253533 - DNA, 21 bp, Homo sapiens
tccctgtggcactcagggagc

SEQ ID NO: 3253534 - DNA, 11 bp, Homo sapiens
tccctgtgggg

SEQ ID NO: 3253535 - DNA, 22 bp, Homo sapiens
tccctgtgggggtggccatccc

SEQ ID NO: 3253536 - DNA, 23 bp, Homo sapiens
tccctgtgggggtggccatccct

SEQ ID NO: 3253537 - DNA, 17 bp, Homo sapiens
tccctgtgttgtctcta

SEQ ID NO: 3253538 - DNA, 14 bp, Homo sapiens
tccctgttctccct

SEQ ID NO: 3253539 - DNA, 17 bp, Homo sapiens
tccctgttctccctttc

SEQ ID NO: 3253540 - DNA, 18 bp, Homo sapiens
tccctgttcttcctccag

SEQ ID NO: 3253541 - DNA, 14 bp, Homo sapiens
tccctgtttaatat

SEQ ID NO: 3253542 - DNA, 15 bp, Homo sapiens
tccctgtttaatatt

SEQ ID NO: 3253543 - DNA, 18 bp, Homo sapiens
tccctgtttaatatttaa

SEQ ID NO: 3253544 - DNA, 21 bp, Homo sapiens
tccctgtttaatatttaaaca

SEQ ID NO: 3253545 - DNA, 19 bp, Homo sapiens
tccctgttttcccacgagg

SEQ ID NO: 3253546 - DNA, 21 bp, Homo sapiens
tatctggggagctcctggcca

SEQ ID NO: 3253547 - DNA, 21 bp, Homo sapiens
tatctgggtaagaagaaagca

SEQ ID NO: 3253548 - DNA, 16 bp, Homo sapiens
tatctgtaatgatact

SEQ ID NO: 3253549 - DNA, 13 bp, Homo sapiens
tatctgtaatggt

SEQ ID NO: 3253550 - DNA, 22 bp, Homo sapiens
tatctgtaatggtactgacttt

SEQ ID NO: 3253551 - DNA, 12 bp, Homo sapiens
tatctgtattta

SEQ ID NO: 3253552 - DNA, 21 bp, Homo sapiens
tatctgtatttattatttgaa

SEQ ID NO: 3253553 - DNA, 16 bp, Homo sapiens
tatctgtcatatagta

SEQ ID NO: 3253554 - DNA, 19 bp, Homo sapiens
tatctgtgcgtgaaacaca

SEQ ID NO: 3253555 - DNA, 20 bp, Homo sapiens
tatctgtgcgtgaaacacac

SEQ ID NO: 3253556 - DNA, 20 bp, Homo sapiens
tatctgtttcctgacattgt

SEQ ID NO: 3253557 - DNA, 13 bp, Homo sapiens
tatcttaaaacct

SEQ ID NO: 3253558 - DNA, 18 bp, Homo sapiens
tatcttaaagaaacagct

SEQ ID NO: 3253559 - DNA, 13 bp, Homo sapiens
tatcttcaaactt

SEQ ID NO: 3253560 - DNA, 17 bp, Homo sapiens
tatcttcaaactttcac

SEQ ID NO: 3253561 - DNA, 15 bp, Homo sapiens
tatcttcacatagtt

SEQ ID NO: 3253562 - DNA, 18 bp, Homo sapiens
tatcttcagctctttttg

SEQ ID NO: 3253563 - DNA, 14 bp, Homo sapiens
tatcttccatattt

SEQ ID NO: 3253564 - DNA, 17 bp, Homo sapiens
tatcttctcaagttcta

SEQ ID NO: 3253565 - DNA, 14 bp, Homo sapiens
tatcttctgatttg

SEQ ID NO: 3253566 - DNA, 15 bp, Homo sapiens
tatcttcttcaaata

SEQ ID NO: 3253567 - DNA, 20 bp, Homo sapiens
tatcttcttcaaatacaaag

SEQ ID NO: 3253568 - DNA, 20 bp, Homo sapiens
tatcttggactgacatttag

SEQ ID NO: 3253569 - DNA, 20 bp, Homo sapiens
tatcttggggcaagactgca

SEQ ID NO: 3253570 - DNA, 22 bp, Homo sapiens
tatcttggggcaagactgcaaa

SEQ ID NO: 3253571 - DNA, 17 bp, Homo sapiens
tatcttgtctctgggct

SEQ ID NO: 3253572 - DNA, 14 bp, Homo sapiens
tatctttatacaga

SEQ ID NO: 3253573 - DNA, 15 bp, Homo sapiens
tcccaggcccgagat

SEQ ID NO: 3253574 - DNA, 20 bp, Homo sapiens
tcccaggccgcaccatttct

SEQ ID NO: 3253575 - DNA, 23 bp, Homo sapiens
tcccaggccgcaccatttctgtc

SEQ ID NO: 3253576 - DNA, 20 bp, Homo sapiens
tcccaggcgccccttccccc

SEQ ID NO: 3253577 - DNA, 17 bp, Homo sapiens
tcccagggccagggccc

SEQ ID NO: 3253578 - DNA, 16 bp, Homo sapiens
tcccagggctggctct

SEQ ID NO: 3253579 - DNA, 17 bp, Homo sapiens
tcccagggctggctctg

SEQ ID NO: 3253580 - DNA, 20 bp, Homo sapiens
tcccagggctggctctgcac

SEQ ID NO: 3253581 - DNA, 12 bp, Homo sapiens
tcccaggggacc

SEQ ID NO: 3253582 - DNA, 19 bp, Homo sapiens
tcccaggtaccagctgcgc

SEQ ID NO: 3253583 - DNA, 15 bp, Homo sapiens
tcccaggttccagca

SEQ ID NO: 3253584 - DNA, 16 bp, Homo sapiens
tcccaggttcccccag

SEQ ID NO: 3253585 - DNA, 20 bp, Homo sapiens
tcccaggttgacaccattct

SEQ ID NO: 3253586 - DNA, 18 bp, Homo sapiens
tcccaggtttagtgaaaa

SEQ ID NO: 3253587 - DNA, 23 bp, Homo sapiens
tcccagtccccagcccttcacat

SEQ ID NO: 3253588 - DNA, 16 bp, Homo sapiens
tcccagtcctccagac

SEQ ID NO: 3253589 - DNA, 10 bp, Homo sapiens
tcccagtggg

SEQ ID NO: 3253590 - DNA, 22 bp, Homo sapiens
tcccagtgggaggggcaggctg

SEQ ID NO: 3253591 - DNA, 23 bp, Homo sapiens
tcccagttggggaagccaggtga

SEQ ID NO: 3253592 - DNA, 21 bp, Homo sapiens
tcccataattgctttgccaaa

SEQ ID NO: 3253593 - DNA, 22 bp, Homo sapiens
tcccataattttcttcatgcaa

SEQ ID NO: 3253594 - DNA, 21 bp, Homo sapiens
tcccatagtggggcctgggag

SEQ ID NO: 3253595 - DNA, 22 bp, Homo sapiens
tcccatagtggggcctgggagg

SEQ ID NO: 3253596 - DNA, 15 bp, Homo sapiens
tcccatatcttgcct

SEQ ID NO: 3253597 - DNA, 23 bp, Homo sapiens
tcccatcattacccttccctgca

SEQ ID NO: 3253598 - DNA, 15 bp, Homo sapiens
tcccatccaggcagt

SEQ ID NO: 3253599 - DNA, 13 bp, Homo sapiens
tcccatccccctg

SEQ ID NO: 3253600 - DNA, 14 bp, Homo sapiens
tcccatccccctgc

SEQ ID NO: 3253601 - DNA, 15 bp, Homo sapiens
tcccatccccctgcc

SEQ ID NO: 3253602 - DNA, 16 bp, Homo sapiens
tcccatccccctgccc

SEQ ID NO: 3253603 - DNA, 17 bp, Homo sapiens
tcccatccccctgccct

SEQ ID NO: 3253604 - DNA, 19 bp, Homo sapiens
tcccatccccctgccctcg

SEQ ID NO: 3253605 - DNA, 15 bp, Homo sapiens
tcccatcctggggca

SEQ ID NO: 3253606 - DNA, 14 bp, Homo sapiens
tcccatctcttcct

SEQ ID NO: 3253607 - DNA, 17 bp, Homo sapiens
tcccatctgggagtccc

SEQ ID NO: 3253608 - DNA, 19 bp, Homo sapiens
tcccatctgggagtcccct

SEQ ID NO: 3253609 - DNA, 21 bp, Homo sapiens
tcccatgacccacccctgtgc

SEQ ID NO: 3253610 - DNA, 24 bp, Homo sapiens
tcccatgacccacccctgtgctcc

SEQ ID NO: 3253611 - DNA, 14 bp, Homo sapiens
tcccatgactgcac

SEQ ID NO: 3253612 - DNA, 21 bp, Homo sapiens
tcccatgactgcacccagctc

SEQ ID NO: 3253613 - DNA, 15 bp, Homo sapiens
tcccatgagcctcag

SEQ ID NO: 3253614 - DNA, 17 bp, Homo sapiens
tcccatgagcctcagca

SEQ ID NO: 3253615 - DNA, 20 bp, Homo sapiens
tcccatgagcctcagcatcc

SEQ ID NO: 3253616 - DNA, 16 bp, Homo sapiens
tcccatgcctgtctct

SEQ ID NO: 3253617 - DNA, 17 bp, Homo sapiens
tcccatgcctgtctctg

SEQ ID NO: 3253618 - DNA, 15 bp, Homo sapiens
tcccatggacactcc

SEQ ID NO: 3253619 - DNA, 21 bp, Homo sapiens
tcccatgtagccccctggcct

SEQ ID NO: 3253620 - DNA, 22 bp, Homo sapiens
tcccatgtagccccctggcctc

SEQ ID NO: 3253621 - DNA, 13 bp, Homo sapiens
tcccatgtatgga

SEQ ID NO: 3253622 - DNA, 22 bp, Homo sapiens
tcccatgtatttatctctattt

SEQ ID NO: 3253623 - DNA, 21 bp, Homo sapiens
tcccattaggacaatcagtcc

SEQ ID NO: 3253624 - DNA, 19 bp, Homo sapiens
tcccattcacttctgcatt

SEQ ID NO: 3253625 - DNA, 23 bp, Homo sapiens
tcccattcacttctgcattcctg

SEQ ID NO: 3253626 - DNA, 15 bp, Homo sapiens
tcccattcctccctc

SEQ ID NO: 3253627 - DNA, 18 bp, Homo sapiens
tcccatttctcactgaga

SEQ ID NO: 3253628 - DNA, 16 bp, Homo sapiens
tcccatttgtgccaga

SEQ ID NO: 3253629 - DNA, 13 bp, Homo sapiens
tcccattttcccc

SEQ ID NO: 3253630 - DNA, 16 bp, Homo sapiens
tcccattttccccttc

SEQ ID NO: 3253631 - DNA, 13 bp, Homo sapiens
tcccattttgcaa

SEQ ID NO: 3253632 - DNA, 21 bp, Homo sapiens
tcccattttgcaaaatttcca

SEQ ID NO: 3253633 - DNA, 10 bp, Homo sapiens
tccccaaagt

SEQ ID NO: 3253634 - DNA, 18 bp, Homo sapiens
tccccaaatcaatacact

SEQ ID NO: 3253635 - DNA, 22 bp, Homo sapiens
tccccaaccctaggttccctgt

SEQ ID NO: 3253636 - DNA, 20 bp, Homo sapiens
tccccacaccttccagggcc

SEQ ID NO: 3253637 - DNA, 10 bp, Homo sapiens
tccccacact

SEQ ID NO: 3253638 - DNA, 13 bp, Homo sapiens
tccccacagcctc

SEQ ID NO: 3253639 - DNA, 14 bp, Homo sapiens
tccccacagcctct

SEQ ID NO: 3253640 - DNA, 17 bp, Homo sapiens
tccccacagcgtccctg

SEQ ID NO: 3253641 - DNA, 18 bp, Homo sapiens
tccccacagcgtccctgg

SEQ ID NO: 3253642 - DNA, 20 bp, Homo sapiens
tccccacagcgtccctggcg

SEQ ID NO: 3253643 - DNA, 13 bp, Homo sapiens
tccccaccagctc

SEQ ID NO: 3253644 - DNA, 22 bp, Homo sapiens
tccccacccctgcccccagccc

SEQ ID NO: 3253645 - DNA, 14 bp, Homo sapiens
tccccaccctccac

SEQ ID NO: 3253646 - DNA, 19 bp, Homo sapiens
tccccaccctcctcttgga

SEQ ID NO: 3253647 - DNA, 17 bp, Homo sapiens
tccccacccttgagaag

SEQ ID NO: 3253648 - DNA, 20 bp, Homo sapiens
tccccaccttcaattcctgg

SEQ ID NO: 3253649 - DNA, 23 bp, Homo sapiens
tccccaccttcaattcctgggcc

SEQ ID NO: 3253650 - DNA, 22 bp, Homo sapiens
tccccacgagtcacctgcaagc

SEQ ID NO: 3253651 - DNA, 18 bp, Homo sapiens
tccccacgccctcccctc

SEQ ID NO: 3253652 - DNA, 20 bp, Homo sapiens
tccccactaggttcttttcc

SEQ ID NO: 3253653 - DNA, 20 bp, Homo sapiens
tccccactcctctcccacag

SEQ ID NO: 3253654 - DNA, 14 bp, Homo sapiens
tccccactgtccta

SEQ ID NO: 3253655 - DNA, 21 bp, Homo sapiens
tccccacttgtccgctgggtg

SEQ ID NO: 3253656 - DNA, 20 bp, Homo sapiens
tccccagactcagctggaag

SEQ ID NO: 3253657 - DNA, 12 bp, Homo sapiens
tccccagagcac

SEQ ID NO: 3253658 - DNA, 21 bp, Homo sapiens
tccccagagcactgggttgca

SEQ ID NO: 3253659 - DNA, 17 bp, Homo sapiens
tccccagagctgtgcca

SEQ ID NO: 3253660 - DNA, 20 bp, Homo sapiens
tccccagagctgtgccagca

SEQ ID NO: 3253661 - DNA, 15 bp, Homo sapiens
tccccagatctccca

SEQ ID NO: 3253662 - DNA, 17 bp, Homo sapiens
tccccagatctcccact

SEQ ID NO: 3253663 - DNA, 13 bp, Homo sapiens
tccccagattgca

SEQ ID NO: 3253664 - DNA, 20 bp, Homo sapiens
tccccagattgcaacaggct

SEQ ID NO: 3253665 - DNA, 21 bp, Homo sapiens
tccccagcaagtgagagctgg

SEQ ID NO: 3253666 - DNA, 20 bp, Homo sapiens
tccccagcattccagcccct

SEQ ID NO: 3253667 - DNA, 15 bp, Homo sapiens
tccccagccccaccc

SEQ ID NO: 3253668 - DNA, 15 bp, Homo sapiens
tccccagcccctagc

SEQ ID NO: 3253669 - DNA, 14 bp, Homo sapiens
tccccagccctgtc

SEQ ID NO: 3253670 - DNA, 16 bp, Homo sapiens
tccccagccctgtcct

SEQ ID NO: 3253671 - DNA, 12 bp, Homo sapiens
tccccagccctt

SEQ ID NO: 3253672 - DNA, 16 bp, Homo sapiens
tccccagcccttcaca

SEQ ID NO: 3253673 - DNA, 19 bp, Homo sapiens
tccccaggatggactcttc

SEQ ID NO: 3253674 - DNA, 21 bp, Homo sapiens
tccccaggcccaccatcacca

SEQ ID NO: 3253675 - DNA, 21 bp, Homo sapiens
tccccaggcctccagcctctc

SEQ ID NO: 3253676 - DNA, 12 bp, Homo sapiens
tccccagggata

SEQ ID NO: 3253677 - DNA, 15 bp, Homo sapiens
tccccagggcccctc

SEQ ID NO: 3253678 - DNA, 21 bp, Homo sapiens
tccccagggcccctccctctg

SEQ ID NO: 3253679 - DNA, 19 bp, Homo sapiens
tccccagggctcccttatg

SEQ ID NO: 3253680 - DNA, 18 bp, Homo sapiens
tccccaggggaaaatgaa

SEQ ID NO: 3253681 - DNA, 15 bp, Homo sapiens
tccccaggggagttg

SEQ ID NO: 3253682 - DNA, 17 bp, Homo sapiens
tccccaggggtcccagc

SEQ ID NO: 3253683 - DNA, 17 bp, Homo sapiens
tccccaggtccagctct

SEQ ID NO: 3253684 - DNA, 16 bp, Homo sapiens
tccccagtcccaatgc

SEQ ID NO: 3253685 - DNA, 16 bp, Homo sapiens
tccccatcatcccagc

SEQ ID NO: 3253686 - DNA, 17 bp, Homo sapiens
tccccatcatcccagct

SEQ ID NO: 3253687 - DNA, 18 bp, Homo sapiens
tccccatccccaccagct

SEQ ID NO: 3253688 - DNA, 15 bp, Homo sapiens
tccccatcctccagc

SEQ ID NO: 3253689 - DNA, 19 bp, Homo sapiens
tccccatcttctaaaccca

SEQ ID NO: 3253690 - DNA, 21 bp, Homo sapiens
tccccatgccacgttccacag

SEQ ID NO: 3253691 - DNA, 22 bp, Homo sapiens
tccccatgccacgttccacagt

SEQ ID NO: 3253692 - DNA, 19 bp, Homo sapiens
tccccattagagtcagcct

SEQ ID NO: 3253693 - DNA, 17 bp, Homo sapiens
tatatgcttactgatat

SEQ ID NO: 3253694 - DNA, 21 bp, Homo sapiens
tatatgcttactgatatattt

SEQ ID NO: 3253695 - DNA, 21 bp, Homo sapiens
tatatgtatatttttttaatt

SEQ ID NO: 3253696 - DNA, 20 bp, Homo sapiens
tatatgtggactaaatatct

SEQ ID NO: 3253697 - DNA, 22 bp, Homo sapiens
tatatgtggactaaatatctgt

SEQ ID NO: 3253698 - DNA, 13 bp, Homo sapiens
tatatgtgtgtgt

SEQ ID NO: 3253699 - DNA, 22 bp, Homo sapiens
tatatgtgtgtgtatgtttgca

SEQ ID NO: 3253700 - DNA, 15 bp, Homo sapiens
tatatgttcttcata

SEQ ID NO: 3253701 - DNA, 13 bp, Homo sapiens
tatattaaacaaa

SEQ ID NO: 3253702 - DNA, 22 bp, Homo sapiens
tatattaaacaaagtttcagag

SEQ ID NO: 3253703 - DNA, 20 bp, Homo sapiens
tatattaatcaccttctttg

SEQ ID NO: 3253704 - DNA, 21 bp, Homo sapiens
tatattacacatttgtacaga

SEQ ID NO: 3253705 - DNA, 18 bp, Homo sapiens
tatattaccagcaagaat

SEQ ID NO: 3253706 - DNA, 21 bp, Homo sapiens
tatattacctcaaattcctaa

SEQ ID NO: 3253707 - DNA, 16 bp, Homo sapiens
tatattactgacattt

SEQ ID NO: 3253708 - DNA, 23 bp, Homo sapiens
tatattactgacatttcttctag

SEQ ID NO: 3253709 - DNA, 22 bp, Homo sapiens
tatattaggatctgcaaacaat

SEQ ID NO: 3253710 - DNA, 13 bp, Homo sapiens
tatattatgtctt

SEQ ID NO: 3253711 - DNA, 13 bp, Homo sapiens
tatattatgtgaa

SEQ ID NO: 3253712 - DNA, 15 bp, Homo sapiens
tatattatgtgaaga

SEQ ID NO: 3253713 - DNA, 18 bp, Homo sapiens
tatattatgtgaagaatt

SEQ ID NO: 3253714 - DNA, 13 bp, Homo sapiens
tatattattgtaa

SEQ ID NO: 3253715 - DNA, 23 bp, Homo sapiens
tatattattgtaagttgtacaaa

SEQ ID NO: 3253716 - DNA, 13 bp, Homo sapiens
tatattatttggc

SEQ ID NO: 3253717 - DNA, 14 bp, Homo sapiens
tatattcacagttt

SEQ ID NO: 3253718 - DNA, 16 bp, Homo sapiens
tatattcacagttttt

SEQ ID NO: 3253719 - DNA, 18 bp, Homo sapiens
tatattcccaatagcaac

SEQ ID NO: 3253720 - DNA, 18 bp, Homo sapiens
tatattcttattggaaat

SEQ ID NO: 3253721 - DNA, 22 bp, Homo sapiens
tatattcttattggaaatgtac

SEQ ID NO: 3253722 - DNA, 22 bp, Homo sapiens
tatattgaataaaaaatagaca

SEQ ID NO: 3253723 - DNA, 22 bp, Homo sapiens
tatattgagaatcccttaaaat

SEQ ID NO: 3253724 - DNA, 12 bp, Homo sapiens
tatattgcctta

SEQ ID NO: 3253725 - DNA, 18 bp, Homo sapiens
tatattggtttgcacaag

SEQ ID NO: 3253726 - DNA, 22 bp, Homo sapiens
tatattggtttgcacaagttcc

SEQ ID NO: 3253727 - DNA, 15 bp, Homo sapiens
tatattgtacaaatg

SEQ ID NO: 3253728 - DNA, 18 bp, Homo sapiens
tatattgtgtttgtgtat

SEQ ID NO: 3253729 - DNA, 15 bp, Homo sapiens
tatattgttgaagag

SEQ ID NO: 3253730 - DNA, 23 bp, Homo sapiens
tatattgttgttactttttcttg

SEQ ID NO: 3253731 - DNA, 16 bp, Homo sapiens
tatattgtttttgtat

SEQ ID NO: 3253732 - DNA, 21 bp, Homo sapiens
tatatttaaaaaattatggaa

SEQ ID NO: 3253733 - DNA, 17 bp, Homo sapiens
tatatttaaaaattgtt

SEQ ID NO: 3253734 - DNA, 13 bp, Homo sapiens
tatatttaagcct

SEQ ID NO: 3253735 - DNA, 15 bp, Homo sapiens
tatatttaatgataa

SEQ ID NO: 3253736 - DNA, 16 bp, Homo sapiens
tatatttaatgcatta

SEQ ID NO: 3253737 - DNA, 24 bp, Homo sapiens
tatatttacagtgaaaatgtaagc

SEQ ID NO: 3253738 - DNA, 14 bp, Homo sapiens
tatatttagtgctg

SEQ ID NO: 3253739 - DNA, 18 bp, Homo sapiens
tatatttagttatagttt

SEQ ID NO: 3253740 - DNA, 14 bp, Homo sapiens
tatatttataactc

SEQ ID NO: 3253741 - DNA, 22 bp, Homo sapiens
tatatttataactcatcataaa

SEQ ID NO: 3253742 - DNA, 12 bp, Homo sapiens
tatatttattca

SEQ ID NO: 3253743 - DNA, 16 bp, Homo sapiens
tatatttattcataat

SEQ ID NO: 3253744 - DNA, 17 bp, Homo sapiens
tatatttattcataatg

SEQ ID NO: 3253745 - DNA, 19 bp, Homo sapiens
tatatttcacaggctgtaa

SEQ ID NO: 3253746 - DNA, 20 bp, Homo sapiens
tatatttcacaggctgtaaa

SEQ ID NO: 3253747 - DNA, 16 bp, Homo sapiens
tatatttcactatttt

SEQ ID NO: 3253748 - DNA, 20 bp, Homo sapiens
tatatttccctaaaatacat

SEQ ID NO: 3253749 - DNA, 14 bp, Homo sapiens
tatatttctttgtt

SEQ ID NO: 3253750 - DNA, 16 bp, Homo sapiens
tatatttggaaagaga

SEQ ID NO: 3253751 - DNA, 17 bp, Homo sapiens
tatatttggaaagagac

SEQ ID NO: 3253752 - DNA, 18 bp, Homo sapiens
tatatttggtttctagat

SEQ ID NO: 3253753 - DNA, 22 bp, Homo sapiens
tatatttggtttctagatcact

SEQ ID NO: 3253754 - DNA, 14 bp, Homo sapiens
tatatttgtacaaa

SEQ ID NO: 3253755 - DNA, 17 bp, Homo sapiens
tatatttgtaggagaaa

SEQ ID NO: 3253756 - DNA, 13 bp, Homo sapiens
tatatttgtatcg

SEQ ID NO: 3253757 - DNA, 21 bp, Homo sapiens
tatatttgtgtattttcctgg

SEQ ID NO: 3253758 - DNA, 16 bp, Homo sapiens
tatattttacaatttt

SEQ ID NO: 3253759 - DNA, 17 bp, Homo sapiens
tatattttagcatttta

SEQ ID NO: 3253760 - DNA, 13 bp, Homo sapiens
tatattttatata

SEQ ID NO: 3253761 - DNA, 18 bp, Homo sapiens
tatattttatataaagta

SEQ ID NO: 3253762 - DNA, 12 bp, Homo sapiens
tatattttcgta

SEQ ID NO: 3253763 - DNA, 20 bp, Homo sapiens
tatattttcgtatgaaaatg

SEQ ID NO: 3253764 - DNA, 18 bp, Homo sapiens
tatattttgtgtgaaatt

SEQ ID NO: 3253765 - DNA, 18 bp, Homo sapiens
tatatttttaataaaagt

SEQ ID NO: 3253766 - DNA, 18 bp, Homo sapiens
tatatttttatatttagt

SEQ ID NO: 3253767 - DNA, 15 bp, Homo sapiens
tatatttttcacagt

SEQ ID NO: 3253768 - DNA, 14 bp, Homo sapiens
tatatttttgtaca

SEQ ID NO: 3253769 - DNA, 16 bp, Homo sapiens
tatatttttgtgtttt

SEQ ID NO: 3253770 - DNA, 18 bp, Homo sapiens
tatatttttgtgttttct

SEQ ID NO: 3253771 - DNA, 13 bp, Homo sapiens
tatcaaaagaaat

SEQ ID NO: 3253772 - DNA, 18 bp, Homo sapiens
tatcaaaagaaatagaaa

SEQ ID NO: 3253773 - DNA, 13 bp, Homo sapiens
tatcaaaattcta

SEQ ID NO: 3253774 - DNA, 20 bp, Homo sapiens
tatcaaacagaattttaaag

SEQ ID NO: 3253775 - DNA, 19 bp, Homo sapiens
tatcaaaccctagccttgc

SEQ ID NO: 3253776 - DNA, 15 bp, Homo sapiens
tatcaaatctaccac

SEQ ID NO: 3253777 - DNA, 13 bp, Homo sapiens
tatcaaatctgta

SEQ ID NO: 3253778 - DNA, 16 bp, Homo sapiens
tatcaaatctgtatat

SEQ ID NO: 3253779 - DNA, 12 bp, Homo sapiens
tatcaagaaagt

SEQ ID NO: 3253780 - DNA, 15 bp, Homo sapiens
tatcaagacatagca

SEQ ID NO: 3253781 - DNA, 17 bp, Homo sapiens
tatcaagtggcatgtgc

SEQ ID NO: 3253782 - DNA, 17 bp, Homo sapiens
tatcaatatctaatata

SEQ ID NO: 3253783 - DNA, 22 bp, Homo sapiens
tatcaatatctaatatatatga

SEQ ID NO: 3253784 - DNA, 16 bp, Homo sapiens
tatcaattggcagtga

SEQ ID NO: 3253785 - DNA, 18 bp, Homo sapiens
tatcacctagcagcctca

SEQ ID NO: 3253786 - DNA, 20 bp, Homo sapiens
tatcactctaaaaaacattt

SEQ ID NO: 3253787 - DNA, 14 bp, Homo sapiens
tatcacttatatat

SEQ ID NO: 3253788 - DNA, 15 bp, Homo sapiens
tatcactttttgaac

SEQ ID NO: 3253789 - DNA, 17 bp, Homo sapiens
tatcactttttgaacta

SEQ ID NO: 3253790 - DNA, 20 bp, Homo sapiens
tatcactttttgaactaaga

SEQ ID NO: 3253791 - DNA, 22 bp, Homo sapiens
tatcactttttgaactaagaaa

SEQ ID NO: 3253792 - DNA, 14 bp, Homo sapiens
tatcagaagaccac

SEQ ID NO: 3253793 - DNA, 17 bp, Homo sapiens
tatcagacaagcactat

SEQ ID NO: 3253794 - DNA, 15 bp, Homo sapiens
tatcagagctcttaa

SEQ ID NO: 3253795 - DNA, 22 bp, Homo sapiens
tatcagagctcttaatgttgct

SEQ ID NO: 3253796 - DNA, 13 bp, Homo sapiens
tatcagatacatc

SEQ ID NO: 3253797 - DNA, 19 bp, Homo sapiens
tatcagatacatcactgct

SEQ ID NO: 3253798 - DNA, 19 bp, Homo sapiens
tatcagcctgagtctcctg

SEQ ID NO: 3253799 - DNA, 19 bp, Homo sapiens
tatcagctacttaagagaa

SEQ ID NO: 3253800 - DNA, 14 bp, Homo sapiens
tatcagcttcagaa

SEQ ID NO: 3253801 - DNA, 23 bp, Homo sapiens
tatcaggtctcccacgtgggaga

SEQ ID NO: 3253802 - DNA, 17 bp, Homo sapiens
tatcaggtgctgccatc

SEQ ID NO: 3253803 - DNA, 19 bp, Homo sapiens
tatcaggtgctgccatcca

SEQ ID NO: 3253804 - DNA, 20 bp, Homo sapiens
tatcaggtgctgccatccag

SEQ ID NO: 3253805 - DNA, 22 bp, Homo sapiens
tatcagtcataactaaataaag

SEQ ID NO: 3253806 - DNA, 17 bp, Homo sapiens
tatcagtgacagagttc

SEQ ID NO: 3253807 - DNA, 20 bp, Homo sapiens
tatcagtgacagagttcact

SEQ ID NO: 3253808 - DNA, 17 bp, Homo sapiens
tatcagtgttttaaatt

SEQ ID NO: 3253809 - DNA, 17 bp, Homo sapiens
tatcagttatcctttgt

SEQ ID NO: 3253810 - DNA, 23 bp, Homo sapiens
tatcagtttgctagcagaaatct

SEQ ID NO: 3253811 - DNA, 20 bp, Homo sapiens
tatcagtttgtcctgtagag

SEQ ID NO: 3253812 - DNA, 16 bp, Homo sapiens
tatcatacaaatcagt

SEQ ID NO: 3253813 - DNA, 18 bp, Homo sapiens
tatcataccctttattct

SEQ ID NO: 3253814 - DNA, 14 bp, Homo sapiens
tatcatactgattt

SEQ ID NO: 3253815 - DNA, 18 bp, Homo sapiens
tatcatataaacatttta

SEQ ID NO: 3253816 - DNA, 18 bp, Homo sapiens
tatcatcaatgtgacatt

SEQ ID NO: 3253817 - DNA, 13 bp, Homo sapiens
tatcatctgtcat

SEQ ID NO: 3253818 - DNA, 17 bp, Homo sapiens
tatcatctgtcattata

SEQ ID NO: 3253819 - DNA, 18 bp, Homo sapiens
tatcatctgtcattatat

SEQ ID NO: 3253820 - DNA, 20 bp, Homo sapiens
tatcatctgtcattatattc

SEQ ID NO: 3253821 - DNA, 11 bp, Homo sapiens
tatcatgaatg

SEQ ID NO: 3253822 - DNA, 21 bp, Homo sapiens
taggcccttgtcctgccagct

SEQ ID NO: 3253823 - DNA, 16 bp, Homo sapiens
taggcctgggtgctgg

SEQ ID NO: 3253824 - DNA, 19 bp, Homo sapiens
taggcctgggtgctggctg

SEQ ID NO: 3253825 - DNA, 20 bp, Homo sapiens
taggcctgggtgctggctgc

SEQ ID NO: 3253826 - DNA, 21 bp, Homo sapiens
taggccttcctctctccagat

SEQ ID NO: 3253827 - DNA, 13 bp, Homo sapiens
taggcctttcctg

SEQ ID NO: 3253828 - DNA, 16 bp, Homo sapiens
taggccttttaacatt

SEQ ID NO: 3253829 - DNA, 17 bp, Homo sapiens
taggctattaaaaaagt

SEQ ID NO: 3253830 - DNA, 16 bp, Homo sapiens
taggctatttgtaaat

SEQ ID NO: 3253831 - DNA, 20 bp, Homo sapiens
taggctatttgtaaatctgc

SEQ ID NO: 3253832 - DNA, 11 bp, Homo sapiens
taggctctgca

SEQ ID NO: 3253833 - DNA, 15 bp, Homo sapiens
taggctcttaagcag

SEQ ID NO: 3253834 - DNA, 19 bp, Homo sapiens
taggctcttaagcagcatg

SEQ ID NO: 3253835 - DNA, 21 bp, Homo sapiens
taggctcttaagcagcatgga

SEQ ID NO: 3253836 - DNA, 21 bp, Homo sapiens
taggctcttatgtgtgccttt

SEQ ID NO: 3253837 - DNA, 19 bp, Homo sapiens
taggctgtaactactttat

SEQ ID NO: 3253838 - DNA, 20 bp, Homo sapiens
taggctgttccttgtactct

SEQ ID NO: 3253839 - DNA, 22 bp, Homo sapiens
taggctgttccttgtactctta

SEQ ID NO: 3253840 - DNA, 18 bp, Homo sapiens
taggcttatcaaaatctt

SEQ ID NO: 3253841 - DNA, 12 bp, Homo sapiens
taggcttttgtt

SEQ ID NO: 3253842 - DNA, 16 bp, Homo sapiens
tagggaaataataggg

SEQ ID NO: 3253843 - DNA, 19 bp, Homo sapiens
tagggaagctggcctgaga

SEQ ID NO: 3253844 - DNA, 20 bp, Homo sapiens
tagggactacccatagacat

SEQ ID NO: 3253845 - DNA, 16 bp, Homo sapiens
tagggagaaatgttgt

SEQ ID NO: 3253846 - DNA, 17 bp, Homo sapiens
tagggagccatttgaga

SEQ ID NO: 3253847 - DNA, 23 bp, Homo sapiens
tagggatcaaccagctaagaaaa

SEQ ID NO: 3253848 - DNA, 14 bp, Homo sapiens
tagggatgcctcct

SEQ ID NO: 3253849 - DNA, 15 bp, Homo sapiens
tagggcaattggaac

SEQ ID NO: 3253850 - DNA, 13 bp, Homo sapiens
tagggcactgggc

SEQ ID NO: 3253851 - DNA, 15 bp, Homo sapiens
tagggcactgggctg

SEQ ID NO: 3253852 - DNA, 15 bp, Homo sapiens
tagggcagcttgccc

SEQ ID NO: 3253853 - DNA, 14 bp, Homo sapiens
tagggctggaccta

SEQ ID NO: 3253854 - DNA, 13 bp, Homo sapiens
tagggcttttatt

SEQ ID NO: 3253855 - DNA, 18 bp, Homo sapiens
taggggaaggagaagtaa

SEQ ID NO: 3253856 - DNA, 18 bp, Homo sapiens
taggggatggtccaggat

SEQ ID NO: 3253857 - DNA, 14 bp, Homo sapiens
taggggccacctcc

SEQ ID NO: 3253858 - DNA, 16 bp, Homo sapiens
taggggccacctcctc

SEQ ID NO: 3253859 - DNA, 19 bp, Homo sapiens
taggggccacctcctcccc

SEQ ID NO: 3253860 - DNA, 14 bp, Homo sapiens
taggggtcaaagaa

SEQ ID NO: 3253861 - DNA, 17 bp, Homo sapiens
taggggtgaaggagggg

SEQ ID NO: 3253862 - DNA, 16 bp, Homo sapiens
tagggtacatttataa

SEQ ID NO: 3253863 - DNA, 19 bp, Homo sapiens
tagggtactaaatttaaat

SEQ ID NO: 3253864 - DNA, 18 bp, Homo sapiens
tagggtcagccattttta

SEQ ID NO: 3253865 - DNA, 15 bp, Homo sapiens
tagggtctcttcagg

SEQ ID NO: 3253866 - DNA, 19 bp, Homo sapiens
tagggtggctttaattgta

SEQ ID NO: 3253867 - DNA, 14 bp, Homo sapiens
taggtaaaatgtat

SEQ ID NO: 3253868 - DNA, 15 bp, Homo sapiens
taggtaaaatgtatt

SEQ ID NO: 3253869 - DNA, 15 bp, Homo sapiens
taggtaatgttttgt

SEQ ID NO: 3253870 - DNA, 17 bp, Homo sapiens
taggtaatgttttgtat

SEQ ID NO: 3253871 - DNA, 14 bp, Homo sapiens
taggtatttcaaaa

SEQ ID NO: 3253872 - DNA, 19 bp, Homo sapiens
taggtcactggctctccaa

SEQ ID NO: 3253873 - DNA, 12 bp, Homo sapiens
taggtcctcact

SEQ ID NO: 3253874 - DNA, 13 bp, Homo sapiens
taggtctcatctc

SEQ ID NO: 3253875 - DNA, 21 bp, Homo sapiens
taggtctcctcagggtggggg

SEQ ID NO: 3253876 - DNA, 16 bp, Homo sapiens
taggtgacagagtgag

SEQ ID NO: 3253877 - DNA, 15 bp, Homo sapiens
taggtgagaaaaaaa

SEQ ID NO: 3253878 - DNA, 17 bp, Homo sapiens
taggtgttcaggccagt

SEQ ID NO: 3253879 - DNA, 20 bp, Homo sapiens
taggttaaaaaaaaaagtca

SEQ ID NO: 3253880 - DNA, 13 bp, Homo sapiens
taggttatacaat

SEQ ID NO: 3253881 - DNA, 14 bp, Homo sapiens
taggttatacaata

SEQ ID NO: 3253882 - DNA, 21 bp, Homo sapiens
taggttatacaataacccagt

SEQ ID NO: 3253883 - DNA, 20 bp, Homo sapiens
taggttccctgttcttcctc

SEQ ID NO: 3253884 - DNA, 12 bp, Homo sapiens
taggttctaaaa

SEQ ID NO: 3253885 - DNA, 15 bp, Homo sapiens
taggttctaaagttc

SEQ ID NO: 3253886 - DNA, 16 bp, Homo sapiens
taggttctaaagttct

SEQ ID NO: 3253887 - DNA, 20 bp, Homo sapiens
taggttctaaagttctaaga

SEQ ID NO: 3253888 - DNA, 22 bp, Homo sapiens
taggttctaaagttctaagatt

SEQ ID NO: 3253889 - DNA, 15 bp, Homo sapiens
taggttcttaaggat

SEQ ID NO: 3253890 - DNA, 20 bp, Homo sapiens
taggttgccaataatacact

SEQ ID NO: 3253891 - DNA, 21 bp, Homo sapiens
taggtttttcctactgtcctc

SEQ ID NO: 3253892 - DNA, 23 bp, Homo sapiens
tagtaaaaccttgttctattttt

SEQ ID NO: 3253893 - DNA, 21 bp, Homo sapiens
tagtaaaagtcataaatgcat

SEQ ID NO: 3253894 - DNA, 15 bp, Homo sapiens
tagtaaaatttattt

SEQ ID NO: 3253895 - DNA, 23 bp, Homo sapiens
tagtaacaatacatgagaaagat

SEQ ID NO: 3253896 - DNA, 12 bp, Homo sapiens
tagtaactgaca

SEQ ID NO: 3253897 - DNA, 21 bp, Homo sapiens
tagtaactgcctcagtgtttc

SEQ ID NO: 3253898 - DNA, 11 bp, Homo sapiens
tagtaagcata

SEQ ID NO: 3253899 - DNA, 12 bp, Homo sapiens
tagtaagcatag

SEQ ID NO: 3253900 - DNA, 16 bp, Homo sapiens
tagtaagcatagaaac

SEQ ID NO: 3253901 - DNA, 17 bp, Homo sapiens
tagtaagtaattatgca

SEQ ID NO: 3253902 - DNA, 16 bp, Homo sapiens
tagtaagttaatgtat

SEQ ID NO: 3253903 - DNA, 20 bp, Homo sapiens
tagtaatagagcaaaattga

SEQ ID NO: 3253904 - DNA, 13 bp, Homo sapiens
tagtaatggcaga

SEQ ID NO: 3253905 - DNA, 15 bp, Homo sapiens
tagtaatggcagagc

SEQ ID NO: 3253906 - DNA, 14 bp, Homo sapiens
tagtaattgacatg

SEQ ID NO: 3253907 - DNA, 24 bp, Homo sapiens
tagtaatttattgtctgtctacat

SEQ ID NO: 3253908 - DNA, 23 bp, Homo sapiens
tagtaccaatcattttaattatt

SEQ ID NO: 3253909 - DNA, 18 bp, Homo sapiens
tagtaccatttatacaaa

SEQ ID NO: 3253910 - DNA, 19 bp, Homo sapiens
tagtaccctatagagaggg

SEQ ID NO: 3253911 - DNA, 22 bp, Homo sapiens
tagtaccctatagagagggggc

SEQ ID NO: 3253912 - DNA, 19 bp, Homo sapiens
tagtactccttaagaacac

SEQ ID NO: 3253913 - DNA, 15 bp, Homo sapiens
tagtactgtattggc

SEQ ID NO: 3253914 - DNA, 14 bp, Homo sapiens
tagtacttattaca

SEQ ID NO: 3253915 - DNA, 14 bp, Homo sapiens
tagtagagacaggg

SEQ ID NO: 3253916 - DNA, 22 bp, Homo sapiens
tagtagagacagggttttgcca

SEQ ID NO: 3253917 - DNA, 14 bp, Homo sapiens
tagtagcatgttga

SEQ ID NO: 3253918 - DNA, 16 bp, Homo sapiens
tagtagccctttctgt

SEQ ID NO: 3253919 - DNA, 17 bp, Homo sapiens
tagtagccctttctgtg

SEQ ID NO: 3253920 - DNA, 18 bp, Homo sapiens
tagtagccctttctgtgt

SEQ ID NO: 3253921 - DNA, 20 bp, Homo sapiens
tagtatagccacaaatgcct

SEQ ID NO: 3253922 - DNA, 13 bp, Homo sapiens
tagtatcagtgtt

SEQ ID NO: 3253923 - DNA, 21 bp, Homo sapiens
tagtatcagtgttttaaattc

SEQ ID NO: 3253924 - DNA, 16 bp, Homo sapiens
tagtatggtggctggg

SEQ ID NO: 3253925 - DNA, 19 bp, Homo sapiens
tagtatggttcaagattgt

SEQ ID NO: 3253926 - DNA, 11 bp, Homo sapiens
tagtatgtctg

SEQ ID NO: 3253927 - DNA, 19 bp, Homo sapiens
tagtatgtctgtttttgta

SEQ ID NO: 3253928 - DNA, 20 bp, Homo sapiens
tagtatgtctgtttttgtat

SEQ ID NO: 3253929 - DNA, 23 bp, Homo sapiens
tagtatgtgacttttctgattaa

SEQ ID NO: 3253930 - DNA, 18 bp, Homo sapiens
tagtattaaaagttgcat

SEQ ID NO: 3253931 - DNA, 22 bp, Homo sapiens
tagtattatcttgttcaggaaa

SEQ ID NO: 3253932 - DNA, 18 bp, Homo sapiens
tagtatttctcctttgca

SEQ ID NO: 3253933 - DNA, 21 bp, Homo sapiens
tagtatttttactattataat

SEQ ID NO: 3253934 - DNA, 15 bp, Homo sapiens
tagtatttttatcca

SEQ ID NO: 3253935 - DNA, 19 bp, Homo sapiens
tagtattttttgtataatt

SEQ ID NO: 3253936 - DNA, 21 bp, Homo sapiens
tagtcaaaactatttttgtaa

SEQ ID NO: 3253937 - DNA, 16 bp, Homo sapiens
tagtcaaattatgtat

SEQ ID NO: 3253938 - DNA, 22 bp, Homo sapiens
tagtcaatgtaaaaatacacta

SEQ ID NO: 3253939 - DNA, 23 bp, Homo sapiens
tagtcacatggcctatgcacata

SEQ ID NO: 3253940 - DNA, 19 bp, Homo sapiens
tagtcaccccaagtagtct

SEQ ID NO: 3253941 - DNA, 14 bp, Homo sapiens
tagtcattcttccc

SEQ ID NO: 3253942 - DNA, 21 bp, Homo sapiens
tagtccaaatgtgatcaactg

SEQ ID NO: 3253943 - DNA, 19 bp, Homo sapiens
tagtccacggacccccaga

SEQ ID NO: 3253944 - DNA, 23 bp, Homo sapiens
tagtcccagctacttgggaggct

SEQ ID NO: 3253945 - DNA, 21 bp, Homo sapiens
tagtccccctgttttctgttt

SEQ ID NO: 3253946 - DNA, 14 bp, Homo sapiens
tagtcctattctat

SEQ ID NO: 3253947 - DNA, 12 bp, Homo sapiens
tagtcctgtact

SEQ ID NO: 3253948 - DNA, 10 bp, Homo sapiens
tatacatttg

SEQ ID NO: 3253949 - DNA, 17 bp, Homo sapiens
tatacatttgttggtaa

SEQ ID NO: 3253950 - DNA, 22 bp, Homo sapiens
tatacattttgttatagaatac

SEQ ID NO: 3253951 - DNA, 16 bp, Homo sapiens
tataccaaattaaaaa

SEQ ID NO: 3253952 - DNA, 14 bp, Homo sapiens
tataccagcagaaa

SEQ ID NO: 3253953 - DNA, 18 bp, Homo sapiens
tataccatttcctcagct

SEQ ID NO: 3253954 - DNA, 17 bp, Homo sapiens
tatacctataatgtgtg

SEQ ID NO: 3253955 - DNA, 17 bp, Homo sapiens
tatacctcatttttcat

SEQ ID NO: 3253956 - DNA, 20 bp, Homo sapiens
tatacctggcttttacttta

SEQ ID NO: 3253957 - DNA, 18 bp, Homo sapiens
tatactaaaccaactcta

SEQ ID NO: 3253958 - DNA, 22 bp, Homo sapiens
tatactccagtgtacatagtgt

SEQ ID NO: 3253959 - DNA, 22 bp, Homo sapiens
tatactctttctgtatatactt

SEQ ID NO: 3253960 - DNA, 12 bp, Homo sapiens
tatactgaagga

SEQ ID NO: 3253961 - DNA, 13 bp, Homo sapiens
tatactgcagctt

SEQ ID NO: 3253962 - DNA, 14 bp, Homo sapiens
tatactgcagcttt

SEQ ID NO: 3253963 - DNA, 12 bp, Homo sapiens
tatactgcatac

SEQ ID NO: 3253964 - DNA, 15 bp, Homo sapiens
tatactgggtttcaa

SEQ ID NO: 3253965 - DNA, 16 bp, Homo sapiens
tatactgtatttctaa

SEQ ID NO: 3253966 - DNA, 18 bp, Homo sapiens
tatactgtgtgcttgttt

SEQ ID NO: 3253967 - DNA, 15 bp, Homo sapiens
tatacttgactctaa

SEQ ID NO: 3253968 - DNA, 18 bp, Homo sapiens
tatacttgactctaatat

SEQ ID NO: 3253969 - DNA, 20 bp, Homo sapiens
tatacttgactctaatatga

SEQ ID NO: 3253970 - DNA, 20 bp, Homo sapiens
tatacttttcccctgttaaa

SEQ ID NO: 3253971 - DNA, 23 bp, Homo sapiens
tatacttttcccctgttaaacag

SEQ ID NO: 3253972 - DNA, 21 bp, Homo sapiens
tatacttttttcttatttaac

SEQ ID NO: 3253973 - DNA, 23 bp, Homo sapiens
tatagaaaaataaaaatctcttt

SEQ ID NO: 3253974 - DNA, 15 bp, Homo sapiens
tatagaatatttatt

SEQ ID NO: 3253975 - DNA, 21 bp, Homo sapiens
tatagaatatttattacctct

SEQ ID NO: 3253976 - DNA, 11 bp, Homo sapiens
tatagactcta

SEQ ID NO: 3253977 - DNA, 23 bp, Homo sapiens
tatagagaaaaactttcattttt

SEQ ID NO: 3253978 - DNA, 16 bp, Homo sapiens
tatagagatgcattca

SEQ ID NO: 3253979 - DNA, 16 bp, Homo sapiens
tatagagttcatccca

SEQ ID NO: 3253980 - DNA, 20 bp, Homo sapiens
tatagatataatgaacaaaa

SEQ ID NO: 3253981 - DNA, 22 bp, Homo sapiens
tatagatgcaagatatttatat

SEQ ID NO: 3253982 - DNA, 22 bp, Homo sapiens
tatagcactttgaaatacctca

SEQ ID NO: 3253983 - DNA, 22 bp, Homo sapiens
tatagcagcaaaaatataaaat

SEQ ID NO: 3253984 - DNA, 17 bp, Homo sapiens
tatagcattgataatct

SEQ ID NO: 3253985 - DNA, 18 bp, Homo sapiens
tatagccaactgctaatg

SEQ ID NO: 3253986 - DNA, 19 bp, Homo sapiens
tatagccaactgctaatgc

SEQ ID NO: 3253987 - DNA, 18 bp, Homo sapiens
tatagcctaggtgacaga

SEQ ID NO: 3253988 - DNA, 13 bp, Homo sapiens
tatagcctgcctc

SEQ ID NO: 3253989 - DNA, 14 bp, Homo sapiens
tatagcctgcctca

SEQ ID NO: 3253990 - DNA, 22 bp, Homo sapiens
tatagctattactgtctggttt

SEQ ID NO: 3253991 - DNA, 15 bp, Homo sapiens
tatagcttgcagaac

SEQ ID NO: 3253992 - DNA, 19 bp, Homo sapiens
tataggaacatatgaaaat

SEQ ID NO: 3253993 - DNA, 12 bp, Homo sapiens
tataggagagga

SEQ ID NO: 3253994 - DNA, 19 bp, Homo sapiens
tataggccagggcatgtgt

SEQ ID NO: 3253995 - DNA, 23 bp, Homo sapiens
tataggccagggcatgtgtatgt

SEQ ID NO: 3253996 - DNA, 20 bp, Homo sapiens
tataggtctcttctcccaga

SEQ ID NO: 3253997 - DNA, 17 bp, Homo sapiens
tataggtgatgtttgct

SEQ ID NO: 3253998 - DNA, 20 bp, Homo sapiens
tataggtgatgtttgctctt

SEQ ID NO: 3253999 - DNA, 21 bp, Homo sapiens
tataggtgttggttttggggg

SEQ ID NO: 3254000 - DNA, 20 bp, Homo sapiens
tataggtttttctcatgtat

SEQ ID NO: 3254001 - DNA, 13 bp, Homo sapiens
tatagtatatctg

SEQ ID NO: 3254002 - DNA, 18 bp, Homo sapiens
tatagtatatctggacaa

SEQ ID NO: 3254003 - DNA, 13 bp, Homo sapiens
tatagtatctgta

SEQ ID NO: 3254004 - DNA, 15 bp, Homo sapiens
tatagtatctgtata

SEQ ID NO: 3254005 - DNA, 16 bp, Homo sapiens
tatagtcaatgtaaaa

SEQ ID NO: 3254006 - DNA, 22 bp, Homo sapiens
tatagtcatttattttaaaaaa

SEQ ID NO: 3254007 - DNA, 16 bp, Homo sapiens
tatagttaatattttg

SEQ ID NO: 3254008 - DNA, 22 bp, Homo sapiens
tatagttactgtgtaattagtg

SEQ ID NO: 3254009 - DNA, 16 bp, Homo sapiens
tatagttatacatcaa

SEQ ID NO: 3254010 - DNA, 22 bp, Homo sapiens
tatagttcctaagaagcttcta

SEQ ID NO: 3254011 - DNA, 23 bp, Homo sapiens
tatagttcctaagaagcttctaa

SEQ ID NO: 3254012 - DNA, 15 bp, Homo sapiens
tatagttctagacat

SEQ ID NO: 3254013 - DNA, 12 bp, Homo sapiens
tatagttctagg

SEQ ID NO: 3254014 - DNA, 18 bp, Homo sapiens
tatagttgttttatatgt

SEQ ID NO: 3254015 - DNA, 14 bp, Homo sapiens
tatagtttaaaaca

SEQ ID NO: 3254016 - DNA, 13 bp, Homo sapiens
tatagtttcagat

SEQ ID NO: 3254017 - DNA, 22 bp, Homo sapiens
tatagtttcagatatatatcat

SEQ ID NO: 3254018 - DNA, 22 bp, Homo sapiens
tatagtttctgaggctttatga

SEQ ID NO: 3254019 - DNA, 16 bp, Homo sapiens
tatagttttactttta

SEQ ID NO: 3254020 - DNA, 17 bp, Homo sapiens
tatagttttacttttaa

SEQ ID NO: 3254021 - DNA, 14 bp, Homo sapiens
tatataaaaatata

SEQ ID NO: 3254022 - DNA, 15 bp, Homo sapiens
tatataaaaatatat

SEQ ID NO: 3254023 - DNA, 13 bp, Homo sapiens
tatataaaataac

SEQ ID NO: 3254024 - DNA, 16 bp, Homo sapiens
tatataaaatatctat

SEQ ID NO: 3254025 - DNA, 22 bp, Homo sapiens
tatataaacagaactcccttca

SEQ ID NO: 3254026 - DNA, 19 bp, Homo sapiens
tatataaagaatatatata

SEQ ID NO: 3254027 - DNA, 16 bp, Homo sapiens
tatataattctgtaca

SEQ ID NO: 3254028 - DNA, 22 bp, Homo sapiens
tatataatttttttatgttttg

SEQ ID NO: 3254029 - DNA, 13 bp, Homo sapiens
tatatacacatat

SEQ ID NO: 3254030 - DNA, 17 bp, Homo sapiens
tatatacagtaacttta

SEQ ID NO: 3254031 - DNA, 21 bp, Homo sapiens
tatatacagttattttggata

SEQ ID NO: 3254032 - DNA, 23 bp, Homo sapiens
tatatacatacacttgtataaat

SEQ ID NO: 3254033 - DNA, 15 bp, Homo sapiens
tatatacatatatat

SEQ ID NO: 3254034 - DNA, 16 bp, Homo sapiens
tatatacatatatatt

SEQ ID NO: 3254035 - DNA, 14 bp, Homo sapiens
tatatacatatgta

SEQ ID NO: 3254036 - DNA, 16 bp, Homo sapiens
tatatacatatgtaga

SEQ ID NO: 3254037 - DNA, 13 bp, Homo sapiens
tatatacatgtgt

SEQ ID NO: 3254038 - DNA, 14 bp, Homo sapiens
tatatacatgtgtg

SEQ ID NO: 3254039 - DNA, 17 bp, Homo sapiens
tatatacatgtgtgtat

SEQ ID NO: 3254040 - DNA, 18 bp, Homo sapiens
tatatacgcatctataaa

SEQ ID NO: 3254041 - DNA, 17 bp, Homo sapiens
tatataggttgtgcaaa

SEQ ID NO: 3254042 - DNA, 14 bp, Homo sapiens
tatatagtgctata

SEQ ID NO: 3254043 - DNA, 12 bp, Homo sapiens
tatatataaaat

SEQ ID NO: 3254044 - DNA, 14 bp, Homo sapiens
tatatataaaatat

SEQ ID NO: 3254045 - DNA, 12 bp, Homo sapiens
tatatataaaga

SEQ ID NO: 3254046 - DNA, 13 bp, Homo sapiens
tatatataaagta

SEQ ID NO: 3254047 - DNA, 15 bp, Homo sapiens
tatatataaagtata

SEQ ID NO: 3254048 - DNA, 13 bp, Homo sapiens
tatatataaatgt

SEQ ID NO: 3254049 - DNA, 22 bp, Homo sapiens
tatatatacatacacttgtata

SEQ ID NO: 3254050 - DNA, 12 bp, Homo sapiens
tatatatataaa

SEQ ID NO: 3254051 - DNA, 13 bp, Homo sapiens
tatatatataaaa

SEQ ID NO: 3254052 - DNA, 11 bp, Homo sapiens
tatatatatat

SEQ ID NO: 3254053 - DNA, 15 bp, Homo sapiens
tatatatatataaag

SEQ ID NO: 3254054 - DNA, 13 bp, Homo sapiens
tatatatatatat

SEQ ID NO: 3254055 - DNA, 19 bp, Homo sapiens
tatatatctgcttcagtgg

SEQ ID NO: 3254056 - DNA, 21 bp, Homo sapiens
tatatatctgcttcagtggag

SEQ ID NO: 3254057 - DNA, 14 bp, Homo sapiens
tatatatgatcatt

SEQ ID NO: 3254058 - DNA, 20 bp, Homo sapiens
tatatatgatcattgaaata

SEQ ID NO: 3254059 - DNA, 21 bp, Homo sapiens
tatatatgcacttaatttgtt

SEQ ID NO: 3254060 - DNA, 19 bp, Homo sapiens
tatatatgtgtatatatac

SEQ ID NO: 3254061 - DNA, 22 bp, Homo sapiens
tatatatgtgtatatatacata

SEQ ID NO: 3254062 - DNA, 23 bp, Homo sapiens
tatatatgtgtatatatacatac

SEQ ID NO: 3254063 - DNA, 16 bp, Homo sapiens
tatatatgtgtatgta

SEQ ID NO: 3254064 - DNA, 23 bp, Homo sapiens
tatatattaggatctgcaaacaa

SEQ ID NO: 3254065 - DNA, 21 bp, Homo sapiens
tatatattatgtgaagaattt

SEQ ID NO: 3254066 - DNA, 14 bp, Homo sapiens
tatatattctatta

SEQ ID NO: 3254067 - DNA, 20 bp, Homo sapiens
tatatattcttataaaaatg

SEQ ID NO: 3254068 - DNA, 19 bp, Homo sapiens
tatatatttctaactatat

SEQ ID NO: 3254069 - DNA, 13 bp, Homo sapiens
tatatatttctat

SEQ ID NO: 3254070 - DNA, 17 bp, Homo sapiens
tatatatttctattatt

SEQ ID NO: 3254071 - DNA, 18 bp, Homo sapiens
tatatattttgtgtgaaa

SEQ ID NO: 3254072 - DNA, 13 bp, Homo sapiens
tatatcagaaaag

SEQ ID NO: 3254073 - DNA, 23 bp, Homo sapiens
tatatcagcctgagtctcctgtg

SEQ ID NO: 3254074 - DNA, 15 bp, Homo sapiens
tatatcatatgtata

SEQ ID NO: 3254075 - DNA, 15 bp, Homo sapiens
tatatcattctacag

SEQ ID NO: 3254076 - DNA, 20 bp, Homo sapiens
tatatccaaaagctttttat

SEQ ID NO: 3254077 - DNA, 14 bp, Homo sapiens
tatatccatgtact

SEQ ID NO: 3254078 - DNA, 18 bp, Homo sapiens
tatatccatgtactgtag

SEQ ID NO: 3254079 - DNA, 14 bp, Homo sapiens
tatatcccagaaat

SEQ ID NO: 3254080 - DNA, 14 bp, Homo sapiens
tatatcctgtgact

SEQ ID NO: 3254081 - DNA, 21 bp, Homo sapiens
tatatctatatataattctgt

SEQ ID NO: 3254082 - DNA, 22 bp, Homo sapiens
tatatgaaaacaagttccaaat

SEQ ID NO: 3254083 - DNA, 13 bp, Homo sapiens
tatatgaacatag

SEQ ID NO: 3254084 - DNA, 21 bp, Homo sapiens
tatatgatttatagtttgtac

SEQ ID NO: 3254085 - DNA, 18 bp, Homo sapiens
tatatgcctttttcctag

SEQ ID NO: 3254086 - DNA, 18 bp, Homo sapiens
tagattcaagttgtgtct

SEQ ID NO: 3254087 - DNA, 12 bp, Homo sapiens
tagattctaaag

SEQ ID NO: 3254088 - DNA, 13 bp, Homo sapiens
tagattctaaaga

SEQ ID NO: 3254089 - DNA, 14 bp, Homo sapiens
tagattctaaagat

SEQ ID NO: 3254090 - DNA, 22 bp, Homo sapiens
tagattctctggctgtaaggct

SEQ ID NO: 3254091 - DNA, 22 bp, Homo sapiens
tagattctctgtgtctaagatt

SEQ ID NO: 3254092 - DNA, 15 bp, Homo sapiens
tagattgagaaatgt

SEQ ID NO: 3254093 - DNA, 17 bp, Homo sapiens
tagatttaccctttata

SEQ ID NO: 3254094 - DNA, 20 bp, Homo sapiens
tagatttaccctttatagaa

SEQ ID NO: 3254095 - DNA, 22 bp, Homo sapiens
tagatttcatagttcagaattt

SEQ ID NO: 3254096 - DNA, 22 bp, Homo sapiens
tagatttctatgatcctttttt

SEQ ID NO: 3254097 - DNA, 13 bp, Homo sapiens
tagatttggaata

SEQ ID NO: 3254098 - DNA, 11 bp, Homo sapiens
tagatttgtcc

SEQ ID NO: 3254099 - DNA, 13 bp, Homo sapiens
tagatttgtcctt

SEQ ID NO: 3254100 - DNA, 23 bp, Homo sapiens
tagatttgtccttttatttctcc

SEQ ID NO: 3254101 - DNA, 16 bp, Homo sapiens
tagattttaatttatt

SEQ ID NO: 3254102 - DNA, 14 bp, Homo sapiens
tagattttctggtt

SEQ ID NO: 3254103 - DNA, 22 bp, Homo sapiens
tagattttctggttctaacatt

SEQ ID NO: 3254104 - DNA, 14 bp, Homo sapiens
tagcaaaaacatgt

SEQ ID NO: 3254105 - DNA, 23 bp, Homo sapiens
tagcaaaacgcatggagtgtgta

SEQ ID NO: 3254106 - DNA, 15 bp, Homo sapiens
tagcaaacagaggaa

SEQ ID NO: 3254107 - DNA, 11 bp, Homo sapiens
tagcaaagatt

SEQ ID NO: 3254108 - DNA, 17 bp, Homo sapiens
tagcaaagcaaaaggct

SEQ ID NO: 3254109 - DNA, 20 bp, Homo sapiens
tagcaaagcaaaaggctgag

SEQ ID NO: 3254110 - DNA, 12 bp, Homo sapiens
tagcaaatgcag

SEQ ID NO: 3254111 - DNA, 19 bp, Homo sapiens
tagcaaatgcagaaccaca

SEQ ID NO: 3254112 - DNA, 14 bp, Homo sapiens
tagcaaggctgggt

SEQ ID NO: 3254113 - DNA, 16 bp, Homo sapiens
tagcaattccatcacc

SEQ ID NO: 3254114 - DNA, 13 bp, Homo sapiens
tagcacaaaaaaa

SEQ ID NO: 3254115 - DNA, 18 bp, Homo sapiens
tagcacataaactttggg

SEQ ID NO: 3254116 - DNA, 15 bp, Homo sapiens
tagcacctttcaacc

SEQ ID NO: 3254117 - DNA, 20 bp, Homo sapiens
tagcacgtttaaagttctgt

SEQ ID NO: 3254118 - DNA, 20 bp, Homo sapiens
tagcactagacatgtcatgg

SEQ ID NO: 3254119 - DNA, 19 bp, Homo sapiens
tagcactcattttctataa

SEQ ID NO: 3254120 - DNA, 16 bp, Homo sapiens
tagcactgttgatgta

SEQ ID NO: 3254121 - DNA, 19 bp, Homo sapiens
tagcacttaaattcctcaa

SEQ ID NO: 3254122 - DNA, 17 bp, Homo sapiens
tagcactttcattgcca

SEQ ID NO: 3254123 - DNA, 14 bp, Homo sapiens
tagcactttgaaat

SEQ ID NO: 3254124 - DNA, 21 bp, Homo sapiens
tagcagaagaaaggaacattt

SEQ ID NO: 3254125 - DNA, 22 bp, Homo sapiens
tagcagaagaaaggaacattta

SEQ ID NO: 3254126 - DNA, 13 bp, Homo sapiens
tagcagacagaaa

SEQ ID NO: 3254127 - DNA, 15 bp, Homo sapiens
tagcagacagtgttt

SEQ ID NO: 3254128 - DNA, 16 bp, Homo sapiens
tagcagaggggccagg

SEQ ID NO: 3254129 - DNA, 17 bp, Homo sapiens
tagcagaggggccaggc

SEQ ID NO: 3254130 - DNA, 18 bp, Homo sapiens
tagcagaggggccaggcc

SEQ ID NO: 3254131 - DNA, 20 bp, Homo sapiens
tagcagaggggccaggccca

SEQ ID NO: 3254132 - DNA, 13 bp, Homo sapiens
tagcagagttaaa

SEQ ID NO: 3254133 - DNA, 16 bp, Homo sapiens
tagcagagttaaatct

SEQ ID NO: 3254134 - DNA, 12 bp, Homo sapiens
tagcagatggtt

SEQ ID NO: 3254135 - DNA, 21 bp, Homo sapiens
tagcagatggtttccacattt

SEQ ID NO: 3254136 - DNA, 14 bp, Homo sapiens
tagcagattttaat

SEQ ID NO: 3254137 - DNA, 17 bp, Homo sapiens
tagcagcaaaaatataa

SEQ ID NO: 3254138 - DNA, 14 bp, Homo sapiens
tagcagcacctcct

SEQ ID NO: 3254139 - DNA, 12 bp, Homo sapiens
tagcagcctttc

SEQ ID NO: 3254140 - DNA, 16 bp, Homo sapiens
tagcagcctttctctc

SEQ ID NO: 3254141 - DNA, 12 bp, Homo sapiens
tagcagctggac

SEQ ID NO: 3254142 - DNA, 15 bp, Homo sapiens
tagcagcttccagat

SEQ ID NO: 3254143 - DNA, 23 bp, Homo sapiens
tagcagtccaaagaacaagaaat

SEQ ID NO: 3254144 - DNA, 23 bp, Homo sapiens
tagcagtcgcgagcacatgttca

SEQ ID NO: 3254145 - DNA, 13 bp, Homo sapiens
tagcagttataac

SEQ ID NO: 3254146 - DNA, 15 bp, Homo sapiens
tagcataaataaaac

SEQ ID NO: 3254147 - DNA, 17 bp, Homo sapiens
tagcataaataaaactg

SEQ ID NO: 3254148 - DNA, 22 bp, Homo sapiens
tagcatattcttttctgcaaaa

SEQ ID NO: 3254149 - DNA, 21 bp, Homo sapiens
tagcatgggtccaagagacat

SEQ ID NO: 3254150 - DNA, 20 bp, Homo sapiens
tagcatgttgagccaggcct

SEQ ID NO: 3254151 - DNA, 12 bp, Homo sapiens
tagcattaacta

SEQ ID NO: 3254152 - DNA, 22 bp, Homo sapiens
tagcattaccatgagtgaattt

SEQ ID NO: 3254153 - DNA, 15 bp, Homo sapiens
tagcattatgcaatt

SEQ ID NO: 3254154 - DNA, 16 bp, Homo sapiens
tagcattatgcaatta

SEQ ID NO: 3254155 - DNA, 16 bp, Homo sapiens
tagcattgataatctt

SEQ ID NO: 3254156 - DNA, 19 bp, Homo sapiens
tagcattgataatcttcag

SEQ ID NO: 3254157 - DNA, 20 bp, Homo sapiens
tagcattgataatcttcagg

SEQ ID NO: 3254158 - DNA, 21 bp, Homo sapiens
tagcattgtcttgttctgtcc

SEQ ID NO: 3254159 - DNA, 13 bp, Homo sapiens
tagcatttcattc

SEQ ID NO: 3254160 - DNA, 16 bp, Homo sapiens
tagcatttcattcttc

SEQ ID NO: 3254161 - DNA, 18 bp, Homo sapiens
tagcatttcattcttctc

SEQ ID NO: 3254162 - DNA, 13 bp, Homo sapiens
tagcatttcttga

SEQ ID NO: 3254163 - DNA, 21 bp, Homo sapiens
tagcatttttccaacacacac

SEQ ID NO: 3254164 - DNA, 22 bp, Homo sapiens
tagcatttttccaacacacaca

SEQ ID NO: 3254165 - DNA, 14 bp, Homo sapiens
tagccaacatagta

SEQ ID NO: 3254166 - DNA, 23 bp, Homo sapiens
tagccaaggtgggctgagccctg

SEQ ID NO: 3254167 - DNA, 19 bp, Homo sapiens
tagccaatattaaaagaga

SEQ ID NO: 3254168 - DNA, 21 bp, Homo sapiens
tagccaatattaaaagagacc

SEQ ID NO: 3254169 - DNA, 14 bp, Homo sapiens
tagccaatgtggga

SEQ ID NO: 3254170 - DNA, 17 bp, Homo sapiens
tagccacaaatgccttg

SEQ ID NO: 3254171 - DNA, 23 bp, Homo sapiens
tagccacaaatgccttgaactgt

SEQ ID NO: 3254172 - DNA, 16 bp, Homo sapiens
tagccacatttggaat

SEQ ID NO: 3254173 - DNA, 21 bp, Homo sapiens
tagccacatttggaatacttt

SEQ ID NO: 3254174 - DNA, 19 bp, Homo sapiens
tagccaccccagaaatggt

SEQ ID NO: 3254175 - DNA, 15 bp, Homo sapiens
tagccagagaggagc

SEQ ID NO: 3254176 - DNA, 17 bp, Homo sapiens
tagccagagaggagcac

SEQ ID NO: 3254177 - DNA, 18 bp, Homo sapiens
tagccaggagtctgtgct

SEQ ID NO: 3254178 - DNA, 18 bp, Homo sapiens
tagccaggatcatggtgt

SEQ ID NO: 3254179 - DNA, 20 bp, Homo sapiens
tagccagtgaaacacttgct

SEQ ID NO: 3254180 - DNA, 12 bp, Homo sapiens
tagccagtgact

SEQ ID NO: 3254181 - DNA, 23 bp, Homo sapiens
tagccagtgactttttctgagct

SEQ ID NO: 3254182 - DNA, 22 bp, Homo sapiens
tagccagttcaaagtgtatatt

SEQ ID NO: 3254183 - DNA, 23 bp, Homo sapiens
tagccatggctcaggcaagcccc

SEQ ID NO: 3254184 - DNA, 19 bp, Homo sapiens
tagccattcctggtaccca

SEQ ID NO: 3254185 - DNA, 17 bp, Homo sapiens
tagccattcttttccca

SEQ ID NO: 3254186 - DNA, 15 bp, Homo sapiens
tagcccaagaggtct

SEQ ID NO: 3254187 - DNA, 15 bp, Homo sapiens
tagcccaaggctcag

SEQ ID NO: 3254188 - DNA, 15 bp, Homo sapiens
tagcccaccctgctg

SEQ ID NO: 3254189 - DNA, 17 bp, Homo sapiens
tagcccagcgctctgcc

SEQ ID NO: 3254190 - DNA, 13 bp, Homo sapiens
tagcccaggagag

SEQ ID NO: 3254191 - DNA, 15 bp, Homo sapiens
tagcccaggagagag

SEQ ID NO: 3254192 - DNA, 22 bp, Homo sapiens
tagcccaggagagagaaagcca

SEQ ID NO: 3254193 - DNA, 15 bp, Homo sapiens
tagcccatccctgcc

SEQ ID NO: 3254194 - DNA, 18 bp, Homo sapiens
tagcccatccctgcctgg

SEQ ID NO: 3254195 - DNA, 22 bp, Homo sapiens
tagccccagagatgccagccct

SEQ ID NO: 3254196 - DNA, 15 bp, Homo sapiens
tagccccctggcctc

SEQ ID NO: 3254197 - DNA, 16 bp, Homo sapiens
tagccccctggcctct

SEQ ID NO: 3254198 - DNA, 15 bp, Homo sapiens
tagccccggcccccc

SEQ ID NO: 3254199 - DNA, 12 bp, Homo sapiens
tagccctcagtc

SEQ ID NO: 3254200 - DNA, 15 bp, Homo sapiens
tagccgatggaaaat

SEQ ID NO: 3254201 - DNA, 21 bp, Homo sapiens
tagccgcaccctgcacctgct

SEQ ID NO: 3254202 - DNA, 19 bp, Homo sapiens
tagccgtccatggcaccag

SEQ ID NO: 3254203 - DNA, 16 bp, Homo sapiens
tagccttgatttgttc

SEQ ID NO: 3254204 - DNA, 14 bp, Homo sapiens
tagcctttgccctg

SEQ ID NO: 3254205 - DNA, 15 bp, Homo sapiens
tagcctttgccctgt

SEQ ID NO: 3254206 - DNA, 14 bp, Homo sapiens
tagccttttgtaac

SEQ ID NO: 3254207 - DNA, 15 bp, Homo sapiens
tagcctttttgtata

SEQ ID NO: 3254208 - DNA, 17 bp, Homo sapiens
tagcctttttgtataaa

SEQ ID NO: 3254209 - DNA, 16 bp, Homo sapiens
tagcgatctctcctgg

SEQ ID NO: 3254210 - DNA, 14 bp, Homo sapiens
tagcgcccagttgg

SEQ ID NO: 3254211 - DNA, 15 bp, Homo sapiens
tagcggagcccagcc

SEQ ID NO: 3254212 - DNA, 18 bp, Homo sapiens
tagcgtgggttatcagtt

SEQ ID NO: 3254213 - DNA, 19 bp, Homo sapiens
tagctaaacggattccaaa

SEQ ID NO: 3254214 - DNA, 15 bp, Homo sapiens
tagctacaggaagca

SEQ ID NO: 3254215 - DNA, 15 bp, Homo sapiens
tagctacagtgcata

SEQ ID NO: 3254216 - DNA, 18 bp, Homo sapiens
tagctactgtatgcaaag

SEQ ID NO: 3254217 - DNA, 16 bp, Homo sapiens
tagctatatccatgta

SEQ ID NO: 3254218 - DNA, 22 bp, Homo sapiens
tagctatatccatgtactgtag

SEQ ID NO: 3254219 - DNA, 15 bp, Homo sapiens
tagctatatctatat

SEQ ID NO: 3254220 - DNA, 17 bp, Homo sapiens
tagctatatctatatat

SEQ ID NO: 3254221 - DNA, 13 bp, Homo sapiens
tagctattactgt

SEQ ID NO: 3254222 - DNA, 15 bp, Homo sapiens
tagctcaagtttaaa

SEQ ID NO: 3254223 - DNA, 16 bp, Homo sapiens
tagctcaggtgtccct

SEQ ID NO: 3254224 - DNA, 20 bp, Homo sapiens
tagctcaggtgtccctgcac

SEQ ID NO: 3254225 - DNA, 21 bp, Homo sapiens
tagctcaggtgtccctgcact

SEQ ID NO: 3254226 - DNA, 13 bp, Homo sapiens
tagctcccagcta

SEQ ID NO: 3254227 - DNA, 19 bp, Homo sapiens
tagctcccagctagggggc

SEQ ID NO: 3254228 - DNA, 24 bp, Homo sapiens
tagctcctctccctcacaagcgct

SEQ ID NO: 3254229 - DNA, 16 bp, Homo sapiens
tagctcctgtggcccc

SEQ ID NO: 3254230 - DNA, 19 bp, Homo sapiens
tagctccttggagcaggca

SEQ ID NO: 3254231 - DNA, 21 bp, Homo sapiens
tagctctaggagggctggcaa

SEQ ID NO: 3254232 - DNA, 17 bp, Homo sapiens
tagctctattttaaagt

SEQ ID NO: 3254233 - DNA, 15 bp, Homo sapiens
tagctctctaggcct

SEQ ID NO: 3254234 - DNA, 11 bp, Homo sapiens
tagctctgggg

SEQ ID NO: 3254235 - DNA, 12 bp, Homo sapiens
tagctctggggg

SEQ ID NO: 3254236 - DNA, 17 bp, Homo sapiens
tagctgaaacaaaaatg

SEQ ID NO: 3254237 - DNA, 14 bp, Homo sapiens
tagctgatgaaact

SEQ ID NO: 3254238 - DNA, 15 bp, Homo sapiens
tagctggcaggacac

SEQ ID NO: 3254239 - DNA, 22 bp, Homo sapiens
tagctggctctgtgagggtgct

SEQ ID NO: 3254240 - DNA, 20 bp, Homo sapiens
tagctgggactacaggcacc

SEQ ID NO: 3254241 - DNA, 14 bp, Homo sapiens
tagctggggcttca

SEQ ID NO: 3254242 - DNA, 19 bp, Homo sapiens
tagctggggcttcaccagt

SEQ ID NO: 3254243 - DNA, 22 bp, Homo sapiens
tagctggtttcctcattcctga

SEQ ID NO: 3254244 - DNA, 17 bp, Homo sapiens
tagctgtaagggcagtg

SEQ ID NO: 3254245 - DNA, 21 bp, Homo sapiens
tagctgtaagggcagtgccca

SEQ ID NO: 3254246 - DNA, 23 bp, Homo sapiens
tagctgtaagggcagtgcccatg

SEQ ID NO: 3254247 - DNA, 23 bp, Homo sapiens
tagctgtacttcttgaatataaa

SEQ ID NO: 3254248 - DNA, 15 bp, Homo sapiens
tagctgtctagagta

SEQ ID NO: 3254249 - DNA, 10 bp, Homo sapiens
tagctgtggg

SEQ ID NO: 3254250 - DNA, 22 bp, Homo sapiens
tagctgtgtgaatacctgctca

SEQ ID NO: 3254251 - DNA, 17 bp, Homo sapiens
tagctgttgagctgttt

SEQ ID NO: 3254252 - DNA, 19 bp, Homo sapiens
tagcttaactaatttgaat

SEQ ID NO: 3254253 - DNA, 21 bp, Homo sapiens
tagcttacagtcaattttaca

SEQ ID NO: 3254254 - DNA, 16 bp, Homo sapiens
tagcttacctgacaca

SEQ ID NO: 3254255 - DNA, 14 bp, Homo sapiens
tagcttatctttct

SEQ ID NO: 3254256 - DNA, 20 bp, Homo sapiens
tagcttatctttctttccat

SEQ ID NO: 3254257 - DNA, 15 bp, Homo sapiens
tagcttctgcttttc

SEQ ID NO: 3254258 - DNA, 16 bp, Homo sapiens
tagcttctgcttttct

SEQ ID NO: 3254259 - DNA, 16 bp, Homo sapiens
tagctttagaccctgg

SEQ ID NO: 3254260 - DNA, 18 bp, Homo sapiens
tagctttagaccctgggt

SEQ ID NO: 3254261 - DNA, 20 bp, Homo sapiens
tagctttattttttaagtat

SEQ ID NO: 3254262 - DNA, 13 bp, Homo sapiens
tagctttcctggt

SEQ ID NO: 3254263 - DNA, 15 bp, Homo sapiens
tagctttttaaaaca

SEQ ID NO: 3254264 - DNA, 18 bp, Homo sapiens
tagctttttaaaacatta

SEQ ID NO: 3254265 - DNA, 20 bp, Homo sapiens
tagctttttaattaagcaaa

SEQ ID NO: 3254266 - DNA, 20 bp, Homo sapiens
taggaaaaaaactgggataa

SEQ ID NO: 3254267 - DNA, 22 bp, Homo sapiens
taggaaaaaaactgggataact

SEQ ID NO: 3254268 - DNA, 19 bp, Homo sapiens
taggaaaagtacatttaat

SEQ ID NO: 3254269 - DNA, 21 bp, Homo sapiens
taggaaaatcatgtgctcaga

SEQ ID NO: 3254270 - DNA, 17 bp, Homo sapiens
taggaaataaaaccttt

SEQ ID NO: 3254271 - DNA, 22 bp, Homo sapiens
taggaaatggctttgtgattca

SEQ ID NO: 3254272 - DNA, 16 bp, Homo sapiens
taggaacttcagagat

SEQ ID NO: 3254273 - DNA, 20 bp, Homo sapiens
taggaagaagtggtactagt

SEQ ID NO: 3254274 - DNA, 15 bp, Homo sapiens
taggaaggttaatgt

SEQ ID NO: 3254275 - DNA, 18 bp, Homo sapiens
taggaagtgtaacagctg

SEQ ID NO: 3254276 - DNA, 21 bp, Homo sapiens
taggaagtgtaacagctgagg

SEQ ID NO: 3254277 - DNA, 16 bp, Homo sapiens
taggaagttttctgta

SEQ ID NO: 3254278 - DNA, 17 bp, Homo sapiens
taggaagttttctgtag

SEQ ID NO: 3254279 - DNA, 18 bp, Homo sapiens
taggaatagaggaagaaa

SEQ ID NO: 3254280 - DNA, 18 bp, Homo sapiens
taggaattaagttatctt

SEQ ID NO: 3254281 - DNA, 17 bp, Homo sapiens
taggaattcatcttttg

SEQ ID NO: 3254282 - DNA, 18 bp, Homo sapiens
taggaattcatcttttga

SEQ ID NO: 3254283 - DNA, 20 bp, Homo sapiens
taggacataaattagaggtc

SEQ ID NO: 3254284 - DNA, 14 bp, Homo sapiens
taggaccaagaaag

SEQ ID NO: 3254285 - DNA, 22 bp, Homo sapiens
taggaccaagcatcttgggggg

SEQ ID NO: 3254286 - DNA, 19 bp, Homo sapiens
taggaccactcagccccta

SEQ ID NO: 3254287 - DNA, 21 bp, Homo sapiens
taggacctttccaccacagcc

SEQ ID NO: 3254288 - DNA, 15 bp, Homo sapiens
taggacgttggcctc

SEQ ID NO: 3254289 - DNA, 20 bp, Homo sapiens
taggagaaccaaatctggaa

SEQ ID NO: 3254290 - DNA, 23 bp, Homo sapiens
taggagaagaggcatcctgcctg

SEQ ID NO: 3254291 - DNA, 18 bp, Homo sapiens
taggagaggatgagagcc

SEQ ID NO: 3254292 - DNA, 22 bp, Homo sapiens
taggagaggatgagagcccaga

SEQ ID NO: 3254293 - DNA, 21 bp, Homo sapiens
taggagagtttactgatgaaa

SEQ ID NO: 3254294 - DNA, 13 bp, Homo sapiens
taggagctaaggc

SEQ ID NO: 3254295 - DNA, 16 bp, Homo sapiens
taggagctaaggctct

SEQ ID NO: 3254296 - DNA, 21 bp, Homo sapiens
taggagttcgagaccagcctg

SEQ ID NO: 3254297 - DNA, 18 bp, Homo sapiens
taggatagttgatgcatg

SEQ ID NO: 3254298 - DNA, 14 bp, Homo sapiens
taggatatttgagt

SEQ ID NO: 3254299 - DNA, 20 bp, Homo sapiens
taggatcatttgttggaatg

SEQ ID NO: 3254300 - DNA, 21 bp, Homo sapiens
taggatccagtgatccttaca

SEQ ID NO: 3254301 - DNA, 23 bp, Homo sapiens
taggatctgcaaacaatgaagaa

SEQ ID NO: 3254302 - DNA, 17 bp, Homo sapiens
taggatggggctcccag

SEQ ID NO: 3254303 - DNA, 19 bp, Homo sapiens
taggatgtatattttatat

SEQ ID NO: 3254304 - DNA, 23 bp, Homo sapiens
taggatgtatattttatataaag

SEQ ID NO: 3254305 - DNA, 15 bp, Homo sapiens
taggatgtctgtaat

SEQ ID NO: 3254306 - DNA, 14 bp, Homo sapiens
taggattctaaaat

SEQ ID NO: 3254307 - DNA, 14 bp, Homo sapiens
taggatttcttaaa

SEQ ID NO: 3254308 - DNA, 22 bp, Homo sapiens
taggattttcacattcttggct

SEQ ID NO: 3254309 - DNA, 18 bp, Homo sapiens
taggcaacctttattttt

SEQ ID NO: 3254310 - DNA, 18 bp, Homo sapiens
taggcaactattaataat

SEQ ID NO: 3254311 - DNA, 19 bp, Homo sapiens
taggcaaggctatgtgatt

SEQ ID NO: 3254312 - DNA, 20 bp, Homo sapiens
taggcactgtagttctaaga

SEQ ID NO: 3254313 - DNA, 13 bp, Homo sapiens
taggcagcagctt

SEQ ID NO: 3254314 - DNA, 21 bp, Homo sapiens
taggcatgtcccacccacccg

SEQ ID NO: 3254315 - DNA, 20 bp, Homo sapiens
taggcattaacacaaaggag

SEQ ID NO: 3254316 - DNA, 12 bp, Homo sapiens
taggcatttcct

SEQ ID NO: 3254317 - DNA, 19 bp, Homo sapiens
taggccaccccctatcctc

SEQ ID NO: 3254318 - DNA, 22 bp, Homo sapiens
taggccagggcatgtgtatgtg

SEQ ID NO: 3254319 - DNA, 20 bp, Homo sapiens
taggccatgaaaaaaatgat

SEQ ID NO: 3254320 - DNA, 13 bp, Homo sapiens
taggccatgggac

SEQ ID NO: 3254321 - DNA, 16 bp, Homo sapiens
taggccatgggacagg

SEQ ID NO: 3254322 - DNA, 23 bp, Homo sapiens
taggcccaaggtcccctccacat

SEQ ID NO: 3254323 - DNA, 13 bp, Homo sapiens
taggcccaggcct

SEQ ID NO: 3254324 - DNA, 14 bp, Homo sapiens
taggccccagaggc

SEQ ID NO: 3254325 - DNA, 12 bp, Homo sapiens
taccaatctctg

SEQ ID NO: 3254326 - DNA, 14 bp, Homo sapiens
taccaatgccaaga

SEQ ID NO: 3254327 - DNA, 13 bp, Homo sapiens
taccaatgctgca

SEQ ID NO: 3254328 - DNA, 18 bp, Homo sapiens
taccacaagcctgagaac

SEQ ID NO: 3254329 - DNA, 13 bp, Homo sapiens
taccacagtgtct

SEQ ID NO: 3254330 - DNA, 17 bp, Homo sapiens
taccacatcaaataaga

SEQ ID NO: 3254331 - DNA, 20 bp, Homo sapiens
taccacatctgctctaggga

SEQ ID NO: 3254332 - DNA, 20 bp, Homo sapiens
taccacccttcagaccccag

SEQ ID NO: 3254333 - DNA, 23 bp, Homo sapiens
taccacccttcagaccccagttc

SEQ ID NO: 3254334 - DNA, 15 bp, Homo sapiens
taccactaactcctg

SEQ ID NO: 3254335 - DNA, 19 bp, Homo sapiens
taccactaactcctgagaa

SEQ ID NO: 3254336 - DNA, 15 bp, Homo sapiens
taccactatttaagt

SEQ ID NO: 3254337 - DNA, 20 bp, Homo sapiens
taccacttacctcaaattaa

SEQ ID NO: 3254338 - DNA, 22 bp, Homo sapiens
taccagacaaaaaaatttaaaa

SEQ ID NO: 3254339 - DNA, 15 bp, Homo sapiens
taccagactgcaggt

SEQ ID NO: 3254340 - DNA, 23 bp, Homo sapiens
taccagactgcaggttggacccc

SEQ ID NO: 3254341 - DNA, 15 bp, Homo sapiens
taccagagctagttt

SEQ ID NO: 3254342 - DNA, 15 bp, Homo sapiens
taccagatgctactg

SEQ ID NO: 3254343 - DNA, 19 bp, Homo sapiens
taccagatgctactggact

SEQ ID NO: 3254344 - DNA, 16 bp, Homo sapiens
taccagcagaaaacct

SEQ ID NO: 3254345 - DNA, 16 bp, Homo sapiens
taccagcatgttaact

SEQ ID NO: 3254346 - DNA, 20 bp, Homo sapiens
taccagctcatacaaaataa

SEQ ID NO: 3254347 - DNA, 13 bp, Homo sapiens
taccagctgcgct

SEQ ID NO: 3254348 - DNA, 17 bp, Homo sapiens
taccagggatgtagatt

SEQ ID NO: 3254349 - DNA, 18 bp, Homo sapiens
taccaggtgtgcctggaa

SEQ ID NO: 3254350 - DNA, 19 bp, Homo sapiens
taccaggtgtgcctggaag

SEQ ID NO: 3254351 - DNA, 18 bp, Homo sapiens
taccagtatttagaagcc

SEQ ID NO: 3254352 - DNA, 15 bp, Homo sapiens
taccagttaattact

SEQ ID NO: 3254353 - DNA, 17 bp, Homo sapiens
taccataagggactgtg

SEQ ID NO: 3254354 - DNA, 19 bp, Homo sapiens
taccatagcgctgctctta

SEQ ID NO: 3254355 - DNA, 13 bp, Homo sapiens
taccatgctgctt

SEQ ID NO: 3254356 - DNA, 22 bp, Homo sapiens
taccatgctgctttttggcaca

SEQ ID NO: 3254357 - DNA, 23 bp, Homo sapiens
taccatgctgctttttggcacag

SEQ ID NO: 3254358 - DNA, 15 bp, Homo sapiens
taccatgtcactgtg

SEQ ID NO: 3254359 - DNA, 22 bp, Homo sapiens
taccattaattacatacagatt

SEQ ID NO: 3254360 - DNA, 20 bp, Homo sapiens
taccattcagatcactgaat

SEQ ID NO: 3254361 - DNA, 22 bp, Homo sapiens
taccattcagttaattcaatgt

SEQ ID NO: 3254362 - DNA, 19 bp, Homo sapiens
taccatttagtaagaatac

SEQ ID NO: 3254363 - DNA, 15 bp, Homo sapiens
taccatttcagagag

SEQ ID NO: 3254364 - DNA, 21 bp, Homo sapiens
taccatttgctactgtacata

SEQ ID NO: 3254365 - DNA, 12 bp, Homo sapiens
taccatttgtgt

SEQ ID NO: 3254366 - DNA, 12 bp, Homo sapiens
taccattttcta

SEQ ID NO: 3254367 - DNA, 23 bp, Homo sapiens
taccattttggggtacccactgc

SEQ ID NO: 3254368 - DNA, 20 bp, Homo sapiens
taccattttttaaggaaaca

SEQ ID NO: 3254369 - DNA, 15 bp, Homo sapiens
tacccaaaagagaaa

SEQ ID NO: 3254370 - DNA, 16 bp, Homo sapiens
tacccaaaccctaggt

SEQ ID NO: 3254371 - DNA, 14 bp, Homo sapiens
tacccaaagcacat

SEQ ID NO: 3254372 - DNA, 23 bp, Homo sapiens
tacccaaagcacatgcttagctt

SEQ ID NO: 3254373 - DNA, 18 bp, Homo sapiens
tacccaagggcagaaagt

SEQ ID NO: 3254374 - DNA, 18 bp, Homo sapiens
tacccacatgtacagaca

SEQ ID NO: 3254375 - DNA, 22 bp, Homo sapiens
tacccacctagaacactaactc

SEQ ID NO: 3254376 - DNA, 15 bp, Homo sapiens
tacccactgctctgg

SEQ ID NO: 3254377 - DNA, 18 bp, Homo sapiens
tacccagaatgtcagatt

SEQ ID NO: 3254378 - DNA, 22 bp, Homo sapiens
tacccagaatgtcagattcctt

SEQ ID NO: 3254379 - DNA, 15 bp, Homo sapiens
tacccagagaatata

SEQ ID NO: 3254380 - DNA, 14 bp, Homo sapiens
tacccagccatctg

SEQ ID NO: 3254381 - DNA, 16 bp, Homo sapiens
tacccagccatctgcc

SEQ ID NO: 3254382 - DNA, 20 bp, Homo sapiens
tacccagccatctgcccagg

SEQ ID NO: 3254383 - DNA, 18 bp, Homo sapiens
tacccagcgagccctggt

SEQ ID NO: 3254384 - DNA, 16 bp, Homo sapiens
tacccaggaccaagcc

SEQ ID NO: 3254385 - DNA, 18 bp, Homo sapiens
tacccaggctggagtgca

SEQ ID NO: 3254386 - DNA, 16 bp, Homo sapiens
tacccatagacatgaa

SEQ ID NO: 3254387 - DNA, 17 bp, Homo sapiens
tacccatgagcctgccc

SEQ ID NO: 3254388 - DNA, 13 bp, Homo sapiens
taccccaccctca

SEQ ID NO: 3254389 - DNA, 14 bp, Homo sapiens
taccccaccctcag

SEQ ID NO: 3254390 - DNA, 15 bp, Homo sapiens
taccccaccctcagc

SEQ ID NO: 3254391 - DNA, 21 bp, Homo sapiens
taccccagactagatgtagta

SEQ ID NO: 3254392 - DNA, 22 bp, Homo sapiens
taccccagactagatgtagtat

SEQ ID NO: 3254393 - DNA, 20 bp, Homo sapiens
taccccagggcctactgcca

SEQ ID NO: 3254394 - DNA, 21 bp, Homo sapiens
taccccagtcccagggaaggt

SEQ ID NO: 3254395 - DNA, 20 bp, Homo sapiens
taccccatggagctgggcta

SEQ ID NO: 3254396 - DNA, 21 bp, Homo sapiens
tacccccaggtggaaggcaga

SEQ ID NO: 3254397 - DNA, 13 bp, Homo sapiens
taccccctccttc

SEQ ID NO: 3254398 - DNA, 16 bp, Homo sapiens
taccccctccttcaga

SEQ ID NO: 3254399 - DNA, 21 bp, Homo sapiens
tacccccttttcagctgagcc

SEQ ID NO: 3254400 - DNA, 22 bp, Homo sapiens
tacccccttttcagctgagccc

SEQ ID NO: 3254401 - DNA, 17 bp, Homo sapiens
taccccgcagacacctt

SEQ ID NO: 3254402 - DNA, 14 bp, Homo sapiens
tacccctgctccca

SEQ ID NO: 3254403 - DNA, 20 bp, Homo sapiens
tacccctgctcccattcctc

SEQ ID NO: 3254404 - DNA, 17 bp, Homo sapiens
taccctaatgtcttcat

SEQ ID NO: 3254405 - DNA, 13 bp, Homo sapiens
taccctcccaccc

SEQ ID NO: 3254406 - DNA, 15 bp, Homo sapiens
taccctcccaccccc

SEQ ID NO: 3254407 - DNA, 21 bp, Homo sapiens
taccctcgggcccacctggcc

SEQ ID NO: 3254408 - DNA, 22 bp, Homo sapiens
taccctctgcagaacagtgaaa

SEQ ID NO: 3254409 - DNA, 12 bp, Homo sapiens
taccctctggag

SEQ ID NO: 3254410 - DNA, 14 bp, Homo sapiens
tacccttccacctc

SEQ ID NO: 3254411 - DNA, 20 bp, Homo sapiens
tacccttccacctcctagag

SEQ ID NO: 3254412 - DNA, 17 bp, Homo sapiens
tacccttccctgcacta

SEQ ID NO: 3254413 - DNA, 21 bp, Homo sapiens
tacccttgtgagagcccattc

SEQ ID NO: 3254414 - DNA, 23 bp, Homo sapiens
taccctttaagatatccatcttt

SEQ ID NO: 3254415 - DNA, 14 bp, Homo sapiens
taccgccctgggct

SEQ ID NO: 3254416 - DNA, 15 bp, Homo sapiens
taccgccctgggctg

SEQ ID NO: 3254417 - DNA, 17 bp, Homo sapiens
taccgccctgggctgga

SEQ ID NO: 3254418 - DNA, 15 bp, Homo sapiens
taccgcctgtctctt

SEQ ID NO: 3254419 - DNA, 13 bp, Homo sapiens
taccgcttcctta

SEQ ID NO: 3254420 - DNA, 23 bp, Homo sapiens
tacctaaaaggaaatctcacccc

SEQ ID NO: 3254421 - DNA, 15 bp, Homo sapiens
tacctaaacagatat

SEQ ID NO: 3254422 - DNA, 15 bp, Homo sapiens
tacctaacattattt

SEQ ID NO: 3254423 - DNA, 20 bp, Homo sapiens
tacctaagattacaaatcag

SEQ ID NO: 3254424 - DNA, 17 bp, Homo sapiens
tacctacaataaactgg

SEQ ID NO: 3254425 - DNA, 15 bp, Homo sapiens
tacctacatacaatt

SEQ ID NO: 3254426 - DNA, 15 bp, Homo sapiens
tacctactgagtagg

SEQ ID NO: 3254427 - DNA, 15 bp, Homo sapiens
tacctagctggctct

SEQ ID NO: 3254428 - DNA, 19 bp, Homo sapiens
tacctataaagtaaagcta

SEQ ID NO: 3254429 - DNA, 14 bp, Homo sapiens
tacctataatgtgt

SEQ ID NO: 3254430 - DNA, 17 bp, Homo sapiens
tacctataatgtgtgta

SEQ ID NO: 3254431 - DNA, 19 bp, Homo sapiens
tacctcaaccatcctggct

SEQ ID NO: 3254432 - DNA, 23 bp, Homo sapiens
tacctcagcagcagttggatctt

SEQ ID NO: 3254433 - DNA, 14 bp, Homo sapiens
tacctcagcctaga

SEQ ID NO: 3254434 - DNA, 12 bp, Homo sapiens
tacctcaggttg

SEQ ID NO: 3254435 - DNA, 20 bp, Homo sapiens
tacctcagtggatcttcaga

SEQ ID NO: 3254436 - DNA, 23 bp, Homo sapiens
tacctcatttttcatactgaaaa

SEQ ID NO: 3254437 - DNA, 20 bp, Homo sapiens
tacctccaacagaactaaat

SEQ ID NO: 3254438 - DNA, 23 bp, Homo sapiens
tacctccaacagaactaaatgtt

SEQ ID NO: 3254439 - DNA, 12 bp, Homo sapiens
tacctccctccc

SEQ ID NO: 3254440 - DNA, 11 bp, Homo sapiens
tacctcctcct

SEQ ID NO: 3254441 - DNA, 14 bp, Homo sapiens
tacctcctctcagt

SEQ ID NO: 3254442 - DNA, 17 bp, Homo sapiens
tacctcctctcagtgtt

SEQ ID NO: 3254443 - DNA, 22 bp, Homo sapiens
tacctccttagctttccctgtg

SEQ ID NO: 3254444 - DNA, 23 bp, Homo sapiens
tacctccttagctttccctgtgc

SEQ ID NO: 3254445 - DNA, 14 bp, Homo sapiens
tacctctctgtccc

SEQ ID NO: 3254446 - DNA, 15 bp, Homo sapiens
tacctctctgtccct

SEQ ID NO: 3254447 - DNA, 17 bp, Homo sapiens
tacctctgaccaacagg

SEQ ID NO: 3254448 - DNA, 16 bp, Homo sapiens
tacctctgagaagaca

SEQ ID NO: 3254449 - DNA, 13 bp, Homo sapiens
tacctctgtatag

SEQ ID NO: 3254450 - DNA, 18 bp, Homo sapiens
tacctctgtatagaaatc

SEQ ID NO: 3254451 - DNA, 13 bp, Homo sapiens
tacctgacacaag

SEQ ID NO: 3254452 - DNA, 19 bp, Homo sapiens
tacctgacctcttgctgtc

SEQ ID NO: 3254453 - DNA, 20 bp, Homo sapiens
tacctgacctcttgctgtct

SEQ ID NO: 3254454 - DNA, 16 bp, Homo sapiens
tactcttgatgtgaag

SEQ ID NO: 3254455 - DNA, 14 bp, Homo sapiens
tactcttgctgatg

SEQ ID NO: 3254456 - DNA, 16 bp, Homo sapiens
tactcttggtttttat

SEQ ID NO: 3254457 - DNA, 17 bp, Homo sapiens
tactcttgttgagttct

SEQ ID NO: 3254458 - DNA, 20 bp, Homo sapiens
tactctttttctaaagtgtt

SEQ ID NO: 3254459 - DNA, 20 bp, Homo sapiens
tactgaaaaaaaaagcttgt

SEQ ID NO: 3254460 - DNA, 17 bp, Homo sapiens
tactgaaaaaggtgatt

SEQ ID NO: 3254461 - DNA, 22 bp, Homo sapiens
tactgaaatttgttatacttca

SEQ ID NO: 3254462 - DNA, 13 bp, Homo sapiens
tactgaagccaaa

SEQ ID NO: 3254463 - DNA, 19 bp, Homo sapiens
tactgaagccaaatgaaac

SEQ ID NO: 3254464 - DNA, 19 bp, Homo sapiens
tactgaatgaagcagtatt

SEQ ID NO: 3254465 - DNA, 17 bp, Homo sapiens
tactgaatgcataaata

SEQ ID NO: 3254466 - DNA, 23 bp, Homo sapiens
tactgacactttgccagaaagca

SEQ ID NO: 3254467 - DNA, 14 bp, Homo sapiens
tactgacatttctt

SEQ ID NO: 3254468 - DNA, 16 bp, Homo sapiens
tactgactttgcttgc

SEQ ID NO: 3254469 - DNA, 22 bp, Homo sapiens
tactgagcatttgcacctctgt

SEQ ID NO: 3254470 - DNA, 15 bp, Homo sapiens
tactgagccttgtaa

SEQ ID NO: 3254471 - DNA, 22 bp, Homo sapiens
tactgagctgagaccactgagt

SEQ ID NO: 3254472 - DNA, 14 bp, Homo sapiens
tactgagcttctct

SEQ ID NO: 3254473 - DNA, 18 bp, Homo sapiens
tactgagcttctctgtga

SEQ ID NO: 3254474 - DNA, 15 bp, Homo sapiens
tactgaggtgctatg

SEQ ID NO: 3254475 - DNA, 14 bp, Homo sapiens
tactgatttcagta

SEQ ID NO: 3254476 - DNA, 21 bp, Homo sapiens
tactgatttcctttggagctt

SEQ ID NO: 3254477 - DNA, 15 bp, Homo sapiens
tactgatttttgtga

SEQ ID NO: 3254478 - DNA, 16 bp, Homo sapiens
tactgcaaaaagaaaa

SEQ ID NO: 3254479 - DNA, 14 bp, Homo sapiens
tactgcaagaaaat

SEQ ID NO: 3254480 - DNA, 18 bp, Homo sapiens
tactgcactccagcctgg

SEQ ID NO: 3254481 - DNA, 19 bp, Homo sapiens
tactgcactccagcctggg

SEQ ID NO: 3254482 - DNA, 17 bp, Homo sapiens
tactgcagaatacagta

SEQ ID NO: 3254483 - DNA, 22 bp, Homo sapiens
tactgcagaatacagtaagctg

SEQ ID NO: 3254484 - DNA, 16 bp, Homo sapiens
tactgcagcacctcca

SEQ ID NO: 3254485 - DNA, 22 bp, Homo sapiens
tactgcagcctttgcctccccg

SEQ ID NO: 3254486 - DNA, 10 bp, Homo sapiens
tactgcaggg

SEQ ID NO: 3254487 - DNA, 12 bp, Homo sapiens
tactgcagggcc

SEQ ID NO: 3254488 - DNA, 17 bp, Homo sapiens
tactgcatactttttaa

SEQ ID NO: 3254489 - DNA, 19 bp, Homo sapiens
tactgcattctctcccatc

SEQ ID NO: 3254490 - DNA, 11 bp, Homo sapiens
tactgccaaag

SEQ ID NO: 3254491 - DNA, 21 bp, Homo sapiens
tactgccatgtactagtttta

SEQ ID NO: 3254492 - DNA, 20 bp, Homo sapiens
tactgccattcacttcataa

SEQ ID NO: 3254493 - DNA, 22 bp, Homo sapiens
tactgcccaggcctgcctgttc

SEQ ID NO: 3254494 - DNA, 19 bp, Homo sapiens
tactgcgactttctgcctg

SEQ ID NO: 3254495 - DNA, 21 bp, Homo sapiens
tactgcgactttctgcctgga

SEQ ID NO: 3254496 - DNA, 21 bp, Homo sapiens
tactggaagctgcagatcttt

SEQ ID NO: 3254497 - DNA, 23 bp, Homo sapiens
tactggaagttttgcatttatgg

SEQ ID NO: 3254498 - DNA, 22 bp, Homo sapiens
tactggacttgaatggttaata

SEQ ID NO: 3254499 - DNA, 19 bp, Homo sapiens
tactggagcttcattttgg

SEQ ID NO: 3254500 - DNA, 12 bp, Homo sapiens
tactggcagctc

SEQ ID NO: 3254501 - DNA, 14 bp, Homo sapiens
tactggcaggaggg

SEQ ID NO: 3254502 - DNA, 23 bp, Homo sapiens
tactgggccttagtgggccaggg

SEQ ID NO: 3254503 - DNA, 22 bp, Homo sapiens
tactgggtgaggaaatccattg

SEQ ID NO: 3254504 - DNA, 16 bp, Homo sapiens
tactgggtttcaagaa

SEQ ID NO: 3254505 - DNA, 17 bp, Homo sapiens
tactgggtttcaagaaa

SEQ ID NO: 3254506 - DNA, 23 bp, Homo sapiens
tactggtttccccagggaaggaa

SEQ ID NO: 3254507 - DNA, 17 bp, Homo sapiens
tactgtaataatacctc

SEQ ID NO: 3254508 - DNA, 19 bp, Homo sapiens
tactgtacataaacaatga

SEQ ID NO: 3254509 - DNA, 14 bp, Homo sapiens
tactgtacttaata

SEQ ID NO: 3254510 - DNA, 14 bp, Homo sapiens
tactgtagtattct

SEQ ID NO: 3254511 - DNA, 15 bp, Homo sapiens
tactgtatataaact

SEQ ID NO: 3254512 - DNA, 16 bp, Homo sapiens
tactgtatgccttctg

SEQ ID NO: 3254513 - DNA, 22 bp, Homo sapiens
tactgtatggaaacactgattt

SEQ ID NO: 3254514 - DNA, 14 bp, Homo sapiens
tactgtcaataaac

SEQ ID NO: 3254515 - DNA, 15 bp, Homo sapiens
tactgtcctcagagg

SEQ ID NO: 3254516 - DNA, 17 bp, Homo sapiens
tactgtctattaatatt

SEQ ID NO: 3254517 - DNA, 18 bp, Homo sapiens
tactgtctattaatattc

SEQ ID NO: 3254518 - DNA, 14 bp, Homo sapiens
tactgtctcactga

SEQ ID NO: 3254519 - DNA, 15 bp, Homo sapiens
tactgtctgattggc

SEQ ID NO: 3254520 - DNA, 17 bp, Homo sapiens
tactgtctgattggctt

SEQ ID NO: 3254521 - DNA, 13 bp, Homo sapiens
tactgtctgggat

SEQ ID NO: 3254522 - DNA, 16 bp, Homo sapiens
tactgtctggttttaa

SEQ ID NO: 3254523 - DNA, 15 bp, Homo sapiens
tactgtcttactatt

SEQ ID NO: 3254524 - DNA, 19 bp, Homo sapiens
tactgtctttattcttatt

SEQ ID NO: 3254525 - DNA, 12 bp, Homo sapiens
tactgtggagga

SEQ ID NO: 3254526 - DNA, 23 bp, Homo sapiens
tactgtgtaaatatatgtctgat

SEQ ID NO: 3254527 - DNA, 19 bp, Homo sapiens
tactgtgtggaacttttat

SEQ ID NO: 3254528 - DNA, 22 bp, Homo sapiens
tactgtgtgtgtgaatgaacac

SEQ ID NO: 3254529 - DNA, 23 bp, Homo sapiens
tactgtgtgtgtgaatgaacact

SEQ ID NO: 3254530 - DNA, 12 bp, Homo sapiens
tactgtgttcct

SEQ ID NO: 3254531 - DNA, 14 bp, Homo sapiens
tactgtgttcctgg

SEQ ID NO: 3254532 - DNA, 19 bp, Homo sapiens
tactgtgttcctggcaata

SEQ ID NO: 3254533 - DNA, 15 bp, Homo sapiens
tactgttaaccattt

SEQ ID NO: 3254534 - DNA, 16 bp, Homo sapiens
tactgttatctatctg

SEQ ID NO: 3254535 - DNA, 14 bp, Homo sapiens
tactgttcctttca

SEQ ID NO: 3254536 - DNA, 17 bp, Homo sapiens
tactgttcctttcagat

SEQ ID NO: 3254537 - DNA, 14 bp, Homo sapiens
tactgttctgtgtc

SEQ ID NO: 3254538 - DNA, 17 bp, Homo sapiens
tactgttctgtgtcttt

SEQ ID NO: 3254539 - DNA, 13 bp, Homo sapiens
tactgttcttgct

SEQ ID NO: 3254540 - DNA, 15 bp, Homo sapiens
tactgttcttgctgc

SEQ ID NO: 3254541 - DNA, 17 bp, Homo sapiens
tactgttcttgctgcta

SEQ ID NO: 3254542 - DNA, 17 bp, Homo sapiens
tactgttgtaagaattc

SEQ ID NO: 3254543 - DNA, 15 bp, Homo sapiens
tactgttttaattgt

SEQ ID NO: 3254544 - DNA, 19 bp, Homo sapiens
tacttaaatatatatttct

SEQ ID NO: 3254545 - DNA, 17 bp, Homo sapiens
tacttaaatgaaagcat

SEQ ID NO: 3254546 - DNA, 21 bp, Homo sapiens
tacttaaatggtaataagcac

SEQ ID NO: 3254547 - DNA, 22 bp, Homo sapiens
tacttaacaaccaacttgttgt

SEQ ID NO: 3254548 - DNA, 16 bp, Homo sapiens
tacttaagagaaatgg

SEQ ID NO: 3254549 - DNA, 19 bp, Homo sapiens
tacttaataaattcagata

SEQ ID NO: 3254550 - DNA, 15 bp, Homo sapiens
tacttactataattt

SEQ ID NO: 3254551 - DNA, 21 bp, Homo sapiens
tacttagccagttcaaagtgt

SEQ ID NO: 3254552 - DNA, 19 bp, Homo sapiens
tacttaggttattttgctt

SEQ ID NO: 3254553 - DNA, 16 bp, Homo sapiens
tacttagtggtatgtc

SEQ ID NO: 3254554 - DNA, 14 bp, Homo sapiens
tacttataaagaag

SEQ ID NO: 3254555 - DNA, 22 bp, Homo sapiens
tacttatattttcgtatgaaaa

SEQ ID NO: 3254556 - DNA, 19 bp, Homo sapiens
tacttattttcagtgcatc

SEQ ID NO: 3254557 - DNA, 17 bp, Homo sapiens
tacttcaaaaataatgt

SEQ ID NO: 3254558 - DNA, 19 bp, Homo sapiens
tacttcaagtaatacgttt

SEQ ID NO: 3254559 - DNA, 18 bp, Homo sapiens
tacttcaagttaaagtga

SEQ ID NO: 3254560 - DNA, 22 bp, Homo sapiens
tacttcaggggcacttcattga

SEQ ID NO: 3254561 - DNA, 18 bp, Homo sapiens
tacttcatagctccttgg

SEQ ID NO: 3254562 - DNA, 16 bp, Homo sapiens
tacttccaatttataa

SEQ ID NO: 3254563 - DNA, 23 bp, Homo sapiens
tacttcccattttggaagttttc

SEQ ID NO: 3254564 - DNA, 17 bp, Homo sapiens
tacttcctcctgatggc

SEQ ID NO: 3254565 - DNA, 17 bp, Homo sapiens
tacttcgtcttctaatt

SEQ ID NO: 3254566 - DNA, 16 bp, Homo sapiens
tacttctgactttact

SEQ ID NO: 3254567 - DNA, 17 bp, Homo sapiens
tacttctgactttactt

SEQ ID NO: 3254568 - DNA, 15 bp, Homo sapiens
tacttctgctacata

SEQ ID NO: 3254569 - DNA, 22 bp, Homo sapiens
tacttctgtaattgtgtggatt

SEQ ID NO: 3254570 - DNA, 13 bp, Homo sapiens
tacttctgtgttc

SEQ ID NO: 3254571 - DNA, 18 bp, Homo sapiens
tacttcttcattcaatac

SEQ ID NO: 3254572 - DNA, 20 bp, Homo sapiens
tacttgaaatctaggattat

SEQ ID NO: 3254573 - DNA, 18 bp, Homo sapiens
tacttgaagaaacagagt

SEQ ID NO: 3254574 - DNA, 14 bp, Homo sapiens
tacttgactctaat

SEQ ID NO: 3254575 - DNA, 16 bp, Homo sapiens
tacttgactctaatat

SEQ ID NO: 3254576 - DNA, 18 bp, Homo sapiens
tacttgagtgtaatgttt

SEQ ID NO: 3254577 - DNA, 20 bp, Homo sapiens
tacttgataatattagtgat

SEQ ID NO: 3254578 - DNA, 14 bp, Homo sapiens
tacttgatactgaa

SEQ ID NO: 3254579 - DNA, 15 bp, Homo sapiens
tacttgatactgaat

SEQ ID NO: 3254580 - DNA, 22 bp, Homo sapiens
tacttgatttgatgtgactttt

SEQ ID NO: 3254581 - DNA, 18 bp, Homo sapiens
tacttgcttattacattt

SEQ ID NO: 3254582 - DNA, 21 bp, Homo sapiens
tacttgctttcaattgacaaa

SEQ ID NO: 3254583 - DNA, 22 bp, Homo sapiens
tacctgacctcttgctgtctct

SEQ ID NO: 3254584 - DNA, 18 bp, Homo sapiens
tacctgattttttttcct

SEQ ID NO: 3254585 - DNA, 18 bp, Homo sapiens
tacctgcaggctgagcca

SEQ ID NO: 3254586 - DNA, 24 bp, Homo sapiens
tacctgccctctatttattagcca

SEQ ID NO: 3254587 - DNA, 21 bp, Homo sapiens
tacctgctcacgtcaaatgca

SEQ ID NO: 3254588 - DNA, 18 bp, Homo sapiens
tacctgctgccccagctg

SEQ ID NO: 3254589 - DNA, 17 bp, Homo sapiens
tacctggcttttacttt

SEQ ID NO: 3254590 - DNA, 19 bp, Homo sapiens
tacctgggaaaggacccac

SEQ ID NO: 3254591 - DNA, 12 bp, Homo sapiens
tacctgtgcctg

SEQ ID NO: 3254592 - DNA, 14 bp, Homo sapiens
tacctgtgtatata

SEQ ID NO: 3254593 - DNA, 13 bp, Homo sapiens
tacctgttcctta

SEQ ID NO: 3254594 - DNA, 17 bp, Homo sapiens
taccttaagatttttct

SEQ ID NO: 3254595 - DNA, 17 bp, Homo sapiens
taccttatagttactgt

SEQ ID NO: 3254596 - DNA, 23 bp, Homo sapiens
taccttatcttacaatattgatt

SEQ ID NO: 3254597 - DNA, 15 bp, Homo sapiens
taccttgaggtcttt

SEQ ID NO: 3254598 - DNA, 20 bp, Homo sapiens
taccttgtatactgtaggca

SEQ ID NO: 3254599 - DNA, 13 bp, Homo sapiens
taccttttaagac

SEQ ID NO: 3254600 - DNA, 16 bp, Homo sapiens
taccttttctgttgta

SEQ ID NO: 3254601 - DNA, 21 bp, Homo sapiens
taccttttgaggagccccagc

SEQ ID NO: 3254602 - DNA, 15 bp, Homo sapiens
taccttttgtctctt

SEQ ID NO: 3254603 - DNA, 20 bp, Homo sapiens
tacctttttgtatgtgaaca

SEQ ID NO: 3254604 - DNA, 14 bp, Homo sapiens
tacgactttatttt

SEQ ID NO: 3254605 - DNA, 20 bp, Homo sapiens
tacgagggaggaacacctga

SEQ ID NO: 3254606 - DNA, 23 bp, Homo sapiens
tacgcactacatgtggtttatag

SEQ ID NO: 3254607 - DNA, 14 bp, Homo sapiens
tacgctttgattca

SEQ ID NO: 3254608 - DNA, 17 bp, Homo sapiens
tacgcttttctttgtta

SEQ ID NO: 3254609 - DNA, 20 bp, Homo sapiens
tacggagaagaatagaggtc

SEQ ID NO: 3254610 - DNA, 15 bp, Homo sapiens
tacggattttcagtt

SEQ ID NO: 3254611 - DNA, 21 bp, Homo sapiens
tacggttttataaaagccttg

SEQ ID NO: 3254612 - DNA, 15 bp, Homo sapiens
tacgtctgacaggca

SEQ ID NO: 3254613 - DNA, 15 bp, Homo sapiens
tacgtgtagctatat

SEQ ID NO: 3254614 - DNA, 13 bp, Homo sapiens
tacgtttgtatgt

SEQ ID NO: 3254615 - DNA, 16 bp, Homo sapiens
tactaaaagcaaatct

SEQ ID NO: 3254616 - DNA, 22 bp, Homo sapiens
tactaaaagcaaatctacagat

SEQ ID NO: 3254617 - DNA, 19 bp, Homo sapiens
tactaaacagtaagatatc

SEQ ID NO: 3254618 - DNA, 18 bp, Homo sapiens
tactaaacatatgatttc

SEQ ID NO: 3254619 - DNA, 18 bp, Homo sapiens
tactaaacattttgttat

SEQ ID NO: 3254620 - DNA, 18 bp, Homo sapiens
tactaaaccaactctaat

SEQ ID NO: 3254621 - DNA, 18 bp, Homo sapiens
tactaaagatatcagagc

SEQ ID NO: 3254622 - DNA, 20 bp, Homo sapiens
tactaaattacgtatgcaag

SEQ ID NO: 3254623 - DNA, 17 bp, Homo sapiens
tactaaatttaaattta

SEQ ID NO: 3254624 - DNA, 22 bp, Homo sapiens
tactaaatttaaatttaaagat

SEQ ID NO: 3254625 - DNA, 20 bp, Homo sapiens
tactaagcatagcaaacaga

SEQ ID NO: 3254626 - DNA, 14 bp, Homo sapiens
tactaaggaatctt

SEQ ID NO: 3254627 - DNA, 22 bp, Homo sapiens
tactaagggaacaatccatgtg

SEQ ID NO: 3254628 - DNA, 14 bp, Homo sapiens
tactaagttcacat

SEQ ID NO: 3254629 - DNA, 23 bp, Homo sapiens
tactaatagaataaaggcagttt

SEQ ID NO: 3254630 - DNA, 13 bp, Homo sapiens
tactaatgatgtt

SEQ ID NO: 3254631 - DNA, 14 bp, Homo sapiens
tactaatgatgttt

SEQ ID NO: 3254632 - DNA, 20 bp, Homo sapiens
tactaattttttaagaggaa

SEQ ID NO: 3254633 - DNA, 15 bp, Homo sapiens
tactaccaatgccaa

SEQ ID NO: 3254634 - DNA, 14 bp, Homo sapiens
tactaccacaagga

SEQ ID NO: 3254635 - DNA, 15 bp, Homo sapiens
tactaccctttgctg

SEQ ID NO: 3254636 - DNA, 18 bp, Homo sapiens
tactactagatgtcttta

SEQ ID NO: 3254637 - DNA, 13 bp, Homo sapiens
tactactcctgta

SEQ ID NO: 3254638 - DNA, 17 bp, Homo sapiens
tactactcctgtaggaa

SEQ ID NO: 3254639 - DNA, 20 bp, Homo sapiens
tactactttctctttttcgt

SEQ ID NO: 3254640 - DNA, 12 bp, Homo sapiens
tactactttgtt

SEQ ID NO: 3254641 - DNA, 19 bp, Homo sapiens
tactactttgttaggattt

SEQ ID NO: 3254642 - DNA, 22 bp, Homo sapiens
tactactttgttaggattttca

SEQ ID NO: 3254643 - DNA, 23 bp, Homo sapiens
tactactttgttaggattttcac

SEQ ID NO: 3254644 - DNA, 21 bp, Homo sapiens
tactagatgcatcactgggtg

SEQ ID NO: 3254645 - DNA, 14 bp, Homo sapiens
tactagatgtcttt

SEQ ID NO: 3254646 - DNA, 15 bp, Homo sapiens
tactaggtaacttca

SEQ ID NO: 3254647 - DNA, 16 bp, Homo sapiens
tactaggtaacttcat

SEQ ID NO: 3254648 - DNA, 19 bp, Homo sapiens
tactagtctgtgtgggact

SEQ ID NO: 3254649 - DNA, 13 bp, Homo sapiens
tactagtgtggtg

SEQ ID NO: 3254650 - DNA, 18 bp, Homo sapiens
tactagtgtggtgtgttt

SEQ ID NO: 3254651 - DNA, 22 bp, Homo sapiens
tactataaaatgcagtaacatt

SEQ ID NO: 3254652 - DNA, 17 bp, Homo sapiens
tactataatcaaatgat

SEQ ID NO: 3254653 - DNA, 19 bp, Homo sapiens
tactatagatataactgta

SEQ ID NO: 3254654 - DNA, 18 bp, Homo sapiens
tactatatacatatatat

SEQ ID NO: 3254655 - DNA, 21 bp, Homo sapiens
tactatatttacaaataaaat

SEQ ID NO: 3254656 - DNA, 15 bp, Homo sapiens
tactatcattctcag

SEQ ID NO: 3254657 - DNA, 13 bp, Homo sapiens
tactatggctcca

SEQ ID NO: 3254658 - DNA, 22 bp, Homo sapiens
tactatggctgatttatttcta

SEQ ID NO: 3254659 - DNA, 16 bp, Homo sapiens
tactatgtatcaatga

SEQ ID NO: 3254660 - DNA, 22 bp, Homo sapiens
tactattaagcagtaaaaactg

SEQ ID NO: 3254661 - DNA, 15 bp, Homo sapiens
tactattcatgtttt

SEQ ID NO: 3254662 - DNA, 11 bp, Homo sapiens
tactatttaaa

SEQ ID NO: 3254663 - DNA, 19 bp, Homo sapiens
tactatttaaagcctcctc

SEQ ID NO: 3254664 - DNA, 21 bp, Homo sapiens
tactatttaaagcctcctcat

SEQ ID NO: 3254665 - DNA, 22 bp, Homo sapiens
tactatttaaagcctcctcatc

SEQ ID NO: 3254666 - DNA, 13 bp, Homo sapiens
tactatttagata

SEQ ID NO: 3254667 - DNA, 17 bp, Homo sapiens
tactcaaatgagtaaca

SEQ ID NO: 3254668 - DNA, 15 bp, Homo sapiens
tactcaatactacct

SEQ ID NO: 3254669 - DNA, 23 bp, Homo sapiens
tactcacagcacttgttttcagg

SEQ ID NO: 3254670 - DNA, 21 bp, Homo sapiens
tactcacagtctctttaatct

SEQ ID NO: 3254671 - DNA, 19 bp, Homo sapiens
tactcagaagcctgaggct

SEQ ID NO: 3254672 - DNA, 14 bp, Homo sapiens
tactcagagcagag

SEQ ID NO: 3254673 - DNA, 15 bp, Homo sapiens
tactcagggctcctc

SEQ ID NO: 3254674 - DNA, 19 bp, Homo sapiens
tactcagggctcctcccag

SEQ ID NO: 3254675 - DNA, 21 bp, Homo sapiens
tactcagggctcctcccagct

SEQ ID NO: 3254676 - DNA, 17 bp, Homo sapiens
tactcattgaaatgtca

SEQ ID NO: 3254677 - DNA, 22 bp, Homo sapiens
tactcattgcccccacctctgg

SEQ ID NO: 3254678 - DNA, 18 bp, Homo sapiens
tactcatttctaaaagaa

SEQ ID NO: 3254679 - DNA, 19 bp, Homo sapiens
tactccactgccctggcag

SEQ ID NO: 3254680 - DNA, 21 bp, Homo sapiens
tactccactgccctggcagca

SEQ ID NO: 3254681 - DNA, 13 bp, Homo sapiens
tactccagcctgg

SEQ ID NO: 3254682 - DNA, 15 bp, Homo sapiens
tactccctacactga

SEQ ID NO: 3254683 - DNA, 17 bp, Homo sapiens
tactccctacactgatg

SEQ ID NO: 3254684 - DNA, 13 bp, Homo sapiens
tactccctcttcc

SEQ ID NO: 3254685 - DNA, 18 bp, Homo sapiens
tactccctgcagatgcca

SEQ ID NO: 3254686 - DNA, 13 bp, Homo sapiens
tactcccttcctg

SEQ ID NO: 3254687 - DNA, 14 bp, Homo sapiens
tactcctacctcag

SEQ ID NO: 3254688 - DNA, 13 bp, Homo sapiens
tactcctattttt

SEQ ID NO: 3254689 - DNA, 14 bp, Homo sapiens
tactcctatttttg

SEQ ID NO: 3254690 - DNA, 21 bp, Homo sapiens
tactcctctgcagtgccttgg

SEQ ID NO: 3254691 - DNA, 17 bp, Homo sapiens
tactcctctttacactg

SEQ ID NO: 3254692 - DNA, 16 bp, Homo sapiens
tactcctgcaaaattt

SEQ ID NO: 3254693 - DNA, 22 bp, Homo sapiens
tactcctgcaaaattttatagc

SEQ ID NO: 3254694 - DNA, 18 bp, Homo sapiens
tactctaagatcttagat

SEQ ID NO: 3254695 - DNA, 18 bp, Homo sapiens
tactctagcctgggccag

SEQ ID NO: 3254696 - DNA, 20 bp, Homo sapiens
tactctatgccccaaatata

SEQ ID NO: 3254697 - DNA, 18 bp, Homo sapiens
tactctcaaaatctttgt

SEQ ID NO: 3254698 - DNA, 13 bp, Homo sapiens
tactctccatatc

SEQ ID NO: 3254699 - DNA, 14 bp, Homo sapiens
tactctcctagaga

SEQ ID NO: 3254700 - DNA, 19 bp, Homo sapiens
tactctcctcggccccctc

SEQ ID NO: 3254701 - DNA, 14 bp, Homo sapiens
tactctgaaaagca

SEQ ID NO: 3254702 - DNA, 13 bp, Homo sapiens
tactctgaaacac

SEQ ID NO: 3254703 - DNA, 20 bp, Homo sapiens
tactctgaaacacactgaaa

SEQ ID NO: 3254704 - DNA, 14 bp, Homo sapiens
tactctgagcccag

SEQ ID NO: 3254705 - DNA, 16 bp, Homo sapiens
tactctgagcccaggc

SEQ ID NO: 3254706 - DNA, 15 bp, Homo sapiens
tactctgctatttct

SEQ ID NO: 3254707 - DNA, 15 bp, Homo sapiens
tactctggttctttg

SEQ ID NO: 3254708 - DNA, 15 bp, Homo sapiens
tactctgtgtgtgta

SEQ ID NO: 3254709 - DNA, 18 bp, Homo sapiens
tactcttaggatatttga

SEQ ID NO: 3254710 - DNA, 19 bp, Homo sapiens
tactcttaggatatttgag

SEQ ID NO: 3254711 - DNA, 18 bp, Homo sapiens
tactcttcttgaaatttt

SEQ ID NO: 3254712 - DNA, 14 bp, Homo sapiens
tacagtcaatttta

SEQ ID NO: 3254713 - DNA, 15 bp, Homo sapiens
tacagtcaattttac

SEQ ID NO: 3254714 - DNA, 22 bp, Homo sapiens
tacagtctctttcttcctttct

SEQ ID NO: 3254715 - DNA, 13 bp, Homo sapiens
tacagtctgtcat

SEQ ID NO: 3254716 - DNA, 14 bp, Homo sapiens
tacagtctgtcatg

SEQ ID NO: 3254717 - DNA, 15 bp, Homo sapiens
tacagtgaaaatgta

SEQ ID NO: 3254718 - DNA, 16 bp, Homo sapiens
tacagtgaattgtctt

SEQ ID NO: 3254719 - DNA, 19 bp, Homo sapiens
tacagtgaattgtctttta

SEQ ID NO: 3254720 - DNA, 15 bp, Homo sapiens
tacagtgcagacagg

SEQ ID NO: 3254721 - DNA, 20 bp, Homo sapiens
tacagtgcagacaggccatg

SEQ ID NO: 3254722 - DNA, 22 bp, Homo sapiens
tacagtgcatagttgtagacaa

SEQ ID NO: 3254723 - DNA, 16 bp, Homo sapiens
tacagtgttattttct

SEQ ID NO: 3254724 - DNA, 20 bp, Homo sapiens
tacagttaggcaccagaaga

SEQ ID NO: 3254725 - DNA, 19 bp, Homo sapiens
tacagttagggttttgcaa

SEQ ID NO: 3254726 - DNA, 22 bp, Homo sapiens
tacagttagggttttgcaataa

SEQ ID NO: 3254727 - DNA, 17 bp, Homo sapiens
tacagttattttggata

SEQ ID NO: 3254728 - DNA, 16 bp, Homo sapiens
tacagtttgctgtact

SEQ ID NO: 3254729 - DNA, 17 bp, Homo sapiens
tacagtttgctgtacta

SEQ ID NO: 3254730 - DNA, 17 bp, Homo sapiens
tacagttttaactgtgg

SEQ ID NO: 3254731 - DNA, 13 bp, Homo sapiens
tacagttttatgc

SEQ ID NO: 3254732 - DNA, 19 bp, Homo sapiens
tacagttttatgctctttt

SEQ ID NO: 3254733 - DNA, 15 bp, Homo sapiens
tacataaaattttct

SEQ ID NO: 3254734 - DNA, 23 bp, Homo sapiens
tacataaatagtagaaaaatcag

SEQ ID NO: 3254735 - DNA, 17 bp, Homo sapiens
tacataactgaaaatgt

SEQ ID NO: 3254736 - DNA, 21 bp, Homo sapiens
tacataactgaaaatgtgcta

SEQ ID NO: 3254737 - DNA, 19 bp, Homo sapiens
tacataagataaatgtgct

SEQ ID NO: 3254738 - DNA, 22 bp, Homo sapiens
tacataagcggcgtaagtttaa

SEQ ID NO: 3254739 - DNA, 17 bp, Homo sapiens
tacataagtaattcaag

SEQ ID NO: 3254740 - DNA, 20 bp, Homo sapiens
tacataatgcttaatttcta

SEQ ID NO: 3254741 - DNA, 20 bp, Homo sapiens
tacataatgtttttcctttc

SEQ ID NO: 3254742 - DNA, 19 bp, Homo sapiens
tacataattttttattcaa

SEQ ID NO: 3254743 - DNA, 21 bp, Homo sapiens
tacatacacttgtataaatgt

SEQ ID NO: 3254744 - DNA, 22 bp, Homo sapiens
tacatacacttgtataaatgta

SEQ ID NO: 3254745 - DNA, 22 bp, Homo sapiens
tacataccctggccgccccctg

SEQ ID NO: 3254746 - DNA, 15 bp, Homo sapiens
tacatacggtcaggt

SEQ ID NO: 3254747 - DNA, 22 bp, Homo sapiens
tacatacggtcaggtttaacat

SEQ ID NO: 3254748 - DNA, 23 bp, Homo sapiens
tacatacggtcaggtttaacatt

SEQ ID NO: 3254749 - DNA, 15 bp, Homo sapiens
tacatactttatcaa

SEQ ID NO: 3254750 - DNA, 16 bp, Homo sapiens
tacatacttttgcaaa

SEQ ID NO: 3254751 - DNA, 17 bp, Homo sapiens
tacatacttttgcaaaa

SEQ ID NO: 3254752 - DNA, 18 bp, Homo sapiens
tacatagagatctatttt

SEQ ID NO: 3254753 - DNA, 14 bp, Homo sapiens
tacatagagctcta

SEQ ID NO: 3254754 - DNA, 20 bp, Homo sapiens
tacatagcctatatttacag

SEQ ID NO: 3254755 - DNA, 14 bp, Homo sapiens
tacatatatatatt

SEQ ID NO: 3254756 - DNA, 23 bp, Homo sapiens
tacatatcgctgacttcatggaa

SEQ ID NO: 3254757 - DNA, 12 bp, Homo sapiens
tacatatcttta

SEQ ID NO: 3254758 - DNA, 22 bp, Homo sapiens
tacatatctttattaatcacta

SEQ ID NO: 3254759 - DNA, 22 bp, Homo sapiens
tacatatgagtgtggaagccgg

SEQ ID NO: 3254760 - DNA, 23 bp, Homo sapiens
tacatatgtagactatatacatg

SEQ ID NO: 3254761 - DNA, 18 bp, Homo sapiens
tacatattaggaaaatat

SEQ ID NO: 3254762 - DNA, 22 bp, Homo sapiens
tacatattgcaggagacatttt

SEQ ID NO: 3254763 - DNA, 13 bp, Homo sapiens
tacatattgtctg

SEQ ID NO: 3254764 - DNA, 13 bp, Homo sapiens
tacatcactgctt

SEQ ID NO: 3254765 - DNA, 23 bp, Homo sapiens
tacatcactgcttgatgaagcaa

SEQ ID NO: 3254766 - DNA, 18 bp, Homo sapiens
tacatcagttattcattc

SEQ ID NO: 3254767 - DNA, 13 bp, Homo sapiens
tacatcccagcct

SEQ ID NO: 3254768 - DNA, 14 bp, Homo sapiens
tacatcccagcctg

SEQ ID NO: 3254769 - DNA, 19 bp, Homo sapiens
tacatctgcaatatgaatt

SEQ ID NO: 3254770 - DNA, 13 bp, Homo sapiens
tacatctggctta

SEQ ID NO: 3254771 - DNA, 13 bp, Homo sapiens
tacatctgtcatg

SEQ ID NO: 3254772 - DNA, 14 bp, Homo sapiens
tacatcttctgcct

SEQ ID NO: 3254773 - DNA, 17 bp, Homo sapiens
tacatcttctgccttag

SEQ ID NO: 3254774 - DNA, 13 bp, Homo sapiens
tacatgaaacaga

SEQ ID NO: 3254775 - DNA, 14 bp, Homo sapiens
tacatgaaacagaa

SEQ ID NO: 3254776 - DNA, 15 bp, Homo sapiens
tacatgaaacagaaa

SEQ ID NO: 3254777 - DNA, 14 bp, Homo sapiens
tacatgaatacaaa

SEQ ID NO: 3254778 - DNA, 18 bp, Homo sapiens
tacatgaattgcatttta

SEQ ID NO: 3254779 - DNA, 18 bp, Homo sapiens
tacatgacgacaaagctg

SEQ ID NO: 3254780 - DNA, 16 bp, Homo sapiens
tacatgactgggcctc

SEQ ID NO: 3254781 - DNA, 14 bp, Homo sapiens
tacatgagaaagat

SEQ ID NO: 3254782 - DNA, 20 bp, Homo sapiens
tacatgcaatttattaaaat

SEQ ID NO: 3254783 - DNA, 22 bp, Homo sapiens
tacatgcagcccatgcccacct

SEQ ID NO: 3254784 - DNA, 14 bp, Homo sapiens
tacatgcatttgag

SEQ ID NO: 3254785 - DNA, 22 bp, Homo sapiens
tacatgctgaaaaatatagcct

SEQ ID NO: 3254786 - DNA, 19 bp, Homo sapiens
tacatggaataacatgtaa

SEQ ID NO: 3254787 - DNA, 15 bp, Homo sapiens
tacatggcaacgtgt

SEQ ID NO: 3254788 - DNA, 21 bp, Homo sapiens
tacatggcaacgtgtgaactg

SEQ ID NO: 3254789 - DNA, 19 bp, Homo sapiens
tacatggcagagtttgtgt

SEQ ID NO: 3254790 - DNA, 14 bp, Homo sapiens
tacatgtaatttga

SEQ ID NO: 3254791 - DNA, 15 bp, Homo sapiens
tacatgtatggttac

SEQ ID NO: 3254792 - DNA, 17 bp, Homo sapiens
tacatgtgatacatttt

SEQ ID NO: 3254793 - DNA, 16 bp, Homo sapiens
tacatgtgtagcctgt

SEQ ID NO: 3254794 - DNA, 18 bp, Homo sapiens
tacatgtgtagcctgtgc

SEQ ID NO: 3254795 - DNA, 12 bp, Homo sapiens
tacatgtgtgta

SEQ ID NO: 3254796 - DNA, 14 bp, Homo sapiens
tacatgtgtgtata

SEQ ID NO: 3254797 - DNA, 21 bp, Homo sapiens
tacatgtgtgtatatatgtgt

SEQ ID NO: 3254798 - DNA, 13 bp, Homo sapiens
tacatgtttataa

SEQ ID NO: 3254799 - DNA, 22 bp, Homo sapiens
tacattaaaactaggtaatgtt

SEQ ID NO: 3254800 - DNA, 15 bp, Homo sapiens
tacattaaaataaac

SEQ ID NO: 3254801 - DNA, 15 bp, Homo sapiens
tacattaatgttaat

SEQ ID NO: 3254802 - DNA, 14 bp, Homo sapiens
tacattattgctta

SEQ ID NO: 3254803 - DNA, 15 bp, Homo sapiens
tacattcatttagct

SEQ ID NO: 3254804 - DNA, 15 bp, Homo sapiens
tacattcctaactag

SEQ ID NO: 3254805 - DNA, 19 bp, Homo sapiens
tacattctgcctagagtgt

SEQ ID NO: 3254806 - DNA, 21 bp, Homo sapiens
tacattgacacacagaaatgt

SEQ ID NO: 3254807 - DNA, 15 bp, Homo sapiens
tacattgtgtgaaaa

SEQ ID NO: 3254808 - DNA, 23 bp, Homo sapiens
tacattgtgtgaaaaaagaaaat

SEQ ID NO: 3254809 - DNA, 13 bp, Homo sapiens
tacatttaaaatt

SEQ ID NO: 3254810 - DNA, 17 bp, Homo sapiens
tacatttaaaattgcta

SEQ ID NO: 3254811 - DNA, 18 bp, Homo sapiens
tacatttaaaattgctat

SEQ ID NO: 3254812 - DNA, 14 bp, Homo sapiens
tacatttaaatcct

SEQ ID NO: 3254813 - DNA, 14 bp, Homo sapiens
tacatttaaatttt

SEQ ID NO: 3254814 - DNA, 14 bp, Homo sapiens
tacatttatgattt

SEQ ID NO: 3254815 - DNA, 11 bp, Homo sapiens
tacatttctgc

SEQ ID NO: 3254816 - DNA, 22 bp, Homo sapiens
tacatttcttagactacattta

SEQ ID NO: 3254817 - DNA, 23 bp, Homo sapiens
tacatttgagggcccagccagga

SEQ ID NO: 3254818 - DNA, 19 bp, Homo sapiens
tacatttgatgcatgtctt

SEQ ID NO: 3254819 - DNA, 23 bp, Homo sapiens
tacatttggagacacaactattt

SEQ ID NO: 3254820 - DNA, 23 bp, Homo sapiens
tacattttaaaggataatggtga

SEQ ID NO: 3254821 - DNA, 21 bp, Homo sapiens
tacattttatatttttgtaca

SEQ ID NO: 3254822 - DNA, 23 bp, Homo sapiens
tacattttattaagctttttgga

SEQ ID NO: 3254823 - DNA, 12 bp, Homo sapiens
tacattttgtta

SEQ ID NO: 3254824 - DNA, 23 bp, Homo sapiens
tacattttgttgtaaaaagaaaa

SEQ ID NO: 3254825 - DNA, 16 bp, Homo sapiens
tacatttttacaataa

SEQ ID NO: 3254826 - DNA, 19 bp, Homo sapiens
tacatttttacaataaata

SEQ ID NO: 3254827 - DNA, 21 bp, Homo sapiens
tacatttttacaataaataat

SEQ ID NO: 3254828 - DNA, 15 bp, Homo sapiens
taccaaaaataaata

SEQ ID NO: 3254829 - DNA, 11 bp, Homo sapiens
taccaaaataa

SEQ ID NO: 3254830 - DNA, 13 bp, Homo sapiens
taccaaaatttta

SEQ ID NO: 3254831 - DNA, 19 bp, Homo sapiens
taccaaagtgacctaccca

SEQ ID NO: 3254832 - DNA, 21 bp, Homo sapiens
taccaaatacacatttcacat

SEQ ID NO: 3254833 - DNA, 18 bp, Homo sapiens
taccaacctcatagagtt

SEQ ID NO: 3254834 - DNA, 12 bp, Homo sapiens
taccaacctgtt

SEQ ID NO: 3254835 - DNA, 12 bp, Homo sapiens
taccaactttac

SEQ ID NO: 3254836 - DNA, 14 bp, Homo sapiens
taccaactttactg

SEQ ID NO: 3254837 - DNA, 14 bp, Homo sapiens
taccaactttctgt

SEQ ID NO: 3254838 - DNA, 19 bp, Homo sapiens
taccaactttctgtaaact

SEQ ID NO: 3254839 - DNA, 17 bp, Homo sapiens
taccaagagtaacttta

SEQ ID NO: 3254840 - DNA, 15 bp, Homo sapiens
taccaatcattttaa

SEQ ID NO: 3254841 - DNA, 15 bp, Homo sapiens
gtttgaaggaaacag

SEQ ID NO: 3254842 - DNA, 16 bp, Homo sapiens
gtttgaaggaaacagt

SEQ ID NO: 3254843 - DNA, 17 bp, Homo sapiens
gtttgaaggaaacagtt

SEQ ID NO: 3254844 - DNA, 13 bp, Homo sapiens
gtttgaattcagt

SEQ ID NO: 3254845 - DNA, 21 bp, Homo sapiens
gtttgacctcacagtgaccct

SEQ ID NO: 3254846 - DNA, 13 bp, Homo sapiens
gtttgactgtgct

SEQ ID NO: 3254847 - DNA, 14 bp, Homo sapiens
gtttgacttgtttg

SEQ ID NO: 3254848 - DNA, 17 bp, Homo sapiens
gtttgacttgtttgtgc

SEQ ID NO: 3254849 - DNA, 19 bp, Homo sapiens
gtttgactttcaaaatata

SEQ ID NO: 3254850 - DNA, 21 bp, Homo sapiens
gtttgagacaagccctggcaa

SEQ ID NO: 3254851 - DNA, 18 bp, Homo sapiens
gtttgagctgccttccct

SEQ ID NO: 3254852 - DNA, 17 bp, Homo sapiens
gtttgaggaagtggctg

SEQ ID NO: 3254853 - DNA, 22 bp, Homo sapiens
gtttgaggagcatgttttgtat

SEQ ID NO: 3254854 - DNA, 20 bp, Homo sapiens
gtttgaggcaaattaactgt

SEQ ID NO: 3254855 - DNA, 22 bp, Homo sapiens
gtttgaggcaaattaactgtat

SEQ ID NO: 3254856 - DNA, 14 bp, Homo sapiens
gtttgatgtatgtg

SEQ ID NO: 3254857 - DNA, 18 bp, Homo sapiens
gtttgatgtatgtgtgaa

SEQ ID NO: 3254858 - DNA, 16 bp, Homo sapiens
gtttgattgaggagct

SEQ ID NO: 3254859 - DNA, 15 bp, Homo sapiens
gtttgatttcattaa

SEQ ID NO: 3254860 - DNA, 15 bp, Homo sapiens
gtttgcacacttgtg

SEQ ID NO: 3254861 - DNA, 16 bp, Homo sapiens
gtttgcaggggtgacg

SEQ ID NO: 3254862 - DNA, 14 bp, Homo sapiens
gtttgccatacttt

SEQ ID NO: 3254863 - DNA, 13 bp, Homo sapiens
gtttgctgtgaac

SEQ ID NO: 3254864 - DNA, 16 bp, Homo sapiens
gtttgcttaaacaaag

SEQ ID NO: 3254865 - DNA, 17 bp, Homo sapiens
gtttgcttaaacaaagt

SEQ ID NO: 3254866 - DNA, 16 bp, Homo sapiens
gtttgcttattgttcc

SEQ ID NO: 3254867 - DNA, 17 bp, Homo sapiens
gtttgcttattgttcca

SEQ ID NO: 3254868 - DNA, 17 bp, Homo sapiens
gtttggaaaagtggcgt

SEQ ID NO: 3254869 - DNA, 15 bp, Homo sapiens
gtttggaatattaaa

SEQ ID NO: 3254870 - DNA, 20 bp, Homo sapiens
gtttggatgggagtgagaca

SEQ ID NO: 3254871 - DNA, 14 bp, Homo sapiens
gtttggcaaggaaa

SEQ ID NO: 3254872 - DNA, 15 bp, Homo sapiens
gtttggcaaggaaag

SEQ ID NO: 3254873 - DNA, 17 bp, Homo sapiens
gtttggcaatagtttgc

SEQ ID NO: 3254874 - DNA, 17 bp, Homo sapiens
gtttggcacttgtattt

SEQ ID NO: 3254875 - DNA, 18 bp, Homo sapiens
gtttggcctcaaaacaga

SEQ ID NO: 3254876 - DNA, 17 bp, Homo sapiens
gtttggcttggccttgg

SEQ ID NO: 3254877 - DNA, 15 bp, Homo sapiens
gtttgggaaagatgg

SEQ ID NO: 3254878 - DNA, 16 bp, Homo sapiens
gtttgggaaagatgga

SEQ ID NO: 3254879 - DNA, 18 bp, Homo sapiens
gtttgggcccctcagagc

SEQ ID NO: 3254880 - DNA, 22 bp, Homo sapiens
gtttgggtatcctgcccagtgt

SEQ ID NO: 3254881 - DNA, 23 bp, Homo sapiens
gtttggtctgggacttccttgct

SEQ ID NO: 3254882 - DNA, 13 bp, Homo sapiens
gtttggtgctttt

SEQ ID NO: 3254883 - DNA, 17 bp, Homo sapiens
gtttggtttgacttgtt

SEQ ID NO: 3254884 - DNA, 15 bp, Homo sapiens
gtttgtaaataagag

SEQ ID NO: 3254885 - DNA, 16 bp, Homo sapiens
gtttgtaccatttatg

SEQ ID NO: 3254886 - DNA, 13 bp, Homo sapiens
gtttgtagccagg

SEQ ID NO: 3254887 - DNA, 15 bp, Homo sapiens
gtttgtagccaggta

SEQ ID NO: 3254888 - DNA, 13 bp, Homo sapiens
gtttgtatgtgtg

SEQ ID NO: 3254889 - DNA, 22 bp, Homo sapiens
gtttgtatttggaatatttgaa

SEQ ID NO: 3254890 - DNA, 16 bp, Homo sapiens
gtttgtattttttatt

SEQ ID NO: 3254891 - DNA, 16 bp, Homo sapiens
gtttgtgcatcctgtg

SEQ ID NO: 3254892 - DNA, 13 bp, Homo sapiens
gtttgtggcctca

SEQ ID NO: 3254893 - DNA, 14 bp, Homo sapiens
gtttgtggcctcag

SEQ ID NO: 3254894 - DNA, 15 bp, Homo sapiens
gtttgtggcctcaga

SEQ ID NO: 3254895 - DNA, 22 bp, Homo sapiens
gtttgtggctgggggcaggagg

SEQ ID NO: 3254896 - DNA, 14 bp, Homo sapiens
gtttgtgtgtctta

SEQ ID NO: 3254897 - DNA, 22 bp, Homo sapiens
gtttgtgttctgtttgttaaaa

SEQ ID NO: 3254898 - DNA, 23 bp, Homo sapiens
gtttgttctccgggtgtggcctc

SEQ ID NO: 3254899 - DNA, 22 bp, Homo sapiens
gtttgtttaaacacttatcttc

SEQ ID NO: 3254900 - DNA, 19 bp, Homo sapiens
gtttgtttctccccctggg

SEQ ID NO: 3254901 - DNA, 13 bp, Homo sapiens
gtttgtttgttgc

SEQ ID NO: 3254902 - DNA, 15 bp, Homo sapiens
gttttaaaaagccag

SEQ ID NO: 3254903 - DNA, 24 bp, Homo sapiens
gttttaaaataaaaattctgaatg

SEQ ID NO: 3254904 - DNA, 23 bp, Homo sapiens
gttttaaacattaatagcagcct

SEQ ID NO: 3254905 - DNA, 14 bp, Homo sapiens
gttttaaactcatt

SEQ ID NO: 3254906 - DNA, 22 bp, Homo sapiens
gttttaaatacgcactacatgt

SEQ ID NO: 3254907 - DNA, 13 bp, Homo sapiens
gttttaaattctg

SEQ ID NO: 3254908 - DNA, 19 bp, Homo sapiens
gttttaaatttatttcaaa

SEQ ID NO: 3254909 - DNA, 16 bp, Homo sapiens
gttttaagaggcaggg

SEQ ID NO: 3254910 - DNA, 16 bp, Homo sapiens
gttttaatctgaaatt

SEQ ID NO: 3254911 - DNA, 18 bp, Homo sapiens
gttttaatctgaaattct

SEQ ID NO: 3254912 - DNA, 20 bp, Homo sapiens
gttttaatctgaaattctaa

SEQ ID NO: 3254913 - DNA, 21 bp, Homo sapiens
gttttaatttaaacacctcct

SEQ ID NO: 3254914 - DNA, 12 bp, Homo sapiens
gttttactcttt

SEQ ID NO: 3254915 - DNA, 20 bp, Homo sapiens
gttttactgtcagattaaat

SEQ ID NO: 3254916 - DNA, 15 bp, Homo sapiens
gttttactgtctatt

SEQ ID NO: 3254917 - DNA, 15 bp, Homo sapiens
gttttactgttttaa

SEQ ID NO: 3254918 - DNA, 21 bp, Homo sapiens
gttttacttttaaactgtgta

SEQ ID NO: 3254919 - DNA, 21 bp, Homo sapiens
gttttagaataaggaggagga

SEQ ID NO: 3254920 - DNA, 18 bp, Homo sapiens
gttttagaggcattgtta

SEQ ID NO: 3254921 - DNA, 15 bp, Homo sapiens
gttttagttggtgct

SEQ ID NO: 3254922 - DNA, 13 bp, Homo sapiens
gttttatatacct

SEQ ID NO: 3254923 - DNA, 15 bp, Homo sapiens
gttttatatattatg

SEQ ID NO: 3254924 - DNA, 20 bp, Homo sapiens
gttttatatattatgtgaag

SEQ ID NO: 3254925 - DNA, 14 bp, Homo sapiens
gttttatcatgaca

SEQ ID NO: 3254926 - DNA, 20 bp, Homo sapiens
gttttattcctgtatgttgt

SEQ ID NO: 3254927 - DNA, 22 bp, Homo sapiens
gttttattgtccttcagagctc

SEQ ID NO: 3254928 - DNA, 13 bp, Homo sapiens
gttttatttttgc

SEQ ID NO: 3254929 - DNA, 21 bp, Homo sapiens
gttttattttttattgttttc

SEQ ID NO: 3254930 - DNA, 17 bp, Homo sapiens
gttttcaaaataaaaat

SEQ ID NO: 3254931 - DNA, 23 bp, Homo sapiens
gttttcaaattggactttcaaaa

SEQ ID NO: 3254932 - DNA, 15 bp, Homo sapiens
gttttcaagtcaaat

SEQ ID NO: 3254933 - DNA, 11 bp, Homo sapiens
gttttcactct

SEQ ID NO: 3254934 - DNA, 13 bp, Homo sapiens
gttttcacttgta

SEQ ID NO: 3254935 - DNA, 17 bp, Homo sapiens
gttttcacttgtattga

SEQ ID NO: 3254936 - DNA, 19 bp, Homo sapiens
gttttcagaacctcttccc

SEQ ID NO: 3254937 - DNA, 18 bp, Homo sapiens
gttttcagaagaaataaa

SEQ ID NO: 3254938 - DNA, 17 bp, Homo sapiens
gttttcagtgtacatgg

SEQ ID NO: 3254939 - DNA, 22 bp, Homo sapiens
gttttcatggtgaaaatgtact

SEQ ID NO: 3254940 - DNA, 21 bp, Homo sapiens
gttttcattatgttcatgtaa

SEQ ID NO: 3254941 - DNA, 16 bp, Homo sapiens
gttttcatttggttca

SEQ ID NO: 3254942 - DNA, 16 bp, Homo sapiens
gttttccagtattgaa

SEQ ID NO: 3254943 - DNA, 18 bp, Homo sapiens
gttttccagtattgaaaa

SEQ ID NO: 3254944 - DNA, 13 bp, Homo sapiens
gttttccatgaaa

SEQ ID NO: 3254945 - DNA, 14 bp, Homo sapiens
gttttccatgaaaa

SEQ ID NO: 3254946 - DNA, 21 bp, Homo sapiens
gttttccccaaaccataaaac

SEQ ID NO: 3254947 - DNA, 12 bp, Homo sapiens
gttttcccctgg

SEQ ID NO: 3254948 - DNA, 14 bp, Homo sapiens
gttttcccctggcc

SEQ ID NO: 3254949 - DNA, 23 bp, Homo sapiens
gttttcccctggcctcagttccc

SEQ ID NO: 3254950 - DNA, 21 bp, Homo sapiens
gttttccctgacctccctcta

SEQ ID NO: 3254951 - DNA, 16 bp, Homo sapiens
gttttcctaaatgcag

SEQ ID NO: 3254952 - DNA, 17 bp, Homo sapiens
gttttcctttctcaccg

SEQ ID NO: 3254953 - DNA, 23 bp, Homo sapiens
gttttcgcacctaccatcaggga

SEQ ID NO: 3254954 - DNA, 19 bp, Homo sapiens
gttttctcagaacagctga

SEQ ID NO: 3254955 - DNA, 19 bp, Homo sapiens
gttttctctcggctcccca

SEQ ID NO: 3254956 - DNA, 14 bp, Homo sapiens
gttttctctgtgtg

SEQ ID NO: 3254957 - DNA, 14 bp, Homo sapiens
gttttctgagcccg

SEQ ID NO: 3254958 - DNA, 19 bp, Homo sapiens
gttttctgagcccgggctg

SEQ ID NO: 3254959 - DNA, 23 bp, Homo sapiens
gttttctgtagtcatttactaaa

SEQ ID NO: 3254960 - DNA, 12 bp, Homo sapiens
gttttcttcctt

SEQ ID NO: 3254961 - DNA, 19 bp, Homo sapiens
gttttcttccttgtaaatt

SEQ ID NO: 3254962 - DNA, 12 bp, Homo sapiens
gttttcttgtaa

SEQ ID NO: 3254963 - DNA, 17 bp, Homo sapiens
gttttcttgtaaatgtt

SEQ ID NO: 3254964 - DNA, 13 bp, Homo sapiens
gttttctttagta

SEQ ID NO: 3254965 - DNA, 15 bp, Homo sapiens
gttttctttctttaa

SEQ ID NO: 3254966 - DNA, 16 bp, Homo sapiens
gttttctttctttaaa

SEQ ID NO: 3254967 - DNA, 15 bp, Homo sapiens
gttttgaaaagctat

SEQ ID NO: 3254968 - DNA, 13 bp, Homo sapiens
gttttgaaatgct

SEQ ID NO: 3254969 - DNA, 18 bp, Homo sapiens
gttttgaagctactgtgt

SEQ ID NO: 3254970 - DNA, 15 bp, Homo sapiens
gttttgaaggcaaaa

SEQ ID NO: 3254971 - DNA, 18 bp, Homo sapiens
taatcctgtaccaaatct

SEQ ID NO: 3254972 - DNA, 23 bp, Homo sapiens
taatcctgtaccaaatctgacat

SEQ ID NO: 3254973 - DNA, 15 bp, Homo sapiens
taatccttgataata

SEQ ID NO: 3254974 - DNA, 13 bp, Homo sapiens
taatcgaaagaaa

SEQ ID NO: 3254975 - DNA, 22 bp, Homo sapiens
taatctagaacacaggcaaaat

SEQ ID NO: 3254976 - DNA, 17 bp, Homo sapiens
taatctagtttacagaa

SEQ ID NO: 3254977 - DNA, 17 bp, Homo sapiens
taatctcaaaggagaaa

SEQ ID NO: 3254978 - DNA, 19 bp, Homo sapiens
taatctctctctctttttt

SEQ ID NO: 3254979 - DNA, 21 bp, Homo sapiens
taatctctgttatgtactgta

SEQ ID NO: 3254980 - DNA, 14 bp, Homo sapiens
taatctgaaattct

SEQ ID NO: 3254981 - DNA, 22 bp, Homo sapiens
taatctgaaattctaaagagca

SEQ ID NO: 3254982 - DNA, 17 bp, Homo sapiens
taatctgaataaagtgt

SEQ ID NO: 3254983 - DNA, 21 bp, Homo sapiens
taatctgaataaagtgtaaca

SEQ ID NO: 3254984 - DNA, 21 bp, Homo sapiens
taatctgcaaagaatgagaag

SEQ ID NO: 3254985 - DNA, 22 bp, Homo sapiens
taatctggactcctctgtccag

SEQ ID NO: 3254986 - DNA, 20 bp, Homo sapiens
taatctgggcagacattatg

SEQ ID NO: 3254987 - DNA, 13 bp, Homo sapiens
taatctgtacatt

SEQ ID NO: 3254988 - DNA, 18 bp, Homo sapiens
taatctgtcaaaacactg

SEQ ID NO: 3254989 - DNA, 13 bp, Homo sapiens
taatctgttatgt

SEQ ID NO: 3254990 - DNA, 18 bp, Homo sapiens
taatcttagtgtatgatt

SEQ ID NO: 3254991 - DNA, 13 bp, Homo sapiens
taatcttatacaa

SEQ ID NO: 3254992 - DNA, 14 bp, Homo sapiens
taatcttatacaac

SEQ ID NO: 3254993 - DNA, 16 bp, Homo sapiens
taatcttcaaagcctt

SEQ ID NO: 3254994 - DNA, 15 bp, Homo sapiens
taatcttcaggtgaa

SEQ ID NO: 3254995 - DNA, 21 bp, Homo sapiens
taatcttcaggtgaacactta

SEQ ID NO: 3254996 - DNA, 17 bp, Homo sapiens
taatcttgtagacactt

SEQ ID NO: 3254997 - DNA, 22 bp, Homo sapiens
taatcttgtagacacttacttg

SEQ ID NO: 3254998 - DNA, 21 bp, Homo sapiens
taatctttcacttgaaagatt

SEQ ID NO: 3254999 - DNA, 22 bp, Homo sapiens
taatctttcacttgaaagattt

SEQ ID NO: 3255000 - DNA, 23 bp, Homo sapiens
taatctttcacttgaaagatttt

SEQ ID NO: 3255001 - DNA, 18 bp, Homo sapiens
taatgaaaatagatgcaa

SEQ ID NO: 3255002 - DNA, 18 bp, Homo sapiens
taatgaaagactgtacaa

SEQ ID NO: 3255003 - DNA, 17 bp, Homo sapiens
taatgaaataatcagtg

SEQ ID NO: 3255004 - DNA, 17 bp, Homo sapiens
taatgaacaaaattatt

SEQ ID NO: 3255005 - DNA, 15 bp, Homo sapiens
taatgaataaactga

SEQ ID NO: 3255006 - DNA, 16 bp, Homo sapiens
taatgaatttttatga

SEQ ID NO: 3255007 - DNA, 21 bp, Homo sapiens
taatgaatttttatgatattc

SEQ ID NO: 3255008 - DNA, 17 bp, Homo sapiens
taatgacagatggtgaa

SEQ ID NO: 3255009 - DNA, 18 bp, Homo sapiens
taatgaccaattgagtaa

SEQ ID NO: 3255010 - DNA, 17 bp, Homo sapiens
taatgactctttctgaa

SEQ ID NO: 3255011 - DNA, 22 bp, Homo sapiens
taatgactctttctgaaggaag

SEQ ID NO: 3255012 - DNA, 11 bp, Homo sapiens
taatgagccat

SEQ ID NO: 3255013 - DNA, 12 bp, Homo sapiens
taatgagccatc

SEQ ID NO: 3255014 - DNA, 15 bp, Homo sapiens
taatgagtatttggt

SEQ ID NO: 3255015 - DNA, 16 bp, Homo sapiens
taatgagtatttggta

SEQ ID NO: 3255016 - DNA, 15 bp, Homo sapiens
taatgatactgatta

SEQ ID NO: 3255017 - DNA, 13 bp, Homo sapiens
taatgatatactg

SEQ ID NO: 3255018 - DNA, 15 bp, Homo sapiens
taatgatcaaaacat

SEQ ID NO: 3255019 - DNA, 20 bp, Homo sapiens
taatgatctcggatgaccaa

SEQ ID NO: 3255020 - DNA, 22 bp, Homo sapiens
taatgatgacaaaaaatgtttt

SEQ ID NO: 3255021 - DNA, 20 bp, Homo sapiens
taatgatttgctctttgaca

SEQ ID NO: 3255022 - DNA, 18 bp, Homo sapiens
taatgcaaattaaaacat

SEQ ID NO: 3255023 - DNA, 17 bp, Homo sapiens
taatgcattaaacctgt

SEQ ID NO: 3255024 - DNA, 21 bp, Homo sapiens
taatgccttactcttcttgaa

SEQ ID NO: 3255025 - DNA, 14 bp, Homo sapiens
taatgctacaattt

SEQ ID NO: 3255026 - DNA, 13 bp, Homo sapiens
taatgctactgtc

SEQ ID NO: 3255027 - DNA, 12 bp, Homo sapiens
taatgctgcctt

SEQ ID NO: 3255028 - DNA, 17 bp, Homo sapiens
taatgcttcaagtgttg

SEQ ID NO: 3255029 - DNA, 15 bp, Homo sapiens
taatgcttgatttag

SEQ ID NO: 3255030 - DNA, 19 bp, Homo sapiens
taatgctttcacaacattt

SEQ ID NO: 3255031 - DNA, 16 bp, Homo sapiens
taatgctttggaaaaa

SEQ ID NO: 3255032 - DNA, 17 bp, Homo sapiens
taatgctttggaaaaat

SEQ ID NO: 3255033 - DNA, 21 bp, Homo sapiens
taatgctttggaaaaatgggt

SEQ ID NO: 3255034 - DNA, 23 bp, Homo sapiens
taatggacatgagataatgttag

SEQ ID NO: 3255035 - DNA, 13 bp, Homo sapiens
taatggagaagac

SEQ ID NO: 3255036 - DNA, 15 bp, Homo sapiens
taatggcagagcagt

SEQ ID NO: 3255037 - DNA, 19 bp, Homo sapiens
taatggcagagcagtctaa

SEQ ID NO: 3255038 - DNA, 16 bp, Homo sapiens
taatggccatggtacc

SEQ ID NO: 3255039 - DNA, 16 bp, Homo sapiens
taatgggcctgcccaa

SEQ ID NO: 3255040 - DNA, 15 bp, Homo sapiens
taatggggcggtgag

SEQ ID NO: 3255041 - DNA, 20 bp, Homo sapiens
taatggtatcctactgagca

SEQ ID NO: 3255042 - DNA, 22 bp, Homo sapiens
taatggtatcctactgagcatt

SEQ ID NO: 3255043 - DNA, 13 bp, Homo sapiens
taatggtctaaaa

SEQ ID NO: 3255044 - DNA, 17 bp, Homo sapiens
taatggtgaacatttta

SEQ ID NO: 3255045 - DNA, 22 bp, Homo sapiens
taatggtttttatttctcgggt

SEQ ID NO: 3255046 - DNA, 14 bp, Homo sapiens
taatgtaagaaaat

SEQ ID NO: 3255047 - DNA, 20 bp, Homo sapiens
taatgtaagaaaatttgaag

SEQ ID NO: 3255048 - DNA, 21 bp, Homo sapiens
taatgtacaagttttgtataa

SEQ ID NO: 3255049 - DNA, 18 bp, Homo sapiens
taatgtactgatttcagt

SEQ ID NO: 3255050 - DNA, 19 bp, Homo sapiens
taatgtactgatttcagta

SEQ ID NO: 3255051 - DNA, 13 bp, Homo sapiens
taatgtactgcat

SEQ ID NO: 3255052 - DNA, 14 bp, Homo sapiens
taatgtagctattt

SEQ ID NO: 3255053 - DNA, 17 bp, Homo sapiens
taatgtaggactgtata

SEQ ID NO: 3255054 - DNA, 18 bp, Homo sapiens
taatgtattagtatggtt

SEQ ID NO: 3255055 - DNA, 17 bp, Homo sapiens
taatgtcacaggcaggt

SEQ ID NO: 3255056 - DNA, 18 bp, Homo sapiens
taatgtcacaggcaggtc

SEQ ID NO: 3255057 - DNA, 17 bp, Homo sapiens
taatgtcagtatttcaa

SEQ ID NO: 3255058 - DNA, 15 bp, Homo sapiens
taatgtcatggcctt

SEQ ID NO: 3255059 - DNA, 16 bp, Homo sapiens
taatgtgaaaagtatc

SEQ ID NO: 3255060 - DNA, 13 bp, Homo sapiens
taatgtgaaaatc

SEQ ID NO: 3255061 - DNA, 14 bp, Homo sapiens
taatgtgaaaatca

SEQ ID NO: 3255062 - DNA, 16 bp, Homo sapiens
taatgtgaaaatcatc

SEQ ID NO: 3255063 - DNA, 16 bp, Homo sapiens
taatgtgaagacattt

SEQ ID NO: 3255064 - DNA, 21 bp, Homo sapiens
taatgtgatatgaaaatatct

SEQ ID NO: 3255065 - DNA, 20 bp, Homo sapiens
taatgtgatggatggcacaa

SEQ ID NO: 3255066 - DNA, 15 bp, Homo sapiens
taatgtggaagaaaa

SEQ ID NO: 3255067 - DNA, 15 bp, Homo sapiens
taatgtgtggattgc

SEQ ID NO: 3255068 - DNA, 23 bp, Homo sapiens
taatgtgtggattgcctctgaaa

SEQ ID NO: 3255069 - DNA, 13 bp, Homo sapiens
taatgtgtgtatg

SEQ ID NO: 3255070 - DNA, 15 bp, Homo sapiens
taatgtgtgtatgtg

SEQ ID NO: 3255071 - DNA, 18 bp, Homo sapiens
taatgtgtgtatgtgtat

SEQ ID NO: 3255072 - DNA, 20 bp, Homo sapiens
taatgttaaatttgtaagtt

SEQ ID NO: 3255073 - DNA, 11 bp, Homo sapiens
taatgttactg

SEQ ID NO: 3255074 - DNA, 23 bp, Homo sapiens
taatgttactgatcatgcattgt

SEQ ID NO: 3255075 - DNA, 18 bp, Homo sapiens
taatgttccccgtggcta

SEQ ID NO: 3255076 - DNA, 21 bp, Homo sapiens
taatgttggacacctttaggt

SEQ ID NO: 3255077 - DNA, 13 bp, Homo sapiens
taatgttgtccag

SEQ ID NO: 3255078 - DNA, 14 bp, Homo sapiens
taatgttgttattt

SEQ ID NO: 3255079 - DNA, 21 bp, Homo sapiens
taatgtttaaatcatgtatgt

SEQ ID NO: 3255080 - DNA, 16 bp, Homo sapiens
taatgtttatgagcca

SEQ ID NO: 3255081 - DNA, 15 bp, Homo sapiens
taatgtttattaaat

SEQ ID NO: 3255082 - DNA, 17 bp, Homo sapiens
taatgtttattaaatgc

SEQ ID NO: 3255083 - DNA, 17 bp, Homo sapiens
taatgtttctatctgat

SEQ ID NO: 3255084 - DNA, 12 bp, Homo sapiens
taatgtttgcta

SEQ ID NO: 3255085 - DNA, 18 bp, Homo sapiens
taatgtttgttacctcca

SEQ ID NO: 3255086 - DNA, 13 bp, Homo sapiens
taatgttttcaaa

SEQ ID NO: 3255087 - DNA, 14 bp, Homo sapiens
taatgttttgtaca

SEQ ID NO: 3255088 - DNA, 20 bp, Homo sapiens
taatgttttgtatatacagt

SEQ ID NO: 3255089 - DNA, 23 bp, Homo sapiens
taatgttttgtatatacagttat

SEQ ID NO: 3255090 - DNA, 23 bp, Homo sapiens
taatgttttttgccacagctttt

SEQ ID NO: 3255091 - DNA, 22 bp, Homo sapiens
taattaaaaagaattcttccac

SEQ ID NO: 3255092 - DNA, 18 bp, Homo sapiens
taattaaaattgtgcata

SEQ ID NO: 3255093 - DNA, 14 bp, Homo sapiens
taattaaacttctt

SEQ ID NO: 3255094 - DNA, 15 bp, Homo sapiens
taattaaacttcttt

SEQ ID NO: 3255095 - DNA, 13 bp, Homo sapiens
taattaaatttaa

SEQ ID NO: 3255096 - DNA, 15 bp, Homo sapiens
taattaaatttaact

SEQ ID NO: 3255097 - DNA, 13 bp, Homo sapiens
taattttaacatc

SEQ ID NO: 3255098 - DNA, 14 bp, Homo sapiens
taattttattcatt

SEQ ID NO: 3255099 - DNA, 17 bp, Homo sapiens
taattttatttataaac

SEQ ID NO: 3255100 - DNA, 16 bp, Homo sapiens
taattttcctcatttt

SEQ ID NO: 3255101 - DNA, 21 bp, Homo sapiens
taattttctagattttctact

SEQ ID NO: 3255102 - DNA, 12 bp, Homo sapiens
taattttctcaa

SEQ ID NO: 3255103 - DNA, 13 bp, Homo sapiens
taattttctcaaa

SEQ ID NO: 3255104 - DNA, 18 bp, Homo sapiens
taattttctcaaaagcat

SEQ ID NO: 3255105 - DNA, 16 bp, Homo sapiens
taattttgatatacat

SEQ ID NO: 3255106 - DNA, 18 bp, Homo sapiens
taattttgatatacattg

SEQ ID NO: 3255107 - DNA, 18 bp, Homo sapiens
taattttgcatactgaaa

SEQ ID NO: 3255108 - DNA, 15 bp, Homo sapiens
taattttgcctttaa

SEQ ID NO: 3255109 - DNA, 14 bp, Homo sapiens
taattttggataat

SEQ ID NO: 3255110 - DNA, 14 bp, Homo sapiens
taattttgtgcatt

SEQ ID NO: 3255111 - DNA, 16 bp, Homo sapiens
taattttgtgcattct

SEQ ID NO: 3255112 - DNA, 11 bp, Homo sapiens
taattttgtgt

SEQ ID NO: 3255113 - DNA, 18 bp, Homo sapiens
taattttgtgttgtacaa

SEQ ID NO: 3255114 - DNA, 13 bp, Homo sapiens
taatttttaaagt

SEQ ID NO: 3255115 - DNA, 20 bp, Homo sapiens
taatttttaccctaatgtct

SEQ ID NO: 3255116 - DNA, 18 bp, Homo sapiens
taatttttatttcttcct

SEQ ID NO: 3255117 - DNA, 18 bp, Homo sapiens
taatttttgcttttagaa

SEQ ID NO: 3255118 - DNA, 20 bp, Homo sapiens
taatttttgcttttagaaaa

SEQ ID NO: 3255119 - DNA, 14 bp, Homo sapiens
taatttttggggaa

SEQ ID NO: 3255120 - DNA, 14 bp, Homo sapiens
taatttttgtaatt

SEQ ID NO: 3255121 - DNA, 17 bp, Homo sapiens
taatttttgtattattt

SEQ ID NO: 3255122 - DNA, 20 bp, Homo sapiens
taattttttgtacttttagt

SEQ ID NO: 3255123 - DNA, 16 bp, Homo sapiens
taatttttttcaatat

SEQ ID NO: 3255124 - DNA, 18 bp, Homo sapiens
taatttttttgagacaga

SEQ ID NO: 3255125 - DNA, 16 bp, Homo sapiens
taattttttttaatgt

SEQ ID NO: 3255126 - DNA, 15 bp, Homo sapiens
taattttttttgttt

SEQ ID NO: 3255127 - DNA, 21 bp, Homo sapiens
taattttttttgttttttgta

SEQ ID NO: 3255128 - DNA, 19 bp, Homo sapiens
tacaaaaaaaaagttttat

SEQ ID NO: 3255129 - DNA, 20 bp, Homo sapiens
tacaaaaaaaaagttttatt

SEQ ID NO: 3255130 - DNA, 20 bp, Homo sapiens
tacaaaaaggtataaataat

SEQ ID NO: 3255131 - DNA, 16 bp, Homo sapiens
tacaaaactgtaaata

SEQ ID NO: 3255132 - DNA, 21 bp, Homo sapiens
tacaaaagaagggctggtatt

SEQ ID NO: 3255133 - DNA, 23 bp, Homo sapiens
tacaaacaagtggatgtttttaa

SEQ ID NO: 3255134 - DNA, 19 bp, Homo sapiens
tacaaactcccacttgtca

SEQ ID NO: 3255135 - DNA, 14 bp, Homo sapiens
tacaaactgcaata

SEQ ID NO: 3255136 - DNA, 19 bp, Homo sapiens
tacaaagaaccatgcagga

SEQ ID NO: 3255137 - DNA, 19 bp, Homo sapiens
tacaaagagccttcctatt

SEQ ID NO: 3255138 - DNA, 16 bp, Homo sapiens
tacaaagctttgctac

SEQ ID NO: 3255139 - DNA, 15 bp, Homo sapiens
tacaaagttttcctt

SEQ ID NO: 3255140 - DNA, 17 bp, Homo sapiens
tacaaagttttcctttg

SEQ ID NO: 3255141 - DNA, 18 bp, Homo sapiens
tacaaagttttcctttgt

SEQ ID NO: 3255142 - DNA, 16 bp, Homo sapiens
tacaaatcaagtattt

SEQ ID NO: 3255143 - DNA, 17 bp, Homo sapiens
tacaaatcagaagtcat

SEQ ID NO: 3255144 - DNA, 19 bp, Homo sapiens
tacaaatcagaagtcatct

SEQ ID NO: 3255145 - DNA, 22 bp, Homo sapiens
tacaaatcagaagtcatcttgc

SEQ ID NO: 3255146 - DNA, 17 bp, Homo sapiens
tacaaatgtattttgaa

SEQ ID NO: 3255147 - DNA, 20 bp, Homo sapiens
tacaaatgtattttgaagaa

SEQ ID NO: 3255148 - DNA, 15 bp, Homo sapiens
tacaaattaaaaaga

SEQ ID NO: 3255149 - DNA, 15 bp, Homo sapiens
tacaaattagaaaat

SEQ ID NO: 3255150 - DNA, 13 bp, Homo sapiens
tacaaattataaa

SEQ ID NO: 3255151 - DNA, 15 bp, Homo sapiens
tacaaattataaaaa

SEQ ID NO: 3255152 - DNA, 19 bp, Homo sapiens
tacaaattataaaaagcca

SEQ ID NO: 3255153 - DNA, 21 bp, Homo sapiens
tacaaattataaaaagccact

SEQ ID NO: 3255154 - DNA, 14 bp, Homo sapiens
tacaaatttatgca

SEQ ID NO: 3255155 - DNA, 19 bp, Homo sapiens
tacaaatttatgcatttca

SEQ ID NO: 3255156 - DNA, 21 bp, Homo sapiens
tacaaatttatgcatttcatt

SEQ ID NO: 3255157 - DNA, 22 bp, Homo sapiens
tacaacaagagtttatttccaa

SEQ ID NO: 3255158 - DNA, 21 bp, Homo sapiens
tacaacagaaaccagaaaagc

SEQ ID NO: 3255159 - DNA, 22 bp, Homo sapiens
tacaacataatctagtttacag

SEQ ID NO: 3255160 - DNA, 18 bp, Homo sapiens
tacaactcaaaaaacatt

SEQ ID NO: 3255161 - DNA, 22 bp, Homo sapiens
tacaagaagtttattctcattt

SEQ ID NO: 3255162 - DNA, 19 bp, Homo sapiens
tacaagactgttgtgatct

SEQ ID NO: 3255163 - DNA, 20 bp, Homo sapiens
tacaagactgttgtgatctt

SEQ ID NO: 3255164 - DNA, 23 bp, Homo sapiens
tacaagagcagcctgtggcatct

SEQ ID NO: 3255165 - DNA, 18 bp, Homo sapiens
tacaagatattgatgata

SEQ ID NO: 3255166 - DNA, 19 bp, Homo sapiens
tacaagatccatttgcctt

SEQ ID NO: 3255167 - DNA, 22 bp, Homo sapiens
tacaagatccatttgcctttct

SEQ ID NO: 3255168 - DNA, 21 bp, Homo sapiens
tacaagattagaagctgaaaa

SEQ ID NO: 3255169 - DNA, 19 bp, Homo sapiens
tacaagcgtgagccactgc

SEQ ID NO: 3255170 - DNA, 21 bp, Homo sapiens
tacaagcgtgagccactgcac

SEQ ID NO: 3255171 - DNA, 15 bp, Homo sapiens
tacaaggatgaaaga

SEQ ID NO: 3255172 - DNA, 18 bp, Homo sapiens
tacaaggcaagcattttt

SEQ ID NO: 3255173 - DNA, 14 bp, Homo sapiens
tacaagtgtatatc

SEQ ID NO: 3255174 - DNA, 16 bp, Homo sapiens
tacaagtttcagacag

SEQ ID NO: 3255175 - DNA, 12 bp, Homo sapiens
tacaataaacta

SEQ ID NO: 3255176 - DNA, 19 bp, Homo sapiens
tacaataaactattggaaa

SEQ ID NO: 3255177 - DNA, 22 bp, Homo sapiens
tacaataagcgttaagggcaga

SEQ ID NO: 3255178 - DNA, 17 bp, Homo sapiens
tacaataccgttaagat

SEQ ID NO: 3255179 - DNA, 18 bp, Homo sapiens
tacaataccgttaagata

SEQ ID NO: 3255180 - DNA, 18 bp, Homo sapiens
tacaatattatgtttcct

SEQ ID NO: 3255181 - DNA, 14 bp, Homo sapiens
tacaatattgattg

SEQ ID NO: 3255182 - DNA, 18 bp, Homo sapiens
tacacccagttctgaata

SEQ ID NO: 3255183 - DNA, 19 bp, Homo sapiens
tacacccagttctgaataa

SEQ ID NO: 3255184 - DNA, 12 bp, Homo sapiens
tacacctggctg

SEQ ID NO: 3255185 - DNA, 22 bp, Homo sapiens
tacacctggctgaggttcctct

SEQ ID NO: 3255186 - DNA, 23 bp, Homo sapiens
tacacctggctgaggttcctctg

SEQ ID NO: 3255187 - DNA, 14 bp, Homo sapiens
tacaccttgccttg

SEQ ID NO: 3255188 - DNA, 16 bp, Homo sapiens
tacacgtctggacccc

SEQ ID NO: 3255189 - DNA, 13 bp, Homo sapiens
tacacgtgtcctg

SEQ ID NO: 3255190 - DNA, 17 bp, Homo sapiens
tacacgtgtcctgtagt

SEQ ID NO: 3255191 - DNA, 12 bp, Homo sapiens
tacactaacatt

SEQ ID NO: 3255192 - DNA, 20 bp, Homo sapiens
tacactaagggtgtaagtaa

SEQ ID NO: 3255193 - DNA, 16 bp, Homo sapiens
tacactccagcctgag

SEQ ID NO: 3255194 - DNA, 17 bp, Homo sapiens
tacactccagcctgagc

SEQ ID NO: 3255195 - DNA, 18 bp, Homo sapiens
tacactccagcctgagca

SEQ ID NO: 3255196 - DNA, 13 bp, Homo sapiens
tacactgcctgta

SEQ ID NO: 3255197 - DNA, 23 bp, Homo sapiens
tacactgcctgtatactttagta

SEQ ID NO: 3255198 - DNA, 23 bp, Homo sapiens
tacactgctgtacccagatgcct

SEQ ID NO: 3255199 - DNA, 24 bp, Homo sapiens
tacactgctgtacccagatgccta

SEQ ID NO: 3255200 - DNA, 16 bp, Homo sapiens
tacactgtgccttttc

SEQ ID NO: 3255201 - DNA, 18 bp, Homo sapiens
tacactgtgccttttccc

SEQ ID NO: 3255202 - DNA, 18 bp, Homo sapiens
tacactgttagaacacta

SEQ ID NO: 3255203 - DNA, 13 bp, Homo sapiens
tacacttcttttg

SEQ ID NO: 3255204 - DNA, 18 bp, Homo sapiens
tacacttgtataaatgta

SEQ ID NO: 3255205 - DNA, 16 bp, Homo sapiens
tacacttttatttcct

SEQ ID NO: 3255206 - DNA, 17 bp, Homo sapiens
tacacttttttccaaag

SEQ ID NO: 3255207 - DNA, 14 bp, Homo sapiens
tacagaaactgatg

SEQ ID NO: 3255208 - DNA, 16 bp, Homo sapiens
tacagaaactgatgcc

SEQ ID NO: 3255209 - DNA, 13 bp, Homo sapiens
tacagaaagctgc

SEQ ID NO: 3255210 - DNA, 14 bp, Homo sapiens
tacagaaatactat

SEQ ID NO: 3255211 - DNA, 14 bp, Homo sapiens
tacagaaatgcaaa

SEQ ID NO: 3255212 - DNA, 15 bp, Homo sapiens
tacagaacttcagaa

SEQ ID NO: 3255213 - DNA, 19 bp, Homo sapiens
tacagaacttcagaaagac

SEQ ID NO: 3255214 - DNA, 23 bp, Homo sapiens
tacagaataatccagtattgctg

SEQ ID NO: 3255215 - DNA, 18 bp, Homo sapiens
tacagaataatgtgttaa

SEQ ID NO: 3255216 - DNA, 18 bp, Homo sapiens
tacagaatatttctattg

SEQ ID NO: 3255217 - DNA, 16 bp, Homo sapiens
tacagaatttgaatta

SEQ ID NO: 3255218 - DNA, 21 bp, Homo sapiens
tacagacaaacttgatttctt

SEQ ID NO: 3255219 - DNA, 11 bp, Homo sapiens
tacagacacta

SEQ ID NO: 3255220 - DNA, 14 bp, Homo sapiens
tacagacactaagt

SEQ ID NO: 3255221 - DNA, 20 bp, Homo sapiens
tacagacctgctttttgaaa

SEQ ID NO: 3255222 - DNA, 20 bp, Homo sapiens
tacagactgttttactgttt

SEQ ID NO: 3255223 - DNA, 20 bp, Homo sapiens
tacagagaggagaaacacat

SEQ ID NO: 3255224 - DNA, 22 bp, Homo sapiens
tacagagaggagaaacacatct

SEQ ID NO: 3255225 - DNA, 14 bp, Homo sapiens
tacagataattcat

SEQ ID NO: 3255226 - DNA, 19 bp, Homo sapiens
tacagataattcatttgta

SEQ ID NO: 3255227 - DNA, 24 bp, Homo sapiens
tacagataattcatttgtattgct

SEQ ID NO: 3255228 - DNA, 17 bp, Homo sapiens
tacagatcctttttcca

SEQ ID NO: 3255229 - DNA, 22 bp, Homo sapiens
tacagatgaatgtatttatttg

SEQ ID NO: 3255230 - DNA, 14 bp, Homo sapiens
tacagatgcctttt

SEQ ID NO: 3255231 - DNA, 17 bp, Homo sapiens
tacagatgtgaaaataa

SEQ ID NO: 3255232 - DNA, 16 bp, Homo sapiens
tacagattttatttgt

SEQ ID NO: 3255233 - DNA, 19 bp, Homo sapiens
tacagcaacaatttatgaa

SEQ ID NO: 3255234 - DNA, 19 bp, Homo sapiens
tacagcccctttttcatat

SEQ ID NO: 3255235 - DNA, 18 bp, Homo sapiens
tacagctaatcagcattc

SEQ ID NO: 3255236 - DNA, 11 bp, Homo sapiens
tacagctcccc

SEQ ID NO: 3255237 - DNA, 15 bp, Homo sapiens
tacagctccccaagt

SEQ ID NO: 3255238 - DNA, 16 bp, Homo sapiens
tacagctcccttccct

SEQ ID NO: 3255239 - DNA, 20 bp, Homo sapiens
tacagctctcccctcccttg

SEQ ID NO: 3255240 - DNA, 14 bp, Homo sapiens
tacagctgcctgca

SEQ ID NO: 3255241 - DNA, 10 bp, Homo sapiens
tacagctggg

SEQ ID NO: 3255242 - DNA, 16 bp, Homo sapiens
tacagctgtttaagat

SEQ ID NO: 3255243 - DNA, 23 bp, Homo sapiens
tacagcttcattatctgagttgc

SEQ ID NO: 3255244 - DNA, 20 bp, Homo sapiens
tacagctttacacacacaga

SEQ ID NO: 3255245 - DNA, 18 bp, Homo sapiens
tacagctttcatgattag

SEQ ID NO: 3255246 - DNA, 19 bp, Homo sapiens
tacaggaaaagctgctgac

SEQ ID NO: 3255247 - DNA, 21 bp, Homo sapiens
tacaggaagcaccccatgcca

SEQ ID NO: 3255248 - DNA, 16 bp, Homo sapiens
tacaggaatgaagaac

SEQ ID NO: 3255249 - DNA, 19 bp, Homo sapiens
tacaggacaaagggaggga

SEQ ID NO: 3255250 - DNA, 23 bp, Homo sapiens
tacaggacaaagggagggagcaa

SEQ ID NO: 3255251 - DNA, 13 bp, Homo sapiens
tacaggactgtaa

SEQ ID NO: 3255252 - DNA, 15 bp, Homo sapiens
tacaggagaggcagc

SEQ ID NO: 3255253 - DNA, 18 bp, Homo sapiens
tacaggagaggcagcatg

SEQ ID NO: 3255254 - DNA, 19 bp, Homo sapiens
tacaggagaggcagcatgc

SEQ ID NO: 3255255 - DNA, 15 bp, Homo sapiens
tacaggagggaacat

SEQ ID NO: 3255256 - DNA, 21 bp, Homo sapiens
tacaggagggaacatttccga

SEQ ID NO: 3255257 - DNA, 14 bp, Homo sapiens
tacaggcaccgaga

SEQ ID NO: 3255258 - DNA, 20 bp, Homo sapiens
tacaggcaccgagaatgttg

SEQ ID NO: 3255259 - DNA, 15 bp, Homo sapiens
tacaggccctgctcc

SEQ ID NO: 3255260 - DNA, 20 bp, Homo sapiens
tacagggagcctcctgccca

SEQ ID NO: 3255261 - DNA, 21 bp, Homo sapiens
tacagggcatgcattttgcag

SEQ ID NO: 3255262 - DNA, 20 bp, Homo sapiens
tacagggtaactgtgctgaa

SEQ ID NO: 3255263 - DNA, 19 bp, Homo sapiens
tacagggtagataacctgt

SEQ ID NO: 3255264 - DNA, 14 bp, Homo sapiens
tacagggtgactca

SEQ ID NO: 3255265 - DNA, 22 bp, Homo sapiens
tacaggtgtgtgccaccacacc

SEQ ID NO: 3255266 - DNA, 16 bp, Homo sapiens
tacagtaactaatttt

SEQ ID NO: 3255267 - DNA, 18 bp, Homo sapiens
tacagtaactttatgtgt

SEQ ID NO: 3255268 - DNA, 20 bp, Homo sapiens
tacagtaactttatgtgtaa

SEQ ID NO: 3255269 - DNA, 20 bp, Homo sapiens
tacagtacaatcagcagtct

SEQ ID NO: 3255270 - DNA, 16 bp, Homo sapiens
gttgacagttctgaag

SEQ ID NO: 3255271 - DNA, 17 bp, Homo sapiens
gttgacagttctgaaga

SEQ ID NO: 3255272 - DNA, 18 bp, Homo sapiens
gttgacatccaaatctag

SEQ ID NO: 3255273 - DNA, 15 bp, Homo sapiens
gttgacgagactggt

SEQ ID NO: 3255274 - DNA, 22 bp, Homo sapiens
gttgactcacaggccctggaga

SEQ ID NO: 3255275 - DNA, 21 bp, Homo sapiens
gttgacttattttctctgtgt

SEQ ID NO: 3255276 - DNA, 12 bp, Homo sapiens
gttgactttctc

SEQ ID NO: 3255277 - DNA, 16 bp, Homo sapiens
gttgagaatcccaaat

SEQ ID NO: 3255278 - DNA, 14 bp, Homo sapiens
gttgagagggaaaa

SEQ ID NO: 3255279 - DNA, 23 bp, Homo sapiens
gttgagccaggcctgggtctgtg

SEQ ID NO: 3255280 - DNA, 10 bp, Homo sapiens
gttgagcccc

SEQ ID NO: 3255281 - DNA, 19 bp, Homo sapiens
gttgagccccaagtcctga

SEQ ID NO: 3255282 - DNA, 14 bp, Homo sapiens
gttgagccttttcc

SEQ ID NO: 3255283 - DNA, 21 bp, Homo sapiens
gttgaggagtttcctaaaagt

SEQ ID NO: 3255284 - DNA, 21 bp, Homo sapiens
gttgaggcagggcaaatgaca

SEQ ID NO: 3255285 - DNA, 20 bp, Homo sapiens
gttgaggcggtttcctgaat

SEQ ID NO: 3255286 - DNA, 17 bp, Homo sapiens
gttgaggggctcctgga

SEQ ID NO: 3255287 - DNA, 16 bp, Homo sapiens
gttgaggtttttaaat

SEQ ID NO: 3255288 - DNA, 19 bp, Homo sapiens
gttgagtacagtgaggagg

SEQ ID NO: 3255289 - DNA, 21 bp, Homo sapiens
gttgataaattccactggact

SEQ ID NO: 3255290 - DNA, 20 bp, Homo sapiens
gttgatatttcgaaagctgc

SEQ ID NO: 3255291 - DNA, 20 bp, Homo sapiens
gttgatcactggcaatgaaa

SEQ ID NO: 3255292 - DNA, 22 bp, Homo sapiens
gttgatcatgtactttttagta

SEQ ID NO: 3255293 - DNA, 19 bp, Homo sapiens
gttgatcttacaagatatt

SEQ ID NO: 3255294 - DNA, 22 bp, Homo sapiens
gttgatgatctttgcagacagg

SEQ ID NO: 3255295 - DNA, 23 bp, Homo sapiens
gttgatgatctttgcagacaggc

SEQ ID NO: 3255296 - DNA, 22 bp, Homo sapiens
gttgatttttttttttttttcc

SEQ ID NO: 3255297 - DNA, 13 bp, Homo sapiens
gttgcaaccactg

SEQ ID NO: 3255298 - DNA, 14 bp, Homo sapiens
gttgcaaccactgc

SEQ ID NO: 3255299 - DNA, 19 bp, Homo sapiens
gttgcaccatctgcttggt

SEQ ID NO: 3255300 - DNA, 21 bp, Homo sapiens
gttgcagagaagcatcctcca

SEQ ID NO: 3255301 - DNA, 15 bp, Homo sapiens
gttgcagtgagctga

SEQ ID NO: 3255302 - DNA, 19 bp, Homo sapiens
gttgcatactgagccaagt

SEQ ID NO: 3255303 - DNA, 18 bp, Homo sapiens
gttgcatagcagtatatg

SEQ ID NO: 3255304 - DNA, 20 bp, Homo sapiens
gttgcatgtcgtgaccaact

SEQ ID NO: 3255305 - DNA, 20 bp, Homo sapiens
gttgccaaatctggctcctt

SEQ ID NO: 3255306 - DNA, 13 bp, Homo sapiens
gttgccaagctgg

SEQ ID NO: 3255307 - DNA, 15 bp, Homo sapiens
gttgccacaggcctc

SEQ ID NO: 3255308 - DNA, 19 bp, Homo sapiens
gttgccacagtagaactgt

SEQ ID NO: 3255309 - DNA, 17 bp, Homo sapiens
gttgccaccacctctgt

SEQ ID NO: 3255310 - DNA, 14 bp, Homo sapiens
gttgcccaggcagg

SEQ ID NO: 3255311 - DNA, 18 bp, Homo sapiens
gttgcccaggcaggtctt

SEQ ID NO: 3255312 - DNA, 13 bp, Homo sapiens
gttgcccaggctg

SEQ ID NO: 3255313 - DNA, 20 bp, Homo sapiens
gttgcctttatttgctgtta

SEQ ID NO: 3255314 - DNA, 12 bp, Homo sapiens
gttgccttttat

SEQ ID NO: 3255315 - DNA, 20 bp, Homo sapiens
gttgcgacggagagaaaaaa

SEQ ID NO: 3255316 - DNA, 17 bp, Homo sapiens
gttgcgttcctttcttt

SEQ ID NO: 3255317 - DNA, 15 bp, Homo sapiens
gttgctaaaaaaagt

SEQ ID NO: 3255318 - DNA, 18 bp, Homo sapiens
gttgctcaaaaaatgagc

SEQ ID NO: 3255319 - DNA, 22 bp, Homo sapiens
gttgctcagcaaggggctctgc

SEQ ID NO: 3255320 - DNA, 20 bp, Homo sapiens
gttgctctaggaagacattt

SEQ ID NO: 3255321 - DNA, 23 bp, Homo sapiens
gttgctgatgaactcttaatcaa

SEQ ID NO: 3255322 - DNA, 17 bp, Homo sapiens
gttgctggttgctgtgt

SEQ ID NO: 3255323 - DNA, 16 bp, Homo sapiens
gttgctgtgtggtttg

SEQ ID NO: 3255324 - DNA, 15 bp, Homo sapiens
gttgctgtttatttt

SEQ ID NO: 3255325 - DNA, 23 bp, Homo sapiens
gttgcttagatgagggtgactgt

SEQ ID NO: 3255326 - DNA, 14 bp, Homo sapiens
gttgcttgtcttct

SEQ ID NO: 3255327 - DNA, 22 bp, Homo sapiens
gttggaaaagaatacagaaaga

SEQ ID NO: 3255328 - DNA, 20 bp, Homo sapiens
gttggaagcttgttttccag

SEQ ID NO: 3255329 - DNA, 22 bp, Homo sapiens
gttggaaggggccttgctgagt

SEQ ID NO: 3255330 - DNA, 22 bp, Homo sapiens
gttggaatgaattaaataaacc

SEQ ID NO: 3255331 - DNA, 15 bp, Homo sapiens
gttggaatggatttt

SEQ ID NO: 3255332 - DNA, 14 bp, Homo sapiens
gttggactaaatgc

SEQ ID NO: 3255333 - DNA, 15 bp, Homo sapiens
gttggactaaatgcc

SEQ ID NO: 3255334 - DNA, 14 bp, Homo sapiens
gttggacttcagtc

SEQ ID NO: 3255335 - DNA, 12 bp, Homo sapiens
gttggagccact

SEQ ID NO: 3255336 - DNA, 13 bp, Homo sapiens
gttggagccactc

SEQ ID NO: 3255337 - DNA, 20 bp, Homo sapiens
gttggagccactcctgtccc

SEQ ID NO: 3255338 - DNA, 13 bp, Homo sapiens
gttggatcttcaa

SEQ ID NO: 3255339 - DNA, 15 bp, Homo sapiens
gttggatgggagtgg

SEQ ID NO: 3255340 - DNA, 18 bp, Homo sapiens
gttggatgggagtgggca

SEQ ID NO: 3255341 - DNA, 17 bp, Homo sapiens
gttggcaacaggacaga

SEQ ID NO: 3255342 - DNA, 15 bp, Homo sapiens
gttggcacagaacag

SEQ ID NO: 3255343 - DNA, 17 bp, Homo sapiens
gttggcacatttcatga

SEQ ID NO: 3255344 - DNA, 20 bp, Homo sapiens
gttggcactcacagacctgg

SEQ ID NO: 3255345 - DNA, 12 bp, Homo sapiens
gttggcagctct

SEQ ID NO: 3255346 - DNA, 17 bp, Homo sapiens
gttggcaggctggccag

SEQ ID NO: 3255347 - DNA, 20 bp, Homo sapiens
gttggcaggctggccagtcc

SEQ ID NO: 3255348 - DNA, 16 bp, Homo sapiens
gttggcagtgagtgag

SEQ ID NO: 3255349 - DNA, 22 bp, Homo sapiens
gttggcctcagggccaggaagg

SEQ ID NO: 3255350 - DNA, 13 bp, Homo sapiens
gttggcctgcact

SEQ ID NO: 3255351 - DNA, 14 bp, Homo sapiens
gttgggactcagga

SEQ ID NO: 3255352 - DNA, 15 bp, Homo sapiens
gttgggagcactgga

SEQ ID NO: 3255353 - DNA, 16 bp, Homo sapiens
gttgggagcactggag

SEQ ID NO: 3255354 - DNA, 17 bp, Homo sapiens
gttgggcccagatctgg

SEQ ID NO: 3255355 - DNA, 22 bp, Homo sapiens
gttgggggcactcagccacgac

SEQ ID NO: 3255356 - DNA, 22 bp, Homo sapiens
gttggggggactctgagcggga

SEQ ID NO: 3255357 - DNA, 19 bp, Homo sapiens
gttgggtagatgggtgggg

SEQ ID NO: 3255358 - DNA, 13 bp, Homo sapiens
gttggtagtttct

SEQ ID NO: 3255359 - DNA, 18 bp, Homo sapiens
gttggtatattttatatt

SEQ ID NO: 3255360 - DNA, 22 bp, Homo sapiens
gttggtccagagcggaggctgt

SEQ ID NO: 3255361 - DNA, 12 bp, Homo sapiens
gttggtgctgat

SEQ ID NO: 3255362 - DNA, 12 bp, Homo sapiens
gttggtggggcc

SEQ ID NO: 3255363 - DNA, 15 bp, Homo sapiens
gttggtggggccagg

SEQ ID NO: 3255364 - DNA, 19 bp, Homo sapiens
gttggtggggccaggccag

SEQ ID NO: 3255365 - DNA, 20 bp, Homo sapiens
gttggtggggccaggccagg

SEQ ID NO: 3255366 - DNA, 14 bp, Homo sapiens
gttggtgtgttttt

SEQ ID NO: 3255367 - DNA, 18 bp, Homo sapiens
gttggttccaagccctgg

SEQ ID NO: 3255368 - DNA, 14 bp, Homo sapiens
gttggtttactttc

SEQ ID NO: 3255369 - DNA, 23 bp, Homo sapiens
gttgtaaacaacgtgtatagtgc

SEQ ID NO: 3255370 - DNA, 20 bp, Homo sapiens
gttgtaaatatttatgtaaa

SEQ ID NO: 3255371 - DNA, 15 bp, Homo sapiens
gtttcctaaaagttc

SEQ ID NO: 3255372 - DNA, 20 bp, Homo sapiens
gtttcctcattcctgaaaga

SEQ ID NO: 3255373 - DNA, 14 bp, Homo sapiens
gtttcctgcaggca

SEQ ID NO: 3255374 - DNA, 17 bp, Homo sapiens
gtttccttattccacag

SEQ ID NO: 3255375 - DNA, 14 bp, Homo sapiens
gtttccttttggaa

SEQ ID NO: 3255376 - DNA, 22 bp, Homo sapiens
gtttccttttggaacatttctt

SEQ ID NO: 3255377 - DNA, 16 bp, Homo sapiens
gtttcgactggtccag

SEQ ID NO: 3255378 - DNA, 19 bp, Homo sapiens
gtttcgactggtccagctc

SEQ ID NO: 3255379 - DNA, 20 bp, Homo sapiens
gtttcgactggtccagctct

SEQ ID NO: 3255380 - DNA, 21 bp, Homo sapiens
gtttcgactggtccagctctg

SEQ ID NO: 3255381 - DNA, 16 bp, Homo sapiens
gtttctaagattctaa

SEQ ID NO: 3255382 - DNA, 17 bp, Homo sapiens
gtttctaagattctaaa

SEQ ID NO: 3255383 - DNA, 18 bp, Homo sapiens
gtttctaagattctaaag

SEQ ID NO: 3255384 - DNA, 21 bp, Homo sapiens
gtttctaagattctaaaggtc

SEQ ID NO: 3255385 - DNA, 18 bp, Homo sapiens
gtttctagaggcctcagt

SEQ ID NO: 3255386 - DNA, 20 bp, Homo sapiens
gtttctagaggcctcagttt

SEQ ID NO: 3255387 - DNA, 14 bp, Homo sapiens
gtttctcagctccc

SEQ ID NO: 3255388 - DNA, 14 bp, Homo sapiens
gtttctccccctgg

SEQ ID NO: 3255389 - DNA, 17 bp, Homo sapiens
gtttctccccctgggct

SEQ ID NO: 3255390 - DNA, 23 bp, Homo sapiens
gtttctccccctgggctctgccc

SEQ ID NO: 3255391 - DNA, 12 bp, Homo sapiens
gtttctctgctg

SEQ ID NO: 3255392 - DNA, 18 bp, Homo sapiens
gtttctgaaaatgtttaa

SEQ ID NO: 3255393 - DNA, 12 bp, Homo sapiens
gtttctgactct

SEQ ID NO: 3255394 - DNA, 17 bp, Homo sapiens
gtttctgactctgagct

SEQ ID NO: 3255395 - DNA, 14 bp, Homo sapiens
gtttctgagaaaag

SEQ ID NO: 3255396 - DNA, 22 bp, Homo sapiens
gtttctgggtcctgaagaatta

SEQ ID NO: 3255397 - DNA, 18 bp, Homo sapiens
gtttctggtgccatttct

SEQ ID NO: 3255398 - DNA, 13 bp, Homo sapiens
gtttctgtctgta

SEQ ID NO: 3255399 - DNA, 13 bp, Homo sapiens
gtttctgttccaa

SEQ ID NO: 3255400 - DNA, 14 bp, Homo sapiens
gtttctgttccaaa

SEQ ID NO: 3255401 - DNA, 13 bp, Homo sapiens
gtttcttagcttt

SEQ ID NO: 3255402 - DNA, 20 bp, Homo sapiens
gtttcttctgcgcctcaggc

SEQ ID NO: 3255403 - DNA, 13 bp, Homo sapiens
gtttcttcttgtg

SEQ ID NO: 3255404 - DNA, 18 bp, Homo sapiens
gtttcttgacaagctgac

SEQ ID NO: 3255405 - DNA, 21 bp, Homo sapiens
gtttctttgtggtctgtgtca

SEQ ID NO: 3255406 - DNA, 22 bp, Homo sapiens
gtttcttttttttttttttaca

SEQ ID NO: 3255407 - DNA, 23 bp, Homo sapiens
gttttgattaatgtttcttaaat

SEQ ID NO: 3255408 - DNA, 14 bp, Homo sapiens
gttttgcaataact

SEQ ID NO: 3255409 - DNA, 22 bp, Homo sapiens
gttttgcacagccaaatttaaa

SEQ ID NO: 3255410 - DNA, 22 bp, Homo sapiens
gttttgccccaagtcctcattt

SEQ ID NO: 3255411 - DNA, 19 bp, Homo sapiens
gttttggagagtttgcctg

SEQ ID NO: 3255412 - DNA, 18 bp, Homo sapiens
gttttggatcttgaatgt

SEQ ID NO: 3255413 - DNA, 23 bp, Homo sapiens
gttttgggccagaggcagcctct

SEQ ID NO: 3255414 - DNA, 21 bp, Homo sapiens
gttttgggggtgtgagtgttt

SEQ ID NO: 3255415 - DNA, 18 bp, Homo sapiens
gttttgggtgaatcttga

SEQ ID NO: 3255416 - DNA, 16 bp, Homo sapiens
gttttgtacaaagttt

SEQ ID NO: 3255417 - DNA, 17 bp, Homo sapiens
gttttgtacactgctgt

SEQ ID NO: 3255418 - DNA, 17 bp, Homo sapiens
gttttgtacatagattt

SEQ ID NO: 3255419 - DNA, 18 bp, Homo sapiens
gttttgtacatagattta

SEQ ID NO: 3255420 - DNA, 19 bp, Homo sapiens
gttttgtcttgaaagtggc

SEQ ID NO: 3255421 - DNA, 13 bp, Homo sapiens
gttttgtttgtct

SEQ ID NO: 3255422 - DNA, 15 bp, Homo sapiens
gtttttaaaagtttc

SEQ ID NO: 3255423 - DNA, 18 bp, Homo sapiens
gtttttaaatgaggatta

SEQ ID NO: 3255424 - DNA, 22 bp, Homo sapiens
gtttttaacctgttttgttaat

SEQ ID NO: 3255425 - DNA, 14 bp, Homo sapiens
gtttttaagctgtt

SEQ ID NO: 3255426 - DNA, 15 bp, Homo sapiens
gtttttaagctgttt

SEQ ID NO: 3255427 - DNA, 20 bp, Homo sapiens
gtttttaatagctatggaat

SEQ ID NO: 3255428 - DNA, 18 bp, Homo sapiens
gtttttaatataaagcct

SEQ ID NO: 3255429 - DNA, 21 bp, Homo sapiens
gtttttaattttgtgttgcta

SEQ ID NO: 3255430 - DNA, 11 bp, Homo sapiens
gtttttacagc

SEQ ID NO: 3255431 - DNA, 17 bp, Homo sapiens
gtttttacagttagggt

SEQ ID NO: 3255432 - DNA, 22 bp, Homo sapiens
gtttttacctaccacagtgtct

SEQ ID NO: 3255433 - DNA, 20 bp, Homo sapiens
gtttttaggctgttccttgt

SEQ ID NO: 3255434 - DNA, 20 bp, Homo sapiens
gtttttagtaatctgtacat

SEQ ID NO: 3255435 - DNA, 16 bp, Homo sapiens
gtttttattttcaaga

SEQ ID NO: 3255436 - DNA, 21 bp, Homo sapiens
gtttttcagcacccccaccca

SEQ ID NO: 3255437 - DNA, 16 bp, Homo sapiens
gtttttcattttaaaa

SEQ ID NO: 3255438 - DNA, 14 bp, Homo sapiens
gtttttcctttaaa

SEQ ID NO: 3255439 - DNA, 13 bp, Homo sapiens
gtttttcctttct

SEQ ID NO: 3255440 - DNA, 15 bp, Homo sapiens
gtttttctcatgtat

SEQ ID NO: 3255441 - DNA, 17 bp, Homo sapiens
gtttttctcatgtatct

SEQ ID NO: 3255442 - DNA, 13 bp, Homo sapiens
gtttttgaaatac

SEQ ID NO: 3255443 - DNA, 23 bp, Homo sapiens
gtttttgatcaaaaactatttgg

SEQ ID NO: 3255444 - DNA, 15 bp, Homo sapiens
gtttttgcacatgtt

SEQ ID NO: 3255445 - DNA, 13 bp, Homo sapiens
gtttttgcttctc

SEQ ID NO: 3255446 - DNA, 17 bp, Homo sapiens
gtttttgggatgtctta

SEQ ID NO: 3255447 - DNA, 14 bp, Homo sapiens
gtttttgtactgta

SEQ ID NO: 3255448 - DNA, 19 bp, Homo sapiens
gtttttgtatctttatgct

SEQ ID NO: 3255449 - DNA, 12 bp, Homo sapiens
gtttttgtgctg

SEQ ID NO: 3255450 - DNA, 19 bp, Homo sapiens
gtttttgttactgcctgga

SEQ ID NO: 3255451 - DNA, 23 bp, Homo sapiens
gtttttgttcttaattgcactct

SEQ ID NO: 3255452 - DNA, 21 bp, Homo sapiens
gttttttaaaatatttatctg

SEQ ID NO: 3255453 - DNA, 16 bp, Homo sapiens
gttttttaaagcaagt

SEQ ID NO: 3255454 - DNA, 16 bp, Homo sapiens
gttttttatgaagtgc

SEQ ID NO: 3255455 - DNA, 16 bp, Homo sapiens
gttttttattattgtg

SEQ ID NO: 3255456 - DNA, 13 bp, Homo sapiens
gttttttccccct

SEQ ID NO: 3255457 - DNA, 13 bp, Homo sapiens
gttttttcctttg

SEQ ID NO: 3255458 - DNA, 12 bp, Homo sapiens
gttttttgaaaa

SEQ ID NO: 3255459 - DNA, 13 bp, Homo sapiens
gttttttgtaact

SEQ ID NO: 3255460 - DNA, 22 bp, Homo sapiens
gttttttgttggagtgtttcta

SEQ ID NO: 3255461 - DNA, 20 bp, Homo sapiens
gtttttttaagattgtaaaa

SEQ ID NO: 3255462 - DNA, 20 bp, Homo sapiens
gtttttttcctcatgtaaca

SEQ ID NO: 3255463 - DNA, 19 bp, Homo sapiens
gtttttttcttctgtattt

SEQ ID NO: 3255464 - DNA, 18 bp, Homo sapiens
gttttttttaaataaaag

SEQ ID NO: 3255465 - DNA, 20 bp, Homo sapiens
gttttttttgactaaagcta

SEQ ID NO: 3255466 - DNA, 19 bp, Homo sapiens
gtttttttttttcttaaat

SEQ ID NO: 3255467 - DNA, 16 bp, Homo sapiens
taaaaaaaaaagtcac

SEQ ID NO: 3255468 - DNA, 21 bp, Homo sapiens
taaaaaaaaaagttacagaaa

SEQ ID NO: 3255469 - DNA, 17 bp, Homo sapiens
taaaaaaaaatgccttt

SEQ ID NO: 3255470 - DNA, 15 bp, Homo sapiens
taaaaaaagagaatt

SEQ ID NO: 3255471 - DNA, 15 bp, Homo sapiens
taaaaaaagcaaaaa

SEQ ID NO: 3255472 - DNA, 13 bp, Homo sapiens
taaaaaaagtgca

SEQ ID NO: 3255473 - DNA, 15 bp, Homo sapiens
taaaaaaagtgcatg

SEQ ID NO: 3255474 - DNA, 12 bp, Homo sapiens
taaaaaaattta

SEQ ID NO: 3255475 - DNA, 15 bp, Homo sapiens
taaaaaaatttaagt

SEQ ID NO: 3255476 - DNA, 14 bp, Homo sapiens
taaaaaacattcaa

SEQ ID NO: 3255477 - DNA, 20 bp, Homo sapiens
taaaaaagaagcactttgat

SEQ ID NO: 3255478 - DNA, 18 bp, Homo sapiens
taaaaaagactgaacatg

SEQ ID NO: 3255479 - DNA, 22 bp, Homo sapiens
taaaaaagagttttctttagta

SEQ ID NO: 3255480 - DNA, 18 bp, Homo sapiens
taaaaaaggagaattgaa

SEQ ID NO: 3255481 - DNA, 12 bp, Homo sapiens
taaaaaagtctc

SEQ ID NO: 3255482 - DNA, 13 bp, Homo sapiens
taaaaaagtctct

SEQ ID NO: 3255483 - DNA, 16 bp, Homo sapiens
taaaaaagtctctatt

SEQ ID NO: 3255484 - DNA, 17 bp, Homo sapiens
taaaaaagtctctattt

SEQ ID NO: 3255485 - DNA, 18 bp, Homo sapiens
taaaaaagtctctattta

SEQ ID NO: 3255486 - DNA, 17 bp, Homo sapiens
taaaaaatactctgcta

SEQ ID NO: 3255487 - DNA, 16 bp, Homo sapiens
taaaaaatagacatgt

SEQ ID NO: 3255488 - DNA, 13 bp, Homo sapiens
taaaaaatatttt

SEQ ID NO: 3255489 - DNA, 16 bp, Homo sapiens
taaaaaatattttctc

SEQ ID NO: 3255490 - DNA, 22 bp, Homo sapiens
taaaaaatcatgccagtatttt

SEQ ID NO: 3255491 - DNA, 13 bp, Homo sapiens
taaaaaatctgaa

SEQ ID NO: 3255492 - DNA, 12 bp, Homo sapiens
taaaaaatggaa

SEQ ID NO: 3255493 - DNA, 15 bp, Homo sapiens
taaaaaatggaaaaa

SEQ ID NO: 3255494 - DNA, 15 bp, Homo sapiens
taaaaaatggaaaga

SEQ ID NO: 3255495 - DNA, 12 bp, Homo sapiens
taaaaaatggtt

SEQ ID NO: 3255496 - DNA, 15 bp, Homo sapiens
taaaaaattatggaa

SEQ ID NO: 3255497 - DNA, 16 bp, Homo sapiens
taaaaaattatggaat

SEQ ID NO: 3255498 - DNA, 17 bp, Homo sapiens
taaaaaattatggaata

SEQ ID NO: 3255499 - DNA, 22 bp, Homo sapiens
taaaaacagcattgctttctga

SEQ ID NO: 3255500 - DNA, 13 bp, Homo sapiens
taaaaacatgagt

SEQ ID NO: 3255501 - DNA, 19 bp, Homo sapiens
taaaaacattttgaagtgt

SEQ ID NO: 3255502 - DNA, 23 bp, Homo sapiens
taaaaaccatgctggtatatggc

SEQ ID NO: 3255503 - DNA, 21 bp, Homo sapiens
taaaaacccaagtttatttct

SEQ ID NO: 3255504 - DNA, 23 bp, Homo sapiens
taaaaacccacaaaaatgttgaa

SEQ ID NO: 3255505 - DNA, 20 bp, Homo sapiens
taaaaagaaaaaccactccc

SEQ ID NO: 3255506 - DNA, 17 bp, Homo sapiens
taaaaagaaaagataaa

SEQ ID NO: 3255507 - DNA, 23 bp, Homo sapiens
taaaaagaaaagataaagatgat

SEQ ID NO: 3255508 - DNA, 14 bp, Homo sapiens
taaaaagatcactt

SEQ ID NO: 3255509 - DNA, 20 bp, Homo sapiens
taaaaagattgaagtatttt

SEQ ID NO: 3255510 - DNA, 18 bp, Homo sapiens
taaaaagcagaattttaa

SEQ ID NO: 3255511 - DNA, 16 bp, Homo sapiens
taaaaagcctcagtga

SEQ ID NO: 3255512 - DNA, 16 bp, Homo sapiens
taaaaagctcactgct

SEQ ID NO: 3255513 - DNA, 15 bp, Homo sapiens
taaaaaggaaatttg

SEQ ID NO: 3255514 - DNA, 22 bp, Homo sapiens
taaaaaggaaatttgtttgtat

SEQ ID NO: 3255515 - DNA, 13 bp, Homo sapiens
taaaaaggaacaa

SEQ ID NO: 3255516 - DNA, 15 bp, Homo sapiens
taaaaagtaagttaa

SEQ ID NO: 3255517 - DNA, 17 bp, Homo sapiens
taaaaagtgacacagca

SEQ ID NO: 3255518 - DNA, 17 bp, Homo sapiens
taaaaataaatttggtt

SEQ ID NO: 3255519 - DNA, 13 bp, Homo sapiens
taaaaataatcag

SEQ ID NO: 3255520 - DNA, 15 bp, Homo sapiens
taaaaatacttaata

SEQ ID NO: 3255521 - DNA, 15 bp, Homo sapiens
taaaaatatagcaaa

SEQ ID NO: 3255522 - DNA, 16 bp, Homo sapiens
taaaaatatagcaaat

SEQ ID NO: 3255523 - DNA, 13 bp, Homo sapiens
taaaaatatatat

SEQ ID NO: 3255524 - DNA, 18 bp, Homo sapiens
taaaaatatccttgatgt

SEQ ID NO: 3255525 - DNA, 21 bp, Homo sapiens
taaaaatattgtcatgtttat

SEQ ID NO: 3255526 - DNA, 15 bp, Homo sapiens
taaaaatatttcaga

SEQ ID NO: 3255527 - DNA, 16 bp, Homo sapiens
taaaaatattttctga

SEQ ID NO: 3255528 - DNA, 14 bp, Homo sapiens
taaaaatcacactg

SEQ ID NO: 3255529 - DNA, 15 bp, Homo sapiens
taaaaatcacactgt

SEQ ID NO: 3255530 - DNA, 15 bp, Homo sapiens
taaaaatcatagtac

SEQ ID NO: 3255531 - DNA, 18 bp, Homo sapiens
taaaaatcttttgaagca

SEQ ID NO: 3255532 - DNA, 22 bp, Homo sapiens
taaaaatggctcaagtagaaaa

SEQ ID NO: 3255533 - DNA, 21 bp, Homo sapiens
taaaaatgtaaatattctata

SEQ ID NO: 3255534 - DNA, 23 bp, Homo sapiens
taaaaatgtagaaattcttcatg

SEQ ID NO: 3255535 - DNA, 18 bp, Homo sapiens
taaaaatgttagtatttt

SEQ ID NO: 3255536 - DNA, 16 bp, Homo sapiens
taaaaattagatggaa

SEQ ID NO: 3255537 - DNA, 13 bp, Homo sapiens
taaaaattagcat

SEQ ID NO: 3255538 - DNA, 20 bp, Homo sapiens
taaaaattagcatgctgctt

SEQ ID NO: 3255539 - DNA, 15 bp, Homo sapiens
taaaaattctgaatg

SEQ ID NO: 3255540 - DNA, 17 bp, Homo sapiens
taaaaattctgaatgta

SEQ ID NO: 3255541 - DNA, 22 bp, Homo sapiens
taaaaattgtttcttgacaagc

SEQ ID NO: 3255542 - DNA, 17 bp, Homo sapiens
taaaacaaaatctgaac

SEQ ID NO: 3255543 - DNA, 14 bp, Homo sapiens
taaaacaaaatgtt

SEQ ID NO: 3255544 - DNA, 14 bp, Homo sapiens
taaaacaaaatttg

SEQ ID NO: 3255545 - DNA, 21 bp, Homo sapiens
taaaacaaaatttgactaatt

SEQ ID NO: 3255546 - DNA, 15 bp, Homo sapiens
taaaacaacactcac

SEQ ID NO: 3255547 - DNA, 14 bp, Homo sapiens
taaaacactaaaag

SEQ ID NO: 3255548 - DNA, 15 bp, Homo sapiens
taaaacactcatccc

SEQ ID NO: 3255549 - DNA, 15 bp, Homo sapiens
taaaacagacactgg

SEQ ID NO: 3255550 - DNA, 23 bp, Homo sapiens
taaaacagctgtctctaacttat

SEQ ID NO: 3255551 - DNA, 21 bp, Homo sapiens
taaaacaggtagaattatcta

SEQ ID NO: 3255552 - DNA, 21 bp, Homo sapiens
taaaacaggttataacagtgt

SEQ ID NO: 3255553 - DNA, 16 bp, Homo sapiens
taaaacatatttcatt

SEQ ID NO: 3255554 - DNA, 21 bp, Homo sapiens
taaaaccccagccaactcatt

SEQ ID NO: 3255555 - DNA, 15 bp, Homo sapiens
taaaacctgtcaatg

SEQ ID NO: 3255556 - DNA, 14 bp, Homo sapiens
taaaaccttgttct

SEQ ID NO: 3255557 - DNA, 17 bp, Homo sapiens
taaaaccttgttctatt

SEQ ID NO: 3255558 - DNA, 20 bp, Homo sapiens
taaaaccttgttctattttt

SEQ ID NO: 3255559 - DNA, 10 bp, Homo sapiens
taaaaccttt

SEQ ID NO: 3255560 - DNA, 13 bp, Homo sapiens
taaaacctttcaa

SEQ ID NO: 3255561 - DNA, 14 bp, Homo sapiens
taaaacctttcaaa

SEQ ID NO: 3255562 - DNA, 16 bp, Homo sapiens
taaaacctttcaaatt

SEQ ID NO: 3255563 - DNA, 21 bp, Homo sapiens
taaaacgtcttagagcctttt

SEQ ID NO: 3255564 - DNA, 13 bp, Homo sapiens
taaaactcagaat

SEQ ID NO: 3255565 - DNA, 17 bp, Homo sapiens
taaaactcagaatataa

SEQ ID NO: 3255566 - DNA, 13 bp, Homo sapiens
taaaactctcctt

SEQ ID NO: 3255567 - DNA, 23 bp, Homo sapiens
taaaactctccttttccttacca

SEQ ID NO: 3255568 - DNA, 21 bp, Homo sapiens
taaaactgcttttttttttcc

SEQ ID NO: 3255569 - DNA, 19 bp, Homo sapiens
taaaactggcatctgacac

SEQ ID NO: 3255570 - DNA, 20 bp, Homo sapiens
taaaacttacctaagtgaca

SEQ ID NO: 3255571 - DNA, 18 bp, Homo sapiens
taaaactttatgtactgc

SEQ ID NO: 3255572 - DNA, 13 bp, Homo sapiens
taaaactttcctc

SEQ ID NO: 3255573 - DNA, 14 bp, Homo sapiens
taaaactttgctgc

SEQ ID NO: 3255574 - DNA, 16 bp, Homo sapiens
taaaactttgctgcca

SEQ ID NO: 3255575 - DNA, 22 bp, Homo sapiens
taaaagaaaggttgcgtttaat

SEQ ID NO: 3255576 - DNA, 15 bp, Homo sapiens
taaaagaaatttatt

SEQ ID NO: 3255577 - DNA, 18 bp, Homo sapiens
taaaagaattttaccatt

SEQ ID NO: 3255578 - DNA, 19 bp, Homo sapiens
taaaagacaagcactttgg

SEQ ID NO: 3255579 - DNA, 16 bp, Homo sapiens
taaaagagagagagag

SEQ ID NO: 3255580 - DNA, 14 bp, Homo sapiens
taaaagataaatta

SEQ ID NO: 3255581 - DNA, 13 bp, Homo sapiens
taaaagatcgcag

SEQ ID NO: 3255582 - DNA, 19 bp, Homo sapiens
taaaagcacaatcactaaa

SEQ ID NO: 3255583 - DNA, 15 bp, Homo sapiens
taaaagcagggcagc

SEQ ID NO: 3255584 - DNA, 16 bp, Homo sapiens
taaaagcagggcagca

SEQ ID NO: 3255585 - DNA, 15 bp, Homo sapiens
taaaagcataaatgc

SEQ ID NO: 3255586 - DNA, 16 bp, Homo sapiens
taaaagcattgtctct

SEQ ID NO: 3255587 - DNA, 21 bp, Homo sapiens
taaaagcattttaatactaag

SEQ ID NO: 3255588 - DNA, 13 bp, Homo sapiens
taaaagccacata

SEQ ID NO: 3255589 - DNA, 15 bp, Homo sapiens
taaaagccacataga

SEQ ID NO: 3255590 - DNA, 12 bp, Homo sapiens
taaaagcctgct

SEQ ID NO: 3255591 - DNA, 16 bp, Homo sapiens
taaaagctataaagta

SEQ ID NO: 3255592 - DNA, 15 bp, Homo sapiens
taaaaggatagtatt

SEQ ID NO: 3255593 - DNA, 18 bp, Homo sapiens
taaaaggcaaatgtgtac

SEQ ID NO: 3255594 - DNA, 17 bp, Homo sapiens
taaaagggcaaatctgc

SEQ ID NO: 3255595 - DNA, 12 bp, Homo sapiens
taaaaggggccc

SEQ ID NO: 3255596 - DNA, 19 bp, Homo sapiens
taaaagggggtccgtggaa

SEQ ID NO: 3255597 - DNA, 21 bp, Homo sapiens
taaaagggggtccgtggaaga

SEQ ID NO: 3255598 - DNA, 21 bp, Homo sapiens
taaaaggtagagtcttacaat

SEQ ID NO: 3255599 - DNA, 12 bp, Homo sapiens
taaaaggtgacc

SEQ ID NO: 3255600 - DNA, 19 bp, Homo sapiens
taaaaggtgaccaatgatg

SEQ ID NO: 3255601 - DNA, 18 bp, Homo sapiens
taaaagtaaaatgtcttt

SEQ ID NO: 3255602 - DNA, 13 bp, Homo sapiens
taaaagtaaacat

SEQ ID NO: 3255603 - DNA, 17 bp, Homo sapiens
taaaagtagtaaatttt

SEQ ID NO: 3255604 - DNA, 15 bp, Homo sapiens
taaaagtcataaatg

SEQ ID NO: 3255605 - DNA, 15 bp, Homo sapiens
taaaagtctatttta

SEQ ID NO: 3255606 - DNA, 18 bp, Homo sapiens
taaaagtgaatgaaagat

SEQ ID NO: 3255607 - DNA, 19 bp, Homo sapiens
taaaagtgaatgaaagatt

SEQ ID NO: 3255608 - DNA, 15 bp, Homo sapiens
taaaagtgatcaata

SEQ ID NO: 3255609 - DNA, 22 bp, Homo sapiens
taaaagtgggcttgattctgca

SEQ ID NO: 3255610 - DNA, 22 bp, Homo sapiens
taaaagttaataacagctcctt

SEQ ID NO: 3255611 - DNA, 12 bp, Homo sapiens
taaaagttactt

SEQ ID NO: 3255612 - DNA, 14 bp, Homo sapiens
taaaagttcataac

SEQ ID NO: 3255613 - DNA, 12 bp, Homo sapiens
taaaagttcttt

SEQ ID NO: 3255614 - DNA, 15 bp, Homo sapiens
taaaagttgtgattc

SEQ ID NO: 3255615 - DNA, 19 bp, Homo sapiens
taaaagttttatatgcttt

SEQ ID NO: 3255616 - DNA, 16 bp, Homo sapiens
taaaagttttctccaa

SEQ ID NO: 3255617 - DNA, 20 bp, Homo sapiens
taaaagttttgatatttatt

SEQ ID NO: 3255618 - DNA, 21 bp, Homo sapiens
taaaagttttttattatgcat

SEQ ID NO: 3255619 - DNA, 16 bp, Homo sapiens
taaaataaaatgaaaa

SEQ ID NO: 3255620 - DNA, 22 bp, Homo sapiens
taaaataaaatgaaaattgtat

SEQ ID NO: 3255621 - DNA, 16 bp, Homo sapiens
taaaataaacagttgt

SEQ ID NO: 3255622 - DNA, 17 bp, Homo sapiens
taaaataaacagttgtg

SEQ ID NO: 3255623 - DNA, 13 bp, Homo sapiens
taaaataaaccaa

SEQ ID NO: 3255624 - DNA, 15 bp, Homo sapiens
taaaataaaccaaat

SEQ ID NO: 3255625 - DNA, 17 bp, Homo sapiens
taaaataaagtatatat

SEQ ID NO: 3255626 - DNA, 17 bp, Homo sapiens
taaaataactaaaatgt

SEQ ID NO: 3255627 - DNA, 19 bp, Homo sapiens
taaaataactaaaatgtat

SEQ ID NO: 3255628 - DNA, 19 bp, Homo sapiens
taaaataattaaataaatg

SEQ ID NO: 3255629 - DNA, 21 bp, Homo sapiens
taaaataattaaataaatgaa

SEQ ID NO: 3255630 - DNA, 16 bp, Homo sapiens
taaaataattctaaag

SEQ ID NO: 3255631 - DNA, 20 bp, Homo sapiens
taaaatacttttactctgcc

SEQ ID NO: 3255632 - DNA, 17 bp, Homo sapiens
taaaatagaaataagtg

SEQ ID NO: 3255633 - DNA, 17 bp, Homo sapiens
taaaatagttgtccata

SEQ ID NO: 3255634 - DNA, 15 bp, Homo sapiens
taaaatatctatatt

SEQ ID NO: 3255635 - DNA, 14 bp, Homo sapiens
taaaatatggctat

SEQ ID NO: 3255636 - DNA, 18 bp, Homo sapiens
taaaatatttgaatgaaa

SEQ ID NO: 3255637 - DNA, 22 bp, Homo sapiens
taaaatatttgaatgaaaacat

SEQ ID NO: 3255638 - DNA, 21 bp, Homo sapiens
taaaatatttgtctttaaaca

SEQ ID NO: 3255639 - DNA, 18 bp, Homo sapiens
taaaatcaacttaacatg

SEQ ID NO: 3255640 - DNA, 11 bp, Homo sapiens
taaaatcacta

SEQ ID NO: 3255641 - DNA, 16 bp, Homo sapiens
taaaatcactaacatt

SEQ ID NO: 3255642 - DNA, 19 bp, Homo sapiens
taaaatcactaacattata

SEQ ID NO: 3255643 - DNA, 20 bp, Homo sapiens
taaaatcactaacattatat

SEQ ID NO: 3255644 - DNA, 15 bp, Homo sapiens
taaaatcattgtcaa

SEQ ID NO: 3255645 - DNA, 19 bp, Homo sapiens
taaaatcttatagttctag

SEQ ID NO: 3255646 - DNA, 15 bp, Homo sapiens
taaaatgaaaattgt

SEQ ID NO: 3255647 - DNA, 14 bp, Homo sapiens
taaaatgaaattac

SEQ ID NO: 3255648 - DNA, 17 bp, Homo sapiens
taaaatgaggacatgtt

SEQ ID NO: 3255649 - DNA, 18 bp, Homo sapiens
taaaatggctgtaatcat

SEQ ID NO: 3255650 - DNA, 13 bp, Homo sapiens
taaaatggtcatg

SEQ ID NO: 3255651 - DNA, 17 bp, Homo sapiens
taaaatgtattcaagca

SEQ ID NO: 3255652 - DNA, 20 bp, Homo sapiens
taaaatgtctcgagtcctaa

SEQ ID NO: 3255653 - DNA, 13 bp, Homo sapiens
taaaatgtgaagt

SEQ ID NO: 3255654 - DNA, 20 bp, Homo sapiens
taaaatgtgatgttctaagg

SEQ ID NO: 3255655 - DNA, 14 bp, Homo sapiens
taaaatgtgttgaa

SEQ ID NO: 3255656 - DNA, 14 bp, Homo sapiens
taaaatgttgaata

SEQ ID NO: 3255657 - DNA, 18 bp, Homo sapiens
taaaattaagtagaacaa

SEQ ID NO: 3255658 - DNA, 17 bp, Homo sapiens
taaaattaggactgtat

SEQ ID NO: 3255659 - DNA, 17 bp, Homo sapiens
taaaattataaactttt

SEQ ID NO: 3255660 - DNA, 22 bp, Homo sapiens
taaaattatcaatatctaatat

SEQ ID NO: 3255661 - DNA, 14 bp, Homo sapiens
taaaattcagtttt

SEQ ID NO: 3255662 - DNA, 19 bp, Homo sapiens
taaaattcagtttttgtat

SEQ ID NO: 3255663 - DNA, 22 bp, Homo sapiens
taaaattcagtttttttccagt

SEQ ID NO: 3255664 - DNA, 14 bp, Homo sapiens
taaaattcatttct

SEQ ID NO: 3255665 - DNA, 13 bp, Homo sapiens
taaaattgatttt

SEQ ID NO: 3255666 - DNA, 14 bp, Homo sapiens
taaaattgcacttt

SEQ ID NO: 3255667 - DNA, 17 bp, Homo sapiens
taaaattgtatgaaaat

SEQ ID NO: 3255668 - DNA, 23 bp, Homo sapiens
taaaattgtcacctctgttaagg

SEQ ID NO: 3255669 - DNA, 17 bp, Homo sapiens
taaaattgtgcataatg

SEQ ID NO: 3255670 - DNA, 17 bp, Homo sapiens
taaaatttaagtatctt

SEQ ID NO: 3255671 - DNA, 14 bp, Homo sapiens
taaaatttgttgtt

SEQ ID NO: 3255672 - DNA, 15 bp, Homo sapiens
taaaattttctagaa

SEQ ID NO: 3255673 - DNA, 23 bp, Homo sapiens
taaaattttgtatgttaaagaga

SEQ ID NO: 3255674 - DNA, 14 bp, Homo sapiens
taaacaaagttact

SEQ ID NO: 3255675 - DNA, 23 bp, Homo sapiens
taaacaaagtttcagagtatatt

SEQ ID NO: 3255676 - DNA, 19 bp, Homo sapiens
taaacaaattcatattctg

SEQ ID NO: 3255677 - DNA, 15 bp, Homo sapiens
taaacaagaaccatt

SEQ ID NO: 3255678 - DNA, 16 bp, Homo sapiens
taaacaatgtaaagta

SEQ ID NO: 3255679 - DNA, 16 bp, Homo sapiens
taaacaatgtataaag

SEQ ID NO: 3255680 - DNA, 17 bp, Homo sapiens
taaacaatgtataaaga

SEQ ID NO: 3255681 - DNA, 14 bp, Homo sapiens
taaacacacagata

SEQ ID NO: 3255682 - DNA, 18 bp, Homo sapiens
taaacacacagatacaca

SEQ ID NO: 3255683 - DNA, 16 bp, Homo sapiens
taaacacagtcaaaat

SEQ ID NO: 3255684 - DNA, 18 bp, Homo sapiens
taaacacagtcaaaataa

SEQ ID NO: 3255685 - DNA, 18 bp, Homo sapiens
taaacacatgccttaaat

SEQ ID NO: 3255686 - DNA, 15 bp, Homo sapiens
taaacacattgaatg

SEQ ID NO: 3255687 - DNA, 14 bp, Homo sapiens
taaacactcacctt

SEQ ID NO: 3255688 - DNA, 18 bp, Homo sapiens
taaacactggctctggga

SEQ ID NO: 3255689 - DNA, 20 bp, Homo sapiens
taaacacttatcttctggat

SEQ ID NO: 3255690 - DNA, 22 bp, Homo sapiens
taaacacttatcttctggatta

SEQ ID NO: 3255691 - DNA, 19 bp, Homo sapiens
taaacagaagcctgtttca

SEQ ID NO: 3255692 - DNA, 21 bp, Homo sapiens
taaacagatataaatggctgg

SEQ ID NO: 3255693 - DNA, 18 bp, Homo sapiens
taaacagatgatgagaat

SEQ ID NO: 3255694 - DNA, 20 bp, Homo sapiens
taaacagatgatgagaattt

SEQ ID NO: 3255695 - DNA, 18 bp, Homo sapiens
taaacagcaactacagaa

SEQ ID NO: 3255696 - DNA, 14 bp, Homo sapiens
taaacagctattta

SEQ ID NO: 3255697 - DNA, 17 bp, Homo sapiens
taaacaggaattttatt

SEQ ID NO: 3255698 - DNA, 13 bp, Homo sapiens
taaacaggcccag

SEQ ID NO: 3255699 - DNA, 14 bp, Homo sapiens
taaacaggcccagc

SEQ ID NO: 3255700 - DNA, 17 bp, Homo sapiens
taaacagtaagatatct

SEQ ID NO: 3255701 - DNA, 19 bp, Homo sapiens
taaacagtagttgtattct

SEQ ID NO: 3255702 - DNA, 21 bp, Homo sapiens
taaacagtagttgtattcttc

SEQ ID NO: 3255703 - DNA, 21 bp, Homo sapiens
taaacagtatattctttggtt

SEQ ID NO: 3255704 - DNA, 19 bp, Homo sapiens
taaacagtggctcataaaa

SEQ ID NO: 3255705 - DNA, 15 bp, Homo sapiens
taaacataattcttg

SEQ ID NO: 3255706 - DNA, 20 bp, Homo sapiens
taaacataattcttgtatat

SEQ ID NO: 3255707 - DNA, 15 bp, Homo sapiens
taaacatatgatttc

SEQ ID NO: 3255708 - DNA, 18 bp, Homo sapiens
taaacatatgatttcact

SEQ ID NO: 3255709 - DNA, 22 bp, Homo sapiens
taaacatatgatttcactagaa

SEQ ID NO: 3255710 - DNA, 15 bp, Homo sapiens
taaacatcacacaca

SEQ ID NO: 3255711 - DNA, 20 bp, Homo sapiens
taaacatccaatattttctt

SEQ ID NO: 3255712 - DNA, 13 bp, Homo sapiens
taaacatgtgttt

SEQ ID NO: 3255713 - DNA, 18 bp, Homo sapiens
taaacattaaatgtctta

SEQ ID NO: 3255714 - DNA, 20 bp, Homo sapiens
taaacattaatagcagcctt

SEQ ID NO: 3255715 - DNA, 22 bp, Homo sapiens
taaacattaatcaatcatctgt

SEQ ID NO: 3255716 - DNA, 15 bp, Homo sapiens
taaacattttattta

SEQ ID NO: 3255717 - DNA, 15 bp, Homo sapiens
taaacattttcatgc

SEQ ID NO: 3255718 - DNA, 15 bp, Homo sapiens
taaaccaaaggacat

SEQ ID NO: 3255719 - DNA, 20 bp, Homo sapiens
taaaccaaaggacattatgt

SEQ ID NO: 3255720 - DNA, 22 bp, Homo sapiens
taaaccaaatatgttaaagttt

SEQ ID NO: 3255721 - DNA, 13 bp, Homo sapiens
taaaccaaccttt

SEQ ID NO: 3255722 - DNA, 21 bp, Homo sapiens
taaaccaacctttaaaattgt

SEQ ID NO: 3255723 - DNA, 23 bp, Homo sapiens
taaaccaacctttaaaattgtca

SEQ ID NO: 3255724 - DNA, 17 bp, Homo sapiens
taaaccaactctaatat

SEQ ID NO: 3255725 - DNA, 22 bp, Homo sapiens
taaaccaccagtgcccaaagtc

SEQ ID NO: 3255726 - DNA, 22 bp, Homo sapiens
taaaccacctcagaaaggattt

SEQ ID NO: 3255727 - DNA, 19 bp, Homo sapiens
taaaccagtttagatttca

SEQ ID NO: 3255728 - DNA, 13 bp, Homo sapiens
taaaccattgtaa

SEQ ID NO: 3255729 - DNA, 19 bp, Homo sapiens
taaacccaatcagatgcct

SEQ ID NO: 3255730 - DNA, 23 bp, Homo sapiens
taaacccatattgtaaaacaggt

SEQ ID NO: 3255731 - DNA, 18 bp, Homo sapiens
taaacctcaaaatgtcta

SEQ ID NO: 3255732 - DNA, 19 bp, Homo sapiens
taaacctgtagaatcaatt

SEQ ID NO: 3255733 - DNA, 19 bp, Homo sapiens
taaacctgtttttttttca

SEQ ID NO: 3255734 - DNA, 16 bp, Homo sapiens
taaacctttttcttga

SEQ ID NO: 3255735 - DNA, 17 bp, Homo sapiens
taaacctttttcttgat

SEQ ID NO: 3255736 - DNA, 23 bp, Homo sapiens
taaacctttttcttgatcttaaa

SEQ ID NO: 3255737 - DNA, 14 bp, Homo sapiens
taaactaaataatg

SEQ ID NO: 3255738 - DNA, 16 bp, Homo sapiens
taaactaaataatgaa

SEQ ID NO: 3255739 - DNA, 18 bp, Homo sapiens
taaactaaataatgaata

SEQ ID NO: 3255740 - DNA, 15 bp, Homo sapiens
taaactaggtaaaat

SEQ ID NO: 3255741 - DNA, 20 bp, Homo sapiens
taaactatcttggtgaattt

SEQ ID NO: 3255742 - DNA, 19 bp, Homo sapiens
taaactcaaaacttaacat

SEQ ID NO: 3255743 - DNA, 14 bp, Homo sapiens
taaactcaaaatat

SEQ ID NO: 3255744 - DNA, 19 bp, Homo sapiens
taaactcagggacagagcc

SEQ ID NO: 3255745 - DNA, 20 bp, Homo sapiens
taaactcagggacagagcca

SEQ ID NO: 3255746 - DNA, 20 bp, Homo sapiens
taaactccttaacttcaggg

SEQ ID NO: 3255747 - DNA, 15 bp, Homo sapiens
taaactctaaacatt

SEQ ID NO: 3255748 - DNA, 12 bp, Homo sapiens
gttcctcctgct

SEQ ID NO: 3255749 - DNA, 19 bp, Homo sapiens
gttcctcgctctgggatgc

SEQ ID NO: 3255750 - DNA, 14 bp, Homo sapiens
gttcctctgcctgc

SEQ ID NO: 3255751 - DNA, 16 bp, Homo sapiens
gttcctctgcctgccc

SEQ ID NO: 3255752 - DNA, 23 bp, Homo sapiens
gttcctctgctcaccgcccatca

SEQ ID NO: 3255753 - DNA, 14 bp, Homo sapiens
gttcctgactggca

SEQ ID NO: 3255754 - DNA, 20 bp, Homo sapiens
gttcctgccccaccctaact

SEQ ID NO: 3255755 - DNA, 19 bp, Homo sapiens
gttccttgtactcttagga

SEQ ID NO: 3255756 - DNA, 15 bp, Homo sapiens
gttcctttcagatga

SEQ ID NO: 3255757 - DNA, 16 bp, Homo sapiens
gttcctttgcaccctg

SEQ ID NO: 3255758 - DNA, 19 bp, Homo sapiens
gttcctttgcaccctgtag

SEQ ID NO: 3255759 - DNA, 19 bp, Homo sapiens
gttcctttgtgtgtactca

SEQ ID NO: 3255760 - DNA, 20 bp, Homo sapiens
gttcctttttaaatgtgaat

SEQ ID NO: 3255761 - DNA, 23 bp, Homo sapiens
gttcctttttaaatgtgaatttt

SEQ ID NO: 3255762 - DNA, 20 bp, Homo sapiens
gttccttttttcaatatgca

SEQ ID NO: 3255763 - DNA, 16 bp, Homo sapiens
gttcgagaccagcctg

SEQ ID NO: 3255764 - DNA, 16 bp, Homo sapiens
gttcgagaccagtctg

SEQ ID NO: 3255765 - DNA, 18 bp, Homo sapiens
gttcgatttctacctcag

SEQ ID NO: 3255766 - DNA, 14 bp, Homo sapiens
gttcgcatggtcac

SEQ ID NO: 3255767 - DNA, 20 bp, Homo sapiens
gttcgcatggtcacacactg

SEQ ID NO: 3255768 - DNA, 16 bp, Homo sapiens
gttcgggtgtgcaatg

SEQ ID NO: 3255769 - DNA, 19 bp, Homo sapiens
gttctaaaaattgtgatca

SEQ ID NO: 3255770 - DNA, 10 bp, Homo sapiens
gttctaaagc

SEQ ID NO: 3255771 - DNA, 12 bp, Homo sapiens
gttctaaagctc

SEQ ID NO: 3255772 - DNA, 18 bp, Homo sapiens
gttctaaaggactaacat

SEQ ID NO: 3255773 - DNA, 17 bp, Homo sapiens
gttctaagactcaaatg

SEQ ID NO: 3255774 - DNA, 22 bp, Homo sapiens
gttctaagatgtgatattctaa

SEQ ID NO: 3255775 - DNA, 20 bp, Homo sapiens
gttctaagattctaatgatg

SEQ ID NO: 3255776 - DNA, 14 bp, Homo sapiens
gttctaaggctctg

SEQ ID NO: 3255777 - DNA, 19 bp, Homo sapiens
gttctaagtttctaagatt

SEQ ID NO: 3255778 - DNA, 21 bp, Homo sapiens
gttctaagtttctaagattct

SEQ ID NO: 3255779 - DNA, 20 bp, Homo sapiens
gttctaatactttgtttatt

SEQ ID NO: 3255780 - DNA, 14 bp, Homo sapiens
gttctagaaccact

SEQ ID NO: 3255781 - DNA, 15 bp, Homo sapiens
gttctagaaccactt

SEQ ID NO: 3255782 - DNA, 23 bp, Homo sapiens
gttctaggatagttgatgcatgt

SEQ ID NO: 3255783 - DNA, 22 bp, Homo sapiens
gttctaggcactgtagttctaa

SEQ ID NO: 3255784 - DNA, 23 bp, Homo sapiens
gttctaggcactgtagttctaag

SEQ ID NO: 3255785 - DNA, 14 bp, Homo sapiens
gttctagtctcctt

SEQ ID NO: 3255786 - DNA, 14 bp, Homo sapiens
gttctatccaaaca

SEQ ID NO: 3255787 - DNA, 15 bp, Homo sapiens
gttctatgcctttag

SEQ ID NO: 3255788 - DNA, 16 bp, Homo sapiens
gttctatggttatgaa

SEQ ID NO: 3255789 - DNA, 15 bp, Homo sapiens
gttctattttacttt

SEQ ID NO: 3255790 - DNA, 16 bp, Homo sapiens
gttctcacacccaccg

SEQ ID NO: 3255791 - DNA, 21 bp, Homo sapiens
gttctcacactggtctgctgt

SEQ ID NO: 3255792 - DNA, 21 bp, Homo sapiens
gttctcactcctaggagagcc

SEQ ID NO: 3255793 - DNA, 12 bp, Homo sapiens
gttctcagagcc

SEQ ID NO: 3255794 - DNA, 13 bp, Homo sapiens
gttctcagctccc

SEQ ID NO: 3255795 - DNA, 15 bp, Homo sapiens
gttctcagctccccc

SEQ ID NO: 3255796 - DNA, 17 bp, Homo sapiens
gttctcagctccccctg

SEQ ID NO: 3255797 - DNA, 23 bp, Homo sapiens
gttctcagggctcctgccttctg

SEQ ID NO: 3255798 - DNA, 17 bp, Homo sapiens
gttctcaggtgttgcca

SEQ ID NO: 3255799 - DNA, 15 bp, Homo sapiens
gttctcatttgatca

SEQ ID NO: 3255800 - DNA, 17 bp, Homo sapiens
gttctccagaatgtaag

SEQ ID NO: 3255801 - DNA, 15 bp, Homo sapiens
gttctccctttctct

SEQ ID NO: 3255802 - DNA, 17 bp, Homo sapiens
gttctccctttctctct

SEQ ID NO: 3255803 - DNA, 20 bp, Homo sapiens
gttctccctttctctctcct

SEQ ID NO: 3255804 - DNA, 18 bp, Homo sapiens
gttctccgggtgtggcct

SEQ ID NO: 3255805 - DNA, 20 bp, Homo sapiens
gttctccgggtgtggcctca

SEQ ID NO: 3255806 - DNA, 22 bp, Homo sapiens
gttctccgttagctcctgtggc

SEQ ID NO: 3255807 - DNA, 23 bp, Homo sapiens
gttctccgttagctcctgtggcc

SEQ ID NO: 3255808 - DNA, 16 bp, Homo sapiens
gttctctgaggacact

SEQ ID NO: 3255809 - DNA, 14 bp, Homo sapiens
gttctctgtcctac

SEQ ID NO: 3255810 - DNA, 16 bp, Homo sapiens
gttctgaataatttct

SEQ ID NO: 3255811 - DNA, 15 bp, Homo sapiens
gttctgacattaaca

SEQ ID NO: 3255812 - DNA, 16 bp, Homo sapiens
gttctgacattaacag

SEQ ID NO: 3255813 - DNA, 17 bp, Homo sapiens
gttctgacattaacagt

SEQ ID NO: 3255814 - DNA, 20 bp, Homo sapiens
gttctgagaactgactttct

SEQ ID NO: 3255815 - DNA, 23 bp, Homo sapiens
gttctgagaactgactttctccc

SEQ ID NO: 3255816 - DNA, 15 bp, Homo sapiens
gttctgaggtccctg

SEQ ID NO: 3255817 - DNA, 13 bp, Homo sapiens
gttctgattagaa

SEQ ID NO: 3255818 - DNA, 18 bp, Homo sapiens
gttctgattagaaatgac

SEQ ID NO: 3255819 - DNA, 16 bp, Homo sapiens
gttctgcaaaaatatt

SEQ ID NO: 3255820 - DNA, 21 bp, Homo sapiens
gttctgcagacacgccttccc

SEQ ID NO: 3255821 - DNA, 20 bp, Homo sapiens
gttctgcccacgatcccctc

SEQ ID NO: 3255822 - DNA, 23 bp, Homo sapiens
gttctgcccacgatcccctcccc

SEQ ID NO: 3255823 - DNA, 16 bp, Homo sapiens
gttctgcccccagccc

SEQ ID NO: 3255824 - DNA, 19 bp, Homo sapiens
gttctgcccccagcccaaa

SEQ ID NO: 3255825 - DNA, 13 bp, Homo sapiens
gttctgctcctct

SEQ ID NO: 3255826 - DNA, 19 bp, Homo sapiens
gttctgctcctctccaggc

SEQ ID NO: 3255827 - DNA, 22 bp, Homo sapiens
gttctgctcctctccaggcacc

SEQ ID NO: 3255828 - DNA, 14 bp, Homo sapiens
gttctgctggcctg

SEQ ID NO: 3255829 - DNA, 23 bp, Homo sapiens
gttctgcttcaaggcttccactg

SEQ ID NO: 3255830 - DNA, 13 bp, Homo sapiens
gttctggccagaa

SEQ ID NO: 3255831 - DNA, 16 bp, Homo sapiens
gttctggccagaatgc

SEQ ID NO: 3255832 - DNA, 12 bp, Homo sapiens
gttctgggacac

SEQ ID NO: 3255833 - DNA, 23 bp, Homo sapiens
gttctgggacacagttcaattct

SEQ ID NO: 3255834 - DNA, 14 bp, Homo sapiens
gttctgggctcagg

SEQ ID NO: 3255835 - DNA, 16 bp, Homo sapiens
gttctgtcccttccac

SEQ ID NO: 3255836 - DNA, 22 bp, Homo sapiens
gttctgtcccttccacttctaa

SEQ ID NO: 3255837 - DNA, 12 bp, Homo sapiens
gttctgtgaaga

SEQ ID NO: 3255838 - DNA, 18 bp, Homo sapiens
gttctgtggttcctctgc

SEQ ID NO: 3255839 - DNA, 16 bp, Homo sapiens
gttctgtggtttcatg

SEQ ID NO: 3255840 - DNA, 18 bp, Homo sapiens
gttctgtgtaaacagaag

SEQ ID NO: 3255841 - DNA, 13 bp, Homo sapiens
gttctgtgtattt

SEQ ID NO: 3255842 - DNA, 23 bp, Homo sapiens
gttctgtgtatttaattgtaaac

SEQ ID NO: 3255843 - DNA, 13 bp, Homo sapiens
gttctgtgtcttt

SEQ ID NO: 3255844 - DNA, 21 bp, Homo sapiens
gttctgttatatcccctgcta

SEQ ID NO: 3255845 - DNA, 14 bp, Homo sapiens
gttctgttctgggg

SEQ ID NO: 3255846 - DNA, 15 bp, Homo sapiens
gttctgtttgttaaa

SEQ ID NO: 3255847 - DNA, 22 bp, Homo sapiens
gttctgtttgttattgttttgt

SEQ ID NO: 3255848 - DNA, 23 bp, Homo sapiens
gttctgtttgttattgttttgtt

SEQ ID NO: 3255849 - DNA, 14 bp, Homo sapiens
gtccttgaaaatat

SEQ ID NO: 3255850 - DNA, 16 bp, Homo sapiens
gtccttgatttcaaag

SEQ ID NO: 3255851 - DNA, 19 bp, Homo sapiens
gtccttgcacccctcactc

SEQ ID NO: 3255852 - DNA, 13 bp, Homo sapiens
gtccttgggttgc

SEQ ID NO: 3255853 - DNA, 18 bp, Homo sapiens
gtcctttcccaccattcc

SEQ ID NO: 3255854 - DNA, 16 bp, Homo sapiens
gtcctttcccctctct

SEQ ID NO: 3255855 - DNA, 17 bp, Homo sapiens
gtcctttcccctctctg

SEQ ID NO: 3255856 - DNA, 23 bp, Homo sapiens
gtcctttcccctctctgcccctg

SEQ ID NO: 3255857 - DNA, 11 bp, Homo sapiens
gtcctttccct

SEQ ID NO: 3255858 - DNA, 20 bp, Homo sapiens
gtcctttctggaagtttctg

SEQ ID NO: 3255859 - DNA, 22 bp, Homo sapiens
gtccttttatttctccatcttt

SEQ ID NO: 3255860 - DNA, 15 bp, Homo sapiens
gtccttttgacactg

SEQ ID NO: 3255861 - DNA, 19 bp, Homo sapiens
gtccttttgacactgctct

SEQ ID NO: 3255862 - DNA, 22 bp, Homo sapiens
gtccttttgtaccatggtgtga

SEQ ID NO: 3255863 - DNA, 21 bp, Homo sapiens
gtcgaaggatgctctttccct

SEQ ID NO: 3255864 - DNA, 22 bp, Homo sapiens
gttcaacaaagaaacaaagatg

SEQ ID NO: 3255865 - DNA, 23 bp, Homo sapiens
gttcaacaaagaaacaaagatgt

SEQ ID NO: 3255866 - DNA, 13 bp, Homo sapiens
gttcaactacatg

SEQ ID NO: 3255867 - DNA, 15 bp, Homo sapiens
gttcaacttccagaa

SEQ ID NO: 3255868 - DNA, 13 bp, Homo sapiens
gttcaagaaataa

SEQ ID NO: 3255869 - DNA, 13 bp, Homo sapiens
gttcaagcctgtg

SEQ ID NO: 3255870 - DNA, 14 bp, Homo sapiens
gttcaatgttccat

SEQ ID NO: 3255871 - DNA, 13 bp, Homo sapiens
gttcaattagaat

SEQ ID NO: 3255872 - DNA, 23 bp, Homo sapiens
gttcaattctcatttgtcacaca

SEQ ID NO: 3255873 - DNA, 22 bp, Homo sapiens
gttcaatttgttagttcctgta

SEQ ID NO: 3255874 - DNA, 16 bp, Homo sapiens
gttcacaaactacctc

SEQ ID NO: 3255875 - DNA, 20 bp, Homo sapiens
gttcacaaactacctctgga

SEQ ID NO: 3255876 - DNA, 14 bp, Homo sapiens
gttcacaacctagg

SEQ ID NO: 3255877 - DNA, 15 bp, Homo sapiens
gttcacacaaagcct

SEQ ID NO: 3255878 - DNA, 14 bp, Homo sapiens
gttcacaccctgca

SEQ ID NO: 3255879 - DNA, 17 bp, Homo sapiens
gttcacaccctgcaagg

SEQ ID NO: 3255880 - DNA, 19 bp, Homo sapiens
gttcacaccctgcaaggcc

SEQ ID NO: 3255881 - DNA, 11 bp, Homo sapiens
gttcacaggag

SEQ ID NO: 3255882 - DNA, 16 bp, Homo sapiens
gttcacattagaatta

SEQ ID NO: 3255883 - DNA, 19 bp, Homo sapiens
gttcacccatcttatcaag

SEQ ID NO: 3255884 - DNA, 22 bp, Homo sapiens
gttcaccttgaagaacctctca

SEQ ID NO: 3255885 - DNA, 21 bp, Homo sapiens
gttcacgtaagatacaagttt

SEQ ID NO: 3255886 - DNA, 23 bp, Homo sapiens
gttcactccatttggtcctttct

SEQ ID NO: 3255887 - DNA, 24 bp, Homo sapiens
gttcactggacacttcacgccctt

SEQ ID NO: 3255888 - DNA, 20 bp, Homo sapiens
gttcagaattaaacttttaa

SEQ ID NO: 3255889 - DNA, 14 bp, Homo sapiens
gttcagcactgtcc

SEQ ID NO: 3255890 - DNA, 15 bp, Homo sapiens
gttcagcactgtccc

SEQ ID NO: 3255891 - DNA, 16 bp, Homo sapiens
gttcagcactgtccct

SEQ ID NO: 3255892 - DNA, 22 bp, Homo sapiens
gttcagccggcactgagaagaa

SEQ ID NO: 3255893 - DNA, 19 bp, Homo sapiens
gttcagctaagctaggaat

SEQ ID NO: 3255894 - DNA, 19 bp, Homo sapiens
gttcagctactttccattt

SEQ ID NO: 3255895 - DNA, 18 bp, Homo sapiens
gttcagctccagctcacc

SEQ ID NO: 3255896 - DNA, 19 bp, Homo sapiens
gttcagctgtcctccctcc

SEQ ID NO: 3255897 - DNA, 18 bp, Homo sapiens
gttcaggggactcagccc

SEQ ID NO: 3255898 - DNA, 17 bp, Homo sapiens
gttcagggttggcccct

SEQ ID NO: 3255899 - DNA, 18 bp, Homo sapiens
gttcaggtaacaggcaga

SEQ ID NO: 3255900 - DNA, 23 bp, Homo sapiens
gttcaggtcccacgtctggccag

SEQ ID NO: 3255901 - DNA, 17 bp, Homo sapiens
gttcagtggcagggctc

SEQ ID NO: 3255902 - DNA, 23 bp, Homo sapiens
gttcataacagtgccattgtctt

SEQ ID NO: 3255903 - DNA, 16 bp, Homo sapiens
gttcatacatttgagg

SEQ ID NO: 3255904 - DNA, 13 bp, Homo sapiens
gttcatacctaag

SEQ ID NO: 3255905 - DNA, 20 bp, Homo sapiens
gttcataggtcactggctct

SEQ ID NO: 3255906 - DNA, 20 bp, Homo sapiens
gttcatatgctctgctttta

SEQ ID NO: 3255907 - DNA, 19 bp, Homo sapiens
gttcatatgtaccatgtac

SEQ ID NO: 3255908 - DNA, 19 bp, Homo sapiens
gttcatattccatatttat

SEQ ID NO: 3255909 - DNA, 12 bp, Homo sapiens
gttcatcagtgt

SEQ ID NO: 3255910 - DNA, 17 bp, Homo sapiens
gttcatcatcctaagct

SEQ ID NO: 3255911 - DNA, 18 bp, Homo sapiens
gttcatccaatcctcact

SEQ ID NO: 3255912 - DNA, 17 bp, Homo sapiens
gttcatcctattgttga

SEQ ID NO: 3255913 - DNA, 22 bp, Homo sapiens
gttcatcctcattgcctcctgt

SEQ ID NO: 3255914 - DNA, 13 bp, Homo sapiens
gttcatctgtcca

SEQ ID NO: 3255915 - DNA, 22 bp, Homo sapiens
gttcatctgtccatggcctttc

SEQ ID NO: 3255916 - DNA, 16 bp, Homo sapiens
gttcatgctgaatcca

SEQ ID NO: 3255917 - DNA, 23 bp, Homo sapiens
gttcatgctgaatccacctcgga

SEQ ID NO: 3255918 - DNA, 19 bp, Homo sapiens
gttcatgtagagaaaagca

SEQ ID NO: 3255919 - DNA, 15 bp, Homo sapiens
gttcatgtttgcttc

SEQ ID NO: 3255920 - DNA, 18 bp, Homo sapiens
gttcattataatctcaaa

SEQ ID NO: 3255921 - DNA, 20 bp, Homo sapiens
gttcattataatctcaaagg

SEQ ID NO: 3255922 - DNA, 14 bp, Homo sapiens
gttcattattttgt

SEQ ID NO: 3255923 - DNA, 20 bp, Homo sapiens
gttcattgtaatgttactga

SEQ ID NO: 3255924 - DNA, 23 bp, Homo sapiens
gttcattgtaatgttactgatca

SEQ ID NO: 3255925 - DNA, 11 bp, Homo sapiens
gttcatttcac

SEQ ID NO: 3255926 - DNA, 20 bp, Homo sapiens
gttcatttggtgttcctgga

SEQ ID NO: 3255927 - DNA, 21 bp, Homo sapiens
gttcatttggtgttcctggaa

SEQ ID NO: 3255928 - DNA, 22 bp, Homo sapiens
gttcatttggtgttcctggaag

SEQ ID NO: 3255929 - DNA, 17 bp, Homo sapiens
gttcatttgtgtgctca

SEQ ID NO: 3255930 - DNA, 18 bp, Homo sapiens
gttcatttgtgtgctcat

SEQ ID NO: 3255931 - DNA, 13 bp, Homo sapiens
gttcattttagtg

SEQ ID NO: 3255932 - DNA, 16 bp, Homo sapiens
gttccaaagccagtga

SEQ ID NO: 3255933 - DNA, 17 bp, Homo sapiens
gttccaaagccagtgaa

SEQ ID NO: 3255934 - DNA, 19 bp, Homo sapiens
gttccaaatgaatgttgtc

SEQ ID NO: 3255935 - DNA, 14 bp, Homo sapiens
gttccaaattcagt

SEQ ID NO: 3255936 - DNA, 20 bp, Homo sapiens
gttccaaattcagtttcata

SEQ ID NO: 3255937 - DNA, 13 bp, Homo sapiens
gttccaagacatt

SEQ ID NO: 3255938 - DNA, 21 bp, Homo sapiens
gttccaagacattgtcaataa

SEQ ID NO: 3255939 - DNA, 17 bp, Homo sapiens
gttccaagtttccaaac

SEQ ID NO: 3255940 - DNA, 21 bp, Homo sapiens
gttccacacccaatgctgctc

SEQ ID NO: 3255941 - DNA, 14 bp, Homo sapiens
gttccacagttgcc

SEQ ID NO: 3255942 - DNA, 21 bp, Homo sapiens
gttccaccccaagagaactcg

SEQ ID NO: 3255943 - DNA, 21 bp, Homo sapiens
gttccacgtccccctggggct

SEQ ID NO: 3255944 - DNA, 20 bp, Homo sapiens
gttccactgcaaataaagcc

SEQ ID NO: 3255945 - DNA, 14 bp, Homo sapiens
gttccagctctttg

SEQ ID NO: 3255946 - DNA, 17 bp, Homo sapiens
gttccaggccctccagt

SEQ ID NO: 3255947 - DNA, 19 bp, Homo sapiens
gttccaggccctccagtgg

SEQ ID NO: 3255948 - DNA, 20 bp, Homo sapiens
gttccagggtccctctgtgt

SEQ ID NO: 3255949 - DNA, 21 bp, Homo sapiens
gttccagggtccctctgtgta

SEQ ID NO: 3255950 - DNA, 18 bp, Homo sapiens
gttccatagaaaaggcgt

SEQ ID NO: 3255951 - DNA, 21 bp, Homo sapiens
gttccatctcctataatctgt

SEQ ID NO: 3255952 - DNA, 20 bp, Homo sapiens
gttccatgagttatcatgaa

SEQ ID NO: 3255953 - DNA, 20 bp, Homo sapiens
gttccatgcctgagggtgga

SEQ ID NO: 3255954 - DNA, 16 bp, Homo sapiens
gttccatgggatacaa

SEQ ID NO: 3255955 - DNA, 23 bp, Homo sapiens
gttccattgaagccgactctggc

SEQ ID NO: 3255956 - DNA, 19 bp, Homo sapiens
gttcccaaggacttccaca

SEQ ID NO: 3255957 - DNA, 20 bp, Homo sapiens
gttcccaaggacttccacat

SEQ ID NO: 3255958 - DNA, 19 bp, Homo sapiens
gttcccactgccctgggca

SEQ ID NO: 3255959 - DNA, 14 bp, Homo sapiens
gttcccacttggag

SEQ ID NO: 3255960 - DNA, 21 bp, Homo sapiens
gttcccagatggctggaaggg

SEQ ID NO: 3255961 - DNA, 11 bp, Homo sapiens
gttcccagcag

SEQ ID NO: 3255962 - DNA, 18 bp, Homo sapiens
gttcccatgtagccccct

SEQ ID NO: 3255963 - DNA, 15 bp, Homo sapiens
gttccccaaatacaa

SEQ ID NO: 3255964 - DNA, 12 bp, Homo sapiens
gttcccctggcc

SEQ ID NO: 3255965 - DNA, 16 bp, Homo sapiens
gttcccctgtcctgtg

SEQ ID NO: 3255966 - DNA, 13 bp, Homo sapiens
gttccccttggct

SEQ ID NO: 3255967 - DNA, 17 bp, Homo sapiens
gttccccttggcttcct

SEQ ID NO: 3255968 - DNA, 17 bp, Homo sapiens
gttcccggagcacagcc

SEQ ID NO: 3255969 - DNA, 22 bp, Homo sapiens
gttcccggagcacagccctggg

SEQ ID NO: 3255970 - DNA, 23 bp, Homo sapiens
gttcccggagcacagccctggga

SEQ ID NO: 3255971 - DNA, 16 bp, Homo sapiens
gttacacagcccaaga

SEQ ID NO: 3255972 - DNA, 20 bp, Homo sapiens
gttacacattaagtaatcaa

SEQ ID NO: 3255973 - DNA, 16 bp, Homo sapiens
gttacactaaaaggtg

SEQ ID NO: 3255974 - DNA, 22 bp, Homo sapiens
gttacactgttagaacactatt

SEQ ID NO: 3255975 - DNA, 13 bp, Homo sapiens
gttacacttttat

SEQ ID NO: 3255976 - DNA, 13 bp, Homo sapiens
gttacagctcccc

SEQ ID NO: 3255977 - DNA, 15 bp, Homo sapiens
gttacagcttcgctg

SEQ ID NO: 3255978 - DNA, 22 bp, Homo sapiens
gttacaggcaccgagaatgttg

SEQ ID NO: 3255979 - DNA, 15 bp, Homo sapiens
gttacagttctgtgg

SEQ ID NO: 3255980 - DNA, 18 bp, Homo sapiens
gttacataagataaatgt

SEQ ID NO: 3255981 - DNA, 23 bp, Homo sapiens
gttacataatcagtatatttggt

SEQ ID NO: 3255982 - DNA, 14 bp, Homo sapiens
gttaccaaatacac

SEQ ID NO: 3255983 - DNA, 22 bp, Homo sapiens
gttaccattttaacgctgccta

SEQ ID NO: 3255984 - DNA, 17 bp, Homo sapiens
gttaccctcctgtaaat

SEQ ID NO: 3255985 - DNA, 20 bp, Homo sapiens
gttacctaaagtatttttat

SEQ ID NO: 3255986 - DNA, 16 bp, Homo sapiens
gttacctactttgact

SEQ ID NO: 3255987 - DNA, 18 bp, Homo sapiens
gttaccttatagttactg

SEQ ID NO: 3255988 - DNA, 20 bp, Homo sapiens
gttaccttatagttactgtg

SEQ ID NO: 3255989 - DNA, 18 bp, Homo sapiens
gttacgtagcctaaggct

SEQ ID NO: 3255990 - DNA, 15 bp, Homo sapiens
gttactaaaaagtac

SEQ ID NO: 3255991 - DNA, 13 bp, Homo sapiens
gttactagcctct

SEQ ID NO: 3255992 - DNA, 20 bp, Homo sapiens
gttactaggtaacttcatat

SEQ ID NO: 3255993 - DNA, 12 bp, Homo sapiens
gttactattttc

SEQ ID NO: 3255994 - DNA, 19 bp, Homo sapiens
gttactcagtgttagagaa

SEQ ID NO: 3255995 - DNA, 17 bp, Homo sapiens
gttactgatcatgcatt

SEQ ID NO: 3255996 - DNA, 9 bp, Homo sapiens
gttactgtt

SEQ ID NO: 3255997 - DNA, 21 bp, Homo sapiens
gttactgttcttgctgctaga

SEQ ID NO: 3255998 - DNA, 15 bp, Homo sapiens
gttactgttgcactg

SEQ ID NO: 3255999 - DNA, 14 bp, Homo sapiens
gttacttcaagtaa

SEQ ID NO: 3256000 - DNA, 13 bp, Homo sapiens
gttacttcctatc

SEQ ID NO: 3256001 - DNA, 19 bp, Homo sapiens
gttacttgtctgaggcctc

SEQ ID NO: 3256002 - DNA, 15 bp, Homo sapiens
gttagaaaatgactt

SEQ ID NO: 3256003 - DNA, 19 bp, Homo sapiens
gttagaaatgcagaatcct

SEQ ID NO: 3256004 - DNA, 20 bp, Homo sapiens
gttagaacactattttcaga

SEQ ID NO: 3256005 - DNA, 14 bp, Homo sapiens
gttagaaggcttaa

SEQ ID NO: 3256006 - DNA, 14 bp, Homo sapiens
gttagaatgtctgc

SEQ ID NO: 3256007 - DNA, 22 bp, Homo sapiens
gttagaccgctctcttttctgt

SEQ ID NO: 3256008 - DNA, 23 bp, Homo sapiens
gttagaccgctctcttttctgta

SEQ ID NO: 3256009 - DNA, 18 bp, Homo sapiens
gttagacgccttccaggt

SEQ ID NO: 3256010 - DNA, 23 bp, Homo sapiens
gttagacgccttccaggtcagga

SEQ ID NO: 3256011 - DNA, 20 bp, Homo sapiens
gttagagaatatatttttga

SEQ ID NO: 3256012 - DNA, 19 bp, Homo sapiens
gttagagagcttttcactg

SEQ ID NO: 3256013 - DNA, 21 bp, Homo sapiens
gttagagagggaccatgtgtc

SEQ ID NO: 3256014 - DNA, 23 bp, Homo sapiens
gttagatattgctactataatca

SEQ ID NO: 3256015 - DNA, 14 bp, Homo sapiens
gttagcactgttga

SEQ ID NO: 3256016 - DNA, 13 bp, Homo sapiens
gttagccctcagt

SEQ ID NO: 3256017 - DNA, 15 bp, Homo sapiens
gttagccctcagtca

SEQ ID NO: 3256018 - DNA, 16 bp, Homo sapiens
gttagctcctgtggcc

SEQ ID NO: 3256019 - DNA, 17 bp, Homo sapiens
gttagctgaagaattga

SEQ ID NO: 3256020 - DNA, 20 bp, Homo sapiens
gttaggagtgggtgacaaga

SEQ ID NO: 3256021 - DNA, 17 bp, Homo sapiens
gttagtaatggcagagc

SEQ ID NO: 3256022 - DNA, 13 bp, Homo sapiens
gttagtagaaatt

SEQ ID NO: 3256023 - DNA, 19 bp, Homo sapiens
gttagtattttaatcctgt

SEQ ID NO: 3256024 - DNA, 17 bp, Homo sapiens
gttagttaaaagcccat

SEQ ID NO: 3256025 - DNA, 22 bp, Homo sapiens
gttagttaccttatagttactg

SEQ ID NO: 3256026 - DNA, 17 bp, Homo sapiens
gttagttatagatgtct

SEQ ID NO: 3256027 - DNA, 19 bp, Homo sapiens
gttagttatagatgtctag

SEQ ID NO: 3256028 - DNA, 19 bp, Homo sapiens
gttagttgtgaaagaaagc

SEQ ID NO: 3256029 - DNA, 22 bp, Homo sapiens
gttataaaaaatggttcagaat

SEQ ID NO: 3256030 - DNA, 11 bp, Homo sapiens
gttataaaatt

SEQ ID NO: 3256031 - DNA, 16 bp, Homo sapiens
gttataacagatgtga

SEQ ID NO: 3256032 - DNA, 13 bp, Homo sapiens
gttataagactct

SEQ ID NO: 3256033 - DNA, 14 bp, Homo sapiens
gttataagactctc

SEQ ID NO: 3256034 - DNA, 12 bp, Homo sapiens
gttatacaataa

SEQ ID NO: 3256035 - DNA, 18 bp, Homo sapiens
gttatacaataacccagt

SEQ ID NO: 3256036 - DNA, 14 bp, Homo sapiens
gttatatcaacaga

SEQ ID NO: 3256037 - DNA, 16 bp, Homo sapiens
gttatatcccctgcta

SEQ ID NO: 3256038 - DNA, 17 bp, Homo sapiens
gttatatcccctgctac

SEQ ID NO: 3256039 - DNA, 23 bp, Homo sapiens
gttatcaaacttcagctgtactt

SEQ ID NO: 3256040 - DNA, 18 bp, Homo sapiens
gttatcatgaattttaaa

SEQ ID NO: 3256041 - DNA, 17 bp, Homo sapiens
gttatcgaaataacaat

SEQ ID NO: 3256042 - DNA, 18 bp, Homo sapiens
gttatcgaaataacaatg

SEQ ID NO: 3256043 - DNA, 21 bp, Homo sapiens
gttatcgaaataacaatgtta

SEQ ID NO: 3256044 - DNA, 14 bp, Homo sapiens
gttatctctgtgtt

SEQ ID NO: 3256045 - DNA, 15 bp, Homo sapiens
gttatctgcctggcc

SEQ ID NO: 3256046 - DNA, 21 bp, Homo sapiens
gttatctgcctggcctggctc

SEQ ID NO: 3256047 - DNA, 22 bp, Homo sapiens
gttatcttctcaagttctaaga

SEQ ID NO: 3256048 - DNA, 23 bp, Homo sapiens
gttatcttctcaagttctaagat

SEQ ID NO: 3256049 - DNA, 17 bp, Homo sapiens
gttatgaaagaatatat

SEQ ID NO: 3256050 - DNA, 17 bp, Homo sapiens
gttatgatattgtttaa

SEQ ID NO: 3256051 - DNA, 22 bp, Homo sapiens
gttatgatattgtttaaaattc

SEQ ID NO: 3256052 - DNA, 13 bp, Homo sapiens
gttatgctgtcat

SEQ ID NO: 3256053 - DNA, 22 bp, Homo sapiens
gttatgtactagtgttctgttt

SEQ ID NO: 3256054 - DNA, 17 bp, Homo sapiens
gttatgtactgtactaa

SEQ ID NO: 3256055 - DNA, 19 bp, Homo sapiens
gttatgtactgtactaatt

SEQ ID NO: 3256056 - DNA, 20 bp, Homo sapiens
gttatgtatgaaggaatcat

SEQ ID NO: 3256057 - DNA, 18 bp, Homo sapiens
gttatgtgtatgtgccat

SEQ ID NO: 3256058 - DNA, 20 bp, Homo sapiens
gttatgtgtatgtgccattt

SEQ ID NO: 3256059 - DNA, 19 bp, Homo sapiens
gttatgtttaaaaaaacat

SEQ ID NO: 3256060 - DNA, 20 bp, Homo sapiens
gttattatgtagctgaaaca

SEQ ID NO: 3256061 - DNA, 18 bp, Homo sapiens
gttattcaaatttgtaca

SEQ ID NO: 3256062 - DNA, 23 bp, Homo sapiens
gttattcataaagagaaaatgat

SEQ ID NO: 3256063 - DNA, 22 bp, Homo sapiens
gttattcattctgtgatcattt

SEQ ID NO: 3256064 - DNA, 13 bp, Homo sapiens
gttattccatcaa

SEQ ID NO: 3256065 - DNA, 14 bp, Homo sapiens
gttattccatcaat

SEQ ID NO: 3256066 - DNA, 17 bp, Homo sapiens
gttattccatcaataaa

SEQ ID NO: 3256067 - DNA, 17 bp, Homo sapiens
gttattccttgatcatt

SEQ ID NO: 3256068 - DNA, 21 bp, Homo sapiens
gttattctaagccctttgcca

SEQ ID NO: 3256069 - DNA, 17 bp, Homo sapiens
gttattgcaataaagta

SEQ ID NO: 3256070 - DNA, 21 bp, Homo sapiens
gttattgggcaagtgattgaa

SEQ ID NO: 3256071 - DNA, 22 bp, Homo sapiens
gttatttaatcacagtcatctt

SEQ ID NO: 3256072 - DNA, 14 bp, Homo sapiens
gttatttactttta

SEQ ID NO: 3256073 - DNA, 20 bp, Homo sapiens
gttatttatacaagattgaa

SEQ ID NO: 3256074 - DNA, 19 bp, Homo sapiens
gttatttatagtcatttat

SEQ ID NO: 3256075 - DNA, 19 bp, Homo sapiens
gttatttatggaccacttt

SEQ ID NO: 3256076 - DNA, 13 bp, Homo sapiens
gttatttctgtag

SEQ ID NO: 3256077 - DNA, 14 bp, Homo sapiens
gttatttcttgttt

SEQ ID NO: 3256078 - DNA, 18 bp, Homo sapiens
gttatttgttattttcag

SEQ ID NO: 3256079 - DNA, 14 bp, Homo sapiens
gttattttattatt

SEQ ID NO: 3256080 - DNA, 20 bp, Homo sapiens
gttattttctacagtggttt

SEQ ID NO: 3256081 - DNA, 12 bp, Homo sapiens
gggacagctcct

SEQ ID NO: 3256082 - DNA, 13 bp, Homo sapiens
gggacagctcctt

SEQ ID NO: 3256083 - DNA, 16 bp, Homo sapiens
gggacagctccttctg

SEQ ID NO: 3256084 - DNA, 12 bp, Homo sapiens
gggacaggcctc

SEQ ID NO: 3256085 - DNA, 18 bp, Homo sapiens
gggacaggctgaagagag

SEQ ID NO: 3256086 - DNA, 20 bp, Homo sapiens
gggacagttggcagagaagg

SEQ ID NO: 3256087 - DNA, 18 bp, Homo sapiens
gggacatgctcacctcta

SEQ ID NO: 3256088 - DNA, 19 bp, Homo sapiens
gggacattttctggattct

SEQ ID NO: 3256089 - DNA, 19 bp, Homo sapiens
gggaccaaggcaaggcagg

SEQ ID NO: 3256090 - DNA, 22 bp, Homo sapiens
gggaccactgggtgagagagga

SEQ ID NO: 3256091 - DNA, 14 bp, Homo sapiens
gggaccagagccag

SEQ ID NO: 3256092 - DNA, 17 bp, Homo sapiens
gggaccagagccagatg

SEQ ID NO: 3256093 - DNA, 13 bp, Homo sapiens
gggaccatgtgtc

SEQ ID NO: 3256094 - DNA, 20 bp, Homo sapiens
gggacccacggagccctccc

SEQ ID NO: 3256095 - DNA, 22 bp, Homo sapiens
gggacccagctactctgtccag

SEQ ID NO: 3256096 - DNA, 24 bp, Homo sapiens
gggacccagctactctgtccaggc

SEQ ID NO: 3256097 - DNA, 13 bp, Homo sapiens
gggacccaggctc

SEQ ID NO: 3256098 - DNA, 22 bp, Homo sapiens
gggaccctgtccggcccagtgc

SEQ ID NO: 3256099 - DNA, 23 bp, Homo sapiens
gggaccctgtgacatggtgcctg

SEQ ID NO: 3256100 - DNA, 13 bp, Homo sapiens
gggaccggtgctg

SEQ ID NO: 3256101 - DNA, 18 bp, Homo sapiens
gggaccggtgctgcagga

SEQ ID NO: 3256102 - DNA, 21 bp, Homo sapiens
gggacctggtaccctcctggc

SEQ ID NO: 3256103 - DNA, 23 bp, Homo sapiens
gggaccttggtctgatcgacgtg

SEQ ID NO: 3256104 - DNA, 17 bp, Homo sapiens
gggacggtgcccaagcc

SEQ ID NO: 3256105 - DNA, 17 bp, Homo sapiens
gggactcaatgcactga

SEQ ID NO: 3256106 - DNA, 19 bp, Homo sapiens
gggactcaatgcactgaca

SEQ ID NO: 3256107 - DNA, 18 bp, Homo sapiens
gggactcagcgtcccctg

SEQ ID NO: 3256108 - DNA, 13 bp, Homo sapiens
gggactcagggac

SEQ ID NO: 3256109 - DNA, 15 bp, Homo sapiens
gggactcagggaccg

SEQ ID NO: 3256110 - DNA, 12 bp, Homo sapiens
gggactcctggt

SEQ ID NO: 3256111 - DNA, 22 bp, Homo sapiens
gggactcctggtgcccctcgcc

SEQ ID NO: 3256112 - DNA, 22 bp, Homo sapiens
gggactctgagcgggaggcaga

SEQ ID NO: 3256113 - DNA, 23 bp, Homo sapiens
gggactgccagtccccctgcccc

SEQ ID NO: 3256114 - DNA, 21 bp, Homo sapiens
gggactgctacctctgagaag

SEQ ID NO: 3256115 - DNA, 12 bp, Homo sapiens
gggactgggttt

SEQ ID NO: 3256116 - DNA, 14 bp, Homo sapiens
gggactgttccaaa

SEQ ID NO: 3256117 - DNA, 15 bp, Homo sapiens
gggacttccttgctc

SEQ ID NO: 3256118 - DNA, 19 bp, Homo sapiens
gggacttcttacccaaagc

SEQ ID NO: 3256119 - DNA, 18 bp, Homo sapiens
gggacttgaatctttcca

SEQ ID NO: 3256120 - DNA, 17 bp, Homo sapiens
gggacttggaagctccg

SEQ ID NO: 3256121 - DNA, 19 bp, Homo sapiens
gggacttggacaggagtca

SEQ ID NO: 3256122 - DNA, 13 bp, Homo sapiens
gggagaaaattca

SEQ ID NO: 3256123 - DNA, 15 bp, Homo sapiens
gggagaaaattcaat

SEQ ID NO: 3256124 - DNA, 16 bp, Homo sapiens
gggagaacctcaggct

SEQ ID NO: 3256125 - DNA, 12 bp, Homo sapiens
gggagacagcat

SEQ ID NO: 3256126 - DNA, 12 bp, Homo sapiens
gggagagacctc

SEQ ID NO: 3256127 - DNA, 19 bp, Homo sapiens
gggagagagaaccaccact

SEQ ID NO: 3256128 - DNA, 12 bp, Homo sapiens
gggagagcaggc

SEQ ID NO: 3256129 - DNA, 13 bp, Homo sapiens
gggagagcaggct

SEQ ID NO: 3256130 - DNA, 23 bp, Homo sapiens
gggagagcaggctggcagctctc

SEQ ID NO: 3256131 - DNA, 12 bp, Homo sapiens
gggagagcccag

SEQ ID NO: 3256132 - DNA, 16 bp, Homo sapiens
gggagagcctgctggc

SEQ ID NO: 3256133 - DNA, 15 bp, Homo sapiens
gggagatggtcagtg

SEQ ID NO: 3256134 - DNA, 16 bp, Homo sapiens
gggagcactggagtgc

SEQ ID NO: 3256135 - DNA, 22 bp, Homo sapiens
gggagcacttgcgtcctgcaga

SEQ ID NO: 3256136 - DNA, 13 bp, Homo sapiens
gggagcaggagat

SEQ ID NO: 3256137 - DNA, 20 bp, Homo sapiens
gggagcaggaggccaataaa

SEQ ID NO: 3256138 - DNA, 15 bp, Homo sapiens
gggagcagggaaggc

SEQ ID NO: 3256139 - DNA, 19 bp, Homo sapiens
gggagcagtgtcttccata

SEQ ID NO: 3256140 - DNA, 20 bp, Homo sapiens
gggagcagtgtcttccataa

SEQ ID NO: 3256141 - DNA, 22 bp, Homo sapiens
gggagcatttaatggcagctag

SEQ ID NO: 3256142 - DNA, 14 bp, Homo sapiens
gggagccagctgct

SEQ ID NO: 3256143 - DNA, 14 bp, Homo sapiens
gggagccccagggt

SEQ ID NO: 3256144 - DNA, 16 bp, Homo sapiens
gggagcccccaccaca

SEQ ID NO: 3256145 - DNA, 23 bp, Homo sapiens
gggagccctcaggcacctgcact

SEQ ID NO: 3256146 - DNA, 20 bp, Homo sapiens
gggagccctgaccttggctg

SEQ ID NO: 3256147 - DNA, 17 bp, Homo sapiens
gggagcctagctcctgc

SEQ ID NO: 3256148 - DNA, 18 bp, Homo sapiens
gggagcctagctcctgcc

SEQ ID NO: 3256149 - DNA, 11 bp, Homo sapiens
gggagcctcct

SEQ ID NO: 3256150 - DNA, 14 bp, Homo sapiens
gggagcctcctgcc

SEQ ID NO: 3256151 - DNA, 22 bp, Homo sapiens
gggagcctttggttctggccag

SEQ ID NO: 3256152 - DNA, 19 bp, Homo sapiens
gggagctccactctgcttc

SEQ ID NO: 3256153 - DNA, 13 bp, Homo sapiens
gggagctctgtat

SEQ ID NO: 3256154 - DNA, 18 bp, Homo sapiens
gtaaatatgtacatttgt

SEQ ID NO: 3256155 - DNA, 15 bp, Homo sapiens
gtaaatatttactct

SEQ ID NO: 3256156 - DNA, 20 bp, Homo sapiens
gtaaatatttactctttgca

SEQ ID NO: 3256157 - DNA, 12 bp, Homo sapiens
gtaaatatttat

SEQ ID NO: 3256158 - DNA, 21 bp, Homo sapiens
gtaaatcagtaagaggtgtta

SEQ ID NO: 3256159 - DNA, 19 bp, Homo sapiens
gtaaatcctagacttgaaa

SEQ ID NO: 3256160 - DNA, 20 bp, Homo sapiens
gtaaatcctagacttgaaag

SEQ ID NO: 3256161 - DNA, 22 bp, Homo sapiens
gtaaatcctttttctttataaa

SEQ ID NO: 3256162 - DNA, 13 bp, Homo sapiens
gtaaatctgccac

SEQ ID NO: 3256163 - DNA, 14 bp, Homo sapiens
gtaaatcttttaca

SEQ ID NO: 3256164 - DNA, 15 bp, Homo sapiens
gtaaatgctgtgttg

SEQ ID NO: 3256165 - DNA, 16 bp, Homo sapiens
gtaaatggtgtacata

SEQ ID NO: 3256166 - DNA, 20 bp, Homo sapiens
gtaaatggtgtacataatgt

SEQ ID NO: 3256167 - DNA, 11 bp, Homo sapiens
gtaaatgtttc

SEQ ID NO: 3256168 - DNA, 13 bp, Homo sapiens
gtaaatgtttctt

SEQ ID NO: 3256169 - DNA, 21 bp, Homo sapiens
gtaaatgtttgttaaaaataa

SEQ ID NO: 3256170 - DNA, 16 bp, Homo sapiens
gtaaattgcctgattt

SEQ ID NO: 3256171 - DNA, 16 bp, Homo sapiens
gtaaattttgtgatga

SEQ ID NO: 3256172 - DNA, 16 bp, Homo sapiens
gtaacaagaaaacata

SEQ ID NO: 3256173 - DNA, 18 bp, Homo sapiens
gtaacaatacaaatggat

SEQ ID NO: 3256174 - DNA, 20 bp, Homo sapiens
gtaacactagggccttggaa

SEQ ID NO: 3256175 - DNA, 21 bp, Homo sapiens
gtaacactgtgtacacctcaa

SEQ ID NO: 3256176 - DNA, 14 bp, Homo sapiens
gtaacagaacagct

SEQ ID NO: 3256177 - DNA, 19 bp, Homo sapiens
gtaacaggaaaattttaaa

SEQ ID NO: 3256178 - DNA, 19 bp, Homo sapiens
gtaacatgcatactttatt

SEQ ID NO: 3256179 - DNA, 14 bp, Homo sapiens
gtaacatttgctgt

SEQ ID NO: 3256180 - DNA, 16 bp, Homo sapiens
gtaaccagtgcagaaa

SEQ ID NO: 3256181 - DNA, 21 bp, Homo sapiens
gtaaccccatactctcctttt

SEQ ID NO: 3256182 - DNA, 15 bp, Homo sapiens
gtaaccgtggctggt

SEQ ID NO: 3256183 - DNA, 15 bp, Homo sapiens
gtaacctcagctctg

SEQ ID NO: 3256184 - DNA, 18 bp, Homo sapiens
gtaacctcagctctggga

SEQ ID NO: 3256185 - DNA, 19 bp, Homo sapiens
gtaacgtattggacctgcc

SEQ ID NO: 3256186 - DNA, 21 bp, Homo sapiens
gtaactacaaagctttgctac

SEQ ID NO: 3256187 - DNA, 16 bp, Homo sapiens
gtaactattaaccttt

SEQ ID NO: 3256188 - DNA, 14 bp, Homo sapiens
gtaactgctgagcc

SEQ ID NO: 3256189 - DNA, 16 bp, Homo sapiens
gtaactgctgagccac

SEQ ID NO: 3256190 - DNA, 19 bp, Homo sapiens
gtaactgctttctgttcca

SEQ ID NO: 3256191 - DNA, 22 bp, Homo sapiens
gtaactgctttctgttccaaat

SEQ ID NO: 3256192 - DNA, 21 bp, Homo sapiens
gtaactggaaggccttccact

SEQ ID NO: 3256193 - DNA, 20 bp, Homo sapiens
gtaacttcttatggaattga

SEQ ID NO: 3256194 - DNA, 14 bp, Homo sapiens
gtaactttatgtgt

SEQ ID NO: 3256195 - DNA, 12 bp, Homo sapiens
gtaacttttaat

SEQ ID NO: 3256196 - DNA, 14 bp, Homo sapiens
gtaacttttgtaag

SEQ ID NO: 3256197 - DNA, 15 bp, Homo sapiens
gtaacttttgtaaga

SEQ ID NO: 3256198 - DNA, 17 bp, Homo sapiens
gtaacttttgtaagaca

SEQ ID NO: 3256199 - DNA, 21 bp, Homo sapiens
gtaacttttttgtgtatgtac

SEQ ID NO: 3256200 - DNA, 20 bp, Homo sapiens
gtaagaaagtgaagcaaatc

SEQ ID NO: 3256201 - DNA, 18 bp, Homo sapiens
gtaagaacaactacctga

SEQ ID NO: 3256202 - DNA, 19 bp, Homo sapiens
gtaagaacatcataaaatt

SEQ ID NO: 3256203 - DNA, 12 bp, Homo sapiens
gtaagaagaaag

SEQ ID NO: 3256204 - DNA, 16 bp, Homo sapiens
gtaagaccccatctct

SEQ ID NO: 3256205 - DNA, 21 bp, Homo sapiens
gtaagagcaccttcctcactt

SEQ ID NO: 3256206 - DNA, 12 bp, Homo sapiens
gtaagatgctgg

SEQ ID NO: 3256207 - DNA, 16 bp, Homo sapiens
gtaagatgctgggttg

SEQ ID NO: 3256208 - DNA, 20 bp, Homo sapiens
gtaagatgctgggttggtgc

SEQ ID NO: 3256209 - DNA, 20 bp, Homo sapiens
gtaagattatagattctaaa

SEQ ID NO: 3256210 - DNA, 13 bp, Homo sapiens
gtaagccaaagaa

SEQ ID NO: 3256211 - DNA, 22 bp, Homo sapiens
gtaagccaaagaaatgaacatt

SEQ ID NO: 3256212 - DNA, 15 bp, Homo sapiens
gtaagccagagcctg

SEQ ID NO: 3256213 - DNA, 11 bp, Homo sapiens
gtaagctcttt

SEQ ID NO: 3256214 - DNA, 12 bp, Homo sapiens
gtaagctgttta

SEQ ID NO: 3256215 - DNA, 16 bp, Homo sapiens
gtaaggctctagatca

SEQ ID NO: 3256216 - DNA, 18 bp, Homo sapiens
gtaagtaattatgcacta

SEQ ID NO: 3256217 - DNA, 12 bp, Homo sapiens
gtaagtcatcta

SEQ ID NO: 3256218 - DNA, 15 bp, Homo sapiens
gtaagtcccccaggg

SEQ ID NO: 3256219 - DNA, 22 bp, Homo sapiens
gtaagtggggttgcaaccactg

SEQ ID NO: 3256220 - DNA, 14 bp, Homo sapiens
gtaagttgtacaaa

SEQ ID NO: 3256221 - DNA, 21 bp, Homo sapiens
gtaagtttaaaggatgttggt

SEQ ID NO: 3256222 - DNA, 13 bp, Homo sapiens
gtaagtttcaggt

SEQ ID NO: 3256223 - DNA, 14 bp, Homo sapiens
gtaagtttcaggtg

SEQ ID NO: 3256224 - DNA, 16 bp, Homo sapiens
gtaataaactgtgttt

SEQ ID NO: 3256225 - DNA, 15 bp, Homo sapiens
gtaataaactttaat

SEQ ID NO: 3256226 - DNA, 15 bp, Homo sapiens
gtaataaagtatata

SEQ ID NO: 3256227 - DNA, 17 bp, Homo sapiens
gtaataaagtgttttca

SEQ ID NO: 3256228 - DNA, 13 bp, Homo sapiens
gtaataaatactg

SEQ ID NO: 3256229 - DNA, 22 bp, Homo sapiens
gtaataaattcaaaacctgcag

SEQ ID NO: 3256230 - DNA, 14 bp, Homo sapiens
gtaataagacataa

SEQ ID NO: 3256231 - DNA, 13 bp, Homo sapiens
gtaataagcactg

SEQ ID NO: 3256232 - DNA, 21 bp, Homo sapiens
gtaataagcactgtaaacttc

SEQ ID NO: 3256233 - DNA, 13 bp, Homo sapiens
gtaataatacctc

SEQ ID NO: 3256234 - DNA, 15 bp, Homo sapiens
gtaataatacctcaa

SEQ ID NO: 3256235 - DNA, 22 bp, Homo sapiens
gtaatactttcggagaaattct

SEQ ID NO: 3256236 - DNA, 17 bp, Homo sapiens
gtaatagattatagttg

SEQ ID NO: 3256237 - DNA, 19 bp, Homo sapiens
gtaatataaagtattcaac

SEQ ID NO: 3256238 - DNA, 16 bp, Homo sapiens
gtaatatattgtacaa

SEQ ID NO: 3256239 - DNA, 17 bp, Homo sapiens
gtaatatattgtacaaa

SEQ ID NO: 3256240 - DNA, 20 bp, Homo sapiens
gtaatattgacttgtatatt

SEQ ID NO: 3256241 - DNA, 19 bp, Homo sapiens
gtaatcaataaagaaaact

SEQ ID NO: 3256242 - DNA, 12 bp, Homo sapiens
gtaatcaatgaa

SEQ ID NO: 3256243 - DNA, 18 bp, Homo sapiens
gtaatcaatgaatattga

SEQ ID NO: 3256244 - DNA, 14 bp, Homo sapiens
gtaatcaatgtttc

SEQ ID NO: 3256245 - DNA, 17 bp, Homo sapiens
gtaatcactcccatttt

SEQ ID NO: 3256246 - DNA, 19 bp, Homo sapiens
gtaatcactcccattttta

SEQ ID NO: 3256247 - DNA, 14 bp, Homo sapiens
gtaatcacttttca

SEQ ID NO: 3256248 - DNA, 12 bp, Homo sapiens
gtaatcccagct

SEQ ID NO: 3256249 - DNA, 20 bp, Homo sapiens
gtaatcccagctacttggga

SEQ ID NO: 3256250 - DNA, 21 bp, Homo sapiens
gtaatcccttcacagtcccag

SEQ ID NO: 3256251 - DNA, 14 bp, Homo sapiens
gtaatctttatact

SEQ ID NO: 3256252 - DNA, 13 bp, Homo sapiens
gtaatgaagtaaa

SEQ ID NO: 3256253 - DNA, 17 bp, Homo sapiens
gtaatgcactgttttta

SEQ ID NO: 3256254 - DNA, 12 bp, Homo sapiens
gtaatgctgcac

SEQ ID NO: 3256255 - DNA, 16 bp, Homo sapiens
gtaatgggcctgccca

SEQ ID NO: 3256256 - DNA, 14 bp, Homo sapiens
gtaatgtgaataaa

SEQ ID NO: 3256257 - DNA, 20 bp, Homo sapiens
gtaatgtgtggtggcctcag

SEQ ID NO: 3256258 - DNA, 20 bp, Homo sapiens
gtaatgttactgatcatgca

SEQ ID NO: 3256259 - DNA, 15 bp, Homo sapiens
gtaattagctctggg

SEQ ID NO: 3256260 - DNA, 16 bp, Homo sapiens
gtaattagctctgggg

SEQ ID NO: 3256261 - DNA, 21 bp, Homo sapiens
gtaattagtgccacttaatgt

SEQ ID NO: 3256262 - DNA, 21 bp, Homo sapiens
gtaattatcgggaacagtgtt

SEQ ID NO: 3256263 - DNA, 15 bp, Homo sapiens
gtaattctaaatgaa

SEQ ID NO: 3256264 - DNA, 16 bp, Homo sapiens
gtaattgaataaagtt

SEQ ID NO: 3256265 - DNA, 17 bp, Homo sapiens
gtaattgcttacatttt

SEQ ID NO: 3256266 - DNA, 23 bp, Homo sapiens
gtaattggcccaagtcattgttt

SEQ ID NO: 3256267 - DNA, 9 bp, Homo sapiens
gtaattgtg

SEQ ID NO: 3256268 - DNA, 15 bp, Homo sapiens
gtaattgtgtggatt

SEQ ID NO: 3256269 - DNA, 21 bp, Homo sapiens
gtaattgttgctaatcttctt

SEQ ID NO: 3256270 - DNA, 19 bp, Homo sapiens
gtaatttaaacaggcccag

SEQ ID NO: 3256271 - DNA, 12 bp, Homo sapiens
gtaatttaactt

SEQ ID NO: 3256272 - DNA, 20 bp, Homo sapiens
gtaatttagggtactaaatt

SEQ ID NO: 3256273 - DNA, 14 bp, Homo sapiens
gtaatttataaaat

SEQ ID NO: 3256274 - DNA, 13 bp, Homo sapiens
gtaatttattgtc

SEQ ID NO: 3256275 - DNA, 18 bp, Homo sapiens
gtaatttctaaagcagtt

SEQ ID NO: 3256276 - DNA, 18 bp, Homo sapiens
gtaatttggtttaaaaat

SEQ ID NO: 3256277 - DNA, 22 bp, Homo sapiens
gtaatttgtgtaataaagtgtt

SEQ ID NO: 3256278 - DNA, 17 bp, Homo sapiens
gtaattttaaaagtcta

SEQ ID NO: 3256279 - DNA, 20 bp, Homo sapiens
gtacaaaaaaaaagttttat

SEQ ID NO: 3256280 - DNA, 12 bp, Homo sapiens
gtacaaaataaa

SEQ ID NO: 3256281 - DNA, 14 bp, Homo sapiens
gtacaaaataaaca

SEQ ID NO: 3256282 - DNA, 14 bp, Homo sapiens
gtacaaagttttcc

SEQ ID NO: 3256283 - DNA, 18 bp, Homo sapiens
gtacaaagttttcctttg

SEQ ID NO: 3256284 - DNA, 17 bp, Homo sapiens
gtacaaatgtaagcaaa

SEQ ID NO: 3256285 - DNA, 14 bp, Homo sapiens
gtacatttataatt

SEQ ID NO: 3256286 - DNA, 22 bp, Homo sapiens
gtacatttatgatttaataaaa

SEQ ID NO: 3256287 - DNA, 16 bp, Homo sapiens
gtacattttgttgtaa

SEQ ID NO: 3256288 - DNA, 17 bp, Homo sapiens
gtacattttgttgtaaa

SEQ ID NO: 3256289 - DNA, 18 bp, Homo sapiens
gtacattttgttgtaaaa

SEQ ID NO: 3256290 - DNA, 22 bp, Homo sapiens
gtacattttgttgtaaaaagaa

SEQ ID NO: 3256291 - DNA, 16 bp, Homo sapiens
gtaccaaaattttaaa

SEQ ID NO: 3256292 - DNA, 18 bp, Homo sapiens
gtaccaaagttttatcaa

SEQ ID NO: 3256293 - DNA, 21 bp, Homo sapiens
gtaccaatcattttaattatt

SEQ ID NO: 3256294 - DNA, 14 bp, Homo sapiens
gtaccaatgctgtt

SEQ ID NO: 3256295 - DNA, 21 bp, Homo sapiens
gtaccaatgctgttgtaaaca

SEQ ID NO: 3256296 - DNA, 16 bp, Homo sapiens
gtaccagagctagttt

SEQ ID NO: 3256297 - DNA, 19 bp, Homo sapiens
gtaccagctgcgcttgctt

SEQ ID NO: 3256298 - DNA, 10 bp, Homo sapiens
gtaccagtta

SEQ ID NO: 3256299 - DNA, 20 bp, Homo sapiens
gtaccatagcgctgctctta

SEQ ID NO: 3256300 - DNA, 13 bp, Homo sapiens
gtacccactgctc

SEQ ID NO: 3256301 - DNA, 14 bp, Homo sapiens
gtacccactgctct

SEQ ID NO: 3256302 - DNA, 15 bp, Homo sapiens
gtacccagccatctg

SEQ ID NO: 3256303 - DNA, 18 bp, Homo sapiens
gtacccagccatctgccc

SEQ ID NO: 3256304 - DNA, 13 bp, Homo sapiens
gtacccagctcct

SEQ ID NO: 3256305 - DNA, 22 bp, Homo sapiens
gtaccccactgggccagccctg

SEQ ID NO: 3256306 - DNA, 14 bp, Homo sapiens
gtaccccccaaccc

SEQ ID NO: 3256307 - DNA, 19 bp, Homo sapiens
gtacccctggtaaaccaag

SEQ ID NO: 3256308 - DNA, 18 bp, Homo sapiens
gtaccctatagagagggg

SEQ ID NO: 3256309 - DNA, 17 bp, Homo sapiens
gtaccctcctggctctt

SEQ ID NO: 3256310 - DNA, 17 bp, Homo sapiens
gtaccctctcagctcca

SEQ ID NO: 3256311 - DNA, 20 bp, Homo sapiens
gtaccctttaagatatccat

SEQ ID NO: 3256312 - DNA, 19 bp, Homo sapiens
gtacctataaagtaaagct

SEQ ID NO: 3256313 - DNA, 20 bp, Homo sapiens
gtacctataaagtaaagcta

SEQ ID NO: 3256314 - DNA, 13 bp, Homo sapiens
gtacctcaaatga

SEQ ID NO: 3256315 - DNA, 15 bp, Homo sapiens
gtacctcaaatgaat

SEQ ID NO: 3256316 - DNA, 19 bp, Homo sapiens
gtacctcaagccccatttc

SEQ ID NO: 3256317 - DNA, 16 bp, Homo sapiens
gtacctcatcccatga

SEQ ID NO: 3256318 - DNA, 16 bp, Homo sapiens
gtacctcctctcagtg

SEQ ID NO: 3256319 - DNA, 19 bp, Homo sapiens
gtacctcctctcagtgttt

SEQ ID NO: 3256320 - DNA, 15 bp, Homo sapiens
gtacctctgtataga

SEQ ID NO: 3256321 - DNA, 23 bp, Homo sapiens
gtacctgaaaagtaacttggctt

SEQ ID NO: 3256322 - DNA, 15 bp, Homo sapiens
gtacctgatgtacct

SEQ ID NO: 3256323 - DNA, 15 bp, Homo sapiens
gtacctgattgtatt

SEQ ID NO: 3256324 - DNA, 19 bp, Homo sapiens
gtacctgttccttagacct

SEQ ID NO: 3256325 - DNA, 13 bp, Homo sapiens
gtaccttgcttct

SEQ ID NO: 3256326 - DNA, 15 bp, Homo sapiens
gtaccttgtgcccag

SEQ ID NO: 3256327 - DNA, 23 bp, Homo sapiens
gtacgaacctacagttttaactg

SEQ ID NO: 3256328 - DNA, 22 bp, Homo sapiens
gtacgggttgttttgggtgaat

SEQ ID NO: 3256329 - DNA, 21 bp, Homo sapiens
gtacgttattgttgacttatt

SEQ ID NO: 3256330 - DNA, 13 bp, Homo sapiens
gtactaaatttaa

SEQ ID NO: 3256331 - DNA, 20 bp, Homo sapiens
gtactactagatgtctttag

SEQ ID NO: 3256332 - DNA, 21 bp, Homo sapiens
gtactagtgtggtgtgtttgc

SEQ ID NO: 3256333 - DNA, 14 bp, Homo sapiens
gtactagtgttctg

SEQ ID NO: 3256334 - DNA, 20 bp, Homo sapiens
gtactataagtagttggttt

SEQ ID NO: 3256335 - DNA, 21 bp, Homo sapiens
gtactatttagatataacact

SEQ ID NO: 3256336 - DNA, 18 bp, Homo sapiens
gtactcaaattcaatgat

SEQ ID NO: 3256337 - DNA, 14 bp, Homo sapiens
gtactcagagcaga

SEQ ID NO: 3256338 - DNA, 14 bp, Homo sapiens
gtactcctcccagg

SEQ ID NO: 3256339 - DNA, 14 bp, Homo sapiens
gtactctcctagag

SEQ ID NO: 3256340 - DNA, 15 bp, Homo sapiens
gtactctcctagaga

SEQ ID NO: 3256341 - DNA, 13 bp, Homo sapiens
gtactctgtgtgt

SEQ ID NO: 3256342 - DNA, 20 bp, Homo sapiens
gtactctgtgtgtgtatgag

SEQ ID NO: 3256343 - DNA, 18 bp, Homo sapiens
gtactcttgatgtgaaga

SEQ ID NO: 3256344 - DNA, 21 bp, Homo sapiens
gtactgaagccaaatgaaact

SEQ ID NO: 3256345 - DNA, 20 bp, Homo sapiens
gtactgactttgcttgcttt

SEQ ID NO: 3256346 - DNA, 12 bp, Homo sapiens
gtactgagattt

SEQ ID NO: 3256347 - DNA, 16 bp, Homo sapiens
gtactgagccttgtaa

SEQ ID NO: 3256348 - DNA, 15 bp, Homo sapiens
gtactgatttcagta

SEQ ID NO: 3256349 - DNA, 20 bp, Homo sapiens
gtactgatttcagtaagtct

SEQ ID NO: 3256350 - DNA, 18 bp, Homo sapiens
gtactgcattctctccca

SEQ ID NO: 3256351 - DNA, 22 bp, Homo sapiens
gtactgcattctctcccatcct

SEQ ID NO: 3256352 - DNA, 19 bp, Homo sapiens
gtactgccccccatgagga

SEQ ID NO: 3256353 - DNA, 16 bp, Homo sapiens
gtactgcctgccaccg

SEQ ID NO: 3256354 - DNA, 12 bp, Homo sapiens
gtactggccagt

SEQ ID NO: 3256355 - DNA, 14 bp, Homo sapiens
gtactgggacattg

SEQ ID NO: 3256356 - DNA, 19 bp, Homo sapiens
gtactgtaataatacctca

SEQ ID NO: 3256357 - DNA, 14 bp, Homo sapiens
gtactgtagttttt

SEQ ID NO: 3256358 - DNA, 17 bp, Homo sapiens
gtactgtctgattggct

SEQ ID NO: 3256359 - DNA, 17 bp, Homo sapiens
gtactgttctgtgtctt

SEQ ID NO: 3256360 - DNA, 18 bp, Homo sapiens
gtactgttctgtgtcttt

SEQ ID NO: 3256361 - DNA, 13 bp, Homo sapiens
gtactgtttacca

SEQ ID NO: 3256362 - DNA, 17 bp, Homo sapiens
gtacttaaatgaaagca

SEQ ID NO: 3256363 - DNA, 15 bp, Homo sapiens
gtacttaataaattc

SEQ ID NO: 3256364 - DNA, 22 bp, Homo sapiens
gtacttagccagttcaaagtgt

SEQ ID NO: 3256365 - DNA, 21 bp, Homo sapiens
gtacttcctgagtggccaggg

SEQ ID NO: 3256366 - DNA, 17 bp, Homo sapiens
gtacttctccaccctgc

SEQ ID NO: 3256367 - DNA, 21 bp, Homo sapiens
gtacttctccaccctgctctc

SEQ ID NO: 3256368 - DNA, 20 bp, Homo sapiens
gtacttcttgaatataaaaa

SEQ ID NO: 3256369 - DNA, 18 bp, Homo sapiens
gtacttgagtgtaatgtt

SEQ ID NO: 3256370 - DNA, 20 bp, Homo sapiens
gtacttgatactgaatgcat

SEQ ID NO: 3256371 - DNA, 21 bp, Homo sapiens
gtacttggagtattggggtct

SEQ ID NO: 3256372 - DNA, 20 bp, Homo sapiens
gtacttgtgaaacacagctg

SEQ ID NO: 3256373 - DNA, 21 bp, Homo sapiens
gtacttgtgaaacacagctgt

SEQ ID NO: 3256374 - DNA, 17 bp, Homo sapiens
gtactttaaaaaggaaa

SEQ ID NO: 3256375 - DNA, 15 bp, Homo sapiens
gtactttatcatgaa

SEQ ID NO: 3256376 - DNA, 22 bp, Homo sapiens
gtactttattcttgctgggcat

SEQ ID NO: 3256377 - DNA, 22 bp, Homo sapiens
gtactttattgtacagactgtt

SEQ ID NO: 3256378 - DNA, 21 bp, Homo sapiens
gtactttctgttatgggcttt

SEQ ID NO: 3256379 - DNA, 22 bp, Homo sapiens
gtacttttatgatgtatattta

SEQ ID NO: 3256380 - DNA, 18 bp, Homo sapiens
gtatatacacatatacct

SEQ ID NO: 3256381 - DNA, 16 bp, Homo sapiens
gtatatacagttattt

SEQ ID NO: 3256382 - DNA, 16 bp, Homo sapiens
gtatatacgcatctat

SEQ ID NO: 3256383 - DNA, 12 bp, Homo sapiens
gtatatactttt

SEQ ID NO: 3256384 - DNA, 15 bp, Homo sapiens
gtatatacttttaaa

SEQ ID NO: 3256385 - DNA, 19 bp, Homo sapiens
gtatatacttttaaattat

SEQ ID NO: 3256386 - DNA, 17 bp, Homo sapiens
gtatatatacatacact

SEQ ID NO: 3256387 - DNA, 20 bp, Homo sapiens
gtatatatatgccatgatgg

SEQ ID NO: 3256388 - DNA, 22 bp, Homo sapiens
gtatatatctgcttcagtggag

SEQ ID NO: 3256389 - DNA, 20 bp, Homo sapiens
gtatatatgtgtatatatac

SEQ ID NO: 3256390 - DNA, 14 bp, Homo sapiens
gtatatattcccaa

SEQ ID NO: 3256391 - DNA, 22 bp, Homo sapiens
gtatatcattctacagaataat

SEQ ID NO: 3256392 - DNA, 17 bp, Homo sapiens
gtatatctcttggaaaa

SEQ ID NO: 3256393 - DNA, 14 bp, Homo sapiens
gtatatgaaaacaa

SEQ ID NO: 3256394 - DNA, 21 bp, Homo sapiens
gtatatggcttcaagttgtaa

SEQ ID NO: 3256395 - DNA, 13 bp, Homo sapiens
gtatatgtattcc

SEQ ID NO: 3256396 - DNA, 22 bp, Homo sapiens
gtatatgtattcccttgtattt

SEQ ID NO: 3256397 - DNA, 13 bp, Homo sapiens
gtatatgtctcag

SEQ ID NO: 3256398 - DNA, 15 bp, Homo sapiens
gtatatgtctcaggt

SEQ ID NO: 3256399 - DNA, 19 bp, Homo sapiens
gtatatgtttatatactgg

SEQ ID NO: 3256400 - DNA, 11 bp, Homo sapiens
gtatattaaac

SEQ ID NO: 3256401 - DNA, 16 bp, Homo sapiens
gtatattatgtattta

SEQ ID NO: 3256402 - DNA, 23 bp, Homo sapiens
gtatattcttattggaaatgtac

SEQ ID NO: 3256403 - DNA, 13 bp, Homo sapiens
gtatattgtgttt

SEQ ID NO: 3256404 - DNA, 13 bp, Homo sapiens
gtatatttatagt

SEQ ID NO: 3256405 - DNA, 22 bp, Homo sapiens
gtatatttatagtcacaagagc

SEQ ID NO: 3256406 - DNA, 14 bp, Homo sapiens
gtatatttgtacaa

SEQ ID NO: 3256407 - DNA, 19 bp, Homo sapiens
gtatattttaatgaatatt

SEQ ID NO: 3256408 - DNA, 15 bp, Homo sapiens
gtatcaaacccacga

SEQ ID NO: 3256409 - DNA, 13 bp, Homo sapiens
gtatcaaatctgt

SEQ ID NO: 3256410 - DNA, 16 bp, Homo sapiens
gtatcaagacgtttaa

SEQ ID NO: 3256411 - DNA, 15 bp, Homo sapiens
gtatcactctaaaaa

SEQ ID NO: 3256412 - DNA, 18 bp, Homo sapiens
gtatcactctaaaaaaca

SEQ ID NO: 3256413 - DNA, 14 bp, Homo sapiens
gtatcagaggccta

SEQ ID NO: 3256414 - DNA, 15 bp, Homo sapiens
gtatcagaggcctat

SEQ ID NO: 3256415 - DNA, 18 bp, Homo sapiens
gtatcaggaatataaata

SEQ ID NO: 3256416 - DNA, 18 bp, Homo sapiens
gtatcaggtcagggactt

SEQ ID NO: 3256417 - DNA, 15 bp, Homo sapiens
gtatcagtgttttaa

SEQ ID NO: 3256418 - DNA, 12 bp, Homo sapiens
gtatcatagaaa

SEQ ID NO: 3256419 - DNA, 16 bp, Homo sapiens
gtatcattcaactctc

SEQ ID NO: 3256420 - DNA, 14 bp, Homo sapiens
gtatccactttgca

SEQ ID NO: 3256421 - DNA, 20 bp, Homo sapiens
gtatccaggttccctcccag

SEQ ID NO: 3256422 - DNA, 21 bp, Homo sapiens
gtatcccatgagcctcagcat

SEQ ID NO: 3256423 - DNA, 19 bp, Homo sapiens
gtatcccttctcacagcac

SEQ ID NO: 3256424 - DNA, 19 bp, Homo sapiens
gtatccgactctaagctgt

SEQ ID NO: 3256425 - DNA, 20 bp, Homo sapiens
gtatccgactctaagctgtg

SEQ ID NO: 3256426 - DNA, 20 bp, Homo sapiens
gtatcctgtgacatgtaaca

SEQ ID NO: 3256427 - DNA, 18 bp, Homo sapiens
gtatctaagaataataaa

SEQ ID NO: 3256428 - DNA, 22 bp, Homo sapiens
gtatctagagcttaatgctaca

SEQ ID NO: 3256429 - DNA, 11 bp, Homo sapiens
gtatctcagaa

SEQ ID NO: 3256430 - DNA, 13 bp, Homo sapiens
gtatctcagaaag

SEQ ID NO: 3256431 - DNA, 14 bp, Homo sapiens
gtatctcagaaagt

SEQ ID NO: 3256432 - DNA, 18 bp, Homo sapiens
gtatctcagaaagtgcct

SEQ ID NO: 3256433 - DNA, 14 bp, Homo sapiens
gtatctgagttgcc

SEQ ID NO: 3256434 - DNA, 15 bp, Homo sapiens
gtatctgagttgcca

SEQ ID NO: 3256435 - DNA, 23 bp, Homo sapiens
gtatctgagttgccaagacaaat

SEQ ID NO: 3256436 - DNA, 17 bp, Homo sapiens
gtatctgggattattct

SEQ ID NO: 3256437 - DNA, 23 bp, Homo sapiens
gtatctgggtaagaagaaagcaa

SEQ ID NO: 3256438 - DNA, 21 bp, Homo sapiens
gtatctgtatataagttgctg

SEQ ID NO: 3256439 - DNA, 16 bp, Homo sapiens
gtatctgtatctctct

SEQ ID NO: 3256440 - DNA, 19 bp, Homo sapiens
gtatcttccatatttggaa

SEQ ID NO: 3256441 - DNA, 20 bp, Homo sapiens
gtatcttccatatttggaag

SEQ ID NO: 3256442 - DNA, 11 bp, Homo sapiens
gtatcttcctt

SEQ ID NO: 3256443 - DNA, 14 bp, Homo sapiens
gtatcttctatttt

SEQ ID NO: 3256444 - DNA, 16 bp, Homo sapiens
gtatctttatgctgta

SEQ ID NO: 3256445 - DNA, 16 bp, Homo sapiens
gtatcttttttaaatg

SEQ ID NO: 3256446 - DNA, 22 bp, Homo sapiens
gtatgaaagatggctgtgcctc

SEQ ID NO: 3256447 - DNA, 18 bp, Homo sapiens
gtatgaataaagacacct

SEQ ID NO: 3256448 - DNA, 19 bp, Homo sapiens
gtatgaataaagacaccta

SEQ ID NO: 3256449 - DNA, 17 bp, Homo sapiens
gtatgacgctgatacat

SEQ ID NO: 3256450 - DNA, 19 bp, Homo sapiens
gtatgacgctgatacataa

SEQ ID NO: 3256451 - DNA, 17 bp, Homo sapiens
gtatgagaaacctatat

SEQ ID NO: 3256452 - DNA, 17 bp, Homo sapiens
gtatgagatggttaaaa

SEQ ID NO: 3256453 - DNA, 20 bp, Homo sapiens
gtatgagtcaatgtgcagtg

SEQ ID NO: 3256454 - DNA, 21 bp, Homo sapiens
gtatgatcacggctcactgca

SEQ ID NO: 3256455 - DNA, 17 bp, Homo sapiens
gtatgatgtgttgtgat

SEQ ID NO: 3256456 - DNA, 21 bp, Homo sapiens
gtatgattactggcctttttc

SEQ ID NO: 3256457 - DNA, 23 bp, Homo sapiens
gtatgatttataaacagacaata

SEQ ID NO: 3256458 - DNA, 18 bp, Homo sapiens
gtatgatttgttttgaat

SEQ ID NO: 3256459 - DNA, 15 bp, Homo sapiens
gtatgcaagtctgtg

SEQ ID NO: 3256460 - DNA, 18 bp, Homo sapiens
gtatgcaagtctgtgagt

SEQ ID NO: 3256461 - DNA, 14 bp, Homo sapiens
gtatggaaacactg

SEQ ID NO: 3256462 - DNA, 13 bp, Homo sapiens
gtatggaaataaa

SEQ ID NO: 3256463 - DNA, 16 bp, Homo sapiens
gtatggaagttttcct

SEQ ID NO: 3256464 - DNA, 21 bp, Homo sapiens
gtatggagcagcctggagacc

SEQ ID NO: 3256465 - DNA, 22 bp, Homo sapiens
gtatggcactggcattgtccct

SEQ ID NO: 3256466 - DNA, 15 bp, Homo sapiens
gtatggtggctgggt

SEQ ID NO: 3256467 - DNA, 14 bp, Homo sapiens
gtatgtaaacagga

SEQ ID NO: 3256468 - DNA, 15 bp, Homo sapiens
gtatgtaatttatgc

SEQ ID NO: 3256469 - DNA, 23 bp, Homo sapiens
gtatgtctgtttttgtatcttta

SEQ ID NO: 3256470 - DNA, 21 bp, Homo sapiens
gtatgtgacaccaaagccacc

SEQ ID NO: 3256471 - DNA, 13 bp, Homo sapiens
gtatgtgactttt

SEQ ID NO: 3256472 - DNA, 15 bp, Homo sapiens
gtatgtgggatattg

SEQ ID NO: 3256473 - DNA, 20 bp, Homo sapiens
gtatgtgggatattgaatgt

SEQ ID NO: 3256474 - DNA, 13 bp, Homo sapiens
gtatgtgtgtaga

SEQ ID NO: 3256475 - DNA, 22 bp, Homo sapiens
gtatgttaaagcatcagagatg

SEQ ID NO: 3256476 - DNA, 18 bp, Homo sapiens
gtatgttaagctctttat

SEQ ID NO: 3256477 - DNA, 22 bp, Homo sapiens
gtatgttatgatattgtttaaa

SEQ ID NO: 3256478 - DNA, 18 bp, Homo sapiens
gtatgttgtccaattgtt

SEQ ID NO: 3256479 - DNA, 20 bp, Homo sapiens
gtattaaaactaaatttcac

SEQ ID NO: 3256480 - DNA, 13 bp, Homo sapiens
gtattaaagacag

SEQ ID NO: 3256481 - DNA, 14 bp, Homo sapiens
gtattaaagggggg

SEQ ID NO: 3256482 - DNA, 23 bp, Homo sapiens
gtccaacaataaacaggaatttt

SEQ ID NO: 3256483 - DNA, 23 bp, Homo sapiens
gtccaagaatccacatttctaaa

SEQ ID NO: 3256484 - DNA, 13 bp, Homo sapiens
gtccaagagacat

SEQ ID NO: 3256485 - DNA, 18 bp, Homo sapiens
gtccaagaggggccgctg

SEQ ID NO: 3256486 - DNA, 16 bp, Homo sapiens
gtccaagattccggat

SEQ ID NO: 3256487 - DNA, 20 bp, Homo sapiens
gtccaagattccggatccta

SEQ ID NO: 3256488 - DNA, 22 bp, Homo sapiens
gtccaagattccggatcctaag

SEQ ID NO: 3256489 - DNA, 19 bp, Homo sapiens
gtccaagttcttcacctct

SEQ ID NO: 3256490 - DNA, 22 bp, Homo sapiens
gtccaagttcttcacctctatc

SEQ ID NO: 3256491 - DNA, 22 bp, Homo sapiens
gtccacacaaagattttctaag

SEQ ID NO: 3256492 - DNA, 18 bp, Homo sapiens
gtccacaggggcaggcct

SEQ ID NO: 3256493 - DNA, 23 bp, Homo sapiens
gtccacaggggcaggcctgggac

SEQ ID NO: 3256494 - DNA, 21 bp, Homo sapiens
gtccaccacttcaggggatgg

SEQ ID NO: 3256495 - DNA, 12 bp, Homo sapiens
gtccacccagga

SEQ ID NO: 3256496 - DNA, 15 bp, Homo sapiens
gtccacccaggctgc

SEQ ID NO: 3256497 - DNA, 16 bp, Homo sapiens
gtccacccaggctgca

SEQ ID NO: 3256498 - DNA, 17 bp, Homo sapiens
gtccaccggcccctggc

SEQ ID NO: 3256499 - DNA, 18 bp, Homo sapiens
gtccaccggcccctggca

SEQ ID NO: 3256500 - DNA, 17 bp, Homo sapiens
gtccacggacccccaga

SEQ ID NO: 3256501 - DNA, 20 bp, Homo sapiens
gtccactccctgctccacga

SEQ ID NO: 3256502 - DNA, 18 bp, Homo sapiens
gtccactctcggggccct

SEQ ID NO: 3256503 - DNA, 21 bp, Homo sapiens
gtccactctcggggcccttgg

SEQ ID NO: 3256504 - DNA, 12 bp, Homo sapiens
gtccactgtcac

SEQ ID NO: 3256505 - DNA, 14 bp, Homo sapiens
gtccactgtgtata

SEQ ID NO: 3256506 - DNA, 12 bp, Homo sapiens
gtccagaaatgg

SEQ ID NO: 3256507 - DNA, 17 bp, Homo sapiens
gtccagaagaatattca

SEQ ID NO: 3256508 - DNA, 19 bp, Homo sapiens
gtccagaagaatattcagg

SEQ ID NO: 3256509 - DNA, 12 bp, Homo sapiens
gtccagcagctg

SEQ ID NO: 3256510 - DNA, 13 bp, Homo sapiens
gtccagcagctgc

SEQ ID NO: 3256511 - DNA, 14 bp, Homo sapiens
gtccagcagctgcg

SEQ ID NO: 3256512 - DNA, 15 bp, Homo sapiens
gtccagcagctgcgg

SEQ ID NO: 3256513 - DNA, 12 bp, Homo sapiens
gtccagctctga

SEQ ID NO: 3256514 - DNA, 19 bp, Homo sapiens
gtccagctctgacatccct

SEQ ID NO: 3256515 - DNA, 17 bp, Homo sapiens
gtccagcttatagtctt

SEQ ID NO: 3256516 - DNA, 20 bp, Homo sapiens
gtccaggaaggcagctgctc

SEQ ID NO: 3256517 - DNA, 21 bp, Homo sapiens
gtccaggaaggcagctgctct

SEQ ID NO: 3256518 - DNA, 13 bp, Homo sapiens
gtccaggagcctg

SEQ ID NO: 3256519 - DNA, 13 bp, Homo sapiens
gtccaggagctca

SEQ ID NO: 3256520 - DNA, 15 bp, Homo sapiens
gtccaggagctcagg

SEQ ID NO: 3256521 - DNA, 17 bp, Homo sapiens
gtccaggagctcaggaa

SEQ ID NO: 3256522 - DNA, 21 bp, Homo sapiens
gtccaggatgctaacatctaa

SEQ ID NO: 3256523 - DNA, 13 bp, Homo sapiens
gtccaggctgccg

SEQ ID NO: 3256524 - DNA, 14 bp, Homo sapiens
gtccaggctgccgt

SEQ ID NO: 3256525 - DNA, 20 bp, Homo sapiens
gtccaggctgccgtggggcc

SEQ ID NO: 3256526 - DNA, 20 bp, Homo sapiens
gtccagggaagctggccgag

SEQ ID NO: 3256527 - DNA, 18 bp, Homo sapiens
gtccagggctagtgactt

SEQ ID NO: 3256528 - DNA, 17 bp, Homo sapiens
gtccagtgtcacctctc

SEQ ID NO: 3256529 - DNA, 22 bp, Homo sapiens
gtccagtgtcacctctctcaga

SEQ ID NO: 3256530 - DNA, 15 bp, Homo sapiens
gtccatagctcctct

SEQ ID NO: 3256531 - DNA, 21 bp, Homo sapiens
gtccatcccttttcctgtcag

SEQ ID NO: 3256532 - DNA, 22 bp, Homo sapiens
gtccatggcaccagccccctgg

SEQ ID NO: 3256533 - DNA, 15 bp, Homo sapiens
gtccatggcctttct

SEQ ID NO: 3256534 - DNA, 14 bp, Homo sapiens
gtccatttgtaaaa

SEQ ID NO: 3256535 - DNA, 15 bp, Homo sapiens
gtcccaacttgtaaa

SEQ ID NO: 3256536 - DNA, 12 bp, Homo sapiens
gtcccacccacc

SEQ ID NO: 3256537 - DNA, 15 bp, Homo sapiens
gtcccacccccaccc

SEQ ID NO: 3256538 - DNA, 18 bp, Homo sapiens
gtcccaccgggagcctcc

SEQ ID NO: 3256539 - DNA, 17 bp, Homo sapiens
gtcccacctccagcccg

SEQ ID NO: 3256540 - DNA, 22 bp, Homo sapiens
gtcccacctccagcccgggagc

SEQ ID NO: 3256541 - DNA, 15 bp, Homo sapiens
gtcccaccttggctg

SEQ ID NO: 3256542 - DNA, 16 bp, Homo sapiens
gtcccaccttggctgc

SEQ ID NO: 3256543 - DNA, 17 bp, Homo sapiens
gtcccaccttggctgca

SEQ ID NO: 3256544 - DNA, 20 bp, Homo sapiens
gtcccaccttggctgcaggg

SEQ ID NO: 3256545 - DNA, 21 bp, Homo sapiens
gtcccaccttggctgcaggga

SEQ ID NO: 3256546 - DNA, 23 bp, Homo sapiens
gtcccaccttggctgcagggagt

SEQ ID NO: 3256547 - DNA, 13 bp, Homo sapiens
gtcccacgtgtct

SEQ ID NO: 3256548 - DNA, 16 bp, Homo sapiens
gtcccacgtgtcttcc

SEQ ID NO: 3256549 - DNA, 14 bp, Homo sapiens
gtcccactcagtcc

SEQ ID NO: 3256550 - DNA, 19 bp, Homo sapiens
gtcccagcatccctggagc

SEQ ID NO: 3256551 - DNA, 20 bp, Homo sapiens
gtcccagcatccctggagca

SEQ ID NO: 3256552 - DNA, 14 bp, Homo sapiens
gtcccagccacccc

SEQ ID NO: 3256553 - DNA, 15 bp, Homo sapiens
gtcccagccaccccg

SEQ ID NO: 3256554 - DNA, 18 bp, Homo sapiens
gtcccagccaccccgggc

SEQ ID NO: 3256555 - DNA, 21 bp, Homo sapiens
gtcccagccaccccgggctct

SEQ ID NO: 3256556 - DNA, 12 bp, Homo sapiens
gtcccagctgaa

SEQ ID NO: 3256557 - DNA, 21 bp, Homo sapiens
gtcccagctgaaggcagtggc

SEQ ID NO: 3256558 - DNA, 19 bp, Homo sapiens
gtcccaggcagcacagtgt

SEQ ID NO: 3256559 - DNA, 17 bp, Homo sapiens
gtcccagtatacctcat

SEQ ID NO: 3256560 - DNA, 19 bp, Homo sapiens
gtcccagtattctcagagc

SEQ ID NO: 3256561 - DNA, 14 bp, Homo sapiens
gtcccagtgggagg

SEQ ID NO: 3256562 - DNA, 20 bp, Homo sapiens
gtcccagtgggaggggcagg

SEQ ID NO: 3256563 - DNA, 20 bp, Homo sapiens
gtcccatgacccacccctgt

SEQ ID NO: 3256564 - DNA, 17 bp, Homo sapiens
gtcccatgatccctgtg

SEQ ID NO: 3256565 - DNA, 16 bp, Homo sapiens
gtcccatgcaggccct

SEQ ID NO: 3256566 - DNA, 23 bp, Homo sapiens
gtcccatggacactccagtgcca

SEQ ID NO: 3256567 - DNA, 20 bp, Homo sapiens
gtcccattcatattaagaca

SEQ ID NO: 3256568 - DNA, 19 bp, Homo sapiens
gtcccattttccccttcct

SEQ ID NO: 3256569 - DNA, 21 bp, Homo sapiens
gtcccattttccccttcctca

SEQ ID NO: 3256570 - DNA, 11 bp, Homo sapiens
gtccccaaagt

SEQ ID NO: 3256571 - DNA, 22 bp, Homo sapiens
gtccccaaccgtgtctgtctgg

SEQ ID NO: 3256572 - DNA, 17 bp, Homo sapiens
gtccccaacctgcactc

SEQ ID NO: 3256573 - DNA, 15 bp, Homo sapiens
gtccccacctgggac

SEQ ID NO: 3256574 - DNA, 17 bp, Homo sapiens
gtccccactcaccccct

SEQ ID NO: 3256575 - DNA, 16 bp, Homo sapiens
gtccccactcccttgg

SEQ ID NO: 3256576 - DNA, 12 bp, Homo sapiens
gtccccagactc

SEQ ID NO: 3256577 - DNA, 15 bp, Homo sapiens
gtccccagccctgtc

SEQ ID NO: 3256578 - DNA, 14 bp, Homo sapiens
gtccccagcccttc

SEQ ID NO: 3256579 - DNA, 13 bp, Homo sapiens
gtccccagggccc

SEQ ID NO: 3256580 - DNA, 15 bp, Homo sapiens
gtccccatcatccca

SEQ ID NO: 3256581 - DNA, 20 bp, Homo sapiens
gtccccatcatcccagctgc

SEQ ID NO: 3256582 - DNA, 12 bp, Homo sapiens
gtccccatcccc

SEQ ID NO: 3256583 - DNA, 16 bp, Homo sapiens
gtccccatccccacca

SEQ ID NO: 3256584 - DNA, 20 bp, Homo sapiens
gtcccccaaccccagccgct

SEQ ID NO: 3256585 - DNA, 22 bp, Homo sapiens
gtcccccaaggttttggagtca

SEQ ID NO: 3256586 - DNA, 15 bp, Homo sapiens
gtcccccccagtgca

SEQ ID NO: 3256587 - DNA, 15 bp, Homo sapiens
gtccccgtgccccgc

SEQ ID NO: 3256588 - DNA, 16 bp, Homo sapiens
gtcccctcactctgtc

SEQ ID NO: 3256589 - DNA, 17 bp, Homo sapiens
gtcccctcactctgtca

SEQ ID NO: 3256590 - DNA, 15 bp, Homo sapiens
gtcccctcagctcca

SEQ ID NO: 3256591 - DNA, 15 bp, Homo sapiens
gtcccctccaggaag

SEQ ID NO: 3256592 - DNA, 12 bp, Homo sapiens
gtcccctcccat

SEQ ID NO: 3256593 - DNA, 15 bp, Homo sapiens
gtcccctcccatctg

SEQ ID NO: 3256594 - DNA, 13 bp, Homo sapiens
gtattgactttat

SEQ ID NO: 3256595 - DNA, 16 bp, Homo sapiens
gtattgagatttctta

SEQ ID NO: 3256596 - DNA, 18 bp, Homo sapiens
gtattgcacattgtaaaa

SEQ ID NO: 3256597 - DNA, 21 bp, Homo sapiens
gtattgcacattgtaaaaagt

SEQ ID NO: 3256598 - DNA, 16 bp, Homo sapiens
gtattgcttattttat

SEQ ID NO: 3256599 - DNA, 17 bp, Homo sapiens
gtattgtaaacatgtgt

SEQ ID NO: 3256600 - DNA, 22 bp, Homo sapiens
gtattgtcagccatcgtcctgg

SEQ ID NO: 3256601 - DNA, 17 bp, Homo sapiens
gtattgtctgaacttgc

SEQ ID NO: 3256602 - DNA, 11 bp, Homo sapiens
gtattgttccc

SEQ ID NO: 3256603 - DNA, 21 bp, Homo sapiens
gtatttaaagaaaataaacac

SEQ ID NO: 3256604 - DNA, 16 bp, Homo sapiens
gtatttaattgtaaac

SEQ ID NO: 3256605 - DNA, 14 bp, Homo sapiens
gtatttagaagcca

SEQ ID NO: 3256606 - DNA, 12 bp, Homo sapiens
gtatttataata

SEQ ID NO: 3256607 - DNA, 13 bp, Homo sapiens
gtatttatatatt

SEQ ID NO: 3256608 - DNA, 17 bp, Homo sapiens
gtatttatatatttata

SEQ ID NO: 3256609 - DNA, 18 bp, Homo sapiens
gtatttatatttggaaag

SEQ ID NO: 3256610 - DNA, 13 bp, Homo sapiens
gtatttatcttta

SEQ ID NO: 3256611 - DNA, 22 bp, Homo sapiens
gtatttatgggtggatttatcc

SEQ ID NO: 3256612 - DNA, 16 bp, Homo sapiens
gtatttattaatttga

SEQ ID NO: 3256613 - DNA, 18 bp, Homo sapiens
gtatttattaccgtcaca

SEQ ID NO: 3256614 - DNA, 22 bp, Homo sapiens
gtatttattccatattcatgta

SEQ ID NO: 3256615 - DNA, 20 bp, Homo sapiens
gtatttattctctatttatt

SEQ ID NO: 3256616 - DNA, 23 bp, Homo sapiens
gtatttattctctatttattggg

SEQ ID NO: 3256617 - DNA, 18 bp, Homo sapiens
gtatttattgaagaaaca

SEQ ID NO: 3256618 - DNA, 12 bp, Homo sapiens
gtatttattggt

SEQ ID NO: 3256619 - DNA, 15 bp, Homo sapiens
gtatttattggtggg

SEQ ID NO: 3256620 - DNA, 15 bp, Homo sapiens
gtatttcaactgctg

SEQ ID NO: 3256621 - DNA, 22 bp, Homo sapiens
gtatttcaactgctgtaaaatt

SEQ ID NO: 3256622 - DNA, 16 bp, Homo sapiens
gtatttcatgtggctg

SEQ ID NO: 3256623 - DNA, 17 bp, Homo sapiens
gtatttcatgtggctgt

SEQ ID NO: 3256624 - DNA, 17 bp, Homo sapiens
gtatttctcctttgcaa

SEQ ID NO: 3256625 - DNA, 19 bp, Homo sapiens
gtatttgaaaattttactt

SEQ ID NO: 3256626 - DNA, 12 bp, Homo sapiens
gtatttgctgtc

SEQ ID NO: 3256627 - DNA, 22 bp, Homo sapiens
gtatttggtccaaaaaaaggaa

SEQ ID NO: 3256628 - DNA, 21 bp, Homo sapiens
gtatttgtattaataaagcat

SEQ ID NO: 3256629 - DNA, 15 bp, Homo sapiens
gtatttgttcatgtt

SEQ ID NO: 3256630 - DNA, 17 bp, Homo sapiens
gtatttgttcatgtttg

SEQ ID NO: 3256631 - DNA, 15 bp, Homo sapiens
gtattttaaaagcca

SEQ ID NO: 3256632 - DNA, 21 bp, Homo sapiens
gtattttaagagaaaactgca

SEQ ID NO: 3256633 - DNA, 16 bp, Homo sapiens
gtattttaatcctgta

SEQ ID NO: 3256634 - DNA, 12 bp, Homo sapiens
gtattttcctgg

SEQ ID NO: 3256635 - DNA, 19 bp, Homo sapiens
gtattttcgggattctttg

SEQ ID NO: 3256636 - DNA, 23 bp, Homo sapiens
gtattttgaagaatatttaagaa

SEQ ID NO: 3256637 - DNA, 14 bp, Homo sapiens
gtatttttaatggg

SEQ ID NO: 3256638 - DNA, 18 bp, Homo sapiens
gtatttttaatgggggta

SEQ ID NO: 3256639 - DNA, 15 bp, Homo sapiens
gtatttttactatta

SEQ ID NO: 3256640 - DNA, 15 bp, Homo sapiens
gtattttttaaaaca

SEQ ID NO: 3256641 - DNA, 23 bp, Homo sapiens
gtatttttttatcttgggactgg

SEQ ID NO: 3256642 - DNA, 22 bp, Homo sapiens
gtattttttttttaaataaaag

SEQ ID NO: 3256643 - DNA, 12 bp, Homo sapiens
gtcaaaacactg

SEQ ID NO: 3256644 - DNA, 13 bp, Homo sapiens
gtcaaaacactgt

SEQ ID NO: 3256645 - DNA, 14 bp, Homo sapiens
gtcaaaactttaaa

SEQ ID NO: 3256646 - DNA, 13 bp, Homo sapiens
gtcaaaaggaaca

SEQ ID NO: 3256647 - DNA, 22 bp, Homo sapiens
gtcaaaaggaacaaaaattaca

SEQ ID NO: 3256648 - DNA, 21 bp, Homo sapiens
gtcaaaataaaggataactct

SEQ ID NO: 3256649 - DNA, 19 bp, Homo sapiens
gtcaaaattaatatgatta

SEQ ID NO: 3256650 - DNA, 20 bp, Homo sapiens
gtcaaactgtagaaatgatg

SEQ ID NO: 3256651 - DNA, 17 bp, Homo sapiens
gtcaaacttggatactt

SEQ ID NO: 3256652 - DNA, 22 bp, Homo sapiens
gtcaaagctttgactctataag

SEQ ID NO: 3256653 - DNA, 14 bp, Homo sapiens
gtcaaataaagcaa

SEQ ID NO: 3256654 - DNA, 21 bp, Homo sapiens
gtcaacactatatattttatg

SEQ ID NO: 3256655 - DNA, 22 bp, Homo sapiens
gtcaacacttaagggttttaga

SEQ ID NO: 3256656 - DNA, 15 bp, Homo sapiens
gtcaaccactaaagt

SEQ ID NO: 3256657 - DNA, 17 bp, Homo sapiens
gtcaactctttgttatt

SEQ ID NO: 3256658 - DNA, 12 bp, Homo sapiens
gtcaacttctgg

SEQ ID NO: 3256659 - DNA, 12 bp, Homo sapiens
gtcaagaagaaa

SEQ ID NO: 3256660 - DNA, 18 bp, Homo sapiens
gtcaagagggtctgagga

SEQ ID NO: 3256661 - DNA, 19 bp, Homo sapiens
gtcaagagggtctgaggaa

SEQ ID NO: 3256662 - DNA, 14 bp, Homo sapiens
gtcaagggaaaacc

SEQ ID NO: 3256663 - DNA, 18 bp, Homo sapiens
gtcaagttaacaaggaat

SEQ ID NO: 3256664 - DNA, 16 bp, Homo sapiens
gtcaagttgtgcttgt

SEQ ID NO: 3256665 - DNA, 22 bp, Homo sapiens
gtcaataaacaacagctgaagc

SEQ ID NO: 3256666 - DNA, 15 bp, Homo sapiens
gtcaatattaaatac

SEQ ID NO: 3256667 - DNA, 18 bp, Homo sapiens
gtcaatattaaatacaga

SEQ ID NO: 3256668 - DNA, 22 bp, Homo sapiens
gtcaatattaaatacagacact

SEQ ID NO: 3256669 - DNA, 17 bp, Homo sapiens
gtcaatcccaaaagtca

SEQ ID NO: 3256670 - DNA, 14 bp, Homo sapiens
gtcaatgtgcagtg

SEQ ID NO: 3256671 - DNA, 14 bp, Homo sapiens
gtcaatttccctca

SEQ ID NO: 3256672 - DNA, 15 bp, Homo sapiens
gtcaattttttcagg

SEQ ID NO: 3256673 - DNA, 21 bp, Homo sapiens
gtcacaaatcctaaaagaagc

SEQ ID NO: 3256674 - DNA, 17 bp, Homo sapiens
gtcacaagagcccagca

SEQ ID NO: 3256675 - DNA, 12 bp, Homo sapiens
gtcacaataaat

SEQ ID NO: 3256676 - DNA, 20 bp, Homo sapiens
gtcacacagtgttggaggtt

SEQ ID NO: 3256677 - DNA, 11 bp, Homo sapiens
gtcacagctgc

SEQ ID NO: 3256678 - DNA, 14 bp, Homo sapiens
gtcacagctgcagc

SEQ ID NO: 3256679 - DNA, 17 bp, Homo sapiens
gtcacagctgcagctgg

SEQ ID NO: 3256680 - DNA, 21 bp, Homo sapiens
gtcacagctgcagctgggccc

SEQ ID NO: 3256681 - DNA, 13 bp, Homo sapiens
gtcacaggcaggt

SEQ ID NO: 3256682 - DNA, 15 bp, Homo sapiens
gtcacagggccaact

SEQ ID NO: 3256683 - DNA, 22 bp, Homo sapiens
gtcacagtaaaaataaaatact

SEQ ID NO: 3256684 - DNA, 14 bp, Homo sapiens
gtcacataaaactt

SEQ ID NO: 3256685 - DNA, 16 bp, Homo sapiens
gtcacatcagataaga

SEQ ID NO: 3256686 - DNA, 19 bp, Homo sapiens
gtcacatggggcctggccc

SEQ ID NO: 3256687 - DNA, 20 bp, Homo sapiens
gtcacattatttattaaaaa

SEQ ID NO: 3256688 - DNA, 22 bp, Homo sapiens
gtcaccaaatcagctgctacta

SEQ ID NO: 3256689 - DNA, 13 bp, Homo sapiens
gtcaccaaggaaa

SEQ ID NO: 3256690 - DNA, 16 bp, Homo sapiens
gtcaccacgactggcc

SEQ ID NO: 3256691 - DNA, 12 bp, Homo sapiens
gtcaccaggact

SEQ ID NO: 3256692 - DNA, 13 bp, Homo sapiens
gtcaccaggactt

SEQ ID NO: 3256693 - DNA, 16 bp, Homo sapiens
gtcaccaggacttggg

SEQ ID NO: 3256694 - DNA, 23 bp, Homo sapiens
gtcaccaggacttggggtcagga

SEQ ID NO: 3256695 - DNA, 16 bp, Homo sapiens
gtcaccaggggaggag

SEQ ID NO: 3256696 - DNA, 18 bp, Homo sapiens
gtcaccaggggaggagcc

SEQ ID NO: 3256697 - DNA, 19 bp, Homo sapiens
gtcaccggtcagtgccttt

SEQ ID NO: 3256698 - DNA, 22 bp, Homo sapiens
gtcccctctgtcatcactccct

SEQ ID NO: 3256699 - DNA, 15 bp, Homo sapiens
gtcccctgcctggaa

SEQ ID NO: 3256700 - DNA, 23 bp, Homo sapiens
gtcccctgctactcctgtgctct

SEQ ID NO: 3256701 - DNA, 22 bp, Homo sapiens
gtccccttttcttttctaccct

SEQ ID NO: 3256702 - DNA, 23 bp, Homo sapiens
gtccccttttcttttctacccta

SEQ ID NO: 3256703 - DNA, 17 bp, Homo sapiens
gtcccggggccagcact

SEQ ID NO: 3256704 - DNA, 22 bp, Homo sapiens
gtcccggggccagcacttccat

SEQ ID NO: 3256705 - DNA, 21 bp, Homo sapiens
gtccctaccgagtctcttctc

SEQ ID NO: 3256706 - DNA, 22 bp, Homo sapiens
gtccctaccgagtctcttctcc

SEQ ID NO: 3256707 - DNA, 22 bp, Homo sapiens
gtccctatgtatttgcagttca

SEQ ID NO: 3256708 - DNA, 18 bp, Homo sapiens
gtccctcccacctctgtg

SEQ ID NO: 3256709 - DNA, 15 bp, Homo sapiens
gtccctcgtccacag

SEQ ID NO: 3256710 - DNA, 16 bp, Homo sapiens
gtccctcgtccacagg

SEQ ID NO: 3256711 - DNA, 17 bp, Homo sapiens
gtccctctcactcccca

SEQ ID NO: 3256712 - DNA, 18 bp, Homo sapiens
gtccctctcactccccag

SEQ ID NO: 3256713 - DNA, 12 bp, Homo sapiens
gtccctctgtgt

SEQ ID NO: 3256714 - DNA, 13 bp, Homo sapiens
gtcttattcttaa

SEQ ID NO: 3256715 - DNA, 15 bp, Homo sapiens
gtcttatttttagat

SEQ ID NO: 3256716 - DNA, 17 bp, Homo sapiens
gtcttcaaactgtgaag

SEQ ID NO: 3256717 - DNA, 16 bp, Homo sapiens
gtcttcaacatcctgc

SEQ ID NO: 3256718 - DNA, 19 bp, Homo sapiens
gtcttcaacatcctgccag

SEQ ID NO: 3256719 - DNA, 16 bp, Homo sapiens
gtcttcacagctctgt

SEQ ID NO: 3256720 - DNA, 17 bp, Homo sapiens
gtcttcacagctctgtg

SEQ ID NO: 3256721 - DNA, 15 bp, Homo sapiens
gtcttcactcttagg

SEQ ID NO: 3256722 - DNA, 16 bp, Homo sapiens
gtcttcactcttaggc

SEQ ID NO: 3256723 - DNA, 19 bp, Homo sapiens
gtcttcagcattccctccc

SEQ ID NO: 3256724 - DNA, 13 bp, Homo sapiens
gtcttccataatg

SEQ ID NO: 3256725 - DNA, 18 bp, Homo sapiens
gtcttccctacctcaggc

SEQ ID NO: 3256726 - DNA, 18 bp, Homo sapiens
gtcttcctgacactttaa

SEQ ID NO: 3256727 - DNA, 19 bp, Homo sapiens
gtcttcctgacactttaat

SEQ ID NO: 3256728 - DNA, 19 bp, Homo sapiens
gtcttcctgagtggtgcca

SEQ ID NO: 3256729 - DNA, 17 bp, Homo sapiens
gtcttcgctggctccta

SEQ ID NO: 3256730 - DNA, 23 bp, Homo sapiens
gtcttctaaacttccccatcttc

SEQ ID NO: 3256731 - DNA, 19 bp, Homo sapiens
gtcttctcatagcattaac

SEQ ID NO: 3256732 - DNA, 18 bp, Homo sapiens
gtcttctgacaaactgtg

SEQ ID NO: 3256733 - DNA, 17 bp, Homo sapiens
gtcttctgcctgttata

SEQ ID NO: 3256734 - DNA, 18 bp, Homo sapiens
gtcttctgggctgcggga

SEQ ID NO: 3256735 - DNA, 15 bp, Homo sapiens
gtcttctggtctgtg

SEQ ID NO: 3256736 - DNA, 16 bp, Homo sapiens
gtcttctggtctgtgt

SEQ ID NO: 3256737 - DNA, 13 bp, Homo sapiens
gtcttcttttgtg

SEQ ID NO: 3256738 - DNA, 16 bp, Homo sapiens
gtcttgaaagtggcac

SEQ ID NO: 3256739 - DNA, 18 bp, Homo sapiens
gtcttgaactcctggcct

SEQ ID NO: 3256740 - DNA, 15 bp, Homo sapiens
gtcttgaatgtcttt

SEQ ID NO: 3256741 - DNA, 13 bp, Homo sapiens
gtcttgagccagt

SEQ ID NO: 3256742 - DNA, 14 bp, Homo sapiens
gtcttgagccagta

SEQ ID NO: 3256743 - DNA, 17 bp, Homo sapiens
gtcttgcaatggcagcc

SEQ ID NO: 3256744 - DNA, 18 bp, Homo sapiens
gtcttgcaatggcagcct

SEQ ID NO: 3256745 - DNA, 21 bp, Homo sapiens
gtcttgcaatggcagccttgg

SEQ ID NO: 3256746 - DNA, 21 bp, Homo sapiens
gtcttggaagctgtttggaaa

SEQ ID NO: 3256747 - DNA, 22 bp, Homo sapiens
gtcttgggcagagctggctctg

SEQ ID NO: 3256748 - DNA, 16 bp, Homo sapiens
gtcttgggctactggc

SEQ ID NO: 3256749 - DNA, 18 bp, Homo sapiens
gtcttgggctactggcag

SEQ ID NO: 3256750 - DNA, 19 bp, Homo sapiens
gtcttgggctactggcagc

SEQ ID NO: 3256751 - DNA, 15 bp, Homo sapiens
gtcttggtattctta

SEQ ID NO: 3256752 - DNA, 15 bp, Homo sapiens
gtcttggtgcctttt

SEQ ID NO: 3256753 - DNA, 18 bp, Homo sapiens
gtcttgtacttctgtgtt

SEQ ID NO: 3256754 - DNA, 23 bp, Homo sapiens
gtcttgtgtttccacagcctgca

SEQ ID NO: 3256755 - DNA, 16 bp, Homo sapiens
gtcttgttagaaaaca

SEQ ID NO: 3256756 - DNA, 12 bp, Homo sapiens
gtcttgttctgt

SEQ ID NO: 3256757 - DNA, 16 bp, Homo sapiens
gtctttaaaggcccag

SEQ ID NO: 3256758 - DNA, 19 bp, Homo sapiens
gtctttaaaggcccagccc

SEQ ID NO: 3256759 - DNA, 19 bp, Homo sapiens
gtctttaagagactcactg

SEQ ID NO: 3256760 - DNA, 15 bp, Homo sapiens
gtctttattcttatt

SEQ ID NO: 3256761 - DNA, 16 bp, Homo sapiens
gtctttcagtactttt

SEQ ID NO: 3256762 - DNA, 22 bp, Homo sapiens
gtctttcagtacttttttaaat

SEQ ID NO: 3256763 - DNA, 20 bp, Homo sapiens
gtctttcccatggggaggga

SEQ ID NO: 3256764 - DNA, 19 bp, Homo sapiens
gtctttctaagaaatcaag

SEQ ID NO: 3256765 - DNA, 11 bp, Homo sapiens
gtctttctctc

SEQ ID NO: 3256766 - DNA, 14 bp, Homo sapiens
gtctttctctcagt

SEQ ID NO: 3256767 - DNA, 16 bp, Homo sapiens
gtctttctctcagtga

SEQ ID NO: 3256768 - DNA, 19 bp, Homo sapiens
gtctttctttggtgccttt

SEQ ID NO: 3256769 - DNA, 15 bp, Homo sapiens
gtctttgctgtactc

SEQ ID NO: 3256770 - DNA, 19 bp, Homo sapiens
gtctttggaaaaatgtttg

SEQ ID NO: 3256771 - DNA, 17 bp, Homo sapiens
gtctttggttctaagga

SEQ ID NO: 3256772 - DNA, 14 bp, Homo sapiens
gtctttgtaagagt

SEQ ID NO: 3256773 - DNA, 20 bp, Homo sapiens
gtctttgtaagagtgtagaa

SEQ ID NO: 3256774 - DNA, 17 bp, Homo sapiens
gtctttgtatcttccat

SEQ ID NO: 3256775 - DNA, 17 bp, Homo sapiens
gtctttgttatgacagt

SEQ ID NO: 3256776 - DNA, 23 bp, Homo sapiens
gtcttttataggaaaaaaactgg

SEQ ID NO: 3256777 - DNA, 13 bp, Homo sapiens
gtcttttatattt

SEQ ID NO: 3256778 - DNA, 14 bp, Homo sapiens
gtcttttgaatatt

SEQ ID NO: 3256779 - DNA, 19 bp, Homo sapiens
gtcttttgaatattcccaa

SEQ ID NO: 3256780 - DNA, 12 bp, Homo sapiens
gtcttttgcttt

SEQ ID NO: 3256781 - DNA, 16 bp, Homo sapiens
gtcttttgtatttttg

SEQ ID NO: 3256782 - DNA, 16 bp, Homo sapiens
gtctttttatgcattt

SEQ ID NO: 3256783 - DNA, 23 bp, Homo sapiens
gtctttttttggtgattcaaatg

SEQ ID NO: 3256784 - DNA, 13 bp, Homo sapiens
gtgaaaaactgct

SEQ ID NO: 3256785 - DNA, 19 bp, Homo sapiens
gtgaaaacatatttgtgaa

SEQ ID NO: 3256786 - DNA, 22 bp, Homo sapiens
gtgaaaagagtatgtagtggct

SEQ ID NO: 3256787 - DNA, 21 bp, Homo sapiens
gtgaaaataaagcagaagcaa

SEQ ID NO: 3256788 - DNA, 13 bp, Homo sapiens
gtgaaaatgaaga

SEQ ID NO: 3256789 - DNA, 14 bp, Homo sapiens
gtgaaaatgtactg

SEQ ID NO: 3256790 - DNA, 17 bp, Homo sapiens
gtgaaacacaccaggct

SEQ ID NO: 3256791 - DNA, 18 bp, Homo sapiens
gtgaaacacaccaggctg

SEQ ID NO: 3256792 - DNA, 12 bp, Homo sapiens
gtgaaaccctgt

SEQ ID NO: 3256793 - DNA, 19 bp, Homo sapiens
gtgaaacctttagggcagc

SEQ ID NO: 3256794 - DNA, 13 bp, Homo sapiens
gtgaaaccttttt

SEQ ID NO: 3256795 - DNA, 14 bp, Homo sapiens
gtgaaacctttttt

SEQ ID NO: 3256796 - DNA, 19 bp, Homo sapiens
gtgaaaccttttttaagat

SEQ ID NO: 3256797 - DNA, 21 bp, Homo sapiens
gtgaaagctgagaactcctga

SEQ ID NO: 3256798 - DNA, 15 bp, Homo sapiens
gtgaaaggcagggcc

SEQ ID NO: 3256799 - DNA, 21 bp, Homo sapiens
gtgaaagggagctatcaggaa

SEQ ID NO: 3256800 - DNA, 21 bp, Homo sapiens
gtgaaagtcagatgcccagag

SEQ ID NO: 3256801 - DNA, 20 bp, Homo sapiens
gtgaaagtgtaaaatagaat

SEQ ID NO: 3256802 - DNA, 22 bp, Homo sapiens
gtgaaataccaacctgaagaca

SEQ ID NO: 3256803 - DNA, 17 bp, Homo sapiens
gtgaaataccagtgtgg

SEQ ID NO: 3256804 - DNA, 16 bp, Homo sapiens
gtgaaatggccaggat

SEQ ID NO: 3256805 - DNA, 11 bp, Homo sapiens
gtgaaatgtga

SEQ ID NO: 3256806 - DNA, 15 bp, Homo sapiens
gtgaaatgtgaagga

SEQ ID NO: 3256807 - DNA, 18 bp, Homo sapiens
gtgaacaaaagatgctct

SEQ ID NO: 3256808 - DNA, 19 bp, Homo sapiens
gtgaacaaaagatgctctt

SEQ ID NO: 3256809 - DNA, 16 bp, Homo sapiens
gtgaacatcccttatt

SEQ ID NO: 3256810 - DNA, 13 bp, Homo sapiens
gtgaaccacaggt

SEQ ID NO: 3256811 - DNA, 16 bp, Homo sapiens
gtgaacctaccttcat

SEQ ID NO: 3256812 - DNA, 21 bp, Homo sapiens
gtgaacgtccacatgaaacct

SEQ ID NO: 3256813 - DNA, 22 bp, Homo sapiens
gtgaactcaccctgggagccag

SEQ ID NO: 3256814 - DNA, 23 bp, Homo sapiens
gtgaactgctggagtctggcttt

SEQ ID NO: 3256815 - DNA, 13 bp, Homo sapiens
gtgaactggaaga

SEQ ID NO: 3256816 - DNA, 21 bp, Homo sapiens
gtgaacttacacttggagccc

SEQ ID NO: 3256817 - DNA, 17 bp, Homo sapiens
gtgaacttgactgggtg

SEQ ID NO: 3256818 - DNA, 19 bp, Homo sapiens
gtgaacttggctttcctgt

SEQ ID NO: 3256819 - DNA, 14 bp, Homo sapiens
gtgaagaatttaga

SEQ ID NO: 3256820 - DNA, 15 bp, Homo sapiens
gtgaagagccggtgg

SEQ ID NO: 3256821 - DNA, 12 bp, Homo sapiens
gtgaagaggggc

SEQ ID NO: 3256822 - DNA, 16 bp, Homo sapiens
gtgaagaggggcagcc

SEQ ID NO: 3256823 - DNA, 21 bp, Homo sapiens
gtgaagagtgactagtacaaa

SEQ ID NO: 3256824 - DNA, 16 bp, Homo sapiens
gtgaagcagtgcctcg

SEQ ID NO: 3256825 - DNA, 17 bp, Homo sapiens
gtgaagcatgctttgct

SEQ ID NO: 3256826 - DNA, 18 bp, Homo sapiens
gtgaagcatgctttgctg

SEQ ID NO: 3256827 - DNA, 22 bp, Homo sapiens
gtgaaggacttagccgactgcg

SEQ ID NO: 3256828 - DNA, 18 bp, Homo sapiens
gtgaaggatccaggaata

SEQ ID NO: 3256829 - DNA, 23 bp, Homo sapiens
gtgaaggatccaggaatatgaca

SEQ ID NO: 3256830 - DNA, 21 bp, Homo sapiens
gtgaaggattatggaaaaata

SEQ ID NO: 3256831 - DNA, 22 bp, Homo sapiens
gtgaaggattatggaaaaataa

SEQ ID NO: 3256832 - DNA, 19 bp, Homo sapiens
gtgaaggcccaagagcaga

SEQ ID NO: 3256833 - DNA, 23 bp, Homo sapiens
gtgaaggcccaagagcagagtct

SEQ ID NO: 3256834 - DNA, 12 bp, Homo sapiens
gtgaataataat

SEQ ID NO: 3256835 - DNA, 13 bp, Homo sapiens
gtgaatacaatta

SEQ ID NO: 3256836 - DNA, 19 bp, Homo sapiens
gtgaatacaattaaaggtc

SEQ ID NO: 3256837 - DNA, 21 bp, Homo sapiens
gtgaatactgctacagcaatt

SEQ ID NO: 3256838 - DNA, 16 bp, Homo sapiens
gtgaatcttgtctaac

SEQ ID NO: 3256839 - DNA, 12 bp, Homo sapiens
gtgaatgaaaga

SEQ ID NO: 3256840 - DNA, 17 bp, Homo sapiens
gtgaatgaaagattaaa

SEQ ID NO: 3256841 - DNA, 19 bp, Homo sapiens
gtgaatgattcatgttata

SEQ ID NO: 3256842 - DNA, 15 bp, Homo sapiens
gtgaatgctgggact

SEQ ID NO: 3256843 - DNA, 13 bp, Homo sapiens
gtgaatggaagca

SEQ ID NO: 3256844 - DNA, 16 bp, Homo sapiens
gtgaatggaagcaaag

SEQ ID NO: 3256845 - DNA, 20 bp, Homo sapiens
gtgaatggattggattattt

SEQ ID NO: 3256846 - DNA, 18 bp, Homo sapiens
gtgaattcttgaaggaaa

SEQ ID NO: 3256847 - DNA, 22 bp, Homo sapiens
gtgaattcttgaaggaaaatga

SEQ ID NO: 3256848 - DNA, 12 bp, Homo sapiens
gtgacaaaccat

SEQ ID NO: 3256849 - DNA, 18 bp, Homo sapiens
gtgacaaagactcctctg

SEQ ID NO: 3256850 - DNA, 19 bp, Homo sapiens
gtgacaaagactcctctgg

SEQ ID NO: 3256851 - DNA, 14 bp, Homo sapiens
gtgacaagagcctg

SEQ ID NO: 3256852 - DNA, 21 bp, Homo sapiens
gtgacaataatattgttgtat

SEQ ID NO: 3256853 - DNA, 23 bp, Homo sapiens
gtgacaatacaccttccccaccc

SEQ ID NO: 3256854 - DNA, 12 bp, Homo sapiens
gtgacacagcag

SEQ ID NO: 3256855 - DNA, 22 bp, Homo sapiens
gtgacacagcagcttcaccaga

SEQ ID NO: 3256856 - DNA, 22 bp, Homo sapiens
gtgacacttcagagagctggta

SEQ ID NO: 3256857 - DNA, 23 bp, Homo sapiens
gtgacagaccacatctttatctg

SEQ ID NO: 3256858 - DNA, 15 bp, Homo sapiens
gtgacagaggcagcc

SEQ ID NO: 3256859 - DNA, 23 bp, Homo sapiens
gtgacagaggcagccccattctg

SEQ ID NO: 3256860 - DNA, 18 bp, Homo sapiens
gtgacagagttcactata

SEQ ID NO: 3256861 - DNA, 15 bp, Homo sapiens
gtgacaggaaagccc

SEQ ID NO: 3256862 - DNA, 13 bp, Homo sapiens
gtgacagggccag

SEQ ID NO: 3256863 - DNA, 13 bp, Homo sapiens
gtgacagtcatca

SEQ ID NO: 3256864 - DNA, 17 bp, Homo sapiens
gtgacagtgcctgggaa

SEQ ID NO: 3256865 - DNA, 23 bp, Homo sapiens
gtgacataatatattctattttt

SEQ ID NO: 3256866 - DNA, 19 bp, Homo sapiens
gtgacatggtgcctgagag

SEQ ID NO: 3256867 - DNA, 20 bp, Homo sapiens
gtgacatggtgcctgagagg

SEQ ID NO: 3256868 - DNA, 16 bp, Homo sapiens
gtgacatgtgaaacct

SEQ ID NO: 3256869 - DNA, 17 bp, Homo sapiens
gtgacatgtgaaacctt

SEQ ID NO: 3256870 - DNA, 14 bp, Homo sapiens
gtgacatttcccaa

SEQ ID NO: 3256871 - DNA, 19 bp, Homo sapiens
gtgaccaactagacattct

SEQ ID NO: 3256872 - DNA, 17 bp, Homo sapiens
gtgaccaatgatggtca

SEQ ID NO: 3256873 - DNA, 13 bp, Homo sapiens
gtgaccaccttct

SEQ ID NO: 3256874 - DNA, 22 bp, Homo sapiens
gtgaccaccttctgtccccagc

SEQ ID NO: 3256875 - DNA, 17 bp, Homo sapiens
gtgaccactctgtcttg

SEQ ID NO: 3256876 - DNA, 13 bp, Homo sapiens
gtgaccatgttca

SEQ ID NO: 3256877 - DNA, 13 bp, Homo sapiens
gtgacccatctgt

SEQ ID NO: 3256878 - DNA, 15 bp, Homo sapiens
gtgacccatctgtag

SEQ ID NO: 3256879 - DNA, 19 bp, Homo sapiens
gtgaccccacgatttgtct

SEQ ID NO: 3256880 - DNA, 16 bp, Homo sapiens
gtgacccttcagggcc

SEQ ID NO: 3256881 - DNA, 12 bp, Homo sapiens
gtgacccttccc

SEQ ID NO: 3256882 - DNA, 13 bp, Homo sapiens
gtgacctctgcct

SEQ ID NO: 3256883 - DNA, 14 bp, Homo sapiens
gtgacctctgcctg

SEQ ID NO: 3256884 - DNA, 15 bp, Homo sapiens
gtgacctctgcctga

SEQ ID NO: 3256885 - DNA, 23 bp, Homo sapiens
gtgacctgaggatttaagggatg

SEQ ID NO: 3256886 - DNA, 23 bp, Homo sapiens
gtgacctgccccgcccagctgca

SEQ ID NO: 3256887 - DNA, 18 bp, Homo sapiens
gtgacgccccggggcgcc

SEQ ID NO: 3256888 - DNA, 17 bp, Homo sapiens
gtgactatatagagatg

SEQ ID NO: 3256889 - DNA, 14 bp, Homo sapiens
gtgactcagcagcc

SEQ ID NO: 3256890 - DNA, 16 bp, Homo sapiens
gtgactctttttaggg

SEQ ID NO: 3256891 - DNA, 22 bp, Homo sapiens
gtgactctttttagggccaggc

SEQ ID NO: 3256892 - DNA, 10 bp, Homo sapiens
gtgactgaaa

SEQ ID NO: 3256893 - DNA, 18 bp, Homo sapiens
gtgactgaaaccattttc

SEQ ID NO: 3256894 - DNA, 12 bp, Homo sapiens
gtgactgaaggg

SEQ ID NO: 3256895 - DNA, 19 bp, Homo sapiens
gtgactgaaggggcacacc

SEQ ID NO: 3256896 - DNA, 22 bp, Homo sapiens
gtgactgaaggggcacaccact

SEQ ID NO: 3256897 - DNA, 18 bp, Homo sapiens
gtgactggcaagaggcct

SEQ ID NO: 3256898 - DNA, 20 bp, Homo sapiens
gtgactggcaagaggcctca

SEQ ID NO: 3256899 - DNA, 12 bp, Homo sapiens
gtgactggcagg

SEQ ID NO: 3256900 - DNA, 24 bp, Homo sapiens
gtgactggcaggtgcagatgggct

SEQ ID NO: 3256901 - DNA, 21 bp, Homo sapiens
gtgactgtcaagtacaagcaa

SEQ ID NO: 3256902 - DNA, 15 bp, Homo sapiens
gtgacttctccaggt

SEQ ID NO: 3256903 - DNA, 11 bp, Homo sapiens
gtgactttaaa

SEQ ID NO: 3256904 - DNA, 22 bp, Homo sapiens
gtgagaaaaagctcctgtcctc

SEQ ID NO: 3256905 - DNA, 21 bp, Homo sapiens
gtgagaagtgaatgctgggac

SEQ ID NO: 3256906 - DNA, 15 bp, Homo sapiens
gtgagacagtctgga

SEQ ID NO: 3256907 - DNA, 15 bp, Homo sapiens
gtgagacccccacac

SEQ ID NO: 3256908 - DNA, 16 bp, Homo sapiens
gtgagaccctgtctct

SEQ ID NO: 3256909 - DNA, 19 bp, Homo sapiens
gtgagacgccaccattcct

SEQ ID NO: 3256910 - DNA, 14 bp, Homo sapiens
gtgagagaaagaga

SEQ ID NO: 3256911 - DNA, 11 bp, Homo sapiens
gtgagagagga

SEQ ID NO: 3256912 - DNA, 18 bp, Homo sapiens
gtgagagcgaggctgagc

SEQ ID NO: 3256913 - DNA, 12 bp, Homo sapiens
gtgagagctggg

SEQ ID NO: 3256914 - DNA, 16 bp, Homo sapiens
gtgagaggggaacaga

SEQ ID NO: 3256915 - DNA, 22 bp, Homo sapiens
gtgagatccgtgaattctcgga

SEQ ID NO: 3256916 - DNA, 15 bp, Homo sapiens
gtgagatgctggaga

SEQ ID NO: 3256917 - DNA, 18 bp, Homo sapiens
gtgagatgctggagaaga

SEQ ID NO: 3256918 - DNA, 22 bp, Homo sapiens
gtgagatgctggagaagagagg

SEQ ID NO: 3256919 - DNA, 23 bp, Homo sapiens
gtgagcatacctgtctcagctgt

SEQ ID NO: 3256920 - DNA, 19 bp, Homo sapiens
gtgagcatgggtgtgccct

SEQ ID NO: 3256921 - DNA, 15 bp, Homo sapiens
gtgagccaccgctgc

SEQ ID NO: 3256922 - DNA, 24 bp, Homo sapiens
gtgagccaccgctgccagcacaga

SEQ ID NO: 3256923 - DNA, 24 bp, Homo sapiens
gtgagccatgatcgagccactgca

SEQ ID NO: 3256924 - DNA, 13 bp, Homo sapiens
gtgagccccaggg

SEQ ID NO: 3256925 - DNA, 23 bp, Homo sapiens
gtgagccccaggggggcctcctc

SEQ ID NO: 3256926 - DNA, 18 bp, Homo sapiens
gtgagcctcgtgtcatct

SEQ ID NO: 3256927 - DNA, 13 bp, Homo sapiens
gtgagcctggctc

SEQ ID NO: 3256928 - DNA, 14 bp, Homo sapiens
gtgagcggccgctg

SEQ ID NO: 3256929 - DNA, 19 bp, Homo sapiens
gtgagctctgacccttggg

SEQ ID NO: 3256930 - DNA, 23 bp, Homo sapiens
gtgagctcttcctatccctctcc

SEQ ID NO: 3256931 - DNA, 23 bp, Homo sapiens
gtgagctggggactcagggaccg

SEQ ID NO: 3256932 - DNA, 14 bp, Homo sapiens
gtgagctgtgatca

SEQ ID NO: 3256933 - DNA, 21 bp, Homo sapiens
gtgaggaagtgtggaaaaata

SEQ ID NO: 3256934 - DNA, 17 bp, Homo sapiens
gtgaggaatgctctgtg

SEQ ID NO: 3256935 - DNA, 16 bp, Homo sapiens
gtgaggacgcaccgcc

SEQ ID NO: 3256936 - DNA, 11 bp, Homo sapiens
gtgaggagctg

SEQ ID NO: 3256937 - DNA, 15 bp, Homo sapiens
gtgaggagctgctgg

SEQ ID NO: 3256938 - DNA, 13 bp, Homo sapiens
gtgaggaggaaaa

SEQ ID NO: 3256939 - DNA, 18 bp, Homo sapiens
gtgaggaggaaaaggaaa

SEQ ID NO: 3256940 - DNA, 22 bp, Homo sapiens
gtgaggcattcggggaagctgc

SEQ ID NO: 3256941 - DNA, 15 bp, Homo sapiens
gtgaggcttccaggc

SEQ ID NO: 3256942 - DNA, 17 bp, Homo sapiens
gtgaggcttccaggctc

SEQ ID NO: 3256943 - DNA, 19 bp, Homo sapiens
gtgaggggcaagctaggcc

SEQ ID NO: 3256944 - DNA, 15 bp, Homo sapiens
gtgagtcgaggacag

SEQ ID NO: 3256945 - DNA, 22 bp, Homo sapiens
gtgagtcgaggacagggaggtg

SEQ ID NO: 3256946 - DNA, 17 bp, Homo sapiens
gtgagtcttggcggcag

SEQ ID NO: 3256947 - DNA, 21 bp, Homo sapiens
gtgagtcttggcggcagcagc

SEQ ID NO: 3256948 - DNA, 22 bp, Homo sapiens
gtgagtcttggcggcagcagcc

SEQ ID NO: 3256949 - DNA, 17 bp, Homo sapiens
gtgagtctttggttcta

SEQ ID NO: 3256950 - DNA, 13 bp, Homo sapiens
gtgagtgagcctg

SEQ ID NO: 3256951 - DNA, 14 bp, Homo sapiens
gtgagtgagcctgg

SEQ ID NO: 3256952 - DNA, 12 bp, Homo sapiens
gtgagtgccttt

SEQ ID NO: 3256953 - DNA, 13 bp, Homo sapiens
gtgagtgcctttt

SEQ ID NO: 3256954 - DNA, 17 bp, Homo sapiens
gtgagtgccttttgcag

SEQ ID NO: 3256955 - DNA, 17 bp, Homo sapiens
gtgagtgcgtctgaggg

SEQ ID NO: 3256956 - DNA, 19 bp, Homo sapiens
gtgagtgcgtctgagggga

SEQ ID NO: 3256957 - DNA, 20 bp, Homo sapiens
gtgagtggcagccatgcctc

SEQ ID NO: 3256958 - DNA, 16 bp, Homo sapiens
gtgagtgtaagtgtga

SEQ ID NO: 3256959 - DNA, 13 bp, Homo sapiens
gtgagtgtgacag

SEQ ID NO: 3256960 - DNA, 14 bp, Homo sapiens
gtgagtgtgacagg

SEQ ID NO: 3256961 - DNA, 17 bp, Homo sapiens
gtgagtgtttttatctt

SEQ ID NO: 3256962 - DNA, 22 bp, Homo sapiens
gtgagttctccctgtacagtgt

SEQ ID NO: 3256963 - DNA, 21 bp, Homo sapiens
gtgataagggaaaagataaag

SEQ ID NO: 3256964 - DNA, 11 bp, Homo sapiens
gtgataagtgg

SEQ ID NO: 3256965 - DNA, 19 bp, Homo sapiens
gtgataagtggaaaaaaga

SEQ ID NO: 3256966 - DNA, 20 bp, Homo sapiens
gtgatacccatagcttccat

SEQ ID NO: 3256967 - DNA, 18 bp, Homo sapiens
gtgatagctaacatttta

SEQ ID NO: 3256968 - DNA, 13 bp, Homo sapiens
gtgatatatttaa

SEQ ID NO: 3256969 - DNA, 16 bp, Homo sapiens
gtgatcaataaaatgt

SEQ ID NO: 3256970 - DNA, 17 bp, Homo sapiens
gtgatcaataaaatgtg

SEQ ID NO: 3256971 - DNA, 19 bp, Homo sapiens
gtgatcaataaaatgtgat

SEQ ID NO: 3256972 - DNA, 17 bp, Homo sapiens
gtgatcatgtgtggaag

SEQ ID NO: 3256973 - DNA, 23 bp, Homo sapiens
gtgatccacccacctcagcctcc

SEQ ID NO: 3256974 - DNA, 21 bp, Homo sapiens
gtgatccgcctgcctctgcct

SEQ ID NO: 3256975 - DNA, 23 bp, Homo sapiens
gtgatcctcccacctcagcctcc

SEQ ID NO: 3256976 - DNA, 15 bp, Homo sapiens
gtgatcctctatttt

SEQ ID NO: 3256977 - DNA, 12 bp, Homo sapiens
gtgatctatgtt

SEQ ID NO: 3256978 - DNA, 14 bp, Homo sapiens
gtgatctcagatca

SEQ ID NO: 3256979 - DNA, 13 bp, Homo sapiens
gtgatctccatat

SEQ ID NO: 3256980 - DNA, 14 bp, Homo sapiens
gtgatcttggctca

SEQ ID NO: 3256981 - DNA, 14 bp, Homo sapiens
gtgatgaactttct

SEQ ID NO: 3256982 - DNA, 20 bp, Homo sapiens
gtgatgaataaaataattat

SEQ ID NO: 3256983 - DNA, 12 bp, Homo sapiens
gtgatgatgctg

SEQ ID NO: 3256984 - DNA, 17 bp, Homo sapiens
gtgatgatttgggggag

SEQ ID NO: 3256985 - DNA, 15 bp, Homo sapiens
gtgatgccacacaga

SEQ ID NO: 3256986 - DNA, 14 bp, Homo sapiens
gtgatggatggcac

SEQ ID NO: 3256987 - DNA, 18 bp, Homo sapiens
gtgatggatggcacaatg

SEQ ID NO: 3256988 - DNA, 20 bp, Homo sapiens
gtgatggcgcgggaggcacc

SEQ ID NO: 3256989 - DNA, 21 bp, Homo sapiens
gtgatggcgcgggaggcacca

SEQ ID NO: 3256990 - DNA, 15 bp, Homo sapiens
gtgatgggggagagg

SEQ ID NO: 3256991 - DNA, 23 bp, Homo sapiens
gtgatggttcccctgttcactct

SEQ ID NO: 3256992 - DNA, 18 bp, Homo sapiens
gtgatgtcttttcttggc

SEQ ID NO: 3256993 - DNA, 16 bp, Homo sapiens
gtgatgttctaaggct

SEQ ID NO: 3256994 - DNA, 19 bp, Homo sapiens
gtgatgttctaaggctctg

SEQ ID NO: 3256995 - DNA, 22 bp, Homo sapiens
gtgatgttctaaggctctgaga

SEQ ID NO: 3256996 - DNA, 13 bp, Homo sapiens
gtgattaatgttt

SEQ ID NO: 3256997 - DNA, 14 bp, Homo sapiens
gtgattaatgtttt

SEQ ID NO: 3256998 - DNA, 12 bp, Homo sapiens
gtgattcaaatg

SEQ ID NO: 3256999 - DNA, 21 bp, Homo sapiens
gtgattcagaaaatgttctgt

SEQ ID NO: 3257000 - DNA, 14 bp, Homo sapiens
gtgattctcctgcc

SEQ ID NO: 3257001 - DNA, 16 bp, Homo sapiens
gtgattctcctgcctc

SEQ ID NO: 3257002 - DNA, 23 bp, Homo sapiens
gtgattctcctgcctcagcctcc

SEQ ID NO: 3257003 - DNA, 14 bp, Homo sapiens
gtgattgtggaatg

SEQ ID NO: 3257004 - DNA, 23 bp, Homo sapiens
gtgatttagaactgtatgtcaga

SEQ ID NO: 3257005 - DNA, 17 bp, Homo sapiens
gtgatttccatttctga

SEQ ID NO: 3257006 - DNA, 14 bp, Homo sapiens
gtgatttgaaaaat

SEQ ID NO: 3257007 - DNA, 17 bp, Homo sapiens
gtgatttgaaaaatata

SEQ ID NO: 3257008 - DNA, 22 bp, Homo sapiens
gtgatttgaaaaatataaaatt

SEQ ID NO: 3257009 - DNA, 14 bp, Homo sapiens
gtgatttttgtaat

SEQ ID NO: 3257010 - DNA, 19 bp, Homo sapiens
gtgcaaaatatttgactat

SEQ ID NO: 3257011 - DNA, 14 bp, Homo sapiens
gtgcaaattgtatc

SEQ ID NO: 3257012 - DNA, 21 bp, Homo sapiens
gtgcaatgtctgagtgaacct

SEQ ID NO: 3257013 - DNA, 20 bp, Homo sapiens
gtgcaatttcaaggttctaa

SEQ ID NO: 3257014 - DNA, 15 bp, Homo sapiens
gtgcacaaatattta

SEQ ID NO: 3257015 - DNA, 13 bp, Homo sapiens
gtgcacacacaca

SEQ ID NO: 3257016 - DNA, 12 bp, Homo sapiens
gtgcacacacca

SEQ ID NO: 3257017 - DNA, 14 bp, Homo sapiens
gtgcacacaccaga

SEQ ID NO: 3257018 - DNA, 17 bp, Homo sapiens
gtgcacacaccagagcc

SEQ ID NO: 3257019 - DNA, 21 bp, Homo sapiens
gtgcacacagaaatatatata

SEQ ID NO: 3257020 - DNA, 16 bp, Homo sapiens
gtgcacaccaccctcc

SEQ ID NO: 3257021 - DNA, 14 bp, Homo sapiens
gtgcacagctgtcc

SEQ ID NO: 3257022 - DNA, 13 bp, Homo sapiens
gtgcacagtgatt

SEQ ID NO: 3257023 - DNA, 22 bp, Homo sapiens
gtgcacatatccaggcaccagg

SEQ ID NO: 3257024 - DNA, 18 bp, Homo sapiens
gtgcacctgtactcagga

SEQ ID NO: 3257025 - DNA, 20 bp, Homo sapiens
gtgcaccttaccaactttct

SEQ ID NO: 3257026 - DNA, 12 bp, Homo sapiens
gtgcactacagt

SEQ ID NO: 3257027 - DNA, 18 bp, Homo sapiens
gtgcactcatacatatgt

SEQ ID NO: 3257028 - DNA, 17 bp, Homo sapiens
gtgcactttctaatgtt

SEQ ID NO: 3257029 - DNA, 19 bp, Homo sapiens
gtgcagaaatgaaatagct

SEQ ID NO: 3257030 - DNA, 19 bp, Homo sapiens
gtgcagaataatggaaaca

SEQ ID NO: 3257031 - DNA, 22 bp, Homo sapiens
gtgcagacaggccatgtgagcc

SEQ ID NO: 3257032 - DNA, 14 bp, Homo sapiens
gtgcagagaagctg

SEQ ID NO: 3257033 - DNA, 20 bp, Homo sapiens
gtgcagagaagctggacttc

SEQ ID NO: 3257034 - DNA, 21 bp, Homo sapiens
gtgcagagctgcacttggcct

SEQ ID NO: 3257035 - DNA, 23 bp, Homo sapiens
gtgcagaggaagtggaaggcatc

SEQ ID NO: 3257036 - DNA, 22 bp, Homo sapiens
gtgcagaggtcagactaagaaa

SEQ ID NO: 3257037 - DNA, 18 bp, Homo sapiens
gtgcagcgcccctctgca

SEQ ID NO: 3257038 - DNA, 15 bp, Homo sapiens
gtgcagctcctcagc

SEQ ID NO: 3257039 - DNA, 18 bp, Homo sapiens
gtgcagctgattttaaca

SEQ ID NO: 3257040 - DNA, 13 bp, Homo sapiens
gtgcataatgctt

SEQ ID NO: 3257041 - DNA, 14 bp, Homo sapiens
gtgcataatgcttt

SEQ ID NO: 3257042 - DNA, 20 bp, Homo sapiens
gtgcataatgctttggaaaa

SEQ ID NO: 3257043 - DNA, 16 bp, Homo sapiens
gtgcatattcctttct

SEQ ID NO: 3257044 - DNA, 21 bp, Homo sapiens
gtgcatattcctttctatcat

SEQ ID NO: 3257045 - DNA, 19 bp, Homo sapiens
gtgcatcattactgttcca

SEQ ID NO: 3257046 - DNA, 13 bp, Homo sapiens
gtgcatcctcctc

SEQ ID NO: 3257047 - DNA, 16 bp, Homo sapiens
gtgcatcctcctcagc

SEQ ID NO: 3257048 - DNA, 20 bp, Homo sapiens
gtgcatcctcctcagccccc

SEQ ID NO: 3257049 - DNA, 21 bp, Homo sapiens
gtgcatcctcctcagccccca

SEQ ID NO: 3257050 - DNA, 22 bp, Homo sapiens
gtgcatcctcctcagcccccag

SEQ ID NO: 3257051 - DNA, 14 bp, Homo sapiens
gtgcatctccttga

SEQ ID NO: 3257052 - DNA, 14 bp, Homo sapiens
gtgcatgtgaagca

SEQ ID NO: 3257053 - DNA, 14 bp, Homo sapiens
gtgcatgtgtgtat

SEQ ID NO: 3257054 - DNA, 16 bp, Homo sapiens
gtgcattacagagagg

SEQ ID NO: 3257055 - DNA, 21 bp, Homo sapiens
gtgcattagcacagattttaa

SEQ ID NO: 3257056 - DNA, 15 bp, Homo sapiens
gtgcattctttggta

SEQ ID NO: 3257057 - DNA, 16 bp, Homo sapiens
gtgcattctttggtaa

SEQ ID NO: 3257058 - DNA, 22 bp, Homo sapiens
gtgcattgtatagatataatga

SEQ ID NO: 3257059 - DNA, 14 bp, Homo sapiens
gtgcatttctgaat

SEQ ID NO: 3257060 - DNA, 19 bp, Homo sapiens
gtgcatttgagagaagcca

SEQ ID NO: 3257061 - DNA, 23 bp, Homo sapiens
gtgcatttgtgctagaaattttc

SEQ ID NO: 3257062 - DNA, 17 bp, Homo sapiens
gtgcattttcccagata

SEQ ID NO: 3257063 - DNA, 22 bp, Homo sapiens
gtgccaaacaaaaaggttctca

SEQ ID NO: 3257064 - DNA, 15 bp, Homo sapiens
gtgccaatatgtatt

SEQ ID NO: 3257065 - DNA, 20 bp, Homo sapiens
gtgccaatatgtattgtaaa

SEQ ID NO: 3257066 - DNA, 14 bp, Homo sapiens
gtgccaatttcaag

SEQ ID NO: 3257067 - DNA, 18 bp, Homo sapiens
gtgccacccaccagggcg

SEQ ID NO: 3257068 - DNA, 15 bp, Homo sapiens
gtgccactccctgag

SEQ ID NO: 3257069 - DNA, 12 bp, Homo sapiens
gtgccactgccc

SEQ ID NO: 3257070 - DNA, 18 bp, Homo sapiens
gtgccactgcccgagctg

SEQ ID NO: 3257071 - DNA, 19 bp, Homo sapiens
gtgccactgcgggagctct

SEQ ID NO: 3257072 - DNA, 22 bp, Homo sapiens
gtgccacttcttaaaggcctgg

SEQ ID NO: 3257073 - DNA, 18 bp, Homo sapiens
gtgccagaggtgggcagg

SEQ ID NO: 3257074 - DNA, 20 bp, Homo sapiens
gtgccagaggtgggcaggtg

SEQ ID NO: 3257075 - DNA, 20 bp, Homo sapiens
gtgccagcaggggggctgtg

SEQ ID NO: 3257076 - DNA, 15 bp, Homo sapiens
gtgccagcattccag

SEQ ID NO: 3257077 - DNA, 20 bp, Homo sapiens
gtgccaggtttttggtctga

SEQ ID NO: 3257078 - DNA, 23 bp, Homo sapiens
gtgccatctgtacatattactgt

SEQ ID NO: 3257079 - DNA, 13 bp, Homo sapiens
gtgccattcccag

SEQ ID NO: 3257080 - DNA, 16 bp, Homo sapiens
gtgccattcccagcgt

SEQ ID NO: 3257081 - DNA, 21 bp, Homo sapiens
gtgccatttctgaactgttac

SEQ ID NO: 3257082 - DNA, 21 bp, Homo sapiens
gtgcccacaccggggacaggc

SEQ ID NO: 3257083 - DNA, 18 bp, Homo sapiens
gtgccccatgcctgtcca

SEQ ID NO: 3257084 - DNA, 17 bp, Homo sapiens
gtgcccccgcctgccac

SEQ ID NO: 3257085 - DNA, 13 bp, Homo sapiens
gtgccccctcctc

SEQ ID NO: 3257086 - DNA, 16 bp, Homo sapiens
gtgccccgcctccccg

SEQ ID NO: 3257087 - DNA, 17 bp, Homo sapiens
gtgcccctcgccagctt

SEQ ID NO: 3257088 - DNA, 21 bp, Homo sapiens
gtgcccctcgccagcttctcc

SEQ ID NO: 3257089 - DNA, 12 bp, Homo sapiens
gtgcccctggcc

SEQ ID NO: 3257090 - DNA, 17 bp, Homo sapiens
gtgccccttaagggttg

SEQ ID NO: 3257091 - DNA, 17 bp, Homo sapiens
gtgcccgcaggaactgg

SEQ ID NO: 3257092 - DNA, 20 bp, Homo sapiens
gtgcccgcctaggagttgag

SEQ ID NO: 3257093 - DNA, 20 bp, Homo sapiens
gtgccctactcattggggtt

SEQ ID NO: 3257094 - DNA, 12 bp, Homo sapiens
gtgccctcacca

SEQ ID NO: 3257095 - DNA, 20 bp, Homo sapiens
gtgccctccacagccgcagc

SEQ ID NO: 3257096 - DNA, 13 bp, Homo sapiens
gtgccctgccccc

SEQ ID NO: 3257097 - DNA, 22 bp, Homo sapiens
gtgccctgcccccatctcccca

SEQ ID NO: 3257098 - DNA, 21 bp, Homo sapiens
gtgccctgccccctggctgac

SEQ ID NO: 3257099 - DNA, 12 bp, Homo sapiens
gtgcccttgggg

SEQ ID NO: 3257100 - DNA, 13 bp, Homo sapiens
gtgccgtgtgagt

SEQ ID NO: 3257101 - DNA, 18 bp, Homo sapiens
gtgccgtgtgagtgtgac

SEQ ID NO: 3257102 - DNA, 19 bp, Homo sapiens
gtgccgtgtgagtgtgaca

SEQ ID NO: 3257103 - DNA, 20 bp, Homo sapiens
gtgccgtgtgagtgtgacag

SEQ ID NO: 3257104 - DNA, 21 bp, Homo sapiens
gtgccgtgtgagtgtgacagg

SEQ ID NO: 3257105 - DNA, 13 bp, Homo sapiens
gtgcctcactggg

SEQ ID NO: 3257106 - DNA, 13 bp, Homo sapiens
gggaaaggggtgc

SEQ ID NO: 3257107 - DNA, 20 bp, Homo sapiens
gggaaagtgcatatgaaatc

SEQ ID NO: 3257108 - DNA, 22 bp, Homo sapiens
gggaacagactggaagcacagc

SEQ ID NO: 3257109 - DNA, 20 bp, Homo sapiens
gggaacagtgtttcccataa

SEQ ID NO: 3257110 - DNA, 15 bp, Homo sapiens
gggaacatgaagcca

SEQ ID NO: 3257111 - DNA, 14 bp, Homo sapiens
gggaacatttccga

SEQ ID NO: 3257112 - DNA, 15 bp, Homo sapiens
gggaaccccgcagcc

SEQ ID NO: 3257113 - DNA, 18 bp, Homo sapiens
gggaaccccgcagcccgt

SEQ ID NO: 3257114 - DNA, 11 bp, Homo sapiens
gggaacctccc

SEQ ID NO: 3257115 - DNA, 14 bp, Homo sapiens
gggaacctgtgtcc

SEQ ID NO: 3257116 - DNA, 16 bp, Homo sapiens
gggaacgatgtgtctg

SEQ ID NO: 3257117 - DNA, 13 bp, Homo sapiens
gggaactctgaca

SEQ ID NO: 3257118 - DNA, 14 bp, Homo sapiens
gggaactgagtcac

SEQ ID NO: 3257119 - DNA, 20 bp, Homo sapiens
gggaagaaacactttctctt

SEQ ID NO: 3257120 - DNA, 14 bp, Homo sapiens
gggaagaaggggcc

SEQ ID NO: 3257121 - DNA, 18 bp, Homo sapiens
gggaagaaggggccatca

SEQ ID NO: 3257122 - DNA, 18 bp, Homo sapiens
gggaagaggggctggggc

SEQ ID NO: 3257123 - DNA, 22 bp, Homo sapiens
gggaagagtttttgtgatgggg

SEQ ID NO: 3257124 - DNA, 13 bp, Homo sapiens
gggaagcagccag

SEQ ID NO: 3257125 - DNA, 23 bp, Homo sapiens
gggaagcggaggttgcagggagc

SEQ ID NO: 3257126 - DNA, 16 bp, Homo sapiens
gggaagctgcagcttg

SEQ ID NO: 3257127 - DNA, 17 bp, Homo sapiens
gggaagctgccagccca

SEQ ID NO: 3257128 - DNA, 18 bp, Homo sapiens
gggaagctgccagcccag

SEQ ID NO: 3257129 - DNA, 21 bp, Homo sapiens
gggaagctgccagcccagaac

SEQ ID NO: 3257130 - DNA, 18 bp, Homo sapiens
gggaagcttgagcctccc

SEQ ID NO: 3257131 - DNA, 20 bp, Homo sapiens
gggaagcttgagcctccccc

SEQ ID NO: 3257132 - DNA, 22 bp, Homo sapiens
gggaaggccggcagcgggcgga

SEQ ID NO: 3257133 - DNA, 13 bp, Homo sapiens
gggaaggcctgac

SEQ ID NO: 3257134 - DNA, 13 bp, Homo sapiens
gggaagggccagt

SEQ ID NO: 3257135 - DNA, 14 bp, Homo sapiens
gggaaggggcggtg

SEQ ID NO: 3257136 - DNA, 14 bp, Homo sapiens
gggaaggtggggcc

SEQ ID NO: 3257137 - DNA, 14 bp, Homo sapiens
gggaagtcctccct

SEQ ID NO: 3257138 - DNA, 24 bp, Homo sapiens
gggaataaaatcctaagacacaaa

SEQ ID NO: 3257139 - DNA, 15 bp, Homo sapiens
gggaatcagggacca

SEQ ID NO: 3257140 - DNA, 18 bp, Homo sapiens
gggaatcagggaccagct

SEQ ID NO: 3257141 - DNA, 19 bp, Homo sapiens
gggaatcatgtccatccct

SEQ ID NO: 3257142 - DNA, 18 bp, Homo sapiens
gggaatccaagcctccac

SEQ ID NO: 3257143 - DNA, 21 bp, Homo sapiens
gggaatccaagcctccacagc

SEQ ID NO: 3257144 - DNA, 21 bp, Homo sapiens
gggaatctaatatccccaaat

SEQ ID NO: 3257145 - DNA, 15 bp, Homo sapiens
gggaatgagcccaga

SEQ ID NO: 3257146 - DNA, 21 bp, Homo sapiens
gggaatgagcccagagaacag

SEQ ID NO: 3257147 - DNA, 22 bp, Homo sapiens
gggaatgagcccagagaacagc

SEQ ID NO: 3257148 - DNA, 22 bp, Homo sapiens
gggaatgctcccagctgtgctg

SEQ ID NO: 3257149 - DNA, 18 bp, Homo sapiens
gggaatggatggggagaa

SEQ ID NO: 3257150 - DNA, 20 bp, Homo sapiens
gggaatggatggggagaatg

SEQ ID NO: 3257151 - DNA, 16 bp, Homo sapiens
gggaatgttccctgca

SEQ ID NO: 3257152 - DNA, 19 bp, Homo sapiens
gggaatgtttgcctctgcc

SEQ ID NO: 3257153 - DNA, 19 bp, Homo sapiens
gggacacaaaactccgccc

SEQ ID NO: 3257154 - DNA, 14 bp, Homo sapiens
gggacaccagagct

SEQ ID NO: 3257155 - DNA, 14 bp, Homo sapiens
gggacacctgccct

SEQ ID NO: 3257156 - DNA, 17 bp, Homo sapiens
gggacacctgccctgcc

SEQ ID NO: 3257157 - DNA, 22 bp, Homo sapiens
gggacagcctcttcagcccctt

SEQ ID NO: 3257158 - DNA, 15 bp, Homo sapiens
ggccaggcacagggc

SEQ ID NO: 3257159 - DNA, 19 bp, Homo sapiens
ggccaggcacagggcccgc

SEQ ID NO: 3257160 - DNA, 12 bp, Homo sapiens
ggccaggcaggt

SEQ ID NO: 3257161 - DNA, 16 bp, Homo sapiens
ggccaggccagaggga

SEQ ID NO: 3257162 - DNA, 14 bp, Homo sapiens
ggccaggccaggac

SEQ ID NO: 3257163 - DNA, 15 bp, Homo sapiens
ggccaggccaggacc

SEQ ID NO: 3257164 - DNA, 16 bp, Homo sapiens
ggccaggccaggacca

SEQ ID NO: 3257165 - DNA, 17 bp, Homo sapiens
ggccaggccaggaccac

SEQ ID NO: 3257166 - DNA, 21 bp, Homo sapiens
ggccaggcccaggcagagctg

SEQ ID NO: 3257167 - DNA, 16 bp, Homo sapiens
ggccaggctggtctca

SEQ ID NO: 3257168 - DNA, 14 bp, Homo sapiens
ggccagggcagggc

SEQ ID NO: 3257169 - DNA, 16 bp, Homo sapiens
ggccagggcagggcca

SEQ ID NO: 3257170 - DNA, 16 bp, Homo sapiens
ggccagggcatgtgta

SEQ ID NO: 3257171 - DNA, 20 bp, Homo sapiens
ggccagggccacgctccagc

SEQ ID NO: 3257172 - DNA, 20 bp, Homo sapiens
ggccagggctgccctgagaa

SEQ ID NO: 3257173 - DNA, 19 bp, Homo sapiens
ggccagggtctgtgtgaat

SEQ ID NO: 3257174 - DNA, 22 bp, Homo sapiens
ggccagggtctgtgtgaatgtg

SEQ ID NO: 3257175 - DNA, 21 bp, Homo sapiens
ggccagtatctatatatgtgt

SEQ ID NO: 3257176 - DNA, 16 bp, Homo sapiens
ggccagtccaggctgc

SEQ ID NO: 3257177 - DNA, 21 bp, Homo sapiens
ggccagtccaggctgccgtgg

SEQ ID NO: 3257178 - DNA, 19 bp, Homo sapiens
ggccagtccccgaggagct

SEQ ID NO: 3257179 - DNA, 19 bp, Homo sapiens
ggccagtcctcctgggagc

SEQ ID NO: 3257180 - DNA, 22 bp, Homo sapiens
ggccagtcctgcctggccaggc

SEQ ID NO: 3257181 - DNA, 14 bp, Homo sapiens
ggccagtctgtgga

SEQ ID NO: 3257182 - DNA, 16 bp, Homo sapiens
ggccagtggaagaaac

SEQ ID NO: 3257183 - DNA, 16 bp, Homo sapiens
ggccagtggggcctgt

SEQ ID NO: 3257184 - DNA, 22 bp, Homo sapiens
gctctggctgaaccctgtgctg

SEQ ID NO: 3257185 - DNA, 15 bp, Homo sapiens
gctctgggagaggat

SEQ ID NO: 3257186 - DNA, 17 bp, Homo sapiens
gctctgggctcagggct

SEQ ID NO: 3257187 - DNA, 15 bp, Homo sapiens
gctctggggggcagt

SEQ ID NO: 3257188 - DNA, 19 bp, Homo sapiens
gctctggttgtttctgttc

SEQ ID NO: 3257189 - DNA, 21 bp, Homo sapiens
gctctggttgtttctgttcca

SEQ ID NO: 3257190 - DNA, 14 bp, Homo sapiens
gctctgtccccctg

SEQ ID NO: 3257191 - DNA, 14 bp, Homo sapiens
gctctgtgcaggga

SEQ ID NO: 3257192 - DNA, 15 bp, Homo sapiens
gctctgtgccagaaa

SEQ ID NO: 3257193 - DNA, 20 bp, Homo sapiens
gctctgtggcctgtgtccag

SEQ ID NO: 3257194 - DNA, 20 bp, Homo sapiens
gctctgtgtatatctcttgg

SEQ ID NO: 3257195 - DNA, 20 bp, Homo sapiens
gctctgttacccaggctgga

SEQ ID NO: 3257196 - DNA, 18 bp, Homo sapiens
gctcttaagcagcatgga

SEQ ID NO: 3257197 - DNA, 19 bp, Homo sapiens
gctcttaagcagcatggaa

SEQ ID NO: 3257198 - DNA, 12 bp, Homo sapiens
gctcttaatgtt

SEQ ID NO: 3257199 - DNA, 23 bp, Homo sapiens
gctcttagcaaaaacatgtatgt

SEQ ID NO: 3257200 - DNA, 16 bp, Homo sapiens
gctcttagcagcttcc

SEQ ID NO: 3257201 - DNA, 17 bp, Homo sapiens
gctcttagcagcttcca

SEQ ID NO: 3257202 - DNA, 18 bp, Homo sapiens
gctcttagcagcttccag

SEQ ID NO: 3257203 - DNA, 22 bp, Homo sapiens
gctcttagtgcccgcctaggag

SEQ ID NO: 3257204 - DNA, 16 bp, Homo sapiens
gctcttatttctgaat

SEQ ID NO: 3257205 - DNA, 21 bp, Homo sapiens
gctcttatttctgaattcaaa

SEQ ID NO: 3257206 - DNA, 12 bp, Homo sapiens
gctcttcaggcc

SEQ ID NO: 3257207 - DNA, 15 bp, Homo sapiens
gctcttcaggcctcc

SEQ ID NO: 3257208 - DNA, 19 bp, Homo sapiens
gctcttcctatccctctcc

SEQ ID NO: 3257209 - DNA, 14 bp, Homo sapiens
gctcttcctggacc

SEQ ID NO: 3257210 - DNA, 16 bp, Homo sapiens
gctcttcctggacctg

SEQ ID NO: 3257211 - DNA, 20 bp, Homo sapiens
gctcttcctggacctgagtc

SEQ ID NO: 3257212 - DNA, 12 bp, Homo sapiens
gctcttctccag

SEQ ID NO: 3257213 - DNA, 13 bp, Homo sapiens
gctcttctccttt

SEQ ID NO: 3257214 - DNA, 21 bp, Homo sapiens
gctcttctcctttcacaacct

SEQ ID NO: 3257215 - DNA, 17 bp, Homo sapiens
gctcttgcccttccctg

SEQ ID NO: 3257216 - DNA, 19 bp, Homo sapiens
gctcttgctaatcagtgtc

SEQ ID NO: 3257217 - DNA, 20 bp, Homo sapiens
gctcttgctaatcagtgtct

SEQ ID NO: 3257218 - DNA, 19 bp, Homo sapiens
gctcttggcaggtactcag

SEQ ID NO: 3257219 - DNA, 12 bp, Homo sapiens
gctcttggcctt

SEQ ID NO: 3257220 - DNA, 17 bp, Homo sapiens
gctcttggcctttgcat

SEQ ID NO: 3257221 - DNA, 18 bp, Homo sapiens
gctcttggcctttgcatt

SEQ ID NO: 3257222 - DNA, 15 bp, Homo sapiens
gctcttggtccctgg

SEQ ID NO: 3257223 - DNA, 20 bp, Homo sapiens
gctcttggtccctggtccct

SEQ ID NO: 3257224 - DNA, 22 bp, Homo sapiens
gctcttgtcccacgtgtcttcc

SEQ ID NO: 3257225 - DNA, 23 bp, Homo sapiens
gctcttgtttttattaatttata

SEQ ID NO: 3257226 - DNA, 21 bp, Homo sapiens
gctctttcccttttctgttta

SEQ ID NO: 3257227 - DNA, 23 bp, Homo sapiens
gctctttcccttttctgtttagg

SEQ ID NO: 3257228 - DNA, 15 bp, Homo sapiens
gctctttccttgctc

SEQ ID NO: 3257229 - DNA, 14 bp, Homo sapiens
gctctttctctgcc

SEQ ID NO: 3257230 - DNA, 15 bp, Homo sapiens
gctctttctctgcca

SEQ ID NO: 3257231 - DNA, 18 bp, Homo sapiens
gctctttctctgccagtg

SEQ ID NO: 3257232 - DNA, 21 bp, Homo sapiens
gctctttctctgccagtgaca

SEQ ID NO: 3257233 - DNA, 18 bp, Homo sapiens
gctctttctgggccaagt

SEQ ID NO: 3257234 - DNA, 18 bp, Homo sapiens
gctctttcttccctcgtg

SEQ ID NO: 3257235 - DNA, 23 bp, Homo sapiens
gctctttgaaatagtctgtgtga

SEQ ID NO: 3257236 - DNA, 18 bp, Homo sapiens
gctctttggtctattttc

SEQ ID NO: 3257237 - DNA, 22 bp, Homo sapiens
gctcttttttactcattgaaat

SEQ ID NO: 3257238 - DNA, 19 bp, Homo sapiens
gctgaaaaccatctggcct

SEQ ID NO: 3257239 - DNA, 23 bp, Homo sapiens
gctgaaaaccatctggcctggcc

SEQ ID NO: 3257240 - DNA, 20 bp, Homo sapiens
gctgaaaatgcaaagctgaa

SEQ ID NO: 3257241 - DNA, 13 bp, Homo sapiens
ggctggctctgca

SEQ ID NO: 3257242 - DNA, 13 bp, Homo sapiens
ggctggctgagtg

SEQ ID NO: 3257243 - DNA, 14 bp, Homo sapiens
ggctggctgcagtg

SEQ ID NO: 3257244 - DNA, 10 bp, Homo sapiens
ggctggctgg

SEQ ID NO: 3257245 - DNA, 17 bp, Homo sapiens
ggctgggacttcttacc

SEQ ID NO: 3257246 - DNA, 15 bp, Homo sapiens
ggctgggcagcccca

SEQ ID NO: 3257247 - DNA, 17 bp, Homo sapiens
ggctgggccatgtccaa

SEQ ID NO: 3257248 - DNA, 21 bp, Homo sapiens
ggctgggccatgtccaaagag

SEQ ID NO: 3257249 - DNA, 21 bp, Homo sapiens
ggctgggccccccagctcagg

SEQ ID NO: 3257250 - DNA, 22 bp, Homo sapiens
ggctgggccccccagctcaggg

SEQ ID NO: 3257251 - DNA, 18 bp, Homo sapiens
ggctgggccctctttccc

SEQ ID NO: 3257252 - DNA, 19 bp, Homo sapiens
ggctgggcctcgtgcgccc

SEQ ID NO: 3257253 - DNA, 21 bp, Homo sapiens
ggctgggctcacaggcctctc

SEQ ID NO: 3257254 - DNA, 14 bp, Homo sapiens
ggctgggctccctg

SEQ ID NO: 3257255 - DNA, 11 bp, Homo sapiens
ggctgggcttc

SEQ ID NO: 3257256 - DNA, 12 bp, Homo sapiens
ggctgggcttca

SEQ ID NO: 3257257 - DNA, 17 bp, Homo sapiens
ggctgggcttcagtggc

SEQ ID NO: 3257258 - DNA, 22 bp, Homo sapiens
ggctgggcttcagtggcagctg

SEQ ID NO: 3257259 - DNA, 15 bp, Homo sapiens
ggctggggctgctcc

SEQ ID NO: 3257260 - DNA, 16 bp, Homo sapiens
ggctggggctgctccc

SEQ ID NO: 3257261 - DNA, 19 bp, Homo sapiens
ggctggggctgctccccta

SEQ ID NO: 3257262 - DNA, 16 bp, Homo sapiens
ggctgggggcaggagg

SEQ ID NO: 3257263 - DNA, 15 bp, Homo sapiens
ggctgggggcctcag

SEQ ID NO: 3257264 - DNA, 16 bp, Homo sapiens
ggctgggggcctcagt

SEQ ID NO: 3257265 - DNA, 20 bp, Homo sapiens
ggctgggtaatgtgaaggcc

SEQ ID NO: 3257266 - DNA, 19 bp, Homo sapiens
ggctgggtcggccctgccc

SEQ ID NO: 3257267 - DNA, 20 bp, Homo sapiens
ggctgggtgtttcagtttga

SEQ ID NO: 3257268 - DNA, 14 bp, Homo sapiens
ggctgggttggagg

SEQ ID NO: 3257269 - DNA, 21 bp, Homo sapiens
ggctggtagctcaggtgggcg

SEQ ID NO: 3257270 - DNA, 19 bp, Homo sapiens
ggctggtattggtggcttt

SEQ ID NO: 3257271 - DNA, 19 bp, Homo sapiens
ggctggtccgagctgagga

SEQ ID NO: 3257272 - DNA, 17 bp, Homo sapiens
ggctggtgccccacagc

SEQ ID NO: 3257273 - DNA, 14 bp, Homo sapiens
ggctggtggcaagt

SEQ ID NO: 3257274 - DNA, 15 bp, Homo sapiens
ggctggtgggaaggc

SEQ ID NO: 3257275 - DNA, 13 bp, Homo sapiens
ggctggtgggagg

SEQ ID NO: 3257276 - DNA, 22 bp, Homo sapiens
ggctggttttgtaagatgctgg

SEQ ID NO: 3257277 - DNA, 23 bp, Homo sapiens
ggctggttttgtaagatgctggg

SEQ ID NO: 3257278 - DNA, 21 bp, Homo sapiens
ggctgtaaattgaacttccca

SEQ ID NO: 3257279 - DNA, 15 bp, Homo sapiens
ggctgtaaggctcta

SEQ ID NO: 3257280 - DNA, 22 bp, Homo sapiens
ggctgtatggaaatgcaccctc

SEQ ID NO: 3257281 - DNA, 13 bp, Homo sapiens
ggctgtcctgtac

SEQ ID NO: 3257282 - DNA, 15 bp, Homo sapiens
ggctgtctggggcct

SEQ ID NO: 3257283 - DNA, 14 bp, Homo sapiens
ggctgtctgtcacc

SEQ ID NO: 3257284 - DNA, 11 bp, Homo sapiens
ggctgtgagtg

SEQ ID NO: 3257285 - DNA, 13 bp, Homo sapiens
ggctgtgctcaga

SEQ ID NO: 3257286 - DNA, 15 bp, Homo sapiens
ggctgtgctcagaga

SEQ ID NO: 3257287 - DNA, 17 bp, Homo sapiens
ggctgtggaggcctgat

SEQ ID NO: 3257288 - DNA, 17 bp, Homo sapiens
ggcccggccggcctggc

SEQ ID NO: 3257289 - DNA, 18 bp, Homo sapiens
ggcccgggaactcctgcc

SEQ ID NO: 3257290 - DNA, 17 bp, Homo sapiens
ggcccggtggcggcagg

SEQ ID NO: 3257291 - DNA, 15 bp, Homo sapiens
ggcccgtcatgttcc

SEQ ID NO: 3257292 - DNA, 23 bp, Homo sapiens
ggccctagcccagcgctctgcct

SEQ ID NO: 3257293 - DNA, 18 bp, Homo sapiens
ggccctaggcccctccta

SEQ ID NO: 3257294 - DNA, 22 bp, Homo sapiens
ggccctcatctatgaggaaagg

SEQ ID NO: 3257295 - DNA, 16 bp, Homo sapiens
ggccctccatgggcta

SEQ ID NO: 3257296 - DNA, 11 bp, Homo sapiens
ggccctccctg

SEQ ID NO: 3257297 - DNA, 21 bp, Homo sapiens
ggccctccctgactccctgtg

SEQ ID NO: 3257298 - DNA, 20 bp, Homo sapiens
ggccctcggtggctgcacag

SEQ ID NO: 3257299 - DNA, 20 bp, Homo sapiens
ggccctctcttctcaccttt

SEQ ID NO: 3257300 - DNA, 14 bp, Homo sapiens
ggccctctttccct

SEQ ID NO: 3257301 - DNA, 15 bp, Homo sapiens
ggccctctttccctg

SEQ ID NO: 3257302 - DNA, 20 bp, Homo sapiens
ggccctctttccctgcgaga

SEQ ID NO: 3257303 - DNA, 15 bp, Homo sapiens
ggccctgaggtgtgg

SEQ ID NO: 3257304 - DNA, 17 bp, Homo sapiens
ggccctgaggtgtgggg

SEQ ID NO: 3257305 - DNA, 22 bp, Homo sapiens
ggccctgaggtgtgggggctgc

SEQ ID NO: 3257306 - DNA, 23 bp, Homo sapiens
ggccctgcagtgttcgcttggct

SEQ ID NO: 3257307 - DNA, 11 bp, Homo sapiens
ggccctgcccc

SEQ ID NO: 3257308 - DNA, 18 bp, Homo sapiens
ggccctgccctgaggaag

SEQ ID NO: 3257309 - DNA, 10 bp, Homo sapiens
ggccctgcta

SEQ ID NO: 3257310 - DNA, 12 bp, Homo sapiens
ggccctggaggt

SEQ ID NO: 3257311 - DNA, 16 bp, Homo sapiens
ggccctggcaccccca

SEQ ID NO: 3257312 - DNA, 12 bp, Homo sapiens
ggccctggccag

SEQ ID NO: 3257313 - DNA, 12 bp, Homo sapiens
ggccctggccct

SEQ ID NO: 3257314 - DNA, 14 bp, Homo sapiens
ggccctggcctccc

SEQ ID NO: 3257315 - DNA, 19 bp, Homo sapiens
ggccctggctgagggcagc

SEQ ID NO: 3257316 - DNA, 14 bp, Homo sapiens
ggccctgggctgga

SEQ ID NO: 3257317 - DNA, 15 bp, Homo sapiens
ggccctgggctggaa

SEQ ID NO: 3257318 - DNA, 15 bp, Homo sapiens
ggccctgtccctccc

SEQ ID NO: 3257319 - DNA, 15 bp, Homo sapiens
ggcccttcctctcca

SEQ ID NO: 3257320 - DNA, 17 bp, Homo sapiens
ggcccttcctctccact

SEQ ID NO: 3257321 - DNA, 21 bp, Homo sapiens
ggcccttgcctttgtggcctt

SEQ ID NO: 3257322 - DNA, 16 bp, Homo sapiens
ggcccttggaataaag

SEQ ID NO: 3257323 - DNA, 14 bp, Homo sapiens
ggcccttgggacag

SEQ ID NO: 3257324 - DNA, 15 bp, Homo sapiens
ggcccttggggcctg

SEQ ID NO: 3257325 - DNA, 19 bp, Homo sapiens
ggcccttggggcctggctt

SEQ ID NO: 3257326 - DNA, 13 bp, Homo sapiens
ggccctttcccct

SEQ ID NO: 3257327 - DNA, 17 bp, Homo sapiens
ggccctttccccttccc

SEQ ID NO: 3257328 - DNA, 20 bp, Homo sapiens
ggccctttccccttcccctc

SEQ ID NO: 3257329 - DNA, 14 bp, Homo sapiens
ggccgaagctctgg

SEQ ID NO: 3257330 - DNA, 16 bp, Homo sapiens
ggccgaatcccccagg

SEQ ID NO: 3257331 - DNA, 17 bp, Homo sapiens
ggccgaatcccccaggg

SEQ ID NO: 3257332 - DNA, 18 bp, Homo sapiens
ggccgaatcccccaggga

SEQ ID NO: 3257333 - DNA, 13 bp, Homo sapiens
ggccgagccaggt

SEQ ID NO: 3257334 - DNA, 13 bp, Homo sapiens
ggccgaggcagga

SEQ ID NO: 3257335 - DNA, 20 bp, Homo sapiens
ggccgaggcaggaggatcct

SEQ ID NO: 3257336 - DNA, 14 bp, Homo sapiens
ggccgaggcccagc

SEQ ID NO: 3257337 - DNA, 19 bp, Homo sapiens
ggccgaggcccagcgggca

SEQ ID NO: 3257338 - DNA, 21 bp, Homo sapiens
ggccgaggcccagcgggcaga

SEQ ID NO: 3257339 - DNA, 14 bp, Homo sapiens
ggccgaggcgggtg

SEQ ID NO: 3257340 - DNA, 21 bp, Homo sapiens
ggccgcaccatttctgtcact

SEQ ID NO: 3257341 - DNA, 18 bp, Homo sapiens
ggccgcagctcttgccct

SEQ ID NO: 3257342 - DNA, 22 bp, Homo sapiens
ggccgcagctcttgcccttccc

SEQ ID NO: 3257343 - DNA, 15 bp, Homo sapiens
ggccgccacggcctg

SEQ ID NO: 3257344 - DNA, 19 bp, Homo sapiens
ggccgccccctgcccccca

SEQ ID NO: 3257345 - DNA, 16 bp, Homo sapiens
ggccgccgtgacctat

SEQ ID NO: 3257346 - DNA, 18 bp, Homo sapiens
ggccggaaccacagggcc

SEQ ID NO: 3257347 - DNA, 19 bp, Homo sapiens
ggccggaaccacagggcca

SEQ ID NO: 3257348 - DNA, 22 bp, Homo sapiens
ggccggcttcatgccagctact

SEQ ID NO: 3257349 - DNA, 15 bp, Homo sapiens
ggccgggcaggtcct

SEQ ID NO: 3257350 - DNA, 19 bp, Homo sapiens
ggccgggcaggtcctgccc

SEQ ID NO: 3257351 - DNA, 20 bp, Homo sapiens
ggccgggcaggtcctgccca

SEQ ID NO: 3257352 - DNA, 22 bp, Homo sapiens
ggccggggaagctgccagccca

SEQ ID NO: 3257353 - DNA, 23 bp, Homo sapiens
ggccggtagaggctccccagggc

SEQ ID NO: 3257354 - DNA, 17 bp, Homo sapiens
ggccggtctgcaagtca

SEQ ID NO: 3257355 - DNA, 17 bp, Homo sapiens
ggccgtctcctccctca

SEQ ID NO: 3257356 - DNA, 23 bp, Homo sapiens
ggcctaatctcatacctctgacc

SEQ ID NO: 3257357 - DNA, 23 bp, Homo sapiens
ggcctacagctttgatccctgac

SEQ ID NO: 3257358 - DNA, 24 bp, Homo sapiens
ggcctactagagtctgaacagctg

SEQ ID NO: 3257359 - DNA, 13 bp, Homo sapiens
ggcctagactctg

SEQ ID NO: 3257360 - DNA, 18 bp, Homo sapiens
ggcctagactctgtctac

SEQ ID NO: 3257361 - DNA, 18 bp, Homo sapiens
ggcctagcccaccctgct

SEQ ID NO: 3257362 - DNA, 22 bp, Homo sapiens
ggcctagcccaccctgctgcct

SEQ ID NO: 3257363 - DNA, 21 bp, Homo sapiens
ggcctagcgatctctcctggc

SEQ ID NO: 3257364 - DNA, 16 bp, Homo sapiens
ggcctaggctaggacg

SEQ ID NO: 3257365 - DNA, 16 bp, Homo sapiens
ggcctaggtgcagctc

SEQ ID NO: 3257366 - DNA, 22 bp, Homo sapiens
ggcctaggtgcagctcctcagc

SEQ ID NO: 3257367 - DNA, 18 bp, Homo sapiens
ggcctatatgccagcgcc

SEQ ID NO: 3257368 - DNA, 20 bp, Homo sapiens
ggcctatgcacatatggact

SEQ ID NO: 3257369 - DNA, 19 bp, Homo sapiens
ggcctattatattaaaata

SEQ ID NO: 3257370 - DNA, 18 bp, Homo sapiens
ggcctcaaaggcccgctc

SEQ ID NO: 3257371 - DNA, 19 bp, Homo sapiens
ggcctcaaaggcccgctct

SEQ ID NO: 3257372 - DNA, 19 bp, Homo sapiens
ggcctcaagagcacacaga

SEQ ID NO: 3257373 - DNA, 15 bp, Homo sapiens
ggcctcaaggacttg

SEQ ID NO: 3257374 - DNA, 14 bp, Homo sapiens
ggcctcaagtgatt

SEQ ID NO: 3257375 - DNA, 22 bp, Homo sapiens
ggcctcaagtgattctcctgcc

SEQ ID NO: 3257376 - DNA, 23 bp, Homo sapiens
ggcctcaagtgattctcctgcct

SEQ ID NO: 3257377 - DNA, 18 bp, Homo sapiens
ggcctcacccacccctgc

SEQ ID NO: 3257378 - DNA, 13 bp, Homo sapiens
ggcctcaccctga

SEQ ID NO: 3257379 - DNA, 15 bp, Homo sapiens
ggcctcacctctacc

SEQ ID NO: 3257380 - DNA, 13 bp, Homo sapiens
ggcctcagccctc

SEQ ID NO: 3257381 - DNA, 19 bp, Homo sapiens
ggcctcagctcaatgcagt

SEQ ID NO: 3257382 - DNA, 14 bp, Homo sapiens
ggcctcagctggct

SEQ ID NO: 3257383 - DNA, 15 bp, Homo sapiens
ggcctcagctggctg

SEQ ID NO: 3257384 - DNA, 23 bp, Homo sapiens
ggcagcgccaagcaacctgggtc

SEQ ID NO: 3257385 - DNA, 22 bp, Homo sapiens
ggcagcgccaagtgcgtgccgt

SEQ ID NO: 3257386 - DNA, 14 bp, Homo sapiens
ggcagcgggccagg

SEQ ID NO: 3257387 - DNA, 14 bp, Homo sapiens
ggcagctcacccct

SEQ ID NO: 3257388 - DNA, 16 bp, Homo sapiens
ggcagctcacccctgg

SEQ ID NO: 3257389 - DNA, 19 bp, Homo sapiens
ggcagctcacccctgggca

SEQ ID NO: 3257390 - DNA, 22 bp, Homo sapiens
ggcagctcacccctgggcaggc

SEQ ID NO: 3257391 - DNA, 18 bp, Homo sapiens
ggcagctcctctccttgg

SEQ ID NO: 3257392 - DNA, 22 bp, Homo sapiens
ggcagctcctctccttgggctc

SEQ ID NO: 3257393 - DNA, 11 bp, Homo sapiens
ggcagctctcc

SEQ ID NO: 3257394 - DNA, 15 bp, Homo sapiens
ggcagctgcctctgc

SEQ ID NO: 3257395 - DNA, 17 bp, Homo sapiens
ggcagctgcctctgctc

SEQ ID NO: 3257396 - DNA, 20 bp, Homo sapiens
ggcagctgcctctgctccct

SEQ ID NO: 3257397 - DNA, 21 bp, Homo sapiens
ggcagctgcctctgctccctc

SEQ ID NO: 3257398 - DNA, 22 bp, Homo sapiens
ggcagctgcctctgctccctct

SEQ ID NO: 3257399 - DNA, 24 bp, Homo sapiens
ggcagctgcggtccacccaggagc

SEQ ID NO: 3257400 - DNA, 23 bp, Homo sapiens
ggcagctgctcttagtgcccgcc

SEQ ID NO: 3257401 - DNA, 22 bp, Homo sapiens
ggcagctgcttttgtctatggg

SEQ ID NO: 3257402 - DNA, 13 bp, Homo sapiens
ggcagctgggccc

SEQ ID NO: 3257403 - DNA, 18 bp, Homo sapiens
ggcagctgggccccacct

SEQ ID NO: 3257404 - DNA, 19 bp, Homo sapiens
ggcagctgggccccaccta

SEQ ID NO: 3257405 - DNA, 20 bp, Homo sapiens
ggcagctgggccccacctac

SEQ ID NO: 3257406 - DNA, 17 bp, Homo sapiens
ggcagcttcaagtgcct

SEQ ID NO: 3257407 - DNA, 15 bp, Homo sapiens
ggcagcttgccccgg

SEQ ID NO: 3257408 - DNA, 16 bp, Homo sapiens
ggcaggaaggagcggc

SEQ ID NO: 3257409 - DNA, 12 bp, Homo sapiens
ggcaggacacat

SEQ ID NO: 3257410 - DNA, 21 bp, Homo sapiens
ggcaggacacatcccggcctc

SEQ ID NO: 3257411 - DNA, 11 bp, Homo sapiens
ggcaggactga

SEQ ID NO: 3257412 - DNA, 15 bp, Homo sapiens
ggcaggatgaccctg

SEQ ID NO: 3257413 - DNA, 16 bp, Homo sapiens
ggcaggatgctgagct

SEQ ID NO: 3257414 - DNA, 15 bp, Homo sapiens
ggcaggcaagccctt

SEQ ID NO: 3257415 - DNA, 17 bp, Homo sapiens
ggcaggcacacagcagc

SEQ ID NO: 3257416 - DNA, 18 bp, Homo sapiens
ggcaggcacacagcagcc

SEQ ID NO: 3257417 - DNA, 19 bp, Homo sapiens
ggcaggcacacagcagccc

SEQ ID NO: 3257418 - DNA, 13 bp, Homo sapiens
ggcaggcagcgcc

SEQ ID NO: 3257419 - DNA, 13 bp, Homo sapiens
ggcaggcattgag

SEQ ID NO: 3257420 - DNA, 13 bp, Homo sapiens
ggcaggccagtgt

SEQ ID NO: 3257421 - DNA, 13 bp, Homo sapiens
ggcaggccctgca

SEQ ID NO: 3257422 - DNA, 14 bp, Homo sapiens
ggcaggccctgcag

SEQ ID NO: 3257423 - DNA, 13 bp, Homo sapiens
ggcaggcctggga

SEQ ID NO: 3257424 - DNA, 19 bp, Homo sapiens
ggcaggcctgggacccagc

SEQ ID NO: 3257425 - DNA, 20 bp, Homo sapiens
ggcaggcgtgactcagcagc

SEQ ID NO: 3257426 - DNA, 22 bp, Homo sapiens
ggcaggcgtgactcagcagcct

SEQ ID NO: 3257427 - DNA, 16 bp, Homo sapiens
ggcaggctcactgcca

SEQ ID NO: 3257428 - DNA, 12 bp, Homo sapiens
ggcaggctggcc

SEQ ID NO: 3257429 - DNA, 12 bp, Homo sapiens
ggcaggctgggc

SEQ ID NO: 3257430 - DNA, 16 bp, Homo sapiens
ggcaggctgggtgacc

SEQ ID NO: 3257431 - DNA, 18 bp, Homo sapiens
ggcagggaaaggctctga

SEQ ID NO: 3257432 - DNA, 16 bp, Homo sapiens
ggcagggaaggacagg

SEQ ID NO: 3257433 - DNA, 17 bp, Homo sapiens
ggcagggaaggacagga

SEQ ID NO: 3257434 - DNA, 14 bp, Homo sapiens
ggcagggaccacac

SEQ ID NO: 3257435 - DNA, 17 bp, Homo sapiens
ggcagggaggtcaggcc

SEQ ID NO: 3257436 - DNA, 14 bp, Homo sapiens
ggcagggatggggg

SEQ ID NO: 3257437 - DNA, 14 bp, Homo sapiens
ggcagggcccacgt

SEQ ID NO: 3257438 - DNA, 17 bp, Homo sapiens
ggcagggcccacgtgta

SEQ ID NO: 3257439 - DNA, 21 bp, Homo sapiens
ggcagggcccttggggctggg

SEQ ID NO: 3257440 - DNA, 19 bp, Homo sapiens
ggcagggcgggcagagggc

SEQ ID NO: 3257441 - DNA, 14 bp, Homo sapiens
ggcagggctctgat

SEQ ID NO: 3257442 - DNA, 19 bp, Homo sapiens
ggcaggggagacaggagcc

SEQ ID NO: 3257443 - DNA, 13 bp, Homo sapiens
ggcaggggagcag

SEQ ID NO: 3257444 - DNA, 14 bp, Homo sapiens
ggcaggggcctgga

SEQ ID NO: 3257445 - DNA, 17 bp, Homo sapiens
ggcaggggcctggagat

SEQ ID NO: 3257446 - DNA, 22 bp, Homo sapiens
ggcagggggccccgccagggct

SEQ ID NO: 3257447 - DNA, 16 bp, Homo sapiens
ggcaggtcctgcccat

SEQ ID NO: 3257448 - DNA, 15 bp, Homo sapiens
ggcaggtcctggcca

SEQ ID NO: 3257449 - DNA, 13 bp, Homo sapiens
ggcaggtgcagat

SEQ ID NO: 3257450 - DNA, 13 bp, Homo sapiens
ggcaggtgcctcc

SEQ ID NO: 3257451 - DNA, 14 bp, Homo sapiens
ggcaggtgcctcca

SEQ ID NO: 3257452 - DNA, 21 bp, Homo sapiens
ggcaggtgcctccaggtgtgc

SEQ ID NO: 3257453 - DNA, 15 bp, Homo sapiens
ggcaggtgtcatatg

SEQ ID NO: 3257454 - DNA, 20 bp, Homo sapiens
ggcaggttggatgggagtgg

SEQ ID NO: 3257455 - DNA, 15 bp, Homo sapiens
ggcagtaaagagaaa

SEQ ID NO: 3257456 - DNA, 14 bp, Homo sapiens
ggcagtacctggga

SEQ ID NO: 3257457 - DNA, 22 bp, Homo sapiens
ggcagtcgggggctggcctagg

SEQ ID NO: 3257458 - DNA, 21 bp, Homo sapiens
ggcagtctgaacccttgtgct

SEQ ID NO: 3257459 - DNA, 14 bp, Homo sapiens
ggcagtgactggca

SEQ ID NO: 3257460 - DNA, 20 bp, Homo sapiens
ggcagtgactggcaggtgca

SEQ ID NO: 3257461 - DNA, 21 bp, Homo sapiens
ggcagtgactggcaggtgcag

SEQ ID NO: 3257462 - DNA, 16 bp, Homo sapiens
ggcagtgagtgagcct

SEQ ID NO: 3257463 - DNA, 18 bp, Homo sapiens
ggcagtgagtgagcctgg

SEQ ID NO: 3257464 - DNA, 14 bp, Homo sapiens
ggcagtggcagaga

SEQ ID NO: 3257465 - DNA, 18 bp, Homo sapiens
ggcagtgggagctgcctg

SEQ ID NO: 3257466 - DNA, 13 bp, Homo sapiens
ggcagtgtcccag

SEQ ID NO: 3257467 - DNA, 16 bp, Homo sapiens
ggcagtgtttaaaatg

SEQ ID NO: 3257468 - DNA, 21 bp, Homo sapiens
ggcagttgacggggcagtcag

SEQ ID NO: 3257469 - DNA, 14 bp, Homo sapiens
ggcagttgggtaga

SEQ ID NO: 3257470 - DNA, 13 bp, Homo sapiens
ggcataaaacagc

SEQ ID NO: 3257471 - DNA, 14 bp, Homo sapiens
ggcataaactgttt

SEQ ID NO: 3257472 - DNA, 13 bp, Homo sapiens
ggcatagctctgg

SEQ ID NO: 3257473 - DNA, 15 bp, Homo sapiens
ggcataggcctgggt

SEQ ID NO: 3257474 - DNA, 22 bp, Homo sapiens
ggcatcacagggcagagccggg

SEQ ID NO: 3257475 - DNA, 13 bp, Homo sapiens
ggcatccacccag

SEQ ID NO: 3257476 - DNA, 17 bp, Homo sapiens
ggcatccacccagtgct

SEQ ID NO: 3257477 - DNA, 14 bp, Homo sapiens
ggcatcctccggag

SEQ ID NO: 3257478 - DNA, 17 bp, Homo sapiens
ggcatcctccggagaga

SEQ ID NO: 3257479 - DNA, 16 bp, Homo sapiens
ggcatcctgcctgggt

SEQ ID NO: 3257480 - DNA, 12 bp, Homo sapiens
ggcatcctggat

SEQ ID NO: 3257481 - DNA, 18 bp, Homo sapiens
ggcatcgcaccattctga

SEQ ID NO: 3257482 - DNA, 21 bp, Homo sapiens
ggcatctcctgtgcatgggtg

SEQ ID NO: 3257483 - DNA, 17 bp, Homo sapiens
ggcatctgacacaaaaa

SEQ ID NO: 3257484 - DNA, 20 bp, Homo sapiens
ggcatctgacacaaaaaaag

SEQ ID NO: 3257485 - DNA, 16 bp, Homo sapiens
ggcatctgcccctccc

SEQ ID NO: 3257486 - DNA, 17 bp, Homo sapiens
ggcatctttgccttggg

SEQ ID NO: 3257487 - DNA, 19 bp, Homo sapiens
ggcatctttgccttgggct

SEQ ID NO: 3257488 - DNA, 21 bp, Homo sapiens
ggcatctttgccttgggctgc

SEQ ID NO: 3257489 - DNA, 20 bp, Homo sapiens
ggcatgaagagcaaaaatat

SEQ ID NO: 3257490 - DNA, 13 bp, Homo sapiens
ggcatgagaaaga

SEQ ID NO: 3257491 - DNA, 22 bp, Homo sapiens
ggcatgagccactgagcctggc

SEQ ID NO: 3257492 - DNA, 14 bp, Homo sapiens
ggcatgagggatca

SEQ ID NO: 3257493 - DNA, 16 bp, Homo sapiens
ggcatgccaccctcac

SEQ ID NO: 3257494 - DNA, 15 bp, Homo sapiens
ggcatgccccggcca

SEQ ID NO: 3257495 - DNA, 19 bp, Homo sapiens
ggcatgccccggccacctc

SEQ ID NO: 3257496 - DNA, 23 bp, Homo sapiens
ggcatgcctctgatatgggactg

SEQ ID NO: 3257497 - DNA, 12 bp, Homo sapiens
ggcatgctgggg

SEQ ID NO: 3257498 - DNA, 17 bp, Homo sapiens
ggcatggcgaggctgag

SEQ ID NO: 3257499 - DNA, 17 bp, Homo sapiens
ggcatggctcagagctt

SEQ ID NO: 3257500 - DNA, 16 bp, Homo sapiens
ggcatgggcgcaggcc

SEQ ID NO: 3257501 - DNA, 18 bp, Homo sapiens
ggcatgggcgcaggccca

SEQ ID NO: 3257502 - DNA, 19 bp, Homo sapiens
ggcatgggcgcaggcccag

SEQ ID NO: 3257503 - DNA, 20 bp, Homo sapiens
ggcatgggcgcaggcccagt

SEQ ID NO: 3257504 - DNA, 17 bp, Homo sapiens
ggcatggtaccagccct

SEQ ID NO: 3257505 - DNA, 18 bp, Homo sapiens
ggcatggtaccagccctg

SEQ ID NO: 3257506 - DNA, 20 bp, Homo sapiens
ggcatggtaccagccctggg

SEQ ID NO: 3257507 - DNA, 21 bp, Homo sapiens
ggcatggtggctcatgcctgt

SEQ ID NO: 3257508 - DNA, 22 bp, Homo sapiens
ggcatggttccttccctgggaa

SEQ ID NO: 3257509 - DNA, 16 bp, Homo sapiens
ggcatgtaggaccctg

SEQ ID NO: 3257510 - DNA, 12 bp, Homo sapiens
ggcatgtggaga

SEQ ID NO: 3257511 - DNA, 18 bp, Homo sapiens
ggcatgtgtatgtgtctg

SEQ ID NO: 3257512 - DNA, 17 bp, Homo sapiens
ggcatgtgtgcctgtgg

SEQ ID NO: 3257513 - DNA, 21 bp, Homo sapiens
ggcatgtgtgcctgtggcaga

SEQ ID NO: 3257514 - DNA, 20 bp, Homo sapiens
ggatacttagtggtatgtct

SEQ ID NO: 3257515 - DNA, 23 bp, Homo sapiens
ggataggagaagaggcatcctgc

SEQ ID NO: 3257516 - DNA, 18 bp, Homo sapiens
ggataggttttctgctag

SEQ ID NO: 3257517 - DNA, 16 bp, Homo sapiens
ggatataatgtatttt

SEQ ID NO: 3257518 - DNA, 16 bp, Homo sapiens
ggatatagttttactt

SEQ ID NO: 3257519 - DNA, 20 bp, Homo sapiens
ggatatccttatcagagcta

SEQ ID NO: 3257520 - DNA, 20 bp, Homo sapiens
ggatatgctgaacgcagaag

SEQ ID NO: 3257521 - DNA, 16 bp, Homo sapiens
ggatatttaagaaaat

SEQ ID NO: 3257522 - DNA, 12 bp, Homo sapiens
ggatatttaagg

SEQ ID NO: 3257523 - DNA, 22 bp, Homo sapiens
ggatcaattttcattaaacttg

SEQ ID NO: 3257524 - DNA, 14 bp, Homo sapiens
ggatcacagagaca

SEQ ID NO: 3257525 - DNA, 13 bp, Homo sapiens
ggatcacagggcc

SEQ ID NO: 3257526 - DNA, 13 bp, Homo sapiens
ggatcactggagc

SEQ ID NO: 3257527 - DNA, 16 bp, Homo sapiens
ggatcagagcaggagc

SEQ ID NO: 3257528 - DNA, 19 bp, Homo sapiens
ggatcatcaacaagatttc

SEQ ID NO: 3257529 - DNA, 19 bp, Homo sapiens
ggatcatggtgtaataaga

SEQ ID NO: 3257530 - DNA, 21 bp, Homo sapiens
ggatcatggtgtaataagaca

SEQ ID NO: 3257531 - DNA, 13 bp, Homo sapiens
ggatccagccact

SEQ ID NO: 3257532 - DNA, 16 bp, Homo sapiens
ggatcccaagcctcct

SEQ ID NO: 3257533 - DNA, 21 bp, Homo sapiens
ggatcccaagcctcctgctgc

SEQ ID NO: 3257534 - DNA, 16 bp, Homo sapiens
ggatcccaccctgggg

SEQ ID NO: 3257535 - DNA, 19 bp, Homo sapiens
ggatccccgcctggccagg

SEQ ID NO: 3257536 - DNA, 21 bp, Homo sapiens
ggatccccgcctggccaggag

SEQ ID NO: 3257537 - DNA, 19 bp, Homo sapiens
ggatccgactgctttggac

SEQ ID NO: 3257538 - DNA, 15 bp, Homo sapiens
ggatcggcctcctct

SEQ ID NO: 3257539 - DNA, 13 bp, Homo sapiens
ggatctaccagca

SEQ ID NO: 3257540 - DNA, 21 bp, Homo sapiens
ggatctctcaggagcacaggc

SEQ ID NO: 3257541 - DNA, 22 bp, Homo sapiens
ggatctctcaggagcacaggca

SEQ ID NO: 3257542 - DNA, 23 bp, Homo sapiens
ggatctctctagtgatggtcaga

SEQ ID NO: 3257543 - DNA, 15 bp, Homo sapiens
ggatcttgaatgtgg

SEQ ID NO: 3257544 - DNA, 20 bp, Homo sapiens
ggatcttgaatgtggtctca

SEQ ID NO: 3257545 - DNA, 21 bp, Homo sapiens
ggatcttgaatgtggtctcag

SEQ ID NO: 3257546 - DNA, 14 bp, Homo sapiens
ggatcttgccacat

SEQ ID NO: 3257547 - DNA, 21 bp, Homo sapiens
ggatgaaagttcccccatcag

SEQ ID NO: 3257548 - DNA, 13 bp, Homo sapiens
ggatgaatctccc

SEQ ID NO: 3257549 - DNA, 16 bp, Homo sapiens
ggatgacaccctggcc

SEQ ID NO: 3257550 - DNA, 22 bp, Homo sapiens
ggatgagaaacagctcagccag

SEQ ID NO: 3257551 - DNA, 14 bp, Homo sapiens
ggatgagagcccag

SEQ ID NO: 3257552 - DNA, 21 bp, Homo sapiens
ggatgattcagaaattggaac

SEQ ID NO: 3257553 - DNA, 23 bp, Homo sapiens
ggatgatttcatcttctggaata

SEQ ID NO: 3257554 - DNA, 17 bp, Homo sapiens
ggatgcatttcaaatgt

SEQ ID NO: 3257555 - DNA, 18 bp, Homo sapiens
ggatgcatttcaaatgtt

SEQ ID NO: 3257556 - DNA, 20 bp, Homo sapiens
ggatgccactcctccctccg

SEQ ID NO: 3257557 - DNA, 12 bp, Homo sapiens
ggatgccagccc

SEQ ID NO: 3257558 - DNA, 13 bp, Homo sapiens
ggatgccagcccc

SEQ ID NO: 3257559 - DNA, 11 bp, Homo sapiens
ggatgcctcct

SEQ ID NO: 3257560 - DNA, 17 bp, Homo sapiens
ggatgcctggtggcagc

SEQ ID NO: 3257561 - DNA, 19 bp, Homo sapiens
ggatgcctggtggcagctg

SEQ ID NO: 3257562 - DNA, 14 bp, Homo sapiens
ggatgctctttccc

SEQ ID NO: 3257563 - DNA, 14 bp, Homo sapiens
ggatgctgcagcag

SEQ ID NO: 3257564 - DNA, 15 bp, Homo sapiens
ggatgctgctccgcc

SEQ ID NO: 3257565 - DNA, 12 bp, Homo sapiens
ggatgctgctgt

SEQ ID NO: 3257566 - DNA, 15 bp, Homo sapiens
ggatggacagtgggc

SEQ ID NO: 3257567 - DNA, 23 bp, Homo sapiens
ggatggactcttctcggctcagg

SEQ ID NO: 3257568 - DNA, 19 bp, Homo sapiens
ggatggagaaagaagtgga

SEQ ID NO: 3257569 - DNA, 14 bp, Homo sapiens
ggatggcacaatga

SEQ ID NO: 3257570 - DNA, 15 bp, Homo sapiens
ggatggcacaatgaa

SEQ ID NO: 3257571 - DNA, 12 bp, Homo sapiens
ggatggcagact

SEQ ID NO: 3257572 - DNA, 14 bp, Homo sapiens
ggatggcagactct

SEQ ID NO: 3257573 - DNA, 13 bp, Homo sapiens
ggatggccagtgt

SEQ ID NO: 3257574 - DNA, 13 bp, Homo sapiens
ggatggccccagc

SEQ ID NO: 3257575 - DNA, 15 bp, Homo sapiens
ggatggcctggaacc

SEQ ID NO: 3257576 - DNA, 22 bp, Homo sapiens
ggatgggagtgggcacctcaga

SEQ ID NO: 3257577 - DNA, 17 bp, Homo sapiens
ggatgggggatgggcca

SEQ ID NO: 3257578 - DNA, 19 bp, Homo sapiens
ggatgggggtggctgggac

SEQ ID NO: 3257579 - DNA, 14 bp, Homo sapiens
ggatggtcctgggg

SEQ ID NO: 3257580 - DNA, 16 bp, Homo sapiens
ggatggtcctggggct

SEQ ID NO: 3257581 - DNA, 20 bp, Homo sapiens
ggatggtcctggggctctgt

SEQ ID NO: 3257582 - DNA, 20 bp, Homo sapiens
ggatggtctcgatctcctga

SEQ ID NO: 3257583 - DNA, 12 bp, Homo sapiens
ggatggtgtctc

SEQ ID NO: 3257584 - DNA, 17 bp, Homo sapiens
ggatggtttgagctcag

SEQ ID NO: 3257585 - DNA, 20 bp, Homo sapiens
ggatgtaattagctctgggg

SEQ ID NO: 3257586 - DNA, 21 bp, Homo sapiens
ggatgtaattagctctggggg

SEQ ID NO: 3257587 - DNA, 21 bp, Homo sapiens
ggatgtacttaagagtggcat

SEQ ID NO: 3257588 - DNA, 13 bp, Homo sapiens
ggatgtcaacagc

SEQ ID NO: 3257589 - DNA, 23 bp, Homo sapiens
ggatgtcctctttactcccttcc

SEQ ID NO: 3257590 - DNA, 14 bp, Homo sapiens
ggatgtcttccttg

SEQ ID NO: 3257591 - DNA, 17 bp, Homo sapiens
ggatgtgagccccaggg

SEQ ID NO: 3257592 - DNA, 18 bp, Homo sapiens
ggatgtgagccccagggg

SEQ ID NO: 3257593 - DNA, 15 bp, Homo sapiens
ggatgtgggagggag

SEQ ID NO: 3257594 - DNA, 17 bp, Homo sapiens
ggatgtgtgctttccca

SEQ ID NO: 3257595 - DNA, 23 bp, Homo sapiens
ggatgttcagcactgtcccttgc

SEQ ID NO: 3257596 - DNA, 14 bp, Homo sapiens
ggattaatatgaaa

SEQ ID NO: 3257597 - DNA, 21 bp, Homo sapiens
ggattaattagttgattgctg

SEQ ID NO: 3257598 - DNA, 21 bp, Homo sapiens
ggattattcatttaaaatgat

SEQ ID NO: 3257599 - DNA, 19 bp, Homo sapiens
ggattattctttgaaaaca

SEQ ID NO: 3257600 - DNA, 18 bp, Homo sapiens
ggattcaattacggactc

SEQ ID NO: 3257601 - DNA, 15 bp, Homo sapiens
ggattcaggctgctt

SEQ ID NO: 3257602 - DNA, 18 bp, Homo sapiens
ggattcaggggctggggg

SEQ ID NO: 3257603 - DNA, 22 bp, Homo sapiens
ggattcattgtctctcacagat

SEQ ID NO: 3257604 - DNA, 15 bp, Homo sapiens
ggattcccccagcca

SEQ ID NO: 3257605 - DNA, 12 bp, Homo sapiens
ggattcctcaca

SEQ ID NO: 3257606 - DNA, 16 bp, Homo sapiens
ggattcctgacccagg

SEQ ID NO: 3257607 - DNA, 19 bp, Homo sapiens
ggattcctgacccaggccg

SEQ ID NO: 3257608 - DNA, 20 bp, Homo sapiens
ggattctactttaagcacta

SEQ ID NO: 3257609 - DNA, 20 bp, Homo sapiens
ggattctgaggccctgccca

SEQ ID NO: 3257610 - DNA, 23 bp, Homo sapiens
ggattctgatttgtattaaaatt

SEQ ID NO: 3257611 - DNA, 18 bp, Homo sapiens
ggattctggttccagggt

SEQ ID NO: 3257612 - DNA, 12 bp, Homo sapiens
ggattctttaaa

SEQ ID NO: 3257613 - DNA, 18 bp, Homo sapiens
ggattctttccattatga

SEQ ID NO: 3257614 - DNA, 20 bp, Homo sapiens
ggattctttgacatttggtg

SEQ ID NO: 3257615 - DNA, 17 bp, Homo sapiens
ggattgcacgtggcctc

SEQ ID NO: 3257616 - DNA, 17 bp, Homo sapiens
ggattgctactgtccta

SEQ ID NO: 3257617 - DNA, 16 bp, Homo sapiens
ggatttaaaagcctgc

SEQ ID NO: 3257618 - DNA, 19 bp, Homo sapiens
ggatttaaaagcctgctca

SEQ ID NO: 3257619 - DNA, 21 bp, Homo sapiens
ggatttatagtatgtgacttt

SEQ ID NO: 3257620 - DNA, 15 bp, Homo sapiens
ggatttcgtttttct

SEQ ID NO: 3257621 - DNA, 15 bp, Homo sapiens
ggatttcttaaattt

SEQ ID NO: 3257622 - DNA, 12 bp, Homo sapiens
ggatttcttagg

SEQ ID NO: 3257623 - DNA, 14 bp, Homo sapiens
ggatttgccccttc

SEQ ID NO: 3257624 - DNA, 15 bp, Homo sapiens
ggatttgttgccatg

SEQ ID NO: 3257625 - DNA, 17 bp, Homo sapiens
ggattttaaaaattgga

SEQ ID NO: 3257626 - DNA, 22 bp, Homo sapiens
ggattttaacaaaagcaagact

SEQ ID NO: 3257627 - DNA, 13 bp, Homo sapiens
ggattttaccaaa

SEQ ID NO: 3257628 - DNA, 13 bp, Homo sapiens
ggcaaaacccagg

SEQ ID NO: 3257629 - DNA, 15 bp, Homo sapiens
ggcaaaacccaggac

SEQ ID NO: 3257630 - DNA, 15 bp, Homo sapiens
ggcaaaaccttgcta

SEQ ID NO: 3257631 - DNA, 15 bp, Homo sapiens
ggactcaatgcactg

SEQ ID NO: 3257632 - DNA, 16 bp, Homo sapiens
ggactcaatgcactga

SEQ ID NO: 3257633 - DNA, 18 bp, Homo sapiens
ggactcaatgcactgaca

SEQ ID NO: 3257634 - DNA, 22 bp, Homo sapiens
ggactcaatgcactgacattgt

SEQ ID NO: 3257635 - DNA, 17 bp, Homo sapiens
ggactcagcccacctgc

SEQ ID NO: 3257636 - DNA, 13 bp, Homo sapiens
ggactcagccctg

SEQ ID NO: 3257637 - DNA, 14 bp, Homo sapiens
ggactcagccctga

SEQ ID NO: 3257638 - DNA, 17 bp, Homo sapiens
ggactcagccttcagac

SEQ ID NO: 3257639 - DNA, 17 bp, Homo sapiens
ggactccactggacaga

SEQ ID NO: 3257640 - DNA, 15 bp, Homo sapiens
ggactccaggcccaa

SEQ ID NO: 3257641 - DNA, 23 bp, Homo sapiens
ggactccaggcccaaggctcccg

SEQ ID NO: 3257642 - DNA, 22 bp, Homo sapiens
ggactccatctctcatcctcca

SEQ ID NO: 3257643 - DNA, 18 bp, Homo sapiens
ggactcccaaccctggct

SEQ ID NO: 3257644 - DNA, 22 bp, Homo sapiens
ggactccctcctcacctctgga

SEQ ID NO: 3257645 - DNA, 12 bp, Homo sapiens
ggactcctctgt

SEQ ID NO: 3257646 - DNA, 14 bp, Homo sapiens
ggactcctctgtcc

SEQ ID NO: 3257647 - DNA, 15 bp, Homo sapiens
ggactcctctgtcca

SEQ ID NO: 3257648 - DNA, 17 bp, Homo sapiens
ggactcctgccaccagc

SEQ ID NO: 3257649 - DNA, 15 bp, Homo sapiens
ggactcctggtgccc

SEQ ID NO: 3257650 - DNA, 15 bp, Homo sapiens
ggactctgcacatga

SEQ ID NO: 3257651 - DNA, 21 bp, Homo sapiens
ggactctgcacatgtcttgta

SEQ ID NO: 3257652 - DNA, 21 bp, Homo sapiens
ggactctgcatcccagcacct

SEQ ID NO: 3257653 - DNA, 17 bp, Homo sapiens
ggactctggatatttgc

SEQ ID NO: 3257654 - DNA, 22 bp, Homo sapiens
ggactcttctcggctcaggctc

SEQ ID NO: 3257655 - DNA, 18 bp, Homo sapiens
ggactcttgctctttcta

SEQ ID NO: 3257656 - DNA, 23 bp, Homo sapiens
ggactgagactggcacttagccc

SEQ ID NO: 3257657 - DNA, 13 bp, Homo sapiens
ggactgagatttc

SEQ ID NO: 3257658 - DNA, 20 bp, Homo sapiens
ggactgagccaaggaggcct

SEQ ID NO: 3257659 - DNA, 22 bp, Homo sapiens
ggactgagccaaggaggcctgg

SEQ ID NO: 3257660 - DNA, 13 bp, Homo sapiens
ggactgagcctgg

SEQ ID NO: 3257661 - DNA, 21 bp, Homo sapiens
ggactgagcggccgcagagac

SEQ ID NO: 3257662 - DNA, 21 bp, Homo sapiens
ggactgccagtccccctgccc

SEQ ID NO: 3257663 - DNA, 12 bp, Homo sapiens
ggactgcctctg

SEQ ID NO: 3257664 - DNA, 22 bp, Homo sapiens
ggactgcctctgccacactctg

SEQ ID NO: 3257665 - DNA, 17 bp, Homo sapiens
ggactggacacaaacag

SEQ ID NO: 3257666 - DNA, 23 bp, Homo sapiens
ggactggctagagtcctcactcc

SEQ ID NO: 3257667 - DNA, 15 bp, Homo sapiens
ggactgggggccaga

SEQ ID NO: 3257668 - DNA, 11 bp, Homo sapiens
ggactgggttt

SEQ ID NO: 3257669 - DNA, 9 bp, Homo sapiens
ggactggtg

SEQ ID NO: 3257670 - DNA, 15 bp, Homo sapiens
ggactggtgccctcc

SEQ ID NO: 3257671 - DNA, 19 bp, Homo sapiens
ggactggtggcccctgcct

SEQ ID NO: 3257672 - DNA, 14 bp, Homo sapiens
ggactgtaaagatt

SEQ ID NO: 3257673 - DNA, 18 bp, Homo sapiens
ggactgtaaagatttgtt

SEQ ID NO: 3257674 - DNA, 19 bp, Homo sapiens
ggactgtacacactttatt

SEQ ID NO: 3257675 - DNA, 20 bp, Homo sapiens
ggactgtagggagggcggca

SEQ ID NO: 3257676 - DNA, 20 bp, Homo sapiens
ggactgttccaaagccagtg

SEQ ID NO: 3257677 - DNA, 13 bp, Homo sapiens
ggactgttccagg

SEQ ID NO: 3257678 - DNA, 14 bp, Homo sapiens
ggactgttccaggc

SEQ ID NO: 3257679 - DNA, 15 bp, Homo sapiens
ggacttagaaagcag

SEQ ID NO: 3257680 - DNA, 17 bp, Homo sapiens
ggacttagaaagcaggg

SEQ ID NO: 3257681 - DNA, 18 bp, Homo sapiens
ggacttagaaagcagggg

SEQ ID NO: 3257682 - DNA, 20 bp, Homo sapiens
ggacttagaaagcaggggct

SEQ ID NO: 3257683 - DNA, 19 bp, Homo sapiens
ggacttattacaatttgtt

SEQ ID NO: 3257684 - DNA, 18 bp, Homo sapiens
ggacttccttgctctccc

SEQ ID NO: 3257685 - DNA, 17 bp, Homo sapiens
ggacttctacctgccct

SEQ ID NO: 3257686 - DNA, 15 bp, Homo sapiens
ggacttggaagctcc

SEQ ID NO: 3257687 - DNA, 16 bp, Homo sapiens
ggacttggacaggagt

SEQ ID NO: 3257688 - DNA, 15 bp, Homo sapiens
ggacttgtatatttg

SEQ ID NO: 3257689 - DNA, 19 bp, Homo sapiens
ggacttgtatatttgtaca

SEQ ID NO: 3257690 - DNA, 17 bp, Homo sapiens
ggactttatttatttct

SEQ ID NO: 3257691 - DNA, 16 bp, Homo sapiens
ggactttgcagccggc

SEQ ID NO: 3257692 - DNA, 15 bp, Homo sapiens
ggagaaaagagaaac

SEQ ID NO: 3257693 - DNA, 12 bp, Homo sapiens
ggagaaaccagc

SEQ ID NO: 3257694 - DNA, 19 bp, Homo sapiens
ggagaaactccaaagtcca

SEQ ID NO: 3257695 - DNA, 18 bp, Homo sapiens
ggagaaactgaaagtgtt

SEQ ID NO: 3257696 - DNA, 21 bp, Homo sapiens
ggagaaagaagtggagacagt

SEQ ID NO: 3257697 - DNA, 18 bp, Homo sapiens
ggagaacagtggttgcct

SEQ ID NO: 3257698 - DNA, 14 bp, Homo sapiens
ggagaagagaggag

SEQ ID NO: 3257699 - DNA, 20 bp, Homo sapiens
ggagaagaggcatcctgcct

SEQ ID NO: 3257700 - DNA, 22 bp, Homo sapiens
ggagaagaggcatcctgcctgg

SEQ ID NO: 3257701 - DNA, 23 bp, Homo sapiens
ggagaagaggcatcctgcctggg

SEQ ID NO: 3257702 - DNA, 22 bp, Homo sapiens
ggagaagcagctaacaatgtct

SEQ ID NO: 3257703 - DNA, 14 bp, Homo sapiens
ggagaagctttttt

SEQ ID NO: 3257704 - DNA, 18 bp, Homo sapiens
ggagaaggaagggcagag

SEQ ID NO: 3257705 - DNA, 12 bp, Homo sapiens
ggagaatatgat

SEQ ID NO: 3257706 - DNA, 22 bp, Homo sapiens
ggagaatggtgtgaacccggga

SEQ ID NO: 3257707 - DNA, 17 bp, Homo sapiens
ggagacagaatagagtg

SEQ ID NO: 3257708 - DNA, 13 bp, Homo sapiens
ggagacagaccac

SEQ ID NO: 3257709 - DNA, 17 bp, Homo sapiens
ggagacagcatcagggt

SEQ ID NO: 3257710 - DNA, 17 bp, Homo sapiens
ggagacagccccagagc

SEQ ID NO: 3257711 - DNA, 22 bp, Homo sapiens
ggagaccctgcaaacagaacag

SEQ ID NO: 3257712 - DNA, 12 bp, Homo sapiens
ggagaccctgga

SEQ ID NO: 3257713 - DNA, 21 bp, Homo sapiens
ggagaccgcttcacccctgca

SEQ ID NO: 3257714 - DNA, 21 bp, Homo sapiens
ggagacctctccttcctaccc

SEQ ID NO: 3257715 - DNA, 22 bp, Homo sapiens
ggagacgtttataaacagaaat

SEQ ID NO: 3257716 - DNA, 16 bp, Homo sapiens
ggagactaagccctgt

SEQ ID NO: 3257717 - DNA, 10 bp, Homo sapiens
ggagactaga

SEQ ID NO: 3257718 - DNA, 15 bp, Homo sapiens
ggagactatggcctc

SEQ ID NO: 3257719 - DNA, 16 bp, Homo sapiens
ggagactatggcctcg

SEQ ID NO: 3257720 - DNA, 12 bp, Homo sapiens
ggagactcctgc

SEQ ID NO: 3257721 - DNA, 20 bp, Homo sapiens
ggagactctgtggggccttg

SEQ ID NO: 3257722 - DNA, 18 bp, Homo sapiens
ggagactgcttcccatcc

SEQ ID NO: 3257723 - DNA, 19 bp, Homo sapiens
ggagactgcttcccatcct

SEQ ID NO: 3257724 - DNA, 23 bp, Homo sapiens
ggagactgcttcccatcctaccc

SEQ ID NO: 3257725 - DNA, 12 bp, Homo sapiens
ggagactggcag

SEQ ID NO: 3257726 - DNA, 15 bp, Homo sapiens
ggagactggcaggcg

SEQ ID NO: 3257727 - DNA, 16 bp, Homo sapiens
ggagactggcaggcgg

SEQ ID NO: 3257728 - DNA, 18 bp, Homo sapiens
ggagactggggggcttga

SEQ ID NO: 3257729 - DNA, 16 bp, Homo sapiens
ggagactgtctcaaga

SEQ ID NO: 3257730 - DNA, 13 bp, Homo sapiens
ggagagaaaaaag

SEQ ID NO: 3257731 - DNA, 15 bp, Homo sapiens
ggagagaaaaaagaa

SEQ ID NO: 3257732 - DNA, 13 bp, Homo sapiens
ggagagacctcat

SEQ ID NO: 3257733 - DNA, 13 bp, Homo sapiens
ggagagacgtgca

SEQ ID NO: 3257734 - DNA, 11 bp, Homo sapiens
ggagagagaaa

SEQ ID NO: 3257735 - DNA, 12 bp, Homo sapiens
ggagagagaaag

SEQ ID NO: 3257736 - DNA, 14 bp, Homo sapiens
ggagagagaaagcc

SEQ ID NO: 3257737 - DNA, 20 bp, Homo sapiens
ggagagagaaagccaggcag

SEQ ID NO: 3257738 - DNA, 19 bp, Homo sapiens
ggagagagagagagagagg

SEQ ID NO: 3257739 - DNA, 12 bp, Homo sapiens
ggagagagccag

SEQ ID NO: 3257740 - DNA, 18 bp, Homo sapiens
ggagagaggcagagagcg

SEQ ID NO: 3257741 - DNA, 14 bp, Homo sapiens
ggagagaggggaat

SEQ ID NO: 3257742 - DNA, 21 bp, Homo sapiens
ggagagaggggaataatagaa

SEQ ID NO: 3257743 - DNA, 14 bp, Homo sapiens
ggagagcagcagca

SEQ ID NO: 3257744 - DNA, 23 bp, Homo sapiens
ggagagcaggctggcagctctcc

SEQ ID NO: 3257745 - DNA, 17 bp, Homo sapiens
ggagagccaacctcggc

SEQ ID NO: 3257746 - DNA, 17 bp, Homo sapiens
ggagagcccctggggcc

SEQ ID NO: 3257747 - DNA, 18 bp, Homo sapiens
ggagagctggtgcccgga

SEQ ID NO: 3257748 - DNA, 12 bp, Homo sapiens
ggagaggagaga

SEQ ID NO: 3257749 - DNA, 13 bp, Homo sapiens
ggagaggagagag

SEQ ID NO: 3257750 - DNA, 14 bp, Homo sapiens
ggagaggagagagg

SEQ ID NO: 3257751 - DNA, 11 bp, Homo sapiens
ggacacagctc

SEQ ID NO: 3257752 - DNA, 21 bp, Homo sapiens
ggacacagctcttctccaggc

SEQ ID NO: 3257753 - DNA, 15 bp, Homo sapiens
ggacacagtggagcc

SEQ ID NO: 3257754 - DNA, 14 bp, Homo sapiens
ggacacagttcctg

SEQ ID NO: 3257755 - DNA, 16 bp, Homo sapiens
ggacacagttcctggg

SEQ ID NO: 3257756 - DNA, 14 bp, Homo sapiens
ggacacatcccggc

SEQ ID NO: 3257757 - DNA, 15 bp, Homo sapiens
ggacacatcccggcc

SEQ ID NO: 3257758 - DNA, 17 bp, Homo sapiens
ggacacatcccggcctc

SEQ ID NO: 3257759 - DNA, 19 bp, Homo sapiens
ggacacatcccggcctctt

SEQ ID NO: 3257760 - DNA, 20 bp, Homo sapiens
ggacacatcccggcctcttc

SEQ ID NO: 3257761 - DNA, 17 bp, Homo sapiens
ggacaccacacccagcc

SEQ ID NO: 3257762 - DNA, 19 bp, Homo sapiens
ggacaccacacccagcctc

SEQ ID NO: 3257763 - DNA, 20 bp, Homo sapiens
ggacaccacacccagcctca

SEQ ID NO: 3257764 - DNA, 22 bp, Homo sapiens
ggacaccacacccagcctcagt

SEQ ID NO: 3257765 - DNA, 16 bp, Homo sapiens
ggacaccagtgaaaga

SEQ ID NO: 3257766 - DNA, 14 bp, Homo sapiens
ggacacccctgctc

SEQ ID NO: 3257767 - DNA, 17 bp, Homo sapiens
ggacacccctgctctac

SEQ ID NO: 3257768 - DNA, 14 bp, Homo sapiens
ggacacctgccctg

SEQ ID NO: 3257769 - DNA, 14 bp, Homo sapiens
ggacactccagtgc

SEQ ID NO: 3257770 - DNA, 21 bp, Homo sapiens
ggacactccagtgccagcaat

SEQ ID NO: 3257771 - DNA, 18 bp, Homo sapiens
ggacacttaacagatgca

SEQ ID NO: 3257772 - DNA, 16 bp, Homo sapiens
ggacagacccaggtct

SEQ ID NO: 3257773 - DNA, 17 bp, Homo sapiens
ggacagacccaggtctt

SEQ ID NO: 3257774 - DNA, 18 bp, Homo sapiens
ggacagacccaggtcttc

SEQ ID NO: 3257775 - DNA, 20 bp, Homo sapiens
ggacagacccaggtcttcca

SEQ ID NO: 3257776 - DNA, 18 bp, Homo sapiens
ggacagactggccgggca

SEQ ID NO: 3257777 - DNA, 19 bp, Homo sapiens
ggacagactggccgggcag

SEQ ID NO: 3257778 - DNA, 20 bp, Homo sapiens
ggacagactggccgggcagg

SEQ ID NO: 3257779 - DNA, 17 bp, Homo sapiens
ggacagagcaggggctc

SEQ ID NO: 3257780 - DNA, 16 bp, Homo sapiens
ggacagagttcacagg

SEQ ID NO: 3257781 - DNA, 18 bp, Homo sapiens
ggacagagttcacaggag

SEQ ID NO: 3257782 - DNA, 23 bp, Homo sapiens
ggacagagttcacaggaggccag

SEQ ID NO: 3257783 - DNA, 21 bp, Homo sapiens
ggacagcatgccccttggctg

SEQ ID NO: 3257784 - DNA, 15 bp, Homo sapiens
ggacagccacggcca

SEQ ID NO: 3257785 - DNA, 21 bp, Homo sapiens
ggacagccacggccaggccag

SEQ ID NO: 3257786 - DNA, 14 bp, Homo sapiens
ggacagcccactga

SEQ ID NO: 3257787 - DNA, 15 bp, Homo sapiens
ggacagcccatctgc

SEQ ID NO: 3257788 - DNA, 11 bp, Homo sapiens
ggacagccccc

SEQ ID NO: 3257789 - DNA, 14 bp, Homo sapiens
ggacagcctccgcc

SEQ ID NO: 3257790 - DNA, 22 bp, Homo sapiens
ggacagcctcttcagccccttc

SEQ ID NO: 3257791 - DNA, 23 bp, Homo sapiens
ggacagcctcttcagccccttct

SEQ ID NO: 3257792 - DNA, 19 bp, Homo sapiens
ggacagctgactgaatgca

SEQ ID NO: 3257793 - DNA, 19 bp, Homo sapiens
ggacagcttgagccgggcc

SEQ ID NO: 3257794 - DNA, 22 bp, Homo sapiens
ggacagctttgctccgctccca

SEQ ID NO: 3257795 - DNA, 17 bp, Homo sapiens
ggacaggaccctcagga

SEQ ID NO: 3257796 - DNA, 19 bp, Homo sapiens
ggacaggaggcggcccggc

SEQ ID NO: 3257797 - DNA, 15 bp, Homo sapiens
ggacaggagtcagtg

SEQ ID NO: 3257798 - DNA, 15 bp, Homo sapiens
ggacaggcaggccag

SEQ ID NO: 3257799 - DNA, 13 bp, Homo sapiens
ggacaggcccagc

SEQ ID NO: 3257800 - DNA, 20 bp, Homo sapiens
ggacaggcccagcgcggcca

SEQ ID NO: 3257801 - DNA, 19 bp, Homo sapiens
ggacaggctgaagagaggg

SEQ ID NO: 3257802 - DNA, 22 bp, Homo sapiens
ggacagggcatggccaggtggc

SEQ ID NO: 3257803 - DNA, 22 bp, Homo sapiens
ggacagggtcttttttcatttc

SEQ ID NO: 3257804 - DNA, 12 bp, Homo sapiens
ggacagtcactg

SEQ ID NO: 3257805 - DNA, 16 bp, Homo sapiens
ggacagtcctgggaga

SEQ ID NO: 3257806 - DNA, 22 bp, Homo sapiens
ggacagtgataggcccaaggtc

SEQ ID NO: 3257807 - DNA, 17 bp, Homo sapiens
ggacagtgcttcagcct

SEQ ID NO: 3257808 - DNA, 22 bp, Homo sapiens
ggacagtgcttcagcctgaggc

SEQ ID NO: 3257809 - DNA, 23 bp, Homo sapiens
ggacagtgcttcagcctgaggct

SEQ ID NO: 3257810 - DNA, 19 bp, Homo sapiens
ggacagttcacaccctgca

SEQ ID NO: 3257811 - DNA, 15 bp, Homo sapiens
ggacagttggcagag

SEQ ID NO: 3257812 - DNA, 16 bp, Homo sapiens
ggacagttggcagaga

SEQ ID NO: 3257813 - DNA, 18 bp, Homo sapiens
ggacagttggcagagaag

SEQ ID NO: 3257814 - DNA, 19 bp, Homo sapiens
ggacatactctctgcctgg

SEQ ID NO: 3257815 - DNA, 17 bp, Homo sapiens
ggacatgctcacctcta

SEQ ID NO: 3257816 - DNA, 16 bp, Homo sapiens
ggaccaagcatcttgg

SEQ ID NO: 3257817 - DNA, 17 bp, Homo sapiens
ggaccaaggcaaggcag

SEQ ID NO: 3257818 - DNA, 19 bp, Homo sapiens
ggaccaaggcaaggcaggt

SEQ ID NO: 3257819 - DNA, 23 bp, Homo sapiens
ggaccaaggcaaggcaggtgcct

SEQ ID NO: 3257820 - DNA, 19 bp, Homo sapiens
ggaccacacagtccccaga

SEQ ID NO: 3257821 - DNA, 21 bp, Homo sapiens
ggaccactcagcccctaggag

SEQ ID NO: 3257822 - DNA, 19 bp, Homo sapiens
ggaccagaagccaaagact

SEQ ID NO: 3257823 - DNA, 12 bp, Homo sapiens
ggaccagagcca

SEQ ID NO: 3257824 - DNA, 15 bp, Homo sapiens
ggaccaggctgtagg

SEQ ID NO: 3257825 - DNA, 20 bp, Homo sapiens
ggaccagtggtttccagtca

SEQ ID NO: 3257826 - DNA, 22 bp, Homo sapiens
ggaccagtggtttccagtcatg

SEQ ID NO: 3257827 - DNA, 19 bp, Homo sapiens
ggacccaaaacacaggaag

SEQ ID NO: 3257828 - DNA, 10 bp, Homo sapiens
ggacccacca

SEQ ID NO: 3257829 - DNA, 22 bp, Homo sapiens
ggacccacccatcttcctgctg

SEQ ID NO: 3257830 - DNA, 13 bp, Homo sapiens
ggacccagctact

SEQ ID NO: 3257831 - DNA, 14 bp, Homo sapiens
ggacccagctactc

SEQ ID NO: 3257832 - DNA, 20 bp, Homo sapiens
ggacccatagatcttctgaa

SEQ ID NO: 3257833 - DNA, 20 bp, Homo sapiens
ggaccccagctgggaggcaa

SEQ ID NO: 3257834 - DNA, 21 bp, Homo sapiens
ggaccccagctgggaggcaag

SEQ ID NO: 3257835 - DNA, 21 bp, Homo sapiens
ggaccccagctgtgagccttg

SEQ ID NO: 3257836 - DNA, 21 bp, Homo sapiens
ggacccccacgattggccacc

SEQ ID NO: 3257837 - DNA, 13 bp, Homo sapiens
ggacccccagctt

SEQ ID NO: 3257838 - DNA, 20 bp, Homo sapiens
ggacccggaggggcctggca

SEQ ID NO: 3257839 - DNA, 12 bp, Homo sapiens
ggaccctgtccg

SEQ ID NO: 3257840 - DNA, 16 bp, Homo sapiens
ggaccctgtgacatgg

SEQ ID NO: 3257841 - DNA, 24 bp, Homo sapiens
ggacccttaggatggggctcccag

SEQ ID NO: 3257842 - DNA, 18 bp, Homo sapiens
ggaccgggtgggcctggc

SEQ ID NO: 3257843 - DNA, 20 bp, Homo sapiens
ggaccgggtgggcctggcct

SEQ ID NO: 3257844 - DNA, 15 bp, Homo sapiens
ggaccgtggacaggc

SEQ ID NO: 3257845 - DNA, 20 bp, Homo sapiens
ggaccgtggccctgccctct

SEQ ID NO: 3257846 - DNA, 17 bp, Homo sapiens
ggacctaaatggcctca

SEQ ID NO: 3257847 - DNA, 22 bp, Homo sapiens
ggacctaacattcgatctcatt

SEQ ID NO: 3257848 - DNA, 17 bp, Homo sapiens
ggacctatgtcctaagg

SEQ ID NO: 3257849 - DNA, 11 bp, Homo sapiens
ggacctccctt

SEQ ID NO: 3257850 - DNA, 17 bp, Homo sapiens
ggacctcccttccgacc

SEQ ID NO: 3257851 - DNA, 23 bp, Homo sapiens
ggacctcctcttcccccttccaa

SEQ ID NO: 3257852 - DNA, 16 bp, Homo sapiens
ggacctctcagcagaa

SEQ ID NO: 3257853 - DNA, 20 bp, Homo sapiens
ggacctctcagcagaaacac

SEQ ID NO: 3257854 - DNA, 17 bp, Homo sapiens
ggacctgaaatttaaac

SEQ ID NO: 3257855 - DNA, 16 bp, Homo sapiens
ggacctgttttcttca

SEQ ID NO: 3257856 - DNA, 15 bp, Homo sapiens
ggaccttatctgtgc

SEQ ID NO: 3257857 - DNA, 22 bp, Homo sapiens
ggaccttatctgtgcgtgaaac

SEQ ID NO: 3257858 - DNA, 17 bp, Homo sapiens
ggaccttcgggctgtgc

SEQ ID NO: 3257859 - DNA, 20 bp, Homo sapiens
ggaccttcgggctgtgcccg

SEQ ID NO: 3257860 - DNA, 13 bp, Homo sapiens
ggaccttggtctg

SEQ ID NO: 3257861 - DNA, 14 bp, Homo sapiens
ggaccttggtctga

SEQ ID NO: 3257862 - DNA, 21 bp, Homo sapiens
ggacgcaccgccgccaccagc

SEQ ID NO: 3257863 - DNA, 22 bp, Homo sapiens
ggacgcaccgccgccaccagcc

SEQ ID NO: 3257864 - DNA, 23 bp, Homo sapiens
ggacgcacgctcgctgccatcac

SEQ ID NO: 3257865 - DNA, 24 bp, Homo sapiens
ggacgcacgctcgctgccatcacc

SEQ ID NO: 3257866 - DNA, 14 bp, Homo sapiens
ggacgctctctggc

SEQ ID NO: 3257867 - DNA, 18 bp, Homo sapiens
ggagaggagagaggcaga

SEQ ID NO: 3257868 - DNA, 13 bp, Homo sapiens
ggagaggatgaga

SEQ ID NO: 3257869 - DNA, 22 bp, Homo sapiens
ggagaggatgagagcccagagg

SEQ ID NO: 3257870 - DNA, 21 bp, Homo sapiens
ggagaggcagcatgcttgggc

SEQ ID NO: 3257871 - DNA, 21 bp, Homo sapiens
ggagaggcggcctcgtgccat

SEQ ID NO: 3257872 - DNA, 16 bp, Homo sapiens
ggagaggctgtctggg

SEQ ID NO: 3257873 - DNA, 13 bp, Homo sapiens
ggagagggaggtc

SEQ ID NO: 3257874 - DNA, 23 bp, Homo sapiens
ggagagggatacaagagaggaga

SEQ ID NO: 3257875 - DNA, 17 bp, Homo sapiens
ggagaggggtgcaccca

SEQ ID NO: 3257876 - DNA, 18 bp, Homo sapiens
ggagagtcttgggcctgg

SEQ ID NO: 3257877 - DNA, 21 bp, Homo sapiens
ggagagtggttgttgccaact

SEQ ID NO: 3257878 - DNA, 22 bp, Homo sapiens
ggagagttcaagcctgtgggag

SEQ ID NO: 3257879 - DNA, 13 bp, Homo sapiens
ggagagtttgcct

SEQ ID NO: 3257880 - DNA, 19 bp, Homo sapiens
ggagatagatgactttgca

SEQ ID NO: 3257881 - DNA, 13 bp, Homo sapiens
ggagatcctcctg

SEQ ID NO: 3257882 - DNA, 15 bp, Homo sapiens
ggagatcctcctgca

SEQ ID NO: 3257883 - DNA, 18 bp, Homo sapiens
ggagatgaccagggatgc

SEQ ID NO: 3257884 - DNA, 23 bp, Homo sapiens
ggagatgagttttaggaccagca

SEQ ID NO: 3257885 - DNA, 20 bp, Homo sapiens
ggagatgcatcgggaaagaa

SEQ ID NO: 3257886 - DNA, 15 bp, Homo sapiens
ggagatggagggctt

SEQ ID NO: 3257887 - DNA, 20 bp, Homo sapiens
ggagattgagaaggagagaa

SEQ ID NO: 3257888 - DNA, 14 bp, Homo sapiens
ggagcaaaaggcag

SEQ ID NO: 3257889 - DNA, 19 bp, Homo sapiens
ggagcaaaaggcagctcac

SEQ ID NO: 3257890 - DNA, 20 bp, Homo sapiens
ggagcaaaatcgatgcagtg

SEQ ID NO: 3257891 - DNA, 13 bp, Homo sapiens
ggagcacagccct

SEQ ID NO: 3257892 - DNA, 13 bp, Homo sapiens
ggagcacaggcag

SEQ ID NO: 3257893 - DNA, 19 bp, Homo sapiens
ggagcacctgaaccccatg

SEQ ID NO: 3257894 - DNA, 10 bp, Homo sapiens
ggagcagaaa

SEQ ID NO: 3257895 - DNA, 18 bp, Homo sapiens
ggagcagcctggagaccc

SEQ ID NO: 3257896 - DNA, 21 bp, Homo sapiens
ggagcaggagattgagaagga

SEQ ID NO: 3257897 - DNA, 23 bp, Homo sapiens
ggagcaggagattgagaaggaga

SEQ ID NO: 3257898 - DNA, 19 bp, Homo sapiens
ggagcaggaggccaataaa

SEQ ID NO: 3257899 - DNA, 21 bp, Homo sapiens
ggagcagggaaggcctgactt

SEQ ID NO: 3257900 - DNA, 13 bp, Homo sapiens
ggagcagtgtctt

SEQ ID NO: 3257901 - DNA, 16 bp, Homo sapiens
ggagcagttttcccct

SEQ ID NO: 3257902 - DNA, 19 bp, Homo sapiens
ggagcagttttcccctggc

SEQ ID NO: 3257903 - DNA, 22 bp, Homo sapiens
ggagcatagcagaggggccagg

SEQ ID NO: 3257904 - DNA, 23 bp, Homo sapiens
ggagcatagcagaggggccaggc

SEQ ID NO: 3257905 - DNA, 17 bp, Homo sapiens
ggagcatgcagaggagg

SEQ ID NO: 3257906 - DNA, 20 bp, Homo sapiens
ggagcatttaatggcagcta

SEQ ID NO: 3257907 - DNA, 23 bp, Homo sapiens
ggagcatttaatggcagctagtg

SEQ ID NO: 3257908 - DNA, 24 bp, Homo sapiens
ggagcatttaatggcagctagtgc

SEQ ID NO: 3257909 - DNA, 16 bp, Homo sapiens
ggagccaactgctgct

SEQ ID NO: 3257910 - DNA, 17 bp, Homo sapiens
ggagccaactgctgctt

SEQ ID NO: 3257911 - DNA, 16 bp, Homo sapiens
ggagccaatggagact

SEQ ID NO: 3257912 - DNA, 13 bp, Homo sapiens
ggagccagacaga

SEQ ID NO: 3257913 - DNA, 15 bp, Homo sapiens
ggagccagcctccct

SEQ ID NO: 3257914 - DNA, 12 bp, Homo sapiens
ggagccagctct

SEQ ID NO: 3257915 - DNA, 14 bp, Homo sapiens
ggagccatttgaga

SEQ ID NO: 3257916 - DNA, 13 bp, Homo sapiens
ggagcccacaacc

SEQ ID NO: 3257917 - DNA, 14 bp, Homo sapiens
ggagcccacaacct

SEQ ID NO: 3257918 - DNA, 16 bp, Homo sapiens
ggagcccacactgcca

SEQ ID NO: 3257919 - DNA, 12 bp, Homo sapiens
ggagcccagcct

SEQ ID NO: 3257920 - DNA, 13 bp, Homo sapiens
ggagcccagcctg

SEQ ID NO: 3257921 - DNA, 17 bp, Homo sapiens
ggagcccagcctgggag

SEQ ID NO: 3257922 - DNA, 19 bp, Homo sapiens
ggagcccagcctgggagcc

SEQ ID NO: 3257923 - DNA, 19 bp, Homo sapiens
ggagcccatactcagcctg

SEQ ID NO: 3257924 - DNA, 13 bp, Homo sapiens
ggagccccaggcc

SEQ ID NO: 3257925 - DNA, 14 bp, Homo sapiens
ggagccccaggcct

SEQ ID NO: 3257926 - DNA, 14 bp, Homo sapiens
ggagccccagggtc

SEQ ID NO: 3257927 - DNA, 20 bp, Homo sapiens
ggagccccagggtcttccct

SEQ ID NO: 3257928 - DNA, 15 bp, Homo sapiens
ggagcccccagatag

SEQ ID NO: 3257929 - DNA, 14 bp, Homo sapiens
ggagcccctgggtg

SEQ ID NO: 3257930 - DNA, 21 bp, Homo sapiens
ggagcccctgggtgggtggtg

SEQ ID NO: 3257931 - DNA, 22 bp, Homo sapiens
ggagcccctgggtgggtggtgg

SEQ ID NO: 3257932 - DNA, 21 bp, Homo sapiens
ggagcccgaagtctgctgctg

SEQ ID NO: 3257933 - DNA, 16 bp, Homo sapiens
ggagcccgtctcagtg

SEQ ID NO: 3257934 - DNA, 17 bp, Homo sapiens
ggagccctccctatgtc

SEQ ID NO: 3257935 - DNA, 12 bp, Homo sapiens
ggagccctgacc

SEQ ID NO: 3257936 - DNA, 19 bp, Homo sapiens
ggagccctgaccttggctg

SEQ ID NO: 3257937 - DNA, 22 bp, Homo sapiens
ggagccctgaccttggctgact

SEQ ID NO: 3257938 - DNA, 20 bp, Homo sapiens
ggagccctgttggcagctct

SEQ ID NO: 3257939 - DNA, 16 bp, Homo sapiens
ggagcccttggcccct

SEQ ID NO: 3257940 - DNA, 17 bp, Homo sapiens
ggagcccttggcccctc

SEQ ID NO: 3257941 - DNA, 21 bp, Homo sapiens
ggagccgagatcacgccactg

SEQ ID NO: 3257942 - DNA, 17 bp, Homo sapiens
ggagcctagcggagccc

SEQ ID NO: 3257943 - DNA, 15 bp, Homo sapiens
ggagcctagctcctg

SEQ ID NO: 3257944 - DNA, 16 bp, Homo sapiens
ggagcctagctcctgc

SEQ ID NO: 3257945 - DNA, 15 bp, Homo sapiens
ggagcctcctgccca

SEQ ID NO: 3257946 - DNA, 13 bp, Homo sapiens
ggagcctggcaca

SEQ ID NO: 3257947 - DNA, 14 bp, Homo sapiens
ggagcctggcacag

SEQ ID NO: 3257948 - DNA, 19 bp, Homo sapiens
ggagcctggcacaggactg

SEQ ID NO: 3257949 - DNA, 22 bp, Homo sapiens
ggagcctgtgcgtcccagctga

SEQ ID NO: 3257950 - DNA, 15 bp, Homo sapiens
ggagcgcacctgccc

SEQ ID NO: 3257951 - DNA, 19 bp, Homo sapiens
ggagcggaggttgcagtga

SEQ ID NO: 3257952 - DNA, 19 bp, Homo sapiens
ggagcggccgcctgcgggc

SEQ ID NO: 3257953 - DNA, 19 bp, Homo sapiens
ggagcggcgccctggactt

SEQ ID NO: 3257954 - DNA, 15 bp, Homo sapiens
ggagctcaccctgcc

SEQ ID NO: 3257955 - DNA, 15 bp, Homo sapiens
ggagctcctggccag

SEQ ID NO: 3257956 - DNA, 18 bp, Homo sapiens
ggagctcctggccaggat

SEQ ID NO: 3257957 - DNA, 21 bp, Homo sapiens
ggagctctaccctgctccctg

SEQ ID NO: 3257958 - DNA, 22 bp, Homo sapiens
ggagctgagctggaaggggcca

SEQ ID NO: 3257959 - DNA, 17 bp, Homo sapiens
ggagctgatttccaggc

SEQ ID NO: 3257960 - DNA, 22 bp, Homo sapiens
ggagctgatttccaggcccctg

SEQ ID NO: 3257961 - DNA, 13 bp, Homo sapiens
ggagctgccacag

SEQ ID NO: 3257962 - DNA, 16 bp, Homo sapiens
ggagctgcctgcttgg

SEQ ID NO: 3257963 - DNA, 21 bp, Homo sapiens
ggagctgcctgcttggcccgg

SEQ ID NO: 3257964 - DNA, 22 bp, Homo sapiens
ggagctgcctgcttggcccggc

SEQ ID NO: 3257965 - DNA, 23 bp, Homo sapiens
ggagctgcctgcttggcccggcc

SEQ ID NO: 3257966 - DNA, 17 bp, Homo sapiens
ggagctgccttggctca

SEQ ID NO: 3257967 - DNA, 21 bp, Homo sapiens
ggagctgccttggctcagaca

SEQ ID NO: 3257968 - DNA, 23 bp, Homo sapiens
ggagctgctggcttgcagtgcgc

SEQ ID NO: 3257969 - DNA, 17 bp, Homo sapiens
ggagctgggcccctgca

SEQ ID NO: 3257970 - DNA, 13 bp, Homo sapiens
ggagcttccgctt

SEQ ID NO: 3257971 - DNA, 20 bp, Homo sapiens
ggagctttcaaagaaggaat

SEQ ID NO: 3257972 - DNA, 21 bp, Homo sapiens
ggagcttttttccttaatcca

SEQ ID NO: 3257973 - DNA, 17 bp, Homo sapiens
ggaggaaaaaagaacca

SEQ ID NO: 3257974 - DNA, 23 bp, Homo sapiens
ggaggaaatttgaatgggtccat

SEQ ID NO: 3257975 - DNA, 10 bp, Homo sapiens
ggaggaaggg

SEQ ID NO: 3257976 - DNA, 16 bp, Homo sapiens
ggaggaatgctggact

SEQ ID NO: 3257977 - DNA, 18 bp, Homo sapiens
ggaggacaggcaggccag

SEQ ID NO: 3257978 - DNA, 12 bp, Homo sapiens
ggaggaccttat

SEQ ID NO: 3257979 - DNA, 16 bp, Homo sapiens
ggaggacgctctctgg

SEQ ID NO: 3257980 - DNA, 13 bp, Homo sapiens
ggaggactggacc

SEQ ID NO: 3257981 - DNA, 19 bp, Homo sapiens
ggaggagagagaccccgca

SEQ ID NO: 3257982 - DNA, 13 bp, Homo sapiens
ggaggagctgcct

SEQ ID NO: 3257983 - DNA, 13 bp, Homo sapiens
ggaggaggaaggc

SEQ ID NO: 3257984 - DNA, 20 bp, Homo sapiens
ggaggaggaccctggaaatg

SEQ ID NO: 3257985 - DNA, 13 bp, Homo sapiens
ggaggaggaggga

SEQ ID NO: 3257986 - DNA, 15 bp, Homo sapiens
ggaggaggagggaga

SEQ ID NO: 3257987 - DNA, 19 bp, Homo sapiens
ggaggaggccacctctcca

SEQ ID NO: 3257988 - DNA, 22 bp, Homo sapiens
ggaggaggccacctctccaagg

SEQ ID NO: 3257989 - DNA, 16 bp, Homo sapiens
ggaggatcactggagc

SEQ ID NO: 3257990 - DNA, 19 bp, Homo sapiens
ggaggatcactggagccca

SEQ ID NO: 3257991 - DNA, 20 bp, Homo sapiens
ggaggatcactggagcccag

SEQ ID NO: 3257992 - DNA, 18 bp, Homo sapiens
ggaggatcagttttttgt

SEQ ID NO: 3257993 - DNA, 20 bp, Homo sapiens
ggaggcaagaaaaggacaaa

SEQ ID NO: 3257994 - DNA, 19 bp, Homo sapiens
ggaggcaagaggggtggag

SEQ ID NO: 3257995 - DNA, 12 bp, Homo sapiens
ggaggcaccagc

SEQ ID NO: 3257996 - DNA, 13 bp, Homo sapiens
ggaagagcagcct

SEQ ID NO: 3257997 - DNA, 15 bp, Homo sapiens
ggaagagcagcctga

SEQ ID NO: 3257998 - DNA, 16 bp, Homo sapiens
ggaagagcaggactcc

SEQ ID NO: 3257999 - DNA, 23 bp, Homo sapiens
ggaagagcaggactccaggccca

SEQ ID NO: 3258000 - DNA, 15 bp, Homo sapiens
ggaagagcaggcaca

SEQ ID NO: 3258001 - DNA, 17 bp, Homo sapiens
ggaagagccgagcacct

SEQ ID NO: 3258002 - DNA, 13 bp, Homo sapiens
ggaagagtttttg

SEQ ID NO: 3258003 - DNA, 21 bp, Homo sapiens
ggaagataggctctgcacaga

SEQ ID NO: 3258004 - DNA, 12 bp, Homo sapiens
ggaagatcctgc

SEQ ID NO: 3258005 - DNA, 22 bp, Homo sapiens
ggaagatgggggcaagaagatc

SEQ ID NO: 3258006 - DNA, 20 bp, Homo sapiens
ggaagatttgcccatttaca

SEQ ID NO: 3258007 - DNA, 17 bp, Homo sapiens
ggaagcacagcttcatt

SEQ ID NO: 3258008 - DNA, 19 bp, Homo sapiens
ggaagcagtgccttccata

SEQ ID NO: 3258009 - DNA, 22 bp, Homo sapiens
ggaagcatagatatctatattt

SEQ ID NO: 3258010 - DNA, 20 bp, Homo sapiens
ggaagcatgtgacacccaca

SEQ ID NO: 3258011 - DNA, 22 bp, Homo sapiens
ggaagccaaaatgtaggcttag

SEQ ID NO: 3258012 - DNA, 16 bp, Homo sapiens
ggaagccagctttccc

SEQ ID NO: 3258013 - DNA, 11 bp, Homo sapiens
ggaagccaggt

SEQ ID NO: 3258014 - DNA, 14 bp, Homo sapiens
ggaagcccctgggc

SEQ ID NO: 3258015 - DNA, 19 bp, Homo sapiens
ggaagcccctgggcccagt

SEQ ID NO: 3258016 - DNA, 18 bp, Homo sapiens
ggaagccgtctgactcca

SEQ ID NO: 3258017 - DNA, 14 bp, Homo sapiens
ggaagcctgcagtc

SEQ ID NO: 3258018 - DNA, 20 bp, Homo sapiens
ggaagcggaggttgcaggga

SEQ ID NO: 3258019 - DNA, 21 bp, Homo sapiens
ggaagcggccctaagggagtg

SEQ ID NO: 3258020 - DNA, 20 bp, Homo sapiens
ggaagctcttggagctgtga

SEQ ID NO: 3258021 - DNA, 21 bp, Homo sapiens
ggaagctcttggagctgtgag

SEQ ID NO: 3258022 - DNA, 11 bp, Homo sapiens
ggaagctgcag

SEQ ID NO: 3258023 - DNA, 15 bp, Homo sapiens
ggaagctgcagcttg

SEQ ID NO: 3258024 - DNA, 19 bp, Homo sapiens
ggaagctgccagcccagaa

SEQ ID NO: 3258025 - DNA, 17 bp, Homo sapiens
ggaagctgccctgccca

SEQ ID NO: 3258026 - DNA, 15 bp, Homo sapiens
ggaagctggcctgag

SEQ ID NO: 3258027 - DNA, 23 bp, Homo sapiens
ggaagctgtactcagagcagagc

SEQ ID NO: 3258028 - DNA, 20 bp, Homo sapiens
ggaagcttgagcctccccca

SEQ ID NO: 3258029 - DNA, 15 bp, Homo sapiens
ggaaggaaaactatg

SEQ ID NO: 3258030 - DNA, 15 bp, Homo sapiens
ggaaggacagactgg

SEQ ID NO: 3258031 - DNA, 14 bp, Homo sapiens
ggaaggagagcctg

SEQ ID NO: 3258032 - DNA, 17 bp, Homo sapiens
ggaaggagagcctgctg

SEQ ID NO: 3258033 - DNA, 12 bp, Homo sapiens
ggaaggagccag

SEQ ID NO: 3258034 - DNA, 13 bp, Homo sapiens
ggaaggagccagt

SEQ ID NO: 3258035 - DNA, 21 bp, Homo sapiens
ggaaggagcggcgccctggac

SEQ ID NO: 3258036 - DNA, 19 bp, Homo sapiens
ggaaggaggggaagctgca

SEQ ID NO: 3258037 - DNA, 13 bp, Homo sapiens
ggaaggattgtaa

SEQ ID NO: 3258038 - DNA, 18 bp, Homo sapiens
ggaaggcagacagcaggc

SEQ ID NO: 3258039 - DNA, 22 bp, Homo sapiens
ggaaggcagacagcaggcagcg

SEQ ID NO: 3258040 - DNA, 15 bp, Homo sapiens
ggaaggcagagaaat

SEQ ID NO: 3258041 - DNA, 14 bp, Homo sapiens
ggaaggcagggcag

SEQ ID NO: 3258042 - DNA, 14 bp, Homo sapiens
ggaaggcctgggtg

SEQ ID NO: 3258043 - DNA, 13 bp, Homo sapiens
ggaaggctggctg

SEQ ID NO: 3258044 - DNA, 17 bp, Homo sapiens
ggaaggctggctgggca

SEQ ID NO: 3258045 - DNA, 15 bp, Homo sapiens
ggaagggaaagtttt

SEQ ID NO: 3258046 - DNA, 23 bp, Homo sapiens
ggaagggattggtttggcaagaa

SEQ ID NO: 3258047 - DNA, 11 bp, Homo sapiens
ggaagggccag

SEQ ID NO: 3258048 - DNA, 21 bp, Homo sapiens
ggaagggccagtctgggctgc

SEQ ID NO: 3258049 - DNA, 16 bp, Homo sapiens
ggaaggggccttgctg

SEQ ID NO: 3258050 - DNA, 23 bp, Homo sapiens
ggaaggtgaagatgaagaagcct

SEQ ID NO: 3258051 - DNA, 15 bp, Homo sapiens
ggaaggtggggccct

SEQ ID NO: 3258052 - DNA, 18 bp, Homo sapiens
ggaaggtttgtatattgt

SEQ ID NO: 3258053 - DNA, 18 bp, Homo sapiens
ggaagtacatgaatacaa

SEQ ID NO: 3258054 - DNA, 17 bp, Homo sapiens
ggaagtacttccctcag

SEQ ID NO: 3258055 - DNA, 14 bp, Homo sapiens
ggaagtctacctgc

SEQ ID NO: 3258056 - DNA, 22 bp, Homo sapiens
ggaagtctacctgctggacagc

SEQ ID NO: 3258057 - DNA, 17 bp, Homo sapiens
ggaagtggctgtccctg

SEQ ID NO: 3258058 - DNA, 22 bp, Homo sapiens
ggaagtgttcaagaaataaaaa

SEQ ID NO: 3258059 - DNA, 17 bp, Homo sapiens
ggaagttatttatttta

SEQ ID NO: 3258060 - DNA, 18 bp, Homo sapiens
ggaagtttcatatattgt

SEQ ID NO: 3258061 - DNA, 11 bp, Homo sapiens
ggaagttttca

SEQ ID NO: 3258062 - DNA, 14 bp, Homo sapiens
ggaataaaaggctt

SEQ ID NO: 3258063 - DNA, 17 bp, Homo sapiens
ggaataaaaggcttgaa

SEQ ID NO: 3258064 - DNA, 15 bp, Homo sapiens
ggaataaagttgcag

SEQ ID NO: 3258065 - DNA, 17 bp, Homo sapiens
ggaataaagttgcagat

SEQ ID NO: 3258066 - DNA, 19 bp, Homo sapiens
ggaataaatgcctttatat

SEQ ID NO: 3258067 - DNA, 22 bp, Homo sapiens
ggaataaatgcctttatatttc

SEQ ID NO: 3258068 - DNA, 14 bp, Homo sapiens
ggaataaccttcca

SEQ ID NO: 3258069 - DNA, 20 bp, Homo sapiens
ggaataaggccttaatatgt

SEQ ID NO: 3258070 - DNA, 13 bp, Homo sapiens
ggaataataccta

SEQ ID NO: 3258071 - DNA, 13 bp, Homo sapiens
ggaataattattt

SEQ ID NO: 3258072 - DNA, 16 bp, Homo sapiens
ggaatagccagagagg

SEQ ID NO: 3258073 - DNA, 13 bp, Homo sapiens
ggaatagggagac

SEQ ID NO: 3258074 - DNA, 16 bp, Homo sapiens
ggaatagttgagcccc

SEQ ID NO: 3258075 - DNA, 20 bp, Homo sapiens
ggaatagttgagccccaagt

SEQ ID NO: 3258076 - DNA, 23 bp, Homo sapiens
ggaatataaggaaagcaataaat

SEQ ID NO: 3258077 - DNA, 19 bp, Homo sapiens
ggaatatcatctgtcatta

SEQ ID NO: 3258078 - DNA, 19 bp, Homo sapiens
ggaatatttataggccagg

SEQ ID NO: 3258079 - DNA, 15 bp, Homo sapiens
ggaatatttgaataa

SEQ ID NO: 3258080 - DNA, 19 bp, Homo sapiens
ggaatcagggaccagcttt

SEQ ID NO: 3258081 - DNA, 15 bp, Homo sapiens
ggaatcatgtcaggc

SEQ ID NO: 3258082 - DNA, 21 bp, Homo sapiens
ggaatcatgtcaggcctgtgt

SEQ ID NO: 3258083 - DNA, 18 bp, Homo sapiens
ggaatcatgtccatccct

SEQ ID NO: 3258084 - DNA, 17 bp, Homo sapiens
ggaatcattccagtgct

SEQ ID NO: 3258085 - DNA, 16 bp, Homo sapiens
ggaatcctcctccagg

SEQ ID NO: 3258086 - DNA, 20 bp, Homo sapiens
ggaatcctgaaagggcactt

SEQ ID NO: 3258087 - DNA, 21 bp, Homo sapiens
ggaatcctggcagcccagaga

SEQ ID NO: 3258088 - DNA, 21 bp, Homo sapiens
ggaatctagccgatggaaaat

SEQ ID NO: 3258089 - DNA, 21 bp, Homo sapiens
ggaatctttgtaccaaaattt

SEQ ID NO: 3258090 - DNA, 20 bp, Homo sapiens
ggaatgaaattaacacaaag

SEQ ID NO: 3258091 - DNA, 19 bp, Homo sapiens
ggaatgactataaacatta

SEQ ID NO: 3258092 - DNA, 17 bp, Homo sapiens
ggaatgaggaaaattct

SEQ ID NO: 3258093 - DNA, 20 bp, Homo sapiens
ggaatgcagggaagagggca

SEQ ID NO: 3258094 - DNA, 21 bp, Homo sapiens
ggaatgcagggaagagggcag

SEQ ID NO: 3258095 - DNA, 14 bp, Homo sapiens
ggaatgctggactg

SEQ ID NO: 3258096 - DNA, 21 bp, Homo sapiens
ggaatggaaaaagcagaaggc

SEQ ID NO: 3258097 - DNA, 20 bp, Homo sapiens
ggaatggatttttctttaac

SEQ ID NO: 3258098 - DNA, 16 bp, Homo sapiens
ggaatgggagaggggt

SEQ ID NO: 3258099 - DNA, 14 bp, Homo sapiens
ggaatgtgcccctg

SEQ ID NO: 3258100 - DNA, 14 bp, Homo sapiens
ggaattaacctggt

SEQ ID NO: 3258101 - DNA, 16 bp, Homo sapiens
ggaattaacctggtgc

SEQ ID NO: 3258102 - DNA, 22 bp, Homo sapiens
ggaattaagttatctttaaaat

SEQ ID NO: 3258103 - DNA, 19 bp, Homo sapiens
ggaattacatgtaaaacat

SEQ ID NO: 3258104 - DNA, 16 bp, Homo sapiens
ggaattcagcaccctg

SEQ ID NO: 3258105 - DNA, 23 bp, Homo sapiens
ggaattcattttcatcactggga

SEQ ID NO: 3258106 - DNA, 17 bp, Homo sapiens
ggaattccaattaaatt

SEQ ID NO: 3258107 - DNA, 23 bp, Homo sapiens
ggaattggtggcagattttacaa

SEQ ID NO: 3258108 - DNA, 23 bp, Homo sapiens
ggaattgtctttagtgccggctg

SEQ ID NO: 3258109 - DNA, 11 bp, Homo sapiens
ggaatttaaaa

SEQ ID NO: 3258110 - DNA, 18 bp, Homo sapiens
ggaatttaaaattaagta

SEQ ID NO: 3258111 - DNA, 18 bp, Homo sapiens
ggaatttcttaacttctt

SEQ ID NO: 3258112 - DNA, 22 bp, Homo sapiens
ggaatttcttaacttcttgctt

SEQ ID NO: 3258113 - DNA, 16 bp, Homo sapiens
ggaatttgcctgctgg

SEQ ID NO: 3258114 - DNA, 17 bp, Homo sapiens
ggaatttgtaacctcag

SEQ ID NO: 3258115 - DNA, 13 bp, Homo sapiens
ggaatttgtactt

SEQ ID NO: 3258116 - DNA, 14 bp, Homo sapiens
ggaatttgtacttc

SEQ ID NO: 3258117 - DNA, 14 bp, Homo sapiens
ggacaaaacttctt

SEQ ID NO: 3258118 - DNA, 14 bp, Homo sapiens
ggacaaagggaggg

SEQ ID NO: 3258119 - DNA, 17 bp, Homo sapiens
ggacaaagggagggagc

SEQ ID NO: 3258120 - DNA, 18 bp, Homo sapiens
ggacaaagggagggagca

SEQ ID NO: 3258121 - DNA, 20 bp, Homo sapiens
ggacaagcagaggtggccag

SEQ ID NO: 3258122 - DNA, 14 bp, Homo sapiens
ggacaagggattct

SEQ ID NO: 3258123 - DNA, 19 bp, Homo sapiens
ggacaagggattctgggaa

SEQ ID NO: 3258124 - DNA, 19 bp, Homo sapiens
ggacaataaacctccgcca

SEQ ID NO: 3258125 - DNA, 13 bp, Homo sapiens
gctgtcctccctc

SEQ ID NO: 3258126 - DNA, 14 bp, Homo sapiens
gctgtcctgatctg

SEQ ID NO: 3258127 - DNA, 23 bp, Homo sapiens
gctgtcgccccaggccctccctg

SEQ ID NO: 3258128 - DNA, 20 bp, Homo sapiens
gctgtctatgattgtacttt

SEQ ID NO: 3258129 - DNA, 13 bp, Homo sapiens
gctgtctgcctgt

SEQ ID NO: 3258130 - DNA, 17 bp, Homo sapiens
gctgtctgcctgtattt

SEQ ID NO: 3258131 - DNA, 15 bp, Homo sapiens
gctgtcttctggtct

SEQ ID NO: 3258132 - DNA, 16 bp, Homo sapiens
gctgtcttctggtctg

SEQ ID NO: 3258133 - DNA, 13 bp, Homo sapiens
gctgtgaacaggc

SEQ ID NO: 3258134 - DNA, 18 bp, Homo sapiens
gctgtgaagacccaggag

SEQ ID NO: 3258135 - DNA, 19 bp, Homo sapiens
gctgtgaagacccaggaga

SEQ ID NO: 3258136 - DNA, 18 bp, Homo sapiens
gctgtgacaataagtttg

SEQ ID NO: 3258137 - DNA, 14 bp, Homo sapiens
gctgtgacaggtat

SEQ ID NO: 3258138 - DNA, 22 bp, Homo sapiens
gctgtgaccatttataatgtta

SEQ ID NO: 3258139 - DNA, 16 bp, Homo sapiens
gctgtgacttctccag

SEQ ID NO: 3258140 - DNA, 17 bp, Homo sapiens
gctgtgacttctccagg

SEQ ID NO: 3258141 - DNA, 13 bp, Homo sapiens
gctgtgagccttg

SEQ ID NO: 3258142 - DNA, 14 bp, Homo sapiens
gctgtgagccttgg

SEQ ID NO: 3258143 - DNA, 16 bp, Homo sapiens
gctgtgaggcccctgg

SEQ ID NO: 3258144 - DNA, 22 bp, Homo sapiens
gctgtgaggcccctggacaagc

SEQ ID NO: 3258145 - DNA, 12 bp, Homo sapiens
gctgtgaggctg

SEQ ID NO: 3258146 - DNA, 14 bp, Homo sapiens
gctgtgaggctgtc

SEQ ID NO: 3258147 - DNA, 19 bp, Homo sapiens
gctgtgagttctccctgta

SEQ ID NO: 3258148 - DNA, 18 bp, Homo sapiens
gctgtgcagcgcagctgg

SEQ ID NO: 3258149 - DNA, 15 bp, Homo sapiens
gctgtgcctctgcct

SEQ ID NO: 3258150 - DNA, 18 bp, Homo sapiens
gctgtgcctgctagagca

SEQ ID NO: 3258151 - DNA, 15 bp, Homo sapiens
gctgtgctctggaca

SEQ ID NO: 3258152 - DNA, 13 bp, Homo sapiens
gctgtgctgtgga

SEQ ID NO: 3258153 - DNA, 24 bp, Homo sapiens
gctgtggaccgtggacaggcccag

SEQ ID NO: 3258154 - DNA, 22 bp, Homo sapiens
gctgtggagcaaaaggcagctc

SEQ ID NO: 3258155 - DNA, 12 bp, Homo sapiens
gctgtggaggcc

SEQ ID NO: 3258156 - DNA, 19 bp, Homo sapiens
gctgtggccgtctcctccc

SEQ ID NO: 3258157 - DNA, 22 bp, Homo sapiens
gctgtggccgtctcctccctca

SEQ ID NO: 3258158 - DNA, 18 bp, Homo sapiens
gctgtgggcaagcctaag

SEQ ID NO: 3258159 - DNA, 15 bp, Homo sapiens
gctgtgggcagcacc

SEQ ID NO: 3258160 - DNA, 18 bp, Homo sapiens
gctgtgggcagcaccctc

SEQ ID NO: 3258161 - DNA, 22 bp, Homo sapiens
gctgtggggctggtagctcagg

SEQ ID NO: 3258162 - DNA, 21 bp, Homo sapiens
gctgtgtctgcccaatgaata

SEQ ID NO: 3258163 - DNA, 14 bp, Homo sapiens
gctgtgtgattaga

SEQ ID NO: 3258164 - DNA, 15 bp, Homo sapiens
gctgtgtgcctgggg

SEQ ID NO: 3258165 - DNA, 13 bp, Homo sapiens
gctgtgttcatgg

SEQ ID NO: 3258166 - DNA, 16 bp, Homo sapiens
gctgtgtttaatttga

SEQ ID NO: 3258167 - DNA, 17 bp, Homo sapiens
gctgtgtttgcagcctg

SEQ ID NO: 3258168 - DNA, 22 bp, Homo sapiens
gctgttaaactgttagcactgt

SEQ ID NO: 3258169 - DNA, 17 bp, Homo sapiens
gctgttaccgcctgtct

SEQ ID NO: 3258170 - DNA, 16 bp, Homo sapiens
gctgttccccctgccg

SEQ ID NO: 3258171 - DNA, 16 bp, Homo sapiens
gctgttcctgctccat

SEQ ID NO: 3258172 - DNA, 21 bp, Homo sapiens
gctgttcctgttcagtaataa

SEQ ID NO: 3258173 - DNA, 13 bp, Homo sapiens
gctgttctgcact

SEQ ID NO: 3258174 - DNA, 12 bp, Homo sapiens
gctgttctgtgg

SEQ ID NO: 3258175 - DNA, 21 bp, Homo sapiens
gctgttctgtggttcctctgc

SEQ ID NO: 3258176 - DNA, 12 bp, Homo sapiens
gctgttcttctg

SEQ ID NO: 3258177 - DNA, 20 bp, Homo sapiens
gctgttgagatggtaacaga

SEQ ID NO: 3258178 - DNA, 14 bp, Homo sapiens
gctgttgccatagc

SEQ ID NO: 3258179 - DNA, 13 bp, Homo sapiens
gctgttggcactc

SEQ ID NO: 3258180 - DNA, 14 bp, Homo sapiens
gctgttggctgggg

SEQ ID NO: 3258181 - DNA, 21 bp, Homo sapiens
gctgttggctgggggcctcag

SEQ ID NO: 3258182 - DNA, 14 bp, Homo sapiens
gctgtttatggcct

SEQ ID NO: 3258183 - DNA, 23 bp, Homo sapiens
gctgtttatggcctcagctgcct

SEQ ID NO: 3258184 - DNA, 21 bp, Homo sapiens
gctgtttattttttttggcct

SEQ ID NO: 3258185 - DNA, 13 bp, Homo sapiens
gctgtttccatag

SEQ ID NO: 3258186 - DNA, 14 bp, Homo sapiens
gctgtttggaaaag

SEQ ID NO: 3258187 - DNA, 21 bp, Homo sapiens
gctgttttgattcccgggctt

SEQ ID NO: 3258188 - DNA, 13 bp, Homo sapiens
gcttaaaagacat

SEQ ID NO: 3258189 - DNA, 19 bp, Homo sapiens
gcttaaaataaacagttgt

SEQ ID NO: 3258190 - DNA, 17 bp, Homo sapiens
gcttaaaataagcaggt

SEQ ID NO: 3258191 - DNA, 21 bp, Homo sapiens
gcttaaaataagcaggtggat

SEQ ID NO: 3258192 - DNA, 18 bp, Homo sapiens
gcttaacaatgcaacttt

SEQ ID NO: 3258193 - DNA, 17 bp, Homo sapiens
gcttaataaaaatgaca

SEQ ID NO: 3258194 - DNA, 19 bp, Homo sapiens
gcttaataaaaatgacaga

SEQ ID NO: 3258195 - DNA, 15 bp, Homo sapiens
gcttaatagccctcc

SEQ ID NO: 3258196 - DNA, 21 bp, Homo sapiens
gcttaatcattttcattccta

SEQ ID NO: 3258197 - DNA, 12 bp, Homo sapiens
gcttaatgttta

SEQ ID NO: 3258198 - DNA, 12 bp, Homo sapiens
gcttaatttcta

SEQ ID NO: 3258199 - DNA, 13 bp, Homo sapiens
gcttaatttctaa

SEQ ID NO: 3258200 - DNA, 14 bp, Homo sapiens
gcttacatttttac

SEQ ID NO: 3258201 - DNA, 14 bp, Homo sapiens
gcttacctgacaca

SEQ ID NO: 3258202 - DNA, 22 bp, Homo sapiens
gcttacctgacctcttgctgtc

SEQ ID NO: 3258203 - DNA, 23 bp, Homo sapiens
gcttacctgacctcttgctgtct

SEQ ID NO: 3258204 - DNA, 22 bp, Homo sapiens
gcttactgaagaaatctttcca

SEQ ID NO: 3258205 - DNA, 23 bp, Homo sapiens
gcttagacttcgactcaggatcc

SEQ ID NO: 3258206 - DNA, 18 bp, Homo sapiens
gcttagagaatgttctcc

SEQ ID NO: 3258207 - DNA, 20 bp, Homo sapiens
gcttagatgagggtgactgt

SEQ ID NO: 3258208 - DNA, 13 bp, Homo sapiens
gcttagccttgtg

SEQ ID NO: 3258209 - DNA, 19 bp, Homo sapiens
gcttagccttgtgccctgc

SEQ ID NO: 3258210 - DNA, 20 bp, Homo sapiens
gcttagccttgtgccctgcc

SEQ ID NO: 3258211 - DNA, 13 bp, Homo sapiens
gcttaggagagac

SEQ ID NO: 3258212 - DNA, 19 bp, Homo sapiens
gcttagtaaaatttatttc

SEQ ID NO: 3258213 - DNA, 16 bp, Homo sapiens
gcttagtttgtgtgtt

SEQ ID NO: 3258214 - DNA, 13 bp, Homo sapiens
gcttataaacaca

SEQ ID NO: 3258215 - DNA, 18 bp, Homo sapiens
gcttataacctagttaaa

SEQ ID NO: 3258216 - DNA, 22 bp, Homo sapiens
gcttataacctagttaaagaaa

SEQ ID NO: 3258217 - DNA, 12 bp, Homo sapiens
gcttatacactt

SEQ ID NO: 3258218 - DNA, 16 bp, Homo sapiens
gcttatagaataaaag

SEQ ID NO: 3258219 - DNA, 18 bp, Homo sapiens
gcttatcaactaatgatt

SEQ ID NO: 3258220 - DNA, 16 bp, Homo sapiens
gcttatgaatatttat

SEQ ID NO: 3258221 - DNA, 21 bp, Homo sapiens
gcttatgagatctaatgtgaa

SEQ ID NO: 3258222 - DNA, 20 bp, Homo sapiens
gcttattgttccaagacatt

SEQ ID NO: 3258223 - DNA, 22 bp, Homo sapiens
gcttattgttccaagacattgt

SEQ ID NO: 3258224 - DNA, 17 bp, Homo sapiens
gcttattttaatgtgat

SEQ ID NO: 3258225 - DNA, 19 bp, Homo sapiens
gcttattttttaaaatatt

SEQ ID NO: 3258226 - DNA, 20 bp, Homo sapiens
gcttattttttaaaatattt

SEQ ID NO: 3258227 - DNA, 21 bp, Homo sapiens
gcttcaaggatatactgcagc

SEQ ID NO: 3258228 - DNA, 20 bp, Homo sapiens
gcttcaagtgccttttgctg

SEQ ID NO: 3258229 - DNA, 22 bp, Homo sapiens
gcttcaagtgccttttgctgcg

SEQ ID NO: 3258230 - DNA, 16 bp, Homo sapiens
gcttcaatatttttct

SEQ ID NO: 3258231 - DNA, 23 bp, Homo sapiens
gcttcaccagtctgtctactgtg

SEQ ID NO: 3258232 - DNA, 17 bp, Homo sapiens
gcttcaccatggcctta

SEQ ID NO: 3258233 - DNA, 17 bp, Homo sapiens
gcttcacccctgcactt

SEQ ID NO: 3258234 - DNA, 22 bp, Homo sapiens
gcttcagacttttatcaaaatc

SEQ ID NO: 3258235 - DNA, 17 bp, Homo sapiens
gcttcagagtttgtgtg

SEQ ID NO: 3258236 - DNA, 12 bp, Homo sapiens
gcttcagcctcc

SEQ ID NO: 3258237 - DNA, 12 bp, Homo sapiens
gcttcagcctga

SEQ ID NO: 3258238 - DNA, 15 bp, Homo sapiens
gcttcagcctgaggc

SEQ ID NO: 3258239 - DNA, 20 bp, Homo sapiens
gcttcagcctgaggctgaga

SEQ ID NO: 3258240 - DNA, 21 bp, Homo sapiens
gcttcagcctgaggctgagac

SEQ ID NO: 3258241 - DNA, 17 bp, Homo sapiens
gcttcaggcaccagcat

SEQ ID NO: 3258242 - DNA, 19 bp, Homo sapiens
gcttcaggcaccagcatcc

SEQ ID NO: 3258243 - DNA, 14 bp, Homo sapiens
gcttcagtggagaa

SEQ ID NO: 3258244 - DNA, 20 bp, Homo sapiens
gcttcagtggcagctgcttt

SEQ ID NO: 3258245 - DNA, 14 bp, Homo sapiens
gcttcataaatgaa

SEQ ID NO: 3258246 - DNA, 18 bp, Homo sapiens
gcttcataaatgaagcag

SEQ ID NO: 3258247 - DNA, 17 bp, Homo sapiens
gcttcatcattccctct

SEQ ID NO: 3258248 - DNA, 13 bp, Homo sapiens
gcttcatgccttt

SEQ ID NO: 3258249 - DNA, 15 bp, Homo sapiens
gcttcatgcctttgt

SEQ ID NO: 3258250 - DNA, 17 bp, Homo sapiens
gcttcatgcctttgtaa

SEQ ID NO: 3258251 - DNA, 13 bp, Homo sapiens
gcttcatttcaat

SEQ ID NO: 3258252 - DNA, 13 bp, Homo sapiens
gcttcatttcctg

SEQ ID NO: 3258253 - DNA, 16 bp, Homo sapiens
gcttcatttcctgtgt

SEQ ID NO: 3258254 - DNA, 21 bp, Homo sapiens
gcttccacaggcaaaactcag

SEQ ID NO: 3258255 - DNA, 22 bp, Homo sapiens
gctggctttgggaaagcccaga

SEQ ID NO: 3258256 - DNA, 14 bp, Homo sapiens
gctgggaaagcata

SEQ ID NO: 3258257 - DNA, 23 bp, Homo sapiens
gctgggaagctgtactcagagca

SEQ ID NO: 3258258 - DNA, 14 bp, Homo sapiens
gctgggaccagagc

SEQ ID NO: 3258259 - DNA, 16 bp, Homo sapiens
gctgggaccagagcca

SEQ ID NO: 3258260 - DNA, 20 bp, Homo sapiens
gctgggactacaggcaccca

SEQ ID NO: 3258261 - DNA, 22 bp, Homo sapiens
gctgggactcagccttcagaca

SEQ ID NO: 3258262 - DNA, 16 bp, Homo sapiens
gctgggactcctggtg

SEQ ID NO: 3258263 - DNA, 17 bp, Homo sapiens
gctgggactcctggtgc

SEQ ID NO: 3258264 - DNA, 22 bp, Homo sapiens
gctgggacttcttacccaaagc

SEQ ID NO: 3258265 - DNA, 20 bp, Homo sapiens
gctgggagctccactctgct

SEQ ID NO: 3258266 - DNA, 21 bp, Homo sapiens
gctgggagctccactctgctt

SEQ ID NO: 3258267 - DNA, 14 bp, Homo sapiens
gctgggaggactgg

SEQ ID NO: 3258268 - DNA, 15 bp, Homo sapiens
gctgggagttctaga

SEQ ID NO: 3258269 - DNA, 21 bp, Homo sapiens
gctgggagttctagaaccact

SEQ ID NO: 3258270 - DNA, 16 bp, Homo sapiens
gctgggatcagagcag

SEQ ID NO: 3258271 - DNA, 17 bp, Homo sapiens
gctgggatcagagcagg

SEQ ID NO: 3258272 - DNA, 20 bp, Homo sapiens
gctgggatcagagcaggagc

SEQ ID NO: 3258273 - DNA, 21 bp, Homo sapiens
gctgggatcagagcaggagca

SEQ ID NO: 3258274 - DNA, 16 bp, Homo sapiens
gctgggattacaggtg

SEQ ID NO: 3258275 - DNA, 19 bp, Homo sapiens
gctgggattacaggtgtga

SEQ ID NO: 3258276 - DNA, 20 bp, Homo sapiens
gctgggatttcttcgctgct

SEQ ID NO: 3258277 - DNA, 22 bp, Homo sapiens
gctgggatttcttcgctgctct

SEQ ID NO: 3258278 - DNA, 23 bp, Homo sapiens
gctgggatttcttcgctgctcta

SEQ ID NO: 3258279 - DNA, 17 bp, Homo sapiens
gctgggcagccccagag

SEQ ID NO: 3258280 - DNA, 18 bp, Homo sapiens
gctgggcagccccagaga

SEQ ID NO: 3258281 - DNA, 19 bp, Homo sapiens
gctgggcatggtaccagcc

SEQ ID NO: 3258282 - DNA, 18 bp, Homo sapiens
gctgggccactggggact

SEQ ID NO: 3258283 - DNA, 12 bp, Homo sapiens
gctgggcccagc

SEQ ID NO: 3258284 - DNA, 15 bp, Homo sapiens
gctgggccccaccta

SEQ ID NO: 3258285 - DNA, 13 bp, Homo sapiens
gctgggcccctgc

SEQ ID NO: 3258286 - DNA, 15 bp, Homo sapiens
gctgggcccctgcac

SEQ ID NO: 3258287 - DNA, 15 bp, Homo sapiens
gctgggcccctggga

SEQ ID NO: 3258288 - DNA, 15 bp, Homo sapiens
gctgggccctctctt

SEQ ID NO: 3258289 - DNA, 19 bp, Homo sapiens
gctgggccctctttccctg

SEQ ID NO: 3258290 - DNA, 20 bp, Homo sapiens
gctgggctccctgatgacac

SEQ ID NO: 3258291 - DNA, 13 bp, Homo sapiens
gctgggctctgca

SEQ ID NO: 3258292 - DNA, 15 bp, Homo sapiens
gctgggctgggccct

SEQ ID NO: 3258293 - DNA, 14 bp, Homo sapiens
gctgggctgggtgg

SEQ ID NO: 3258294 - DNA, 17 bp, Homo sapiens
gctggggactcagggac

SEQ ID NO: 3258295 - DNA, 21 bp, Homo sapiens
gctggggatccccgcctggcc

SEQ ID NO: 3258296 - DNA, 13 bp, Homo sapiens
gctggggcagagg

SEQ ID NO: 3258297 - DNA, 19 bp, Homo sapiens
gctggggcatggcaggctg

SEQ ID NO: 3258298 - DNA, 18 bp, Homo sapiens
gctggggcatgtgtgcct

SEQ ID NO: 3258299 - DNA, 22 bp, Homo sapiens
gctggggccgccacggcctggc

SEQ ID NO: 3258300 - DNA, 16 bp, Homo sapiens
gctggggctctctgag

SEQ ID NO: 3258301 - DNA, 14 bp, Homo sapiens
gctggggctgctcc

SEQ ID NO: 3258302 - DNA, 15 bp, Homo sapiens
gctggggctgctccc

SEQ ID NO: 3258303 - DNA, 16 bp, Homo sapiens
gctggggctgctcccc

SEQ ID NO: 3258304 - DNA, 18 bp, Homo sapiens
gctgggggcctcagtgcc

SEQ ID NO: 3258305 - DNA, 20 bp, Homo sapiens
gctgggggcctcagtgccac

SEQ ID NO: 3258306 - DNA, 16 bp, Homo sapiens
gctgggggtgctggat

SEQ ID NO: 3258307 - DNA, 18 bp, Homo sapiens
gctggggtgagagaggaa

SEQ ID NO: 3258308 - DNA, 19 bp, Homo sapiens
gctgggtcggccctgccca

SEQ ID NO: 3258309 - DNA, 20 bp, Homo sapiens
gctgggtgggcccagaactg

SEQ ID NO: 3258310 - DNA, 21 bp, Homo sapiens
gctgggtggttttttccccct

SEQ ID NO: 3258311 - DNA, 16 bp, Homo sapiens
gctgggttcatttgtg

SEQ ID NO: 3258312 - DNA, 21 bp, Homo sapiens
gctgggttggagggtgtccca

SEQ ID NO: 3258313 - DNA, 17 bp, Homo sapiens
gctgggttggtgcacag

SEQ ID NO: 3258314 - DNA, 14 bp, Homo sapiens
gctggtaaactatt

SEQ ID NO: 3258315 - DNA, 16 bp, Homo sapiens
gctggtaacagtggct

SEQ ID NO: 3258316 - DNA, 14 bp, Homo sapiens
gctggtacctgccc

SEQ ID NO: 3258317 - DNA, 19 bp, Homo sapiens
gctggtagagacccccagg

SEQ ID NO: 3258318 - DNA, 21 bp, Homo sapiens
gctggtagagacccccaggcc

SEQ ID NO: 3258319 - DNA, 18 bp, Homo sapiens
gctggtatctcagaaagt

SEQ ID NO: 3258320 - DNA, 14 bp, Homo sapiens
gctggtccagggct

SEQ ID NO: 3258321 - DNA, 19 bp, Homo sapiens
gctggtccagggctagtga

SEQ ID NO: 3258322 - DNA, 22 bp, Homo sapiens
gctggtccgagctgaggactct

SEQ ID NO: 3258323 - DNA, 15 bp, Homo sapiens
gctggtccgtgggac

SEQ ID NO: 3258324 - DNA, 16 bp, Homo sapiens
gctggtccgtgggacg

SEQ ID NO: 3258325 - DNA, 20 bp, Homo sapiens
gctggtctattttgattttg

SEQ ID NO: 3258326 - DNA, 17 bp, Homo sapiens
gctggtgcattacagag

SEQ ID NO: 3258327 - DNA, 18 bp, Homo sapiens
gctggtgcattacagaga

SEQ ID NO: 3258328 - DNA, 22 bp, Homo sapiens
gctggtgcattacagagaggag

SEQ ID NO: 3258329 - DNA, 18 bp, Homo sapiens
gctggtgccccacagcta

SEQ ID NO: 3258330 - DNA, 16 bp, Homo sapiens
gctggtgggaaggccg

SEQ ID NO: 3258331 - DNA, 21 bp, Homo sapiens
gctggtgggaaggccggcagc

SEQ ID NO: 3258332 - DNA, 12 bp, Homo sapiens
gctggtggtttc

SEQ ID NO: 3258333 - DNA, 13 bp, Homo sapiens
gctggtggtttca

SEQ ID NO: 3258334 - DNA, 22 bp, Homo sapiens
gctggtggtttcacggtgccag

SEQ ID NO: 3258335 - DNA, 15 bp, Homo sapiens
gctggtgtcacctga

SEQ ID NO: 3258336 - DNA, 16 bp, Homo sapiens
gctggtgtcacctgaa

SEQ ID NO: 3258337 - DNA, 21 bp, Homo sapiens
gctggtgttcaccaaaaccaa

SEQ ID NO: 3258338 - DNA, 14 bp, Homo sapiens
gctggttactcagg

SEQ ID NO: 3258339 - DNA, 18 bp, Homo sapiens
gctggttcctgactggca

SEQ ID NO: 3258340 - DNA, 19 bp, Homo sapiens
gctggttggattaatcttt

SEQ ID NO: 3258341 - DNA, 24 bp, Homo sapiens
gctggttgtcatttttgcagtaga

SEQ ID NO: 3258342 - DNA, 23 bp, Homo sapiens
gctggtttctgagagagtgccat

SEQ ID NO: 3258343 - DNA, 22 bp, Homo sapiens
gctggtttgaaagattatgatg

SEQ ID NO: 3258344 - DNA, 23 bp, Homo sapiens
gctggttttcctaaatgcagtga

SEQ ID NO: 3258345 - DNA, 22 bp, Homo sapiens
gctggttttgtaagatgctggg

SEQ ID NO: 3258346 - DNA, 18 bp, Homo sapiens
gctgtaaaattataaact

SEQ ID NO: 3258347 - DNA, 19 bp, Homo sapiens
gctgtaaaattataaactt

SEQ ID NO: 3258348 - DNA, 20 bp, Homo sapiens
gctgtaaaattataaacttt

SEQ ID NO: 3258349 - DNA, 16 bp, Homo sapiens
gctgtaaattgaactt

SEQ ID NO: 3258350 - DNA, 16 bp, Homo sapiens
gctgtaacgtggcact

SEQ ID NO: 3258351 - DNA, 21 bp, Homo sapiens
gctgtaactactttataacta

SEQ ID NO: 3258352 - DNA, 21 bp, Homo sapiens
gctgtaactgctgagccactc

SEQ ID NO: 3258353 - DNA, 12 bp, Homo sapiens
gctgtaagggca

SEQ ID NO: 3258354 - DNA, 14 bp, Homo sapiens
gctgtaagggcagt

SEQ ID NO: 3258355 - DNA, 23 bp, Homo sapiens
gctgtacatctattttggattgt

SEQ ID NO: 3258356 - DNA, 21 bp, Homo sapiens
gctgtaccacatctgctctag

SEQ ID NO: 3258357 - DNA, 17 bp, Homo sapiens
gctgtacccagatgcct

SEQ ID NO: 3258358 - DNA, 20 bp, Homo sapiens
gctgtacccttccacctcct

SEQ ID NO: 3258359 - DNA, 18 bp, Homo sapiens
gctgtactataagtagtt

SEQ ID NO: 3258360 - DNA, 15 bp, Homo sapiens
gctgtactcagagca

SEQ ID NO: 3258361 - DNA, 22 bp, Homo sapiens
gctgtactcttgctgatggctg

SEQ ID NO: 3258362 - DNA, 18 bp, Homo sapiens
gctgtacttcttgaatat

SEQ ID NO: 3258363 - DNA, 14 bp, Homo sapiens
gctgtagccatggc

SEQ ID NO: 3258364 - DNA, 15 bp, Homo sapiens
gctgtagccatggct

SEQ ID NO: 3258365 - DNA, 17 bp, Homo sapiens
gctgtagccatggctca

SEQ ID NO: 3258366 - DNA, 19 bp, Homo sapiens
gctgtagccatggctcagg

SEQ ID NO: 3258367 - DNA, 20 bp, Homo sapiens
gctgtagtagccctttctgt

SEQ ID NO: 3258368 - DNA, 21 bp, Homo sapiens
gctgtagtagccctttctgtg

SEQ ID NO: 3258369 - DNA, 14 bp, Homo sapiens
gctgtagtcctttc

SEQ ID NO: 3258370 - DNA, 20 bp, Homo sapiens
gctgtagtcctttctgcctt

SEQ ID NO: 3258371 - DNA, 15 bp, Homo sapiens
gctgtatgatttgtt

SEQ ID NO: 3258372 - DNA, 15 bp, Homo sapiens
gctgtattgtctgaa

SEQ ID NO: 3258373 - DNA, 18 bp, Homo sapiens
gctgtatttgttcagtga

SEQ ID NO: 3258374 - DNA, 22 bp, Homo sapiens
gctgtattttaacactttgtat

SEQ ID NO: 3258375 - DNA, 23 bp, Homo sapiens
gctgtcactggctggctcctagg

SEQ ID NO: 3258376 - DNA, 18 bp, Homo sapiens
gctgtcataagaatgaat

SEQ ID NO: 3258377 - DNA, 18 bp, Homo sapiens
gctgtccagaaaggtttg

SEQ ID NO: 3258378 - DNA, 16 bp, Homo sapiens
gctgtcccctctgtca

SEQ ID NO: 3258379 - DNA, 23 bp, Homo sapiens
gctgtccccttggcaggtcctgg

SEQ ID NO: 3258380 - DNA, 19 bp, Homo sapiens
gctgtccctatacactaga

SEQ ID NO: 3258381 - DNA, 11 bp, Homo sapiens
gctgtccctgc

SEQ ID NO: 3258382 - DNA, 15 bp, Homo sapiens
gctgtccctgcaggg

SEQ ID NO: 3258383 - DNA, 15 bp, Homo sapiens
gctgagttgttctaa

SEQ ID NO: 3258384 - DNA, 16 bp, Homo sapiens
gctgagttgttctaac

SEQ ID NO: 3258385 - DNA, 12 bp, Homo sapiens
gctgagtttcct

SEQ ID NO: 3258386 - DNA, 15 bp, Homo sapiens
gctgagtttcctatg

SEQ ID NO: 3258387 - DNA, 23 bp, Homo sapiens
gctgatacataactaaatttgat

SEQ ID NO: 3258388 - DNA, 16 bp, Homo sapiens
gctgatcagtgggcct

SEQ ID NO: 3258389 - DNA, 18 bp, Homo sapiens
gctgatcatcgccagagg

SEQ ID NO: 3258390 - DNA, 20 bp, Homo sapiens
gctgatcatcgccagaggtg

SEQ ID NO: 3258391 - DNA, 16 bp, Homo sapiens
gctgatcgtagaaaat

SEQ ID NO: 3258392 - DNA, 17 bp, Homo sapiens
gctgatgaaactcctga

SEQ ID NO: 3258393 - DNA, 21 bp, Homo sapiens
gctgatgaacttattctgtag

SEQ ID NO: 3258394 - DNA, 17 bp, Homo sapiens
gctgatggagccttccc

SEQ ID NO: 3258395 - DNA, 13 bp, Homo sapiens
gctgatggaggaa

SEQ ID NO: 3258396 - DNA, 16 bp, Homo sapiens
gctgatgtatcctttc

SEQ ID NO: 3258397 - DNA, 20 bp, Homo sapiens
gctgatgttggaagagaaag

SEQ ID NO: 3258398 - DNA, 20 bp, Homo sapiens
gctgattactgtcaataaac

SEQ ID NO: 3258399 - DNA, 21 bp, Homo sapiens
gctgattactgtcaataaaca

SEQ ID NO: 3258400 - DNA, 20 bp, Homo sapiens
gctgattgcagaaaggagag

SEQ ID NO: 3258401 - DNA, 23 bp, Homo sapiens
gctgatttacatgtatggttact

SEQ ID NO: 3258402 - DNA, 15 bp, Homo sapiens
gctgatttccaggcc

SEQ ID NO: 3258403 - DNA, 15 bp, Homo sapiens
gctgcaatgcctaga

SEQ ID NO: 3258404 - DNA, 14 bp, Homo sapiens
gctgcaccagagtg

SEQ ID NO: 3258405 - DNA, 22 bp, Homo sapiens
gctgcaccagagtgaaagggct

SEQ ID NO: 3258406 - DNA, 17 bp, Homo sapiens
gctgcacctgccagcct

SEQ ID NO: 3258407 - DNA, 20 bp, Homo sapiens
gctgcacctgccagcctggc

SEQ ID NO: 3258408 - DNA, 17 bp, Homo sapiens
gctgcacctttttgcat

SEQ ID NO: 3258409 - DNA, 14 bp, Homo sapiens
gctgcactgcagtg

SEQ ID NO: 3258410 - DNA, 15 bp, Homo sapiens
gctgcactgcagtga

SEQ ID NO: 3258411 - DNA, 21 bp, Homo sapiens
gctgcacttgacaccaaccag

SEQ ID NO: 3258412 - DNA, 23 bp, Homo sapiens
gctgcagatttgatatttgcatt

SEQ ID NO: 3258413 - DNA, 16 bp, Homo sapiens
gctgcagcctgcgcca

SEQ ID NO: 3258414 - DNA, 21 bp, Homo sapiens
gctgcagcctgcgccaccgcc

SEQ ID NO: 3258415 - DNA, 22 bp, Homo sapiens
gctgcagctgggccccatgctc

SEQ ID NO: 3258416 - DNA, 13 bp, Homo sapiens
gctgcagcttggg

SEQ ID NO: 3258417 - DNA, 14 bp, Homo sapiens
gctgcagcttggga

SEQ ID NO: 3258418 - DNA, 22 bp, Homo sapiens
gctgcagcttgggagagcccct

SEQ ID NO: 3258419 - DNA, 17 bp, Homo sapiens
gctgcaggacttgagaa

SEQ ID NO: 3258420 - DNA, 23 bp, Homo sapiens
gctgcaggagtgtcctgcccatg

SEQ ID NO: 3258421 - DNA, 11 bp, Homo sapiens
gctgcaggggc

SEQ ID NO: 3258422 - DNA, 23 bp, Homo sapiens
gctgcaggggcaggagaggctgg

SEQ ID NO: 3258423 - DNA, 21 bp, Homo sapiens
gctgcagtagctgtggcctca

SEQ ID NO: 3258424 - DNA, 19 bp, Homo sapiens
gctgcatcttatagcactt

SEQ ID NO: 3258425 - DNA, 16 bp, Homo sapiens
gctgcatgacctacca

SEQ ID NO: 3258426 - DNA, 21 bp, Homo sapiens
gctgcatgacctaccaggaca

SEQ ID NO: 3258427 - DNA, 23 bp, Homo sapiens
gctgcatgacctaccaggacaga

SEQ ID NO: 3258428 - DNA, 18 bp, Homo sapiens
gctgcatgcctggtcttt

SEQ ID NO: 3258429 - DNA, 16 bp, Homo sapiens
gctgcatttaaatcaa

SEQ ID NO: 3258430 - DNA, 17 bp, Homo sapiens
gctgccaaggccagagt

SEQ ID NO: 3258431 - DNA, 22 bp, Homo sapiens
gctgccaaggccagagtggcct

SEQ ID NO: 3258432 - DNA, 15 bp, Homo sapiens
gctgccacacttcag

SEQ ID NO: 3258433 - DNA, 21 bp, Homo sapiens
gctgccacacttcaggctctt

SEQ ID NO: 3258434 - DNA, 15 bp, Homo sapiens
gctcctctccccagc

SEQ ID NO: 3258435 - DNA, 19 bp, Homo sapiens
gctcctctccccagcaagt

SEQ ID NO: 3258436 - DNA, 19 bp, Homo sapiens
gctcctctccttgggctcc

SEQ ID NO: 3258437 - DNA, 19 bp, Homo sapiens
gctcctctgtcctgcttct

SEQ ID NO: 3258438 - DNA, 23 bp, Homo sapiens
gctcctcttaccgtagcctccgt

SEQ ID NO: 3258439 - DNA, 18 bp, Homo sapiens
gctcctgaggggcatctg

SEQ ID NO: 3258440 - DNA, 21 bp, Homo sapiens
gctcctgaggggcatctgccc

SEQ ID NO: 3258441 - DNA, 14 bp, Homo sapiens
gctcctgcagcatg

SEQ ID NO: 3258442 - DNA, 23 bp, Homo sapiens
gctcctgcaggccacagccacct

SEQ ID NO: 3258443 - DNA, 23 bp, Homo sapiens
gctcctgccgcagacgggcacag

SEQ ID NO: 3258444 - DNA, 19 bp, Homo sapiens
gctcctgccttctgtcctg

SEQ ID NO: 3258445 - DNA, 21 bp, Homo sapiens
gctcctggaaaggctcagtct

SEQ ID NO: 3258446 - DNA, 22 bp, Homo sapiens
gctcctggaaaggctcagtctc

SEQ ID NO: 3258447 - DNA, 23 bp, Homo sapiens
gctcctggccaggataatatatt

SEQ ID NO: 3258448 - DNA, 14 bp, Homo sapiens
gctcctggctgcca

SEQ ID NO: 3258449 - DNA, 15 bp, Homo sapiens
gctcctggctgccag

SEQ ID NO: 3258450 - DNA, 18 bp, Homo sapiens
gctcctggctgccaggcg

SEQ ID NO: 3258451 - DNA, 19 bp, Homo sapiens
gctcctggtcttgagatgt

SEQ ID NO: 3258452 - DNA, 20 bp, Homo sapiens
gctcctggtggccttctgct

SEQ ID NO: 3258453 - DNA, 22 bp, Homo sapiens
gctcctgttttgcacagccaaa

SEQ ID NO: 3258454 - DNA, 13 bp, Homo sapiens
gctccttcactgt

SEQ ID NO: 3258455 - DNA, 18 bp, Homo sapiens
gctccttcactgttccct

SEQ ID NO: 3258456 - DNA, 23 bp, Homo sapiens
gctccttcactgttccctctggc

SEQ ID NO: 3258457 - DNA, 24 bp, Homo sapiens
gctccttcactgttccctctggct

SEQ ID NO: 3258458 - DNA, 18 bp, Homo sapiens
gctccttcccatcgctgt

SEQ ID NO: 3258459 - DNA, 15 bp, Homo sapiens
gctccttctgtccta

SEQ ID NO: 3258460 - DNA, 21 bp, Homo sapiens
gctccttctgtcctactctgt

SEQ ID NO: 3258461 - DNA, 17 bp, Homo sapiens
gctcctttctccagcca

SEQ ID NO: 3258462 - DNA, 19 bp, Homo sapiens
gctcctttctccagccagc

SEQ ID NO: 3258463 - DNA, 21 bp, Homo sapiens
gctccttttccgttctgttct

SEQ ID NO: 3258464 - DNA, 23 bp, Homo sapiens
gctccttttccgttctgttctgc

SEQ ID NO: 3258465 - DNA, 14 bp, Homo sapiens
gctccttttgtccc

SEQ ID NO: 3258466 - DNA, 17 bp, Homo sapiens
gctccttttgtccccag

SEQ ID NO: 3258467 - DNA, 23 bp, Homo sapiens
gctccttttgtccccagggcccc

SEQ ID NO: 3258468 - DNA, 15 bp, Homo sapiens
gctcgaatctctgtg

SEQ ID NO: 3258469 - DNA, 16 bp, Homo sapiens
gctcgaatctctgtgc

SEQ ID NO: 3258470 - DNA, 19 bp, Homo sapiens
gctcgaatctctgtgcctt

SEQ ID NO: 3258471 - DNA, 15 bp, Homo sapiens
gctcgaggctggtgc

SEQ ID NO: 3258472 - DNA, 16 bp, Homo sapiens
gctcgaggctggtgcc

SEQ ID NO: 3258473 - DNA, 16 bp, Homo sapiens
gctcgaggggtgggct

SEQ ID NO: 3258474 - DNA, 16 bp, Homo sapiens
gctcgcacccccctgt

SEQ ID NO: 3258475 - DNA, 20 bp, Homo sapiens
gctcgcacccccctgttcta

SEQ ID NO: 3258476 - DNA, 21 bp, Homo sapiens
gctcgcacccccctgttctaa

SEQ ID NO: 3258477 - DNA, 12 bp, Homo sapiens
gctcgcccagca

SEQ ID NO: 3258478 - DNA, 13 bp, Homo sapiens
gctcgcccagcag

SEQ ID NO: 3258479 - DNA, 14 bp, Homo sapiens
gctcgcccaggaag

SEQ ID NO: 3258480 - DNA, 17 bp, Homo sapiens
gctcgcccaggaaggcc

SEQ ID NO: 3258481 - DNA, 15 bp, Homo sapiens
gctcgccccacctcc

SEQ ID NO: 3258482 - DNA, 17 bp, Homo sapiens
gctcgccccacctccac

SEQ ID NO: 3258483 - DNA, 21 bp, Homo sapiens
gctcgccccacctccacctgt

SEQ ID NO: 3258484 - DNA, 23 bp, Homo sapiens
gctcgccccacctccacctgtga

SEQ ID NO: 3258485 - DNA, 17 bp, Homo sapiens
gctcgcgggcagcgggc

SEQ ID NO: 3258486 - DNA, 20 bp, Homo sapiens
gctcgcgggcagcgggccag

SEQ ID NO: 3258487 - DNA, 16 bp, Homo sapiens
gctcgctccctgtagc

SEQ ID NO: 3258488 - DNA, 21 bp, Homo sapiens
gctcgctccctgtagctctgc

SEQ ID NO: 3258489 - DNA, 23 bp, Homo sapiens
gctcgctccctgtagctctgcct

SEQ ID NO: 3258490 - DNA, 15 bp, Homo sapiens
gctcgctgccatcac

SEQ ID NO: 3258491 - DNA, 21 bp, Homo sapiens
gctcgctgccatcaccgctgg

SEQ ID NO: 3258492 - DNA, 11 bp, Homo sapiens
gctcggcagga

SEQ ID NO: 3258493 - DNA, 18 bp, Homo sapiens
gctcggcaggaaggagcg

SEQ ID NO: 3258494 - DNA, 15 bp, Homo sapiens
gctcgtggccttccc

SEQ ID NO: 3258495 - DNA, 14 bp, Homo sapiens
gctctaaaaggtaa

SEQ ID NO: 3258496 - DNA, 12 bp, Homo sapiens
gcctggccaggg

SEQ ID NO: 3258497 - DNA, 14 bp, Homo sapiens
gcctggccagggca

SEQ ID NO: 3258498 - DNA, 17 bp, Homo sapiens
gcctggccagggcaggg

SEQ ID NO: 3258499 - DNA, 18 bp, Homo sapiens
gcctggccagggcagggc

SEQ ID NO: 3258500 - DNA, 19 bp, Homo sapiens
gcctggccagggcagggcc

SEQ ID NO: 3258501 - DNA, 20 bp, Homo sapiens
gcctggccagggcagggcca

SEQ ID NO: 3258502 - DNA, 21 bp, Homo sapiens
gcctggccatctccctcccca

SEQ ID NO: 3258503 - DNA, 15 bp, Homo sapiens
gcctggccctgccct

SEQ ID NO: 3258504 - DNA, 16 bp, Homo sapiens
gcctggccctgccctg

SEQ ID NO: 3258505 - DNA, 19 bp, Homo sapiens
gcctggccctgccctgagg

SEQ ID NO: 3258506 - DNA, 18 bp, Homo sapiens
gcctggccggcaacccca

SEQ ID NO: 3258507 - DNA, 14 bp, Homo sapiens
gcctggcctgagct

SEQ ID NO: 3258508 - DNA, 17 bp, Homo sapiens
gcctggcctgagctggg

SEQ ID NO: 3258509 - DNA, 18 bp, Homo sapiens
gcctggcctgagctgggg

SEQ ID NO: 3258510 - DNA, 16 bp, Homo sapiens
gcctggcctggcacac

SEQ ID NO: 3258511 - DNA, 15 bp, Homo sapiens
gcctggcctggccct

SEQ ID NO: 3258512 - DNA, 13 bp, Homo sapiens
gcctggcctggct

SEQ ID NO: 3258513 - DNA, 19 bp, Homo sapiens
gcctggcgacagagcgaga

SEQ ID NO: 3258514 - DNA, 23 bp, Homo sapiens
gcctggctctttcgtcacccttg

SEQ ID NO: 3258515 - DNA, 12 bp, Homo sapiens
gcctggctgtgg

SEQ ID NO: 3258516 - DNA, 13 bp, Homo sapiens
gcctggctgtgga

SEQ ID NO: 3258517 - DNA, 14 bp, Homo sapiens
gcctggctgtggag

SEQ ID NO: 3258518 - DNA, 17 bp, Homo sapiens
gcctggctgtggaggcc

SEQ ID NO: 3258519 - DNA, 18 bp, Homo sapiens
gcctggctgtggaggcct

SEQ ID NO: 3258520 - DNA, 21 bp, Homo sapiens
gcctggctgtggaggcctgat

SEQ ID NO: 3258521 - DNA, 13 bp, Homo sapiens
gcctggcttctgg

SEQ ID NO: 3258522 - DNA, 15 bp, Homo sapiens
gcctggcttctggag

SEQ ID NO: 3258523 - DNA, 17 bp, Homo sapiens
gcctggcttgctccagg

SEQ ID NO: 3258524 - DNA, 18 bp, Homo sapiens
gcctggcttgctccaggg

SEQ ID NO: 3258525 - DNA, 21 bp, Homo sapiens
gcctggcttgctccagggtct

SEQ ID NO: 3258526 - DNA, 15 bp, Homo sapiens
gcctgggaatgtatt

SEQ ID NO: 3258527 - DNA, 17 bp, Homo sapiens
gcctgggacccagctac

SEQ ID NO: 3258528 - DNA, 17 bp, Homo sapiens
gcctgggagcccagagg

SEQ ID NO: 3258529 - DNA, 22 bp, Homo sapiens
gcctgggagggttcccctggcc

SEQ ID NO: 3258530 - DNA, 12 bp, Homo sapiens
gcctgggcaaga

SEQ ID NO: 3258531 - DNA, 18 bp, Homo sapiens
gcctgggcagccaggctg

SEQ ID NO: 3258532 - DNA, 16 bp, Homo sapiens
gcctgggccgctgcca

SEQ ID NO: 3258533 - DNA, 14 bp, Homo sapiens
gcctgggcctctgc

SEQ ID NO: 3258534 - DNA, 17 bp, Homo sapiens
gcctgggcctctgcccc

SEQ ID NO: 3258535 - DNA, 14 bp, Homo sapiens
gcctgggcctgggt

SEQ ID NO: 3258536 - DNA, 15 bp, Homo sapiens
gcctgggcctgtgca

SEQ ID NO: 3258537 - DNA, 21 bp, Homo sapiens
gcctgggcctgtgcagcagcc

SEQ ID NO: 3258538 - DNA, 12 bp, Homo sapiens
gcctgggctagg

SEQ ID NO: 3258539 - DNA, 15 bp, Homo sapiens
gcctgggctgttggc

SEQ ID NO: 3258540 - DNA, 14 bp, Homo sapiens
gcctggggaggccc

SEQ ID NO: 3258541 - DNA, 13 bp, Homo sapiens
gcctggggccggt

SEQ ID NO: 3258542 - DNA, 15 bp, Homo sapiens
gcctggggcctgaga

SEQ ID NO: 3258543 - DNA, 13 bp, Homo sapiens
gcctggggcctgg

SEQ ID NO: 3258544 - DNA, 15 bp, Homo sapiens
gcctggggcctggca

SEQ ID NO: 3258545 - DNA, 16 bp, Homo sapiens
gcctggggctccctct

SEQ ID NO: 3258546 - DNA, 23 bp, Homo sapiens
gcctggggctcctttctccagcc

SEQ ID NO: 3258547 - DNA, 15 bp, Homo sapiens
gcctgggggcagtga

SEQ ID NO: 3258548 - DNA, 23 bp, Homo sapiens
gcctgggggcagtgactggcagg

SEQ ID NO: 3258549 - DNA, 14 bp, Homo sapiens
gcctgggtctgtgt

SEQ ID NO: 3258550 - DNA, 16 bp, Homo sapiens
gcctgggtctgtgtct

SEQ ID NO: 3258551 - DNA, 14 bp, Homo sapiens
gcctgggtgctggc

SEQ ID NO: 3258552 - DNA, 18 bp, Homo sapiens
gcctgggtgggacagcct

SEQ ID NO: 3258553 - DNA, 22 bp, Homo sapiens
gcctgggttttgtggtcatcta

SEQ ID NO: 3258554 - DNA, 20 bp, Homo sapiens
gcctggtatatccaaaagct

SEQ ID NO: 3258555 - DNA, 15 bp, Homo sapiens
gcctggtggcagctg

SEQ ID NO: 3258556 - DNA, 17 bp, Homo sapiens
gcctggtggcagctgcg

SEQ ID NO: 3258557 - DNA, 19 bp, Homo sapiens
gcctggtggcagctgcggt

SEQ ID NO: 3258558 - DNA, 14 bp, Homo sapiens
gcctggttagaggc

SEQ ID NO: 3258559 - DNA, 16 bp, Homo sapiens
gcctgtaatcccagct

SEQ ID NO: 3258560 - DNA, 14 bp, Homo sapiens
gcctgtagcagtga

SEQ ID NO: 3258561 - DNA, 19 bp, Homo sapiens
gcctgtagctttcctggtc

SEQ ID NO: 3258562 - DNA, 17 bp, Homo sapiens
gcctgtagttaggaaat

SEQ ID NO: 3258563 - DNA, 13 bp, Homo sapiens
gcctgtatacttt

SEQ ID NO: 3258564 - DNA, 15 bp, Homo sapiens
gcctgtatactttag

SEQ ID NO: 3258565 - DNA, 17 bp, Homo sapiens
gcctgtatactttagta

SEQ ID NO: 3258566 - DNA, 18 bp, Homo sapiens
gcctgtatactttagtat

SEQ ID NO: 3258567 - DNA, 18 bp, Homo sapiens
gcctgtccaccctgccaa

SEQ ID NO: 3258568 - DNA, 21 bp, Homo sapiens
gcctgtccaccctgccaagac

SEQ ID NO: 3258569 - DNA, 15 bp, Homo sapiens
gcctgtccagcctgg

SEQ ID NO: 3258570 - DNA, 14 bp, Homo sapiens
gcctgtcgtgccag

SEQ ID NO: 3258571 - DNA, 15 bp, Homo sapiens
gcctgtcgtgccagt

SEQ ID NO: 3258572 - DNA, 16 bp, Homo sapiens
gcctgtcgtgccagtc

SEQ ID NO: 3258573 - DNA, 18 bp, Homo sapiens
gcctgtcgtgccagtcct

SEQ ID NO: 3258574 - DNA, 17 bp, Homo sapiens
gcctgtctcatccccag

SEQ ID NO: 3258575 - DNA, 14 bp, Homo sapiens
gcctgtctctgttc

SEQ ID NO: 3258576 - DNA, 19 bp, Homo sapiens
gcctgtctctttaagggca

SEQ ID NO: 3258577 - DNA, 13 bp, Homo sapiens
gcctgtgcacaca

SEQ ID NO: 3258578 - DNA, 23 bp, Homo sapiens
gcctgtgcacacacacacacatg

SEQ ID NO: 3258579 - DNA, 19 bp, Homo sapiens
gcctgtgcagcagcccagc

SEQ ID NO: 3258580 - DNA, 19 bp, Homo sapiens
gcctgtgcatgtatgtctt

SEQ ID NO: 3258581 - DNA, 16 bp, Homo sapiens
gcctgtgcctctggga

SEQ ID NO: 3258582 - DNA, 13 bp, Homo sapiens
gcctgtgcctgcc

SEQ ID NO: 3258583 - DNA, 17 bp, Homo sapiens
gcctgtgcctgccatgg

SEQ ID NO: 3258584 - DNA, 22 bp, Homo sapiens
gcctcagttcccagctcccccc

SEQ ID NO: 3258585 - DNA, 16 bp, Homo sapiens
gcctcagtttctccat

SEQ ID NO: 3258586 - DNA, 22 bp, Homo sapiens
gcctcatatttaaagacaggga

SEQ ID NO: 3258587 - DNA, 13 bp, Homo sapiens
gcctcatgccaca

SEQ ID NO: 3258588 - DNA, 14 bp, Homo sapiens
gcctcatgccacac

SEQ ID NO: 3258589 - DNA, 16 bp, Homo sapiens
gcctcatgcctgctga

SEQ ID NO: 3258590 - DNA, 14 bp, Homo sapiens
gcctcatgtggctg

SEQ ID NO: 3258591 - DNA, 16 bp, Homo sapiens
gcctccaacgcccctg

SEQ ID NO: 3258592 - DNA, 17 bp, Homo sapiens
gcctccaacgcccctgt

SEQ ID NO: 3258593 - DNA, 19 bp, Homo sapiens
gcctccaacgcccctgtgg

SEQ ID NO: 3258594 - DNA, 21 bp, Homo sapiens
gcctccaacgcccctgtggcc

SEQ ID NO: 3258595 - DNA, 23 bp, Homo sapiens
gcctccaaggaggggctgtaaaa

SEQ ID NO: 3258596 - DNA, 22 bp, Homo sapiens
gcctccacagcgagggcagctg

SEQ ID NO: 3258597 - DNA, 23 bp, Homo sapiens
gcctccacagcgagggcagctgc

SEQ ID NO: 3258598 - DNA, 15 bp, Homo sapiens
gcctccaccaccact

SEQ ID NO: 3258599 - DNA, 16 bp, Homo sapiens
gcctccaccaccactg

SEQ ID NO: 3258600 - DNA, 20 bp, Homo sapiens
gcctccaccaccactggcca

SEQ ID NO: 3258601 - DNA, 21 bp, Homo sapiens
gcctccaccaccactggccac

SEQ ID NO: 3258602 - DNA, 19 bp, Homo sapiens
gcctccactcccccacctg

SEQ ID NO: 3258603 - DNA, 20 bp, Homo sapiens
gcctccactcccccacctga

SEQ ID NO: 3258604 - DNA, 15 bp, Homo sapiens
gcctccagagccagc

SEQ ID NO: 3258605 - DNA, 20 bp, Homo sapiens
gcctccagagccagcctggg

SEQ ID NO: 3258606 - DNA, 23 bp, Homo sapiens
gcctccagagccagcctgggact

SEQ ID NO: 3258607 - DNA, 11 bp, Homo sapiens
gcctccagcct

SEQ ID NO: 3258608 - DNA, 13 bp, Homo sapiens
gcctccagcctct

SEQ ID NO: 3258609 - DNA, 14 bp, Homo sapiens
gcctccagcctctc

SEQ ID NO: 3258610 - DNA, 13 bp, Homo sapiens
gcctccagggccc

SEQ ID NO: 3258611 - DNA, 13 bp, Homo sapiens
gcctccatcctga

SEQ ID NO: 3258612 - DNA, 17 bp, Homo sapiens
gcctccattctgaccat

SEQ ID NO: 3258613 - DNA, 21 bp, Homo sapiens
gcctcccaaggtcctctcagt

SEQ ID NO: 3258614 - DNA, 12 bp, Homo sapiens
gcctcccacact

SEQ ID NO: 3258615 - DNA, 22 bp, Homo sapiens
gcctcccacacttgctggggct

SEQ ID NO: 3258616 - DNA, 18 bp, Homo sapiens
gcctcccacccgatgctg

SEQ ID NO: 3258617 - DNA, 20 bp, Homo sapiens
gcctcccacccgatgctgct

SEQ ID NO: 3258618 - DNA, 10 bp, Homo sapiens
gcctcccagc

SEQ ID NO: 3258619 - DNA, 14 bp, Homo sapiens
gcctcccagcctgg

SEQ ID NO: 3258620 - DNA, 21 bp, Homo sapiens
gcctcccataattgctttgcc

SEQ ID NO: 3258621 - DNA, 12 bp, Homo sapiens
gcctcccatgcc

SEQ ID NO: 3258622 - DNA, 19 bp, Homo sapiens
gcctccccacggccgctcc

SEQ ID NO: 3258623 - DNA, 13 bp, Homo sapiens
gcctccccatttc

SEQ ID NO: 3258624 - DNA, 18 bp, Homo sapiens
gcctccccatttcccatc

SEQ ID NO: 3258625 - DNA, 13 bp, Homo sapiens
gcctcccctccat

SEQ ID NO: 3258626 - DNA, 21 bp, Homo sapiens
gcctcccctctccttcctgtg

SEQ ID NO: 3258627 - DNA, 16 bp, Homo sapiens
gcctcccctgccacca

SEQ ID NO: 3258628 - DNA, 20 bp, Homo sapiens
gcctcccgaatagctgggac

SEQ ID NO: 3258629 - DNA, 23 bp, Homo sapiens
gcctcccgaatagctgggactac

SEQ ID NO: 3258630 - DNA, 18 bp, Homo sapiens
gcctcccgagtagctggg

SEQ ID NO: 3258631 - DNA, 21 bp, Homo sapiens
gcctcccgagtagctgggact

SEQ ID NO: 3258632 - DNA, 16 bp, Homo sapiens
gcctccctagccagca

SEQ ID NO: 3258633 - DNA, 21 bp, Homo sapiens
gcctccctctccatatctcct

SEQ ID NO: 3258634 - DNA, 21 bp, Homo sapiens
gcctccctctctcttctgctc

SEQ ID NO: 3258635 - DNA, 23 bp, Homo sapiens
gcctccctctctcttctgctcca

SEQ ID NO: 3258636 - DNA, 11 bp, Homo sapiens
gcctccctgaa

SEQ ID NO: 3258637 - DNA, 17 bp, Homo sapiens
gcctccctgctgtgcca

SEQ ID NO: 3258638 - DNA, 23 bp, Homo sapiens
gcctccctgctgtgccatgctgg

SEQ ID NO: 3258639 - DNA, 15 bp, Homo sapiens
gcctcccttgggctg

SEQ ID NO: 3258640 - DNA, 14 bp, Homo sapiens
gcctccgctggctt

SEQ ID NO: 3258641 - DNA, 20 bp, Homo sapiens
gcctccggtgagcagggtca

SEQ ID NO: 3258642 - DNA, 18 bp, Homo sapiens
gcctccgtttatgggcct

SEQ ID NO: 3258643 - DNA, 23 bp, Homo sapiens
gcctccgtttatgggccttgctt

SEQ ID NO: 3258644 - DNA, 17 bp, Homo sapiens
gcctcctcatcccgtgt

SEQ ID NO: 3258645 - DNA, 22 bp, Homo sapiens
gcctcctcatcccgtgttctcc

SEQ ID NO: 3258646 - DNA, 16 bp, Homo sapiens
gcctcctcccccaccc

SEQ ID NO: 3258647 - DNA, 17 bp, Homo sapiens
gcctcctcccccacccc

SEQ ID NO: 3258648 - DNA, 18 bp, Homo sapiens
gcctcctcccccacccct

SEQ ID NO: 3258649 - DNA, 19 bp, Homo sapiens
gcctcctcccccacccctt

SEQ ID NO: 3258650 - DNA, 15 bp, Homo sapiens
gcctcctcgttcctt

SEQ ID NO: 3258651 - DNA, 14 bp, Homo sapiens
gcctcctgagcctg

SEQ ID NO: 3258652 - DNA, 17 bp, Homo sapiens
gcctcctgagcctgtgg

SEQ ID NO: 3258653 - DNA, 12 bp, Homo sapiens
gcctcctggcca

SEQ ID NO: 3258654 - DNA, 13 bp, Homo sapiens
gcctcctggccag

SEQ ID NO: 3258655 - DNA, 14 bp, Homo sapiens
gcctcctggccaga

SEQ ID NO: 3258656 - DNA, 13 bp, Homo sapiens
gcctcctgtacct

SEQ ID NO: 3258657 - DNA, 18 bp, Homo sapiens
gcctcctgtacctcagtg

SEQ ID NO: 3258658 - DNA, 13 bp, Homo sapiens
gcctcctgtgggg

SEQ ID NO: 3258659 - DNA, 14 bp, Homo sapiens
gcctcctgtgggga

SEQ ID NO: 3258660 - DNA, 18 bp, Homo sapiens
gcctcctgtggggaaagg

SEQ ID NO: 3258661 - DNA, 19 bp, Homo sapiens
gcctcctgtgtgtgcgcct

SEQ ID NO: 3258662 - DNA, 19 bp, Homo sapiens
gcctccttccacctccctc

SEQ ID NO: 3258663 - DNA, 22 bp, Homo sapiens
gcctcgcctaccaatctctgct

SEQ ID NO: 3258664 - DNA, 17 bp, Homo sapiens
gcctcggcctcccaaag

SEQ ID NO: 3258665 - DNA, 18 bp, Homo sapiens
gcctcgtgaggggcaagc

SEQ ID NO: 3258666 - DNA, 19 bp, Homo sapiens
gcctcgtgaggggcaagct

SEQ ID NO: 3258667 - DNA, 19 bp, Homo sapiens
gcctcgtgccatgatctgt

SEQ ID NO: 3258668 - DNA, 23 bp, Homo sapiens
gcctcgtggttattagcaaggct

SEQ ID NO: 3258669 - DNA, 14 bp, Homo sapiens
gcctcgtgtcatct

SEQ ID NO: 3258670 - DNA, 16 bp, Homo sapiens
gcctctcatcaactga

SEQ ID NO: 3258671 - DNA, 19 bp, Homo sapiens
gcctctcatcaactgaatg

SEQ ID NO: 3258672 - DNA, 23 bp, Homo sapiens
gcctctccaggcaccatctccct

SEQ ID NO: 3258673 - DNA, 21 bp, Homo sapiens
gcctctccagtttgcacctgt

SEQ ID NO: 3258674 - DNA, 23 bp, Homo sapiens
gcctctccccaggtccagctctg

SEQ ID NO: 3258675 - DNA, 13 bp, Homo sapiens
gcctctcccggct

SEQ ID NO: 3258676 - DNA, 18 bp, Homo sapiens
gcctctcccggctgcctg

SEQ ID NO: 3258677 - DNA, 22 bp, Homo sapiens
gcctctcccggctgcctgccgc

SEQ ID NO: 3258678 - DNA, 23 bp, Homo sapiens
gcctctcccggctgcctgccgcc

SEQ ID NO: 3258679 - DNA, 13 bp, Homo sapiens
gcctctcccgtca

SEQ ID NO: 3258680 - DNA, 16 bp, Homo sapiens
gccttataaaccaatc

SEQ ID NO: 3258681 - DNA, 17 bp, Homo sapiens
gccttataaaccaatct

SEQ ID NO: 3258682 - DNA, 20 bp, Homo sapiens
gccttatcaagtgtcttcca

SEQ ID NO: 3258683 - DNA, 19 bp, Homo sapiens
gccttcaaaactatagctt

SEQ ID NO: 3258684 - DNA, 12 bp, Homo sapiens
gccttcaagtgc

SEQ ID NO: 3258685 - DNA, 13 bp, Homo sapiens
gccttcagctcta

SEQ ID NO: 3258686 - DNA, 16 bp, Homo sapiens
gccttcagctctacag

SEQ ID NO: 3258687 - DNA, 20 bp, Homo sapiens
gccttcatctgggacaaaac

SEQ ID NO: 3258688 - DNA, 16 bp, Homo sapiens
gccttccccctgccct

SEQ ID NO: 3258689 - DNA, 13 bp, Homo sapiens
gccttcccctgtc

SEQ ID NO: 3258690 - DNA, 18 bp, Homo sapiens
gccttccccttttgcctg

SEQ ID NO: 3258691 - DNA, 21 bp, Homo sapiens
gccttccccttttgcctggct

SEQ ID NO: 3258692 - DNA, 24 bp, Homo sapiens
gccttccccttttgcctggctgtg

SEQ ID NO: 3258693 - DNA, 15 bp, Homo sapiens
gccttcctcatcccc

SEQ ID NO: 3258694 - DNA, 17 bp, Homo sapiens
gccttcctcatcccctc

SEQ ID NO: 3258695 - DNA, 13 bp, Homo sapiens
gccttcctcctcc

SEQ ID NO: 3258696 - DNA, 14 bp, Homo sapiens
gccttcctcctcca

SEQ ID NO: 3258697 - DNA, 16 bp, Homo sapiens
gccttcctcctccaca

SEQ ID NO: 3258698 - DNA, 22 bp, Homo sapiens
gccttcctcctccacagtgctg

SEQ ID NO: 3258699 - DNA, 16 bp, Homo sapiens
gccttcctctctccag

SEQ ID NO: 3258700 - DNA, 19 bp, Homo sapiens
gccttcctgccctacagag

SEQ ID NO: 3258701 - DNA, 13 bp, Homo sapiens
gccttccttgacc

SEQ ID NO: 3258702 - DNA, 17 bp, Homo sapiens
gccttcctttctccagg

SEQ ID NO: 3258703 - DNA, 20 bp, Homo sapiens
gccttcctttctccaggacc

SEQ ID NO: 3258704 - DNA, 18 bp, Homo sapiens
gccttcgatacaccgggc

SEQ ID NO: 3258705 - DNA, 17 bp, Homo sapiens
gccttcgcttcttgcct

SEQ ID NO: 3258706 - DNA, 20 bp, Homo sapiens
gccttcgcttcttgcctctg

SEQ ID NO: 3258707 - DNA, 14 bp, Homo sapiens
gccttctcccacat

SEQ ID NO: 3258708 - DNA, 16 bp, Homo sapiens
gccttctcctctctgg

SEQ ID NO: 3258709 - DNA, 18 bp, Homo sapiens
gccttctccttccccagg

SEQ ID NO: 3258710 - DNA, 21 bp, Homo sapiens
gccttctccttccccaggatg

SEQ ID NO: 3258711 - DNA, 16 bp, Homo sapiens
gccttctctgaaggac

SEQ ID NO: 3258712 - DNA, 18 bp, Homo sapiens
gccttctgacggccctgc

SEQ ID NO: 3258713 - DNA, 23 bp, Homo sapiens
gccttctgatgtctctaaagcac

SEQ ID NO: 3258714 - DNA, 18 bp, Homo sapiens
gccttctgcagcaggaac

SEQ ID NO: 3258715 - DNA, 23 bp, Homo sapiens
gccttctgctgcccaggccacag

SEQ ID NO: 3258716 - DNA, 15 bp, Homo sapiens
gccttcttcacccag

SEQ ID NO: 3258717 - DNA, 17 bp, Homo sapiens
gccttcttccatcccag

SEQ ID NO: 3258718 - DNA, 21 bp, Homo sapiens
gccttcttctttttgctgttg

SEQ ID NO: 3258719 - DNA, 22 bp, Homo sapiens
gccttcttttgattatgttttt

SEQ ID NO: 3258720 - DNA, 21 bp, Homo sapiens
gccttgagagaaaaagtgccc

SEQ ID NO: 3258721 - DNA, 18 bp, Homo sapiens
gccttgcagaactgccat

SEQ ID NO: 3258722 - DNA, 19 bp, Homo sapiens
gccttgctacctcaagggg

SEQ ID NO: 3258723 - DNA, 19 bp, Homo sapiens
gccttgctcctagcagaca

SEQ ID NO: 3258724 - DNA, 22 bp, Homo sapiens
gccttgctgatggcttgacatg

SEQ ID NO: 3258725 - DNA, 20 bp, Homo sapiens
gccttgctgctgctgcaccc

SEQ ID NO: 3258726 - DNA, 22 bp, Homo sapiens
gccttgctgtttgtcctgagat

SEQ ID NO: 3258727 - DNA, 22 bp, Homo sapiens
gccttgctttgggctttgcagg

SEQ ID NO: 3258728 - DNA, 17 bp, Homo sapiens
gccttggcatgggcgca

SEQ ID NO: 3258729 - DNA, 23 bp, Homo sapiens
gccttggcatgggcgcaggccca

SEQ ID NO: 3258730 - DNA, 15 bp, Homo sapiens
gccttggcctcccaa

SEQ ID NO: 3258731 - DNA, 20 bp, Homo sapiens
gccttggctgacatgaagct

SEQ ID NO: 3258732 - DNA, 20 bp, Homo sapiens
gccttggctgttggcagtga

SEQ ID NO: 3258733 - DNA, 17 bp, Homo sapiens
gccttgggccttgctgc

SEQ ID NO: 3258734 - DNA, 16 bp, Homo sapiens
gccttgggctgctcct

SEQ ID NO: 3258735 - DNA, 22 bp, Homo sapiens
gccttgggctgctcctcatggt

SEQ ID NO: 3258736 - DNA, 19 bp, Homo sapiens
gccttggggaatttcctct

SEQ ID NO: 3258737 - DNA, 18 bp, Homo sapiens
gccttgggttccaaccag

SEQ ID NO: 3258738 - DNA, 12 bp, Homo sapiens
gccttgtataaa

SEQ ID NO: 3258739 - DNA, 19 bp, Homo sapiens
gccttgtataatattgaaa

SEQ ID NO: 3258740 - DNA, 15 bp, Homo sapiens
gccttgtccctctca

SEQ ID NO: 3258741 - DNA, 23 bp, Homo sapiens
gccttgtccctctcactccccag

SEQ ID NO: 3258742 - DNA, 14 bp, Homo sapiens
gccttgtctcctac

SEQ ID NO: 3258743 - DNA, 20 bp, Homo sapiens
gccttgtctcctactcctga

SEQ ID NO: 3258744 - DNA, 13 bp, Homo sapiens
gccttgtgccctg

SEQ ID NO: 3258745 - DNA, 19 bp, Homo sapiens
gccttgtgccctgccccca

SEQ ID NO: 3258746 - DNA, 12 bp, Homo sapiens
gccttgtgtaca

SEQ ID NO: 3258747 - DNA, 22 bp, Homo sapiens
gccttgttttattcaaagacag

SEQ ID NO: 3258748 - DNA, 21 bp, Homo sapiens
gcctttaagccaaagaaacaa

SEQ ID NO: 3258749 - DNA, 21 bp, Homo sapiens
gcctttaatggacttatttct

SEQ ID NO: 3258750 - DNA, 16 bp, Homo sapiens
gcctttatatttcaca

SEQ ID NO: 3258751 - DNA, 23 bp, Homo sapiens
gcctttatgttttttgtaagata

SEQ ID NO: 3258752 - DNA, 23 bp, Homo sapiens
gcctttatttttggcgtggctga

SEQ ID NO: 3258753 - DNA, 14 bp, Homo sapiens
gcctttctcccccg

SEQ ID NO: 3258754 - DNA, 19 bp, Homo sapiens
gcctttctcgattttatct

SEQ ID NO: 3258755 - DNA, 19 bp, Homo sapiens
gcctttctgcagtttttca

SEQ ID NO: 3258756 - DNA, 12 bp, Homo sapiens
gcctttgacatt

SEQ ID NO: 3258757 - DNA, 13 bp, Homo sapiens
gcctttgacattt

SEQ ID NO: 3258758 - DNA, 19 bp, Homo sapiens
gcctttgagacagtttctt

SEQ ID NO: 3258759 - DNA, 23 bp, Homo sapiens
gcctttgagcccacaaagcctta

SEQ ID NO: 3258760 - DNA, 18 bp, Homo sapiens
gcctttgcaaatcagtgt

SEQ ID NO: 3258761 - DNA, 14 bp, Homo sapiens
gcctttgcaagatg

SEQ ID NO: 3258762 - DNA, 18 bp, Homo sapiens
gcggaggaggctggtgac

SEQ ID NO: 3258763 - DNA, 14 bp, Homo sapiens
gcggaggcgcaggc

SEQ ID NO: 3258764 - DNA, 21 bp, Homo sapiens
gcggaggggatccagccactt

SEQ ID NO: 3258765 - DNA, 21 bp, Homo sapiens
gcggaggtgtggagccgaggc

SEQ ID NO: 3258766 - DNA, 15 bp, Homo sapiens
gcggaggttgcaggg

SEQ ID NO: 3258767 - DNA, 21 bp, Homo sapiens
gcggagtgaagaggggcagcc

SEQ ID NO: 3258768 - DNA, 13 bp, Homo sapiens
gcggatcctgctg

SEQ ID NO: 3258769 - DNA, 22 bp, Homo sapiens
gcggcagggccaggctggtccg

SEQ ID NO: 3258770 - DNA, 15 bp, Homo sapiens
gcggcaggggcctgg

SEQ ID NO: 3258771 - DNA, 16 bp, Homo sapiens
gcggcaggggcctgga

SEQ ID NO: 3258772 - DNA, 19 bp, Homo sapiens
gcggcaggggcctggagat

SEQ ID NO: 3258773 - DNA, 19 bp, Homo sapiens
gcggccacgcactgggcca

SEQ ID NO: 3258774 - DNA, 18 bp, Homo sapiens
gcggccaggcacagggcc

SEQ ID NO: 3258775 - DNA, 19 bp, Homo sapiens
gcggccaggcacagggccc

SEQ ID NO: 3258776 - DNA, 20 bp, Homo sapiens
gcggccaggcacagggcccg

SEQ ID NO: 3258777 - DNA, 23 bp, Homo sapiens
gcggccaggcacagggcccgcag

SEQ ID NO: 3258778 - DNA, 19 bp, Homo sapiens
gcggcccagaagtttccct

SEQ ID NO: 3258779 - DNA, 12 bp, Homo sapiens
gcggcccggcca

SEQ ID NO: 3258780 - DNA, 19 bp, Homo sapiens
gcggcccggccagcgggca

SEQ ID NO: 3258781 - DNA, 16 bp, Homo sapiens
gcggcctcccgaggag

SEQ ID NO: 3258782 - DNA, 21 bp, Homo sapiens
gcggcctcccgaggaggggcc

SEQ ID NO: 3258783 - DNA, 16 bp, Homo sapiens
gcggcgaccgccctcc

SEQ ID NO: 3258784 - DNA, 17 bp, Homo sapiens
gcggcgccctggacttg

SEQ ID NO: 3258785 - DNA, 20 bp, Homo sapiens
gcggcgtggagactggcagg

SEQ ID NO: 3258786 - DNA, 19 bp, Homo sapiens
gcggctcaaaaggaaacca

SEQ ID NO: 3258787 - DNA, 22 bp, Homo sapiens
gcggctggctctgtggaggggc

SEQ ID NO: 3258788 - DNA, 16 bp, Homo sapiens
gcgggagacctgtgct

SEQ ID NO: 3258789 - DNA, 21 bp, Homo sapiens
gcgggagcggtggccctgtcc

SEQ ID NO: 3258790 - DNA, 18 bp, Homo sapiens
gcgggaggcaccagctct

SEQ ID NO: 3258791 - DNA, 17 bp, Homo sapiens
gcgggaggccctggccc

SEQ ID NO: 3258792 - DNA, 15 bp, Homo sapiens
gcgggcacaataaat

SEQ ID NO: 3258793 - DNA, 13 bp, Homo sapiens
gcgggcacagggc

SEQ ID NO: 3258794 - DNA, 20 bp, Homo sapiens
gcgggcacctatagtcccag

SEQ ID NO: 3258795 - DNA, 17 bp, Homo sapiens
gcgggcagagggctgga

SEQ ID NO: 3258796 - DNA, 18 bp, Homo sapiens
gcgggcagagggctggag

SEQ ID NO: 3258797 - DNA, 19 bp, Homo sapiens
gcgggcagagggctggagg

SEQ ID NO: 3258798 - DNA, 16 bp, Homo sapiens
gcgggcagcgggccag

SEQ ID NO: 3258799 - DNA, 19 bp, Homo sapiens
gcgggccagccaggcgggc

SEQ ID NO: 3258800 - DNA, 14 bp, Homo sapiens
gcgggccaggcccg

SEQ ID NO: 3258801 - DNA, 17 bp, Homo sapiens
gcgggccatgagggaca

SEQ ID NO: 3258802 - DNA, 21 bp, Homo sapiens
gcgggctaacgggaggctggg

SEQ ID NO: 3258803 - DNA, 16 bp, Homo sapiens
gcgggctccctggcag

SEQ ID NO: 3258804 - DNA, 21 bp, Homo sapiens
gcgggcttttctggggcccag

SEQ ID NO: 3258805 - DNA, 19 bp, Homo sapiens
gcggggacagctccttctg

SEQ ID NO: 3258806 - DNA, 23 bp, Homo sapiens
gcggggatcagagcgcacaggga

SEQ ID NO: 3258807 - DNA, 17 bp, Homo sapiens
gcggggcgaagcccagg

SEQ ID NO: 3258808 - DNA, 21 bp, Homo sapiens
gcggggggggcgcctggagag

SEQ ID NO: 3258809 - DNA, 22 bp, Homo sapiens
gcggggggggcgcctggagagc

SEQ ID NO: 3258810 - DNA, 11 bp, Homo sapiens
gcggtacccca

SEQ ID NO: 3258811 - DNA, 13 bp, Homo sapiens
gcggtccacccag

SEQ ID NO: 3258812 - DNA, 16 bp, Homo sapiens
gcggtccccatcccca

SEQ ID NO: 3258813 - DNA, 22 bp, Homo sapiens
gcggtccccatccccaccagct

SEQ ID NO: 3258814 - DNA, 23 bp, Homo sapiens
gcggtcttcaacatcctgccagc

SEQ ID NO: 3258815 - DNA, 21 bp, Homo sapiens
gcggtgccatgtctgcagtgt

SEQ ID NO: 3258816 - DNA, 22 bp, Homo sapiens
gcggtgctctggcggcttcctg

SEQ ID NO: 3258817 - DNA, 14 bp, Homo sapiens
gcggtggccctgtc

SEQ ID NO: 3258818 - DNA, 14 bp, Homo sapiens
gcggtgggggagga

SEQ ID NO: 3258819 - DNA, 17 bp, Homo sapiens
gcgtaatgggcctgccc

SEQ ID NO: 3258820 - DNA, 16 bp, Homo sapiens
gcgtagcagagttaaa

SEQ ID NO: 3258821 - DNA, 21 bp, Homo sapiens
gcgtatgtctgttaccatgtc

SEQ ID NO: 3258822 - DNA, 21 bp, Homo sapiens
gcgtcagggttggtgtgctga

SEQ ID NO: 3258823 - DNA, 19 bp, Homo sapiens
gcgtcccctgctactcctg

SEQ ID NO: 3258824 - DNA, 12 bp, Homo sapiens
gcgtccctggcg

SEQ ID NO: 3258825 - DNA, 13 bp, Homo sapiens
gcgtcctgtccac

SEQ ID NO: 3258826 - DNA, 21 bp, Homo sapiens
gcgtccttccccctgtagact

SEQ ID NO: 3258827 - DNA, 14 bp, Homo sapiens
gcgtctagcttagt

SEQ ID NO: 3258828 - DNA, 20 bp, Homo sapiens
gcgtctcctgtttttctggg

SEQ ID NO: 3258829 - DNA, 17 bp, Homo sapiens
gcgtctggaggggcccc

SEQ ID NO: 3258830 - DNA, 21 bp, Homo sapiens
gcgtctggaggggcccctgct

SEQ ID NO: 3258831 - DNA, 21 bp, Homo sapiens
gcgtcttcctgagtggtgcca

SEQ ID NO: 3258832 - DNA, 17 bp, Homo sapiens
gcgtctttaagagactc

SEQ ID NO: 3258833 - DNA, 14 bp, Homo sapiens
gcgtgaaggactta

SEQ ID NO: 3258834 - DNA, 15 bp, Homo sapiens
gcgtgagacgccacc

SEQ ID NO: 3258835 - DNA, 15 bp, Homo sapiens
gcgtgagccactgca

SEQ ID NO: 3258836 - DNA, 16 bp, Homo sapiens
gcgtgagccactgcac

SEQ ID NO: 3258837 - DNA, 18 bp, Homo sapiens
gcgtgagccactgcaccg

SEQ ID NO: 3258838 - DNA, 16 bp, Homo sapiens
gcgtgaggtcccagga

SEQ ID NO: 3258839 - DNA, 19 bp, Homo sapiens
gcgtgccgcctgctcctca

SEQ ID NO: 3258840 - DNA, 14 bp, Homo sapiens
gcgtgccgtgtgag

SEQ ID NO: 3258841 - DNA, 17 bp, Homo sapiens
gcgtgccgtgtgagtgt

SEQ ID NO: 3258842 - DNA, 21 bp, Homo sapiens
gcgtgccgtgtgagtgtgaca

SEQ ID NO: 3258843 - DNA, 18 bp, Homo sapiens
gcgtggagactggcaggc

SEQ ID NO: 3258844 - DNA, 14 bp, Homo sapiens
gcgtggagcaggcg

SEQ ID NO: 3258845 - DNA, 17 bp, Homo sapiens
gcgtggcaaatataaaa

SEQ ID NO: 3258846 - DNA, 23 bp, Homo sapiens
gcgtggctctaaaaggtaatgtg

SEQ ID NO: 3258847 - DNA, 12 bp, Homo sapiens
gcgtggctgtgg

SEQ ID NO: 3258848 - DNA, 13 bp, Homo sapiens
gcgtggctgtggc

SEQ ID NO: 3258849 - DNA, 16 bp, Homo sapiens
gcgtggtcactgctgt

SEQ ID NO: 3258850 - DNA, 18 bp, Homo sapiens
gcgtggtcactgctgtca

SEQ ID NO: 3258851 - DNA, 18 bp, Homo sapiens
gcgtggtgtgtccctgga

SEQ ID NO: 3258852 - DNA, 22 bp, Homo sapiens
gcgtggtgtgtccctggacaca

SEQ ID NO: 3258853 - DNA, 23 bp, Homo sapiens
gcgtggtgtgtccctggacacag

SEQ ID NO: 3258854 - DNA, 19 bp, Homo sapiens
gcgtgtcgtgggtgtgtgt

SEQ ID NO: 3258855 - DNA, 15 bp, Homo sapiens
gcgtgtgtagagtta

SEQ ID NO: 3258856 - DNA, 13 bp, Homo sapiens
gcgttcacctccc

SEQ ID NO: 3258857 - DNA, 22 bp, Homo sapiens
gcgttcatatgctctgctttta

SEQ ID NO: 3258858 - DNA, 13 bp, Homo sapiens
gcgttcctttctt

SEQ ID NO: 3258859 - DNA, 15 bp, Homo sapiens
gcgttcctttctttt

SEQ ID NO: 3258860 - DNA, 15 bp, Homo sapiens
gcgttggagccactc

SEQ ID NO: 3258861 - DNA, 14 bp, Homo sapiens
gcgttgggagccta

SEQ ID NO: 3258862 - DNA, 15 bp, Homo sapiens
gcgttgggagcctag

SEQ ID NO: 3258863 - DNA, 14 bp, Homo sapiens
gcgttggtgccact

SEQ ID NO: 3258864 - DNA, 14 bp, Homo sapiens
gcgtttagaccaag

SEQ ID NO: 3258865 - DNA, 16 bp, Homo sapiens
gcgtttagaccaagga

SEQ ID NO: 3258866 - DNA, 21 bp, Homo sapiens
gcgtttagtttctagaggcct

SEQ ID NO: 3258867 - DNA, 17 bp, Homo sapiens
gctaaaaaaagtgcatg

SEQ ID NO: 3258868 - DNA, 18 bp, Homo sapiens
gctaaaaaaagtgcatga

SEQ ID NO: 3258869 - DNA, 15 bp, Homo sapiens
gctaaaatatataat

SEQ ID NO: 3258870 - DNA, 18 bp, Homo sapiens
gctaaacaagtaagaaaa

SEQ ID NO: 3258871 - DNA, 14 bp, Homo sapiens
gctaaagagccctt

SEQ ID NO: 3258872 - DNA, 18 bp, Homo sapiens
gctaaagagcccttgcct

SEQ ID NO: 3258873 - DNA, 18 bp, Homo sapiens
gctaaaggggagaaactg

SEQ ID NO: 3258874 - DNA, 23 bp, Homo sapiens
gctaaattctatgttaaatactg

SEQ ID NO: 3258875 - DNA, 16 bp, Homo sapiens
gctaacaatgtctggt

SEQ ID NO: 3258876 - DNA, 19 bp, Homo sapiens
gctaacacgtgaaaccccg

SEQ ID NO: 3258877 - DNA, 13 bp, Homo sapiens
gctaacattttaa

SEQ ID NO: 3258878 - DNA, 17 bp, Homo sapiens
gctaacattttaaataa

SEQ ID NO: 3258879 - DNA, 14 bp, Homo sapiens
gctaacctggaaag

SEQ ID NO: 3258880 - DNA, 18 bp, Homo sapiens
gctaacctggacctggaa

SEQ ID NO: 3258881 - DNA, 17 bp, Homo sapiens
gctaacgggaggctggg

SEQ ID NO: 3258882 - DNA, 13 bp, Homo sapiens
gctaagaggctgc

SEQ ID NO: 3258883 - DNA, 14 bp, Homo sapiens
gctaagaggctgct

SEQ ID NO: 3258884 - DNA, 18 bp, Homo sapiens
gctaagattatctgggga

SEQ ID NO: 3258885 - DNA, 14 bp, Homo sapiens
gctaagctggctct

SEQ ID NO: 3258886 - DNA, 15 bp, Homo sapiens
gctaagctggctctg

SEQ ID NO: 3258887 - DNA, 19 bp, Homo sapiens
gctaaggctcctccttgcc

SEQ ID NO: 3258888 - DNA, 11 bp, Homo sapiens
gctaaggctct

SEQ ID NO: 3258889 - DNA, 17 bp, Homo sapiens
gctaaggttctaaggcc

SEQ ID NO: 3258890 - DNA, 13 bp, Homo sapiens
gctaagtccatca

SEQ ID NO: 3258891 - DNA, 14 bp, Homo sapiens
gctaagtctttccc

SEQ ID NO: 3258892 - DNA, 13 bp, Homo sapiens
gctaagtgaaaag

SEQ ID NO: 3258893 - DNA, 18 bp, Homo sapiens
gctaagtgaaaaggtcat

SEQ ID NO: 3258894 - DNA, 18 bp, Homo sapiens
gctaagtgatcctcccac

SEQ ID NO: 3258895 - DNA, 23 bp, Homo sapiens
gctaagtgatcctcccacctcag

SEQ ID NO: 3258896 - DNA, 20 bp, Homo sapiens
gctaataaacactggctctg

SEQ ID NO: 3258897 - DNA, 22 bp, Homo sapiens
gctaataaacactggctctggg

SEQ ID NO: 3258898 - DNA, 15 bp, Homo sapiens
gctaataaactgtat

SEQ ID NO: 3258899 - DNA, 17 bp, Homo sapiens
gctaataaatctcttct

SEQ ID NO: 3258900 - DNA, 18 bp, Homo sapiens
gctaatcaaagccagggt

SEQ ID NO: 3258901 - DNA, 19 bp, Homo sapiens
gctaatcagtgtctcacac

SEQ ID NO: 3258902 - DNA, 21 bp, Homo sapiens
gctaatcatgtgggtgagcca

SEQ ID NO: 3258903 - DNA, 23 bp, Homo sapiens
gctaatcatgtgggtgagccagt

SEQ ID NO: 3258904 - DNA, 20 bp, Homo sapiens
gctaatctgtagggctggac

SEQ ID NO: 3258905 - DNA, 21 bp, Homo sapiens
gctaatctgtagggctggacc

SEQ ID NO: 3258906 - DNA, 22 bp, Homo sapiens
gctaattcaaggaatttcttaa

SEQ ID NO: 3258907 - DNA, 15 bp, Homo sapiens
gctaatttgcattaa

SEQ ID NO: 3258908 - DNA, 17 bp, Homo sapiens
gctaattttctcaaaag

SEQ ID NO: 3258909 - DNA, 17 bp, Homo sapiens
gctaatttttgtaattt

SEQ ID NO: 3258910 - DNA, 17 bp, Homo sapiens
gctacaaatttatgcat

SEQ ID NO: 3258911 - DNA, 17 bp, Homo sapiens
gctacaacttcagcagt

SEQ ID NO: 3258912 - DNA, 16 bp, Homo sapiens
gctacacagacccctc

SEQ ID NO: 3258913 - DNA, 12 bp, Homo sapiens
gctacagagccg

SEQ ID NO: 3258914 - DNA, 17 bp, Homo sapiens
gctacagcaatttctaa

SEQ ID NO: 3258915 - DNA, 11 bp, Homo sapiens
gctacaggagg

SEQ ID NO: 3258916 - DNA, 16 bp, Homo sapiens
gctacatgctggggtc

SEQ ID NO: 3258917 - DNA, 14 bp, Homo sapiens
gctaccaaaacagt

SEQ ID NO: 3258918 - DNA, 20 bp, Homo sapiens
gctaccacgggtctgccatg

SEQ ID NO: 3258919 - DNA, 22 bp, Homo sapiens
gctaccagcgccaaatgttcat

SEQ ID NO: 3258920 - DNA, 23 bp, Homo sapiens
gctaccagcgccaaatgttcatc

SEQ ID NO: 3258921 - DNA, 14 bp, Homo sapiens
gctaccagtattta

SEQ ID NO: 3258922 - DNA, 18 bp, Homo sapiens
gctaccagtatttagaag

SEQ ID NO: 3258923 - DNA, 21 bp, Homo sapiens
gctaccagtatttagaagcca

SEQ ID NO: 3258924 - DNA, 15 bp, Homo sapiens
gctacccaaaagaga

SEQ ID NO: 3258925 - DNA, 19 bp, Homo sapiens
gctacccaaaagagaaaaa

SEQ ID NO: 3258926 - DNA, 21 bp, Homo sapiens
gctaccccttctttgcagggc

SEQ ID NO: 3258927 - DNA, 20 bp, Homo sapiens
gctacccttttcctttgtgg

SEQ ID NO: 3258928 - DNA, 20 bp, Homo sapiens
gctaccctttttctccagct

SEQ ID NO: 3258929 - DNA, 19 bp, Homo sapiens
gctaccgccctgggctgga

SEQ ID NO: 3258930 - DNA, 21 bp, Homo sapiens
gctaccgccctgggctggact

SEQ ID NO: 3258931 - DNA, 15 bp, Homo sapiens
gctacgaatcttccg

SEQ ID NO: 3258932 - DNA, 14 bp, Homo sapiens
gctactaatgatgt

SEQ ID NO: 3258933 - DNA, 18 bp, Homo sapiens
gctactaatgatgttttc

SEQ ID NO: 3258934 - DNA, 16 bp, Homo sapiens
gctactataaagagaa

SEQ ID NO: 3258935 - DNA, 15 bp, Homo sapiens
gctactataatcaaa

SEQ ID NO: 3258936 - DNA, 16 bp, Homo sapiens
gctactcagaagcctg

SEQ ID NO: 3258937 - DNA, 19 bp, Homo sapiens
gctactcagaagcctgagg

SEQ ID NO: 3258938 - DNA, 14 bp, Homo sapiens
gctactcctgtgct

SEQ ID NO: 3258939 - DNA, 22 bp, Homo sapiens
gctactcgggaggctgaggcag

SEQ ID NO: 3258940 - DNA, 13 bp, Homo sapiens
gctactctgtcca

SEQ ID NO: 3258941 - DNA, 14 bp, Homo sapiens
gctactctgtccag

SEQ ID NO: 3258942 - DNA, 16 bp, Homo sapiens
gccgctgagtggcagg

SEQ ID NO: 3258943 - DNA, 11 bp, Homo sapiens
gccgctgcagg

SEQ ID NO: 3258944 - DNA, 15 bp, Homo sapiens
gccgctgccgctgca

SEQ ID NO: 3258945 - DNA, 17 bp, Homo sapiens
gccgctgccgctgcacc

SEQ ID NO: 3258946 - DNA, 23 bp, Homo sapiens
gccgctgtgagcccctggtcctg

SEQ ID NO: 3258947 - DNA, 18 bp, Homo sapiens
gccggaaccacagggcca

SEQ ID NO: 3258948 - DNA, 22 bp, Homo sapiens
gccggaaccacagggccagagg

SEQ ID NO: 3258949 - DNA, 16 bp, Homo sapiens
gccggaagtggctccg

SEQ ID NO: 3258950 - DNA, 19 bp, Homo sapiens
gccggcaaccccagttctg

SEQ ID NO: 3258951 - DNA, 20 bp, Homo sapiens
gccggcaaccccagttctgc

SEQ ID NO: 3258952 - DNA, 23 bp, Homo sapiens
gccggcaaccccagttctgctcc

SEQ ID NO: 3258953 - DNA, 23 bp, Homo sapiens
gccggcctctctggcctcccacc

SEQ ID NO: 3258954 - DNA, 23 bp, Homo sapiens
gccggcgtggcaaatataaaact

SEQ ID NO: 3258955 - DNA, 16 bp, Homo sapiens
gccggctgtgctcaga

SEQ ID NO: 3258956 - DNA, 15 bp, Homo sapiens
gccggctgtggagca

SEQ ID NO: 3258957 - DNA, 12 bp, Homo sapiens
gccgggcaggcg

SEQ ID NO: 3258958 - DNA, 22 bp, Homo sapiens
gccgggcaggcgtgactcagca

SEQ ID NO: 3258959 - DNA, 23 bp, Homo sapiens
gccgggcaggcgtgactcagcag

SEQ ID NO: 3258960 - DNA, 12 bp, Homo sapiens
gccgggcccctg

SEQ ID NO: 3258961 - DNA, 14 bp, Homo sapiens
gccgggcccctggg

SEQ ID NO: 3258962 - DNA, 17 bp, Homo sapiens
gccgggcccctgggctt

SEQ ID NO: 3258963 - DNA, 18 bp, Homo sapiens
gccgggcgcggtggctca

SEQ ID NO: 3258964 - DNA, 21 bp, Homo sapiens
gccggggaagctgccagccca

SEQ ID NO: 3258965 - DNA, 22 bp, Homo sapiens
gccggggaagctgccagcccag

SEQ ID NO: 3258966 - DNA, 22 bp, Homo sapiens
gccgggggttcataggtcactg

SEQ ID NO: 3258967 - DNA, 14 bp, Homo sapiens
gccggtagaggctc

SEQ ID NO: 3258968 - DNA, 17 bp, Homo sapiens
gccggtcgggcagccag

SEQ ID NO: 3258969 - DNA, 18 bp, Homo sapiens
gccggtctgcaagtcaga

SEQ ID NO: 3258970 - DNA, 18 bp, Homo sapiens
gccggtgggaccctgtcc

SEQ ID NO: 3258971 - DNA, 20 bp, Homo sapiens
gccggtgggaccctgtccgg

SEQ ID NO: 3258972 - DNA, 13 bp, Homo sapiens
gccgtaatttaac

SEQ ID NO: 3258973 - DNA, 20 bp, Homo sapiens
gccgtagggagtacctgctg

SEQ ID NO: 3258974 - DNA, 23 bp, Homo sapiens
gccgtattttacatgaagctgta

SEQ ID NO: 3258975 - DNA, 18 bp, Homo sapiens
gccgtcagccaaatgtaa

SEQ ID NO: 3258976 - DNA, 14 bp, Homo sapiens
gccgtccatggcac

SEQ ID NO: 3258977 - DNA, 20 bp, Homo sapiens
gccgtccatggcaccagccc

SEQ ID NO: 3258978 - DNA, 16 bp, Homo sapiens
gccgtctgactccaga

SEQ ID NO: 3258979 - DNA, 16 bp, Homo sapiens
gccgtgagttctcagg

SEQ ID NO: 3258980 - DNA, 21 bp, Homo sapiens
gccgtgagttctcagggctcc

SEQ ID NO: 3258981 - DNA, 23 bp, Homo sapiens
gccgtgagttctcagggctcctg

SEQ ID NO: 3258982 - DNA, 19 bp, Homo sapiens
gccgtgccttcagctctac

SEQ ID NO: 3258983 - DNA, 20 bp, Homo sapiens
gccgtggggccgccgcctct

SEQ ID NO: 3258984 - DNA, 18 bp, Homo sapiens
gccgtgggggttgaggca

SEQ ID NO: 3258985 - DNA, 14 bp, Homo sapiens
gccgtgtgagtgtg

SEQ ID NO: 3258986 - DNA, 18 bp, Homo sapiens
gccgtgtgagtgtgacag

SEQ ID NO: 3258987 - DNA, 23 bp, Homo sapiens
gccgtgtgagtgtgacagggcca

SEQ ID NO: 3258988 - DNA, 16 bp, Homo sapiens
gccgtgttactgttgc

SEQ ID NO: 3258989 - DNA, 15 bp, Homo sapiens
gccgttccccttggc

SEQ ID NO: 3258990 - DNA, 23 bp, Homo sapiens
gcctaaaagtgggcttgattctg

SEQ ID NO: 3258991 - DNA, 12 bp, Homo sapiens
gcctaaaatctt

SEQ ID NO: 3258992 - DNA, 20 bp, Homo sapiens
gcctaaaggatagatcaaag

SEQ ID NO: 3258993 - DNA, 15 bp, Homo sapiens
gcctaaagggcaggg

SEQ ID NO: 3258994 - DNA, 20 bp, Homo sapiens
gcctaaatttaatgctgcct

SEQ ID NO: 3258995 - DNA, 16 bp, Homo sapiens
gcctaacaccagcgtt

SEQ ID NO: 3258996 - DNA, 16 bp, Homo sapiens
gcctaaccaggcccag

SEQ ID NO: 3258997 - DNA, 17 bp, Homo sapiens
gcctaaccaggcccagc

SEQ ID NO: 3258998 - DNA, 19 bp, Homo sapiens
gcctaaccaggcccagcca

SEQ ID NO: 3258999 - DNA, 21 bp, Homo sapiens
gcctaaccaggcccagccagt

SEQ ID NO: 3259000 - DNA, 18 bp, Homo sapiens
gcctaactaactggcagg

SEQ ID NO: 3259001 - DNA, 14 bp, Homo sapiens
gcctaatccctggg

SEQ ID NO: 3259002 - DNA, 23 bp, Homo sapiens
gcctaatccctgggcattgcttt

SEQ ID NO: 3259003 - DNA, 14 bp, Homo sapiens
gcctaattggaaag

SEQ ID NO: 3259004 - DNA, 17 bp, Homo sapiens
gcctacaaccatccctg

SEQ ID NO: 3259005 - DNA, 22 bp, Homo sapiens
gcctacaaccatccctgccaca

SEQ ID NO: 3259006 - DNA, 23 bp, Homo sapiens
gcctacagctttgatccctgaca

SEQ ID NO: 3259007 - DNA, 17 bp, Homo sapiens
gcctacaggagtgagca

SEQ ID NO: 3259008 - DNA, 17 bp, Homo sapiens
gcctaccccgcagacac

SEQ ID NO: 3259009 - DNA, 21 bp, Homo sapiens
gcctaccccgcagacaccttg

SEQ ID NO: 3259010 - DNA, 13 bp, Homo sapiens
gcctacctcactc

SEQ ID NO: 3259011 - DNA, 17 bp, Homo sapiens
gcctagaagctggtggc

SEQ ID NO: 3259012 - DNA, 18 bp, Homo sapiens
gcctagaatctttattca

SEQ ID NO: 3259013 - DNA, 15 bp, Homo sapiens
gcctagactgttact

SEQ ID NO: 3259014 - DNA, 16 bp, Homo sapiens
gcctagagtgtagcct

SEQ ID NO: 3259015 - DNA, 23 bp, Homo sapiens
gcctagatccacacacagaggaa

SEQ ID NO: 3259016 - DNA, 15 bp, Homo sapiens
gcctagcaagctggc

SEQ ID NO: 3259017 - DNA, 17 bp, Homo sapiens
gcctagcaagctggcct

SEQ ID NO: 3259018 - DNA, 16 bp, Homo sapiens
gcctagcccaccctgc

SEQ ID NO: 3259019 - DNA, 19 bp, Homo sapiens
gcctagcggagcccagcct

SEQ ID NO: 3259020 - DNA, 23 bp, Homo sapiens
gcctagctcctgccacatggagc

SEQ ID NO: 3259021 - DNA, 22 bp, Homo sapiens
gcctaggaccactcagccccta

SEQ ID NO: 3259022 - DNA, 18 bp, Homo sapiens
gcctaggagatatctgag

SEQ ID NO: 3259023 - DNA, 15 bp, Homo sapiens
gcctaggtgacagag

SEQ ID NO: 3259024 - DNA, 17 bp, Homo sapiens
gcctagttcatccaatc

SEQ ID NO: 3259025 - DNA, 15 bp, Homo sapiens
gcctagtttttagta

SEQ ID NO: 3259026 - DNA, 16 bp, Homo sapiens
gcctataatgaagctt

SEQ ID NO: 3259027 - DNA, 13 bp, Homo sapiens
gcctatccgctgc

SEQ ID NO: 3259028 - DNA, 16 bp, Homo sapiens
gcctatgagcatcctg

SEQ ID NO: 3259029 - DNA, 20 bp, Homo sapiens
gcctatgagcatcctgagcc

SEQ ID NO: 3259030 - DNA, 22 bp, Homo sapiens
gcctatgagcatcctgagcccc

SEQ ID NO: 3259031 - DNA, 15 bp, Homo sapiens
gcctatgatcccagc

SEQ ID NO: 3259032 - DNA, 18 bp, Homo sapiens
gcctatgatcccagcact

SEQ ID NO: 3259033 - DNA, 22 bp, Homo sapiens
gcctatgcacatatggactctg

SEQ ID NO: 3259034 - DNA, 23 bp, Homo sapiens
gcctatgcacatatggactctgc

SEQ ID NO: 3259035 - DNA, 18 bp, Homo sapiens
gcctatgtggtctaaggt

SEQ ID NO: 3259036 - DNA, 15 bp, Homo sapiens
gcctattatattaaa

SEQ ID NO: 3259037 - DNA, 17 bp, Homo sapiens
gcctcaaaggcccgctc

SEQ ID NO: 3259038 - DNA, 18 bp, Homo sapiens
gcctcaacctcctgggct

SEQ ID NO: 3259039 - DNA, 14 bp, Homo sapiens
gcctcaagagcaca

SEQ ID NO: 3259040 - DNA, 18 bp, Homo sapiens
gccctgctcctccctggc

SEQ ID NO: 3259041 - DNA, 14 bp, Homo sapiens
gccctgctcctgca

SEQ ID NO: 3259042 - DNA, 21 bp, Homo sapiens
gccctgctgccgcctcccagc

SEQ ID NO: 3259043 - DNA, 23 bp, Homo sapiens
gccctgctgccgcctcccagcct

SEQ ID NO: 3259044 - DNA, 21 bp, Homo sapiens
gccctgctggggatccccgcc

SEQ ID NO: 3259045 - DNA, 17 bp, Homo sapiens
gccctgctgtgggagag

SEQ ID NO: 3259046 - DNA, 18 bp, Homo sapiens
gccctgctttgggctgcc

SEQ ID NO: 3259047 - DNA, 19 bp, Homo sapiens
gccctgctttgggctgccc

SEQ ID NO: 3259048 - DNA, 20 bp, Homo sapiens
gccctggaacatcctttgca

SEQ ID NO: 3259049 - DNA, 21 bp, Homo sapiens
gccctggaactctatctgggc

SEQ ID NO: 3259050 - DNA, 18 bp, Homo sapiens
gccctggaggtctccagg

SEQ ID NO: 3259051 - DNA, 17 bp, Homo sapiens
gccctggcacccccaca

SEQ ID NO: 3259052 - DNA, 19 bp, Homo sapiens
gccctggcagcagcaggtg

SEQ ID NO: 3259053 - DNA, 16 bp, Homo sapiens
gccctggccagccctt

SEQ ID NO: 3259054 - DNA, 17 bp, Homo sapiens
gccctggccagcccttc

SEQ ID NO: 3259055 - DNA, 17 bp, Homo sapiens
gccctggccctgaggtg

SEQ ID NO: 3259056 - DNA, 18 bp, Homo sapiens
gccctggccctgaggtgt

SEQ ID NO: 3259057 - DNA, 12 bp, Homo sapiens
gccctggccctt

SEQ ID NO: 3259058 - DNA, 14 bp, Homo sapiens
gccctggccctttc

SEQ ID NO: 3259059 - DNA, 15 bp, Homo sapiens
gccctggccctttcc

SEQ ID NO: 3259060 - DNA, 19 bp, Homo sapiens
gccctggccctttcccctt

SEQ ID NO: 3259061 - DNA, 20 bp, Homo sapiens
gccctggccctttccccttc

SEQ ID NO: 3259062 - DNA, 12 bp, Homo sapiens
gccctggcctcc

SEQ ID NO: 3259063 - DNA, 17 bp, Homo sapiens
gccctggcctcccctgc

SEQ ID NO: 3259064 - DNA, 21 bp, Homo sapiens
gccctggcctcccctgccacc

SEQ ID NO: 3259065 - DNA, 14 bp, Homo sapiens
gccctggctctgca

SEQ ID NO: 3259066 - DNA, 15 bp, Homo sapiens
gccctggctgctgcc

SEQ ID NO: 3259067 - DNA, 16 bp, Homo sapiens
gccctggctgctgccc

SEQ ID NO: 3259068 - DNA, 21 bp, Homo sapiens
gccgcagacgggcacagacac

SEQ ID NO: 3259069 - DNA, 13 bp, Homo sapiens
gccgcagagactg

SEQ ID NO: 3259070 - DNA, 14 bp, Homo sapiens
gccgcagctcttgc

SEQ ID NO: 3259071 - DNA, 22 bp, Homo sapiens
gccgcaggtgggtgctgccctg

SEQ ID NO: 3259072 - DNA, 17 bp, Homo sapiens
gccgcattggtgactca

SEQ ID NO: 3259073 - DNA, 13 bp, Homo sapiens
gccgccaccagcc

SEQ ID NO: 3259074 - DNA, 16 bp, Homo sapiens
gccgccacccccatct

SEQ ID NO: 3259075 - DNA, 18 bp, Homo sapiens
gccgccacggcctggctg

SEQ ID NO: 3259076 - DNA, 15 bp, Homo sapiens
gccgccagctgggag

SEQ ID NO: 3259077 - DNA, 16 bp, Homo sapiens
gccgccattgccacca

SEQ ID NO: 3259078 - DNA, 15 bp, Homo sapiens
gccgccccagcccct

SEQ ID NO: 3259079 - DNA, 16 bp, Homo sapiens
gccgccccctcctgaa

SEQ ID NO: 3259080 - DNA, 17 bp, Homo sapiens
gccgccccctgcccccc

SEQ ID NO: 3259081 - DNA, 13 bp, Homo sapiens
gccgccctgggct

SEQ ID NO: 3259082 - DNA, 23 bp, Homo sapiens
gccgccctgggctgtctgtcacc

SEQ ID NO: 3259083 - DNA, 24 bp, Homo sapiens
gccgccctgggctgtctgtcacca

SEQ ID NO: 3259084 - DNA, 13 bp, Homo sapiens
gccgccgcgggtg

SEQ ID NO: 3259085 - DNA, 14 bp, Homo sapiens
gccgccgtgaccta

SEQ ID NO: 3259086 - DNA, 13 bp, Homo sapiens
gccgcctcccacg

SEQ ID NO: 3259087 - DNA, 16 bp, Homo sapiens
gccgcctcccacggca

SEQ ID NO: 3259088 - DNA, 19 bp, Homo sapiens
gccgcctcccagcctgggg

SEQ ID NO: 3259089 - DNA, 23 bp, Homo sapiens
gccgcctcctcggggctccaggc

SEQ ID NO: 3259090 - DNA, 19 bp, Homo sapiens
gccgcctgcgggctgcccc

SEQ ID NO: 3259091 - DNA, 13 bp, Homo sapiens
gccgcctgctcct

SEQ ID NO: 3259092 - DNA, 16 bp, Homo sapiens
gccgcctgctcctcac

SEQ ID NO: 3259093 - DNA, 11 bp, Homo sapiens
gccgctacctc

SEQ ID NO: 3259094 - DNA, 17 bp, Homo sapiens
gccgctacctccctccc

SEQ ID NO: 3259095 - DNA, 15 bp, Homo sapiens
gccgctcggaggccc

SEQ ID NO: 3259096 - DNA, 18 bp, Homo sapiens
gccgctcggaggccccaa

SEQ ID NO: 3259097 - DNA, 21 bp, Homo sapiens
gccgctcggaggccccaaagg

SEQ ID NO: 3259098 - DNA, 14 bp, Homo sapiens
gagagcccagaggt

SEQ ID NO: 3259099 - DNA, 23 bp, Homo sapiens
gagagcccagaggtaacagaaca

SEQ ID NO: 3259100 - DNA, 14 bp, Homo sapiens
gagagcccattccc

SEQ ID NO: 3259101 - DNA, 17 bp, Homo sapiens
gagagcccctggggcct

SEQ ID NO: 3259102 - DNA, 19 bp, Homo sapiens
gagagccctgaggcctaga

SEQ ID NO: 3259103 - DNA, 14 bp, Homo sapiens
gagagccctgctgt

SEQ ID NO: 3259104 - DNA, 16 bp, Homo sapiens
gagagccctgctgtgg

SEQ ID NO: 3259105 - DNA, 16 bp, Homo sapiens
gagagcccttcatttg

SEQ ID NO: 3259106 - DNA, 12 bp, Homo sapiens
gagagcctgctg

SEQ ID NO: 3259107 - DNA, 13 bp, Homo sapiens
gagagcctgctgg

SEQ ID NO: 3259108 - DNA, 15 bp, Homo sapiens
gagagcctgctggca

SEQ ID NO: 3259109 - DNA, 14 bp, Homo sapiens
gagagcgaggaggc

SEQ ID NO: 3259110 - DNA, 22 bp, Homo sapiens
gagaggaacgggcagcctgggc

SEQ ID NO: 3259111 - DNA, 23 bp, Homo sapiens
gagaggaactccttggcctagcc

SEQ ID NO: 3259112 - DNA, 10 bp, Homo sapiens
gagaggacag

SEQ ID NO: 3259113 - DNA, 11 bp, Homo sapiens
gagaggagaga

SEQ ID NO: 3259114 - DNA, 18 bp, Homo sapiens
gagaggagagaggcagag

SEQ ID NO: 3259115 - DNA, 21 bp, Homo sapiens
gagaggaggcagccccctcca

SEQ ID NO: 3259116 - DNA, 14 bp, Homo sapiens
gagaggatgaatgt

SEQ ID NO: 3259117 - DNA, 16 bp, Homo sapiens
gagaggatgagagccc

SEQ ID NO: 3259118 - DNA, 20 bp, Homo sapiens
gagaggatgagagcccagag

SEQ ID NO: 3259119 - DNA, 20 bp, Homo sapiens
gagaggatgggagtgggcag

SEQ ID NO: 3259120 - DNA, 20 bp, Homo sapiens
gagaggatgtggaaagcact

SEQ ID NO: 3259121 - DNA, 14 bp, Homo sapiens
gagaggcaatgatt

SEQ ID NO: 3259122 - DNA, 21 bp, Homo sapiens
gcccctggggtggccaccagt

SEQ ID NO: 3259123 - DNA, 20 bp, Homo sapiens
gcccctgggtgggtggtggg

SEQ ID NO: 3259124 - DNA, 14 bp, Homo sapiens
gcccctgtggccaa

SEQ ID NO: 3259125 - DNA, 20 bp, Homo sapiens
gcccctgtggccaactgcaa

SEQ ID NO: 3259126 - DNA, 21 bp, Homo sapiens
gcccctgtgtattcaccacca

SEQ ID NO: 3259127 - DNA, 13 bp, Homo sapiens
gccccttcccttc

SEQ ID NO: 3259128 - DNA, 12 bp, Homo sapiens
gccccttcctgg

SEQ ID NO: 3259129 - DNA, 16 bp, Homo sapiens
gccccttctctccctg

SEQ ID NO: 3259130 - DNA, 20 bp, Homo sapiens
gccccttcttgggccccaga

SEQ ID NO: 3259131 - DNA, 21 bp, Homo sapiens
gccccttgggcatccacccag

SEQ ID NO: 3259132 - DNA, 14 bp, Homo sapiens
gcccgacagcctgg

SEQ ID NO: 3259133 - DNA, 19 bp, Homo sapiens
gcccgacagcctggcacag

SEQ ID NO: 3259134 - DNA, 17 bp, Homo sapiens
gcccgacagtgccatcc

SEQ ID NO: 3259135 - DNA, 17 bp, Homo sapiens
gcccgacagttctgaac

SEQ ID NO: 3259136 - DNA, 19 bp, Homo sapiens
gcccgcaactctccagccg

SEQ ID NO: 3259137 - DNA, 13 bp, Homo sapiens
gcccgcacaccct

SEQ ID NO: 3259138 - DNA, 22 bp, Homo sapiens
gcccgcacaccctcactctgcc

SEQ ID NO: 3259139 - DNA, 13 bp, Homo sapiens
gcccgcacagcag

SEQ ID NO: 3259140 - DNA, 13 bp, Homo sapiens
gcccgcacccccg

SEQ ID NO: 3259141 - DNA, 17 bp, Homo sapiens
gcccgcacccccgcacc

SEQ ID NO: 3259142 - DNA, 20 bp, Homo sapiens
gcccgcaccccggcctcagg

SEQ ID NO: 3259143 - DNA, 18 bp, Homo sapiens
gcccgcagtgctgggacc

SEQ ID NO: 3259144 - DNA, 19 bp, Homo sapiens
gcccgcagtgctgggacca

SEQ ID NO: 3259145 - DNA, 15 bp, Homo sapiens
gcccgcgctctttct

SEQ ID NO: 3259146 - DNA, 22 bp, Homo sapiens
gcccgcgggagacagcttctct

SEQ ID NO: 3259147 - DNA, 20 bp, Homo sapiens
gagaaggacccggaggggcc

SEQ ID NO: 3259148 - DNA, 20 bp, Homo sapiens
gagaagggaatcctcctcca

SEQ ID NO: 3259149 - DNA, 15 bp, Homo sapiens
gagaagtgccttctc

SEQ ID NO: 3259150 - DNA, 19 bp, Homo sapiens
gagaagtttgtagccaggt

SEQ ID NO: 3259151 - DNA, 20 bp, Homo sapiens
gagaagtttgtagccaggta

SEQ ID NO: 3259152 - DNA, 23 bp, Homo sapiens
gagaagtttgtagccaggtactg

SEQ ID NO: 3259153 - DNA, 16 bp, Homo sapiens
gagaagttttgttttt

SEQ ID NO: 3259154 - DNA, 19 bp, Homo sapiens
gagaatagatcagtatttc

SEQ ID NO: 3259155 - DNA, 12 bp, Homo sapiens
gagaatatatac

SEQ ID NO: 3259156 - DNA, 18 bp, Homo sapiens
gagaatcactgcagccca

SEQ ID NO: 3259157 - DNA, 21 bp, Homo sapiens
gagaatctacccccagatcca

SEQ ID NO: 3259158 - DNA, 14 bp, Homo sapiens
gagaatggagacag

SEQ ID NO: 3259159 - DNA, 21 bp, Homo sapiens
gagaattgctgaagggcattc

SEQ ID NO: 3259160 - DNA, 18 bp, Homo sapiens
gagaattgcttgaaccca

SEQ ID NO: 3259161 - DNA, 18 bp, Homo sapiens
gagaattgtatgtcatgt

SEQ ID NO: 3259162 - DNA, 16 bp, Homo sapiens
gagaattttaaattat

SEQ ID NO: 3259163 - DNA, 18 bp, Homo sapiens
gagacaaaatatttccca

SEQ ID NO: 3259164 - DNA, 18 bp, Homo sapiens
gactcttctcggctcagg

SEQ ID NO: 3259165 - DNA, 19 bp, Homo sapiens
gactcttctcggctcaggc

SEQ ID NO: 3259166 - DNA, 15 bp, Homo sapiens
gactctttagagcag

SEQ ID NO: 3259167 - DNA, 16 bp, Homo sapiens
gactctttagagcagc

SEQ ID NO: 3259168 - DNA, 20 bp, Homo sapiens
gactctttctgaaggaagag

SEQ ID NO: 3259169 - DNA, 17 bp, Homo sapiens
gactcttttccttccct

SEQ ID NO: 3259170 - DNA, 20 bp, Homo sapiens
gactctttttagggccaggc

SEQ ID NO: 3259171 - DNA, 23 bp, Homo sapiens
gactctttttggactcagcccac

SEQ ID NO: 3259172 - DNA, 18 bp, Homo sapiens
gactgaaagcagcagcta

SEQ ID NO: 3259173 - DNA, 15 bp, Homo sapiens
gactgaaagtagggg

SEQ ID NO: 3259174 - DNA, 15 bp, Homo sapiens
gactgaaggggcaca

SEQ ID NO: 3259175 - DNA, 15 bp, Homo sapiens
gactgagaacttttt

SEQ ID NO: 3259176 - DNA, 16 bp, Homo sapiens
gactgagactggcact

SEQ ID NO: 3259177 - DNA, 22 bp, Homo sapiens
gactgagactggcacttagccc

SEQ ID NO: 3259178 - DNA, 21 bp, Homo sapiens
gactgagcaagaccctgtctc

SEQ ID NO: 3259179 - DNA, 16 bp, Homo sapiens
gactgagcagccgcca

SEQ ID NO: 3259180 - DNA, 20 bp, Homo sapiens
gactgagcagccgccagctg

SEQ ID NO: 3259181 - DNA, 22 bp, Homo sapiens
gactgagccccgcagacctccc

SEQ ID NO: 3259182 - DNA, 22 bp, Homo sapiens
gactgagcggccgcagagactg

SEQ ID NO: 3259183 - DNA, 23 bp, Homo sapiens
gactgagcggccgcagagactgg

SEQ ID NO: 3259184 - DNA, 15 bp, Homo sapiens
gactgaggacaaagt

SEQ ID NO: 3259185 - DNA, 15 bp, Homo sapiens
gactgaggtataaag

SEQ ID NO: 3259186 - DNA, 16 bp, Homo sapiens
gactgattctgggatg

SEQ ID NO: 3259187 - DNA, 14 bp, Homo sapiens
gactgatttagaaa

SEQ ID NO: 3259188 - DNA, 14 bp, Homo sapiens
gactgatttcagag

SEQ ID NO: 3259189 - DNA, 21 bp, Homo sapiens
gactgcaaacttttttatatc

SEQ ID NO: 3259190 - DNA, 19 bp, Homo sapiens
gactgcaagccccaccctc

SEQ ID NO: 3259191 - DNA, 21 bp, Homo sapiens
gactgcacagcgtcctgtcca

SEQ ID NO: 3259192 - DNA, 20 bp, Homo sapiens
gactgcacccagctccaggg

SEQ ID NO: 3259193 - DNA, 22 bp, Homo sapiens
gactgcatttaaatttgatttc

SEQ ID NO: 3259194 - DNA, 22 bp, Homo sapiens
gactgcccctgctgtgctgctc

SEQ ID NO: 3259195 - DNA, 15 bp, Homo sapiens
gactgcctctgccac

SEQ ID NO: 3259196 - DNA, 20 bp, Homo sapiens
gactgcgctgctttttcaaa

SEQ ID NO: 3259197 - DNA, 14 bp, Homo sapiens
gactgcgctggacg

SEQ ID NO: 3259198 - DNA, 14 bp, Homo sapiens
gactgcgttctgca

SEQ ID NO: 3259199 - DNA, 23 bp, Homo sapiens
gactgctacctctgagaagacac

SEQ ID NO: 3259200 - DNA, 19 bp, Homo sapiens
gactgctccccagccctgg

SEQ ID NO: 3259201 - DNA, 24 bp, Homo sapiens
gactgctccccagccctggctctg

SEQ ID NO: 3259202 - DNA, 12 bp, Homo sapiens
gactgctgggac

SEQ ID NO: 3259203 - DNA, 13 bp, Homo sapiens
gactgcttcccat

SEQ ID NO: 3259204 - DNA, 17 bp, Homo sapiens
gactgcttcccatccta

SEQ ID NO: 3259205 - DNA, 14 bp, Homo sapiens
gactggaagacact

SEQ ID NO: 3259206 - DNA, 18 bp, Homo sapiens
gactggaagcacagcttc

SEQ ID NO: 3259207 - DNA, 21 bp, Homo sapiens
gactggaagctaatttgcatt

SEQ ID NO: 3259208 - DNA, 13 bp, Homo sapiens
gactggaagttca

SEQ ID NO: 3259209 - DNA, 21 bp, Homo sapiens
gactggaagttcatacctaag

SEQ ID NO: 3259210 - DNA, 22 bp, Homo sapiens
gactggacatttaacttttcta

SEQ ID NO: 3259211 - DNA, 16 bp, Homo sapiens
gactggaccgtttcca

SEQ ID NO: 3259212 - DNA, 17 bp, Homo sapiens
gactggacctggtggct

SEQ ID NO: 3259213 - DNA, 15 bp, Homo sapiens
gactggaggcccctg

SEQ ID NO: 3259214 - DNA, 20 bp, Homo sapiens
gactggaggcccctggagcc

SEQ ID NO: 3259215 - DNA, 17 bp, Homo sapiens
gactggcaagaggcctc

SEQ ID NO: 3259216 - DNA, 23 bp, Homo sapiens
gactggcaagaggcctcatgcct

SEQ ID NO: 3259217 - DNA, 12 bp, Homo sapiens
gactggcaataa

SEQ ID NO: 3259218 - DNA, 16 bp, Homo sapiens
gactggcacttagccc

SEQ ID NO: 3259219 - DNA, 14 bp, Homo sapiens
gactggcaggtgca

SEQ ID NO: 3259220 - DNA, 22 bp, Homo sapiens
gactggccagttgcccagagca

SEQ ID NO: 3259221 - DNA, 23 bp, Homo sapiens
gactggccagttgcccagagcac

SEQ ID NO: 3259222 - DNA, 21 bp, Homo sapiens
gactggcccctaggctgctgc

SEQ ID NO: 3259223 - DNA, 17 bp, Homo sapiens
gactggcgttcacctcc

SEQ ID NO: 3259224 - DNA, 20 bp, Homo sapiens
gactggctagagtcctcact

SEQ ID NO: 3259225 - DNA, 17 bp, Homo sapiens
gactggctggctgcagt

SEQ ID NO: 3259226 - DNA, 13 bp, Homo sapiens
gactgggaggtag

SEQ ID NO: 3259227 - DNA, 19 bp, Homo sapiens
gactgggagtcagagccct

SEQ ID NO: 3259228 - DNA, 23 bp, Homo sapiens
gactgggagtcagagccctggct

SEQ ID NO: 3259229 - DNA, 17 bp, Homo sapiens
gactgggcctcccttgg

SEQ ID NO: 3259230 - DNA, 21 bp, Homo sapiens
gactgggcctcccttgggctg

SEQ ID NO: 3259231 - DNA, 22 bp, Homo sapiens
gactgggcctcccttgggctgg

SEQ ID NO: 3259232 - DNA, 23 bp, Homo sapiens
gactggggatgtgggagggagca

SEQ ID NO: 3259233 - DNA, 18 bp, Homo sapiens
gactgggggactgggagt

SEQ ID NO: 3259234 - DNA, 16 bp, Homo sapiens
gactggggtgggaggt

SEQ ID NO: 3259235 - DNA, 11 bp, Homo sapiens
gactggtccag

SEQ ID NO: 3259236 - DNA, 16 bp, Homo sapiens
gactggtccagctctg

SEQ ID NO: 3259237 - DNA, 17 bp, Homo sapiens
gactggtccagctctga

SEQ ID NO: 3259238 - DNA, 18 bp, Homo sapiens
gactggtccagctctgac

SEQ ID NO: 3259239 - DNA, 10 bp, Homo sapiens
gactggtgcc

SEQ ID NO: 3259240 - DNA, 16 bp, Homo sapiens
gactggtgccctcctc

SEQ ID NO: 3259241 - DNA, 17 bp, Homo sapiens
gactggtttacaggccc

SEQ ID NO: 3259242 - DNA, 13 bp, Homo sapiens
gactgtaagatgt

SEQ ID NO: 3259243 - DNA, 17 bp, Homo sapiens
gactgtaagatgttgtt

SEQ ID NO: 3259244 - DNA, 22 bp, Homo sapiens
gactgtacaaagtagaagtctt

SEQ ID NO: 3259245 - DNA, 16 bp, Homo sapiens
gactgtacacacttta

SEQ ID NO: 3259246 - DNA, 20 bp, Homo sapiens
gactgtaccacagacacaat

SEQ ID NO: 3259247 - DNA, 16 bp, Homo sapiens
gactgtactcctccca

SEQ ID NO: 3259248 - DNA, 23 bp, Homo sapiens
gactgtactcctcccaggcgccc

SEQ ID NO: 3259249 - DNA, 13 bp, Homo sapiens
gactgtagggagg

SEQ ID NO: 3259250 - DNA, 23 bp, Homo sapiens
gactgtagggagggcggcagggg

SEQ ID NO: 3259251 - DNA, 20 bp, Homo sapiens
gactgtataggtagatccag

SEQ ID NO: 3259252 - DNA, 19 bp, Homo sapiens
gactgtcctctcccctcca

SEQ ID NO: 3259253 - DNA, 23 bp, Homo sapiens
gactgtcctctcccctccagcct

SEQ ID NO: 3259254 - DNA, 21 bp, Homo sapiens
gactgtctcaagagggcactg

SEQ ID NO: 3259255 - DNA, 23 bp, Homo sapiens
gactgtctcaagagggcactggt

SEQ ID NO: 3259256 - DNA, 19 bp, Homo sapiens
gactgtctcacttaatcct

SEQ ID NO: 3259257 - DNA, 13 bp, Homo sapiens
gactgtggctgca

SEQ ID NO: 3259258 - DNA, 14 bp, Homo sapiens
gactgtggctgcag

SEQ ID NO: 3259259 - DNA, 15 bp, Homo sapiens
gactgtggctgcagg

SEQ ID NO: 3259260 - DNA, 20 bp, Homo sapiens
gactgtggctgcaggtggga

SEQ ID NO: 3259261 - DNA, 20 bp, Homo sapiens
gactgttccaaagccagtga

SEQ ID NO: 3259262 - DNA, 20 bp, Homo sapiens
gactgttccaggccctccag

SEQ ID NO: 3259263 - DNA, 11 bp, Homo sapiens
gactgttcttt

SEQ ID NO: 3259264 - DNA, 14 bp, Homo sapiens
gactgttgtgatct

SEQ ID NO: 3259265 - DNA, 14 bp, Homo sapiens
gactgtttggctta

SEQ ID NO: 3259266 - DNA, 22 bp, Homo sapiens
gactgtttggcttataaacaca

SEQ ID NO: 3259267 - DNA, 22 bp, Homo sapiens
gactgttttactgttttaattg

SEQ ID NO: 3259268 - DNA, 19 bp, Homo sapiens
gacttaaaatattcctgca

SEQ ID NO: 3259269 - DNA, 20 bp, Homo sapiens
gacttaaaattggaaatgtc

SEQ ID NO: 3259270 - DNA, 14 bp, Homo sapiens
gacttaaaggacag

SEQ ID NO: 3259271 - DNA, 19 bp, Homo sapiens
gacttaaaggacaggagga

SEQ ID NO: 3259272 - DNA, 19 bp, Homo sapiens
gacttaacggctccaggat

SEQ ID NO: 3259273 - DNA, 20 bp, Homo sapiens
gacttaagcaaaagaaaaag

SEQ ID NO: 3259274 - DNA, 20 bp, Homo sapiens
gacttaagcatctggctcta

SEQ ID NO: 3259275 - DNA, 12 bp, Homo sapiens
gacttactctaa

SEQ ID NO: 3259276 - DNA, 18 bp, Homo sapiens
gacttagaaagcaggggc

SEQ ID NO: 3259277 - DNA, 20 bp, Homo sapiens
gacttagaggcaacaggatt

SEQ ID NO: 3259278 - DNA, 23 bp, Homo sapiens
gacttaggggagttcagtattta

SEQ ID NO: 3259279 - DNA, 13 bp, Homo sapiens
gacttatgggccc

SEQ ID NO: 3259280 - DNA, 15 bp, Homo sapiens
gacttattcttttat

SEQ ID NO: 3259281 - DNA, 18 bp, Homo sapiens
gacttatttctgctctgg

SEQ ID NO: 3259282 - DNA, 20 bp, Homo sapiens
gacttatttctgctctggaa

SEQ ID NO: 3259283 - DNA, 15 bp, Homo sapiens
gacttattttctctg

SEQ ID NO: 3259284 - DNA, 18 bp, Homo sapiens
gacttattttgtcttatt

SEQ ID NO: 3259285 - DNA, 21 bp, Homo sapiens
gacttattttgtcttattctt

SEQ ID NO: 3259286 - DNA, 14 bp, Homo sapiens
gacttcagggcagg

SEQ ID NO: 3259287 - DNA, 18 bp, Homo sapiens
gacttcagggcagggctc

SEQ ID NO: 3259288 - DNA, 17 bp, Homo sapiens
gacttcattttatattt

SEQ ID NO: 3259289 - DNA, 14 bp, Homo sapiens
gacttccacatttt

SEQ ID NO: 3259290 - DNA, 15 bp, Homo sapiens
gacttccacattttt

SEQ ID NO: 3259291 - DNA, 14 bp, Homo sapiens
gacttccatctagt

SEQ ID NO: 3259292 - DNA, 20 bp, Homo sapiens
gaattatcagcaaagaaaaa

SEQ ID NO: 3259293 - DNA, 14 bp, Homo sapiens
gaattatctaattt

SEQ ID NO: 3259294 - DNA, 20 bp, Homo sapiens
gaattatcttggttgaaaat

SEQ ID NO: 3259295 - DNA, 20 bp, Homo sapiens
gaattattgtaccattttct

SEQ ID NO: 3259296 - DNA, 21 bp, Homo sapiens
gaattcaaactggggcctcca

SEQ ID NO: 3259297 - DNA, 14 bp, Homo sapiens
gaattcaaagcttg

SEQ ID NO: 3259298 - DNA, 16 bp, Homo sapiens
gaattcaaagcttgtg

SEQ ID NO: 3259299 - DNA, 17 bp, Homo sapiens
gaattcaaagcttgtga

SEQ ID NO: 3259300 - DNA, 17 bp, Homo sapiens
gaattcaagaaaggaaa

SEQ ID NO: 3259301 - DNA, 23 bp, Homo sapiens
gaattcagaagacccctgactca

SEQ ID NO: 3259302 - DNA, 18 bp, Homo sapiens
gaattcagcaccctgggt

SEQ ID NO: 3259303 - DNA, 23 bp, Homo sapiens
gaattcagctcagcttcttccta

SEQ ID NO: 3259304 - DNA, 13 bp, Homo sapiens
gaattcagtgcct

SEQ ID NO: 3259305 - DNA, 17 bp, Homo sapiens
gaattcgggtggcatcc

SEQ ID NO: 3259306 - DNA, 18 bp, Homo sapiens
gaattctgcaactagcca

SEQ ID NO: 3259307 - DNA, 14 bp, Homo sapiens
gaattctgtacttc

SEQ ID NO: 3259308 - DNA, 11 bp, Homo sapiens
gaattcttcct

SEQ ID NO: 3259309 - DNA, 20 bp, Homo sapiens
gaattgatcattttcccccc

SEQ ID NO: 3259310 - DNA, 21 bp, Homo sapiens
gaattgatcattttcccccca

SEQ ID NO: 3259311 - DNA, 14 bp, Homo sapiens
gaattgatttgcat

SEQ ID NO: 3259312 - DNA, 22 bp, Homo sapiens
gaattgatttgcattgaacaca

SEQ ID NO: 3259313 - DNA, 13 bp, Homo sapiens
gaattgcattgac

SEQ ID NO: 3259314 - DNA, 20 bp, Homo sapiens
gaatttaaaattaagtagaa

SEQ ID NO: 3259315 - DNA, 13 bp, Homo sapiens
gaatttaaatata

SEQ ID NO: 3259316 - DNA, 15 bp, Homo sapiens
gaatttaaatataat

SEQ ID NO: 3259317 - DNA, 16 bp, Homo sapiens
gaatttaagctgtaaa

SEQ ID NO: 3259318 - DNA, 15 bp, Homo sapiens
gaatttagatcttat

SEQ ID NO: 3259319 - DNA, 19 bp, Homo sapiens
gaatttagggagaaatgtt

SEQ ID NO: 3259320 - DNA, 21 bp, Homo sapiens
gaatttagggagaaatgttgt

SEQ ID NO: 3259321 - DNA, 17 bp, Homo sapiens
gaatttcacctgtaaac

SEQ ID NO: 3259322 - DNA, 18 bp, Homo sapiens
gaatttcatatctacaga

SEQ ID NO: 3259323 - DNA, 17 bp, Homo sapiens
gaatttcccacataccc

SEQ ID NO: 3259324 - DNA, 18 bp, Homo sapiens
gaatttccttactcttga

SEQ ID NO: 3259325 - DNA, 19 bp, Homo sapiens
gaatttctatctaaatgat

SEQ ID NO: 3259326 - DNA, 21 bp, Homo sapiens
gaatttcttaacttcttgctt

SEQ ID NO: 3259327 - DNA, 14 bp, Homo sapiens
gaatttcttttcct

SEQ ID NO: 3259328 - DNA, 16 bp, Homo sapiens
gaatttgaatgaaaaa

SEQ ID NO: 3259329 - DNA, 14 bp, Homo sapiens
gaatttgcctgctg

SEQ ID NO: 3259330 - DNA, 20 bp, Homo sapiens
gaatttgcctgctgggattc

SEQ ID NO: 3259331 - DNA, 18 bp, Homo sapiens
gaatttgtaacctcagct

SEQ ID NO: 3259332 - DNA, 14 bp, Homo sapiens
gaatttgtacttct

SEQ ID NO: 3259333 - DNA, 13 bp, Homo sapiens
gaatttgtatttt

SEQ ID NO: 3259334 - DNA, 15 bp, Homo sapiens
gaattttaatgtgaa

SEQ ID NO: 3259335 - DNA, 16 bp, Homo sapiens
gaattttaatgtgaag

SEQ ID NO: 3259336 - DNA, 19 bp, Homo sapiens
gaattttaggaacttcaga

SEQ ID NO: 3259337 - DNA, 13 bp, Homo sapiens
gaattttattttg

SEQ ID NO: 3259338 - DNA, 15 bp, Homo sapiens
gaattttattttgct

SEQ ID NO: 3259339 - DNA, 17 bp, Homo sapiens
gaattttattttgctga

SEQ ID NO: 3259340 - DNA, 18 bp, Homo sapiens
gaattttattttgctgag

SEQ ID NO: 3259341 - DNA, 16 bp, Homo sapiens
gaattttctaaaagct

SEQ ID NO: 3259342 - DNA, 23 bp, Homo sapiens
gaattttgtttttattttcaaga

SEQ ID NO: 3259343 - DNA, 18 bp, Homo sapiens
gacaaaaaatgttttaaa

SEQ ID NO: 3259344 - DNA, 18 bp, Homo sapiens
gacaaaaagtatattaaa

SEQ ID NO: 3259345 - DNA, 18 bp, Homo sapiens
gacaaaaagtttccatat

SEQ ID NO: 3259346 - DNA, 22 bp, Homo sapiens
gacaaaacttcttgtcagacat

SEQ ID NO: 3259347 - DNA, 16 bp, Homo sapiens
gacaaacacctcccag

SEQ ID NO: 3259348 - DNA, 17 bp, Homo sapiens
gacaaacacctcccagg

SEQ ID NO: 3259349 - DNA, 21 bp, Homo sapiens
gacaaagactcctctgggcct

SEQ ID NO: 3259350 - DNA, 19 bp, Homo sapiens
gacaaagctgctaaatctc

SEQ ID NO: 3259351 - DNA, 17 bp, Homo sapiens
gacaaagggagggagca

SEQ ID NO: 3259352 - DNA, 18 bp, Homo sapiens
gacaaatcaacagaagca

SEQ ID NO: 3259353 - DNA, 21 bp, Homo sapiens
gacaaatcaacagaagcattt

SEQ ID NO: 3259354 - DNA, 12 bp, Homo sapiens
gacaaatctgtg

SEQ ID NO: 3259355 - DNA, 14 bp, Homo sapiens
gacaaatctgtgta

SEQ ID NO: 3259356 - DNA, 16 bp, Homo sapiens
gacaaatctttaagaa

SEQ ID NO: 3259357 - DNA, 17 bp, Homo sapiens
gacaaatctttaagaat

SEQ ID NO: 3259358 - DNA, 21 bp, Homo sapiens
gacaacaccttcctcctgcag

SEQ ID NO: 3259359 - DNA, 12 bp, Homo sapiens
gacaacagaagc

SEQ ID NO: 3259360 - DNA, 15 bp, Homo sapiens
gacaacagtgctttg

SEQ ID NO: 3259361 - DNA, 19 bp, Homo sapiens
gacaaccactggtctgtag

SEQ ID NO: 3259362 - DNA, 23 bp, Homo sapiens
gacaacctgtgtgagagaattta

SEQ ID NO: 3259363 - DNA, 17 bp, Homo sapiens
gacaacgtttcagcgac

SEQ ID NO: 3259364 - DNA, 15 bp, Homo sapiens
gacaacttatttaaa

SEQ ID NO: 3259365 - DNA, 16 bp, Homo sapiens
gacaacttatttaaaa

SEQ ID NO: 3259366 - DNA, 17 bp, Homo sapiens
gacaacttatttaaaaa

SEQ ID NO: 3259367 - DNA, 17 bp, Homo sapiens
gacaagccctggcaaca

SEQ ID NO: 3259368 - DNA, 19 bp, Homo sapiens
gacaaggattgctactgtc

SEQ ID NO: 3259369 - DNA, 21 bp, Homo sapiens
gacaaggattgctactgtcct

SEQ ID NO: 3259370 - DNA, 13 bp, Homo sapiens
gacaagggattct

SEQ ID NO: 3259371 - DNA, 17 bp, Homo sapiens
gacaagggattctggga

SEQ ID NO: 3259372 - DNA, 20 bp, Homo sapiens
gacaagggattctgggaagc

SEQ ID NO: 3259373 - DNA, 12 bp, Homo sapiens
gacaagggctga

SEQ ID NO: 3259374 - DNA, 15 bp, Homo sapiens
gacaagtaatttcag

SEQ ID NO: 3259375 - DNA, 14 bp, Homo sapiens
gacaagttccatgg

SEQ ID NO: 3259376 - DNA, 15 bp, Homo sapiens
gacaatactggggtt

SEQ ID NO: 3259377 - DNA, 16 bp, Homo sapiens
gacaatagtatttctc

SEQ ID NO: 3259378 - DNA, 17 bp, Homo sapiens
gacaatagtatttctcc

SEQ ID NO: 3259379 - DNA, 17 bp, Homo sapiens
gacaatcactgaaacaa

SEQ ID NO: 3259380 - DNA, 16 bp, Homo sapiens
gacaatcagtcccctc

SEQ ID NO: 3259381 - DNA, 20 bp, Homo sapiens
gacaatcattgttttgaata

SEQ ID NO: 3259382 - DNA, 20 bp, Homo sapiens
gacaatgatgatgataatga

SEQ ID NO: 3259383 - DNA, 16 bp, Homo sapiens
gacaatggacctctca

SEQ ID NO: 3259384 - DNA, 21 bp, Homo sapiens
gacaatgtcgagtatattatt

SEQ ID NO: 3259385 - DNA, 16 bp, Homo sapiens
gacaattactcaggtt

SEQ ID NO: 3259386 - DNA, 13 bp, Homo sapiens
gacacaaaaaaag

SEQ ID NO: 3259387 - DNA, 21 bp, Homo sapiens
gacacaaaactccgcccccag

SEQ ID NO: 3259388 - DNA, 14 bp, Homo sapiens
gacacaaatgcatg

SEQ ID NO: 3259389 - DNA, 22 bp, Homo sapiens
gacacaacagcagtctccttca

SEQ ID NO: 3259390 - DNA, 22 bp, Homo sapiens
gacacaactgtgtgattaaaag

SEQ ID NO: 3259391 - DNA, 16 bp, Homo sapiens
gacacaatatgtatgc

SEQ ID NO: 3259392 - DNA, 22 bp, Homo sapiens
gacacacaattcattggctcct

SEQ ID NO: 3259393 - DNA, 12 bp, Homo sapiens
gacacacacacg

SEQ ID NO: 3259394 - DNA, 18 bp, Homo sapiens
gacacacacacgcacgca

SEQ ID NO: 3259395 - DNA, 17 bp, Homo sapiens
gacacacagaaatgtgt

SEQ ID NO: 3259396 - DNA, 18 bp, Homo sapiens
gacacaccaggcgctaat

SEQ ID NO: 3259397 - DNA, 18 bp, Homo sapiens
gacacagaaaatgttgag

SEQ ID NO: 3259398 - DNA, 19 bp, Homo sapiens
gacacagaaaatgttgaga

SEQ ID NO: 3259399 - DNA, 21 bp, Homo sapiens
gacacagactggcaataaact

SEQ ID NO: 3259400 - DNA, 22 bp, Homo sapiens
gacacagactggcaataaactc

SEQ ID NO: 3259401 - DNA, 21 bp, Homo sapiens
gacacagatcccactggaaga

SEQ ID NO: 3259402 - DNA, 13 bp, Homo sapiens
gacacagcgtccc

SEQ ID NO: 3259403 - DNA, 12 bp, Homo sapiens
gacacagctctt

SEQ ID NO: 3259404 - DNA, 15 bp, Homo sapiens
gacacagctcttcat

SEQ ID NO: 3259405 - DNA, 20 bp, Homo sapiens
gacacagctcttcattccat

SEQ ID NO: 3259406 - DNA, 19 bp, Homo sapiens
gacacagctcttctccagg

SEQ ID NO: 3259407 - DNA, 20 bp, Homo sapiens
gacacagcttaacaatgcaa

SEQ ID NO: 3259408 - DNA, 18 bp, Homo sapiens
gacacaggaaaccaacac

SEQ ID NO: 3259409 - DNA, 15 bp, Homo sapiens
gacacaggcccggct

SEQ ID NO: 3259410 - DNA, 17 bp, Homo sapiens
gacacaggcccggctcc

SEQ ID NO: 3259411 - DNA, 21 bp, Homo sapiens
gacacaggcccggctccaggc

SEQ ID NO: 3259412 - DNA, 22 bp, Homo sapiens
gacacaggtgcctcacgcctgt

SEQ ID NO: 3259413 - DNA, 19 bp, Homo sapiens
gacacatcaagcttttctg

SEQ ID NO: 3259414 - DNA, 15 bp, Homo sapiens
gacaccaaagccacc

SEQ ID NO: 3259415 - DNA, 15 bp, Homo sapiens
gacaccaaccagaca

SEQ ID NO: 3259416 - DNA, 16 bp, Homo sapiens
gacaccacacccagcc

SEQ ID NO: 3259417 - DNA, 17 bp, Homo sapiens
gacaccacacccagcct

SEQ ID NO: 3259418 - DNA, 20 bp, Homo sapiens
gacaccacacccagcctcag

SEQ ID NO: 3259419 - DNA, 13 bp, Homo sapiens
gacaccagagcag

SEQ ID NO: 3259420 - DNA, 22 bp, Homo sapiens
gacacccaccctgtgccatcac

SEQ ID NO: 3259421 - DNA, 12 bp, Homo sapiens
cttgctcccaac

SEQ ID NO: 3259422 - DNA, 19 bp, Homo sapiens
cttgctcccttcagccccc

SEQ ID NO: 3259423 - DNA, 23 bp, Homo sapiens
cttgctcctagcagacagaaact

SEQ ID NO: 3259424 - DNA, 14 bp, Homo sapiens
cttgctctccctct

SEQ ID NO: 3259425 - DNA, 17 bp, Homo sapiens
cttgctctccctcttct

SEQ ID NO: 3259426 - DNA, 20 bp, Homo sapiens
cttgctctccctcttctcaa

SEQ ID NO: 3259427 - DNA, 12 bp, Homo sapiens
cttgctctgctg

SEQ ID NO: 3259428 - DNA, 14 bp, Homo sapiens
cttgctctgctgac

SEQ ID NO: 3259429 - DNA, 22 bp, Homo sapiens
cttgctctgctgacagacacag

SEQ ID NO: 3259430 - DNA, 19 bp, Homo sapiens
cttgctctgttacccaggc

SEQ ID NO: 3259431 - DNA, 22 bp, Homo sapiens
cttgctctgttacccaggctgg

SEQ ID NO: 3259432 - DNA, 12 bp, Homo sapiens
cttgctgagtgg

SEQ ID NO: 3259433 - DNA, 22 bp, Homo sapiens
cttgctgatggctgctagattt

SEQ ID NO: 3259434 - DNA, 15 bp, Homo sapiens
cttgctgatggcttg

SEQ ID NO: 3259435 - DNA, 13 bp, Homo sapiens
cttgctgctagaa

SEQ ID NO: 3259436 - DNA, 16 bp, Homo sapiens
cttgctgctagaactt

SEQ ID NO: 3259437 - DNA, 17 bp, Homo sapiens
cttgctgctgctgcacc

SEQ ID NO: 3259438 - DNA, 19 bp, Homo sapiens
cttgctgctttagtcccga

SEQ ID NO: 3259439 - DNA, 17 bp, Homo sapiens
cttgctggacggggact

SEQ ID NO: 3259440 - DNA, 22 bp, Homo sapiens
cttgctggacggggactgggga

SEQ ID NO: 3259441 - DNA, 20 bp, Homo sapiens
cttgctggccccagccctgc

SEQ ID NO: 3259442 - DNA, 12 bp, Homo sapiens
cttgctggctct

SEQ ID NO: 3259443 - DNA, 17 bp, Homo sapiens
cttgctgtcctaggcca

SEQ ID NO: 3259444 - DNA, 13 bp, Homo sapiens
cttgctgtcctga

SEQ ID NO: 3259445 - DNA, 15 bp, Homo sapiens
cttgctgtctctgct

SEQ ID NO: 3259446 - DNA, 16 bp, Homo sapiens
cttgctgtctctgctc

SEQ ID NO: 3259447 - DNA, 19 bp, Homo sapiens
cttgcttcttactgataat

SEQ ID NO: 3259448 - DNA, 15 bp, Homo sapiens
cttgcttctttctag

SEQ ID NO: 3259449 - DNA, 18 bp, Homo sapiens
cttgcttctttctagaaa

SEQ ID NO: 3259450 - DNA, 16 bp, Homo sapiens
cttgcttggaagccag

SEQ ID NO: 3259451 - DNA, 18 bp, Homo sapiens
cttgcttggggaacttgt

SEQ ID NO: 3259452 - DNA, 22 bp, Homo sapiens
cttgcttgttgaaaatatttct

SEQ ID NO: 3259453 - DNA, 19 bp, Homo sapiens
cttgctttcaattgacaaa

SEQ ID NO: 3259454 - DNA, 17 bp, Homo sapiens
cttgctttcctgggcct

SEQ ID NO: 3259455 - DNA, 18 bp, Homo sapiens
cttgctttcctgggcctt

SEQ ID NO: 3259456 - DNA, 20 bp, Homo sapiens
cttgctttgatttacagcaa

SEQ ID NO: 3259457 - DNA, 13 bp, Homo sapiens
cttgctttgggct

SEQ ID NO: 3259458 - DNA, 15 bp, Homo sapiens
cttgctttgggcttt

SEQ ID NO: 3259459 - DNA, 21 bp, Homo sapiens
cttgctttgggctttgcaggc

SEQ ID NO: 3259460 - DNA, 23 bp, Homo sapiens
cttggaaaagtggcaagaccaaa

SEQ ID NO: 3259461 - DNA, 16 bp, Homo sapiens
cttggaaaataagaca

SEQ ID NO: 3259462 - DNA, 21 bp, Homo sapiens
cttggaaagaaacaaccgttg

SEQ ID NO: 3259463 - DNA, 20 bp, Homo sapiens
cttggaaagcatcacctcag

SEQ ID NO: 3259464 - DNA, 16 bp, Homo sapiens
cttggaaattcctgta

SEQ ID NO: 3259465 - DNA, 19 bp, Homo sapiens
cttggaaattcctgtactg

SEQ ID NO: 3259466 - DNA, 15 bp, Homo sapiens
cttggaaattccttg

SEQ ID NO: 3259467 - DNA, 21 bp, Homo sapiens
cttggaaattccttgccccac

SEQ ID NO: 3259468 - DNA, 16 bp, Homo sapiens
cttggaacattggaat

SEQ ID NO: 3259469 - DNA, 18 bp, Homo sapiens
cttggaagtgtttcaaaa

SEQ ID NO: 3259470 - DNA, 21 bp, Homo sapiens
cttggaagtttcatatattgt

SEQ ID NO: 3259471 - DNA, 20 bp, Homo sapiens
cttggaatttgtaacctcag

SEQ ID NO: 3259472 - DNA, 22 bp, Homo sapiens
cttggacaagacaaaccaagtc

SEQ ID NO: 3259473 - DNA, 23 bp, Homo sapiens
cttggacaggagtcagtgtctgg

SEQ ID NO: 3259474 - DNA, 21 bp, Homo sapiens
gacccctagttccctctgctc

SEQ ID NO: 3259475 - DNA, 22 bp, Homo sapiens
gacccctagttccctctgctca

SEQ ID NO: 3259476 - DNA, 17 bp, Homo sapiens
gacccctcctcactggc

SEQ ID NO: 3259477 - DNA, 13 bp, Homo sapiens
gacccctgcctgg

SEQ ID NO: 3259478 - DNA, 13 bp, Homo sapiens
gacccctgggagc

SEQ ID NO: 3259479 - DNA, 14 bp, Homo sapiens
gacccctgggagct

SEQ ID NO: 3259480 - DNA, 15 bp, Homo sapiens
gacccctgggagctt

SEQ ID NO: 3259481 - DNA, 18 bp, Homo sapiens
gacccctgggcctcatca

SEQ ID NO: 3259482 - DNA, 12 bp, Homo sapiens
gacccctgtctt

SEQ ID NO: 3259483 - DNA, 15 bp, Homo sapiens
gaccccttgctccct

SEQ ID NO: 3259484 - DNA, 18 bp, Homo sapiens
gacccggaggggcctggc

SEQ ID NO: 3259485 - DNA, 19 bp, Homo sapiens
gacccggaggggcctggca

SEQ ID NO: 3259486 - DNA, 18 bp, Homo sapiens
gaccctactattcatgtt

SEQ ID NO: 3259487 - DNA, 18 bp, Homo sapiens
gaccctatgggtctagga

SEQ ID NO: 3259488 - DNA, 24 bp, Homo sapiens
gaccctcatggcccccaggggcag

SEQ ID NO: 3259489 - DNA, 15 bp, Homo sapiens
gaccctccagtgctg

SEQ ID NO: 3259490 - DNA, 16 bp, Homo sapiens
gaccctcgggccccat

SEQ ID NO: 3259491 - DNA, 20 bp, Homo sapiens
gaccctcgggccccatcctc

SEQ ID NO: 3259492 - DNA, 20 bp, Homo sapiens
gaccctctgaccctagctct

SEQ ID NO: 3259493 - DNA, 16 bp, Homo sapiens
gaccctctgccaccag

SEQ ID NO: 3259494 - DNA, 23 bp, Homo sapiens
gaccctctgggaacctcccagag

SEQ ID NO: 3259495 - DNA, 17 bp, Homo sapiens
gaccctcttgcccatcc

SEQ ID NO: 3259496 - DNA, 17 bp, Homo sapiens
gaccctgacctccgccc

SEQ ID NO: 3259497 - DNA, 17 bp, Homo sapiens
gaccctgcttcaccctc

SEQ ID NO: 3259498 - DNA, 21 bp, Homo sapiens
gaccctggaattcagcaccct

SEQ ID NO: 3259499 - DNA, 16 bp, Homo sapiens
gaccctgggagagaag

SEQ ID NO: 3259500 - DNA, 17 bp, Homo sapiens
gaccctggtgcctggct

SEQ ID NO: 3259501 - DNA, 21 bp, Homo sapiens
gaccctgtccggcccagtgcc

SEQ ID NO: 3259502 - DNA, 20 bp, Homo sapiens
gacccttattgctgtcctgg

SEQ ID NO: 3259503 - DNA, 15 bp, Homo sapiens
gacccttccagacat

SEQ ID NO: 3259504 - DNA, 22 bp, Homo sapiens
gacccttcccaatcagcactga

SEQ ID NO: 3259505 - DNA, 23 bp, Homo sapiens
gaccctttagccaaacccttgtc

SEQ ID NO: 3259506 - DNA, 12 bp, Homo sapiens
gaccgccccctc

SEQ ID NO: 3259507 - DNA, 14 bp, Homo sapiens
gaccgcttcacccc

SEQ ID NO: 3259508 - DNA, 17 bp, Homo sapiens
gaccgcttcacccctgc

SEQ ID NO: 3259509 - DNA, 15 bp, Homo sapiens
gaccgggtgggcctg

SEQ ID NO: 3259510 - DNA, 16 bp, Homo sapiens
gaccgggtgggcctgg

SEQ ID NO: 3259511 - DNA, 19 bp, Homo sapiens
gaccgggtgggcctggcct

SEQ ID NO: 3259512 - DNA, 20 bp, Homo sapiens
gaccgggtgggcctggcctg

SEQ ID NO: 3259513 - DNA, 13 bp, Homo sapiens
gaccgtcctcacc

SEQ ID NO: 3259514 - DNA, 13 bp, Homo sapiens
gaccgtggacagg

SEQ ID NO: 3259515 - DNA, 19 bp, Homo sapiens
gaccgtggacaggcccagc

SEQ ID NO: 3259516 - DNA, 13 bp, Homo sapiens
gaccgtggccctg

SEQ ID NO: 3259517 - DNA, 20 bp, Homo sapiens
gaccgtgtcccaaggagctg

SEQ ID NO: 3259518 - DNA, 20 bp, Homo sapiens
gaccgtttccaagctgcggg

SEQ ID NO: 3259519 - DNA, 16 bp, Homo sapiens
gacctacattccctct

SEQ ID NO: 3259520 - DNA, 14 bp, Homo sapiens
gacctacctcaggt

SEQ ID NO: 3259521 - DNA, 19 bp, Homo sapiens
gacctacctcaggttgctg

SEQ ID NO: 3259522 - DNA, 21 bp, Homo sapiens
gacctacctccagacttcaaa

SEQ ID NO: 3259523 - DNA, 21 bp, Homo sapiens
gacctactaggagaggggggc

SEQ ID NO: 3259524 - DNA, 18 bp, Homo sapiens
gacctactgttctaaagc

SEQ ID NO: 3259525 - DNA, 22 bp, Homo sapiens
gacctatgtcctaaggacacac

SEQ ID NO: 3259526 - DNA, 16 bp, Homo sapiens
gacctattcaccctcc

SEQ ID NO: 3259527 - DNA, 17 bp, Homo sapiens
gacctcaagccctgagg

SEQ ID NO: 3259528 - DNA, 19 bp, Homo sapiens
gacctcaagccctgagggg

SEQ ID NO: 3259529 - DNA, 16 bp, Homo sapiens
gacctcacagtgaccc

SEQ ID NO: 3259530 - DNA, 22 bp, Homo sapiens
gacctcacagtgacccttccca

SEQ ID NO: 3259531 - DNA, 17 bp, Homo sapiens
gacctcaggcactagcc

SEQ ID NO: 3259532 - DNA, 19 bp, Homo sapiens
gacctcatctgtggagctg

SEQ ID NO: 3259533 - DNA, 22 bp, Homo sapiens
gacctccaataaagtgccttct

SEQ ID NO: 3259534 - DNA, 20 bp, Homo sapiens
gacctccacacccgtgagaa

SEQ ID NO: 3259535 - DNA, 16 bp, Homo sapiens
gacctccccagcccct

SEQ ID NO: 3259536 - DNA, 21 bp, Homo sapiens
gacctcccttccgaccctctg

SEQ ID NO: 3259537 - DNA, 18 bp, Homo sapiens
gacctccgcccctgcccc

SEQ ID NO: 3259538 - DNA, 17 bp, Homo sapiens
gacctcctaacaagtag

SEQ ID NO: 3259539 - DNA, 18 bp, Homo sapiens
gacctctactttccaggc

SEQ ID NO: 3259540 - DNA, 21 bp, Homo sapiens
gacctctactttccaggctag

SEQ ID NO: 3259541 - DNA, 20 bp, Homo sapiens
gacctctcagggcctggcag

SEQ ID NO: 3259542 - DNA, 14 bp, Homo sapiens
gacctcttgctgtc

SEQ ID NO: 3259543 - DNA, 17 bp, Homo sapiens
gacctcttgctgtctct

SEQ ID NO: 3259544 - DNA, 18 bp, Homo sapiens
gacctcttgctgtctctg

SEQ ID NO: 3259545 - DNA, 20 bp, Homo sapiens
gacctcttgctgtctctgct

SEQ ID NO: 3259546 - DNA, 17 bp, Homo sapiens
gacctgaaattccaaag

SEQ ID NO: 3259547 - DNA, 23 bp, Homo sapiens
gacctgaataccacttacctcaa

SEQ ID NO: 3259548 - DNA, 16 bp, Homo sapiens
gacctgaggagacatc

SEQ ID NO: 3259549 - DNA, 16 bp, Homo sapiens
gacctgagtcggcccc

SEQ ID NO: 3259550 - DNA, 21 bp, Homo sapiens
gacctgagtcggccccacatg

SEQ ID NO: 3259551 - DNA, 14 bp, Homo sapiens
gacctgatcactag

SEQ ID NO: 3259552 - DNA, 17 bp, Homo sapiens
gacctgatttcagaaga

SEQ ID NO: 3259553 - DNA, 19 bp, Homo sapiens
gacctgatttcagaagaga

SEQ ID NO: 3259554 - DNA, 13 bp, Homo sapiens
gacctgcccacaa

SEQ ID NO: 3259555 - DNA, 21 bp, Homo sapiens
gacctgccccgcccagctgca

SEQ ID NO: 3259556 - DNA, 22 bp, Homo sapiens
gacctgcctctcacacacatag

SEQ ID NO: 3259557 - DNA, 15 bp, Homo sapiens
gacctgctccgctgc

SEQ ID NO: 3259558 - DNA, 18 bp, Homo sapiens
gacctgctccgctgctcc

SEQ ID NO: 3259559 - DNA, 17 bp, Homo sapiens
gacctgcttagctgcct

SEQ ID NO: 3259560 - DNA, 20 bp, Homo sapiens
gacctgcttagctgccttga

SEQ ID NO: 3259561 - DNA, 23 bp, Homo sapiens
gacctgcttcctgaaataaacac

SEQ ID NO: 3259562 - DNA, 14 bp, Homo sapiens
gacctgctttttga

SEQ ID NO: 3259563 - DNA, 19 bp, Homo sapiens
gacctgctttttgaaatga

SEQ ID NO: 3259564 - DNA, 20 bp, Homo sapiens
gacctgctttttgaaatgaa

SEQ ID NO: 3259565 - DNA, 16 bp, Homo sapiens
gacctggaactgtagg

SEQ ID NO: 3259566 - DNA, 22 bp, Homo sapiens
gacctggaactgtagggccagg

SEQ ID NO: 3259567 - DNA, 14 bp, Homo sapiens
gacctggagcccct

SEQ ID NO: 3259568 - DNA, 15 bp, Homo sapiens
gacctggagcccctg

SEQ ID NO: 3259569 - DNA, 18 bp, Homo sapiens
gacctggagcccctgggt

SEQ ID NO: 3259570 - DNA, 15 bp, Homo sapiens
gacctggataactta

SEQ ID NO: 3259571 - DNA, 20 bp, Homo sapiens
gacctggcatctaattctga

SEQ ID NO: 3259572 - DNA, 16 bp, Homo sapiens
gacctggttcccactg

SEQ ID NO: 3259573 - DNA, 20 bp, Homo sapiens
gacctgtcatgcccccctca

SEQ ID NO: 3259574 - DNA, 20 bp, Homo sapiens
gacctgtcttccaaggagac

SEQ ID NO: 3259575 - DNA, 19 bp, Homo sapiens
gacctgtgctagttttaca

SEQ ID NO: 3259576 - DNA, 17 bp, Homo sapiens
gacctgtttatgagatg

SEQ ID NO: 3259577 - DNA, 23 bp, Homo sapiens
gaccttaataaaggcccccactt

SEQ ID NO: 3259578 - DNA, 15 bp, Homo sapiens
gaccttaatttatat

SEQ ID NO: 3259579 - DNA, 12 bp, Homo sapiens
gaccttatctgt

SEQ ID NO: 3259580 - DNA, 12 bp, Homo sapiens
gaccttcctcat

SEQ ID NO: 3259581 - DNA, 16 bp, Homo sapiens
gaccttcgggctgtgc

SEQ ID NO: 3259582 - DNA, 19 bp, Homo sapiens
gaccttctagaattataag

SEQ ID NO: 3259583 - DNA, 16 bp, Homo sapiens
gaccttggagagacac

SEQ ID NO: 3259584 - DNA, 18 bp, Homo sapiens
gaccttggagagacacag

SEQ ID NO: 3259585 - DNA, 19 bp, Homo sapiens
gaccttgtctctacaaaaa

SEQ ID NO: 3259586 - DNA, 16 bp, Homo sapiens
gaccttgttacttctg

SEQ ID NO: 3259587 - DNA, 18 bp, Homo sapiens
gacctttgggtctacaag

SEQ ID NO: 3259588 - DNA, 15 bp, Homo sapiens
gaccttttcttcatt

SEQ ID NO: 3259589 - DNA, 17 bp, Homo sapiens
gaccttttcttcatttt

SEQ ID NO: 3259590 - DNA, 16 bp, Homo sapiens
gacgaaggtcctaagg

SEQ ID NO: 3259591 - DNA, 15 bp, Homo sapiens
gacgacaggcgagag

SEQ ID NO: 3259592 - DNA, 18 bp, Homo sapiens
gacgattccttctctgaa

SEQ ID NO: 3259593 - DNA, 22 bp, Homo sapiens
gacgcaccgccgccaccagccc

SEQ ID NO: 3259594 - DNA, 14 bp, Homo sapiens
gacgcacgctcgct

SEQ ID NO: 3259595 - DNA, 21 bp, Homo sapiens
gacatcagttcctttgtgtgt

SEQ ID NO: 3259596 - DNA, 13 bp, Homo sapiens
gacatcccttcct

SEQ ID NO: 3259597 - DNA, 17 bp, Homo sapiens
gacatcccttcctggaa

SEQ ID NO: 3259598 - DNA, 18 bp, Homo sapiens
gacatcctcctcccaccc

SEQ ID NO: 3259599 - DNA, 23 bp, Homo sapiens
gacatcgccaaggactgactgag

SEQ ID NO: 3259600 - DNA, 22 bp, Homo sapiens
gacatctcaggggccagaggaa

SEQ ID NO: 3259601 - DNA, 20 bp, Homo sapiens
gacatcttcaaagcttgaag

SEQ ID NO: 3259602 - DNA, 21 bp, Homo sapiens
gacatcttcaaagcttgaaga

SEQ ID NO: 3259603 - DNA, 16 bp, Homo sapiens
gacatgaacaatgtgt

SEQ ID NO: 3259604 - DNA, 14 bp, Homo sapiens
gacatgatttcctt

SEQ ID NO: 3259605 - DNA, 19 bp, Homo sapiens
gacatgatttccttgaatg

SEQ ID NO: 3259606 - DNA, 19 bp, Homo sapiens
gacatgcattgttggctat

SEQ ID NO: 3259607 - DNA, 16 bp, Homo sapiens
gacatgctcacctcta

SEQ ID NO: 3259608 - DNA, 22 bp, Homo sapiens
gacatgcttttctgccactcca

SEQ ID NO: 3259609 - DNA, 15 bp, Homo sapiens
gacatggaaatgaag

SEQ ID NO: 3259610 - DNA, 19 bp, Homo sapiens
gacatggatgcgaggacca

SEQ ID NO: 3259611 - DNA, 23 bp, Homo sapiens
gacatggtgcctgagaggcaggc

SEQ ID NO: 3259612 - DNA, 12 bp, Homo sapiens
gacatgtgaaac

SEQ ID NO: 3259613 - DNA, 16 bp, Homo sapiens
gacatgtgacatttat

SEQ ID NO: 3259614 - DNA, 16 bp, Homo sapiens
gacatgtgaggaggaa

SEQ ID NO: 3259615 - DNA, 17 bp, Homo sapiens
gacatgtgaggaggaaa

SEQ ID NO: 3259616 - DNA, 18 bp, Homo sapiens
gacatgtgaggaggaaaa

SEQ ID NO: 3259617 - DNA, 20 bp, Homo sapiens
gacatgtgaggaggaaaagg

SEQ ID NO: 3259618 - DNA, 23 bp, Homo sapiens
gacatgtggaaagtgaatttgaa

SEQ ID NO: 3259619 - DNA, 14 bp, Homo sapiens
gacattaacagttt

SEQ ID NO: 3259620 - DNA, 19 bp, Homo sapiens
gacattaacagttttccat

SEQ ID NO: 3259621 - DNA, 23 bp, Homo sapiens
gacattaacagttttccatgaaa

SEQ ID NO: 3259622 - DNA, 16 bp, Homo sapiens
gacattaagaatgttg

SEQ ID NO: 3259623 - DNA, 18 bp, Homo sapiens
gacattaagcagccttaa

SEQ ID NO: 3259624 - DNA, 23 bp, Homo sapiens
gacattatgtggttttagatttt

SEQ ID NO: 3259625 - DNA, 16 bp, Homo sapiens
gacattatgtgtgcat

SEQ ID NO: 3259626 - DNA, 22 bp, Homo sapiens
gacattatgtgtgcatgtgtgt

SEQ ID NO: 3259627 - DNA, 12 bp, Homo sapiens
gacattccctgc

SEQ ID NO: 3259628 - DNA, 23 bp, Homo sapiens
gacattgcggacagccacggcca

SEQ ID NO: 3259629 - DNA, 13 bp, Homo sapiens
gacattgctctct

SEQ ID NO: 3259630 - DNA, 14 bp, Homo sapiens
gacattgtcaataa

SEQ ID NO: 3259631 - DNA, 15 bp, Homo sapiens
gacatttaaatgtaa

SEQ ID NO: 3259632 - DNA, 17 bp, Homo sapiens
gacatttaacttttcta

SEQ ID NO: 3259633 - DNA, 21 bp, Homo sapiens
gacatttacaccacactttca

SEQ ID NO: 3259634 - DNA, 19 bp, Homo sapiens
gacatttcccaagtcagac

SEQ ID NO: 3259635 - DNA, 22 bp, Homo sapiens
gacatttcccaagtcagacaga

SEQ ID NO: 3259636 - DNA, 21 bp, Homo sapiens
gacatttctctaactcctgcc

SEQ ID NO: 3259637 - DNA, 22 bp, Homo sapiens
gacatttctctaactcctgcca

SEQ ID NO: 3259638 - DNA, 15 bp, Homo sapiens
gacatttgccttgct

SEQ ID NO: 3259639 - DNA, 22 bp, Homo sapiens
gacatttgggagacatgtgaca

SEQ ID NO: 3259640 - DNA, 14 bp, Homo sapiens
gacatttggtggta

SEQ ID NO: 3259641 - DNA, 15 bp, Homo sapiens
gacattttcttcaga

SEQ ID NO: 3259642 - DNA, 20 bp, Homo sapiens
gacattttctttcatgggca

SEQ ID NO: 3259643 - DNA, 17 bp, Homo sapiens
gaccaaaatgacaatga

SEQ ID NO: 3259644 - DNA, 21 bp, Homo sapiens
gaccaaaatgacaatgatgat

SEQ ID NO: 3259645 - DNA, 18 bp, Homo sapiens
gaccaaacttcactctgg

SEQ ID NO: 3259646 - DNA, 17 bp, Homo sapiens
gaccaactagacattct

SEQ ID NO: 3259647 - DNA, 12 bp, Homo sapiens
gaccaactgtgt

SEQ ID NO: 3259648 - DNA, 15 bp, Homo sapiens
gaccaagaactgcat

SEQ ID NO: 3259649 - DNA, 16 bp, Homo sapiens
gaccaagagagaaaga

SEQ ID NO: 3259650 - DNA, 15 bp, Homo sapiens
gaccaagcatcttgg

SEQ ID NO: 3259651 - DNA, 11 bp, Homo sapiens
gaccaaggaac

SEQ ID NO: 3259652 - DNA, 15 bp, Homo sapiens
gaccaaggaacaaaa

SEQ ID NO: 3259653 - DNA, 16 bp, Homo sapiens
gaccaattattgatat

SEQ ID NO: 3259654 - DNA, 18 bp, Homo sapiens
gaccaatttatgggagaa

SEQ ID NO: 3259655 - DNA, 17 bp, Homo sapiens
gaccacagtgggtggca

SEQ ID NO: 3259656 - DNA, 23 bp, Homo sapiens
gaccaccagccgccccagcccct

SEQ ID NO: 3259657 - DNA, 15 bp, Homo sapiens
gaccactgtcttttt

SEQ ID NO: 3259658 - DNA, 14 bp, Homo sapiens
gaccactgttatca

SEQ ID NO: 3259659 - DNA, 23 bp, Homo sapiens
gaccagacaccttgacagggcac

SEQ ID NO: 3259660 - DNA, 21 bp, Homo sapiens
gaccagagccagatgcaggac

SEQ ID NO: 3259661 - DNA, 23 bp, Homo sapiens
gaccagagccagatgcaggacag

SEQ ID NO: 3259662 - DNA, 21 bp, Homo sapiens
gaccagagccccacacggagg

SEQ ID NO: 3259663 - DNA, 16 bp, Homo sapiens
gaccagagctgtctga

SEQ ID NO: 3259664 - DNA, 20 bp, Homo sapiens
gaccagcaacttgtcttttt

SEQ ID NO: 3259665 - DNA, 19 bp, Homo sapiens
gaccagccccttcctgggt

SEQ ID NO: 3259666 - DNA, 20 bp, Homo sapiens
gaccagccccttcctgggta

SEQ ID NO: 3259667 - DNA, 22 bp, Homo sapiens
gaccagcctccatgctgcctcc

SEQ ID NO: 3259668 - DNA, 14 bp, Homo sapiens
gaccagcctcgcca

SEQ ID NO: 3259669 - DNA, 11 bp, Homo sapiens
gaccagcctgg

SEQ ID NO: 3259670 - DNA, 13 bp, Homo sapiens
gaccagctggggc

SEQ ID NO: 3259671 - DNA, 16 bp, Homo sapiens
gaccaggactccctcc

SEQ ID NO: 3259672 - DNA, 23 bp, Homo sapiens
gaccaggactccctcctcacctc

SEQ ID NO: 3259673 - DNA, 20 bp, Homo sapiens
gaccaggatcccaagcctcc

SEQ ID NO: 3259674 - DNA, 21 bp, Homo sapiens
gaccaggatcccaagcctcct

SEQ ID NO: 3259675 - DNA, 22 bp, Homo sapiens
gaccaggatcccaagcctcctg

SEQ ID NO: 3259676 - DNA, 13 bp, Homo sapiens
gaccaggctgtag

SEQ ID NO: 3259677 - DNA, 17 bp, Homo sapiens
gaccagggatgctgggc

SEQ ID NO: 3259678 - DNA, 21 bp, Homo sapiens
gaccagggatgctgggctggg

SEQ ID NO: 3259679 - DNA, 22 bp, Homo sapiens
gaccagggatgggggatgggcc

SEQ ID NO: 3259680 - DNA, 15 bp, Homo sapiens
gaccagtggtgcctt

SEQ ID NO: 3259681 - DNA, 21 bp, Homo sapiens
gaccagtgtatcaggtcaggg

SEQ ID NO: 3259682 - DNA, 14 bp, Homo sapiens
gaccagttgggagc

SEQ ID NO: 3259683 - DNA, 15 bp, Homo sapiens
gaccataatgttaca

SEQ ID NO: 3259684 - DNA, 19 bp, Homo sapiens
gaccatatttactctttct

SEQ ID NO: 3259685 - DNA, 14 bp, Homo sapiens
gaccatcctggcta

SEQ ID NO: 3259686 - DNA, 16 bp, Homo sapiens
gaccatctgattaaaa

SEQ ID NO: 3259687 - DNA, 23 bp, Homo sapiens
gaccatgttcattataatctcaa

SEQ ID NO: 3259688 - DNA, 16 bp, Homo sapiens
gacccaaggaaaactg

SEQ ID NO: 3259689 - DNA, 14 bp, Homo sapiens
gacccaccagtgcc

SEQ ID NO: 3259690 - DNA, 16 bp, Homo sapiens
gacccaccagtgcctt

SEQ ID NO: 3259691 - DNA, 16 bp, Homo sapiens
gacccaccccacctgc

SEQ ID NO: 3259692 - DNA, 17 bp, Homo sapiens
gacccaccccacctgca

SEQ ID NO: 3259693 - DNA, 14 bp, Homo sapiens
gacccacccctgtg

SEQ ID NO: 3259694 - DNA, 17 bp, Homo sapiens
gacccacccctgtgctc

SEQ ID NO: 3259695 - DNA, 11 bp, Homo sapiens
gacccactgct

SEQ ID NO: 3259696 - DNA, 15 bp, Homo sapiens
gacccagcatctccc

SEQ ID NO: 3259697 - DNA, 18 bp, Homo sapiens
gacccagcatctcccagc

SEQ ID NO: 3259698 - DNA, 19 bp, Homo sapiens
gacccagcatctcccagca

SEQ ID NO: 3259699 - DNA, 21 bp, Homo sapiens
gacccagctactctgtccagg

SEQ ID NO: 3259700 - DNA, 15 bp, Homo sapiens
gacccaggccctcca

SEQ ID NO: 3259701 - DNA, 15 bp, Homo sapiens
gacccaggccgcagc

SEQ ID NO: 3259702 - DNA, 19 bp, Homo sapiens
gacccaggccgcagctctt

SEQ ID NO: 3259703 - DNA, 22 bp, Homo sapiens
gacccaggccgcagctcttgcc

SEQ ID NO: 3259704 - DNA, 12 bp, Homo sapiens
gacccaggctcc

SEQ ID NO: 3259705 - DNA, 13 bp, Homo sapiens
gacccaggtcttc

SEQ ID NO: 3259706 - DNA, 19 bp, Homo sapiens
gacccaggtcttccagacc

SEQ ID NO: 3259707 - DNA, 21 bp, Homo sapiens
gacccaggtcttccagacctg

SEQ ID NO: 3259708 - DNA, 23 bp, Homo sapiens
gacccaggtcttccagacctgct

SEQ ID NO: 3259709 - DNA, 22 bp, Homo sapiens
gacccaggtggagggcacagcc

SEQ ID NO: 3259710 - DNA, 12 bp, Homo sapiens
gacccagtgaga

SEQ ID NO: 3259711 - DNA, 15 bp, Homo sapiens
gacccatgctggtca

SEQ ID NO: 3259712 - DNA, 16 bp, Homo sapiens
gacccatgctggtcag

SEQ ID NO: 3259713 - DNA, 20 bp, Homo sapiens
gacccatgctggtcagagac

SEQ ID NO: 3259714 - DNA, 20 bp, Homo sapiens
gacccatgtaatccttttgt

SEQ ID NO: 3259715 - DNA, 23 bp, Homo sapiens
gaccccaaacaccttccagctcc

SEQ ID NO: 3259716 - DNA, 14 bp, Homo sapiens
gaccccaacctcag

SEQ ID NO: 3259717 - DNA, 19 bp, Homo sapiens
gaccccaatccaacccggg

SEQ ID NO: 3259718 - DNA, 12 bp, Homo sapiens
gaccccagctgg

SEQ ID NO: 3259719 - DNA, 13 bp, Homo sapiens
gaccccagctggg

SEQ ID NO: 3259720 - DNA, 21 bp, Homo sapiens
gaccccagctgtgagccttgg

SEQ ID NO: 3259721 - DNA, 13 bp, Homo sapiens
gacccccacacct

SEQ ID NO: 3259722 - DNA, 14 bp, Homo sapiens
gaccccctcccctg

SEQ ID NO: 3259723 - DNA, 18 bp, Homo sapiens
gaactgcccttgctgccc

SEQ ID NO: 3259724 - DNA, 19 bp, Homo sapiens
gaactgcccttgctgcccg

SEQ ID NO: 3259725 - DNA, 20 bp, Homo sapiens
gaactgcccttgctgcccgc

SEQ ID NO: 3259726 - DNA, 13 bp, Homo sapiens
gaactgcttcatg

SEQ ID NO: 3259727 - DNA, 18 bp, Homo sapiens
gaactgcttcatgtgaac

SEQ ID NO: 3259728 - DNA, 13 bp, Homo sapiens
gaactggaagaaa

SEQ ID NO: 3259729 - DNA, 17 bp, Homo sapiens
gaactggaagaaagcaa

SEQ ID NO: 3259730 - DNA, 15 bp, Homo sapiens
gaactggctgtgaag

SEQ ID NO: 3259731 - DNA, 14 bp, Homo sapiens
gaactgggctgggc

SEQ ID NO: 3259732 - DNA, 16 bp, Homo sapiens
gaactgggctgggcct

SEQ ID NO: 3259733 - DNA, 20 bp, Homo sapiens
gaactgtagctgccatggct

SEQ ID NO: 3259734 - DNA, 14 bp, Homo sapiens
gaactgtagggcca

SEQ ID NO: 3259735 - DNA, 13 bp, Homo sapiens
gaactgtccagag

SEQ ID NO: 3259736 - DNA, 14 bp, Homo sapiens
gaactgtccagaga

SEQ ID NO: 3259737 - DNA, 18 bp, Homo sapiens
gaactgtgcatagtgctg

SEQ ID NO: 3259738 - DNA, 11 bp, Homo sapiens
gaactgttaca

SEQ ID NO: 3259739 - DNA, 14 bp, Homo sapiens
gaactgttagatgc

SEQ ID NO: 3259740 - DNA, 20 bp, Homo sapiens
gaacttaaattatgttttaa

SEQ ID NO: 3259741 - DNA, 21 bp, Homo sapiens
gaacttactattcattaaatg

SEQ ID NO: 3259742 - DNA, 22 bp, Homo sapiens
gaacttcaagaagtaagagcta

SEQ ID NO: 3259743 - DNA, 17 bp, Homo sapiens
gaaggggttggattgca

SEQ ID NO: 3259744 - DNA, 16 bp, Homo sapiens
gaagggtcctgccggt

SEQ ID NO: 3259745 - DNA, 15 bp, Homo sapiens
gaagggtttgtggct

SEQ ID NO: 3259746 - DNA, 14 bp, Homo sapiens
gaaggtaattaaag

SEQ ID NO: 3259747 - DNA, 17 bp, Homo sapiens
gaaggtattagcaaagc

SEQ ID NO: 3259748 - DNA, 17 bp, Homo sapiens
gaaggtcctaagggagt

SEQ ID NO: 3259749 - DNA, 15 bp, Homo sapiens
gaaggtctcattctt

SEQ ID NO: 3259750 - DNA, 21 bp, Homo sapiens
gaaggtctttgttatgacagt

SEQ ID NO: 3259751 - DNA, 19 bp, Homo sapiens
gaaggtgataagggaaaag

SEQ ID NO: 3259752 - DNA, 15 bp, Homo sapiens
gaaggtgcctcagac

SEQ ID NO: 3259753 - DNA, 13 bp, Homo sapiens
gaaggtggggccc

SEQ ID NO: 3259754 - DNA, 19 bp, Homo sapiens
gaaggtggggccctgcccc

SEQ ID NO: 3259755 - DNA, 20 bp, Homo sapiens
gaagtaaactttttgttctg

SEQ ID NO: 3259756 - DNA, 15 bp, Homo sapiens
gaagtaaagcctcaa

SEQ ID NO: 3259757 - DNA, 19 bp, Homo sapiens
gaagtagcttgctccctgt

SEQ ID NO: 3259758 - DNA, 15 bp, Homo sapiens
gaagtatacttttcc

SEQ ID NO: 3259759 - DNA, 14 bp, Homo sapiens
gaagtattcacaaa

SEQ ID NO: 3259760 - DNA, 19 bp, Homo sapiens
gaagtattttgctggaata

SEQ ID NO: 3259761 - DNA, 13 bp, Homo sapiens
gaagtcacacagt

SEQ ID NO: 3259762 - DNA, 22 bp, Homo sapiens
gaagtcaccttgtgtgttccaa

SEQ ID NO: 3259763 - DNA, 18 bp, Homo sapiens
gaagtcactcaattgttt

SEQ ID NO: 3259764 - DNA, 12 bp, Homo sapiens
gaagtcatatgt

SEQ ID NO: 3259765 - DNA, 14 bp, Homo sapiens
gaagtccaatgtgg

SEQ ID NO: 3259766 - DNA, 16 bp, Homo sapiens
gaagtcgaaggatgct

SEQ ID NO: 3259767 - DNA, 20 bp, Homo sapiens
gaagtcgaaggatgctcttt

SEQ ID NO: 3259768 - DNA, 18 bp, Homo sapiens
gaagtcttagatgtatat

SEQ ID NO: 3259769 - DNA, 18 bp, Homo sapiens
gaagtctttcagtggaat

SEQ ID NO: 3259770 - DNA, 14 bp, Homo sapiens
gaagtcttttgttc

SEQ ID NO: 3259771 - DNA, 15 bp, Homo sapiens
gaagtgaatgctggg

SEQ ID NO: 3259772 - DNA, 15 bp, Homo sapiens
gaagtgactgttgta

SEQ ID NO: 3259773 - DNA, 13 bp, Homo sapiens
gaagtgatgttca

SEQ ID NO: 3259774 - DNA, 15 bp, Homo sapiens
gaagtgcgtgaatgt

SEQ ID NO: 3259775 - DNA, 20 bp, Homo sapiens
gaagtgctggcaaccactaa

SEQ ID NO: 3259776 - DNA, 21 bp, Homo sapiens
gaagtgcttagtgtacttgga

SEQ ID NO: 3259777 - DNA, 18 bp, Homo sapiens
gaagtgcttgatatgtaa

SEQ ID NO: 3259778 - DNA, 14 bp, Homo sapiens
gaagtggtccatct

SEQ ID NO: 3259779 - DNA, 16 bp, Homo sapiens
gaagtgtaacagctga

SEQ ID NO: 3259780 - DNA, 17 bp, Homo sapiens
gaagtgtaacagctgag

SEQ ID NO: 3259781 - DNA, 18 bp, Homo sapiens
gaagtgtaacagctgagg

SEQ ID NO: 3259782 - DNA, 15 bp, Homo sapiens
gaagtgtgagcgcct

SEQ ID NO: 3259783 - DNA, 14 bp, Homo sapiens
gaagtgtggaaaaa

SEQ ID NO: 3259784 - DNA, 15 bp, Homo sapiens
gaagtgtggaaaaat

SEQ ID NO: 3259785 - DNA, 18 bp, Homo sapiens
gaagtgttgaagggaggt

SEQ ID NO: 3259786 - DNA, 15 bp, Homo sapiens
gaagttaacagagac

SEQ ID NO: 3259787 - DNA, 20 bp, Homo sapiens
gaagttctcaaagttaattc

SEQ ID NO: 3259788 - DNA, 17 bp, Homo sapiens
gaagttggcacatttca

SEQ ID NO: 3259789 - DNA, 20 bp, Homo sapiens
gaagttgtgccttttatagc

SEQ ID NO: 3259790 - DNA, 16 bp, Homo sapiens
gaagtttacattgtaa

SEQ ID NO: 3259791 - DNA, 14 bp, Homo sapiens
gaagtttcacatga

SEQ ID NO: 3259792 - DNA, 14 bp, Homo sapiens
gaagtttgtagcca

SEQ ID NO: 3259793 - DNA, 17 bp, Homo sapiens
gaagtttgtagccaggt

SEQ ID NO: 3259794 - DNA, 20 bp, Homo sapiens
gaagtttgtccatttgtaaa

SEQ ID NO: 3259795 - DNA, 13 bp, Homo sapiens
gaagttttcagtg

SEQ ID NO: 3259796 - DNA, 13 bp, Homo sapiens
gaagttttctgta

SEQ ID NO: 3259797 - DNA, 19 bp, Homo sapiens
gaagtttttgaaatacctt

SEQ ID NO: 3259798 - DNA, 14 bp, Homo sapiens
gaataaaaaagaaa

SEQ ID NO: 3259799 - DNA, 20 bp, Homo sapiens
gaataaaatcctaagacaca

SEQ ID NO: 3259800 - DNA, 21 bp, Homo sapiens
gaataaaattattttggattt

SEQ ID NO: 3259801 - DNA, 23 bp, Homo sapiens
gaataaacattaattttgtgcat

SEQ ID NO: 3259802 - DNA, 22 bp, Homo sapiens
gaataaactgaatattttggaa

SEQ ID NO: 3259803 - DNA, 14 bp, Homo sapiens
gaataaagacacct

SEQ ID NO: 3259804 - DNA, 14 bp, Homo sapiens
gaataaagcagcct

SEQ ID NO: 3259805 - DNA, 16 bp, Homo sapiens
gaataaagcagcctga

SEQ ID NO: 3259806 - DNA, 17 bp, Homo sapiens
gaataaagcagcctgat

SEQ ID NO: 3259807 - DNA, 17 bp, Homo sapiens
gaataaaggcagttttc

SEQ ID NO: 3259808 - DNA, 20 bp, Homo sapiens
gaataaagttctgagtgttt

SEQ ID NO: 3259809 - DNA, 20 bp, Homo sapiens
gaataaagttctgttttctg

SEQ ID NO: 3259810 - DNA, 14 bp, Homo sapiens
gaataacatgtaat

SEQ ID NO: 3259811 - DNA, 12 bp, Homo sapiens
gaataacttgaa

SEQ ID NO: 3259812 - DNA, 17 bp, Homo sapiens
gaataagaaagtttcac

SEQ ID NO: 3259813 - DNA, 23 bp, Homo sapiens
gaataaggaggaggagggagaag

SEQ ID NO: 3259814 - DNA, 22 bp, Homo sapiens
gaataataattaggttaacatt

SEQ ID NO: 3259815 - DNA, 19 bp, Homo sapiens
gaataatatgctgccaaat

SEQ ID NO: 3259816 - DNA, 13 bp, Homo sapiens
gaataattattta

SEQ ID NO: 3259817 - DNA, 21 bp, Homo sapiens
gaataatttcccaattaggaa

SEQ ID NO: 3259818 - DNA, 14 bp, Homo sapiens
gaataatttcttac

SEQ ID NO: 3259819 - DNA, 16 bp, Homo sapiens
gaatacaattaaaggt

SEQ ID NO: 3259820 - DNA, 19 bp, Homo sapiens
gaataccattaaaactgct

SEQ ID NO: 3259821 - DNA, 20 bp, Homo sapiens
gaataccattaaaactgctt

SEQ ID NO: 3259822 - DNA, 22 bp, Homo sapiens
gaataccattaaaactgctttt

SEQ ID NO: 3259823 - DNA, 13 bp, Homo sapiens
gaatacctgctca

SEQ ID NO: 3259824 - DNA, 22 bp, Homo sapiens
gaatactgcttgcttacaatct

SEQ ID NO: 3259825 - DNA, 14 bp, Homo sapiens
gaatacttgaagaa

SEQ ID NO: 3259826 - DNA, 12 bp, Homo sapiens
gaatagatttta

SEQ ID NO: 3259827 - DNA, 19 bp, Homo sapiens
gaatagcaaggtgctcaca

SEQ ID NO: 3259828 - DNA, 15 bp, Homo sapiens
gaatagccacatttg

SEQ ID NO: 3259829 - DNA, 18 bp, Homo sapiens
gaatagccagagaggagc

SEQ ID NO: 3259830 - DNA, 13 bp, Homo sapiens
gaatagcgacagg

SEQ ID NO: 3259831 - DNA, 13 bp, Homo sapiens
gaatataaatatt

SEQ ID NO: 3259832 - DNA, 14 bp, Homo sapiens
gaatataagaaaat

SEQ ID NO: 3259833 - DNA, 12 bp, Homo sapiens
gaatataatctg

SEQ ID NO: 3259834 - DNA, 22 bp, Homo sapiens
gaatatacagcaggtgctcaat

SEQ ID NO: 3259835 - DNA, 13 bp, Homo sapiens
gaatatagcctgc

SEQ ID NO: 3259836 - DNA, 22 bp, Homo sapiens
gaatatagcctgcctcagtggc

SEQ ID NO: 3259837 - DNA, 20 bp, Homo sapiens
gaatatatctctatttgaga

SEQ ID NO: 3259838 - DNA, 11 bp, Homo sapiens
gaatatattat

SEQ ID NO: 3259839 - DNA, 12 bp, Homo sapiens
gaatatattata

SEQ ID NO: 3259840 - DNA, 13 bp, Homo sapiens
gaatatatttatt

SEQ ID NO: 3259841 - DNA, 17 bp, Homo sapiens
gaatatcattgatttta

SEQ ID NO: 3259842 - DNA, 21 bp, Homo sapiens
gaatatgattcactatttaaa

SEQ ID NO: 3259843 - DNA, 19 bp, Homo sapiens
gaatatgtttccttgttta

SEQ ID NO: 3259844 - DNA, 13 bp, Homo sapiens
gaatattaaaaaa

SEQ ID NO: 3259845 - DNA, 11 bp, Homo sapiens
gaatattcagg

SEQ ID NO: 3259846 - DNA, 12 bp, Homo sapiens
gaatattcagga

SEQ ID NO: 3259847 - DNA, 23 bp, Homo sapiens
gaatattgtgttcctttttatga

SEQ ID NO: 3259848 - DNA, 18 bp, Homo sapiens
gaatatttaagaaaagca

SEQ ID NO: 3259849 - DNA, 19 bp, Homo sapiens
gaatatttaagaaaagcac

SEQ ID NO: 3259850 - DNA, 13 bp, Homo sapiens
gaatatttataac

SEQ ID NO: 3259851 - DNA, 18 bp, Homo sapiens
gaatatttataacagcat

SEQ ID NO: 3259852 - DNA, 18 bp, Homo sapiens
gaatatttatatttcact

SEQ ID NO: 3259853 - DNA, 19 bp, Homo sapiens
gaatatttatatttcacta

SEQ ID NO: 3259854 - DNA, 20 bp, Homo sapiens
gaatatttatatttcactat

SEQ ID NO: 3259855 - DNA, 13 bp, Homo sapiens
gaatatttattac

SEQ ID NO: 3259856 - DNA, 15 bp, Homo sapiens
gaatatttattacct

SEQ ID NO: 3259857 - DNA, 17 bp, Homo sapiens
gaatatttattacctct

SEQ ID NO: 3259858 - DNA, 15 bp, Homo sapiens
gaatattttggaaac

SEQ ID NO: 3259859 - DNA, 15 bp, Homo sapiens
gaatcaaaactctcc

SEQ ID NO: 3259860 - DNA, 14 bp, Homo sapiens
gaatcaatgaaaaa

SEQ ID NO: 3259861 - DNA, 22 bp, Homo sapiens
gaatcagaagatagtcttggaa

SEQ ID NO: 3259862 - DNA, 17 bp, Homo sapiens
gaatcagagtagaaata

SEQ ID NO: 3259863 - DNA, 21 bp, Homo sapiens
gaatcaggaaagagattagaa

SEQ ID NO: 3259864 - DNA, 19 bp, Homo sapiens
gaatcagggaccagcttta

SEQ ID NO: 3259865 - DNA, 20 bp, Homo sapiens
gaatcagtaatcacttttca

SEQ ID NO: 3259866 - DNA, 19 bp, Homo sapiens
gaatcatgtcgatcctggg

SEQ ID NO: 3259867 - DNA, 24 bp, Homo sapiens
gaatcatttagcatgttgttgaaa

SEQ ID NO: 3259868 - DNA, 20 bp, Homo sapiens
gaatccaaactcaacaagtg

SEQ ID NO: 3259869 - DNA, 15 bp, Homo sapiens
gaatccaagcctcca

SEQ ID NO: 3259870 - DNA, 15 bp, Homo sapiens
gaatccaagctccct

SEQ ID NO: 3259871 - DNA, 17 bp, Homo sapiens
gaatccaagctccctgc

SEQ ID NO: 3259872 - DNA, 20 bp, Homo sapiens
gaatccaagctccctgcccc

SEQ ID NO: 3259873 - DNA, 14 bp, Homo sapiens
gaatccacctcgga

SEQ ID NO: 3259874 - DNA, 15 bp, Homo sapiens
gaatccacctcggag

SEQ ID NO: 3259875 - DNA, 16 bp, Homo sapiens
gaatccacctcggagc

SEQ ID NO: 3259876 - DNA, 17 bp, Homo sapiens
gaatcccaaatttgatt

SEQ ID NO: 3259877 - DNA, 15 bp, Homo sapiens
gaatcccagccggcc

SEQ ID NO: 3259878 - DNA, 19 bp, Homo sapiens
gaatccccaacatgcactg

SEQ ID NO: 3259879 - DNA, 14 bp, Homo sapiens
gaatcccccaggga

SEQ ID NO: 3259880 - DNA, 20 bp, Homo sapiens
gaatcccctatcccattctg

SEQ ID NO: 3259881 - DNA, 21 bp, Homo sapiens
gaatcccctatcccattctgc

SEQ ID NO: 3259882 - DNA, 20 bp, Homo sapiens
gaatcctaggctccacccca

SEQ ID NO: 3259883 - DNA, 13 bp, Homo sapiens
gaatcctggcagc

SEQ ID NO: 3259884 - DNA, 14 bp, Homo sapiens
gaatcctggcagcc

SEQ ID NO: 3259885 - DNA, 17 bp, Homo sapiens
gaatcctggcagcccag

SEQ ID NO: 3259886 - DNA, 16 bp, Homo sapiens
gaatcgatttcctccc

SEQ ID NO: 3259887 - DNA, 13 bp, Homo sapiens
gaatctaaacgtg

SEQ ID NO: 3259888 - DNA, 23 bp, Homo sapiens
gaatctaaggataatgaaataat

SEQ ID NO: 3259889 - DNA, 16 bp, Homo sapiens
gaatctataaaagaat

SEQ ID NO: 3259890 - DNA, 17 bp, Homo sapiens
gaatctcccactccagc

SEQ ID NO: 3259891 - DNA, 21 bp, Homo sapiens
gaatctgcaattcaaaagttc

SEQ ID NO: 3259892 - DNA, 12 bp, Homo sapiens
gaatctggagac

SEQ ID NO: 3259893 - DNA, 16 bp, Homo sapiens
gaatctggagaccagg

SEQ ID NO: 3259894 - DNA, 18 bp, Homo sapiens
gaatctggagaccaggga

SEQ ID NO: 3259895 - DNA, 19 bp, Homo sapiens
gaatctgtgggtctgggag

SEQ ID NO: 3259896 - DNA, 22 bp, Homo sapiens
gaatctttattcaaacttttat

SEQ ID NO: 3259897 - DNA, 20 bp, Homo sapiens
gaatgaaaaatttaagcatt

SEQ ID NO: 3259898 - DNA, 15 bp, Homo sapiens
gaatgaaaactcatt

SEQ ID NO: 3259899 - DNA, 13 bp, Homo sapiens
gaatgaaaataac

SEQ ID NO: 3259900 - DNA, 16 bp, Homo sapiens
gaatgaaaataactga

SEQ ID NO: 3259901 - DNA, 23 bp, Homo sapiens
gaatgaaaataactgaaccaaat

SEQ ID NO: 3259902 - DNA, 20 bp, Homo sapiens
gaatgaaaataactgaattt

SEQ ID NO: 3259903 - DNA, 19 bp, Homo sapiens
gaatgaaagggcccagaga

SEQ ID NO: 3259904 - DNA, 21 bp, Homo sapiens
gaatgaaagggcccagagagg

SEQ ID NO: 3259905 - DNA, 23 bp, Homo sapiens
gaatgaaatcctgcttcagtgta

SEQ ID NO: 3259906 - DNA, 16 bp, Homo sapiens
gaatgaaattaacaca

SEQ ID NO: 3259907 - DNA, 16 bp, Homo sapiens
gaatgaaattgctgaa

SEQ ID NO: 3259908 - DNA, 16 bp, Homo sapiens
gaatgaagcagtattt

SEQ ID NO: 3259909 - DNA, 22 bp, Homo sapiens
gaatgatagcccagaacaaaaa

SEQ ID NO: 3259910 - DNA, 19 bp, Homo sapiens
gaatgattcatgttatatt

SEQ ID NO: 3259911 - DNA, 23 bp, Homo sapiens
gaatgattctaatttttaagcaa

SEQ ID NO: 3259912 - DNA, 18 bp, Homo sapiens
gaatgcacaagaatggat

SEQ ID NO: 3259913 - DNA, 21 bp, Homo sapiens
gaatgcacaagaatggatcac

SEQ ID NO: 3259914 - DNA, 15 bp, Homo sapiens
gaatgcacagatata

SEQ ID NO: 3259915 - DNA, 16 bp, Homo sapiens
gaatgcacagatatac

SEQ ID NO: 3259916 - DNA, 22 bp, Homo sapiens
gaatgcacagatatactttgtg

SEQ ID NO: 3259917 - DNA, 14 bp, Homo sapiens
gaatgcacgtttca

SEQ ID NO: 3259918 - DNA, 20 bp, Homo sapiens
gaatgcagattcctgggcct

SEQ ID NO: 3259919 - DNA, 21 bp, Homo sapiens
gaatgcagattcctgggcctg

SEQ ID NO: 3259920 - DNA, 21 bp, Homo sapiens
gaatgcagggaagagggcagt

SEQ ID NO: 3259921 - DNA, 14 bp, Homo sapiens
gaatgccgtggatt

SEQ ID NO: 3259922 - DNA, 20 bp, Homo sapiens
gaatgcctcgctcccttcaa

SEQ ID NO: 3259923 - DNA, 15 bp, Homo sapiens
gaatgcctgtgccaa

SEQ ID NO: 3259924 - DNA, 16 bp, Homo sapiens
gaatgctctgtgccag

SEQ ID NO: 3259925 - DNA, 18 bp, Homo sapiens
gaatgctggactggaggc

SEQ ID NO: 3259926 - DNA, 23 bp, Homo sapiens
gaatgctggactggaggcccctg

SEQ ID NO: 3259927 - DNA, 17 bp, Homo sapiens
gaatgctggttttccta

SEQ ID NO: 3259928 - DNA, 18 bp, Homo sapiens
gaatgctggttttcctaa

SEQ ID NO: 3259929 - DNA, 20 bp, Homo sapiens
gaatgctgtacatctatttt

SEQ ID NO: 3259930 - DNA, 15 bp, Homo sapiens
gaatgctgtatatgt

SEQ ID NO: 3259931 - DNA, 15 bp, Homo sapiens
gaatggacatcctgt

SEQ ID NO: 3259932 - DNA, 16 bp, Homo sapiens
gaatggagaatggtgt

SEQ ID NO: 3259933 - DNA, 13 bp, Homo sapiens
gaatggaggcaga

SEQ ID NO: 3259934 - DNA, 19 bp, Homo sapiens
gaatggatcacaagatgga

SEQ ID NO: 3259935 - DNA, 24 bp, Homo sapiens
gaatggccctagaactgtgcctag

SEQ ID NO: 3259936 - DNA, 17 bp, Homo sapiens
gaatggcctgccttgaa

SEQ ID NO: 3259937 - DNA, 11 bp, Homo sapiens
gaatgggaatt

SEQ ID NO: 3259938 - DNA, 18 bp, Homo sapiens
gaatggggatcacagaga

SEQ ID NO: 3259939 - DNA, 22 bp, Homo sapiens
gaatggtgtgaacccgggaagc

SEQ ID NO: 3259940 - DNA, 19 bp, Homo sapiens
gaatggttaataaaactgc

SEQ ID NO: 3259941 - DNA, 22 bp, Homo sapiens
gaatggttttcaaaataaaaat

SEQ ID NO: 3259942 - DNA, 18 bp, Homo sapiens
gaatgtaactccagatag

SEQ ID NO: 3259943 - DNA, 23 bp, Homo sapiens
gaatgtaagaaaacaaaatctaa

SEQ ID NO: 3259944 - DNA, 11 bp, Homo sapiens
gaatgtaatca

SEQ ID NO: 3259945 - DNA, 18 bp, Homo sapiens
gaatgtaatcaatgtttc

SEQ ID NO: 3259946 - DNA, 19 bp, Homo sapiens
gaatgtaatcaatgtttct

SEQ ID NO: 3259947 - DNA, 17 bp, Homo sapiens
gaatgtatcaggaaata

SEQ ID NO: 3259948 - DNA, 14 bp, Homo sapiens
gaatgtatctgtga

SEQ ID NO: 3259949 - DNA, 16 bp, Homo sapiens
gaatgtattattctgc

SEQ ID NO: 3259950 - DNA, 17 bp, Homo sapiens
gaatgtattattctgca

SEQ ID NO: 3259951 - DNA, 18 bp, Homo sapiens
gaatgtattattctgcag

SEQ ID NO: 3259952 - DNA, 14 bp, Homo sapiens
gaatgtatttatgt

SEQ ID NO: 3259953 - DNA, 18 bp, Homo sapiens
gaatgtggcttgagaaat

SEQ ID NO: 3259954 - DNA, 15 bp, Homo sapiens
gaatgtgggcactgg

SEQ ID NO: 3259955 - DNA, 17 bp, Homo sapiens
gaatgtggtctcaggat

SEQ ID NO: 3259956 - DNA, 21 bp, Homo sapiens
gaatgtgtgtgtgtggcaggg

SEQ ID NO: 3259957 - DNA, 19 bp, Homo sapiens
gaatgttaagaattgacca

SEQ ID NO: 3259958 - DNA, 11 bp, Homo sapiens
gaatgttctga

SEQ ID NO: 3259959 - DNA, 19 bp, Homo sapiens
gaatgttctgacattaaca

SEQ ID NO: 3259960 - DNA, 21 bp, Homo sapiens
gaatgtttaaagatcatgaca

SEQ ID NO: 3259961 - DNA, 20 bp, Homo sapiens
gaatgtttacactctttgta

SEQ ID NO: 3259962 - DNA, 23 bp, Homo sapiens
gaatgtttcttaactataaatat

SEQ ID NO: 3259963 - DNA, 14 bp, Homo sapiens
gaattaaaaaagca

SEQ ID NO: 3259964 - DNA, 13 bp, Homo sapiens
gaattaaaactca

SEQ ID NO: 3259965 - DNA, 20 bp, Homo sapiens
gaattaaacttttaattcat

SEQ ID NO: 3259966 - DNA, 12 bp, Homo sapiens
gaattaaataaa

SEQ ID NO: 3259967 - DNA, 21 bp, Homo sapiens
gaattaaattaggaataaata

SEQ ID NO: 3259968 - DNA, 13 bp, Homo sapiens
gaattaaatttaa

SEQ ID NO: 3259969 - DNA, 18 bp, Homo sapiens
gaattaacctggtgctgg

SEQ ID NO: 3259970 - DNA, 19 bp, Homo sapiens
gaattaacctggtgctgga

SEQ ID NO: 3259971 - DNA, 13 bp, Homo sapiens
gaattaagaatat

SEQ ID NO: 3259972 - DNA, 21 bp, Homo sapiens
gaattaatcatctataaagaa

SEQ ID NO: 3259973 - DNA, 22 bp, Homo sapiens
gaattacatgtaaaacattatc

SEQ ID NO: 3259974 - DNA, 15 bp, Homo sapiens
gaattactgtatata

SEQ ID NO: 3259975 - DNA, 17 bp, Homo sapiens
gaattagaagtctttca

SEQ ID NO: 3259976 - DNA, 16 bp, Homo sapiens
gaattagagaagctga

SEQ ID NO: 3259977 - DNA, 18 bp, Homo sapiens
gaattagagaagctgaaa

SEQ ID NO: 3259978 - DNA, 19 bp, Homo sapiens
gaattagagaagctgaaag

SEQ ID NO: 3259979 - DNA, 15 bp, Homo sapiens
gaattagattatatt

SEQ ID NO: 3259980 - DNA, 16 bp, Homo sapiens
gaattaggctgtaact

SEQ ID NO: 3259981 - DNA, 17 bp, Homo sapiens
gaattaggctgtaacta

SEQ ID NO: 3259982 - DNA, 23 bp, Homo sapiens
gaattaggctgtaactactttat

SEQ ID NO: 3259983 - DNA, 13 bp, Homo sapiens
gaattataacagt

SEQ ID NO: 3259984 - DNA, 19 bp, Homo sapiens
gaattataacagttatatt

SEQ ID NO: 3259985 - DNA, 21 bp, Homo sapiens
gaattataacagttatatttt

SEQ ID NO: 3259986 - DNA, 22 bp, Homo sapiens
gaattatatatttctaactata

SEQ ID NO: 3259987 - DNA, 18 bp, Homo sapiens
gaattatcagcaaagaaa

SEQ ID NO: 3259988 - DNA, 14 bp, Homo sapiens
ctttttagccagtg

SEQ ID NO: 3259989 - DNA, 11 bp, Homo sapiens
ctttttataaa

SEQ ID NO: 3259990 - DNA, 19 bp, Homo sapiens
ctttttataaaaagataat

SEQ ID NO: 3259991 - DNA, 15 bp, Homo sapiens
ctttttatttgcatg

SEQ ID NO: 3259992 - DNA, 23 bp, Homo sapiens
ctttttcatttatctataattta

SEQ ID NO: 3259993 - DNA, 13 bp, Homo sapiens
ctttttccagagg

SEQ ID NO: 3259994 - DNA, 19 bp, Homo sapiens
ctttttccatcattttaca

SEQ ID NO: 3259995 - DNA, 17 bp, Homo sapiens
ctttttcccctttctgt

SEQ ID NO: 3259996 - DNA, 18 bp, Homo sapiens
ctttttcctctgagccca

SEQ ID NO: 3259997 - DNA, 21 bp, Homo sapiens
ctttttcctctgagcccagct

SEQ ID NO: 3259998 - DNA, 17 bp, Homo sapiens
ctttttctgttgtaact

SEQ ID NO: 3259999 - DNA, 18 bp, Homo sapiens
ctttttctttataaactt

SEQ ID NO: 3260000 - DNA, 17 bp, Homo sapiens
ctttttgaaatgaaatt

SEQ ID NO: 3260001 - DNA, 18 bp, Homo sapiens
ctttttgaggtggcactt

SEQ ID NO: 3260002 - DNA, 19 bp, Homo sapiens
ctttttgataagcacatta

SEQ ID NO: 3260003 - DNA, 16 bp, Homo sapiens
ctttttgatcctctac

SEQ ID NO: 3260004 - DNA, 11 bp, Homo sapiens
ctttttggaat

SEQ ID NO: 3260005 - DNA, 18 bp, Homo sapiens
ctttttggaatctttgta

SEQ ID NO: 3260006 - DNA, 16 bp, Homo sapiens
ctttttgtaaatactg

SEQ ID NO: 3260007 - DNA, 21 bp, Homo sapiens
ctttttgttgtaaaacaaaat

SEQ ID NO: 3260008 - DNA, 18 bp, Homo sapiens
cttttttaaaatcaactt

SEQ ID NO: 3260009 - DNA, 15 bp, Homo sapiens
cttttttaaataaac

SEQ ID NO: 3260010 - DNA, 19 bp, Homo sapiens
cttttttaaataaactttt

SEQ ID NO: 3260011 - DNA, 18 bp, Homo sapiens
cttttttaaatattttct

SEQ ID NO: 3260012 - DNA, 21 bp, Homo sapiens
cttttttaaattttcttcagt

SEQ ID NO: 3260013 - DNA, 18 bp, Homo sapiens
cttttttatgtgccgtgt

SEQ ID NO: 3260014 - DNA, 14 bp, Homo sapiens
cttttttatttacc

SEQ ID NO: 3260015 - DNA, 12 bp, Homo sapiens
cttttttcaaaa

SEQ ID NO: 3260016 - DNA, 15 bp, Homo sapiens
cttttttcactacat

SEQ ID NO: 3260017 - DNA, 22 bp, Homo sapiens
cttttttcatttcttcctcagc

SEQ ID NO: 3260018 - DNA, 18 bp, Homo sapiens
cttttttccttaatccag

SEQ ID NO: 3260019 - DNA, 16 bp, Homo sapiens
cttttttctttaagat

SEQ ID NO: 3260020 - DNA, 15 bp, Homo sapiens
cttttttgtgtatgt

SEQ ID NO: 3260021 - DNA, 18 bp, Homo sapiens
cttttttgtgtatgtact

SEQ ID NO: 3260022 - DNA, 24 bp, Homo sapiens
cttttttgtgtatgtacttagctg

SEQ ID NO: 3260023 - DNA, 13 bp, Homo sapiens
cttttttgttttg

SEQ ID NO: 3260024 - DNA, 15 bp, Homo sapiens
ctttttttcaatgtg

SEQ ID NO: 3260025 - DNA, 19 bp, Homo sapiens
ctttttttccatctttaca

SEQ ID NO: 3260026 - DNA, 14 bp, Homo sapiens
ctttttttctgtac

SEQ ID NO: 3260027 - DNA, 15 bp, Homo sapiens
ctttttttcttaaaa

SEQ ID NO: 3260028 - DNA, 23 bp, Homo sapiens
ctttttttggtataatgtttaaa

SEQ ID NO: 3260029 - DNA, 23 bp, Homo sapiens
ctttttttttatactgcacagtg

SEQ ID NO: 3260030 - DNA, 17 bp, Homo sapiens
cttttttttttctgttg

SEQ ID NO: 3260031 - DNA, 19 bp, Homo sapiens
cttttttttttctgttgaa

SEQ ID NO: 3260032 - DNA, 16 bp, Homo sapiens
ctttttttttttttcc

SEQ ID NO: 3260033 - DNA, 18 bp, Homo sapiens
cttttttttttttttaca

SEQ ID NO: 3260034 - DNA, 20 bp, Homo sapiens
cttttttttttttttacagt

SEQ ID NO: 3260035 - DNA, 19 bp, Homo sapiens
ctttttttttttttttgaa

SEQ ID NO: 3260036 - DNA, 15 bp, Homo sapiens
gaaaaaaaaaaaagc

SEQ ID NO: 3260037 - DNA, 15 bp, Homo sapiens
gaaaaaaaaacagct

SEQ ID NO: 3260038 - DNA, 21 bp, Homo sapiens
gaaaaaaaaagtcagactgct

SEQ ID NO: 3260039 - DNA, 15 bp, Homo sapiens
gaaaaaaaaccttgt

SEQ ID NO: 3260040 - DNA, 17 bp, Homo sapiens
gaaaaaaactgggataa

SEQ ID NO: 3260041 - DNA, 18 bp, Homo sapiens
gaaaaaaacttggcactt

SEQ ID NO: 3260042 - DNA, 13 bp, Homo sapiens
gaaaaaaatgact

SEQ ID NO: 3260043 - DNA, 17 bp, Homo sapiens
gaaaaaaatgagactta

SEQ ID NO: 3260044 - DNA, 13 bp, Homo sapiens
gaaaaaaattatt

SEQ ID NO: 3260045 - DNA, 19 bp, Homo sapiens
gaaaaaacacctagcttta

SEQ ID NO: 3260046 - DNA, 22 bp, Homo sapiens
gaaaaaagcacatacattaaaa

SEQ ID NO: 3260047 - DNA, 21 bp, Homo sapiens
gaaaaaataattgatttcaag

SEQ ID NO: 3260048 - DNA, 14 bp, Homo sapiens
gaaaaaatttaaaa

SEQ ID NO: 3260049 - DNA, 13 bp, Homo sapiens
gaaaaacaatctt

SEQ ID NO: 3260050 - DNA, 15 bp, Homo sapiens
gaaaaacacaagcaa

SEQ ID NO: 3260051 - DNA, 23 bp, Homo sapiens
gaaaaacaccgcttctgcctttt

SEQ ID NO: 3260052 - DNA, 20 bp, Homo sapiens
gaaaaaccactcccagtccc

SEQ ID NO: 3260053 - DNA, 11 bp, Homo sapiens
gaaaaactgct

SEQ ID NO: 3260054 - DNA, 20 bp, Homo sapiens
gaaaaacttccatgaggcca

SEQ ID NO: 3260055 - DNA, 17 bp, Homo sapiens
gaaaaagcacaagaagc

SEQ ID NO: 3260056 - DNA, 12 bp, Homo sapiens
gaaaaagcatga

SEQ ID NO: 3260057 - DNA, 21 bp, Homo sapiens
gaaaaagctcctgtcctccca

SEQ ID NO: 3260058 - DNA, 12 bp, Homo sapiens
gaaaaaggcagt

SEQ ID NO: 3260059 - DNA, 13 bp, Homo sapiens
gaaaaaggcagtg

SEQ ID NO: 3260060 - DNA, 22 bp, Homo sapiens
gaaaaataccatgtctctaagc

SEQ ID NO: 3260061 - DNA, 12 bp, Homo sapiens
gaaaaatataaa

SEQ ID NO: 3260062 - DNA, 16 bp, Homo sapiens
gaaaaatataaaatta

SEQ ID NO: 3260063 - DNA, 16 bp, Homo sapiens
gaaaaatatcttggcc

SEQ ID NO: 3260064 - DNA, 17 bp, Homo sapiens
gaaaaatcatgggccag

SEQ ID NO: 3260065 - DNA, 17 bp, Homo sapiens
gaaaaatccagaaagaa

SEQ ID NO: 3260066 - DNA, 18 bp, Homo sapiens
gaaaaatccagaaagaaa

SEQ ID NO: 3260067 - DNA, 16 bp, Homo sapiens
gaaaaatctaagtgat

SEQ ID NO: 3260068 - DNA, 20 bp, Homo sapiens
gaaaaatgagaattttatat

SEQ ID NO: 3260069 - DNA, 12 bp, Homo sapiens
gaaaaatgctgc

SEQ ID NO: 3260070 - DNA, 19 bp, Homo sapiens
gaaaaatgggtcttttata

SEQ ID NO: 3260071 - DNA, 11 bp, Homo sapiens
gaaaaatgttt

SEQ ID NO: 3260072 - DNA, 13 bp, Homo sapiens
gaaaaatgtttgt

SEQ ID NO: 3260073 - DNA, 16 bp, Homo sapiens
gaaaaattggggagga

SEQ ID NO: 3260074 - DNA, 19 bp, Homo sapiens
gaaaaattggggaggaggg

SEQ ID NO: 3260075 - DNA, 20 bp, Homo sapiens
gaaaaatttaagcattgttt

SEQ ID NO: 3260076 - DNA, 15 bp, Homo sapiens
gaaaacaaaatctaa

SEQ ID NO: 3260077 - DNA, 22 bp, Homo sapiens
gaaaacaaagccaaacaaaact

SEQ ID NO: 3260078 - DNA, 19 bp, Homo sapiens
gaaaacaatgcaaaacctt

SEQ ID NO: 3260079 - DNA, 17 bp, Homo sapiens
gaaaacacactcaaaag

SEQ ID NO: 3260080 - DNA, 16 bp, Homo sapiens
gaaaacagagcctgcc

SEQ ID NO: 3260081 - DNA, 19 bp, Homo sapiens
gaaaacagagcctgcctaa

SEQ ID NO: 3260082 - DNA, 20 bp, Homo sapiens
gaaaacattctgatttggaa

SEQ ID NO: 3260083 - DNA, 19 bp, Homo sapiens
gaaaacattttatttttaa

SEQ ID NO: 3260084 - DNA, 18 bp, Homo sapiens
gaaaaccaagccgtggct

SEQ ID NO: 3260085 - DNA, 19 bp, Homo sapiens
gaaaaccaagccgtggctt

SEQ ID NO: 3260086 - DNA, 20 bp, Homo sapiens
gaaaagcacttttgttattc

SEQ ID NO: 3260087 - DNA, 19 bp, Homo sapiens
gaaaagcagtcccattcat

SEQ ID NO: 3260088 - DNA, 14 bp, Homo sapiens
gaaaagcataacac

SEQ ID NO: 3260089 - DNA, 17 bp, Homo sapiens
gaaaagcataacaccaa

SEQ ID NO: 3260090 - DNA, 15 bp, Homo sapiens
gaaaagccgaaaggg

SEQ ID NO: 3260091 - DNA, 23 bp, Homo sapiens
gaaaagccgaaagggttaatcat

SEQ ID NO: 3260092 - DNA, 17 bp, Homo sapiens
gaaaagcgtctttaaga

SEQ ID NO: 3260093 - DNA, 21 bp, Homo sapiens
gaaaagcgtctttaagagact

SEQ ID NO: 3260094 - DNA, 24 bp, Homo sapiens
gaaaagctagtgtacctcctctca

SEQ ID NO: 3260095 - DNA, 15 bp, Homo sapiens
gaaaagctgcattta

SEQ ID NO: 3260096 - DNA, 21 bp, Homo sapiens
gaaaagctgcatttaaatcaa

SEQ ID NO: 3260097 - DNA, 21 bp, Homo sapiens
gaaaagctgccatttcccttc

SEQ ID NO: 3260098 - DNA, 17 bp, Homo sapiens
gaaaagctgctgacagt

SEQ ID NO: 3260099 - DNA, 23 bp, Homo sapiens
gaaaagcttcttaattaatttga

SEQ ID NO: 3260100 - DNA, 19 bp, Homo sapiens
gaaaaggaaaaaaagcaaa

SEQ ID NO: 3260101 - DNA, 13 bp, Homo sapiens
gaaaaggaagact

SEQ ID NO: 3260102 - DNA, 17 bp, Homo sapiens
gaaaaggccttcttccc

SEQ ID NO: 3260103 - DNA, 17 bp, Homo sapiens
gaaaagggagtttaaaa

SEQ ID NO: 3260104 - DNA, 21 bp, Homo sapiens
gaaaaggttatgttcattttt

SEQ ID NO: 3260105 - DNA, 17 bp, Homo sapiens
gaaaagtaattttgtca

SEQ ID NO: 3260106 - DNA, 18 bp, Homo sapiens
gaaaagtaattttgtcac

SEQ ID NO: 3260107 - DNA, 14 bp, Homo sapiens
gaaaagtacattta

SEQ ID NO: 3260108 - DNA, 16 bp, Homo sapiens
gaaaagtacatttaat

SEQ ID NO: 3260109 - DNA, 16 bp, Homo sapiens
gaaaagtcgttttcca

SEQ ID NO: 3260110 - DNA, 23 bp, Homo sapiens
gaaaagtggcgtgggagccagcc

SEQ ID NO: 3260111 - DNA, 15 bp, Homo sapiens
gaaaagttaaactaa

SEQ ID NO: 3260112 - DNA, 14 bp, Homo sapiens
gaaaagttgtctta

SEQ ID NO: 3260113 - DNA, 14 bp, Homo sapiens
gaaaataaacacca

SEQ ID NO: 3260114 - DNA, 13 bp, Homo sapiens
gaaaataactgaa

SEQ ID NO: 3260115 - DNA, 18 bp, Homo sapiens
gaaaataactgaatttgg

SEQ ID NO: 3260116 - DNA, 13 bp, Homo sapiens
gaaaataattgtt

SEQ ID NO: 3260117 - DNA, 20 bp, Homo sapiens
gaaaatagtaaatgctttgt

SEQ ID NO: 3260118 - DNA, 13 bp, Homo sapiens
gaaaatagtttgt

SEQ ID NO: 3260119 - DNA, 14 bp, Homo sapiens
gaaaatagtttgtt

SEQ ID NO: 3260120 - DNA, 21 bp, Homo sapiens
gaaaatatctcttgtgctttt

SEQ ID NO: 3260121 - DNA, 20 bp, Homo sapiens
gaaaatattctctatttgaa

SEQ ID NO: 3260122 - DNA, 19 bp, Homo sapiens
gaaaatatttcctgacttg

SEQ ID NO: 3260123 - DNA, 22 bp, Homo sapiens
gaaaatatttcctgacttgagt

SEQ ID NO: 3260124 - DNA, 18 bp, Homo sapiens
gaaaatattttttatata

SEQ ID NO: 3260125 - DNA, 14 bp, Homo sapiens
gaaaatccttttaa

SEQ ID NO: 3260126 - DNA, 22 bp, Homo sapiens
gaaaatccttttaaccatttta

SEQ ID NO: 3260127 - DNA, 21 bp, Homo sapiens
gaaaatctaatattaaaaata

SEQ ID NO: 3260128 - DNA, 19 bp, Homo sapiens
gaaaatctttataaatgta

SEQ ID NO: 3260129 - DNA, 17 bp, Homo sapiens
gaaaatgaagaaggaag

SEQ ID NO: 3260130 - DNA, 14 bp, Homo sapiens
gaaaatgaagggat

SEQ ID NO: 3260131 - DNA, 16 bp, Homo sapiens
gaaaatgaattttttc

SEQ ID NO: 3260132 - DNA, 16 bp, Homo sapiens
gaaaatgagcatcaga

SEQ ID NO: 3260133 - DNA, 19 bp, Homo sapiens
gaaaatgagtatttggtcc

SEQ ID NO: 3260134 - DNA, 20 bp, Homo sapiens
gaaaatgagtatttggtcca

SEQ ID NO: 3260135 - DNA, 18 bp, Homo sapiens
gaaaatgagttgtgaaag

SEQ ID NO: 3260136 - DNA, 22 bp, Homo sapiens
gaaaatggtccaattagtttcc

SEQ ID NO: 3260137 - DNA, 20 bp, Homo sapiens
gaaaatggtttattttgtat

SEQ ID NO: 3260138 - DNA, 11 bp, Homo sapiens
gaaaatgtaaa

SEQ ID NO: 3260139 - DNA, 15 bp, Homo sapiens
gaaaatgtaaaggag

SEQ ID NO: 3260140 - DNA, 12 bp, Homo sapiens
gaaaatgtactg

SEQ ID NO: 3260141 - DNA, 21 bp, Homo sapiens
gaaaatgtcagaaaccagtta

SEQ ID NO: 3260142 - DNA, 16 bp, Homo sapiens
gaaaatgttatttaac

SEQ ID NO: 3260143 - DNA, 17 bp, Homo sapiens
gaaaatgttgagaatcc

SEQ ID NO: 3260144 - DNA, 20 bp, Homo sapiens
gaaaatgttgagaatcccaa

SEQ ID NO: 3260145 - DNA, 18 bp, Homo sapiens
gaaaattaggatttcatg

SEQ ID NO: 3260146 - DNA, 22 bp, Homo sapiens
gaaaattaggatttcatgattt

SEQ ID NO: 3260147 - DNA, 16 bp, Homo sapiens
gaaaattcatttcaca

SEQ ID NO: 3260148 - DNA, 22 bp, Homo sapiens
gaaaattctaacccaggtatcc

SEQ ID NO: 3260149 - DNA, 20 bp, Homo sapiens
gaaaattctgtgccttgttt

SEQ ID NO: 3260150 - DNA, 12 bp, Homo sapiens
gaaaattgcact

SEQ ID NO: 3260151 - DNA, 15 bp, Homo sapiens
gaaaatttgctttaa

SEQ ID NO: 3260152 - DNA, 21 bp, Homo sapiens
gaaaattttaaaaatacatat

SEQ ID NO: 3260153 - DNA, 15 bp, Homo sapiens
gaaaatttttacatt

SEQ ID NO: 3260154 - DNA, 16 bp, Homo sapiens
gaaaattttttttcaa

SEQ ID NO: 3260155 - DNA, 15 bp, Homo sapiens
gaaacaaaaagagct

SEQ ID NO: 3260156 - DNA, 15 bp, Homo sapiens
gaaacaaagaagtgt

SEQ ID NO: 3260157 - DNA, 15 bp, Homo sapiens
gaaacaataaagaga

SEQ ID NO: 3260158 - DNA, 22 bp, Homo sapiens
gaaacacaagagacttaaagga

SEQ ID NO: 3260159 - DNA, 16 bp, Homo sapiens
gaaacacaccaggctg

SEQ ID NO: 3260160 - DNA, 23 bp, Homo sapiens
gaaacacaccaggctgtgggcct

SEQ ID NO: 3260161 - DNA, 15 bp, Homo sapiens
gaaacacagagaagc

SEQ ID NO: 3260162 - DNA, 14 bp, Homo sapiens
gaaacacagctgtt

SEQ ID NO: 3260163 - DNA, 16 bp, Homo sapiens
gaaacactgaaaagaa

SEQ ID NO: 3260164 - DNA, 22 bp, Homo sapiens
gaaacactttgcctcctgtgta

SEQ ID NO: 3260165 - DNA, 16 bp, Homo sapiens
gaaacagaaaaataag

SEQ ID NO: 3260166 - DNA, 19 bp, Homo sapiens
gaaacagagacaggcccaa

SEQ ID NO: 3260167 - DNA, 21 bp, Homo sapiens
gaaacagagtggcctccctgc

SEQ ID NO: 3260168 - DNA, 22 bp, Homo sapiens
gaaacagattcaggccagccca

SEQ ID NO: 3260169 - DNA, 23 bp, Homo sapiens
gaaacagattcaggccagcccag

SEQ ID NO: 3260170 - DNA, 18 bp, Homo sapiens
gaaacagccatgtccaag

SEQ ID NO: 3260171 - DNA, 21 bp, Homo sapiens
gaaacagccattgcggcccca

SEQ ID NO: 3260172 - DNA, 15 bp, Homo sapiens
gaaacagctttcaag

SEQ ID NO: 3260173 - DNA, 21 bp, Homo sapiens
gaaacagttggtaacttttgt

SEQ ID NO: 3260174 - DNA, 18 bp, Homo sapiens
gaaacagtttcttgcttg

SEQ ID NO: 3260175 - DNA, 16 bp, Homo sapiens
gaaacatgacactgac

SEQ ID NO: 3260176 - DNA, 15 bp, Homo sapiens
gaaacatggttttga

SEQ ID NO: 3260177 - DNA, 23 bp, Homo sapiens
gaaacatttagatttagagtttt

SEQ ID NO: 3260178 - DNA, 17 bp, Homo sapiens
gaaaccaaaacataaaa

SEQ ID NO: 3260179 - DNA, 18 bp, Homo sapiens
gaaaccaattaagcagct

SEQ ID NO: 3260180 - DNA, 22 bp, Homo sapiens
gaaaccagcttttactgttttt

SEQ ID NO: 3260181 - DNA, 17 bp, Homo sapiens
gaaaccaggacattaaa

SEQ ID NO: 3260182 - DNA, 18 bp, Homo sapiens
gaaaccagtgcaacagca

SEQ ID NO: 3260183 - DNA, 19 bp, Homo sapiens
gaaaccagtgtagccttgc

SEQ ID NO: 3260184 - DNA, 18 bp, Homo sapiens
gaaaccatgactgtgacc

SEQ ID NO: 3260185 - DNA, 22 bp, Homo sapiens
gaaaccatgactgtgaccacct

SEQ ID NO: 3260186 - DNA, 23 bp, Homo sapiens
gaaaccattttcccatcatcctt

SEQ ID NO: 3260187 - DNA, 17 bp, Homo sapiens
gaaacccaaagccctgg

SEQ ID NO: 3260188 - DNA, 18 bp, Homo sapiens
gaaacccaagctcctcct

SEQ ID NO: 3260189 - DNA, 12 bp, Homo sapiens
gaaacccacagt

SEQ ID NO: 3260190 - DNA, 13 bp, Homo sapiens
gaaacccacagtt

SEQ ID NO: 3260191 - DNA, 14 bp, Homo sapiens
gaaacccacagttt

SEQ ID NO: 3260192 - DNA, 15 bp, Homo sapiens
gaaaccctatttccc

SEQ ID NO: 3260193 - DNA, 14 bp, Homo sapiens
gaaaccgggagaag

SEQ ID NO: 3260194 - DNA, 19 bp, Homo sapiens
gaaacctcacccttgcacc

SEQ ID NO: 3260195 - DNA, 18 bp, Homo sapiens
gaaacctcattggccagc

SEQ ID NO: 3260196 - DNA, 16 bp, Homo sapiens
gaaacctgggattcag

SEQ ID NO: 3260197 - DNA, 17 bp, Homo sapiens
gaaacctttagggcagc

SEQ ID NO: 3260198 - DNA, 19 bp, Homo sapiens
gaaaccttttttaagattt

SEQ ID NO: 3260199 - DNA, 20 bp, Homo sapiens
gaaaccttttttaagatttt

SEQ ID NO: 3260200 - DNA, 23 bp, Homo sapiens
gaaaccttttttaagatttttct

SEQ ID NO: 3260201 - DNA, 19 bp, Homo sapiens
gaaacgccccgggcaaagg

SEQ ID NO: 3260202 - DNA, 21 bp, Homo sapiens
gaaacgccccgggcaaagggt

SEQ ID NO: 3260203 - DNA, 18 bp, Homo sapiens
gaaacgctacctctctgt

SEQ ID NO: 3260204 - DNA, 21 bp, Homo sapiens
gaaacgctacctctctgtccc

SEQ ID NO: 3260205 - DNA, 16 bp, Homo sapiens
gaaacgtcttctaaac

SEQ ID NO: 3260206 - DNA, 15 bp, Homo sapiens
gaaactaagcattgt

SEQ ID NO: 3260207 - DNA, 19 bp, Homo sapiens
gaaactatgtgtttttctc

SEQ ID NO: 3260208 - DNA, 21 bp, Homo sapiens
gaaactatgtgtttttctcat

SEQ ID NO: 3260209 - DNA, 13 bp, Homo sapiens
gaaactatttttg

SEQ ID NO: 3260210 - DNA, 18 bp, Homo sapiens
gaaactcatagacactga

SEQ ID NO: 3260211 - DNA, 14 bp, Homo sapiens
gaaatatatataca

SEQ ID NO: 3260212 - DNA, 16 bp, Homo sapiens
gaaatatatatacata

SEQ ID NO: 3260213 - DNA, 21 bp, Homo sapiens
gaaatatatatacatatgtag

SEQ ID NO: 3260214 - DNA, 14 bp, Homo sapiens
gaaatatcatttat

SEQ ID NO: 3260215 - DNA, 15 bp, Homo sapiens
gaaatatgattttat

SEQ ID NO: 3260216 - DNA, 22 bp, Homo sapiens
gaaatatgattttatttgacaa

SEQ ID NO: 3260217 - DNA, 18 bp, Homo sapiens
gaaatatgcacaatagca

SEQ ID NO: 3260218 - DNA, 13 bp, Homo sapiens
gaaatatgcatct

SEQ ID NO: 3260219 - DNA, 22 bp, Homo sapiens
gaaatatgtagtattaaaagtt

SEQ ID NO: 3260220 - DNA, 19 bp, Homo sapiens
gaaatattttgataataaa

SEQ ID NO: 3260221 - DNA, 18 bp, Homo sapiens
gaaatcaaccctctcctg

SEQ ID NO: 3260222 - DNA, 21 bp, Homo sapiens
gaaatcaaccctctcctgtct

SEQ ID NO: 3260223 - DNA, 18 bp, Homo sapiens
gaaatcagtaatatttat

SEQ ID NO: 3260224 - DNA, 20 bp, Homo sapiens
gaaatcagtaatatttatat

SEQ ID NO: 3260225 - DNA, 17 bp, Homo sapiens
gaaatccagaagtttta

SEQ ID NO: 3260226 - DNA, 16 bp, Homo sapiens
gaaatccattgtttaa

SEQ ID NO: 3260227 - DNA, 19 bp, Homo sapiens
gaaatccattgtttaaaga

SEQ ID NO: 3260228 - DNA, 19 bp, Homo sapiens
gaaatccctgtttaatatt

SEQ ID NO: 3260229 - DNA, 16 bp, Homo sapiens
gaaatcctgccctgga

SEQ ID NO: 3260230 - DNA, 14 bp, Homo sapiens
gaaatctgaacatt

SEQ ID NO: 3260231 - DNA, 16 bp, Homo sapiens
gaaatgaaaacatgta

SEQ ID NO: 3260232 - DNA, 13 bp, Homo sapiens
gaaatgaataatt

SEQ ID NO: 3260233 - DNA, 22 bp, Homo sapiens
gaaatgattcaaattgctgctt

SEQ ID NO: 3260234 - DNA, 20 bp, Homo sapiens
gaaatgcattattttgaatg

SEQ ID NO: 3260235 - DNA, 19 bp, Homo sapiens
gaaatgcattttattcttt

SEQ ID NO: 3260236 - DNA, 20 bp, Homo sapiens
gaaatgctattgttgtgggc

SEQ ID NO: 3260237 - DNA, 22 bp, Homo sapiens
gaaatgcttgtggattgagggt

SEQ ID NO: 3260238 - DNA, 19 bp, Homo sapiens
gaaatggaatgtgcccctg

SEQ ID NO: 3260239 - DNA, 15 bp, Homo sapiens
gaaatgggagatggt

SEQ ID NO: 3260240 - DNA, 16 bp, Homo sapiens
gaaatgtattcctgaa

SEQ ID NO: 3260241 - DNA, 18 bp, Homo sapiens
gaaatgtattcctgaaaa

SEQ ID NO: 3260242 - DNA, 15 bp, Homo sapiens
gaaatgtcatctaac

SEQ ID NO: 3260243 - DNA, 18 bp, Homo sapiens
gaaattaaatccaataaa

SEQ ID NO: 3260244 - DNA, 17 bp, Homo sapiens
gaaattaagaaggcaaa

SEQ ID NO: 3260245 - DNA, 22 bp, Homo sapiens
gaaattaagaaggcaaaaatgt

SEQ ID NO: 3260246 - DNA, 17 bp, Homo sapiens
gaaattacctgtggata

SEQ ID NO: 3260247 - DNA, 18 bp, Homo sapiens
gaaattacctgtggatat

SEQ ID NO: 3260248 - DNA, 14 bp, Homo sapiens
gaaattactgtgta

SEQ ID NO: 3260249 - DNA, 13 bp, Homo sapiens
gaaattagccggg

SEQ ID NO: 3260250 - DNA, 19 bp, Homo sapiens
gaaattagctgtgtgaaat

SEQ ID NO: 3260251 - DNA, 20 bp, Homo sapiens
gaaattaggggttaaagcag

SEQ ID NO: 3260252 - DNA, 15 bp, Homo sapiens
gaaattcgtgtgttt

SEQ ID NO: 3260253 - DNA, 17 bp, Homo sapiens
gaaattctcctggaggt

SEQ ID NO: 3260254 - DNA, 15 bp, Homo sapiens
gaaattctgttaaaa

SEQ ID NO: 3260255 - DNA, 18 bp, Homo sapiens
gaaattctgttaaaatct

SEQ ID NO: 3260256 - DNA, 21 bp, Homo sapiens
gaaattgacacaagtggacct

SEQ ID NO: 3260257 - DNA, 19 bp, Homo sapiens
gaaattgcatttcctgaca

SEQ ID NO: 3260258 - DNA, 16 bp, Homo sapiens
gaaattggaagagcac

SEQ ID NO: 3260259 - DNA, 13 bp, Homo sapiens
gaaattgtgaact

SEQ ID NO: 3260260 - DNA, 19 bp, Homo sapiens
gaaatttattagttaatat

SEQ ID NO: 3260261 - DNA, 13 bp, Homo sapiens
gaaatttctgtga

SEQ ID NO: 3260262 - DNA, 11 bp, Homo sapiens
gaaatttgaat

SEQ ID NO: 3260263 - DNA, 21 bp, Homo sapiens
gaaatttgttatacttcaaaa

SEQ ID NO: 3260264 - DNA, 14 bp, Homo sapiens
gaaatttgtttgta

SEQ ID NO: 3260265 - DNA, 22 bp, Homo sapiens
gaaattttaacctatgatattt

SEQ ID NO: 3260266 - DNA, 15 bp, Homo sapiens
gaaattttacaatag

SEQ ID NO: 3260267 - DNA, 22 bp, Homo sapiens
gaaattttatatgcttactgat

SEQ ID NO: 3260268 - DNA, 12 bp, Homo sapiens
gaaattttcaac

SEQ ID NO: 3260269 - DNA, 18 bp, Homo sapiens
gaaattttctagactttc

SEQ ID NO: 3260270 - DNA, 19 bp, Homo sapiens
gaaattttgcaaatataaa

SEQ ID NO: 3260271 - DNA, 13 bp, Homo sapiens
gaaatttttatca

SEQ ID NO: 3260272 - DNA, 19 bp, Homo sapiens
gaaatttttattaaattat

SEQ ID NO: 3260273 - DNA, 19 bp, Homo sapiens
gaacaaaaaaaccacaaag

SEQ ID NO: 3260274 - DNA, 16 bp, Homo sapiens
gaacaaaaagaaatct

SEQ ID NO: 3260275 - DNA, 19 bp, Homo sapiens
gaacaaaaagaaatcttgt

SEQ ID NO: 3260276 - DNA, 10 bp, Homo sapiens
gaacaaaact

SEQ ID NO: 3260277 - DNA, 15 bp, Homo sapiens
gaacaaaactccaga

SEQ ID NO: 3260278 - DNA, 23 bp, Homo sapiens
gaacaaaactgttcttttgcatt

SEQ ID NO: 3260279 - DNA, 14 bp, Homo sapiens
gaacaaaattattt

SEQ ID NO: 3260280 - DNA, 13 bp, Homo sapiens
gaacaaagctgtt

SEQ ID NO: 3260281 - DNA, 16 bp, Homo sapiens
gaacaaagctgttaaa

SEQ ID NO: 3260282 - DNA, 20 bp, Homo sapiens
gaacaaagctgttaaactgt

SEQ ID NO: 3260283 - DNA, 22 bp, Homo sapiens
gaacaaaggacagagtatgaac

SEQ ID NO: 3260284 - DNA, 17 bp, Homo sapiens
gaacaaagtgaaggaca

SEQ ID NO: 3260285 - DNA, 18 bp, Homo sapiens
gaacaaatcttgggtggg

SEQ ID NO: 3260286 - DNA, 22 bp, Homo sapiens
gaacaaatcttgggtgggtgaa

SEQ ID NO: 3260287 - DNA, 14 bp, Homo sapiens
gaacaaattatttt

SEQ ID NO: 3260288 - DNA, 19 bp, Homo sapiens
gaacaactaggcttcagca

SEQ ID NO: 3260289 - DNA, 13 bp, Homo sapiens
gaacaactgatac

SEQ ID NO: 3260290 - DNA, 20 bp, Homo sapiens
gaacaagtcacagctgcagc

SEQ ID NO: 3260291 - DNA, 21 bp, Homo sapiens
gaacaagtgcctcctggactg

SEQ ID NO: 3260292 - DNA, 20 bp, Homo sapiens
gaacaattgaagtaaacttt

SEQ ID NO: 3260293 - DNA, 22 bp, Homo sapiens
gaacacaaagcggggggagggt

SEQ ID NO: 3260294 - DNA, 15 bp, Homo sapiens
gaacacaagaaaaag

SEQ ID NO: 3260295 - DNA, 15 bp, Homo sapiens
gaacacagcatgtgc

SEQ ID NO: 3260296 - DNA, 12 bp, Homo sapiens
gaacacaggcag

SEQ ID NO: 3260297 - DNA, 20 bp, Homo sapiens
gaacaccattgaaggcttaa

SEQ ID NO: 3260298 - DNA, 16 bp, Homo sapiens
gaacaccctatatttt

SEQ ID NO: 3260299 - DNA, 14 bp, Homo sapiens
gaacaccctcgaag

SEQ ID NO: 3260300 - DNA, 13 bp, Homo sapiens
gaacacccttaga

SEQ ID NO: 3260301 - DNA, 23 bp, Homo sapiens
gaacacctgatcttacagaaaat

SEQ ID NO: 3260302 - DNA, 14 bp, Homo sapiens
gaacacgtttttac

SEQ ID NO: 3260303 - DNA, 18 bp, Homo sapiens
gaacactcttttgcttta

SEQ ID NO: 3260304 - DNA, 15 bp, Homo sapiens
gaacagaatgtttta

SEQ ID NO: 3260305 - DNA, 15 bp, Homo sapiens
gaacagactggaagc

SEQ ID NO: 3260306 - DNA, 18 bp, Homo sapiens
gaacagataatccctgta

SEQ ID NO: 3260307 - DNA, 16 bp, Homo sapiens
gaacagctctgagatc

SEQ ID NO: 3260308 - DNA, 17 bp, Homo sapiens
gaacagctctgagatcc

SEQ ID NO: 3260309 - DNA, 20 bp, Homo sapiens
gaacagctctgagatcctgg

SEQ ID NO: 3260310 - DNA, 16 bp, Homo sapiens
gaacagcttcaggtta

SEQ ID NO: 3260311 - DNA, 18 bp, Homo sapiens
gaacaggaggtgtgaatg

SEQ ID NO: 3260312 - DNA, 22 bp, Homo sapiens
gaacaggaggtgtgaatgcacg

SEQ ID NO: 3260313 - DNA, 23 bp, Homo sapiens
gaacagggaacattggagctgac

SEQ ID NO: 3260314 - DNA, 16 bp, Homo sapiens
gaacaggtggttttta

SEQ ID NO: 3260315 - DNA, 19 bp, Homo sapiens
gaacaggttcttaaaaagg

SEQ ID NO: 3260316 - DNA, 19 bp, Homo sapiens
gaacattcagctctggaga

SEQ ID NO: 3260317 - DNA, 20 bp, Homo sapiens
gaacattcagctctggagaa

SEQ ID NO: 3260318 - DNA, 22 bp, Homo sapiens
gaacattcagctctggagaaca

SEQ ID NO: 3260319 - DNA, 23 bp, Homo sapiens
gaacatttaataatgtatgtaca

SEQ ID NO: 3260320 - DNA, 13 bp, Homo sapiens
gaacatttatatc

SEQ ID NO: 3260321 - DNA, 20 bp, Homo sapiens
gaacatttctgtaaatacca

SEQ ID NO: 3260322 - DNA, 23 bp, Homo sapiens
gaaccaaaacttccaaggccctg

SEQ ID NO: 3260323 - DNA, 15 bp, Homo sapiens
gaaccaaagcctctt

SEQ ID NO: 3260324 - DNA, 17 bp, Homo sapiens
gaaccaaatctggaagc

SEQ ID NO: 3260325 - DNA, 23 bp, Homo sapiens
gaaccaaatggttcttacttttc

SEQ ID NO: 3260326 - DNA, 19 bp, Homo sapiens
gaaccaaattgcactgaag

SEQ ID NO: 3260327 - DNA, 16 bp, Homo sapiens
gaaccaaggcagcctc

SEQ ID NO: 3260328 - DNA, 23 bp, Homo sapiens
gaaccaagtggaccttgagacca

SEQ ID NO: 3260329 - DNA, 14 bp, Homo sapiens
gaaccacaaaaaaa

SEQ ID NO: 3260330 - DNA, 22 bp, Homo sapiens
gaaccacaaaaaaaaaggctgg

SEQ ID NO: 3260331 - DNA, 22 bp, Homo sapiens
gaaccactcccaccacaggcat

SEQ ID NO: 3260332 - DNA, 22 bp, Homo sapiens
gaaccacttcctgctacaggag

SEQ ID NO: 3260333 - DNA, 15 bp, Homo sapiens
gaaccagctcatctc

SEQ ID NO: 3260334 - DNA, 17 bp, Homo sapiens
gaaccagggaggagagg

SEQ ID NO: 3260335 - DNA, 13 bp, Homo sapiens
gaaccataaattc

SEQ ID NO: 3260336 - DNA, 16 bp, Homo sapiens
gaaccatgaagacagg

SEQ ID NO: 3260337 - DNA, 21 bp, Homo sapiens
gaaccatgcaggaaggaaaac

SEQ ID NO: 3260338 - DNA, 19 bp, Homo sapiens
gaacccagcagttctgtta

SEQ ID NO: 3260339 - DNA, 15 bp, Homo sapiens
gaacccaggacgctt

SEQ ID NO: 3260340 - DNA, 19 bp, Homo sapiens
gaacccaggacgcttctga

SEQ ID NO: 3260341 - DNA, 21 bp, Homo sapiens
gaacccagggctctgccccag

SEQ ID NO: 3260342 - DNA, 16 bp, Homo sapiens
gaaccccatgggcttg

SEQ ID NO: 3260343 - DNA, 21 bp, Homo sapiens
gaacccctacatgaaacagaa

SEQ ID NO: 3260344 - DNA, 12 bp, Homo sapiens
gaacccctgtgt

SEQ ID NO: 3260345 - DNA, 20 bp, Homo sapiens
gaacccgggagcggaggttg

SEQ ID NO: 3260346 - DNA, 14 bp, Homo sapiens
gaaccctgtgctgg

SEQ ID NO: 3260347 - DNA, 18 bp, Homo sapiens
gaacccttgtgcttggtg

SEQ ID NO: 3260348 - DNA, 23 bp, Homo sapiens
gaaccctttgtttcttgtttatt

SEQ ID NO: 3260349 - DNA, 17 bp, Homo sapiens
gaaccgagcaaagatca

SEQ ID NO: 3260350 - DNA, 19 bp, Homo sapiens
gaaccgagcaaagatcaaa

SEQ ID NO: 3260351 - DNA, 14 bp, Homo sapiens
gaaccgcacagctc

SEQ ID NO: 3260352 - DNA, 16 bp, Homo sapiens
gaaccgctcacctaga

SEQ ID NO: 3260353 - DNA, 19 bp, Homo sapiens
gaaccgttttgaagctact

SEQ ID NO: 3260354 - DNA, 18 bp, Homo sapiens
gaacctacagttttaact

SEQ ID NO: 3260355 - DNA, 21 bp, Homo sapiens
gaacctacagttttaactgtg

SEQ ID NO: 3260356 - DNA, 23 bp, Homo sapiens
gaacctacagttttaactgtgga

SEQ ID NO: 3260357 - DNA, 20 bp, Homo sapiens
gaacctaccagttggccatg

SEQ ID NO: 3260358 - DNA, 17 bp, Homo sapiens
gaacctactgttccttt

SEQ ID NO: 3260359 - DNA, 20 bp, Homo sapiens
gaacctactgttcctttcag

SEQ ID NO: 3260360 - DNA, 20 bp, Homo sapiens
gaacctagtactctctgctc

SEQ ID NO: 3260361 - DNA, 17 bp, Homo sapiens
gaacctattttcatttg

SEQ ID NO: 3260362 - DNA, 18 bp, Homo sapiens
gaacctcaggcttccttg

SEQ ID NO: 3260363 - DNA, 14 bp, Homo sapiens
gaacctcccagagg

SEQ ID NO: 3260364 - DNA, 21 bp, Homo sapiens
gaacctcccagaggtccagcc

SEQ ID NO: 3260365 - DNA, 18 bp, Homo sapiens
gaacctctgtctcatcct

SEQ ID NO: 3260366 - DNA, 13 bp, Homo sapiens
gaacctcttcccc

SEQ ID NO: 3260367 - DNA, 17 bp, Homo sapiens
gaacctcttccccagaa

SEQ ID NO: 3260368 - DNA, 18 bp, Homo sapiens
gaacctggatccagcact

SEQ ID NO: 3260369 - DNA, 15 bp, Homo sapiens
gaacctgggctgtgc

SEQ ID NO: 3260370 - DNA, 17 bp, Homo sapiens
gaacctgggctgtgctg

SEQ ID NO: 3260371 - DNA, 18 bp, Homo sapiens
gaacctggtgtgtttctt

SEQ ID NO: 3260372 - DNA, 16 bp, Homo sapiens
gaacctgtcctaagga

SEQ ID NO: 3260373 - DNA, 19 bp, Homo sapiens
gaaccttaatgacaacact

SEQ ID NO: 3260374 - DNA, 20 bp, Homo sapiens
gaaccttaatgacaacactt

SEQ ID NO: 3260375 - DNA, 10 bp, Homo sapiens
gaaccttccc

SEQ ID NO: 3260376 - DNA, 15 bp, Homo sapiens
gaaccttccctccaa

SEQ ID NO: 3260377 - DNA, 13 bp, Homo sapiens
gaaccttgctgtc

SEQ ID NO: 3260378 - DNA, 16 bp, Homo sapiens
gaaccttgctgtcctg

SEQ ID NO: 3260379 - DNA, 21 bp, Homo sapiens
gaacgacaatagctttaccct

SEQ ID NO: 3260380 - DNA, 14 bp, Homo sapiens
gaacgagcactggc

SEQ ID NO: 3260381 - DNA, 15 bp, Homo sapiens
gaacgcagaagaaag

SEQ ID NO: 3260382 - DNA, 13 bp, Homo sapiens
gaacgcaggagaa

SEQ ID NO: 3260383 - DNA, 16 bp, Homo sapiens
gaacgccagtctccca

SEQ ID NO: 3260384 - DNA, 21 bp, Homo sapiens
gaacgctcttagctttctcag

SEQ ID NO: 3260385 - DNA, 19 bp, Homo sapiens
gaacggaacgttggacttt

SEQ ID NO: 3260386 - DNA, 22 bp, Homo sapiens
gaacggagccccaggcctctgt

SEQ ID NO: 3260387 - DNA, 16 bp, Homo sapiens
gaacgggcagcctggg

SEQ ID NO: 3260388 - DNA, 22 bp, Homo sapiens
gaacgggcagcctgggcctggg

SEQ ID NO: 3260389 - DNA, 19 bp, Homo sapiens
gaacgttttttcctcagtg

SEQ ID NO: 3260390 - DNA, 22 bp, Homo sapiens
gaactaaactagtttttcctat

SEQ ID NO: 3260391 - DNA, 12 bp, Homo sapiens
gaactaaatgtt

SEQ ID NO: 3260392 - DNA, 16 bp, Homo sapiens
gaactaaatgttctat

SEQ ID NO: 3260393 - DNA, 18 bp, Homo sapiens
gaactaagaaacttttgt

SEQ ID NO: 3260394 - DNA, 22 bp, Homo sapiens
gaactaagaaacttttgtaaag

SEQ ID NO: 3260395 - DNA, 17 bp, Homo sapiens
gaactaataaatacata

SEQ ID NO: 3260396 - DNA, 16 bp, Homo sapiens
gaactacccccttttc

SEQ ID NO: 3260397 - DNA, 12 bp, Homo sapiens
gaactactgtac

SEQ ID NO: 3260398 - DNA, 13 bp, Homo sapiens
gaactactgtact

SEQ ID NO: 3260399 - DNA, 16 bp, Homo sapiens
gaactagagatgtgca

SEQ ID NO: 3260400 - DNA, 17 bp, Homo sapiens
gaactaggctgagcaat

SEQ ID NO: 3260401 - DNA, 15 bp, Homo sapiens
gaactataaagaagt

SEQ ID NO: 3260402 - DNA, 15 bp, Homo sapiens
gaactatgaactaca

SEQ ID NO: 3260403 - DNA, 17 bp, Homo sapiens
gaactcaccctgggagc

SEQ ID NO: 3260404 - DNA, 16 bp, Homo sapiens
gaactcactggggcct

SEQ ID NO: 3260405 - DNA, 21 bp, Homo sapiens
gaactcagcagttgacatcca

SEQ ID NO: 3260406 - DNA, 14 bp, Homo sapiens
gaactccagagtca

SEQ ID NO: 3260407 - DNA, 14 bp, Homo sapiens
gaactccaggccct

SEQ ID NO: 3260408 - DNA, 19 bp, Homo sapiens
gaactcctccaaagcatgt

SEQ ID NO: 3260409 - DNA, 15 bp, Homo sapiens
gaactcctgacctca

SEQ ID NO: 3260410 - DNA, 13 bp, Homo sapiens
gaactccttggcc

SEQ ID NO: 3260411 - DNA, 19 bp, Homo sapiens
gaactcgcgctcagtaaac

SEQ ID NO: 3260412 - DNA, 22 bp, Homo sapiens
gaactctatctgggcctgggct

SEQ ID NO: 3260413 - DNA, 22 bp, Homo sapiens
gaactctcaaaagtctattttt

SEQ ID NO: 3260414 - DNA, 11 bp, Homo sapiens
gaactctgaca

SEQ ID NO: 3260415 - DNA, 14 bp, Homo sapiens
gaactctgacaagg

SEQ ID NO: 3260416 - DNA, 14 bp, Homo sapiens
gaactctggtggca

SEQ ID NO: 3260417 - DNA, 19 bp, Homo sapiens
gaactctggtggcacagga

SEQ ID NO: 3260418 - DNA, 21 bp, Homo sapiens
gaactcttcagaacacacaga

SEQ ID NO: 3260419 - DNA, 12 bp, Homo sapiens
gaactgaacacc

SEQ ID NO: 3260420 - DNA, 21 bp, Homo sapiens
gaactgaacaccattgaaggc

SEQ ID NO: 3260421 - DNA, 17 bp, Homo sapiens
gaactgaagtttcacat

SEQ ID NO: 3260422 - DNA, 17 bp, Homo sapiens
gaactgactttctcccc

SEQ ID NO: 3260423 - DNA, 17 bp, Homo sapiens
cttctgagctatttcat

SEQ ID NO: 3260424 - DNA, 15 bp, Homo sapiens
cttctgagtattctc

SEQ ID NO: 3260425 - DNA, 16 bp, Homo sapiens
cttctgagtattctca

SEQ ID NO: 3260426 - DNA, 17 bp, Homo sapiens
cttctgcaactgaaatt

SEQ ID NO: 3260427 - DNA, 14 bp, Homo sapiens
cttctgcaccctcc

SEQ ID NO: 3260428 - DNA, 19 bp, Homo sapiens
cttctgcaccctccaccct

SEQ ID NO: 3260429 - DNA, 14 bp, Homo sapiens
cttctgcagcagga

SEQ ID NO: 3260430 - DNA, 19 bp, Homo sapiens
cttctgcattcctgtaact

SEQ ID NO: 3260431 - DNA, 15 bp, Homo sapiens
cttctgcctggagac

SEQ ID NO: 3260432 - DNA, 20 bp, Homo sapiens
cttctgccttagtctcagtt

SEQ ID NO: 3260433 - DNA, 21 bp, Homo sapiens
cttctgccttagtctcagttt

SEQ ID NO: 3260434 - DNA, 13 bp, Homo sapiens
cttctgccttttc

SEQ ID NO: 3260435 - DNA, 14 bp, Homo sapiens
cttctgctccaccc

SEQ ID NO: 3260436 - DNA, 18 bp, Homo sapiens
cttctgctgcccaggcca

SEQ ID NO: 3260437 - DNA, 22 bp, Homo sapiens
cttctgctgcccaggccacagc

SEQ ID NO: 3260438 - DNA, 17 bp, Homo sapiens
cttctgctggataaaat

SEQ ID NO: 3260439 - DNA, 15 bp, Homo sapiens
cttctgcttaggaga

SEQ ID NO: 3260440 - DNA, 16 bp, Homo sapiens
cttctgcttaggagag

SEQ ID NO: 3260441 - DNA, 18 bp, Homo sapiens
cttctgcttcagcctccc

SEQ ID NO: 3260442 - DNA, 14 bp, Homo sapiens
cttctgcttttctg

SEQ ID NO: 3260443 - DNA, 19 bp, Homo sapiens
cttctgcttttctgccctg

SEQ ID NO: 3260444 - DNA, 21 bp, Homo sapiens
cttctgcttttctgccctggc

SEQ ID NO: 3260445 - DNA, 17 bp, Homo sapiens
cttctggaaactaccag

SEQ ID NO: 3260446 - DNA, 15 bp, Homo sapiens
cttctggaaggctgg

SEQ ID NO: 3260447 - DNA, 16 bp, Homo sapiens
cttctggaaggctggc

SEQ ID NO: 3260448 - DNA, 17 bp, Homo sapiens
cttctggaaggctggct

SEQ ID NO: 3260449 - DNA, 11 bp, Homo sapiens
cttctggagcc

SEQ ID NO: 3260450 - DNA, 13 bp, Homo sapiens
cttctggccttgt

SEQ ID NO: 3260451 - DNA, 21 bp, Homo sapiens
cttctggcctttcctctctcc

SEQ ID NO: 3260452 - DNA, 14 bp, Homo sapiens
cttctggcttcctt

SEQ ID NO: 3260453 - DNA, 21 bp, Homo sapiens
cttctgggcatctgttctggt

SEQ ID NO: 3260454 - DNA, 20 bp, Homo sapiens
cttctgggctgcgggaggcc

SEQ ID NO: 3260455 - DNA, 23 bp, Homo sapiens
cttctgggctgcgggaggccctg

SEQ ID NO: 3260456 - DNA, 16 bp, Homo sapiens
cttctggggcaggctg

SEQ ID NO: 3260457 - DNA, 19 bp, Homo sapiens
cttctggggcaggctgggc

SEQ ID NO: 3260458 - DNA, 18 bp, Homo sapiens
cttctggtactctcctag

SEQ ID NO: 3260459 - DNA, 19 bp, Homo sapiens
cttctggtgctactccatg

SEQ ID NO: 3260460 - DNA, 16 bp, Homo sapiens
cttctggttgtatttc

SEQ ID NO: 3260461 - DNA, 19 bp, Homo sapiens
cttctggtttaaacttgtt

SEQ ID NO: 3260462 - DNA, 15 bp, Homo sapiens
cttctgtatttctag

SEQ ID NO: 3260463 - DNA, 15 bp, Homo sapiens
cttctgtattttaat

SEQ ID NO: 3260464 - DNA, 16 bp, Homo sapiens
cttctgtcctactctg

SEQ ID NO: 3260465 - DNA, 18 bp, Homo sapiens
cttctgtcctactctgtg

SEQ ID NO: 3260466 - DNA, 19 bp, Homo sapiens
cttctgtcctactctgtgt

SEQ ID NO: 3260467 - DNA, 14 bp, Homo sapiens
cttctgtgaaagta

SEQ ID NO: 3260468 - DNA, 14 bp, Homo sapiens
cttctgtgaaatat

SEQ ID NO: 3260469 - DNA, 20 bp, Homo sapiens
cttctgtgagacccccacac

SEQ ID NO: 3260470 - DNA, 21 bp, Homo sapiens
cttctgtgagacccccacacc

SEQ ID NO: 3260471 - DNA, 22 bp, Homo sapiens
cttctgtgagacccccacacct

SEQ ID NO: 3260472 - DNA, 14 bp, Homo sapiens
cttctgtgatgagc

SEQ ID NO: 3260473 - DNA, 15 bp, Homo sapiens
cttctgtggctcaca

SEQ ID NO: 3260474 - DNA, 22 bp, Homo sapiens
cttctgtggctcacagaaccct

SEQ ID NO: 3260475 - DNA, 24 bp, Homo sapiens
cttctgtgggcccctcaacagcca

SEQ ID NO: 3260476 - DNA, 13 bp, Homo sapiens
cttctgtgtatct

SEQ ID NO: 3260477 - DNA, 13 bp, Homo sapiens
cttctgtgtcaca

SEQ ID NO: 3260478 - DNA, 12 bp, Homo sapiens
cttctgtgttca

SEQ ID NO: 3260479 - DNA, 12 bp, Homo sapiens
cttcttaattaa

SEQ ID NO: 3260480 - DNA, 18 bp, Homo sapiens
cttcttaattaatttgat

SEQ ID NO: 3260481 - DNA, 14 bp, Homo sapiens
cttcttacacttct

SEQ ID NO: 3260482 - DNA, 14 bp, Homo sapiens
cttcttagaatgtt

SEQ ID NO: 3260483 - DNA, 23 bp, Homo sapiens
cttcttatggaattgatttgcat

SEQ ID NO: 3260484 - DNA, 15 bp, Homo sapiens
cttcttatgtagagt

SEQ ID NO: 3260485 - DNA, 19 bp, Homo sapiens
cttgggggggtggccgctg

SEQ ID NO: 3260486 - DNA, 23 bp, Homo sapiens
cttgggggttcaggcccggcagg

SEQ ID NO: 3260487 - DNA, 17 bp, Homo sapiens
cttggggtaagccagag

SEQ ID NO: 3260488 - DNA, 19 bp, Homo sapiens
cttggggtaagccagagcc

SEQ ID NO: 3260489 - DNA, 18 bp, Homo sapiens
cttggggtccctccaccc

SEQ ID NO: 3260490 - DNA, 16 bp, Homo sapiens
cttggggtgtggggtg

SEQ ID NO: 3260491 - DNA, 18 bp, Homo sapiens
cttggggtgtggggtggg

SEQ ID NO: 3260492 - DNA, 19 bp, Homo sapiens
cttggggtgtggggtgggg

SEQ ID NO: 3260493 - DNA, 23 bp, Homo sapiens
cttgggtcccccacgtgacagtg

SEQ ID NO: 3260494 - DNA, 14 bp, Homo sapiens
cttgggtgggtgaa

SEQ ID NO: 3260495 - DNA, 17 bp, Homo sapiens
cttgggtgggtgaaggc

SEQ ID NO: 3260496 - DNA, 20 bp, Homo sapiens
cttggtacagttgcaggagc

SEQ ID NO: 3260497 - DNA, 14 bp, Homo sapiens
cttggtactgaaaa

SEQ ID NO: 3260498 - DNA, 14 bp, Homo sapiens
cttggtcagagcca

SEQ ID NO: 3260499 - DNA, 16 bp, Homo sapiens
cttggtccctggtccc

SEQ ID NO: 3260500 - DNA, 22 bp, Homo sapiens
cttggtctgatcgacgtggtga

SEQ ID NO: 3260501 - DNA, 16 bp, Homo sapiens
cttggtgactgtccca

SEQ ID NO: 3260502 - DNA, 17 bp, Homo sapiens
cttggtgccttttgtgt

SEQ ID NO: 3260503 - DNA, 15 bp, Homo sapiens
cttggtgctctgtgt

SEQ ID NO: 3260504 - DNA, 19 bp, Homo sapiens
cttggtggctcacgcctgt

SEQ ID NO: 3260505 - DNA, 16 bp, Homo sapiens
cttggttggctggcag

SEQ ID NO: 3260506 - DNA, 21 bp, Homo sapiens
cttggttggctggcagctgag

SEQ ID NO: 3260507 - DNA, 16 bp, Homo sapiens
cttggtttttggctct

SEQ ID NO: 3260508 - DNA, 18 bp, Homo sapiens
cttgtaaaaattaaaagt

SEQ ID NO: 3260509 - DNA, 14 bp, Homo sapiens
cttgtaaagactgg

SEQ ID NO: 3260510 - DNA, 15 bp, Homo sapiens
cttgtaaagactggt

SEQ ID NO: 3260511 - DNA, 12 bp, Homo sapiens
cttgtaaataca

SEQ ID NO: 3260512 - DNA, 17 bp, Homo sapiens
cttgtaaatagctcagg

SEQ ID NO: 3260513 - DNA, 22 bp, Homo sapiens
cttgtaaattgatgggagaaat

SEQ ID NO: 3260514 - DNA, 17 bp, Homo sapiens
cttgtaacaagaaaaca

SEQ ID NO: 3260515 - DNA, 14 bp, Homo sapiens
cttgtaaccagtgc

SEQ ID NO: 3260516 - DNA, 16 bp, Homo sapiens
cttgtaattctaaatg

SEQ ID NO: 3260517 - DNA, 12 bp, Homo sapiens
cttgtaatttaa

SEQ ID NO: 3260518 - DNA, 21 bp, Homo sapiens
cttgtaatttaaacaggccca

SEQ ID NO: 3260519 - DNA, 14 bp, Homo sapiens
cttgtaatttccag

SEQ ID NO: 3260520 - DNA, 13 bp, Homo sapiens
cttgtacaaaata

SEQ ID NO: 3260521 - DNA, 20 bp, Homo sapiens
cttgtacatgtgtagcctgt

SEQ ID NO: 3260522 - DNA, 17 bp, Homo sapiens
cttgtactcttaggata

SEQ ID NO: 3260523 - DNA, 22 bp, Homo sapiens
cttgtacttctgtgttcatttt

SEQ ID NO: 3260524 - DNA, 17 bp, Homo sapiens
cttgtagaactcactct

SEQ ID NO: 3260525 - DNA, 20 bp, Homo sapiens
cttgtagaactcactctggg

SEQ ID NO: 3260526 - DNA, 14 bp, Homo sapiens
cttgtagctgtaaa

SEQ ID NO: 3260527 - DNA, 15 bp, Homo sapiens
cttgtagctgtaaaa

SEQ ID NO: 3260528 - DNA, 16 bp, Homo sapiens
cttgtagctgtaaaac

SEQ ID NO: 3260529 - DNA, 21 bp, Homo sapiens
cttgtagtttacctctttaaa

SEQ ID NO: 3260530 - DNA, 13 bp, Homo sapiens
cttgtataaatgt

SEQ ID NO: 3260531 - DNA, 18 bp, Homo sapiens
cttgtataaatgtatata

SEQ ID NO: 3260532 - DNA, 19 bp, Homo sapiens
cttgtataaatgtatatac

SEQ ID NO: 3260533 - DNA, 16 bp, Homo sapiens
cttgtatagtgtaaaa

SEQ ID NO: 3260534 - DNA, 17 bp, Homo sapiens
cttgtatagtgtaaaat

SEQ ID NO: 3260535 - DNA, 14 bp, Homo sapiens
cttgtatatttgta

SEQ ID NO: 3260536 - DNA, 17 bp, Homo sapiens
cttgtatatttgtacaa

SEQ ID NO: 3260537 - DNA, 18 bp, Homo sapiens
ctttaatgtcacaggcag

SEQ ID NO: 3260538 - DNA, 19 bp, Homo sapiens
ctttaatgtcacaggcagg

SEQ ID NO: 3260539 - DNA, 20 bp, Homo sapiens
ctttaatgtcacaggcaggt

SEQ ID NO: 3260540 - DNA, 22 bp, Homo sapiens
ctttaatgtcacaggcaggtcc

SEQ ID NO: 3260541 - DNA, 20 bp, Homo sapiens
ctttaatgtgtattgaagaa

SEQ ID NO: 3260542 - DNA, 21 bp, Homo sapiens
ctttaattaattaagtatctg

SEQ ID NO: 3260543 - DNA, 18 bp, Homo sapiens
ctttaattaccaacctgt

SEQ ID NO: 3260544 - DNA, 12 bp, Homo sapiens
ctttaattatat

SEQ ID NO: 3260545 - DNA, 14 bp, Homo sapiens
ctttaattctgtat

SEQ ID NO: 3260546 - DNA, 15 bp, Homo sapiens
ctttaattgtataag

SEQ ID NO: 3260547 - DNA, 18 bp, Homo sapiens
ctttaatttctgtcagaa

SEQ ID NO: 3260548 - DNA, 20 bp, Homo sapiens
ctttacaaaagaaatacctt

SEQ ID NO: 3260549 - DNA, 16 bp, Homo sapiens
ctttacaatgtgaata

SEQ ID NO: 3260550 - DNA, 14 bp, Homo sapiens
ctttacacacacag

SEQ ID NO: 3260551 - DNA, 18 bp, Homo sapiens
ctttacataagaaatgta

SEQ ID NO: 3260552 - DNA, 18 bp, Homo sapiens
ctttacatactttatcaa

SEQ ID NO: 3260553 - DNA, 14 bp, Homo sapiens
ctttacatgcaatt

SEQ ID NO: 3260554 - DNA, 19 bp, Homo sapiens
ctttacatgcaatttatta

SEQ ID NO: 3260555 - DNA, 22 bp, Homo sapiens
ctttacatgctgtgctctttga

SEQ ID NO: 3260556 - DNA, 23 bp, Homo sapiens
ctttaccaaaggtttttaaagta

SEQ ID NO: 3260557 - DNA, 20 bp, Homo sapiens
ctttacccctcatccaaagt

SEQ ID NO: 3260558 - DNA, 20 bp, Homo sapiens
ctttacctttttgtatgtga

SEQ ID NO: 3260559 - DNA, 22 bp, Homo sapiens
ctttacgtgtttaaaaaaaagc

SEQ ID NO: 3260560 - DNA, 22 bp, Homo sapiens
ctttactattaaaatattttgg

SEQ ID NO: 3260561 - DNA, 17 bp, Homo sapiens
ctttactcccttcctgg

SEQ ID NO: 3260562 - DNA, 18 bp, Homo sapiens
ctttactcccttcctggc

SEQ ID NO: 3260563 - DNA, 19 bp, Homo sapiens
ctttactcccttcctggcc

SEQ ID NO: 3260564 - DNA, 21 bp, Homo sapiens
ctttactcccttcctggcctc

SEQ ID NO: 3260565 - DNA, 14 bp, Homo sapiens
ctttactctgtgtt

SEQ ID NO: 3260566 - DNA, 13 bp, Homo sapiens
ctttactggacct

SEQ ID NO: 3260567 - DNA, 17 bp, Homo sapiens
ctttactggacctgaaa

SEQ ID NO: 3260568 - DNA, 14 bp, Homo sapiens
ctttactgtgctta

SEQ ID NO: 3260569 - DNA, 20 bp, Homo sapiens
ctttactgtgcttatttttt

SEQ ID NO: 3260570 - DNA, 16 bp, Homo sapiens
ctttagaccctgggtg

SEQ ID NO: 3260571 - DNA, 22 bp, Homo sapiens
ctttagagaagtatacataagt

SEQ ID NO: 3260572 - DNA, 18 bp, Homo sapiens
ctttagagcattgccatt

SEQ ID NO: 3260573 - DNA, 20 bp, Homo sapiens
ctttagcacgtttaaagttc

SEQ ID NO: 3260574 - DNA, 16 bp, Homo sapiens
ctttagccaaaccctt

SEQ ID NO: 3260575 - DNA, 21 bp, Homo sapiens
ctttaggagggagttatctaa

SEQ ID NO: 3260576 - DNA, 13 bp, Homo sapiens
ctttagggcagct

SEQ ID NO: 3260577 - DNA, 19 bp, Homo sapiens
ctttaggtcaaactcccta

SEQ ID NO: 3260578 - DNA, 21 bp, Homo sapiens
ctttaggtcaaactccctagt

SEQ ID NO: 3260579 - DNA, 22 bp, Homo sapiens
ctttagtacctgaaaagtaact

SEQ ID NO: 3260580 - DNA, 13 bp, Homo sapiens
ctttagtgccctg

SEQ ID NO: 3260581 - DNA, 14 bp, Homo sapiens
ctttagtgccctgc

SEQ ID NO: 3260582 - DNA, 16 bp, Homo sapiens
ctttagtgccctgccc

SEQ ID NO: 3260583 - DNA, 22 bp, Homo sapiens
ctttagtgccctgccccctggc

SEQ ID NO: 3260584 - DNA, 22 bp, Homo sapiens
ctttagtgccggctgtggagca

SEQ ID NO: 3260585 - DNA, 13 bp, Homo sapiens
ctttagtttttgg

SEQ ID NO: 3260586 - DNA, 23 bp, Homo sapiens
ctttagtttttggttgggaatga

SEQ ID NO: 3260587 - DNA, 15 bp, Homo sapiens
ctttatacacagtgg

SEQ ID NO: 3260588 - DNA, 14 bp, Homo sapiens
ctttatacagctgt

SEQ ID NO: 3260589 - DNA, 20 bp, Homo sapiens
ctttatagaacatattttcc

SEQ ID NO: 3260590 - DNA, 17 bp, Homo sapiens
ctttatatctgtaatga

SEQ ID NO: 3260591 - DNA, 12 bp, Homo sapiens
ctttatatttag

SEQ ID NO: 3260592 - DNA, 20 bp, Homo sapiens
ctttatcaatgtgtctttct

SEQ ID NO: 3260593 - DNA, 16 bp, Homo sapiens
ctttatctcctgctct

SEQ ID NO: 3260594 - DNA, 17 bp, Homo sapiens
ctttatctctgaggcta

SEQ ID NO: 3260595 - DNA, 18 bp, Homo sapiens
ctttatctgttcttgcta

SEQ ID NO: 3260596 - DNA, 22 bp, Homo sapiens
ctttatgaatgaaaaaacagtc

SEQ ID NO: 3260597 - DNA, 19 bp, Homo sapiens
ctttatgataatagattct

SEQ ID NO: 3260598 - DNA, 15 bp, Homo sapiens
ctttatgcacaaaat

SEQ ID NO: 3260599 - DNA, 15 bp, Homo sapiens
ctttatgtagaattg

SEQ ID NO: 3260600 - DNA, 20 bp, Homo sapiens
ctttatgtagtttttatatg

SEQ ID NO: 3260601 - DNA, 13 bp, Homo sapiens
ctttatgtatctc

SEQ ID NO: 3260602 - DNA, 18 bp, Homo sapiens
ctttatgttgtatgattc

SEQ ID NO: 3260603 - DNA, 14 bp, Homo sapiens
ctttattaatgttt

SEQ ID NO: 3260604 - DNA, 20 bp, Homo sapiens
ctttattaccccctccttca

SEQ ID NO: 3260605 - DNA, 22 bp, Homo sapiens
ctttattatggcttgtgaactg

SEQ ID NO: 3260606 - DNA, 16 bp, Homo sapiens
ctttattctttactat

SEQ ID NO: 3260607 - DNA, 18 bp, Homo sapiens
ctttattgcttttttgta

SEQ ID NO: 3260608 - DNA, 18 bp, Homo sapiens
ctttattggctgagatat

SEQ ID NO: 3260609 - DNA, 18 bp, Homo sapiens
ctttattgtacagactgt

SEQ ID NO: 3260610 - DNA, 23 bp, Homo sapiens
ctttattgtgggccatgaaccaa

SEQ ID NO: 3260611 - DNA, 15 bp, Homo sapiens
ctttatttatttcta

SEQ ID NO: 3260612 - DNA, 12 bp, Homo sapiens
ctttatttcaca

SEQ ID NO: 3260613 - DNA, 14 bp, Homo sapiens
ctttatttctgtca

SEQ ID NO: 3260614 - DNA, 22 bp, Homo sapiens
ctttattttaacctttgataga

SEQ ID NO: 3260615 - DNA, 11 bp, Homo sapiens
ctttattttct

SEQ ID NO: 3260616 - DNA, 13 bp, Homo sapiens
ctttattttctgg

SEQ ID NO: 3260617 - DNA, 22 bp, Homo sapiens
cttgaccatcgtccttcctctc

SEQ ID NO: 3260618 - DNA, 15 bp, Homo sapiens
cttgaccgtactctc

SEQ ID NO: 3260619 - DNA, 17 bp, Homo sapiens
cttgaccgtactctcac

SEQ ID NO: 3260620 - DNA, 18 bp, Homo sapiens
cttgaccgtactctcaca

SEQ ID NO: 3260621 - DNA, 23 bp, Homo sapiens
cttgaccgtactctcacatgtgg

SEQ ID NO: 3260622 - DNA, 15 bp, Homo sapiens
cttgacctctataaa

SEQ ID NO: 3260623 - DNA, 14 bp, Homo sapiens
cttgacctgaggct

SEQ ID NO: 3260624 - DNA, 17 bp, Homo sapiens
cttgacctgaggctgtg

SEQ ID NO: 3260625 - DNA, 12 bp, Homo sapiens
cttgaccttcct

SEQ ID NO: 3260626 - DNA, 21 bp, Homo sapiens
cttgactcccaagtttccata

SEQ ID NO: 3260627 - DNA, 14 bp, Homo sapiens
cttgactctaatat

SEQ ID NO: 3260628 - DNA, 22 bp, Homo sapiens
cttgagaaatatggacacttaa

SEQ ID NO: 3260629 - DNA, 19 bp, Homo sapiens
cttgagaaccagtctcctc

SEQ ID NO: 3260630 - DNA, 20 bp, Homo sapiens
cttgagagaaaaagtgcccc

SEQ ID NO: 3260631 - DNA, 22 bp, Homo sapiens
cttgagagaaaaagtgcccctt

SEQ ID NO: 3260632 - DNA, 22 bp, Homo sapiens
cttgagagtatcaggtctccca

SEQ ID NO: 3260633 - DNA, 16 bp, Homo sapiens
cttgagatggtgaggc

SEQ ID NO: 3260634 - DNA, 22 bp, Homo sapiens
cttgagatggtgaggctgtcag

SEQ ID NO: 3260635 - DNA, 13 bp, Homo sapiens
cttgagcagtggc

SEQ ID NO: 3260636 - DNA, 14 bp, Homo sapiens
cttgagcagtggct

SEQ ID NO: 3260637 - DNA, 12 bp, Homo sapiens
cttgagcccagg

SEQ ID NO: 3260638 - DNA, 15 bp, Homo sapiens
cttgagcccaggagt

SEQ ID NO: 3260639 - DNA, 20 bp, Homo sapiens
cttgagcccaggagtttgag

SEQ ID NO: 3260640 - DNA, 12 bp, Homo sapiens
cttgagccctgg

SEQ ID NO: 3260641 - DNA, 14 bp, Homo sapiens
cttgagccctggct

SEQ ID NO: 3260642 - DNA, 20 bp, Homo sapiens
cttgagccgggcccctgggc

SEQ ID NO: 3260643 - DNA, 11 bp, Homo sapiens
cttgagcctcc

SEQ ID NO: 3260644 - DNA, 16 bp, Homo sapiens
cttgagctggcctctc

SEQ ID NO: 3260645 - DNA, 12 bp, Homo sapiens
cttgagcttggc

SEQ ID NO: 3260646 - DNA, 20 bp, Homo sapiens
cttgagcttggcagctgaac

SEQ ID NO: 3260647 - DNA, 16 bp, Homo sapiens
cttgagggcccagagc

SEQ ID NO: 3260648 - DNA, 20 bp, Homo sapiens
cttgagggttgggctggtgt

SEQ ID NO: 3260649 - DNA, 14 bp, Homo sapiens
cttgaggtcttttg

SEQ ID NO: 3260650 - DNA, 17 bp, Homo sapiens
cttgaggtcttttgaca

SEQ ID NO: 3260651 - DNA, 18 bp, Homo sapiens
cttgaggtcttttgacat

SEQ ID NO: 3260652 - DNA, 23 bp, Homo sapiens
cttgagtgcttgttagagagaaa

SEQ ID NO: 3260653 - DNA, 20 bp, Homo sapiens
cttgagtgtaatgtttgtta

SEQ ID NO: 3260654 - DNA, 13 bp, Homo sapiens
cttgagtgttcct

SEQ ID NO: 3260655 - DNA, 19 bp, Homo sapiens
cttgagtgttcctttttaa

SEQ ID NO: 3260656 - DNA, 18 bp, Homo sapiens
cttgagttggagtactat

SEQ ID NO: 3260657 - DNA, 21 bp, Homo sapiens
cttgagtttgtcgctcatgtg

SEQ ID NO: 3260658 - DNA, 22 bp, Homo sapiens
cttgataatattagtgattctg

SEQ ID NO: 3260659 - DNA, 21 bp, Homo sapiens
cttgatactgaatgcataaat

SEQ ID NO: 3260660 - DNA, 16 bp, Homo sapiens
cttgatcttaaagatc

SEQ ID NO: 3260661 - DNA, 23 bp, Homo sapiens
cttgatgccatatgccttgggga

SEQ ID NO: 3260662 - DNA, 21 bp, Homo sapiens
cttgatggctccgaacaccct

SEQ ID NO: 3260663 - DNA, 15 bp, Homo sapiens
cttgatgtgaagata

SEQ ID NO: 3260664 - DNA, 15 bp, Homo sapiens
cttgatgtgttatct

SEQ ID NO: 3260665 - DNA, 14 bp, Homo sapiens
cttgatgttgctta

SEQ ID NO: 3260666 - DNA, 17 bp, Homo sapiens
cttgatgtttggggtct

SEQ ID NO: 3260667 - DNA, 14 bp, Homo sapiens
cttgattaaatcaa

SEQ ID NO: 3260668 - DNA, 15 bp, Homo sapiens
cttgattaagatttt

SEQ ID NO: 3260669 - DNA, 18 bp, Homo sapiens
cttgatttaaacacacag

SEQ ID NO: 3260670 - DNA, 19 bp, Homo sapiens
cttgatttcaaagttttgt

SEQ ID NO: 3260671 - DNA, 23 bp, Homo sapiens
cttgatttcaaagttttgttgta

SEQ ID NO: 3260672 - DNA, 18 bp, Homo sapiens
cttgatttgcatggattt

SEQ ID NO: 3260673 - DNA, 20 bp, Homo sapiens
cttgcaaagacctacctcca

SEQ ID NO: 3260674 - DNA, 21 bp, Homo sapiens
cttgcaaagacctacctccag

SEQ ID NO: 3260675 - DNA, 17 bp, Homo sapiens
cttgcaatggcagcctt

SEQ ID NO: 3260676 - DNA, 22 bp, Homo sapiens
cttgcaccccaaagctttcctg

SEQ ID NO: 3260677 - DNA, 14 bp, Homo sapiens
cttgcacccctcac

SEQ ID NO: 3260678 - DNA, 16 bp, Homo sapiens
cttgcacccctcactc

SEQ ID NO: 3260679 - DNA, 18 bp, Homo sapiens
cttgcacccctcactctg

SEQ ID NO: 3260680 - DNA, 16 bp, Homo sapiens
cttgcacccgcctctc

SEQ ID NO: 3260681 - DNA, 21 bp, Homo sapiens
cttgcactaaagtatgtaaag

SEQ ID NO: 3260682 - DNA, 16 bp, Homo sapiens
cttgcactccttccct

SEQ ID NO: 3260683 - DNA, 17 bp, Homo sapiens
cttgcagaactgccatt

SEQ ID NO: 3260684 - DNA, 18 bp, Homo sapiens
cttgcagactctacagag

SEQ ID NO: 3260685 - DNA, 20 bp, Homo sapiens
cttgcagactctacagaggc

SEQ ID NO: 3260686 - DNA, 13 bp, Homo sapiens
cttgcagagcttg

SEQ ID NO: 3260687 - DNA, 20 bp, Homo sapiens
cttgcagccacatggcccca

SEQ ID NO: 3260688 - DNA, 21 bp, Homo sapiens
cttgcaggggtcccccctcaa

SEQ ID NO: 3260689 - DNA, 19 bp, Homo sapiens
cttgcaggggtccctgcta

SEQ ID NO: 3260690 - DNA, 17 bp, Homo sapiens
cttgcagtggcttttca

SEQ ID NO: 3260691 - DNA, 22 bp, Homo sapiens
cttgcataataagctaaagagg

SEQ ID NO: 3260692 - DNA, 20 bp, Homo sapiens
cttgcataggctcttaagca

SEQ ID NO: 3260693 - DNA, 19 bp, Homo sapiens
cttgcatccaactccagga

SEQ ID NO: 3260694 - DNA, 16 bp, Homo sapiens
cttgcatccattgttg

SEQ ID NO: 3260695 - DNA, 17 bp, Homo sapiens
cttgcatccattgttgt

SEQ ID NO: 3260696 - DNA, 13 bp, Homo sapiens
cttgcatgcttgc

SEQ ID NO: 3260697 - DNA, 14 bp, Homo sapiens
cttgcattcatttt

SEQ ID NO: 3260698 - DNA, 20 bp, Homo sapiens
cttgccacatttctgatcag

SEQ ID NO: 3260699 - DNA, 23 bp, Homo sapiens
cttgccacatttctgatcagagg

SEQ ID NO: 3260700 - DNA, 15 bp, Homo sapiens
cttgccactgcctct

SEQ ID NO: 3260701 - DNA, 17 bp, Homo sapiens
cttgccattccaaaata

SEQ ID NO: 3260702 - DNA, 17 bp, Homo sapiens
cttgcccagactacagg

SEQ ID NO: 3260703 - DNA, 13 bp, Homo sapiens
cttgcccatcctg

SEQ ID NO: 3260704 - DNA, 13 bp, Homo sapiens
cttgccccacagt

SEQ ID NO: 3260705 - DNA, 18 bp, Homo sapiens
cttgccccacagttgtgt

SEQ ID NO: 3260706 - DNA, 21 bp, Homo sapiens
cttgccccggccccggcccca

SEQ ID NO: 3260707 - DNA, 18 bp, Homo sapiens
cttgcccgcgctctttct

SEQ ID NO: 3260708 - DNA, 18 bp, Homo sapiens
cttgcccggattctggga

SEQ ID NO: 3260709 - DNA, 18 bp, Homo sapiens
cttgccctccgcctggga

SEQ ID NO: 3260710 - DNA, 13 bp, Homo sapiens
cttgccctgacct

SEQ ID NO: 3260711 - DNA, 17 bp, Homo sapiens
cttgccctgacctccca

SEQ ID NO: 3260712 - DNA, 18 bp, Homo sapiens
cttgccctgacctcccag

SEQ ID NO: 3260713 - DNA, 19 bp, Homo sapiens
cttgccctgacctcccagc

SEQ ID NO: 3260714 - DNA, 14 bp, Homo sapiens
cttgcccttccctg

SEQ ID NO: 3260715 - DNA, 16 bp, Homo sapiens
cttgcccttccctgtc

SEQ ID NO: 3260716 - DNA, 23 bp, Homo sapiens
cttgcccttccctgtccctctaa

SEQ ID NO: 3260717 - DNA, 13 bp, Homo sapiens
cttgccgaggagc

SEQ ID NO: 3260718 - DNA, 20 bp, Homo sapiens
cttgccgaggagccaggcaa

SEQ ID NO: 3260719 - DNA, 17 bp, Homo sapiens
cttgcctaaatttaatg

SEQ ID NO: 3260720 - DNA, 17 bp, Homo sapiens
cttgcctctctcaggag

SEQ ID NO: 3260721 - DNA, 15 bp, Homo sapiens
cttgcctctgtgctg

SEQ ID NO: 3260722 - DNA, 12 bp, Homo sapiens
cttgcctcttcc

SEQ ID NO: 3260723 - DNA, 16 bp, Homo sapiens
cttgcctcttccttga

SEQ ID NO: 3260724 - DNA, 20 bp, Homo sapiens
cttgcctggagacgtggaac

SEQ ID NO: 3260725 - DNA, 17 bp, Homo sapiens
cttgccttcccctgtct

SEQ ID NO: 3260726 - DNA, 19 bp, Homo sapiens
cttgccttcttcacccagc

SEQ ID NO: 3260727 - DNA, 20 bp, Homo sapiens
cttgccttcttcacccagct

SEQ ID NO: 3260728 - DNA, 17 bp, Homo sapiens
cttgcctttgtggcctt

SEQ ID NO: 3260729 - DNA, 19 bp, Homo sapiens
cttgcgaactagagatgtg

SEQ ID NO: 3260730 - DNA, 14 bp, Homo sapiens
cttgcgaatccaag

SEQ ID NO: 3260731 - DNA, 16 bp, Homo sapiens
cttgcgaatccaagct

SEQ ID NO: 3260732 - DNA, 13 bp, Homo sapiens
cttgctaaagcac

SEQ ID NO: 3260733 - DNA, 16 bp, Homo sapiens
cttgctaaagcacttt

SEQ ID NO: 3260734 - DNA, 19 bp, Homo sapiens
cttgctaataaacactggc

SEQ ID NO: 3260735 - DNA, 16 bp, Homo sapiens
cttgctaatcagtgtc

SEQ ID NO: 3260736 - DNA, 17 bp, Homo sapiens
cttgctaatcagtgtct

SEQ ID NO: 3260737 - DNA, 19 bp, Homo sapiens
cttgctaatcagtgtctca

SEQ ID NO: 3260738 - DNA, 20 bp, Homo sapiens
cttgctaatcagtgtctcac

SEQ ID NO: 3260739 - DNA, 23 bp, Homo sapiens
cttgctaatcagtgtctcacact

SEQ ID NO: 3260740 - DNA, 17 bp, Homo sapiens
cttgctaattttctcaa

SEQ ID NO: 3260741 - DNA, 16 bp, Homo sapiens
cttgctacctcaaggg

SEQ ID NO: 3260742 - DNA, 23 bp, Homo sapiens
cttgctagctatgtgaccttgag

SEQ ID NO: 3260743 - DNA, 14 bp, Homo sapiens
cttgctccagggtc

SEQ ID NO: 3260744 - DNA, 20 bp, Homo sapiens
cttgctccagggtcttgggc

SEQ ID NO: 3260745 - DNA, 22 bp, Homo sapiens
cttgctccagggtcttgggcta

SEQ ID NO: 3260746 - DNA, 17 bp, Homo sapiens
ctgggagtcacacagtg

SEQ ID NO: 3260747 - DNA, 17 bp, Homo sapiens
ctgggagtcagagccct

SEQ ID NO: 3260748 - DNA, 19 bp, Homo sapiens
ctgggagtcagagccctgg

SEQ ID NO: 3260749 - DNA, 12 bp, Homo sapiens
ctgggagtgagc

SEQ ID NO: 3260750 - DNA, 12 bp, Homo sapiens
ctgggataactg

SEQ ID NO: 3260751 - DNA, 14 bp, Homo sapiens
ctgggatatttaac

SEQ ID NO: 3260752 - DNA, 17 bp, Homo sapiens
ctgggatgagccgctgt

SEQ ID NO: 3260753 - DNA, 21 bp, Homo sapiens
ctgggatgaggggtgctgggt

SEQ ID NO: 3260754 - DNA, 15 bp, Homo sapiens
ctgggatgcaggcat

SEQ ID NO: 3260755 - DNA, 22 bp, Homo sapiens
ctgggatgctagccccagagat

SEQ ID NO: 3260756 - DNA, 19 bp, Homo sapiens
ctgggatgggaacactggt

SEQ ID NO: 3260757 - DNA, 20 bp, Homo sapiens
ctgggatgggaccagggatg

SEQ ID NO: 3260758 - DNA, 17 bp, Homo sapiens
ctgggatgtagaacttc

SEQ ID NO: 3260759 - DNA, 18 bp, Homo sapiens
ctgggatgtgtgctttcc

SEQ ID NO: 3260760 - DNA, 21 bp, Homo sapiens
ctgggattacaagcgtgagcc

SEQ ID NO: 3260761 - DNA, 21 bp, Homo sapiens
ctgggattacaggcgtgagcc

SEQ ID NO: 3260762 - DNA, 17 bp, Homo sapiens
ctgggattacaggtgtg

SEQ ID NO: 3260763 - DNA, 22 bp, Homo sapiens
ctgggattatataggcatgagc

SEQ ID NO: 3260764 - DNA, 18 bp, Homo sapiens
ctgggattattctttgaa

SEQ ID NO: 3260765 - DNA, 18 bp, Homo sapiens
ctgggattctactttaag

SEQ ID NO: 3260766 - DNA, 20 bp, Homo sapiens
ctgggcaggcggtccccatc

SEQ ID NO: 3260767 - DNA, 15 bp, Homo sapiens
ctgggcatctgttct

SEQ ID NO: 3260768 - DNA, 19 bp, Homo sapiens
ctgggcatcttctggcttg

SEQ ID NO: 3260769 - DNA, 22 bp, Homo sapiens
ctgggcatggtaccagccctgg

SEQ ID NO: 3260770 - DNA, 13 bp, Homo sapiens
ctgggcattgctt

SEQ ID NO: 3260771 - DNA, 18 bp, Homo sapiens
ctgggccaagttcctcta

SEQ ID NO: 3260772 - DNA, 20 bp, Homo sapiens
ctgggccaagttcctctagt

SEQ ID NO: 3260773 - DNA, 22 bp, Homo sapiens
ctgggccacggaggagggatgc

SEQ ID NO: 3260774 - DNA, 16 bp, Homo sapiens
ctgggccactggggac

SEQ ID NO: 3260775 - DNA, 18 bp, Homo sapiens
ctgggccagccctgcagc

SEQ ID NO: 3260776 - DNA, 22 bp, Homo sapiens
ctgggccaggaggtagtttctc

SEQ ID NO: 3260777 - DNA, 14 bp, Homo sapiens
ctgggccagggtct

SEQ ID NO: 3260778 - DNA, 23 bp, Homo sapiens
ctgggccatgtccaaagaggctg

SEQ ID NO: 3260779 - DNA, 15 bp, Homo sapiens
ctgggcccagcccct

SEQ ID NO: 3260780 - DNA, 20 bp, Homo sapiens
ctgggcccagcccctccacg

SEQ ID NO: 3260781 - DNA, 15 bp, Homo sapiens
ctgggcccaggggct

SEQ ID NO: 3260782 - DNA, 14 bp, Homo sapiens
ctgggccccaccta

SEQ ID NO: 3260783 - DNA, 14 bp, Homo sapiens
ctgggccccatgct

SEQ ID NO: 3260784 - DNA, 22 bp, Homo sapiens
ctgggccccatgctctgcccca

SEQ ID NO: 3260785 - DNA, 19 bp, Homo sapiens
ctgggccccccagctcagg

SEQ ID NO: 3260786 - DNA, 20 bp, Homo sapiens
ctgggcccctccacgcctcc

SEQ ID NO: 3260787 - DNA, 21 bp, Homo sapiens
ctgggcccctccacgcctcct

SEQ ID NO: 3260788 - DNA, 21 bp, Homo sapiens
ctgggcccctcttattcctct

SEQ ID NO: 3260789 - DNA, 14 bp, Homo sapiens
ctgggcccctgcac

SEQ ID NO: 3260790 - DNA, 14 bp, Homo sapiens
ctgggcccctggga

SEQ ID NO: 3260791 - DNA, 11 bp, Homo sapiens
ctgggccctct

SEQ ID NO: 3260792 - DNA, 14 bp, Homo sapiens
ctgggccctctctt

SEQ ID NO: 3260793 - DNA, 16 bp, Homo sapiens
ctgggccctctttccc

SEQ ID NO: 3260794 - DNA, 19 bp, Homo sapiens
ctgggccctctttccctgc

SEQ ID NO: 3260795 - DNA, 20 bp, Homo sapiens
ctgggccctctttccctgcg

SEQ ID NO: 3260796 - DNA, 15 bp, Homo sapiens
ctgggccctggagga

SEQ ID NO: 3260797 - DNA, 18 bp, Homo sapiens
ctgggccctgggctggaa

SEQ ID NO: 3260798 - DNA, 18 bp, Homo sapiens
ctgggcctcccttgggct

SEQ ID NO: 3260799 - DNA, 20 bp, Homo sapiens
ctgggcctcgtgcgcccgtg

SEQ ID NO: 3260800 - DNA, 14 bp, Homo sapiens
ctgggcctctgact

SEQ ID NO: 3260801 - DNA, 20 bp, Homo sapiens
ctgggcctctgactctgagt

SEQ ID NO: 3260802 - DNA, 12 bp, Homo sapiens
ctgggcctgctt

SEQ ID NO: 3260803 - DNA, 23 bp, Homo sapiens
ctgggcctgcttttccaggatcc

SEQ ID NO: 3260804 - DNA, 11 bp, Homo sapiens
ctgggcctggg

SEQ ID NO: 3260805 - DNA, 12 bp, Homo sapiens
ctgggcctgggc

SEQ ID NO: 3260806 - DNA, 14 bp, Homo sapiens
ctgggcctgtcccc

SEQ ID NO: 3260807 - DNA, 17 bp, Homo sapiens
ctgggcctgtgcagcag

SEQ ID NO: 3260808 - DNA, 17 bp, Homo sapiens
ctgggcctgttgccctt

SEQ ID NO: 3260809 - DNA, 17 bp, Homo sapiens
ctgggcctttgcaagat

SEQ ID NO: 3260810 - DNA, 14 bp, Homo sapiens
ctgggcggggctcg

SEQ ID NO: 3260811 - DNA, 16 bp, Homo sapiens
ctgggcggggctcgag

SEQ ID NO: 3260812 - DNA, 14 bp, Homo sapiens
ctgggctcacaggc

SEQ ID NO: 3260813 - DNA, 18 bp, Homo sapiens
ctgggctcacaggcctct

SEQ ID NO: 3260814 - DNA, 12 bp, Homo sapiens
ctgggctcagcc

SEQ ID NO: 3260815 - DNA, 18 bp, Homo sapiens
ctgggctcagggagggag

SEQ ID NO: 3260816 - DNA, 14 bp, Homo sapiens
ctgggctcagggct

SEQ ID NO: 3260817 - DNA, 16 bp, Homo sapiens
ctgggctcagggctgg

SEQ ID NO: 3260818 - DNA, 17 bp, Homo sapiens
ctgggctcagggctgga

SEQ ID NO: 3260819 - DNA, 21 bp, Homo sapiens
ctgggctcagggctggagtgc

SEQ ID NO: 3260820 - DNA, 23 bp, Homo sapiens
ctgggctctgcaattcccctctg

SEQ ID NO: 3260821 - DNA, 23 bp, Homo sapiens
ctgggctgcgggaggccctggcc

SEQ ID NO: 3260822 - DNA, 16 bp, Homo sapiens
ctgggctggactggag

SEQ ID NO: 3260823 - DNA, 16 bp, Homo sapiens
ctgggctgggccctct

SEQ ID NO: 3260824 - DNA, 18 bp, Homo sapiens
ctgggctggggaggacct

SEQ ID NO: 3260825 - DNA, 23 bp, Homo sapiens
ctgggctgggtggcacaccaccc

SEQ ID NO: 3260826 - DNA, 15 bp, Homo sapiens
ctgggctgtgggcaa

SEQ ID NO: 3260827 - DNA, 12 bp, Homo sapiens
ctgggctgttgt

SEQ ID NO: 3260828 - DNA, 24 bp, Homo sapiens
ctgggcttcagtggcagctgcttt

SEQ ID NO: 3260829 - DNA, 17 bp, Homo sapiens
ctgggcttggcctgctg

SEQ ID NO: 3260830 - DNA, 18 bp, Homo sapiens
ctgggcttggcctgctgt

SEQ ID NO: 3260831 - DNA, 23 bp, Homo sapiens
ctgggcttggggtgtggggtggg

SEQ ID NO: 3260832 - DNA, 14 bp, Homo sapiens
ctggggaacatttc

SEQ ID NO: 3260833 - DNA, 12 bp, Homo sapiens
ctggggaaggag

SEQ ID NO: 3260834 - DNA, 18 bp, Homo sapiens
ctggggaaggagccagtt

SEQ ID NO: 3260835 - DNA, 16 bp, Homo sapiens
ctggggaatgctccca

SEQ ID NO: 3260836 - DNA, 18 bp, Homo sapiens
ctggggaatgctcccagc

SEQ ID NO: 3260837 - DNA, 14 bp, Homo sapiens
ctggggacagaggg

SEQ ID NO: 3260838 - DNA, 17 bp, Homo sapiens
ctggggacccccacgat

SEQ ID NO: 3260839 - DNA, 22 bp, Homo sapiens
ctggggacctggtaccctcctg

SEQ ID NO: 3260840 - DNA, 23 bp, Homo sapiens
ctggggactttatttatttctag

SEQ ID NO: 3260841 - DNA, 13 bp, Homo sapiens
ctggggagaaagt

SEQ ID NO: 3260842 - DNA, 20 bp, Homo sapiens
ctggggagcccgtctcagtg

SEQ ID NO: 3260843 - DNA, 15 bp, Homo sapiens
ctggggagctcctgg

SEQ ID NO: 3260844 - DNA, 14 bp, Homo sapiens
ctggggatccccgc

SEQ ID NO: 3260845 - DNA, 16 bp, Homo sapiens
ctggggcaagtccctg

SEQ ID NO: 3260846 - DNA, 13 bp, Homo sapiens
ctggggcagaggg

SEQ ID NO: 3260847 - DNA, 21 bp, Homo sapiens
ctggggcagaggggcagccgc

SEQ ID NO: 3260848 - DNA, 14 bp, Homo sapiens
ctggggcagcactc

SEQ ID NO: 3260849 - DNA, 14 bp, Homo sapiens
ctggggcaggctgg

SEQ ID NO: 3260850 - DNA, 17 bp, Homo sapiens
ctggggcaggctgggcc

SEQ ID NO: 3260851 - DNA, 18 bp, Homo sapiens
ctggggcatcctgtgcca

SEQ ID NO: 3260852 - DNA, 14 bp, Homo sapiens
ctggggcatggcag

SEQ ID NO: 3260853 - DNA, 20 bp, Homo sapiens
ctggggcatgtgtgcctgtg

SEQ ID NO: 3260854 - DNA, 13 bp, Homo sapiens
ctggggcccagga

SEQ ID NO: 3260855 - DNA, 17 bp, Homo sapiens
ctggggccccgctggga

SEQ ID NO: 3260856 - DNA, 13 bp, Homo sapiens
ctggggccgccac

SEQ ID NO: 3260857 - DNA, 21 bp, Homo sapiens
ctggggccgccacggcctggc

SEQ ID NO: 3260858 - DNA, 20 bp, Homo sapiens
ctggggccggtagaggctcc

SEQ ID NO: 3260859 - DNA, 15 bp, Homo sapiens
ctggggcctcagacg

SEQ ID NO: 3260860 - DNA, 15 bp, Homo sapiens
ctggggcctccagaa

SEQ ID NO: 3260861 - DNA, 12 bp, Homo sapiens
ctggggcctggc

SEQ ID NO: 3260862 - DNA, 15 bp, Homo sapiens
ctggggcgggcccct

SEQ ID NO: 3260863 - DNA, 16 bp, Homo sapiens
ctggggcgtggggagg

SEQ ID NO: 3260864 - DNA, 18 bp, Homo sapiens
ctggggctccctctctgg

SEQ ID NO: 3260865 - DNA, 16 bp, Homo sapiens
ctgtcccctctgtcat

SEQ ID NO: 3260866 - DNA, 18 bp, Homo sapiens
ctgtcccctctgtcatca

SEQ ID NO: 3260867 - DNA, 15 bp, Homo sapiens
ctgtccccttggcag

SEQ ID NO: 3260868 - DNA, 18 bp, Homo sapiens
ctgtcccggggtcctgtg

SEQ ID NO: 3260869 - DNA, 15 bp, Homo sapiens
ctgtccctcccacct

SEQ ID NO: 3260870 - DNA, 14 bp, Homo sapiens
ctgtccctgtcccc

SEQ ID NO: 3260871 - DNA, 16 bp, Homo sapiens
ctgtcccttccacttc

SEQ ID NO: 3260872 - DNA, 19 bp, Homo sapiens
ctgtcccttcccccataag

SEQ ID NO: 3260873 - DNA, 14 bp, Homo sapiens
ctgtcccttgctgt

SEQ ID NO: 3260874 - DNA, 18 bp, Homo sapiens
ctgtccggcccagtgcca

SEQ ID NO: 3260875 - DNA, 20 bp, Homo sapiens
ctgtccggcccagtgccact

SEQ ID NO: 3260876 - DNA, 20 bp, Homo sapiens
ctgtcctaaggaaccttcct

SEQ ID NO: 3260877 - DNA, 20 bp, Homo sapiens
ctgtcctaccagttgcccta

SEQ ID NO: 3260878 - DNA, 15 bp, Homo sapiens
ctgtcctaggccaca

SEQ ID NO: 3260879 - DNA, 22 bp, Homo sapiens
ctgtcctcagaggcgtgctggt

SEQ ID NO: 3260880 - DNA, 15 bp, Homo sapiens
ctgtcctccctccac

SEQ ID NO: 3260881 - DNA, 15 bp, Homo sapiens
ctgtcctcctggaag

SEQ ID NO: 3260882 - DNA, 16 bp, Homo sapiens
ctgtcctctcccctcc

SEQ ID NO: 3260883 - DNA, 18 bp, Homo sapiens
ctgtcctctcccctccag

SEQ ID NO: 3260884 - DNA, 19 bp, Homo sapiens
ctgtcctctcccctccagc

SEQ ID NO: 3260885 - DNA, 13 bp, Homo sapiens
ctgtcctctcgag

SEQ ID NO: 3260886 - DNA, 17 bp, Homo sapiens
ctgtcctgatctgtgat

SEQ ID NO: 3260887 - DNA, 19 bp, Homo sapiens
ctgtcctgatggtcagctc

SEQ ID NO: 3260888 - DNA, 22 bp, Homo sapiens
ctgtcctgatggtcagctccct

SEQ ID NO: 3260889 - DNA, 20 bp, Homo sapiens
ctgtgaggaatgctctgtgc

SEQ ID NO: 3260890 - DNA, 18 bp, Homo sapiens
ctgtgaggcccctggaca

SEQ ID NO: 3260891 - DNA, 18 bp, Homo sapiens
ctgtgagtgcgtctgagg

SEQ ID NO: 3260892 - DNA, 20 bp, Homo sapiens
ctgtgagtgcgtctgagggg

SEQ ID NO: 3260893 - DNA, 20 bp, Homo sapiens
ctgtgagtgtaagtgtgagt

SEQ ID NO: 3260894 - DNA, 21 bp, Homo sapiens
ctgtgagtgtaagtgtgagta

SEQ ID NO: 3260895 - DNA, 16 bp, Homo sapiens
ctgtgagttctccctg

SEQ ID NO: 3260896 - DNA, 18 bp, Homo sapiens
ctgtgagttctccctgta

SEQ ID NO: 3260897 - DNA, 22 bp, Homo sapiens
ctgtgagttctccctgtacagt

SEQ ID NO: 3260898 - DNA, 17 bp, Homo sapiens
ctgtgagtttaaagcaa

SEQ ID NO: 3260899 - DNA, 23 bp, Homo sapiens
ctgtgatcaatatttttatatca

SEQ ID NO: 3260900 - DNA, 15 bp, Homo sapiens
ctgtgatcatttatt

SEQ ID NO: 3260901 - DNA, 13 bp, Homo sapiens
ctgtgatgagctg

SEQ ID NO: 3260902 - DNA, 18 bp, Homo sapiens
ctgtgatgagctgatctg

SEQ ID NO: 3260903 - DNA, 22 bp, Homo sapiens
ctgtgatgagctgatctgcgga

SEQ ID NO: 3260904 - DNA, 14 bp, Homo sapiens
ctgtgatgccacac

SEQ ID NO: 3260905 - DNA, 16 bp, Homo sapiens
ctgtgatgccacacag

SEQ ID NO: 3260906 - DNA, 13 bp, Homo sapiens
ctgtgattcagaa

SEQ ID NO: 3260907 - DNA, 16 bp, Homo sapiens
ctgtgattcagaaaat

SEQ ID NO: 3260908 - DNA, 13 bp, Homo sapiens
ctgtgcactgccc

SEQ ID NO: 3260909 - DNA, 19 bp, Homo sapiens
ctgtgcactgccctgttca

SEQ ID NO: 3260910 - DNA, 13 bp, Homo sapiens
ctgtgcagcagcc

SEQ ID NO: 3260911 - DNA, 14 bp, Homo sapiens
ctgtgcagcagccc

SEQ ID NO: 3260912 - DNA, 18 bp, Homo sapiens
ctgtgcagcagcccagct

SEQ ID NO: 3260913 - DNA, 17 bp, Homo sapiens
ctgtgcagcgcagctgg

SEQ ID NO: 3260914 - DNA, 15 bp, Homo sapiens
ctgtgcaggatattt

SEQ ID NO: 3260915 - DNA, 18 bp, Homo sapiens
cttaaaattaccagacaa

SEQ ID NO: 3260916 - DNA, 11 bp, Homo sapiens
cttaaacaaag

SEQ ID NO: 3260917 - DNA, 14 bp, Homo sapiens
cttaaacaatgtat

SEQ ID NO: 3260918 - DNA, 20 bp, Homo sapiens
cttaaacataataaatcaca

SEQ ID NO: 3260919 - DNA, 15 bp, Homo sapiens
cttaaaccttcagtt

SEQ ID NO: 3260920 - DNA, 14 bp, Homo sapiens
cttaaactaaataa

SEQ ID NO: 3260921 - DNA, 19 bp, Homo sapiens
cttaaactaaataatgaat

SEQ ID NO: 3260922 - DNA, 20 bp, Homo sapiens
cttaaactaaataatgaata

SEQ ID NO: 3260923 - DNA, 23 bp, Homo sapiens
cttaaactgtgtggactgtgatg

SEQ ID NO: 3260924 - DNA, 14 bp, Homo sapiens
cttaaacttgtgaa

SEQ ID NO: 3260925 - DNA, 15 bp, Homo sapiens
cttaaacttgtgaat

SEQ ID NO: 3260926 - DNA, 22 bp, Homo sapiens
cttaaagaaagtcgaattaata

SEQ ID NO: 3260927 - DNA, 17 bp, Homo sapiens
cttaaaggacaggagga

SEQ ID NO: 3260928 - DNA, 20 bp, Homo sapiens
cttaaagtggtcatattatt

SEQ ID NO: 3260929 - DNA, 15 bp, Homo sapiens
cttaaagttgtcact

SEQ ID NO: 3260930 - DNA, 19 bp, Homo sapiens
cttaaataatgcttcagat

SEQ ID NO: 3260931 - DNA, 20 bp, Homo sapiens
cttaaataatgcttcagata

SEQ ID NO: 3260932 - DNA, 22 bp, Homo sapiens
cttaaataggaaagtttcttca

SEQ ID NO: 3260933 - DNA, 19 bp, Homo sapiens
cttaaatatatatttctaa

SEQ ID NO: 3260934 - DNA, 12 bp, Homo sapiens
cttaaatatgta

SEQ ID NO: 3260935 - DNA, 16 bp, Homo sapiens
cttaaatctttcttca

SEQ ID NO: 3260936 - DNA, 21 bp, Homo sapiens
cttaaatgaaagcatgtggca

SEQ ID NO: 3260937 - DNA, 14 bp, Homo sapiens
cttaaatgtttata

SEQ ID NO: 3260938 - DNA, 18 bp, Homo sapiens
cttaaatgtttatactgt

SEQ ID NO: 3260939 - DNA, 16 bp, Homo sapiens
cttaaattatgtttta

SEQ ID NO: 3260940 - DNA, 21 bp, Homo sapiens
cttaaattgcttttgttgtga

SEQ ID NO: 3260941 - DNA, 12 bp, Homo sapiens
cttaaatttaat

SEQ ID NO: 3260942 - DNA, 16 bp, Homo sapiens
cttaaattttaactaa

SEQ ID NO: 3260943 - DNA, 15 bp, Homo sapiens
cttaacaaaccaaca

SEQ ID NO: 3260944 - DNA, 20 bp, Homo sapiens
cttaacaaaccaacatcttt

SEQ ID NO: 3260945 - DNA, 20 bp, Homo sapiens
cttaacaaccaacttgttgt

SEQ ID NO: 3260946 - DNA, 22 bp, Homo sapiens
cttaacagatctttactcttga

SEQ ID NO: 3260947 - DNA, 15 bp, Homo sapiens
cttaacctttgctat

SEQ ID NO: 3260948 - DNA, 18 bp, Homo sapiens
cttaacctttgctatgta

SEQ ID NO: 3260949 - DNA, 15 bp, Homo sapiens
cttaacggctccagg

SEQ ID NO: 3260950 - DNA, 12 bp, Homo sapiens
cttaactaattt

SEQ ID NO: 3260951 - DNA, 15 bp, Homo sapiens
cttaactaatttgaa

SEQ ID NO: 3260952 - DNA, 19 bp, Homo sapiens
cttaactggcctaaatttc

SEQ ID NO: 3260953 - DNA, 21 bp, Homo sapiens
cttaacttcttgcttctttct

SEQ ID NO: 3260954 - DNA, 22 bp, Homo sapiens
cttaacttcttgcttctttcta

SEQ ID NO: 3260955 - DNA, 20 bp, Homo sapiens
cttagaacagtggaaactat

SEQ ID NO: 3260956 - DNA, 16 bp, Homo sapiens
cttagaagagagccag

SEQ ID NO: 3260957 - DNA, 17 bp, Homo sapiens
cttagaatccaaacttg

SEQ ID NO: 3260958 - DNA, 17 bp, Homo sapiens
cttagagagaggaggca

SEQ ID NO: 3260959 - DNA, 18 bp, Homo sapiens
cttagagagaggaggcag

SEQ ID NO: 3260960 - DNA, 22 bp, Homo sapiens
cttagagccttttatctgcaga

SEQ ID NO: 3260961 - DNA, 14 bp, Homo sapiens
cttagaggaaaagg

SEQ ID NO: 3260962 - DNA, 13 bp, Homo sapiens
cttagaggaaaat

SEQ ID NO: 3260963 - DNA, 17 bp, Homo sapiens
cttagagtgtagctgta

SEQ ID NO: 3260964 - DNA, 17 bp, Homo sapiens
cttagataatatttctg

SEQ ID NO: 3260965 - DNA, 19 bp, Homo sapiens
cttagatgagggtgactgt

SEQ ID NO: 3260966 - DNA, 19 bp, Homo sapiens
cttagatgtatatatttcc

SEQ ID NO: 3260967 - DNA, 14 bp, Homo sapiens
cttagatttcatag

SEQ ID NO: 3260968 - DNA, 15 bp, Homo sapiens
cttagcagcttccag

SEQ ID NO: 3260969 - DNA, 17 bp, Homo sapiens
cttagcagcttccagat

SEQ ID NO: 3260970 - DNA, 18 bp, Homo sapiens
cttagcagcttccagatt

SEQ ID NO: 3260971 - DNA, 18 bp, Homo sapiens
cttagcagggaaacagct

SEQ ID NO: 3260972 - DNA, 18 bp, Homo sapiens
cttagcatgtgttgaaaa

SEQ ID NO: 3260973 - DNA, 20 bp, Homo sapiens
cttagccagttcaaagtgta

SEQ ID NO: 3260974 - DNA, 15 bp, Homo sapiens
cttagcccaagaggt

SEQ ID NO: 3260975 - DNA, 18 bp, Homo sapiens
cttagcccaagaggtctg

SEQ ID NO: 3260976 - DNA, 19 bp, Homo sapiens
cttagccgactgcgctgct

SEQ ID NO: 3260977 - DNA, 20 bp, Homo sapiens
cttagccgtccatggcacca

SEQ ID NO: 3260978 - DNA, 22 bp, Homo sapiens
cttagccgtccatggcaccagc

SEQ ID NO: 3260979 - DNA, 11 bp, Homo sapiens
cttagcctccc

SEQ ID NO: 3260980 - DNA, 18 bp, Homo sapiens
cttagcctggatttcctt

SEQ ID NO: 3260981 - DNA, 11 bp, Homo sapiens
cttagccttgt

SEQ ID NO: 3260982 - DNA, 15 bp, Homo sapiens
cttagccttgtgccc

SEQ ID NO: 3260983 - DNA, 17 bp, Homo sapiens
cttagccttgtgccctg

SEQ ID NO: 3260984 - DNA, 19 bp, Homo sapiens
cttagccttgtgccctgcc

SEQ ID NO: 3260985 - DNA, 14 bp, Homo sapiens
cttagctactgtat

SEQ ID NO: 3260986 - DNA, 13 bp, Homo sapiens
cttagctcccagc

SEQ ID NO: 3260987 - DNA, 16 bp, Homo sapiens
cttagctcccagctag

SEQ ID NO: 3260988 - DNA, 17 bp, Homo sapiens
cttagctccctcccgca

SEQ ID NO: 3260989 - DNA, 14 bp, Homo sapiens
cttagctgccagtg

SEQ ID NO: 3260990 - DNA, 19 bp, Homo sapiens
cttagctgccagtgctggt

SEQ ID NO: 3260991 - DNA, 22 bp, Homo sapiens
cttagctggatataatgtattt

SEQ ID NO: 3260992 - DNA, 14 bp, Homo sapiens
cttagctgtctgct

SEQ ID NO: 3260993 - DNA, 14 bp, Homo sapiens
cttagcttatcttt

SEQ ID NO: 3260994 - DNA, 18 bp, Homo sapiens
cttagctttccctgtgcc

SEQ ID NO: 3260995 - DNA, 21 bp, Homo sapiens
cttagctttccctgtgccact

SEQ ID NO: 3260996 - DNA, 16 bp, Homo sapiens
cttagctttctcaggg

SEQ ID NO: 3260997 - DNA, 14 bp, Homo sapiens
cttagctttttaat

SEQ ID NO: 3260998 - DNA, 18 bp, Homo sapiens
cttaggatatttgagtca

SEQ ID NO: 3260999 - DNA, 12 bp, Homo sapiens
cttattgcccac

SEQ ID NO: 3261000 - DNA, 16 bp, Homo sapiens
cttattgcgctgctac

SEQ ID NO: 3261001 - DNA, 14 bp, Homo sapiens
cttattggaaatgt

SEQ ID NO: 3261002 - DNA, 20 bp, Homo sapiens
cttattgggatatcatttta

SEQ ID NO: 3261003 - DNA, 22 bp, Homo sapiens
cttattgggatatcattttaaa

SEQ ID NO: 3261004 - DNA, 15 bp, Homo sapiens
cttattgttccaaga

SEQ ID NO: 3261005 - DNA, 22 bp, Homo sapiens
cttattgttccaagacattgtc

SEQ ID NO: 3261006 - DNA, 15 bp, Homo sapiens
cttatttaaaaatat

SEQ ID NO: 3261007 - DNA, 21 bp, Homo sapiens
cttatttaaaaatatttcaga

SEQ ID NO: 3261008 - DNA, 22 bp, Homo sapiens
cttatttaaaaatatttcagat

SEQ ID NO: 3261009 - DNA, 15 bp, Homo sapiens
cttatttaatgaaag

SEQ ID NO: 3261010 - DNA, 11 bp, Homo sapiens
cttatttcact

SEQ ID NO: 3261011 - DNA, 19 bp, Homo sapiens
cttatttccaagtaagagt

SEQ ID NO: 3261012 - DNA, 14 bp, Homo sapiens
cttatttctgaatt

SEQ ID NO: 3261013 - DNA, 18 bp, Homo sapiens
cttatttgccagagccaa

SEQ ID NO: 3261014 - DNA, 15 bp, Homo sapiens
cttatttgcttcatt

SEQ ID NO: 3261015 - DNA, 17 bp, Homo sapiens
cttatttgcttcattgt

SEQ ID NO: 3261016 - DNA, 16 bp, Homo sapiens
cttatttgtatatggt

SEQ ID NO: 3261017 - DNA, 14 bp, Homo sapiens
cttattttcaagaa

SEQ ID NO: 3261018 - DNA, 16 bp, Homo sapiens
cttatttttagatggt

SEQ ID NO: 3261019 - DNA, 22 bp, Homo sapiens
cttatttttagatggttacact

SEQ ID NO: 3261020 - DNA, 23 bp, Homo sapiens
cttatttttagatggttacactg

SEQ ID NO: 3261021 - DNA, 17 bp, Homo sapiens
cttatttttgacagtgt

SEQ ID NO: 3261022 - DNA, 21 bp, Homo sapiens
cttatttttttaagaaaaaag

SEQ ID NO: 3261023 - DNA, 14 bp, Homo sapiens
cttcaaaaataaaa

SEQ ID NO: 3261024 - DNA, 22 bp, Homo sapiens
cttcaaaaataaaaaatctgaa

SEQ ID NO: 3261025 - DNA, 19 bp, Homo sapiens
cttcaaaatgtatatattt

SEQ ID NO: 3261026 - DNA, 20 bp, Homo sapiens
cttcaaaatgttatcttctc

SEQ ID NO: 3261027 - DNA, 14 bp, Homo sapiens
cttcaaactttcac

SEQ ID NO: 3261028 - DNA, 19 bp, Homo sapiens
cttcaaagctgaatatttt

SEQ ID NO: 3261029 - DNA, 18 bp, Homo sapiens
cttcaaagcttgaagatc

SEQ ID NO: 3261030 - DNA, 15 bp, Homo sapiens
cttcaaatacaaagt

SEQ ID NO: 3261031 - DNA, 21 bp, Homo sapiens
cttcaaattcaaggccttcca

SEQ ID NO: 3261032 - DNA, 16 bp, Homo sapiens
cttcaacatcaatgtt

SEQ ID NO: 3261033 - DNA, 18 bp, Homo sapiens
cttcaacatcaatgttca

SEQ ID NO: 3261034 - DNA, 20 bp, Homo sapiens
cttcaacatcctgccagccc

SEQ ID NO: 3261035 - DNA, 16 bp, Homo sapiens
cttcaaccattcccca

SEQ ID NO: 3261036 - DNA, 20 bp, Homo sapiens
cttcaactgaccagcctcca

SEQ ID NO: 3261037 - DNA, 19 bp, Homo sapiens
cttcaagacgaggggcagg

SEQ ID NO: 3261038 - DNA, 15 bp, Homo sapiens
cttcaaggtgacaga

SEQ ID NO: 3261039 - DNA, 17 bp, Homo sapiens
cttcaagtaatacgttt

SEQ ID NO: 3261040 - DNA, 12 bp, Homo sapiens
cttcaagtgcca

SEQ ID NO: 3261041 - DNA, 15 bp, Homo sapiens
cttcaagtgccaaac

SEQ ID NO: 3261042 - DNA, 12 bp, Homo sapiens
cttcaagtgcct

SEQ ID NO: 3261043 - DNA, 14 bp, Homo sapiens
cttcaagtgccttt

SEQ ID NO: 3261044 - DNA, 20 bp, Homo sapiens
cttcaagtgccttttgctgc

SEQ ID NO: 3261045 - DNA, 22 bp, Homo sapiens
cttcaagtgccttttgctgcgc

SEQ ID NO: 3261046 - DNA, 20 bp, Homo sapiens
ctgggggaatgagcccagag

SEQ ID NO: 3261047 - DNA, 13 bp, Homo sapiens
ctgggggactggg

SEQ ID NO: 3261048 - DNA, 16 bp, Homo sapiens
ctgggggactgggagt

SEQ ID NO: 3261049 - DNA, 12 bp, Homo sapiens
ctgggggcagga

SEQ ID NO: 3261050 - DNA, 19 bp, Homo sapiens
ctgggggccttgggtgagt

SEQ ID NO: 3261051 - DNA, 14 bp, Homo sapiens
ctgggggtgctgga

SEQ ID NO: 3261052 - DNA, 15 bp, Homo sapiens
ctgggggtgctggat

SEQ ID NO: 3261053 - DNA, 14 bp, Homo sapiens
ctgggggtggcagg

SEQ ID NO: 3261054 - DNA, 16 bp, Homo sapiens
ctgggggtggcaggca

SEQ ID NO: 3261055 - DNA, 17 bp, Homo sapiens
ctgggggtggcaggcac

SEQ ID NO: 3261056 - DNA, 12 bp, Homo sapiens
ctggggtacagg

SEQ ID NO: 3261057 - DNA, 14 bp, Homo sapiens
ctggggtctgagca

SEQ ID NO: 3261058 - DNA, 17 bp, Homo sapiens
ctggggtgcatcctcct

SEQ ID NO: 3261059 - DNA, 20 bp, Homo sapiens
ctggggtgggaggtcttgct

SEQ ID NO: 3261060 - DNA, 16 bp, Homo sapiens
ctggggtgggcagttt

SEQ ID NO: 3261061 - DNA, 20 bp, Homo sapiens
ctgggtaaaagcagggcagc

SEQ ID NO: 3261062 - DNA, 16 bp, Homo sapiens
ctgggtaaatgcaaag

SEQ ID NO: 3261063 - DNA, 17 bp, Homo sapiens
ctgggtaagaagaaagc

SEQ ID NO: 3261064 - DNA, 15 bp, Homo sapiens
ctgggtaatgtgaag

SEQ ID NO: 3261065 - DNA, 17 bp, Homo sapiens
ctgggtactgaaagcct

SEQ ID NO: 3261066 - DNA, 14 bp, Homo sapiens
ctgggtacttgtgg

SEQ ID NO: 3261067 - DNA, 18 bp, Homo sapiens
ctgggtacttgtggacac

SEQ ID NO: 3261068 - DNA, 21 bp, Homo sapiens
ctgggtacttgtggacacagc

SEQ ID NO: 3261069 - DNA, 15 bp, Homo sapiens
ctgggtattggaaat

SEQ ID NO: 3261070 - DNA, 11 bp, Homo sapiens
ctgggtcaggg

SEQ ID NO: 3261071 - DNA, 13 bp, Homo sapiens
ctgggtccaaata

SEQ ID NO: 3261072 - DNA, 23 bp, Homo sapiens
ctgggtccaaataaaaactaaat

SEQ ID NO: 3261073 - DNA, 18 bp, Homo sapiens
ctgggtccttgcacccct

SEQ ID NO: 3261074 - DNA, 22 bp, Homo sapiens
ctgggtgacagagcaagactct

SEQ ID NO: 3261075 - DNA, 15 bp, Homo sapiens
ctgggtgcagctgag

SEQ ID NO: 3261076 - DNA, 22 bp, Homo sapiens
ctgggtgcctcccacacttgct

SEQ ID NO: 3261077 - DNA, 20 bp, Homo sapiens
ctgggtggatcggcctcctc

SEQ ID NO: 3261078 - DNA, 18 bp, Homo sapiens
ctgggtggcacaccaccc

SEQ ID NO: 3261079 - DNA, 19 bp, Homo sapiens
ctgggtggcctcgggacac

SEQ ID NO: 3261080 - DNA, 16 bp, Homo sapiens
ctgggtgggacagcct

SEQ ID NO: 3261081 - DNA, 20 bp, Homo sapiens
ctgggtgggacagcctcttc

SEQ ID NO: 3261082 - DNA, 15 bp, Homo sapiens
ctgggtgggcccaga

SEQ ID NO: 3261083 - DNA, 15 bp, Homo sapiens
ctgggtgggctctgt

SEQ ID NO: 3261084 - DNA, 14 bp, Homo sapiens
ctgggtggggacag

SEQ ID NO: 3261085 - DNA, 21 bp, Homo sapiens
ctgggtggggtgaggaccact

SEQ ID NO: 3261086 - DNA, 19 bp, Homo sapiens
ctgggtggtaccctctgga

SEQ ID NO: 3261087 - DNA, 22 bp, Homo sapiens
ctgggtgtgtttggcttggcct

SEQ ID NO: 3261088 - DNA, 22 bp, Homo sapiens
ctgggttaatggctagtactgt

SEQ ID NO: 3261089 - DNA, 13 bp, Homo sapiens
ctgggttggaggg

SEQ ID NO: 3261090 - DNA, 14 bp, Homo sapiens
ctgggttggtgcac

SEQ ID NO: 3261091 - DNA, 19 bp, Homo sapiens
ctgggttggtgcacagtga

SEQ ID NO: 3261092 - DNA, 15 bp, Homo sapiens
ctgggtttcctgcag

SEQ ID NO: 3261093 - DNA, 16 bp, Homo sapiens
ctgggtttcctgcagg

SEQ ID NO: 3261094 - DNA, 17 bp, Homo sapiens
ctgggtttcctgcaggc

SEQ ID NO: 3261095 - DNA, 15 bp, Homo sapiens
ctgggtttggacccc

SEQ ID NO: 3261096 - DNA, 23 bp, Homo sapiens
ctggtaaaccaagcctcccacac

SEQ ID NO: 3261097 - DNA, 21 bp, Homo sapiens
ctggtaaagttacacttttat

SEQ ID NO: 3261098 - DNA, 19 bp, Homo sapiens
ctggtaactggaaggcctt

SEQ ID NO: 3261099 - DNA, 15 bp, Homo sapiens
ctggtaatattgact

SEQ ID NO: 3261100 - DNA, 15 bp, Homo sapiens
ctggtacaatccttt

SEQ ID NO: 3261101 - DNA, 16 bp, Homo sapiens
ctggtacccagccatc

SEQ ID NO: 3261102 - DNA, 14 bp, Homo sapiens
ctggtaccctcctg

SEQ ID NO: 3261103 - DNA, 15 bp, Homo sapiens
ctggtaccctcctgg

SEQ ID NO: 3261104 - DNA, 16 bp, Homo sapiens
ctggtacctgccctct

SEQ ID NO: 3261105 - DNA, 19 bp, Homo sapiens
ctggtactccctctcagga

SEQ ID NO: 3261106 - DNA, 15 bp, Homo sapiens
ctggtagagaccccc

SEQ ID NO: 3261107 - DNA, 17 bp, Homo sapiens
ctggtaggaccaagcat

SEQ ID NO: 3261108 - DNA, 15 bp, Homo sapiens
ctggtatactatcat

SEQ ID NO: 3261109 - DNA, 18 bp, Homo sapiens
ctggtatatccaaaagct

SEQ ID NO: 3261110 - DNA, 19 bp, Homo sapiens
ctggtatatccaaaagctt

SEQ ID NO: 3261111 - DNA, 14 bp, Homo sapiens
ctggtatctcagaa

SEQ ID NO: 3261112 - DNA, 21 bp, Homo sapiens
ctggtatgaataattgcatca

SEQ ID NO: 3261113 - DNA, 18 bp, Homo sapiens
ctggtattctgttctgga

SEQ ID NO: 3261114 - DNA, 19 bp, Homo sapiens
ctggtattctgttctggag

SEQ ID NO: 3261115 - DNA, 20 bp, Homo sapiens
ctggtcacaggactctgcct

SEQ ID NO: 3261116 - DNA, 21 bp, Homo sapiens
ctggtcacaggactctgcctc

SEQ ID NO: 3261117 - DNA, 23 bp, Homo sapiens
ctggtcacaggactctgcctcct

SEQ ID NO: 3261118 - DNA, 23 bp, Homo sapiens
ctggtcacagggcatgccccggc

SEQ ID NO: 3261119 - DNA, 18 bp, Homo sapiens
ctggtcagagacggcaga

SEQ ID NO: 3261120 - DNA, 22 bp, Homo sapiens
ctggtccaaaagattgctgaaa

SEQ ID NO: 3261121 - DNA, 15 bp, Homo sapiens
ctggtccagctctga

SEQ ID NO: 3261122 - DNA, 18 bp, Homo sapiens
ctggtccagctctgacat

SEQ ID NO: 3261123 - DNA, 23 bp, Homo sapiens
ctggtccagctctgacatccctt

SEQ ID NO: 3261124 - DNA, 15 bp, Homo sapiens
ctggtccagggaagc

SEQ ID NO: 3261125 - DNA, 21 bp, Homo sapiens
ctggtccagggaagctggccg

SEQ ID NO: 3261126 - DNA, 14 bp, Homo sapiens
ctggtccagggcta

SEQ ID NO: 3261127 - DNA, 15 bp, Homo sapiens
ctggtcccactcagt

SEQ ID NO: 3261128 - DNA, 18 bp, Homo sapiens
ctggtccctcgtccacag

SEQ ID NO: 3261129 - DNA, 13 bp, Homo sapiens
ctggtccctctga

SEQ ID NO: 3261130 - DNA, 17 bp, Homo sapiens
ctggtccctctgaggca

SEQ ID NO: 3261131 - DNA, 19 bp, Homo sapiens
ctggtccctctgaggcagt

SEQ ID NO: 3261132 - DNA, 15 bp, Homo sapiens
ctggtccctgggagg

SEQ ID NO: 3261133 - DNA, 21 bp, Homo sapiens
ctggtcccttgcagctagttt

SEQ ID NO: 3261134 - DNA, 16 bp, Homo sapiens
ctggtccgagctgagg

SEQ ID NO: 3261135 - DNA, 17 bp, Homo sapiens
ctggtccgagctgagga

SEQ ID NO: 3261136 - DNA, 15 bp, Homo sapiens
ctggtccgtgggacg

SEQ ID NO: 3261137 - DNA, 16 bp, Homo sapiens
ctggtccgtgggacgg

SEQ ID NO: 3261138 - DNA, 19 bp, Homo sapiens
ctggtcctggccgtcccta

SEQ ID NO: 3261139 - DNA, 17 bp, Homo sapiens
ctggtccttccaggccc

SEQ ID NO: 3261140 - DNA, 16 bp, Homo sapiens
ctggtcgctcctgccc

SEQ ID NO: 3261141 - DNA, 19 bp, Homo sapiens
ctggtctaatttattaatc

SEQ ID NO: 3261142 - DNA, 23 bp, Homo sapiens
ctggtctcaaactcttgacctca

SEQ ID NO: 3261143 - DNA, 20 bp, Homo sapiens
ctggtctccgtggcacttgt

SEQ ID NO: 3261144 - DNA, 18 bp, Homo sapiens
ctggtctcgaactcctgg

SEQ ID NO: 3261145 - DNA, 19 bp, Homo sapiens
ctggtctcgaactcctggc

SEQ ID NO: 3261146 - DNA, 23 bp, Homo sapiens
ctggtctcgaactcctggcctca

SEQ ID NO: 3261147 - DNA, 19 bp, Homo sapiens
ctggtctctaagtgtaaaa

SEQ ID NO: 3261148 - DNA, 13 bp, Homo sapiens
ctggtctgtgtgt

SEQ ID NO: 3261149 - DNA, 20 bp, Homo sapiens
ctggtgaatggccttccttc

SEQ ID NO: 3261150 - DNA, 12 bp, Homo sapiens
ctggtgcagtgg

SEQ ID NO: 3261151 - DNA, 16 bp, Homo sapiens
ctggtgcattacagag

SEQ ID NO: 3261152 - DNA, 17 bp, Homo sapiens
ctggtgcattacagaga

SEQ ID NO: 3261153 - DNA, 19 bp, Homo sapiens
ctggtgcattacagagagg

SEQ ID NO: 3261154 - DNA, 21 bp, Homo sapiens
ctggtgccaggcgcgtgtaaa

SEQ ID NO: 3261155 - DNA, 15 bp, Homo sapiens
ctggtgccatttctg

SEQ ID NO: 3261156 - DNA, 17 bp, Homo sapiens
ctggtgccccacagcta

SEQ ID NO: 3261157 - DNA, 18 bp, Homo sapiens
ctgtagatatgtattctt

SEQ ID NO: 3261158 - DNA, 14 bp, Homo sapiens
ctgtagatgttcta

SEQ ID NO: 3261159 - DNA, 15 bp, Homo sapiens
ctgtagattctgtgg

SEQ ID NO: 3261160 - DNA, 20 bp, Homo sapiens
ctgtagattctgtggaacaa

SEQ ID NO: 3261161 - DNA, 15 bp, Homo sapiens
ctgtagccagcacct

SEQ ID NO: 3261162 - DNA, 15 bp, Homo sapiens
ctgtagccatctgca

SEQ ID NO: 3261163 - DNA, 14 bp, Homo sapiens
ctgtagccatggct

SEQ ID NO: 3261164 - DNA, 16 bp, Homo sapiens
ctgtagccatggctca

SEQ ID NO: 3261165 - DNA, 19 bp, Homo sapiens
ctgtagccatggctcaggc

SEQ ID NO: 3261166 - DNA, 24 bp, Homo sapiens
ctgtagccatggctcaggcaagcc

SEQ ID NO: 3261167 - DNA, 15 bp, Homo sapiens
ctgtagcctcctttg

SEQ ID NO: 3261168 - DNA, 19 bp, Homo sapiens
ctgtagctacaagggaagc

SEQ ID NO: 3261169 - DNA, 20 bp, Homo sapiens
ctgtagctcaagtttaaaag

SEQ ID NO: 3261170 - DNA, 16 bp, Homo sapiens
ctgtagctttcctggt

SEQ ID NO: 3261171 - DNA, 22 bp, Homo sapiens
ctgtagctttcctggtccctca

SEQ ID NO: 3261172 - DNA, 22 bp, Homo sapiens
ctgtaggagcaggtgaataaag

SEQ ID NO: 3261173 - DNA, 15 bp, Homo sapiens
ctgtagggctggacc

SEQ ID NO: 3261174 - DNA, 20 bp, Homo sapiens
ctgtaggtgaaagaacaagt

SEQ ID NO: 3261175 - DNA, 19 bp, Homo sapiens
ctgtagtaaactatttatc

SEQ ID NO: 3261176 - DNA, 21 bp, Homo sapiens
ctgtagtactccttaagaaca

SEQ ID NO: 3261177 - DNA, 18 bp, Homo sapiens
ctggcggcttcctgtcca

SEQ ID NO: 3261178 - DNA, 21 bp, Homo sapiens
ctggcgtagaagtttttgtac

SEQ ID NO: 3261179 - DNA, 22 bp, Homo sapiens
ctggcgtagaagtttttgtact

SEQ ID NO: 3261180 - DNA, 19 bp, Homo sapiens
ctggcgttcacctccctgc

SEQ ID NO: 3261181 - DNA, 20 bp, Homo sapiens
ctggctaaagataattgcta

SEQ ID NO: 3261182 - DNA, 20 bp, Homo sapiens
ctggctccatgattctctga

SEQ ID NO: 3261183 - DNA, 15 bp, Homo sapiens
ctggctcccacaggc

SEQ ID NO: 3261184 - DNA, 18 bp, Homo sapiens
ctggctccctcctccagg

SEQ ID NO: 3261185 - DNA, 21 bp, Homo sapiens
ctggctccctcctccaggcct

SEQ ID NO: 3261186 - DNA, 22 bp, Homo sapiens
ctggctccctcctccaggcctg

SEQ ID NO: 3261187 - DNA, 12 bp, Homo sapiens
ctggctcctagg

SEQ ID NO: 3261188 - DNA, 15 bp, Homo sapiens
ctggctcctagggga

SEQ ID NO: 3261189 - DNA, 14 bp, Homo sapiens
ctggctcctgaggg

SEQ ID NO: 3261190 - DNA, 17 bp, Homo sapiens
ctggctcctttacaaaa

SEQ ID NO: 3261191 - DNA, 16 bp, Homo sapiens
ctggctctccaagtgc

SEQ ID NO: 3261192 - DNA, 19 bp, Homo sapiens
ctggctctccaagtgccag

SEQ ID NO: 3261193 - DNA, 20 bp, Homo sapiens
ctggctctccaagtgccaga

SEQ ID NO: 3261194 - DNA, 20 bp, Homo sapiens
ctggctctcccatttcctga

SEQ ID NO: 3261195 - DNA, 16 bp, Homo sapiens
ctggctctctccagga

SEQ ID NO: 3261196 - DNA, 13 bp, Homo sapiens
ctggctctgagaa

SEQ ID NO: 3261197 - DNA, 12 bp, Homo sapiens
ctggctctgagc

SEQ ID NO: 3261198 - DNA, 21 bp, Homo sapiens
ctggctctgagcgcctccatc

SEQ ID NO: 3261199 - DNA, 24 bp, Homo sapiens
ctggctctgagcgcctccatccaa

SEQ ID NO: 3261200 - DNA, 14 bp, Homo sapiens
ctggctctgcacta

SEQ ID NO: 3261201 - DNA, 23 bp, Homo sapiens
ctggctctgcactaagagaaaat

SEQ ID NO: 3261202 - DNA, 15 bp, Homo sapiens
ctggctctgctgtcc

SEQ ID NO: 3261203 - DNA, 12 bp, Homo sapiens
ctggctctggga

SEQ ID NO: 3261204 - DNA, 23 bp, Homo sapiens
ctggctcttgatacccccctctg

SEQ ID NO: 3261205 - DNA, 20 bp, Homo sapiens
ctggctcttgtgctggatgg

SEQ ID NO: 3261206 - DNA, 20 bp, Homo sapiens
ctggctctttcgtcaccctt

SEQ ID NO: 3261207 - DNA, 17 bp, Homo sapiens
ctggctgaaccctgtgc

SEQ ID NO: 3261208 - DNA, 19 bp, Homo sapiens
ctggctgaaccctgtgctg

SEQ ID NO: 3261209 - DNA, 23 bp, Homo sapiens
ctggctgaaccctgtgctggtgt

SEQ ID NO: 3261210 - DNA, 17 bp, Homo sapiens
ctggctgaggttcctct

SEQ ID NO: 3261211 - DNA, 21 bp, Homo sapiens
ctggctgaggttcctctgcct

SEQ ID NO: 3261212 - DNA, 21 bp, Homo sapiens
ctggctgagtggaatgcaggg

SEQ ID NO: 3261213 - DNA, 15 bp, Homo sapiens
ctggctgccctggcc

SEQ ID NO: 3261214 - DNA, 17 bp, Homo sapiens
ctggctgccctggccct

SEQ ID NO: 3261215 - DNA, 20 bp, Homo sapiens
ctggctgccctggccctgag

SEQ ID NO: 3261216 - DNA, 19 bp, Homo sapiens
ctggctgccttagaacctt

SEQ ID NO: 3261217 - DNA, 13 bp, Homo sapiens
ctggctggctcct

SEQ ID NO: 3261218 - DNA, 15 bp, Homo sapiens
ctggctggctcctag

SEQ ID NO: 3261219 - DNA, 22 bp, Homo sapiens
ctggctgggatcagagcaggag

SEQ ID NO: 3261220 - DNA, 17 bp, Homo sapiens
ctggctgggcatggacg

SEQ ID NO: 3261221 - DNA, 16 bp, Homo sapiens
ctggctggggcagagg

SEQ ID NO: 3261222 - DNA, 22 bp, Homo sapiens
ctggctggggcagaggggcagc

SEQ ID NO: 3261223 - DNA, 17 bp, Homo sapiens
ctggctgtaaggctcta

SEQ ID NO: 3261224 - DNA, 15 bp, Homo sapiens
ctggctgtatggaaa

SEQ ID NO: 3261225 - DNA, 20 bp, Homo sapiens
ctggctgtctgcctgtattt

SEQ ID NO: 3261226 - DNA, 21 bp, Homo sapiens
ctggctgtctgcctgtatttt

SEQ ID NO: 3261227 - DNA, 15 bp, Homo sapiens
ctggctgtggaggcc

SEQ ID NO: 3261228 - DNA, 19 bp, Homo sapiens
ctggctgtttagcagaact

SEQ ID NO: 3261229 - DNA, 20 bp, Homo sapiens
ctggctgtttagcagaactc

SEQ ID NO: 3261230 - DNA, 16 bp, Homo sapiens
ctggcttattttaatg

SEQ ID NO: 3261231 - DNA, 22 bp, Homo sapiens
ctggcttattttaatgtgatga

SEQ ID NO: 3261232 - DNA, 17 bp, Homo sapiens
ctggcttccagcttcag

SEQ ID NO: 3261233 - DNA, 19 bp, Homo sapiens
ctggcttgctccagggtct

SEQ ID NO: 3261234 - DNA, 20 bp, Homo sapiens
ctggcttgcttgccgagcct

SEQ ID NO: 3261235 - DNA, 20 bp, Homo sapiens
ctggcttggggtcaagaaac

SEQ ID NO: 3261236 - DNA, 17 bp, Homo sapiens
ctggctttaagccttca

SEQ ID NO: 3261237 - DNA, 17 bp, Homo sapiens
ctggctttgggaaagcc

SEQ ID NO: 3261238 - DNA, 23 bp, Homo sapiens
ctggctttgggaaagcccagact

SEQ ID NO: 3261239 - DNA, 15 bp, Homo sapiens
ctggcttttacttta

SEQ ID NO: 3261240 - DNA, 17 bp, Homo sapiens
ctggcttttcactgctg

SEQ ID NO: 3261241 - DNA, 17 bp, Homo sapiens
ctggctttttcctctga

SEQ ID NO: 3261242 - DNA, 20 bp, Homo sapiens
ctggctttttcctctgagcc

SEQ ID NO: 3261243 - DNA, 23 bp, Homo sapiens
ctggctttttcctctgagcccag

SEQ ID NO: 3261244 - DNA, 17 bp, Homo sapiens
ctgggaaaggacccacc

SEQ ID NO: 3261245 - DNA, 20 bp, Homo sapiens
ctgggaaaggacccacccat

SEQ ID NO: 3261246 - DNA, 21 bp, Homo sapiens
ctgggaaaggacccacccatc

SEQ ID NO: 3261247 - DNA, 23 bp, Homo sapiens
ctgggaacatcacattcctctgc

SEQ ID NO: 3261248 - DNA, 17 bp, Homo sapiens
ctgggaaccccgcagcc

SEQ ID NO: 3261249 - DNA, 19 bp, Homo sapiens
ctgggaaccccgcagcccg

SEQ ID NO: 3261250 - DNA, 18 bp, Homo sapiens
ctgggaacctcccagagg

SEQ ID NO: 3261251 - DNA, 22 bp, Homo sapiens
ctgggaacctcccagaggtcca

SEQ ID NO: 3261252 - DNA, 22 bp, Homo sapiens
ctgggaagataggctctgcaca

SEQ ID NO: 3261253 - DNA, 24 bp, Homo sapiens
ctgggaagataggctctgcacaga

SEQ ID NO: 3261254 - DNA, 14 bp, Homo sapiens
ctgggaagatgagg

SEQ ID NO: 3261255 - DNA, 13 bp, Homo sapiens
ctgggaagccctt

SEQ ID NO: 3261256 - DNA, 19 bp, Homo sapiens
ctgggaagctgtactcaga

SEQ ID NO: 3261257 - DNA, 20 bp, Homo sapiens
ctgggaagctgtactcagag

SEQ ID NO: 3261258 - DNA, 18 bp, Homo sapiens
ctgggaagcttgagcctc

SEQ ID NO: 3261259 - DNA, 19 bp, Homo sapiens
ctgggaagcttgagcctcc

SEQ ID NO: 3261260 - DNA, 23 bp, Homo sapiens
ctgggaagcttgagcctccccca

SEQ ID NO: 3261261 - DNA, 16 bp, Homo sapiens
ctgggaatgggagagg

SEQ ID NO: 3261262 - DNA, 18 bp, Homo sapiens
ctgggaatgtattattct

SEQ ID NO: 3261263 - DNA, 19 bp, Homo sapiens
ctgggaatgtattattctg

SEQ ID NO: 3261264 - DNA, 22 bp, Homo sapiens
ctgggaatgtattattctgcag

SEQ ID NO: 3261265 - DNA, 16 bp, Homo sapiens
ctgggacacaaaactc

SEQ ID NO: 3261266 - DNA, 19 bp, Homo sapiens
ctgggacacttaacagatg

SEQ ID NO: 3261267 - DNA, 23 bp, Homo sapiens
ctgggacacttaacagatgcaat

SEQ ID NO: 3261268 - DNA, 15 bp, Homo sapiens
ctgggaccagagcca

SEQ ID NO: 3261269 - DNA, 13 bp, Homo sapiens
ctgggacccagct

SEQ ID NO: 3261270 - DNA, 22 bp, Homo sapiens
ctgggacccagctactctgtcc

SEQ ID NO: 3261271 - DNA, 19 bp, Homo sapiens
ctgggacctgccaggcagg

SEQ ID NO: 3261272 - DNA, 14 bp, Homo sapiens
ctgggactcccagt

SEQ ID NO: 3261273 - DNA, 18 bp, Homo sapiens
ctgggactcctggtgccc

SEQ ID NO: 3261274 - DNA, 14 bp, Homo sapiens
ctgggacttccttg

SEQ ID NO: 3261275 - DNA, 17 bp, Homo sapiens
ctgggacttccttgctc

SEQ ID NO: 3261276 - DNA, 21 bp, Homo sapiens
ctgggacttccttgctctccc

SEQ ID NO: 3261277 - DNA, 16 bp, Homo sapiens
ctgggacttcttaccc

SEQ ID NO: 3261278 - DNA, 12 bp, Homo sapiens
ctgggagaacct

SEQ ID NO: 3261279 - DNA, 15 bp, Homo sapiens
ctgggagaacctcag

SEQ ID NO: 3261280 - DNA, 17 bp, Homo sapiens
ctgggagaacctcaggc

SEQ ID NO: 3261281 - DNA, 18 bp, Homo sapiens
ctgggagaacctcaggct

SEQ ID NO: 3261282 - DNA, 18 bp, Homo sapiens
ctgggagacaactggaca

SEQ ID NO: 3261283 - DNA, 11 bp, Homo sapiens
ctgggagcaga

SEQ ID NO: 3261284 - DNA, 23 bp, Homo sapiens
ctgggagcatagcagaggggcca

SEQ ID NO: 3261285 - DNA, 19 bp, Homo sapiens
ctgggagccacttctcccc

SEQ ID NO: 3261286 - DNA, 20 bp, Homo sapiens
ctgggagccacttctcccca

SEQ ID NO: 3261287 - DNA, 17 bp, Homo sapiens
ctgggagctccactctg

SEQ ID NO: 3261288 - DNA, 21 bp, Homo sapiens
ctgggagctccactctgcttc

SEQ ID NO: 3261289 - DNA, 23 bp, Homo sapiens
ctgggagctccactctgcttctc

SEQ ID NO: 3261290 - DNA, 15 bp, Homo sapiens
ctgggagctctgcag

SEQ ID NO: 3261291 - DNA, 14 bp, Homo sapiens
ctgggaggaagcag

SEQ ID NO: 3261292 - DNA, 21 bp, Homo sapiens
ctgggaggaagcaggttgagg

SEQ ID NO: 3261293 - DNA, 12 bp, Homo sapiens
ctgggaggacag

SEQ ID NO: 3261294 - DNA, 16 bp, Homo sapiens
ctgggaggacaggcag

SEQ ID NO: 3261295 - DNA, 19 bp, Homo sapiens
ctgggaggacaggcaggcc

SEQ ID NO: 3261296 - DNA, 16 bp, Homo sapiens
ctgggaggactggacc

SEQ ID NO: 3261297 - DNA, 20 bp, Homo sapiens
ctgggaggagggagagggag

SEQ ID NO: 3261298 - DNA, 23 bp, Homo sapiens
ctgggaggagggagagggaggtc

SEQ ID NO: 3261299 - DNA, 17 bp, Homo sapiens
ctgggaggcaagagggg

SEQ ID NO: 3261300 - DNA, 22 bp, Homo sapiens
ctgggaggcaagaggggtggag

SEQ ID NO: 3261301 - DNA, 23 bp, Homo sapiens
ctgggaggcagaggttgcagtga

SEQ ID NO: 3261302 - DNA, 22 bp, Homo sapiens
ctgggaggcatggccctggggt

SEQ ID NO: 3261303 - DNA, 21 bp, Homo sapiens
ctgggagtagttgtctttcct

SEQ ID NO: 3261304 - DNA, 23 bp, Homo sapiens
ctgaaggaaaagcaagaaacagt

SEQ ID NO: 3261305 - DNA, 21 bp, Homo sapiens
ctgaaggaatagccagagagg

SEQ ID NO: 3261306 - DNA, 13 bp, Homo sapiens
ctgaaggactgga

SEQ ID NO: 3261307 - DNA, 20 bp, Homo sapiens
ctgaaggcagtggcagggga

SEQ ID NO: 3261308 - DNA, 22 bp, Homo sapiens
ctgaaggcagtggcaggggagc

SEQ ID NO: 3261309 - DNA, 18 bp, Homo sapiens
ctgaagggcattctttcc

SEQ ID NO: 3261310 - DNA, 14 bp, Homo sapiens
ctgaagtcacacag

SEQ ID NO: 3261311 - DNA, 18 bp, Homo sapiens
ctgaagtcacacagtgag

SEQ ID NO: 3261312 - DNA, 21 bp, Homo sapiens
ctgaagtcacacagtgagtcg

SEQ ID NO: 3261313 - DNA, 13 bp, Homo sapiens
ctgaagtcactgc

SEQ ID NO: 3261314 - DNA, 22 bp, Homo sapiens
ctgaagtcactgcacagtgcat

SEQ ID NO: 3261315 - DNA, 21 bp, Homo sapiens
ctgaagtcagcgggcccaggc

SEQ ID NO: 3261316 - DNA, 18 bp, Homo sapiens
ctgaagtgagcacagcct

SEQ ID NO: 3261317 - DNA, 16 bp, Homo sapiens
ctgaagtgcttagtgt

SEQ ID NO: 3261318 - DNA, 16 bp, Homo sapiens
ctgaagttaacagaga

SEQ ID NO: 3261319 - DNA, 11 bp, Homo sapiens
ctgaagttcag

SEQ ID NO: 3261320 - DNA, 13 bp, Homo sapiens
ctgaagtttcaca

SEQ ID NO: 3261321 - DNA, 14 bp, Homo sapiens
ctgaagtttttgaa

SEQ ID NO: 3261322 - DNA, 15 bp, Homo sapiens
ctgaagtttttgaaa

SEQ ID NO: 3261323 - DNA, 17 bp, Homo sapiens
ctgaagtttttttgctg

SEQ ID NO: 3261324 - DNA, 18 bp, Homo sapiens
ctgaataaagtgtaacaa

SEQ ID NO: 3261325 - DNA, 17 bp, Homo sapiens
ctgaataaatggtagta

SEQ ID NO: 3261326 - DNA, 16 bp, Homo sapiens
ctgaataatttcttac

SEQ ID NO: 3261327 - DNA, 16 bp, Homo sapiens
ctgaatagaaatggga

SEQ ID NO: 3261328 - DNA, 15 bp, Homo sapiens
ctgaatagatatgaa

SEQ ID NO: 3261329 - DNA, 20 bp, Homo sapiens
ctgaatatctgttcactttt

SEQ ID NO: 3261330 - DNA, 15 bp, Homo sapiens
ctgaatattttggaa

SEQ ID NO: 3261331 - DNA, 19 bp, Homo sapiens
ctgaatccaaactaatcca

SEQ ID NO: 3261332 - DNA, 20 bp, Homo sapiens
ctgaatccattaaaaatggg

SEQ ID NO: 3261333 - DNA, 22 bp, Homo sapiens
ctgaatcccctatcccattctg

SEQ ID NO: 3261334 - DNA, 13 bp, Homo sapiens
ctgaatccgtggt

SEQ ID NO: 3261335 - DNA, 15 bp, Homo sapiens
ctgaatctgctacca

SEQ ID NO: 3261336 - DNA, 22 bp, Homo sapiens
ctgaatctgctaccaaaacagt

SEQ ID NO: 3261337 - DNA, 17 bp, Homo sapiens
ctgaatctgtgcaaaca

SEQ ID NO: 3261338 - DNA, 15 bp, Homo sapiens
ctgaatgaaaataac

SEQ ID NO: 3261339 - DNA, 20 bp, Homo sapiens
ctgaatgaaaataactgaac

SEQ ID NO: 3261340 - DNA, 15 bp, Homo sapiens
ctgaatgcctcctgt

SEQ ID NO: 3261341 - DNA, 19 bp, Homo sapiens
ctgaatgcctcctgtgggg

SEQ ID NO: 3261342 - DNA, 18 bp, Homo sapiens
ctgaatgcctcgctccct

SEQ ID NO: 3261343 - DNA, 21 bp, Homo sapiens
ctgaatgcctcgctcccttca

SEQ ID NO: 3261344 - DNA, 14 bp, Homo sapiens
ctgaatgctgccac

SEQ ID NO: 3261345 - DNA, 16 bp, Homo sapiens
ctgaatgctgctactt

SEQ ID NO: 3261346 - DNA, 20 bp, Homo sapiens
ctgaatggttttcaaaataa

SEQ ID NO: 3261347 - DNA, 14 bp, Homo sapiens
ctgaatgtaatttg

SEQ ID NO: 3261348 - DNA, 15 bp, Homo sapiens
ctgaatgtaatttgt

SEQ ID NO: 3261349 - DNA, 12 bp, Homo sapiens
ctgaatgttctg

SEQ ID NO: 3261350 - DNA, 22 bp, Homo sapiens
ctgaatgttctgacattaacag

SEQ ID NO: 3261351 - DNA, 16 bp, Homo sapiens
ctgaattaaataaata

SEQ ID NO: 3261352 - DNA, 17 bp, Homo sapiens
ctgaattaatcatctat

SEQ ID NO: 3261353 - DNA, 23 bp, Homo sapiens
ctgaattacagtgaaattttggt

SEQ ID NO: 3261354 - DNA, 17 bp, Homo sapiens
ctgaattatctatttca

SEQ ID NO: 3261355 - DNA, 14 bp, Homo sapiens
ctgaattcaaagct

SEQ ID NO: 3261356 - DNA, 15 bp, Homo sapiens
ctgaattcaaagctt

SEQ ID NO: 3261357 - DNA, 16 bp, Homo sapiens
ctgaattcaaagcttg

SEQ ID NO: 3261358 - DNA, 20 bp, Homo sapiens
ctgaattcaaagcttgtgaa

SEQ ID NO: 3261359 - DNA, 16 bp, Homo sapiens
ctgaattctatttgct

SEQ ID NO: 3261360 - DNA, 23 bp, Homo sapiens
ctgaattctatttgctgggcttt

SEQ ID NO: 3261361 - DNA, 20 bp, Homo sapiens
ctgaatttccccatctgcca

SEQ ID NO: 3261362 - DNA, 16 bp, Homo sapiens
ctgaattttgggactt

SEQ ID NO: 3261363 - DNA, 20 bp, Homo sapiens
ctgacaaccattaaagtcag

SEQ ID NO: 3261364 - DNA, 22 bp, Homo sapiens
ctgacaaccattaaagtcagaa

SEQ ID NO: 3261365 - DNA, 21 bp, Homo sapiens
ctgacaatcaactctaatagt

SEQ ID NO: 3261366 - DNA, 22 bp, Homo sapiens
ctgacaatggcagctagactgg

SEQ ID NO: 3261367 - DNA, 23 bp, Homo sapiens
ctgacaatggcagctagactgga

SEQ ID NO: 3261368 - DNA, 14 bp, Homo sapiens
ctgacaattgcaaa

SEQ ID NO: 3261369 - DNA, 15 bp, Homo sapiens
ctgacaattgcaaat

SEQ ID NO: 3261370 - DNA, 16 bp, Homo sapiens
ctgacacacagctctg

SEQ ID NO: 3261371 - DNA, 23 bp, Homo sapiens
ctgacacactaaccaagctgagt

SEQ ID NO: 3261372 - DNA, 21 bp, Homo sapiens
ctgacacctaccatgctgctt

SEQ ID NO: 3261373 - DNA, 19 bp, Homo sapiens
ctgacactaaccagagtca

SEQ ID NO: 3261374 - DNA, 16 bp, Homo sapiens
ctgacacttcaaggtg

SEQ ID NO: 3261375 - DNA, 13 bp, Homo sapiens
ctgacagaaacca

SEQ ID NO: 3261376 - DNA, 16 bp, Homo sapiens
ctgacagacacaggcc

SEQ ID NO: 3261377 - DNA, 14 bp, Homo sapiens
ctgacagcctccca

SEQ ID NO: 3261378 - DNA, 17 bp, Homo sapiens
ctgacagcctcccaccc

SEQ ID NO: 3261379 - DNA, 19 bp, Homo sapiens
ctgacaggcaatgctggct

SEQ ID NO: 3261380 - DNA, 21 bp, Homo sapiens
ctgacaggcaatgctggctgt

SEQ ID NO: 3261381 - DNA, 14 bp, Homo sapiens
ctgacagtttttct

SEQ ID NO: 3261382 - DNA, 16 bp, Homo sapiens
ctgacagtttttctgt

SEQ ID NO: 3261383 - DNA, 19 bp, Homo sapiens
ctgacatagagaaaaggct

SEQ ID NO: 3261384 - DNA, 15 bp, Homo sapiens
ctgacatcacagcag

SEQ ID NO: 3261385 - DNA, 16 bp, Homo sapiens
ctgacatcacagcagc

SEQ ID NO: 3261386 - DNA, 18 bp, Homo sapiens
ctgacatcacagcagcct

SEQ ID NO: 3261387 - DNA, 23 bp, Homo sapiens
ctgacatcacagcagcctccaac

SEQ ID NO: 3261388 - DNA, 21 bp, Homo sapiens
ctgacatcccttcctggaaac

SEQ ID NO: 3261389 - DNA, 16 bp, Homo sapiens
ctgacatctggaatct

SEQ ID NO: 3261390 - DNA, 17 bp, Homo sapiens
ctgacatctgtgtttca

SEQ ID NO: 3261391 - DNA, 15 bp, Homo sapiens
ctgacatgcattgtt

SEQ ID NO: 3261392 - DNA, 14 bp, Homo sapiens
ctgacatgtggggc

SEQ ID NO: 3261393 - DNA, 22 bp, Homo sapiens
ctgacattgttggccaaagcca

SEQ ID NO: 3261394 - DNA, 14 bp, Homo sapiens
ctgacatttcttct

SEQ ID NO: 3261395 - DNA, 18 bp, Homo sapiens
ctgacatttcttctagtg

SEQ ID NO: 3261396 - DNA, 15 bp, Homo sapiens
ctgaccaaacagcca

SEQ ID NO: 3261397 - DNA, 13 bp, Homo sapiens
ctgaccaacaggc

SEQ ID NO: 3261398 - DNA, 14 bp, Homo sapiens
ctgaccaagtttct

SEQ ID NO: 3261399 - DNA, 16 bp, Homo sapiens
ctgaccaccctcccct

SEQ ID NO: 3261400 - DNA, 17 bp, Homo sapiens
ctgaccaccctcccctc

SEQ ID NO: 3261401 - DNA, 23 bp, Homo sapiens
ctgaccacggacgtttccatcag

SEQ ID NO: 3261402 - DNA, 22 bp, Homo sapiens
ctgaccatattgtgcttcacag

SEQ ID NO: 3261403 - DNA, 22 bp, Homo sapiens
ctgaccatgctcatctgctggt

SEQ ID NO: 3261404 - DNA, 11 bp, Homo sapiens
ctgacccactg

SEQ ID NO: 3261405 - DNA, 15 bp, Homo sapiens
ctgacccactgatct

SEQ ID NO: 3261406 - DNA, 12 bp, Homo sapiens
ctgacccactgc

SEQ ID NO: 3261407 - DNA, 20 bp, Homo sapiens
ctgacccagagtggagtctg

SEQ ID NO: 3261408 - DNA, 22 bp, Homo sapiens
ctgacccagagtggagtctgag

SEQ ID NO: 3261409 - DNA, 21 bp, Homo sapiens
ctgacccagccccttgagaaa

SEQ ID NO: 3261410 - DNA, 15 bp, Homo sapiens
ctgacccaggccgca

SEQ ID NO: 3261411 - DNA, 18 bp, Homo sapiens
ctgacccaggccgcagct

SEQ ID NO: 3261412 - DNA, 21 bp, Homo sapiens
ctgacccaggccgcagctctt

SEQ ID NO: 3261413 - DNA, 11 bp, Homo sapiens
ctgacccagtc

SEQ ID NO: 3261414 - DNA, 14 bp, Homo sapiens
ctgacccagtgaga

SEQ ID NO: 3261415 - DNA, 22 bp, Homo sapiens
ctgaccccaaacaccttccagc

SEQ ID NO: 3261416 - DNA, 16 bp, Homo sapiens
ctgacccctcctcact

SEQ ID NO: 3261417 - DNA, 13 bp, Homo sapiens
ctgacccctgctc

SEQ ID NO: 3261418 - DNA, 16 bp, Homo sapiens
ctgacccctgctcagt

SEQ ID NO: 3261419 - DNA, 14 bp, Homo sapiens
ctgaccccttgctc

SEQ ID NO: 3261420 - DNA, 17 bp, Homo sapiens
ctgaccccttgctccct

SEQ ID NO: 3261421 - DNA, 20 bp, Homo sapiens
ctgaccctactcccttgccc

SEQ ID NO: 3261422 - DNA, 19 bp, Homo sapiens
ctgaccctgcttcaaatat

SEQ ID NO: 3261423 - DNA, 14 bp, Homo sapiens
ctgacccttgggcc

SEQ ID NO: 3261424 - DNA, 11 bp, Homo sapiens
ctgacctccca

SEQ ID NO: 3261425 - DNA, 14 bp, Homo sapiens
ctgacctcccagcc

SEQ ID NO: 3261426 - DNA, 17 bp, Homo sapiens
ctgacctcccagcccta

SEQ ID NO: 3261427 - DNA, 18 bp, Homo sapiens
ctgacctcccagccctat

SEQ ID NO: 3261428 - DNA, 18 bp, Homo sapiens
ctgacctcttgctgtctc

SEQ ID NO: 3261429 - DNA, 20 bp, Homo sapiens
ctgacctcttgctgtctctg

SEQ ID NO: 3261430 - DNA, 12 bp, Homo sapiens
ctgacctgcagg

SEQ ID NO: 3261431 - DNA, 13 bp, Homo sapiens
ctgacctgcaggc

SEQ ID NO: 3261432 - DNA, 17 bp, Homo sapiens
ctgacctgtcatgcccc

SEQ ID NO: 3261433 - DNA, 24 bp, Homo sapiens
ctgcttcccatcctaccctcgggc

SEQ ID NO: 3261434 - DNA, 16 bp, Homo sapiens
ctgcttccccttccta

SEQ ID NO: 3261435 - DNA, 22 bp, Homo sapiens
ctgcttccggtagggaggcagc

SEQ ID NO: 3261436 - DNA, 13 bp, Homo sapiens
ctgcttcctgaaa

SEQ ID NO: 3261437 - DNA, 14 bp, Homo sapiens
ctgcttcctgaaat

SEQ ID NO: 3261438 - DNA, 18 bp, Homo sapiens
ctgcttcctgaaataaac

SEQ ID NO: 3261439 - DNA, 14 bp, Homo sapiens
ctgcttctccagcc

SEQ ID NO: 3261440 - DNA, 14 bp, Homo sapiens
ctgcttctctgact

SEQ ID NO: 3261441 - DNA, 22 bp, Homo sapiens
ctgcttctctgacttctgcctg

SEQ ID NO: 3261442 - DNA, 16 bp, Homo sapiens
ctgcttgatgaagcaa

SEQ ID NO: 3261443 - DNA, 20 bp, Homo sapiens
ctgcttgatgaagcaaggaa

SEQ ID NO: 3261444 - DNA, 13 bp, Homo sapiens
ctgcttgattttt

SEQ ID NO: 3261445 - DNA, 20 bp, Homo sapiens
ctgcttgcttgctttttaat

SEQ ID NO: 3261446 - DNA, 22 bp, Homo sapiens
ctgcttggcccggccggcctgg

SEQ ID NO: 3261447 - DNA, 22 bp, Homo sapiens
ctgctttaaagggcctgcctgg

SEQ ID NO: 3261448 - DNA, 13 bp, Homo sapiens
ctgctttaatcag

SEQ ID NO: 3261449 - DNA, 14 bp, Homo sapiens
ctgctttcccctgt

SEQ ID NO: 3261450 - DNA, 15 bp, Homo sapiens
ctgctttcccctgtg

SEQ ID NO: 3261451 - DNA, 21 bp, Homo sapiens
ctgctttcccctgtggggatc

SEQ ID NO: 3261452 - DNA, 15 bp, Homo sapiens
ctgctttctgttcca

SEQ ID NO: 3261453 - DNA, 17 bp, Homo sapiens
ctgctttctgttccaaa

SEQ ID NO: 3261454 - DNA, 23 bp, Homo sapiens
ctgctttgccaagttgctgtcac

SEQ ID NO: 3261455 - DNA, 23 bp, Homo sapiens
ctgctttgggatttaatttccag

SEQ ID NO: 3261456 - DNA, 16 bp, Homo sapiens
ctgctttgggctgccc

SEQ ID NO: 3261457 - DNA, 17 bp, Homo sapiens
ctgctttgggctgccct

SEQ ID NO: 3261458 - DNA, 18 bp, Homo sapiens
ctgctttgggctgccctg

SEQ ID NO: 3261459 - DNA, 20 bp, Homo sapiens
ctgcttttagttcatatata

SEQ ID NO: 3261460 - DNA, 16 bp, Homo sapiens
ctgcttttccaggatc

SEQ ID NO: 3261461 - DNA, 19 bp, Homo sapiens
ctgcttttccaggatcctg

SEQ ID NO: 3261462 - DNA, 20 bp, Homo sapiens
ctgcttttccaggatcctgc

SEQ ID NO: 3261463 - DNA, 22 bp, Homo sapiens
ctgcttttccaggatcctgcag

SEQ ID NO: 3261464 - DNA, 23 bp, Homo sapiens
ctgcttttccaggatcctgcagg

SEQ ID NO: 3261465 - DNA, 18 bp, Homo sapiens
ctgcttttcctcaagcaa

SEQ ID NO: 3261466 - DNA, 15 bp, Homo sapiens
ctgcttttctgccct

SEQ ID NO: 3261467 - DNA, 17 bp, Homo sapiens
ctgcttttctgccctgg

SEQ ID NO: 3261468 - DNA, 19 bp, Homo sapiens
ctgcttttctgccctggct

SEQ ID NO: 3261469 - DNA, 20 bp, Homo sapiens
ctgcttttctgccctggctg

SEQ ID NO: 3261470 - DNA, 16 bp, Homo sapiens
ctgcttttgagcctca

SEQ ID NO: 3261471 - DNA, 15 bp, Homo sapiens
ctgcttttggtctgt

SEQ ID NO: 3261472 - DNA, 22 bp, Homo sapiens
ctgctttttccaactcagaaat

SEQ ID NO: 3261473 - DNA, 15 bp, Homo sapiens
ctgctttttgaaatg

SEQ ID NO: 3261474 - DNA, 16 bp, Homo sapiens
ctgctttttgaaatga

SEQ ID NO: 3261475 - DNA, 14 bp, Homo sapiens
ctgctttttgacat

SEQ ID NO: 3261476 - DNA, 18 bp, Homo sapiens
ctgctttttggaaagtca

SEQ ID NO: 3261477 - DNA, 18 bp, Homo sapiens
ctgcttttttttttccag

SEQ ID NO: 3261478 - DNA, 19 bp, Homo sapiens
ctgcttttttttttccagc

SEQ ID NO: 3261479 - DNA, 21 bp, Homo sapiens
ctgcttttttttttccagcaa

SEQ ID NO: 3261480 - DNA, 15 bp, Homo sapiens
ctggaaaaaatgagc

SEQ ID NO: 3261481 - DNA, 21 bp, Homo sapiens
ctggaaagactgattgtttta

SEQ ID NO: 3261482 - DNA, 13 bp, Homo sapiens
ctggaaaggctca

SEQ ID NO: 3261483 - DNA, 17 bp, Homo sapiens
ctggaaaggctcagtct

SEQ ID NO: 3261484 - DNA, 17 bp, Homo sapiens
ctggaaaggggagagcc

SEQ ID NO: 3261485 - DNA, 19 bp, Homo sapiens
ctggaaaggggagagcctg

SEQ ID NO: 3261486 - DNA, 23 bp, Homo sapiens
ctggaaaggggggagctggggaa

SEQ ID NO: 3261487 - DNA, 17 bp, Homo sapiens
ctggaacatcctttgca

SEQ ID NO: 3261488 - DNA, 18 bp, Homo sapiens
ctggaacatcctttgcag

SEQ ID NO: 3261489 - DNA, 24 bp, Homo sapiens
ctggaacatcctttgcagggcagc

SEQ ID NO: 3261490 - DNA, 16 bp, Homo sapiens
ctggaacatttgatat

SEQ ID NO: 3261491 - DNA, 20 bp, Homo sapiens
ctggaacatttgatattttt

SEQ ID NO: 3261492 - DNA, 13 bp, Homo sapiens
ctggaaccaggga

SEQ ID NO: 3261493 - DNA, 15 bp, Homo sapiens
ctggaaccttgctgt

SEQ ID NO: 3261494 - DNA, 14 bp, Homo sapiens
ctggaagaaaaaaa

SEQ ID NO: 3261495 - DNA, 19 bp, Homo sapiens
ctggaagaaactaaaaata

SEQ ID NO: 3261496 - DNA, 14 bp, Homo sapiens
ctggaagaaagcaa

SEQ ID NO: 3261497 - DNA, 17 bp, Homo sapiens
ctggaagacacttcaga

SEQ ID NO: 3261498 - DNA, 15 bp, Homo sapiens
ctggaagccagcttt

SEQ ID NO: 3261499 - DNA, 16 bp, Homo sapiens
ctggaagccagctttc

SEQ ID NO: 3261500 - DNA, 17 bp, Homo sapiens
ctggaagccagctttcc

SEQ ID NO: 3261501 - DNA, 20 bp, Homo sapiens
ctggaagcccctgggcccag

SEQ ID NO: 3261502 - DNA, 21 bp, Homo sapiens
ctggaagcccctgggcccagt

SEQ ID NO: 3261503 - DNA, 17 bp, Homo sapiens
ctggaagccctggagac

SEQ ID NO: 3261504 - DNA, 18 bp, Homo sapiens
ctggaagctaatttgcat

SEQ ID NO: 3261505 - DNA, 22 bp, Homo sapiens
ctggaagctaatttgcattaaa

SEQ ID NO: 3261506 - DNA, 12 bp, Homo sapiens
ctggaaggcagg

SEQ ID NO: 3261507 - DNA, 19 bp, Homo sapiens
ctggaaggcagggcagagg

SEQ ID NO: 3261508 - DNA, 16 bp, Homo sapiens
ctggaaggctggctga

SEQ ID NO: 3261509 - DNA, 19 bp, Homo sapiens
ctggaaggctggctgagtg

SEQ ID NO: 3261510 - DNA, 19 bp, Homo sapiens
ctggaaggggaagggacac

SEQ ID NO: 3261511 - DNA, 13 bp, Homo sapiens
ctggaaggggcca

SEQ ID NO: 3261512 - DNA, 17 bp, Homo sapiens
ctggaagtctacctgct

SEQ ID NO: 3261513 - DNA, 19 bp, Homo sapiens
ctggaagtctacctgctgg

SEQ ID NO: 3261514 - DNA, 20 bp, Homo sapiens
ctggaagtctacctgctgga

SEQ ID NO: 3261515 - DNA, 15 bp, Homo sapiens
ctggaagtttctggt

SEQ ID NO: 3261516 - DNA, 23 bp, Homo sapiens
ctggaataaagttgcagatgatt

SEQ ID NO: 3261517 - DNA, 19 bp, Homo sapiens
ctggaatctggagaccagg

SEQ ID NO: 3261518 - DNA, 24 bp, Homo sapiens
ctggaatctggagaccagggagcc

SEQ ID NO: 3261519 - DNA, 14 bp, Homo sapiens
ctggaatgcagtga

SEQ ID NO: 3261520 - DNA, 20 bp, Homo sapiens
ctggaatgtaatcaatgttt

SEQ ID NO: 3261521 - DNA, 15 bp, Homo sapiens
ctggaattcagcacc

SEQ ID NO: 3261522 - DNA, 16 bp, Homo sapiens
ctggaattcagcaccc

SEQ ID NO: 3261523 - DNA, 15 bp, Homo sapiens
ctggacaagcagagg

SEQ ID NO: 3261524 - DNA, 11 bp, Homo sapiens
ctggacaagcc

SEQ ID NO: 3261525 - DNA, 21 bp, Homo sapiens
ctggacaagccaacttgtaaa

SEQ ID NO: 3261526 - DNA, 22 bp, Homo sapiens
ctggacacaataggtctttctc

SEQ ID NO: 3261527 - DNA, 11 bp, Homo sapiens
ctggacacagc

SEQ ID NO: 3261528 - DNA, 15 bp, Homo sapiens
ctggacacagctctt

SEQ ID NO: 3261529 - DNA, 16 bp, Homo sapiens
ctggacacagctcttc

SEQ ID NO: 3261530 - DNA, 22 bp, Homo sapiens
ctggacacagctcttcattcca

SEQ ID NO: 3261531 - DNA, 15 bp, Homo sapiens
ctggacactcagacc

SEQ ID NO: 3261532 - DNA, 16 bp, Homo sapiens
ctggacactcagacct

SEQ ID NO: 3261533 - DNA, 15 bp, Homo sapiens
ctggacagacccagg

SEQ ID NO: 3261534 - DNA, 19 bp, Homo sapiens
ctggacagacccaggtctt

SEQ ID NO: 3261535 - DNA, 22 bp, Homo sapiens
ctggacagacccaggtcttcca

SEQ ID NO: 3261536 - DNA, 14 bp, Homo sapiens
ctggacagcctccg

SEQ ID NO: 3261537 - DNA, 17 bp, Homo sapiens
ctggacagcctccgcca

SEQ ID NO: 3261538 - DNA, 14 bp, Homo sapiens
ctggacaggcatgt

SEQ ID NO: 3261539 - DNA, 23 bp, Homo sapiens
ctggacaggcatgttctctgagg

SEQ ID NO: 3261540 - DNA, 18 bp, Homo sapiens
ctggacatttgccttgct

SEQ ID NO: 3261541 - DNA, 21 bp, Homo sapiens
ctggacccctgggcctcatca

SEQ ID NO: 3261542 - DNA, 20 bp, Homo sapiens
ctggacctatgtcctaagga

SEQ ID NO: 3261543 - DNA, 13 bp, Homo sapiens
ctggacctgaaat

SEQ ID NO: 3261544 - DNA, 13 bp, Homo sapiens
ctggacctgagtc

SEQ ID NO: 3261545 - DNA, 20 bp, Homo sapiens
ctggaccttgaactgggtac

SEQ ID NO: 3261546 - DNA, 20 bp, Homo sapiens
ctggacggcaggctcactgc

SEQ ID NO: 3261547 - DNA, 17 bp, Homo sapiens
ctggacggcattcctgc

SEQ ID NO: 3261548 - DNA, 19 bp, Homo sapiens
ctggacggcattcctgctt

SEQ ID NO: 3261549 - DNA, 16 bp, Homo sapiens
ctggacgtctttcttt

SEQ ID NO: 3261550 - DNA, 14 bp, Homo sapiens
ctggactcctctgt

SEQ ID NO: 3261551 - DNA, 19 bp, Homo sapiens
ctggactcctctgtccagg

SEQ ID NO: 3261552 - DNA, 20 bp, Homo sapiens
ctggactcctctgtccaggc

SEQ ID NO: 3261553 - DNA, 14 bp, Homo sapiens
ctggactctaaaga

SEQ ID NO: 3261554 - DNA, 16 bp, Homo sapiens
ctggactgaagcctgc

SEQ ID NO: 3261555 - DNA, 18 bp, Homo sapiens
ctggactgagccaaggag

SEQ ID NO: 3261556 - DNA, 19 bp, Homo sapiens
ctggactggaggcccctgg

SEQ ID NO: 3261557 - DNA, 22 bp, Homo sapiens
ctggactggaggtgggcatgcc

SEQ ID NO: 3261558 - DNA, 23 bp, Homo sapiens
ctggactggcgttcacctccctg

SEQ ID NO: 3261559 - DNA, 20 bp, Homo sapiens
ctggactgtcatagaaatta

SEQ ID NO: 3261560 - DNA, 15 bp, Homo sapiens
ctggactgttccagg

SEQ ID NO: 3261561 - DNA, 14 bp, Homo sapiens
ctgaaagaggctga

SEQ ID NO: 3261562 - DNA, 22 bp, Homo sapiens
ctgaaagaggctgaggcctgga

SEQ ID NO: 3261563 - DNA, 13 bp, Homo sapiens
ctgaaagcagcag

SEQ ID NO: 3261564 - DNA, 17 bp, Homo sapiens
ctgaaagcagcagctag

SEQ ID NO: 3261565 - DNA, 18 bp, Homo sapiens
ctgaaagcagcagctagg

SEQ ID NO: 3261566 - DNA, 20 bp, Homo sapiens
ctgaaaggaaatacacttct

SEQ ID NO: 3261567 - DNA, 19 bp, Homo sapiens
ctgaaaggatgtggaagag

SEQ ID NO: 3261568 - DNA, 21 bp, Homo sapiens
ctgaaagggggcatgtatgca

SEQ ID NO: 3261569 - DNA, 13 bp, Homo sapiens
ctgaaagtgtttt

SEQ ID NO: 3261570 - DNA, 16 bp, Homo sapiens
ctgaaagtgttttact

SEQ ID NO: 3261571 - DNA, 22 bp, Homo sapiens
ctgaaagtgttttactcttttt

SEQ ID NO: 3261572 - DNA, 18 bp, Homo sapiens
ctgaaagttacccactga

SEQ ID NO: 3261573 - DNA, 22 bp, Homo sapiens
ctgaaagttacccactgaagcc

SEQ ID NO: 3261574 - DNA, 14 bp, Homo sapiens
ctgaaataaacact

SEQ ID NO: 3261575 - DNA, 15 bp, Homo sapiens
ctgaaataaacactg

SEQ ID NO: 3261576 - DNA, 22 bp, Homo sapiens
ctgaaataaacactggtgccaa

SEQ ID NO: 3261577 - DNA, 14 bp, Homo sapiens
ctgaaatctccttt

SEQ ID NO: 3261578 - DNA, 23 bp, Homo sapiens
ctgaaatgagcatgcattttctt

SEQ ID NO: 3261579 - DNA, 16 bp, Homo sapiens
ctgaaattattttctc

SEQ ID NO: 3261580 - DNA, 16 bp, Homo sapiens
ctgaaattccaaagtc

SEQ ID NO: 3261581 - DNA, 17 bp, Homo sapiens
ctgaaattccaaagtct

SEQ ID NO: 3261582 - DNA, 20 bp, Homo sapiens
ctgaaattccaaagtctcta

SEQ ID NO: 3261583 - DNA, 19 bp, Homo sapiens
ctgaaattctcctggaggt

SEQ ID NO: 3261584 - DNA, 13 bp, Homo sapiens
ctgaaatttcaga

SEQ ID NO: 3261585 - DNA, 14 bp, Homo sapiens
ctgaaatttcagat

SEQ ID NO: 3261586 - DNA, 18 bp, Homo sapiens
ctgaaattttagaaatat

SEQ ID NO: 3261587 - DNA, 17 bp, Homo sapiens
ctgaaatttttttccta

SEQ ID NO: 3261588 - DNA, 12 bp, Homo sapiens
ctgaacaagaat

SEQ ID NO: 3261589 - DNA, 21 bp, Homo sapiens
ctgaacaataggctgttccca

SEQ ID NO: 3261590 - DNA, 22 bp, Homo sapiens
ctgaacacaggcagctttctag

SEQ ID NO: 3261591 - DNA, 11 bp, Homo sapiens
ctgaacaccat

SEQ ID NO: 3261592 - DNA, 20 bp, Homo sapiens
ctgaacaccattgaaggctt

SEQ ID NO: 3261593 - DNA, 19 bp, Homo sapiens
ctgaacacttttgttgtaa

SEQ ID NO: 3261594 - DNA, 20 bp, Homo sapiens
ctgaacacttttgttgtaaa

SEQ ID NO: 3261595 - DNA, 20 bp, Homo sapiens
ctgaacatgtttacaggttt

SEQ ID NO: 3261596 - DNA, 12 bp, Homo sapiens
ctgaaccaaagc

SEQ ID NO: 3261597 - DNA, 22 bp, Homo sapiens
ctgaaccaaattgcactgaagt

SEQ ID NO: 3261598 - DNA, 20 bp, Homo sapiens
ctgaaccaccaacagagaaa

SEQ ID NO: 3261599 - DNA, 16 bp, Homo sapiens
ctgaaccccatgggct

SEQ ID NO: 3261600 - DNA, 18 bp, Homo sapiens
ctgaaccccatgggcttg

SEQ ID NO: 3261601 - DNA, 13 bp, Homo sapiens
ctgaaccctgtgc

SEQ ID NO: 3261602 - DNA, 23 bp, Homo sapiens
ctgaaccgcacagctcaggaggc

SEQ ID NO: 3261603 - DNA, 16 bp, Homo sapiens
ctgaacgacaaagcat

SEQ ID NO: 3261604 - DNA, 18 bp, Homo sapiens
ctgaactctcaaaagtct

SEQ ID NO: 3261605 - DNA, 23 bp, Homo sapiens
ctgaactcttcagaacacacaga

SEQ ID NO: 3261606 - DNA, 23 bp, Homo sapiens
ctgaactgaggagatgaccaggg

SEQ ID NO: 3261607 - DNA, 13 bp, Homo sapiens
ctgaactgttaca

SEQ ID NO: 3261608 - DNA, 18 bp, Homo sapiens
ctgaacttgcattgtgat

SEQ ID NO: 3261609 - DNA, 14 bp, Homo sapiens
ctgaactttctccc

SEQ ID NO: 3261610 - DNA, 16 bp, Homo sapiens
ctgaactttctccctc

SEQ ID NO: 3261611 - DNA, 16 bp, Homo sapiens
ctgaactttggagagt

SEQ ID NO: 3261612 - DNA, 13 bp, Homo sapiens
ctgaagaaaaaat

SEQ ID NO: 3261613 - DNA, 21 bp, Homo sapiens
ctgaagaaaaaatcagaacta

SEQ ID NO: 3261614 - DNA, 18 bp, Homo sapiens
ctgaagaaatctttccag

SEQ ID NO: 3261615 - DNA, 17 bp, Homo sapiens
ctgaagaactctctgga

SEQ ID NO: 3261616 - DNA, 15 bp, Homo sapiens
ctgaagactgaggac

SEQ ID NO: 3261617 - DNA, 16 bp, Homo sapiens
ctgaagaggcgggcca

SEQ ID NO: 3261618 - DNA, 21 bp, Homo sapiens
ctgaagaggcgggccagccag

SEQ ID NO: 3261619 - DNA, 17 bp, Homo sapiens
ctgaagaggcttctcct

SEQ ID NO: 3261620 - DNA, 16 bp, Homo sapiens
ctgaagatgatcattt

SEQ ID NO: 3261621 - DNA, 16 bp, Homo sapiens
ctgaagcaactgaaga

SEQ ID NO: 3261622 - DNA, 14 bp, Homo sapiens
ctgaagcagcctct

SEQ ID NO: 3261623 - DNA, 15 bp, Homo sapiens
ctgaagcatgtttca

SEQ ID NO: 3261624 - DNA, 18 bp, Homo sapiens
ctgaagcatgtttcatgt

SEQ ID NO: 3261625 - DNA, 17 bp, Homo sapiens
ctgaagccaaatgaaac

SEQ ID NO: 3261626 - DNA, 14 bp, Homo sapiens
ctgaagccagcctt

SEQ ID NO: 3261627 - DNA, 18 bp, Homo sapiens
ctgaagcccatttctccg

SEQ ID NO: 3261628 - DNA, 21 bp, Homo sapiens
ctgaagccctcccaggtgtta

SEQ ID NO: 3261629 - DNA, 11 bp, Homo sapiens
ctgaaggaaaa

SEQ ID NO: 3261630 - DNA, 17 bp, Homo sapiens
ctgaaggaaaaacacaa

SEQ ID NO: 3261631 - DNA, 22 bp, Homo sapiens
ctgaaggaaaaacacaagcaaa

SEQ ID NO: 3261632 - DNA, 17 bp, Homo sapiens
ctgaaggaaaagcaaga

SEQ ID NO: 3261633 - DNA, 17 bp, Homo sapiens
ctctccctcccctgcca

SEQ ID NO: 3261634 - DNA, 16 bp, Homo sapiens
ctctccctcttctcaa

SEQ ID NO: 3261635 - DNA, 12 bp, Homo sapiens
ctctccctgttg

SEQ ID NO: 3261636 - DNA, 19 bp, Homo sapiens
ctctcccttggcagagaag

SEQ ID NO: 3261637 - DNA, 15 bp, Homo sapiens
ctctccgcgcctacc

SEQ ID NO: 3261638 - DNA, 15 bp, Homo sapiens
ctctccggtctctct

SEQ ID NO: 3261639 - DNA, 12 bp, Homo sapiens
ctctcctctctg

SEQ ID NO: 3261640 - DNA, 15 bp, Homo sapiens
ctctcctcttgccac

SEQ ID NO: 3261641 - DNA, 16 bp, Homo sapiens
ctctcctcttgccact

SEQ ID NO: 3261642 - DNA, 21 bp, Homo sapiens
ctctcctgatagtctttcagt

SEQ ID NO: 3261643 - DNA, 13 bp, Homo sapiens
ctctcctggccta

SEQ ID NO: 3261644 - DNA, 20 bp, Homo sapiens
ctctcctgggggtggcaggc

SEQ ID NO: 3261645 - DNA, 19 bp, Homo sapiens
ctctcctgtaagccaaaga

SEQ ID NO: 3261646 - DNA, 12 bp, Homo sapiens
ctctccttcctt

SEQ ID NO: 3261647 - DNA, 17 bp, Homo sapiens
ctctccttccttaccca

SEQ ID NO: 3261648 - DNA, 21 bp, Homo sapiens
ctctccttcgtgtctctccca

SEQ ID NO: 3261649 - DNA, 15 bp, Homo sapiens
ctctccttgggctcc

SEQ ID NO: 3261650 - DNA, 18 bp, Homo sapiens
ctctccttgggctcctgg

SEQ ID NO: 3261651 - DNA, 21 bp, Homo sapiens
ctctccttgggctcctggctg

SEQ ID NO: 3261652 - DNA, 14 bp, Homo sapiens
ctctcctttctttt

SEQ ID NO: 3261653 - DNA, 11 bp, Homo sapiens
ctctccttttc

SEQ ID NO: 3261654 - DNA, 20 bp, Homo sapiens
ctctccttttccttaccata

SEQ ID NO: 3261655 - DNA, 19 bp, Homo sapiens
ctctccttttcttttgtta

SEQ ID NO: 3261656 - DNA, 22 bp, Homo sapiens
ctctccttttcttttgttactg

SEQ ID NO: 3261657 - DNA, 12 bp, Homo sapiens
ctctcgagccca

SEQ ID NO: 3261658 - DNA, 19 bp, Homo sapiens
ctctcgcacctttccaaag

SEQ ID NO: 3261659 - DNA, 18 bp, Homo sapiens
ctctcggaaggctggctg

SEQ ID NO: 3261660 - DNA, 20 bp, Homo sapiens
ctctctaaactggtacaatt

SEQ ID NO: 3261661 - DNA, 14 bp, Homo sapiens
ctctctagaacctt

SEQ ID NO: 3261662 - DNA, 13 bp, Homo sapiens
ctctctagcacaa

SEQ ID NO: 3261663 - DNA, 14 bp, Homo sapiens
ctctctaggcctct

SEQ ID NO: 3261664 - DNA, 19 bp, Homo sapiens
ctctctaggcctctccagt

SEQ ID NO: 3261665 - DNA, 13 bp, Homo sapiens
ctctctcagagca

SEQ ID NO: 3261666 - DNA, 22 bp, Homo sapiens
ctctctcccctcaaagtctgca

SEQ ID NO: 3261667 - DNA, 12 bp, Homo sapiens
ctctctccctct

SEQ ID NO: 3261668 - DNA, 11 bp, Homo sapiens
ctctctctctc

SEQ ID NO: 3261669 - DNA, 11 bp, Homo sapiens
ctctctcttcc

SEQ ID NO: 3261670 - DNA, 15 bp, Homo sapiens
ctctctcttcccagc

SEQ ID NO: 3261671 - DNA, 21 bp, Homo sapiens
ctctctcttctgctccaccct

SEQ ID NO: 3261672 - DNA, 18 bp, Homo sapiens
ctctctctttctagaggt

SEQ ID NO: 3261673 - DNA, 21 bp, Homo sapiens
ctctctgagactctttagagc

SEQ ID NO: 3261674 - DNA, 21 bp, Homo sapiens
ctctctgcccctgatcactcc

SEQ ID NO: 3261675 - DNA, 13 bp, Homo sapiens
ctctctgctcctt

SEQ ID NO: 3261676 - DNA, 14 bp, Homo sapiens
ctctctgctccttc

SEQ ID NO: 3261677 - DNA, 17 bp, Homo sapiens
ctctctgctgagctggg

SEQ ID NO: 3261678 - DNA, 13 bp, Homo sapiens
ctctctgctgtac

SEQ ID NO: 3261679 - DNA, 20 bp, Homo sapiens
ctctctggaagcccctgggc

SEQ ID NO: 3261680 - DNA, 20 bp, Homo sapiens
ctctctggaagccctggaga

SEQ ID NO: 3261681 - DNA, 14 bp, Homo sapiens
ctctctggcctccc

SEQ ID NO: 3261682 - DNA, 18 bp, Homo sapiens
ctctctggcctcccaccc

SEQ ID NO: 3261683 - DNA, 12 bp, Homo sapiens
ctctctggcctt

SEQ ID NO: 3261684 - DNA, 19 bp, Homo sapiens
ctctctggccttcggcctc

SEQ ID NO: 3261685 - DNA, 18 bp, Homo sapiens
ctctctggggccctgggc

SEQ ID NO: 3261686 - DNA, 13 bp, Homo sapiens
ctctctgtataaa

SEQ ID NO: 3261687 - DNA, 19 bp, Homo sapiens
ctctctgtcccttgctgta

SEQ ID NO: 3261688 - DNA, 21 bp, Homo sapiens
ctctctgtgaatacaattaaa

SEQ ID NO: 3261689 - DNA, 15 bp, Homo sapiens
ctctctgtgtctttc

SEQ ID NO: 3261690 - DNA, 18 bp, Homo sapiens
ctctctgtgtctttctct

SEQ ID NO: 3261691 - DNA, 19 bp, Homo sapiens
ctctcttatagaatattta

SEQ ID NO: 3261692 - DNA, 15 bp, Homo sapiens
ctctcttccctcaga

SEQ ID NO: 3261693 - DNA, 20 bp, Homo sapiens
ctctcttccctttccccagc

SEQ ID NO: 3261694 - DNA, 17 bp, Homo sapiens
ctctcttctgctccacc

SEQ ID NO: 3261695 - DNA, 19 bp, Homo sapiens
ctctctttatacagctgta

SEQ ID NO: 3261696 - DNA, 19 bp, Homo sapiens
ctctctttgttctcagctc

SEQ ID NO: 3261697 - DNA, 10 bp, Homo sapiens
ctctcttttc

SEQ ID NO: 3261698 - DNA, 12 bp, Homo sapiens
ctctcttttcat

SEQ ID NO: 3261699 - DNA, 15 bp, Homo sapiens
ctctcttttcattgt

SEQ ID NO: 3261700 - DNA, 15 bp, Homo sapiens
ctctcttttccccgc

SEQ ID NO: 3261701 - DNA, 13 bp, Homo sapiens
ctctcttttcctg

SEQ ID NO: 3261702 - DNA, 22 bp, Homo sapiens
ctctcttttgaggtccctgtat

SEQ ID NO: 3261703 - DNA, 16 bp, Homo sapiens
ctctgaaatctgaaga

SEQ ID NO: 3261704 - DNA, 15 bp, Homo sapiens
ctctgaaatcttccc

SEQ ID NO: 3261705 - DNA, 23 bp, Homo sapiens
ctctgaaatcttcccatgcattc

SEQ ID NO: 3261706 - DNA, 14 bp, Homo sapiens
ctctgaacacaggc

SEQ ID NO: 3261707 - DNA, 15 bp, Homo sapiens
ctctgaacacaggca

SEQ ID NO: 3261708 - DNA, 19 bp, Homo sapiens
ctctgaacacaggcagctt

SEQ ID NO: 3261709 - DNA, 20 bp, Homo sapiens
ctctgaacacaggcagcttt

SEQ ID NO: 3261710 - DNA, 22 bp, Homo sapiens
ctctgaacacaggcagctttct

SEQ ID NO: 3261711 - DNA, 18 bp, Homo sapiens
ctctgaagatgatcattt

SEQ ID NO: 3261712 - DNA, 14 bp, Homo sapiens
ctctgaagcatgtt

SEQ ID NO: 3261713 - DNA, 14 bp, Homo sapiens
ctctgacaagggct

SEQ ID NO: 3261714 - DNA, 20 bp, Homo sapiens
ctctgacaagggctgacctg

SEQ ID NO: 3261715 - DNA, 15 bp, Homo sapiens
ctctgacacacagct

SEQ ID NO: 3261716 - DNA, 17 bp, Homo sapiens
ctctgacacacagctct

SEQ ID NO: 3261717 - DNA, 19 bp, Homo sapiens
ctctgacacacagctctgt

SEQ ID NO: 3261718 - DNA, 14 bp, Homo sapiens
ctctgacatccctt

SEQ ID NO: 3261719 - DNA, 23 bp, Homo sapiens
ctctgacattatgtggttttaga

SEQ ID NO: 3261720 - DNA, 18 bp, Homo sapiens
ctctgacccctcctcact

SEQ ID NO: 3261721 - DNA, 24 bp, Homo sapiens
ctctgacccttgggcctgggcctc

SEQ ID NO: 3261722 - DNA, 13 bp, Homo sapiens
ctctgacctgcag

SEQ ID NO: 3261723 - DNA, 14 bp, Homo sapiens
ctctgacttctgcc

SEQ ID NO: 3261724 - DNA, 16 bp, Homo sapiens
ctctgacttctgcctg

SEQ ID NO: 3261725 - DNA, 19 bp, Homo sapiens
ctctgacttctgcctggag

SEQ ID NO: 3261726 - DNA, 13 bp, Homo sapiens
ctctgagaagaca

SEQ ID NO: 3261727 - DNA, 15 bp, Homo sapiens
ctctgagaagaggag

SEQ ID NO: 3261728 - DNA, 13 bp, Homo sapiens
ctctgagaatcac

SEQ ID NO: 3261729 - DNA, 21 bp, Homo sapiens
ctctgagactctttagagcag

SEQ ID NO: 3261730 - DNA, 16 bp, Homo sapiens
ctctgagactggcaga

SEQ ID NO: 3261731 - DNA, 15 bp, Homo sapiens
ctctgagagtctaga

SEQ ID NO: 3261732 - DNA, 18 bp, Homo sapiens
ctctgagagtctagattc

SEQ ID NO: 3261733 - DNA, 15 bp, Homo sapiens
ctctgagcccaagct

SEQ ID NO: 3261734 - DNA, 13 bp, Homo sapiens
ctctgagcccagc

SEQ ID NO: 3261735 - DNA, 16 bp, Homo sapiens
ctctgagcccagctgc

SEQ ID NO: 3261736 - DNA, 17 bp, Homo sapiens
ctctgagcccagctgcc

SEQ ID NO: 3261737 - DNA, 21 bp, Homo sapiens
ctctgagcccagctgcctgga

SEQ ID NO: 3261738 - DNA, 16 bp, Homo sapiens
ctctgagcccaggccg

SEQ ID NO: 3261739 - DNA, 12 bp, Homo sapiens
ctctgagcccat

SEQ ID NO: 3261740 - DNA, 21 bp, Homo sapiens
ctctgagcccatgttctgccc

SEQ ID NO: 3261741 - DNA, 14 bp, Homo sapiens
ctctgagctgctca

SEQ ID NO: 3261742 - DNA, 15 bp, Homo sapiens
ctctgagctgctcac

SEQ ID NO: 3261743 - DNA, 20 bp, Homo sapiens
ctctgaggctctttctgggc

SEQ ID NO: 3261744 - DNA, 19 bp, Homo sapiens
ctctgaggtgcctgtccca

SEQ ID NO: 3261745 - DNA, 22 bp, Homo sapiens
ctctgaggtgcctgtcccaccc

SEQ ID NO: 3261746 - DNA, 19 bp, Homo sapiens
ctctgagtccactgctcca

SEQ ID NO: 3261747 - DNA, 22 bp, Homo sapiens
ctctgagtggtggttcctttgc

SEQ ID NO: 3261748 - DNA, 20 bp, Homo sapiens
ctctgatattccatgaatgt

SEQ ID NO: 3261749 - DNA, 23 bp, Homo sapiens
ctctgatattccatgaatgtatc

SEQ ID NO: 3261750 - DNA, 13 bp, Homo sapiens
ctctgatcaaaat

SEQ ID NO: 3261751 - DNA, 15 bp, Homo sapiens
ctctgattttcaaag

SEQ ID NO: 3261752 - DNA, 18 bp, Homo sapiens
ctctgattttcaaagctt

SEQ ID NO: 3261753 - DNA, 18 bp, Homo sapiens
ctctgcaaaggcctgggc

SEQ ID NO: 3261754 - DNA, 20 bp, Homo sapiens
ctctgcaagtgtctggagcg

SEQ ID NO: 3261755 - DNA, 13 bp, Homo sapiens
ctctgcaatgctt

SEQ ID NO: 3261756 - DNA, 23 bp, Homo sapiens
ctctgcaatgggcactgggatga

SEQ ID NO: 3261757 - DNA, 18 bp, Homo sapiens
ctctgcaattcccctctg

SEQ ID NO: 3261758 - DNA, 20 bp, Homo sapiens
ctctgcaattcccctctgct

SEQ ID NO: 3261759 - DNA, 21 bp, Homo sapiens
ctctgcaattcccctctgctg

SEQ ID NO: 3261760 - DNA, 16 bp, Homo sapiens
ctctgctccaccacat

SEQ ID NO: 3261761 - DNA, 19 bp, Homo sapiens
ctctgctccaccacatcct

SEQ ID NO: 3261762 - DNA, 20 bp, Homo sapiens
ctctgctcctctccccagca

SEQ ID NO: 3261763 - DNA, 21 bp, Homo sapiens
ctctgctcctctccccagcaa

SEQ ID NO: 3261764 - DNA, 22 bp, Homo sapiens
ctctgctcctggagcctttgaa

SEQ ID NO: 3261765 - DNA, 14 bp, Homo sapiens
ctctgctctagcca

SEQ ID NO: 3261766 - DNA, 16 bp, Homo sapiens
ctctgctctagccagg

SEQ ID NO: 3261767 - DNA, 17 bp, Homo sapiens
ctctgctctagccagga

SEQ ID NO: 3261768 - DNA, 18 bp, Homo sapiens
ctctgctgacagacacag

SEQ ID NO: 3261769 - DNA, 19 bp, Homo sapiens
ctctgctgacagacacagg

SEQ ID NO: 3261770 - DNA, 20 bp, Homo sapiens
ctctgctgacagacacaggc

SEQ ID NO: 3261771 - DNA, 18 bp, Homo sapiens
ctctgctgagctgggccc

SEQ ID NO: 3261772 - DNA, 11 bp, Homo sapiens
ctctgctgctt

SEQ ID NO: 3261773 - DNA, 16 bp, Homo sapiens
ctctgctggcctggcc

SEQ ID NO: 3261774 - DNA, 19 bp, Homo sapiens
ctctgctggttcctgactg

SEQ ID NO: 3261775 - DNA, 22 bp, Homo sapiens
ctctgctggttcctgactggca

SEQ ID NO: 3261776 - DNA, 17 bp, Homo sapiens
ctctgcttctctgactt

SEQ ID NO: 3261777 - DNA, 21 bp, Homo sapiens
ctctgcttctctgacttctgc

SEQ ID NO: 3261778 - DNA, 22 bp, Homo sapiens
ctctgcttttagtcacgtgtat

SEQ ID NO: 3261779 - DNA, 22 bp, Homo sapiens
ctctgcttttagttcatatata

SEQ ID NO: 3261780 - DNA, 21 bp, Homo sapiens
ctctggaagagaggaatgcct

SEQ ID NO: 3261781 - DNA, 18 bp, Homo sapiens
ctctggaagccctggaga

SEQ ID NO: 3261782 - DNA, 19 bp, Homo sapiens
ctctggaagccctggagac

SEQ ID NO: 3261783 - DNA, 16 bp, Homo sapiens
ctctggacaaagcgtt

SEQ ID NO: 3261784 - DNA, 15 bp, Homo sapiens
ctctggacaggcatg

SEQ ID NO: 3261785 - DNA, 23 bp, Homo sapiens
ctctggacggcaggctcactgcc

SEQ ID NO: 3261786 - DNA, 14 bp, Homo sapiens
ctctggactctaaa

SEQ ID NO: 3261787 - DNA, 16 bp, Homo sapiens
ctctggactggctaga

SEQ ID NO: 3261788 - DNA, 18 bp, Homo sapiens
ctctggagacagccccag

SEQ ID NO: 3261789 - DNA, 20 bp, Homo sapiens
ctctggagacagccccagag

SEQ ID NO: 3261790 - DNA, 15 bp, Homo sapiens
ctctggagagaaaca

SEQ ID NO: 3261791 - DNA, 19 bp, Homo sapiens
ctctggaggcctctggccc

SEQ ID NO: 3261792 - DNA, 17 bp, Homo sapiens
ctctggaggctgcagag

SEQ ID NO: 3261793 - DNA, 19 bp, Homo sapiens
ctctggaggctgcagagct

SEQ ID NO: 3261794 - DNA, 14 bp, Homo sapiens
ctctggaggggagg

SEQ ID NO: 3261795 - DNA, 20 bp, Homo sapiens
ctctggaggggtgtggctcc

SEQ ID NO: 3261796 - DNA, 21 bp, Homo sapiens
ctctggaggggtgtggctcct

SEQ ID NO: 3261797 - DNA, 12 bp, Homo sapiens
ctctggatattt

SEQ ID NO: 3261798 - DNA, 21 bp, Homo sapiens
ctctggatatttgcacttatg

SEQ ID NO: 3261799 - DNA, 19 bp, Homo sapiens
ctctggcattagaattatt

SEQ ID NO: 3261800 - DNA, 10 bp, Homo sapiens
ctctggccag

SEQ ID NO: 3261801 - DNA, 14 bp, Homo sapiens
ctctggccaggcat

SEQ ID NO: 3261802 - DNA, 10 bp, Homo sapiens
ctctggccct

SEQ ID NO: 3261803 - DNA, 16 bp, Homo sapiens
ctctggccctcggtgg

SEQ ID NO: 3261804 - DNA, 14 bp, Homo sapiens
ctctggccctggcc

SEQ ID NO: 3261805 - DNA, 15 bp, Homo sapiens
ctctggccctgtgta

SEQ ID NO: 3261806 - DNA, 22 bp, Homo sapiens
ctctggccctgtgtaggggcag

SEQ ID NO: 3261807 - DNA, 12 bp, Homo sapiens
ctctggcccttg

SEQ ID NO: 3261808 - DNA, 15 bp, Homo sapiens
ctctggcccttgcct

SEQ ID NO: 3261809 - DNA, 18 bp, Homo sapiens
ctctggccgccaccccca

SEQ ID NO: 3261810 - DNA, 14 bp, Homo sapiens
ctctggcctcccac

SEQ ID NO: 3261811 - DNA, 15 bp, Homo sapiens
ctctggcctcccacc

SEQ ID NO: 3261812 - DNA, 16 bp, Homo sapiens
ctctggcctcccaccc

SEQ ID NO: 3261813 - DNA, 12 bp, Homo sapiens
ctctggccttcg

SEQ ID NO: 3261814 - DNA, 20 bp, Homo sapiens
ctctggcggcttcctgtcca

SEQ ID NO: 3261815 - DNA, 16 bp, Homo sapiens
ctctggctagaggcca

SEQ ID NO: 3261816 - DNA, 22 bp, Homo sapiens
ctctggctagaggccagcccca

SEQ ID NO: 3261817 - DNA, 21 bp, Homo sapiens
ctctggctccacacctccacc

SEQ ID NO: 3261818 - DNA, 13 bp, Homo sapiens
ctctggctctcat

SEQ ID NO: 3261819 - DNA, 15 bp, Homo sapiens
ctctggctgaaccct

SEQ ID NO: 3261820 - DNA, 19 bp, Homo sapiens
ctctggctgaaccctgtgc

SEQ ID NO: 3261821 - DNA, 19 bp, Homo sapiens
ctctggctgtaaggctcta

SEQ ID NO: 3261822 - DNA, 21 bp, Homo sapiens
ctctggctgtaaggctctaga

SEQ ID NO: 3261823 - DNA, 12 bp, Homo sapiens
ctctggcttccc

SEQ ID NO: 3261824 - DNA, 20 bp, Homo sapiens
ctctggctttattactcccc

SEQ ID NO: 3261825 - DNA, 19 bp, Homo sapiens
ctctgggaaataagagaga

SEQ ID NO: 3261826 - DNA, 13 bp, Homo sapiens
ctctgggaacctc

SEQ ID NO: 3261827 - DNA, 15 bp, Homo sapiens
ctctgggaacctccc

SEQ ID NO: 3261828 - DNA, 17 bp, Homo sapiens
ctctgggaacctcccag

SEQ ID NO: 3261829 - DNA, 19 bp, Homo sapiens
ctctgggaacctcccagag

SEQ ID NO: 3261830 - DNA, 20 bp, Homo sapiens
ctctgggaacctcccagagg

SEQ ID NO: 3261831 - DNA, 23 bp, Homo sapiens
ctctgggaacctcccagaggtcc

SEQ ID NO: 3261832 - DNA, 17 bp, Homo sapiens
ctctgggagaggatttt

SEQ ID NO: 3261833 - DNA, 22 bp, Homo sapiens
ctctgggcccaggggctgtggc

SEQ ID NO: 3261834 - DNA, 12 bp, Homo sapiens
ctctgggctcag

SEQ ID NO: 3261835 - DNA, 19 bp, Homo sapiens
ctctgggctcagggctgga

SEQ ID NO: 3261836 - DNA, 20 bp, Homo sapiens
ctctggggaccccaacctca

SEQ ID NO: 3261837 - DNA, 21 bp, Homo sapiens
ctctggggccctgggcctcag

SEQ ID NO: 3261838 - DNA, 22 bp, Homo sapiens
ctctggggccctgggcctcagt

SEQ ID NO: 3261839 - DNA, 22 bp, Homo sapiens
ctctggggctgttgaagtcacc

SEQ ID NO: 3261840 - DNA, 22 bp, Homo sapiens
ctctggggggcagttgggtaga

SEQ ID NO: 3261841 - DNA, 18 bp, Homo sapiens
ctctggggtgctgcctga

SEQ ID NO: 3261842 - DNA, 16 bp, Homo sapiens
ctctgggtccctcctc

SEQ ID NO: 3261843 - DNA, 22 bp, Homo sapiens
ctctggtccacactagaaagaa

SEQ ID NO: 3261844 - DNA, 18 bp, Homo sapiens
ctctggtcgctcctgccc

SEQ ID NO: 3261845 - DNA, 23 bp, Homo sapiens
ctctggtgagtcaccacttcagg

SEQ ID NO: 3261846 - DNA, 23 bp, Homo sapiens
ctctggtgagtcttggcggcagc

SEQ ID NO: 3261847 - DNA, 13 bp, Homo sapiens
ctctggtgcctcc

SEQ ID NO: 3261848 - DNA, 16 bp, Homo sapiens
ctctggttcttcattt

SEQ ID NO: 3261849 - DNA, 20 bp, Homo sapiens
ctctggttgtttctgttcca

SEQ ID NO: 3261850 - DNA, 16 bp, Homo sapiens
ctctggtttaattaca

SEQ ID NO: 3261851 - DNA, 21 bp, Homo sapiens
ctctgtaaatgaaaaaaccca

SEQ ID NO: 3261852 - DNA, 20 bp, Homo sapiens
ctctgtacccatgaactccc

SEQ ID NO: 3261853 - DNA, 18 bp, Homo sapiens
ctctgtagggaactctgg

SEQ ID NO: 3261854 - DNA, 14 bp, Homo sapiens
ctctgtagtttatg

SEQ ID NO: 3261855 - DNA, 13 bp, Homo sapiens
ctctgtataaaca

SEQ ID NO: 3261856 - DNA, 21 bp, Homo sapiens
ctctgtcagccagccgccctg

SEQ ID NO: 3261857 - DNA, 23 bp, Homo sapiens
ctctgtcagccagccgccctggg

SEQ ID NO: 3261858 - DNA, 16 bp, Homo sapiens
ctctgtcatcactccc

SEQ ID NO: 3261859 - DNA, 21 bp, Homo sapiens
ctctgtccaggccactgtggc

SEQ ID NO: 3261860 - DNA, 24 bp, Homo sapiens
ctctgtccaggccactgtggccag

SEQ ID NO: 3261861 - DNA, 16 bp, Homo sapiens
ctctgtccctgtcctt

SEQ ID NO: 3261862 - DNA, 15 bp, Homo sapiens
ctctgtcctgcttct

SEQ ID NO: 3261863 - DNA, 17 bp, Homo sapiens
ctctgtcctgcttctga

SEQ ID NO: 3261864 - DNA, 13 bp, Homo sapiens
ctctgtcctggga

SEQ ID NO: 3261865 - DNA, 13 bp, Homo sapiens
ctctgtcgcccag

SEQ ID NO: 3261866 - DNA, 17 bp, Homo sapiens
ctctgtctacccagtgc

SEQ ID NO: 3261867 - DNA, 20 bp, Homo sapiens
ctctgtctacctggtctggt

SEQ ID NO: 3261868 - DNA, 10 bp, Homo sapiens
ctctgtctca

SEQ ID NO: 3261869 - DNA, 22 bp, Homo sapiens
ctctgtctgagtaagaaacaga

SEQ ID NO: 3261870 - DNA, 20 bp, Homo sapiens
ctctgtgaatacaattaaag

SEQ ID NO: 3261871 - DNA, 19 bp, Homo sapiens
ctctgtgacctcaggcact

SEQ ID NO: 3261872 - DNA, 20 bp, Homo sapiens
ctctgtgcacttatttatga

SEQ ID NO: 3261873 - DNA, 20 bp, Homo sapiens
ctctgtgcagtcactggagg

SEQ ID NO: 3261874 - DNA, 14 bp, Homo sapiens
ctctgtggcctgtg

SEQ ID NO: 3261875 - DNA, 15 bp, Homo sapiens
ctctgtggcctgtgt

SEQ ID NO: 3261876 - DNA, 17 bp, Homo sapiens
ctctgtggcctgtgtcc

SEQ ID NO: 3261877 - DNA, 19 bp, Homo sapiens
ctctgtggcctgtgtccag

SEQ ID NO: 3261878 - DNA, 23 bp, Homo sapiens
ctctgtggcctgtgtccagcagc

SEQ ID NO: 3261879 - DNA, 19 bp, Homo sapiens
ctctgtgtcaggtggggca

SEQ ID NO: 3261880 - DNA, 19 bp, Homo sapiens
ctctgtgtctaagattcta

SEQ ID NO: 3261881 - DNA, 22 bp, Homo sapiens
ctctgtgtctaagattctagat

SEQ ID NO: 3261882 - DNA, 15 bp, Homo sapiens
ctctgtgtgcacaaa

SEQ ID NO: 3261883 - DNA, 17 bp, Homo sapiens
ctctgtgtgcacaaata

SEQ ID NO: 3261884 - DNA, 15 bp, Homo sapiens
ctctgttaaggttga

SEQ ID NO: 3261885 - DNA, 20 bp, Homo sapiens
ctctgttaaggttgaacttt

SEQ ID NO: 3261886 - DNA, 19 bp, Homo sapiens
ctctgttacccaggctgga

SEQ ID NO: 3261887 - DNA, 21 bp, Homo sapiens
ctctgttcatttcacacagtg

SEQ ID NO: 3261888 - DNA, 19 bp, Homo sapiens
ctcgcacccccctgttcta

SEQ ID NO: 3261889 - DNA, 18 bp, Homo sapiens
ctcgcagtcgcaggatcc

SEQ ID NO: 3261890 - DNA, 14 bp, Homo sapiens
ctcgccagcttctc

SEQ ID NO: 3261891 - DNA, 18 bp, Homo sapiens
ctcgccagcttctcctgc

SEQ ID NO: 3261892 - DNA, 19 bp, Homo sapiens
ctcgccagcttctcctgcg

SEQ ID NO: 3261893 - DNA, 22 bp, Homo sapiens
ctcgccagcttctcctgcgccc

SEQ ID NO: 3261894 - DNA, 13 bp, Homo sapiens
ctcgccataaatc

SEQ ID NO: 3261895 - DNA, 12 bp, Homo sapiens
ctcgccatgccg

SEQ ID NO: 3261896 - DNA, 17 bp, Homo sapiens
ctcgcccagcaggagag

SEQ ID NO: 3261897 - DNA, 12 bp, Homo sapiens
ctcgcccaggaa

SEQ ID NO: 3261898 - DNA, 14 bp, Homo sapiens
ctcgccccacctcc

SEQ ID NO: 3261899 - DNA, 16 bp, Homo sapiens
ctcgccccacctccac

SEQ ID NO: 3261900 - DNA, 18 bp, Homo sapiens
ctcgccccacctccacct

SEQ ID NO: 3261901 - DNA, 16 bp, Homo sapiens
ctcgcgctcagtaaac

SEQ ID NO: 3261902 - DNA, 15 bp, Homo sapiens
ctcgcgggcagcggg

SEQ ID NO: 3261903 - DNA, 21 bp, Homo sapiens
ctcgcgggcagcgggccaggc

SEQ ID NO: 3261904 - DNA, 15 bp, Homo sapiens
ctcgctccctgtagc

SEQ ID NO: 3261905 - DNA, 21 bp, Homo sapiens
ctcgctccctgtagctctgcc

SEQ ID NO: 3261906 - DNA, 13 bp, Homo sapiens
ctcgctcccttca

SEQ ID NO: 3261907 - DNA, 21 bp, Homo sapiens
ctcgctgccatcaccgctggg

SEQ ID NO: 3261908 - DNA, 15 bp, Homo sapiens
ctcgctgtcactggc

SEQ ID NO: 3261909 - DNA, 16 bp, Homo sapiens
ctcgctgtcactggct

SEQ ID NO: 3261910 - DNA, 19 bp, Homo sapiens
ctcgctgtcactggctggc

SEQ ID NO: 3261911 - DNA, 20 bp, Homo sapiens
ctcgctgtcactggctggct

SEQ ID NO: 3261912 - DNA, 18 bp, Homo sapiens
ctcgcttcccccatagcc

SEQ ID NO: 3261913 - DNA, 14 bp, Homo sapiens
ctcgcttgtaaata

SEQ ID NO: 3261914 - DNA, 20 bp, Homo sapiens
ctcggaaccgctcacctaga

SEQ ID NO: 3261915 - DNA, 23 bp, Homo sapiens
ctcggaaccgctcacctagagcc

SEQ ID NO: 3261916 - DNA, 19 bp, Homo sapiens
ctcggaagccgtctgactc

SEQ ID NO: 3261917 - DNA, 16 bp, Homo sapiens
ctcggagagcagcagc

SEQ ID NO: 3261918 - DNA, 18 bp, Homo sapiens
ctcggagcatcccggagg

SEQ ID NO: 3261919 - DNA, 13 bp, Homo sapiens
ctcggagcatggt

SEQ ID NO: 3261920 - DNA, 12 bp, Homo sapiens
ctcggaggcccc

SEQ ID NO: 3261921 - DNA, 23 bp, Homo sapiens
ctcggagggatggagaaagaagt

SEQ ID NO: 3261922 - DNA, 21 bp, Homo sapiens
ctcggcacctccccggcctct

SEQ ID NO: 3261923 - DNA, 20 bp, Homo sapiens
ctcggcctcccaaagtgctg

SEQ ID NO: 3261924 - DNA, 14 bp, Homo sapiens
ctcggcgcccacca

SEQ ID NO: 3261925 - DNA, 12 bp, Homo sapiens
ctcggctcaggc

SEQ ID NO: 3261926 - DNA, 14 bp, Homo sapiens
ctcggctcaggctc

SEQ ID NO: 3261927 - DNA, 21 bp, Homo sapiens
ctcggctcaggctctgctggt

SEQ ID NO: 3261928 - DNA, 19 bp, Homo sapiens
ctcggctccccatgtgtcc

SEQ ID NO: 3261929 - DNA, 16 bp, Homo sapiens
ctcggcttgtgggctg

SEQ ID NO: 3261930 - DNA, 17 bp, Homo sapiens
ctcggcttgtgggctgg

SEQ ID NO: 3261931 - DNA, 18 bp, Homo sapiens
ctcggcttgtgggctggt

SEQ ID NO: 3261932 - DNA, 15 bp, Homo sapiens
ctcgggaagcagcca

SEQ ID NO: 3261933 - DNA, 20 bp, Homo sapiens
ctcgggacacctgccctgcc

SEQ ID NO: 3261934 - DNA, 18 bp, Homo sapiens
ctcgggagtcctctagca

SEQ ID NO: 3261935 - DNA, 17 bp, Homo sapiens
ctcgggcccacctggcc

SEQ ID NO: 3261936 - DNA, 18 bp, Homo sapiens
ctcgggcccacctggcca

SEQ ID NO: 3261937 - DNA, 20 bp, Homo sapiens
ctcgggcccacctggccacc

SEQ ID NO: 3261938 - DNA, 13 bp, Homo sapiens
ctcgggccgaggc

SEQ ID NO: 3261939 - DNA, 18 bp, Homo sapiens
ctcggggacaccagagct

SEQ ID NO: 3261940 - DNA, 21 bp, Homo sapiens
ctcggggcccttggggcctgg

SEQ ID NO: 3261941 - DNA, 15 bp, Homo sapiens
ctcggggctccaggc

SEQ ID NO: 3261942 - DNA, 16 bp, Homo sapiens
ctcggggctccaggct

SEQ ID NO: 3261943 - DNA, 17 bp, Homo sapiens
ctcggggggtcacaggc

SEQ ID NO: 3261944 - DNA, 14 bp, Homo sapiens
ctcgggtgcatttg

SEQ ID NO: 3261945 - DNA, 13 bp, Homo sapiens
ctcggtttctcca

SEQ ID NO: 3261946 - DNA, 16 bp, Homo sapiens
ctcggtttgccaaaat

SEQ ID NO: 3261947 - DNA, 20 bp, Homo sapiens
ctcgtatatgtctcaggtcc

SEQ ID NO: 3261948 - DNA, 16 bp, Homo sapiens
ctcgtccacaggggca

SEQ ID NO: 3261949 - DNA, 18 bp, Homo sapiens
ctcgtccacaggggcagg

SEQ ID NO: 3261950 - DNA, 21 bp, Homo sapiens
ctcgtccacaggggcaggcct

SEQ ID NO: 3261951 - DNA, 23 bp, Homo sapiens
ctcgtccacaggggcaggcctgg

SEQ ID NO: 3261952 - DNA, 14 bp, Homo sapiens
ctcgtcctgtccca

SEQ ID NO: 3261953 - DNA, 19 bp, Homo sapiens
ctcgtgatccgcctgcctc

SEQ ID NO: 3261954 - DNA, 19 bp, Homo sapiens
ctcgtgccatgatctgtat

SEQ ID NO: 3261955 - DNA, 16 bp, Homo sapiens
ctcgtggccagcccgg

SEQ ID NO: 3261956 - DNA, 11 bp, Homo sapiens
ctcgtggcctt

SEQ ID NO: 3261957 - DNA, 16 bp, Homo sapiens
ctcgtggtccccaaca

SEQ ID NO: 3261958 - DNA, 20 bp, Homo sapiens
ctcgtggttggaagcctccc

SEQ ID NO: 3261959 - DNA, 12 bp, Homo sapiens
ctcgttcccaaa

SEQ ID NO: 3261960 - DNA, 16 bp, Homo sapiens
ctcgtttttcagcacc

SEQ ID NO: 3261961 - DNA, 19 bp, Homo sapiens
ctcgtttttcagcaccccc

SEQ ID NO: 3261962 - DNA, 20 bp, Homo sapiens
ctcgtttttcagcaccccca

SEQ ID NO: 3261963 - DNA, 13 bp, Homo sapiens
ctctaaaaaagaa

SEQ ID NO: 3261964 - DNA, 23 bp, Homo sapiens
ctctaaaagcgttggatgtagca

SEQ ID NO: 3261965 - DNA, 17 bp, Homo sapiens
ctctaaaaggttcaggg

SEQ ID NO: 3261966 - DNA, 18 bp, Homo sapiens
ctctaaagcaataatggt

SEQ ID NO: 3261967 - DNA, 15 bp, Homo sapiens
ctctaagctgtgtgc

SEQ ID NO: 3261968 - DNA, 13 bp, Homo sapiens
ctctaataaaaca

SEQ ID NO: 3261969 - DNA, 19 bp, Homo sapiens
ctctaatatgattatacaa

SEQ ID NO: 3261970 - DNA, 20 bp, Homo sapiens
ctctaattcccattttgcaa

SEQ ID NO: 3261971 - DNA, 15 bp, Homo sapiens
ctctacactcttgta

SEQ ID NO: 3261972 - DNA, 13 bp, Homo sapiens
ctctacagaggcc

SEQ ID NO: 3261973 - DNA, 20 bp, Homo sapiens
ctctacagtgccaactcctc

SEQ ID NO: 3261974 - DNA, 12 bp, Homo sapiens
ctctacatttaa

SEQ ID NO: 3261975 - DNA, 13 bp, Homo sapiens
ctctacatttaaa

SEQ ID NO: 3261976 - DNA, 19 bp, Homo sapiens
ctctacccatattacagat

SEQ ID NO: 3261977 - DNA, 15 bp, Homo sapiens
ctctacccctttctt

SEQ ID NO: 3261978 - DNA, 17 bp, Homo sapiens
ctctacccctttcttct

SEQ ID NO: 3261979 - DNA, 14 bp, Homo sapiens
ctctaccctcccac

SEQ ID NO: 3261980 - DNA, 22 bp, Homo sapiens
ctctaccctcccacccccttct

SEQ ID NO: 3261981 - DNA, 14 bp, Homo sapiens
ctctaccctgctcc

SEQ ID NO: 3261982 - DNA, 15 bp, Homo sapiens
ctctaccctgctccc

SEQ ID NO: 3261983 - DNA, 16 bp, Homo sapiens
ctctaccctgctccct

SEQ ID NO: 3261984 - DNA, 13 bp, Homo sapiens
ctctacctcctta

SEQ ID NO: 3261985 - DNA, 20 bp, Homo sapiens
ctctacgtggcaaattaact

SEQ ID NO: 3261986 - DNA, 22 bp, Homo sapiens
ctctactaaaaatacaaaaatt

SEQ ID NO: 3261987 - DNA, 20 bp, Homo sapiens
ctctactaccacaaggaaaa

SEQ ID NO: 3261988 - DNA, 19 bp, Homo sapiens
ctctactcctacctcagcc

SEQ ID NO: 3261989 - DNA, 17 bp, Homo sapiens
ctctacttaatccaatg

SEQ ID NO: 3261990 - DNA, 13 bp, Homo sapiens
ctctactttccag

SEQ ID NO: 3261991 - DNA, 15 bp, Homo sapiens
ctctactttccaggc

SEQ ID NO: 3261992 - DNA, 18 bp, Homo sapiens
ctctactttccaggctag

SEQ ID NO: 3261993 - DNA, 18 bp, Homo sapiens
ctctagaagccaagggaa

SEQ ID NO: 3261994 - DNA, 23 bp, Homo sapiens
ctctagaattttaagtgctttgt

SEQ ID NO: 3261995 - DNA, 13 bp, Homo sapiens
ctctagcaggcct

SEQ ID NO: 3261996 - DNA, 13 bp, Homo sapiens
ctctagccaggag

SEQ ID NO: 3261997 - DNA, 17 bp, Homo sapiens
ctctagccaggagtctg

SEQ ID NO: 3261998 - DNA, 15 bp, Homo sapiens
ctctagcctgggcca

SEQ ID NO: 3261999 - DNA, 16 bp, Homo sapiens
ctctagctggcaggac

SEQ ID NO: 3262000 - DNA, 17 bp, Homo sapiens
ctctagctggtggtttc

SEQ ID NO: 3262001 - DNA, 23 bp, Homo sapiens
ctctaggcaagcaggacctggca

SEQ ID NO: 3262002 - DNA, 15 bp, Homo sapiens
ctctaggttatacaa

SEQ ID NO: 3262003 - DNA, 13 bp, Homo sapiens
ctctagtgggaca

SEQ ID NO: 3262004 - DNA, 18 bp, Homo sapiens
ctctagtgggacagccca

SEQ ID NO: 3262005 - DNA, 20 bp, Homo sapiens
ctctagtgggacagcccaga

SEQ ID NO: 3262006 - DNA, 23 bp, Homo sapiens
ctctagtgggacagcccagagcc

SEQ ID NO: 3262007 - DNA, 17 bp, Homo sapiens
ctctagtgtattatcac

SEQ ID NO: 3262008 - DNA, 20 bp, Homo sapiens
ctctagtgtattatcactgt

SEQ ID NO: 3262009 - DNA, 20 bp, Homo sapiens
ctctagttttcagccttggg

SEQ ID NO: 3262010 - DNA, 15 bp, Homo sapiens
ctctatacatctctc

SEQ ID NO: 3262011 - DNA, 14 bp, Homo sapiens
ctctatctctcaaa

SEQ ID NO: 3262012 - DNA, 16 bp, Homo sapiens
ctctatctgggcctgg

SEQ ID NO: 3262013 - DNA, 20 bp, Homo sapiens
ctctatctgggcctgggcta

SEQ ID NO: 3262014 - DNA, 14 bp, Homo sapiens
ctctatgagtctag

SEQ ID NO: 3262015 - DNA, 15 bp, Homo sapiens
ctctatgagtctaga

SEQ ID NO: 3262016 - DNA, 16 bp, Homo sapiens
ctctatgagtctagat

SEQ ID NO: 3262017 - DNA, 17 bp, Homo sapiens
ctctatgagtctagatg

SEQ ID NO: 3262018 - DNA, 14 bp, Homo sapiens
ctcctgccattctt

SEQ ID NO: 3262019 - DNA, 13 bp, Homo sapiens
ctcctgcccagtc

SEQ ID NO: 3262020 - DNA, 13 bp, Homo sapiens
ctcctgccgcaga

SEQ ID NO: 3262021 - DNA, 14 bp, Homo sapiens
ctcctgccgcagac

SEQ ID NO: 3262022 - DNA, 23 bp, Homo sapiens
ctcctgcctagctgcctagcaag

SEQ ID NO: 3262023 - DNA, 12 bp, Homo sapiens
ctcctgcctcag

SEQ ID NO: 3262024 - DNA, 18 bp, Homo sapiens
ctcctgcctcgaactggc

SEQ ID NO: 3262025 - DNA, 20 bp, Homo sapiens
ctcctgcctcgaactggctg

SEQ ID NO: 3262026 - DNA, 22 bp, Homo sapiens
ctcctgcctcgaactggctgca

SEQ ID NO: 3262027 - DNA, 18 bp, Homo sapiens
ctcctgcctgtagcagtg

SEQ ID NO: 3262028 - DNA, 15 bp, Homo sapiens
ctcctgcgccccgcc

SEQ ID NO: 3262029 - DNA, 23 bp, Homo sapiens
ctcctgcgccccgcccacaccct

SEQ ID NO: 3262030 - DNA, 11 bp, Homo sapiens
ctcctgctcct

SEQ ID NO: 3262031 - DNA, 12 bp, Homo sapiens
ctcctgctcctc

SEQ ID NO: 3262032 - DNA, 14 bp, Homo sapiens
ctcctgctcctccc

SEQ ID NO: 3262033 - DNA, 15 bp, Homo sapiens
ctcctgctggctctc

SEQ ID NO: 3262034 - DNA, 22 bp, Homo sapiens
ctcctgctggtacctgccctct

SEQ ID NO: 3262035 - DNA, 24 bp, Homo sapiens
ctcctggaaaggctcagtctcagg

SEQ ID NO: 3262036 - DNA, 14 bp, Homo sapiens
ctcctggaaatatt

SEQ ID NO: 3262037 - DNA, 19 bp, Homo sapiens
ctcctggaaccttgctgtc

SEQ ID NO: 3262038 - DNA, 12 bp, Homo sapiens
ctcctggagcct

SEQ ID NO: 3262039 - DNA, 17 bp, Homo sapiens
ctcctggcaatcaatac

SEQ ID NO: 3262040 - DNA, 22 bp, Homo sapiens
ctcctggcctatccgctgccag

SEQ ID NO: 3262041 - DNA, 23 bp, Homo sapiens
ctcctggcctttcctggttttca

SEQ ID NO: 3262042 - DNA, 19 bp, Homo sapiens
ctcctggctaagcctctgc

SEQ ID NO: 3262043 - DNA, 12 bp, Homo sapiens
ctcctggctgcc

SEQ ID NO: 3262044 - DNA, 14 bp, Homo sapiens
ctcctggctgccag

SEQ ID NO: 3262045 - DNA, 16 bp, Homo sapiens
ctcctggctgccaggc

SEQ ID NO: 3262046 - DNA, 19 bp, Homo sapiens
ctcctgggagcccccacca

SEQ ID NO: 3262047 - DNA, 14 bp, Homo sapiens
ctcctggggagagg

SEQ ID NO: 3262048 - DNA, 18 bp, Homo sapiens
ctcctgggggtggcaggc

SEQ ID NO: 3262049 - DNA, 24 bp, Homo sapiens
ctcctgggggtggcaggcacacag

SEQ ID NO: 3262050 - DNA, 23 bp, Homo sapiens
ctcctgggggttctttcttcctc

SEQ ID NO: 3262051 - DNA, 15 bp, Homo sapiens
ctcctggtcttgaga

SEQ ID NO: 3262052 - DNA, 11 bp, Homo sapiens
ctcctggtgcc

SEQ ID NO: 3262053 - DNA, 11 bp, Homo sapiens
ctcctggtggc

SEQ ID NO: 3262054 - DNA, 18 bp, Homo sapiens
ctcctggtggccttctgc

SEQ ID NO: 3262055 - DNA, 20 bp, Homo sapiens
ctcctggtggccttctgctg

SEQ ID NO: 3262056 - DNA, 21 bp, Homo sapiens
ctcctgtaaatggtgtacata

SEQ ID NO: 3262057 - DNA, 17 bp, Homo sapiens
ctcctgtaagccaaaga

SEQ ID NO: 3262058 - DNA, 17 bp, Homo sapiens
ctcctgtacctcagtgg

SEQ ID NO: 3262059 - DNA, 18 bp, Homo sapiens
ctcctgtacctcagtgga

SEQ ID NO: 3262060 - DNA, 21 bp, Homo sapiens
ctcctgtacctcagtggatct

SEQ ID NO: 3262061 - DNA, 19 bp, Homo sapiens
ctcctgtccaaagtaggga

SEQ ID NO: 3262062 - DNA, 22 bp, Homo sapiens
ctcctgtccaaagtagggatgc

SEQ ID NO: 3262063 - DNA, 15 bp, Homo sapiens
ctcctgtcctcccat

SEQ ID NO: 3262064 - DNA, 13 bp, Homo sapiens
ctcctgtctgccc

SEQ ID NO: 3262065 - DNA, 14 bp, Homo sapiens
ctcctgtctgccct

SEQ ID NO: 3262066 - DNA, 16 bp, Homo sapiens
ctcctgtgatcctttg

SEQ ID NO: 3262067 - DNA, 21 bp, Homo sapiens
ctcctgtgctctggaggctgc

SEQ ID NO: 3262068 - DNA, 18 bp, Homo sapiens
ctcctgtggaacccagca

SEQ ID NO: 3262069 - DNA, 20 bp, Homo sapiens
ctcctgtggaacccagcagt

SEQ ID NO: 3262070 - DNA, 13 bp, Homo sapiens
ctcctgtggcccc

SEQ ID NO: 3262071 - DNA, 14 bp, Homo sapiens
ctcctgtgtactgt

SEQ ID NO: 3262072 - DNA, 15 bp, Homo sapiens
ctcctgtgtactgtg

SEQ ID NO: 3262073 - DNA, 16 bp, Homo sapiens
ctcctgtgtactgtgt

SEQ ID NO: 3262074 - DNA, 17 bp, Homo sapiens
ctcctgtgtactgtgtc

SEQ ID NO: 3262075 - DNA, 14 bp, Homo sapiens
ctcctgtgtgtgcg

SEQ ID NO: 3262076 - DNA, 20 bp, Homo sapiens
ctcctgtgtgtgcgcctaca

SEQ ID NO: 3262077 - DNA, 21 bp, Homo sapiens
ctcctgtgtgtgcgcctacag

SEQ ID NO: 3262078 - DNA, 19 bp, Homo sapiens
ctccttactctgagcccag

SEQ ID NO: 3262079 - DNA, 21 bp, Homo sapiens
ctccttactctgagcccaggc

SEQ ID NO: 3262080 - DNA, 22 bp, Homo sapiens
ctccttactctgagcccaggcc

SEQ ID NO: 3262081 - DNA, 20 bp, Homo sapiens
ctccttatagacacttgctc

SEQ ID NO: 3262082 - DNA, 15 bp, Homo sapiens
ctccttattttgtat

SEQ ID NO: 3262083 - DNA, 16 bp, Homo sapiens
ctccttattttgtatt

SEQ ID NO: 3262084 - DNA, 15 bp, Homo sapiens
ctccttcactgtttc

SEQ ID NO: 3262085 - DNA, 14 bp, Homo sapiens
ctccttcagacacc

SEQ ID NO: 3262086 - DNA, 19 bp, Homo sapiens
ctccttcatgacagcctcc

SEQ ID NO: 3262087 - DNA, 19 bp, Homo sapiens
ctccttccacatgtacata

SEQ ID NO: 3262088 - DNA, 15 bp, Homo sapiens
ctccttccacctccc

SEQ ID NO: 3262089 - DNA, 16 bp, Homo sapiens
ctccttccacctccct

SEQ ID NO: 3262090 - DNA, 18 bp, Homo sapiens
ctccttccacctccctcc

SEQ ID NO: 3262091 - DNA, 16 bp, Homo sapiens
ctccttcccatcgctg

SEQ ID NO: 3262092 - DNA, 22 bp, Homo sapiens
ctccttccccaggatggactct

SEQ ID NO: 3262093 - DNA, 18 bp, Homo sapiens
ctccttcctgtgccgtaa

SEQ ID NO: 3262094 - DNA, 13 bp, Homo sapiens
ctccttcctgtgt

SEQ ID NO: 3262095 - DNA, 19 bp, Homo sapiens
ctccttccttacccaaact

SEQ ID NO: 3262096 - DNA, 18 bp, Homo sapiens
ctccttcgtatcccgagt

SEQ ID NO: 3262097 - DNA, 19 bp, Homo sapiens
ctccttcgtatcccgagtc

SEQ ID NO: 3262098 - DNA, 22 bp, Homo sapiens
ctccttcgtatcccgagtctgg

SEQ ID NO: 3262099 - DNA, 15 bp, Homo sapiens
ctccttctccttccc

SEQ ID NO: 3262100 - DNA, 15 bp, Homo sapiens
ctccttctgtcctac

SEQ ID NO: 3262101 - DNA, 16 bp, Homo sapiens
ctccttggcttacctg

SEQ ID NO: 3262102 - DNA, 17 bp, Homo sapiens
ctccttggcttacctga

SEQ ID NO: 3262103 - DNA, 21 bp, Homo sapiens
ctccttggcttacctgacctc

SEQ ID NO: 3262104 - DNA, 16 bp, Homo sapiens
ctccttgggctcctgg

SEQ ID NO: 3262105 - DNA, 21 bp, Homo sapiens
ctccttgggtcattgacctct

SEQ ID NO: 3262106 - DNA, 16 bp, Homo sapiens
ctccttgtaaagactg

SEQ ID NO: 3262107 - DNA, 21 bp, Homo sapiens
ctccttgtctagtttcccaca

SEQ ID NO: 3262108 - DNA, 22 bp, Homo sapiens
ctccttgtctagtttcccacat

SEQ ID NO: 3262109 - DNA, 17 bp, Homo sapiens
ctcctttagcgcccagt

SEQ ID NO: 3262110 - DNA, 13 bp, Homo sapiens
ctcctttcacaac

SEQ ID NO: 3262111 - DNA, 18 bp, Homo sapiens
ctcctttcatcacactgg

SEQ ID NO: 3262112 - DNA, 14 bp, Homo sapiens
ctcctttctccagc

SEQ ID NO: 3262113 - DNA, 17 bp, Homo sapiens
ctcctttctccagccag

SEQ ID NO: 3262114 - DNA, 18 bp, Homo sapiens
ctcctttctccagccagc

SEQ ID NO: 3262115 - DNA, 19 bp, Homo sapiens
ctcctttctccagccagca

SEQ ID NO: 3262116 - DNA, 21 bp, Homo sapiens
ctcctttctccagccagcaat

SEQ ID NO: 3262117 - DNA, 15 bp, Homo sapiens
ctcctttctcctgtg

SEQ ID NO: 3262118 - DNA, 14 bp, Homo sapiens
ctcctttctgtgcc

SEQ ID NO: 3262119 - DNA, 19 bp, Homo sapiens
ctcctttctttttcttctt

SEQ ID NO: 3262120 - DNA, 14 bp, Homo sapiens
ctcctttgctcttg

SEQ ID NO: 3262121 - DNA, 22 bp, Homo sapiens
ctccttttatctggtgcctcct

SEQ ID NO: 3262122 - DNA, 23 bp, Homo sapiens
ctccttttatctggtgcctcctc

SEQ ID NO: 3262123 - DNA, 21 bp, Homo sapiens
ctccttttcttttgttactgt

SEQ ID NO: 3262124 - DNA, 23 bp, Homo sapiens
ctccttttcttttgttactgttc

SEQ ID NO: 3262125 - DNA, 17 bp, Homo sapiens
ctccttttgtatcttcc

SEQ ID NO: 3262126 - DNA, 18 bp, Homo sapiens
ctccttttgtatcttcct

SEQ ID NO: 3262127 - DNA, 13 bp, Homo sapiens
ctcctttttccat

SEQ ID NO: 3262128 - DNA, 14 bp, Homo sapiens
ctcgaaacacagaa

SEQ ID NO: 3262129 - DNA, 20 bp, Homo sapiens
ctcgaaacacagaaaccttt

SEQ ID NO: 3262130 - DNA, 23 bp, Homo sapiens
ctcgaaccaaggcagcctccaga

SEQ ID NO: 3262131 - DNA, 14 bp, Homo sapiens
ctcgaactggctgc

SEQ ID NO: 3262132 - DNA, 15 bp, Homo sapiens
ctcgaactggctgca

SEQ ID NO: 3262133 - DNA, 17 bp, Homo sapiens
ctcgaagcgcgccactc

SEQ ID NO: 3262134 - DNA, 13 bp, Homo sapiens
ctcgaatctctgt

SEQ ID NO: 3262135 - DNA, 14 bp, Homo sapiens
ctcgaatctgtgtg

SEQ ID NO: 3262136 - DNA, 14 bp, Homo sapiens
ctcgagcagagaga

SEQ ID NO: 3262137 - DNA, 22 bp, Homo sapiens
ctcgagcctgggtgacagggca

SEQ ID NO: 3262138 - DNA, 14 bp, Homo sapiens
ctcgaggcaccggc

SEQ ID NO: 3262139 - DNA, 18 bp, Homo sapiens
ctcgaggcaccggcgctg

SEQ ID NO: 3262140 - DNA, 20 bp, Homo sapiens
ctcgaggcaccggcgctgca

SEQ ID NO: 3262141 - DNA, 21 bp, Homo sapiens
ctcgaggcaccggcgctgcag

SEQ ID NO: 3262142 - DNA, 19 bp, Homo sapiens
ctcgaggggtgggctggta

SEQ ID NO: 3262143 - DNA, 12 bp, Homo sapiens
ctcgagtgaatt

SEQ ID NO: 3262144 - DNA, 14 bp, Homo sapiens
ctcgatccaaattg

SEQ ID NO: 3262145 - DNA, 13 bp, Homo sapiens
ctcgatctcctga

SEQ ID NO: 3262146 - DNA, 16 bp, Homo sapiens
ctcgcacccccctgtt

SEQ ID NO: 3262147 - DNA, 22 bp, Homo sapiens
ctccggggtctgtgctgtgcct

SEQ ID NO: 3262148 - DNA, 17 bp, Homo sapiens
ctccggggtggccacag

SEQ ID NO: 3262149 - DNA, 16 bp, Homo sapiens
ctccgggtgtggcctc

SEQ ID NO: 3262150 - DNA, 18 bp, Homo sapiens
ctccgggtgtggcctcag

SEQ ID NO: 3262151 - DNA, 21 bp, Homo sapiens
ctccgggtgtggcctcagccc

SEQ ID NO: 3262152 - DNA, 18 bp, Homo sapiens
ctccggtgtgcctgcagc

SEQ ID NO: 3262153 - DNA, 19 bp, Homo sapiens
ctccggtgtgcctgcagcc

SEQ ID NO: 3262154 - DNA, 23 bp, Homo sapiens
ctccggtgtgcctgcagccccgc

SEQ ID NO: 3262155 - DNA, 16 bp, Homo sapiens
ctccgtccacccaggc

SEQ ID NO: 3262156 - DNA, 19 bp, Homo sapiens
ctccgtccacccaggctgc

SEQ ID NO: 3262157 - DNA, 23 bp, Homo sapiens
ctccgtccacccaggctgcactg

SEQ ID NO: 3262158 - DNA, 22 bp, Homo sapiens
ctccgtccagccgccattgcca

SEQ ID NO: 3262159 - DNA, 14 bp, Homo sapiens
ctccgtgcctccac

SEQ ID NO: 3262160 - DNA, 15 bp, Homo sapiens
ctccgtgcctccacc

SEQ ID NO: 3262161 - DNA, 16 bp, Homo sapiens
ctccgtgcctccacca

SEQ ID NO: 3262162 - DNA, 16 bp, Homo sapiens
ctccgttagctcctgt

SEQ ID NO: 3262163 - DNA, 18 bp, Homo sapiens
ctccgttagctcctgtgg

SEQ ID NO: 3262164 - DNA, 22 bp, Homo sapiens
ctccgttagctcctgtggcccc

SEQ ID NO: 3262165 - DNA, 12 bp, Homo sapiens
ctccgttggcca

SEQ ID NO: 3262166 - DNA, 18 bp, Homo sapiens
ctcctaactccaccgcct

SEQ ID NO: 3262167 - DNA, 20 bp, Homo sapiens
ctcctaactgccagccccct

SEQ ID NO: 3262168 - DNA, 16 bp, Homo sapiens
ctcctaatttgtttct

SEQ ID NO: 3262169 - DNA, 20 bp, Homo sapiens
ctcctacaagatttagaaaa

SEQ ID NO: 3262170 - DNA, 22 bp, Homo sapiens
ctcctaccgaaaccttgccttt

SEQ ID NO: 3262171 - DNA, 14 bp, Homo sapiens
ctcctacctcagcc

SEQ ID NO: 3262172 - DNA, 18 bp, Homo sapiens
ctcctacctcagcctaga

SEQ ID NO: 3262173 - DNA, 20 bp, Homo sapiens
ctcctacctgccctggaaca

SEQ ID NO: 3262174 - DNA, 13 bp, Homo sapiens
ctcctacctggta

SEQ ID NO: 3262175 - DNA, 13 bp, Homo sapiens
ctcctactcctga

SEQ ID NO: 3262176 - DNA, 14 bp, Homo sapiens
ctcctactcctgac

SEQ ID NO: 3262177 - DNA, 19 bp, Homo sapiens
ctcctagaggtgggcagct

SEQ ID NO: 3262178 - DNA, 20 bp, Homo sapiens
ctcctagaggtgggcagctg

SEQ ID NO: 3262179 - DNA, 21 bp, Homo sapiens
ctcctagaggtgggcagctgg

SEQ ID NO: 3262180 - DNA, 23 bp, Homo sapiens
ctcctagcagacagaaactggat

SEQ ID NO: 3262181 - DNA, 13 bp, Homo sapiens
ctcctaggagagc

SEQ ID NO: 3262182 - DNA, 20 bp, Homo sapiens
ctcctagggaaaagttcata

SEQ ID NO: 3262183 - DNA, 18 bp, Homo sapiens
ctcctaggttcttaagga

SEQ ID NO: 3262184 - DNA, 23 bp, Homo sapiens
ctcctagtttgacctcacagtga

SEQ ID NO: 3262185 - DNA, 16 bp, Homo sapiens
ctcctataatctgtca

SEQ ID NO: 3262186 - DNA, 17 bp, Homo sapiens
ctcctataatctgtcaa

SEQ ID NO: 3262187 - DNA, 14 bp, Homo sapiens
ctcctatatatttc

SEQ ID NO: 3262188 - DNA, 22 bp, Homo sapiens
ctcctatcagaagtttctcagc

SEQ ID NO: 3262189 - DNA, 15 bp, Homo sapiens
ctcctatctgtgttt

SEQ ID NO: 3262190 - DNA, 18 bp, Homo sapiens
ctcctatctgtgttttga

SEQ ID NO: 3262191 - DNA, 15 bp, Homo sapiens
ctcctattctataaa

SEQ ID NO: 3262192 - DNA, 19 bp, Homo sapiens
ctcctatttttgtaaactg

SEQ ID NO: 3262193 - DNA, 20 bp, Homo sapiens
ctcctcaacccctcccctcc

SEQ ID NO: 3262194 - DNA, 17 bp, Homo sapiens
ctcctcacccccagctt

SEQ ID NO: 3262195 - DNA, 20 bp, Homo sapiens
ctcctcacccccagctttgc

SEQ ID NO: 3262196 - DNA, 14 bp, Homo sapiens
ctcctcacctcatg

SEQ ID NO: 3262197 - DNA, 17 bp, Homo sapiens
ctcctcacctcatgccc

SEQ ID NO: 3262198 - DNA, 15 bp, Homo sapiens
ctcctcacctgtcta

SEQ ID NO: 3262199 - DNA, 13 bp, Homo sapiens
ctcctcactctgt

SEQ ID NO: 3262200 - DNA, 15 bp, Homo sapiens
ctcctcactctgtcc

SEQ ID NO: 3262201 - DNA, 23 bp, Homo sapiens
ctcctcactctgtccctgtcctt

SEQ ID NO: 3262202 - DNA, 17 bp, Homo sapiens
ctcctcactgcccgcac

SEQ ID NO: 3262203 - DNA, 20 bp, Homo sapiens
ctcctcactggccatccctc

SEQ ID NO: 3262204 - DNA, 16 bp, Homo sapiens
ctcctcactgtatcca

SEQ ID NO: 3262205 - DNA, 19 bp, Homo sapiens
ctcctcagcccccaggcca

SEQ ID NO: 3262206 - DNA, 23 bp, Homo sapiens
ctcctcagcccccaggccaggtg

SEQ ID NO: 3262207 - DNA, 19 bp, Homo sapiens
ctcctcaggcacacagcta

SEQ ID NO: 3262208 - DNA, 16 bp, Homo sapiens
ctcctccacagtgctg

SEQ ID NO: 3262209 - DNA, 16 bp, Homo sapiens
ctcctccagcccctgt

SEQ ID NO: 3262210 - DNA, 19 bp, Homo sapiens
ctcctccaggcctgcctcc

SEQ ID NO: 3262211 - DNA, 21 bp, Homo sapiens
ctcctccagggtgattttatg

SEQ ID NO: 3262212 - DNA, 16 bp, Homo sapiens
ctcctcccagcgtgtg

SEQ ID NO: 3262213 - DNA, 19 bp, Homo sapiens
ctcctcccagcgtgtgtat

SEQ ID NO: 3262214 - DNA, 12 bp, Homo sapiens
ctcctcccagct

SEQ ID NO: 3262215 - DNA, 14 bp, Homo sapiens
ctcctcccagcttg

SEQ ID NO: 3262216 - DNA, 22 bp, Homo sapiens
ctcctcccaggcgccccttccc

SEQ ID NO: 3262217 - DNA, 12 bp, Homo sapiens
ctcctcccccac

SEQ ID NO: 3262218 - DNA, 21 bp, Homo sapiens
ctcctcccccaccccttaggc

SEQ ID NO: 3262219 - DNA, 15 bp, Homo sapiens
ctcctcccggtgccc

SEQ ID NO: 3262220 - DNA, 14 bp, Homo sapiens
ctcctccctgcccc

SEQ ID NO: 3262221 - DNA, 17 bp, Homo sapiens
ctcctccctgcccccca

SEQ ID NO: 3262222 - DNA, 12 bp, Homo sapiens
ctcctccctggc

SEQ ID NO: 3262223 - DNA, 18 bp, Homo sapiens
ctcctccctggctgccct

SEQ ID NO: 3262224 - DNA, 13 bp, Homo sapiens
ctcctcccttcct

SEQ ID NO: 3262225 - DNA, 21 bp, Homo sapiens
ctcctcccttccttttccctg

SEQ ID NO: 3262226 - DNA, 12 bp, Homo sapiens
ctcctcctcgga

SEQ ID NO: 3262227 - DNA, 12 bp, Homo sapiens
ctcctcctgccc

SEQ ID NO: 3262228 - DNA, 22 bp, Homo sapiens
ctcctcggaaccgctcacctag

SEQ ID NO: 3262229 - DNA, 21 bp, Homo sapiens
ctcctcggagagcagcagcac

SEQ ID NO: 3262230 - DNA, 16 bp, Homo sapiens
ctcctcggggctccag

SEQ ID NO: 3262231 - DNA, 17 bp, Homo sapiens
ctcctctagctgtgggg

SEQ ID NO: 3262232 - DNA, 19 bp, Homo sapiens
ctcctctagctgtgggggt

SEQ ID NO: 3262233 - DNA, 18 bp, Homo sapiens
ctcctctcacctctccct

SEQ ID NO: 3262234 - DNA, 14 bp, Homo sapiens
ctcctctcagtgtt

SEQ ID NO: 3262235 - DNA, 13 bp, Homo sapiens
ctcctctccaggc

SEQ ID NO: 3262236 - DNA, 22 bp, Homo sapiens
ctcctctcccacagagtgctgg

SEQ ID NO: 3262237 - DNA, 23 bp, Homo sapiens
ctcctctcccatccccctgccct

SEQ ID NO: 3262238 - DNA, 18 bp, Homo sapiens
ctcctctccctcacaagc

SEQ ID NO: 3262239 - DNA, 16 bp, Homo sapiens
ctcctctccttgggct

SEQ ID NO: 3262240 - DNA, 9 bp, Homo sapiens
ctcctctct

SEQ ID NO: 3262241 - DNA, 11 bp, Homo sapiens
ctcctctctgc

SEQ ID NO: 3262242 - DNA, 15 bp, Homo sapiens
ctcctctctgggcct

SEQ ID NO: 3262243 - DNA, 17 bp, Homo sapiens
ctcctctgcagtgcctt

SEQ ID NO: 3262244 - DNA, 13 bp, Homo sapiens
ctcctctgggcct

SEQ ID NO: 3262245 - DNA, 18 bp, Homo sapiens
ctcctctgtcctgcttct

SEQ ID NO: 3262246 - DNA, 19 bp, Homo sapiens
ctcctcttcccccttccaa

SEQ ID NO: 3262247 - DNA, 16 bp, Homo sapiens
ctcctcttgccactgc

SEQ ID NO: 3262248 - DNA, 20 bp, Homo sapiens
ctcctgaaccgcacagctca

SEQ ID NO: 3262249 - DNA, 21 bp, Homo sapiens
ctcctgaaccgcacagctcag

SEQ ID NO: 3262250 - DNA, 14 bp, Homo sapiens
ctcctgacagaagg

SEQ ID NO: 3262251 - DNA, 16 bp, Homo sapiens
ctcctgacagaaggtg

SEQ ID NO: 3262252 - DNA, 19 bp, Homo sapiens
ctcctgacagaaggtgcca

SEQ ID NO: 3262253 - DNA, 16 bp, Homo sapiens
ctcctgacccagtccc

SEQ ID NO: 3262254 - DNA, 15 bp, Homo sapiens
ctcctgacctcaagt

SEQ ID NO: 3262255 - DNA, 15 bp, Homo sapiens
ctcctgactgtaaca

SEQ ID NO: 3262256 - DNA, 18 bp, Homo sapiens
ctcctgagaaaggtgagg

SEQ ID NO: 3262257 - DNA, 17 bp, Homo sapiens
ctcctgagaaggcgagg

SEQ ID NO: 3262258 - DNA, 18 bp, Homo sapiens
ctcctgagaaggcgagga

SEQ ID NO: 3262259 - DNA, 19 bp, Homo sapiens
ctcctgagcctgtgggtcc

SEQ ID NO: 3262260 - DNA, 16 bp, Homo sapiens
ctcctgaggggcatct

SEQ ID NO: 3262261 - DNA, 23 bp, Homo sapiens
ctcctgataaaacaacagctcga

SEQ ID NO: 3262262 - DNA, 14 bp, Homo sapiens
ctcctgatggccaa

SEQ ID NO: 3262263 - DNA, 15 bp, Homo sapiens
ctcctgatggccaag

SEQ ID NO: 3262264 - DNA, 17 bp, Homo sapiens
ctcctgatggccaagag

SEQ ID NO: 3262265 - DNA, 15 bp, Homo sapiens
ctcctgattttgtag

SEQ ID NO: 3262266 - DNA, 14 bp, Homo sapiens
ctcctgcactgttt

SEQ ID NO: 3262267 - DNA, 22 bp, Homo sapiens
ctcctgcacttacttgcttatt

SEQ ID NO: 3262268 - DNA, 18 bp, Homo sapiens
ctcctgcagacacctgga

SEQ ID NO: 3262269 - DNA, 14 bp, Homo sapiens
ctcctgcagaccac

SEQ ID NO: 3262270 - DNA, 14 bp, Homo sapiens
ctcctgcagcatgg

SEQ ID NO: 3262271 - DNA, 16 bp, Homo sapiens
ctcctgccacaacaga

SEQ ID NO: 3262272 - DNA, 18 bp, Homo sapiens
ctcctgccacaacagaat

SEQ ID NO: 3262273 - DNA, 21 bp, Homo sapiens
ctcctgccacaacagaataaa

SEQ ID NO: 3262274 - DNA, 22 bp, Homo sapiens
ctcctgccacatggagccccct

SEQ ID NO: 3262275 - DNA, 15 bp, Homo sapiens
ctcctgccaccagca

SEQ ID NO: 3262276 - DNA, 20 bp, Homo sapiens
ctcccgaatagctgggacta

SEQ ID NO: 3262277 - DNA, 14 bp, Homo sapiens
ctcccgctcccagg

SEQ ID NO: 3262278 - DNA, 17 bp, Homo sapiens
ctcccggcatgggaaag

SEQ ID NO: 3262279 - DNA, 20 bp, Homo sapiens
ctcccggctatgggggcact

SEQ ID NO: 3262280 - DNA, 15 bp, Homo sapiens
ctcccggctgcctgc

SEQ ID NO: 3262281 - DNA, 16 bp, Homo sapiens
ctcccggctgcctgcc

SEQ ID NO: 3262282 - DNA, 17 bp, Homo sapiens
ctcccggctgcctgccg

SEQ ID NO: 3262283 - DNA, 19 bp, Homo sapiens
ctcccgggccacgccccag

SEQ ID NO: 3262284 - DNA, 23 bp, Homo sapiens
ctcccgggccacgccccagcccg

SEQ ID NO: 3262285 - DNA, 19 bp, Homo sapiens
ctcccgggttcaagtgatt

SEQ ID NO: 3262286 - DNA, 21 bp, Homo sapiens
ctcccggtgcccaagaataga

SEQ ID NO: 3262287 - DNA, 18 bp, Homo sapiens
ctcccgtagtctcctggg

SEQ ID NO: 3262288 - DNA, 19 bp, Homo sapiens
ctcccgtcagggcccaagt

SEQ ID NO: 3262289 - DNA, 19 bp, Homo sapiens
ctccctaatttatgtgcta

SEQ ID NO: 3262290 - DNA, 17 bp, Homo sapiens
ctccctatcaagcacta

SEQ ID NO: 3262291 - DNA, 17 bp, Homo sapiens
ctccctcagcctcagag

SEQ ID NO: 3262292 - DNA, 18 bp, Homo sapiens
ctccctcagcctcagagg

SEQ ID NO: 3262293 - DNA, 22 bp, Homo sapiens
ctccctccccacacctccctac

SEQ ID NO: 3262294 - DNA, 14 bp, Homo sapiens
ctccctcccctgcc

SEQ ID NO: 3262295 - DNA, 18 bp, Homo sapiens
ctccctcccctgccattt

SEQ ID NO: 3262296 - DNA, 18 bp, Homo sapiens
ctccctcccctgccctgg

SEQ ID NO: 3262297 - DNA, 21 bp, Homo sapiens
ctccctcccgtagtctcctgg

SEQ ID NO: 3262298 - DNA, 17 bp, Homo sapiens
ctccctcctcacctctg

SEQ ID NO: 3262299 - DNA, 21 bp, Homo sapiens
ctccctcctcacctctggact

SEQ ID NO: 3262300 - DNA, 14 bp, Homo sapiens
ctccctcctccagg

SEQ ID NO: 3262301 - DNA, 19 bp, Homo sapiens
ctccctccttccttcttgc

SEQ ID NO: 3262302 - DNA, 17 bp, Homo sapiens
ctccctcgacagcgccc

SEQ ID NO: 3262303 - DNA, 21 bp, Homo sapiens
ctccctcgacagcgcccctgc

SEQ ID NO: 3262304 - DNA, 23 bp, Homo sapiens
ctccctcgacagcgcccctgctg

SEQ ID NO: 3262305 - DNA, 12 bp, Homo sapiens
ctccctctccca

SEQ ID NO: 3262306 - DNA, 13 bp, Homo sapiens
ctccctctccctg

SEQ ID NO: 3262307 - DNA, 11 bp, Homo sapiens
ctccctctctc

SEQ ID NO: 3262308 - DNA, 13 bp, Homo sapiens
ctccctctctctt

SEQ ID NO: 3262309 - DNA, 17 bp, Homo sapiens
ctccctctctcttctgc

SEQ ID NO: 3262310 - DNA, 22 bp, Homo sapiens
ctccctctctcttctgctccac

SEQ ID NO: 3262311 - DNA, 21 bp, Homo sapiens
ctccctctgacctgcaggcca

SEQ ID NO: 3262312 - DNA, 12 bp, Homo sapiens
ctccctctgccc

SEQ ID NO: 3262313 - DNA, 20 bp, Homo sapiens
ctccctctgccccaagcagc

SEQ ID NO: 3262314 - DNA, 18 bp, Homo sapiens
ctccctcttcactgtggc

SEQ ID NO: 3262315 - DNA, 13 bp, Homo sapiens
ctccctcttccaa

SEQ ID NO: 3262316 - DNA, 14 bp, Homo sapiens
ctccctcttctcaa

SEQ ID NO: 3262317 - DNA, 15 bp, Homo sapiens
ctccctcttctcaag

SEQ ID NO: 3262318 - DNA, 21 bp, Homo sapiens
ctccctgaaaatgtttttctg

SEQ ID NO: 3262319 - DNA, 23 bp, Homo sapiens
ctccctgaaaatgtttttctgcc

SEQ ID NO: 3262320 - DNA, 16 bp, Homo sapiens
ctccctgaagccagcc

SEQ ID NO: 3262321 - DNA, 19 bp, Homo sapiens
ctccctgaagccagccttc

SEQ ID NO: 3262322 - DNA, 12 bp, Homo sapiens
ctccctgagctt

SEQ ID NO: 3262323 - DNA, 16 bp, Homo sapiens
ctccctgcagatgcca

SEQ ID NO: 3262324 - DNA, 23 bp, Homo sapiens
ctccctgcagatgccaccctagc

SEQ ID NO: 3262325 - DNA, 21 bp, Homo sapiens
ctccctgccaagtctcagaag

SEQ ID NO: 3262326 - DNA, 14 bp, Homo sapiens
ctccctgcccaggc

SEQ ID NO: 3262327 - DNA, 13 bp, Homo sapiens
ctccctgcccccc

SEQ ID NO: 3262328 - DNA, 14 bp, Homo sapiens
ctccctgcccctcc

SEQ ID NO: 3262329 - DNA, 20 bp, Homo sapiens
ctccctgcccctcccttcaa

SEQ ID NO: 3262330 - DNA, 12 bp, Homo sapiens
ctccctgcctgg

SEQ ID NO: 3262331 - DNA, 13 bp, Homo sapiens
ctccctgctcagt

SEQ ID NO: 3262332 - DNA, 18 bp, Homo sapiens
ctccctgctcagtgcttg

SEQ ID NO: 3262333 - DNA, 14 bp, Homo sapiens
ctccctgctccacg

SEQ ID NO: 3262334 - DNA, 13 bp, Homo sapiens
ctccctgctgtgc

SEQ ID NO: 3262335 - DNA, 23 bp, Homo sapiens
ctccctgctgtgccatgctgggc

SEQ ID NO: 3262336 - DNA, 15 bp, Homo sapiens
ctccctgctttggct

SEQ ID NO: 3262337 - DNA, 19 bp, Homo sapiens
ctccctgctttggctgagg

SEQ ID NO: 3262338 - DNA, 20 bp, Homo sapiens
ctccctgctttggctgaggg

SEQ ID NO: 3262339 - DNA, 22 bp, Homo sapiens
ctccctgctttggctgaggggc

SEQ ID NO: 3262340 - DNA, 11 bp, Homo sapiens
ctccctggagc

SEQ ID NO: 3262341 - DNA, 14 bp, Homo sapiens
ctccctggagccct

SEQ ID NO: 3262342 - DNA, 16 bp, Homo sapiens
ctccctggagccctgt

SEQ ID NO: 3262343 - DNA, 17 bp, Homo sapiens
ctccctggcagacacaa

SEQ ID NO: 3262344 - DNA, 16 bp, Homo sapiens
ctccctggcaggatgc

SEQ ID NO: 3262345 - DNA, 20 bp, Homo sapiens
ctccctggcaggatgctgag

SEQ ID NO: 3262346 - DNA, 12 bp, Homo sapiens
ctccctggctcc

SEQ ID NO: 3262347 - DNA, 18 bp, Homo sapiens
ctccctggctctcagaag

SEQ ID NO: 3262348 - DNA, 20 bp, Homo sapiens
ctccctggctctcagaaggt

SEQ ID NO: 3262349 - DNA, 13 bp, Homo sapiens
ctccctggctgcc

SEQ ID NO: 3262350 - DNA, 19 bp, Homo sapiens
ctccctggctgccctggcc

SEQ ID NO: 3262351 - DNA, 21 bp, Homo sapiens
ctccctggctgccctggccct

SEQ ID NO: 3262352 - DNA, 15 bp, Homo sapiens
ctccctgtacagtgt

SEQ ID NO: 3262353 - DNA, 15 bp, Homo sapiens
ctccctgtctctgca

SEQ ID NO: 3262354 - DNA, 17 bp, Homo sapiens
ctccctgtgggggtggc

SEQ ID NO: 3262355 - DNA, 21 bp, Homo sapiens
ctccctgtgggggtggccatc

SEQ ID NO: 3262356 - DNA, 24 bp, Homo sapiens
ctccctgtgggggtggccatccct

SEQ ID NO: 3262357 - DNA, 12 bp, Homo sapiens
ctccctgtttga

SEQ ID NO: 3262358 - DNA, 21 bp, Homo sapiens
ctccctgtttgaagcctgccc

SEQ ID NO: 3262359 - DNA, 22 bp, Homo sapiens
ctccctgtttgaagcctgccct

SEQ ID NO: 3262360 - DNA, 22 bp, Homo sapiens
ctcccttatgtccaccacttca

SEQ ID NO: 3262361 - DNA, 18 bp, Homo sapiens
ctcccttcaaccattccc

SEQ ID NO: 3262362 - DNA, 22 bp, Homo sapiens
ctcccttcaaccattccccatg

SEQ ID NO: 3262363 - DNA, 23 bp, Homo sapiens
ctcccttcaaccattccccatgg

SEQ ID NO: 3262364 - DNA, 20 bp, Homo sapiens
ctcccttcaagacgaggggc

SEQ ID NO: 3262365 - DNA, 19 bp, Homo sapiens
ctcccttcaatgctagaaa

SEQ ID NO: 3262366 - DNA, 13 bp, Homo sapiens
ctcccttcagccc

SEQ ID NO: 3262367 - DNA, 18 bp, Homo sapiens
ctcccttcagcccccagc

SEQ ID NO: 3262368 - DNA, 23 bp, Homo sapiens
ctcccttccgaccctctgggaac

SEQ ID NO: 3262369 - DNA, 17 bp, Homo sapiens
ctcccttcctctctcct

SEQ ID NO: 3262370 - DNA, 19 bp, Homo sapiens
ctcccttcctctctcctta

SEQ ID NO: 3262371 - DNA, 15 bp, Homo sapiens
ctcccttcctggcct

SEQ ID NO: 3262372 - DNA, 21 bp, Homo sapiens
ctcccttctctacactcttgt

SEQ ID NO: 3262373 - DNA, 23 bp, Homo sapiens
ctcccttgctggccccagccctg

SEQ ID NO: 3262374 - DNA, 15 bp, Homo sapiens
ctccctttcactaaa

SEQ ID NO: 3262375 - DNA, 14 bp, Homo sapiens
ctccctttcccttc

SEQ ID NO: 3262376 - DNA, 15 bp, Homo sapiens
ctccctttctctctc

SEQ ID NO: 3262377 - DNA, 18 bp, Homo sapiens
ctccctttctctctcctc

SEQ ID NO: 3262378 - DNA, 16 bp, Homo sapiens
ctccgaccctcatggc

SEQ ID NO: 3262379 - DNA, 15 bp, Homo sapiens
ctccgagacagtcca

SEQ ID NO: 3262380 - DNA, 18 bp, Homo sapiens
ctccgagacagtccagtg

SEQ ID NO: 3262381 - DNA, 16 bp, Homo sapiens
ctccgagagggagaga

SEQ ID NO: 3262382 - DNA, 18 bp, Homo sapiens
ctccgagaggtgggccag

SEQ ID NO: 3262383 - DNA, 13 bp, Homo sapiens
ctccgaggccagt

SEQ ID NO: 3262384 - DNA, 23 bp, Homo sapiens
ctccgcagtgcctgcaggggagc

SEQ ID NO: 3262385 - DNA, 21 bp, Homo sapiens
ctccgcccccagcctatgagc

SEQ ID NO: 3262386 - DNA, 13 bp, Homo sapiens
ctccgcccctgcc

SEQ ID NO: 3262387 - DNA, 14 bp, Homo sapiens
ctccgcccttagtc

SEQ ID NO: 3262388 - DNA, 13 bp, Homo sapiens
ctccgcctgggat

SEQ ID NO: 3262389 - DNA, 19 bp, Homo sapiens
ctccgccttcactccggtg

SEQ ID NO: 3262390 - DNA, 14 bp, Homo sapiens
ctccgcggctggag

SEQ ID NO: 3262391 - DNA, 14 bp, Homo sapiens
ctccgctcccaccg

SEQ ID NO: 3262392 - DNA, 17 bp, Homo sapiens
ctccgctcccaccgccc

SEQ ID NO: 3262393 - DNA, 12 bp, Homo sapiens
ctccgctgctcc

SEQ ID NO: 3262394 - DNA, 18 bp, Homo sapiens
ctccgctgctccttggct

SEQ ID NO: 3262395 - DNA, 12 bp, Homo sapiens
ctccgctggctt

SEQ ID NO: 3262396 - DNA, 22 bp, Homo sapiens
ctccgctttctacccagcgagc

SEQ ID NO: 3262397 - DNA, 14 bp, Homo sapiens
ctccggactggtgc

SEQ ID NO: 3262398 - DNA, 16 bp, Homo sapiens
ctccggactggtgccc

SEQ ID NO: 3262399 - DNA, 13 bp, Homo sapiens
ctccggagagaga

SEQ ID NO: 3262400 - DNA, 20 bp, Homo sapiens
ctccggagagagagagagga

SEQ ID NO: 3262401 - DNA, 12 bp, Homo sapiens
ctccgggcaaat

SEQ ID NO: 3262402 - DNA, 16 bp, Homo sapiens
ctccggggtctgtgct

SEQ ID NO: 3262403 - DNA, 17 bp, Homo sapiens
ctccggggtctgtgctg

SEQ ID NO: 3262404 - DNA, 21 bp, Homo sapiens
ctccggggtctgtgctgtgcc

SEQ ID NO: 3262405 - DNA, 18 bp, Homo sapiens
ctcccacggcacctcggg

SEQ ID NO: 3262406 - DNA, 15 bp, Homo sapiens
ctcccacgtgggaga

SEQ ID NO: 3262407 - DNA, 15 bp, Homo sapiens
ctcccagaatcccag

SEQ ID NO: 3262408 - DNA, 16 bp, Homo sapiens
ctcccagaatcccagc

SEQ ID NO: 3262409 - DNA, 17 bp, Homo sapiens
ctcccagaatcccagcc

SEQ ID NO: 3262410 - DNA, 20 bp, Homo sapiens
ctcccagaatcccagccggc

SEQ ID NO: 3262411 - DNA, 19 bp, Homo sapiens
ctcccagaggagccaccag

SEQ ID NO: 3262412 - DNA, 16 bp, Homo sapiens
ctcccagaggtccagc

SEQ ID NO: 3262413 - DNA, 22 bp, Homo sapiens
ctcccagaggtccagcccatct

SEQ ID NO: 3262414 - DNA, 23 bp, Homo sapiens
ctcccagaggtccagcccatctc

SEQ ID NO: 3262415 - DNA, 21 bp, Homo sapiens
ctcccagatcagtcagagccc

SEQ ID NO: 3262416 - DNA, 17 bp, Homo sapiens
ctcccagcaagacctca

SEQ ID NO: 3262417 - DNA, 19 bp, Homo sapiens
ctcccagcagccctaagga

SEQ ID NO: 3262418 - DNA, 18 bp, Homo sapiens
ctcccagccctatggatg

SEQ ID NO: 3262419 - DNA, 13 bp, Homo sapiens
ctcccagcctgcc

SEQ ID NO: 3262420 - DNA, 24 bp, Homo sapiens
ctcccagcctgccctccagctgct

SEQ ID NO: 3262421 - DNA, 15 bp, Homo sapiens
ctcccagcctgctga

SEQ ID NO: 3262422 - DNA, 15 bp, Homo sapiens
ctcccagctcctttc

SEQ ID NO: 3262423 - DNA, 23 bp, Homo sapiens
ctcccagctcctttctcctgtga

SEQ ID NO: 3262424 - DNA, 19 bp, Homo sapiens
ctcccagcttgtaggagct

SEQ ID NO: 3262425 - DNA, 17 bp, Homo sapiens
ctcccaggcgccccttc

SEQ ID NO: 3262426 - DNA, 22 bp, Homo sapiens
ctcccaggcgccccttccccct

SEQ ID NO: 3262427 - DNA, 16 bp, Homo sapiens
ctcccagggccagggc

SEQ ID NO: 3262428 - DNA, 23 bp, Homo sapiens
ctcccagggccagggccctgcag

SEQ ID NO: 3262429 - DNA, 16 bp, Homo sapiens
ctcccaggggtctccc

SEQ ID NO: 3262430 - DNA, 20 bp, Homo sapiens
ctcccaggggtctccctggc

SEQ ID NO: 3262431 - DNA, 22 bp, Homo sapiens
ctcccaggggtctccctggctc

SEQ ID NO: 3262432 - DNA, 19 bp, Homo sapiens
ctcccaggtaccagctgcg

SEQ ID NO: 3262433 - DNA, 21 bp, Homo sapiens
ctcccaggtgttaacattcca

SEQ ID NO: 3262434 - DNA, 19 bp, Homo sapiens
ctcccaggttcccccagca

SEQ ID NO: 3262435 - DNA, 20 bp, Homo sapiens
ctcccagtccaaatgtcctc

SEQ ID NO: 3262436 - DNA, 22 bp, Homo sapiens
ctcccataattgctttgccaaa

SEQ ID NO: 3262437 - DNA, 16 bp, Homo sapiens
ctcccatcacttccct

SEQ ID NO: 3262438 - DNA, 23 bp, Homo sapiens
ctcccatcatgcccggtcccacc

SEQ ID NO: 3262439 - DNA, 12 bp, Homo sapiens
ctcccatccccc

SEQ ID NO: 3262440 - DNA, 16 bp, Homo sapiens
ctcccatccccctgcc

SEQ ID NO: 3262441 - DNA, 18 bp, Homo sapiens
ctcccatccccctgccct

SEQ ID NO: 3262442 - DNA, 19 bp, Homo sapiens
ctcccatccccctgccctc

SEQ ID NO: 3262443 - DNA, 15 bp, Homo sapiens
ctcccatcccctgga

SEQ ID NO: 3262444 - DNA, 16 bp, Homo sapiens
ctcccatcctggggca

SEQ ID NO: 3262445 - DNA, 21 bp, Homo sapiens
ctcccatcctggggcagcact

SEQ ID NO: 3262446 - DNA, 13 bp, Homo sapiens
ctcccatctggga

SEQ ID NO: 3262447 - DNA, 22 bp, Homo sapiens
ctcccatctgggagtccccttt

SEQ ID NO: 3262448 - DNA, 14 bp, Homo sapiens
ctcccatgtatgga

SEQ ID NO: 3262449 - DNA, 19 bp, Homo sapiens
ctcccattaggacaatcag

SEQ ID NO: 3262450 - DNA, 15 bp, Homo sapiens
ctcccattcctccct

SEQ ID NO: 3262451 - DNA, 21 bp, Homo sapiens
ctcccatttcaggaatttaaa

SEQ ID NO: 3262452 - DNA, 16 bp, Homo sapiens
ctcccattttggaatt

SEQ ID NO: 3262453 - DNA, 13 bp, Homo sapiens
ctcccatttttac

SEQ ID NO: 3262454 - DNA, 14 bp, Homo sapiens
ctcccatttttact

SEQ ID NO: 3262455 - DNA, 15 bp, Homo sapiens
ctcccatttttactt

SEQ ID NO: 3262456 - DNA, 21 bp, Homo sapiens
ctccccaaatcaatacactag

SEQ ID NO: 3262457 - DNA, 15 bp, Homo sapiens
ctccccaacccccaa

SEQ ID NO: 3262458 - DNA, 21 bp, Homo sapiens
ctccccacaccttccagggcc

SEQ ID NO: 3262459 - DNA, 21 bp, Homo sapiens
ctccccacactaacctgggtt

SEQ ID NO: 3262460 - DNA, 11 bp, Homo sapiens
ctccccacagc

SEQ ID NO: 3262461 - DNA, 17 bp, Homo sapiens
ctccccacagcctctgg

SEQ ID NO: 3262462 - DNA, 20 bp, Homo sapiens
ctccccacagcctctggctc

SEQ ID NO: 3262463 - DNA, 15 bp, Homo sapiens
ctccccacccacccc

SEQ ID NO: 3262464 - DNA, 21 bp, Homo sapiens
ctccccacccaccccacgccc

SEQ ID NO: 3262465 - DNA, 21 bp, Homo sapiens
ctccccacgagtcacctgcaa

SEQ ID NO: 3262466 - DNA, 13 bp, Homo sapiens
ctccccactctag

SEQ ID NO: 3262467 - DNA, 12 bp, Homo sapiens
ctccccactgaa

SEQ ID NO: 3262468 - DNA, 23 bp, Homo sapiens
ctccccagaattcacgcctctcc

SEQ ID NO: 3262469 - DNA, 17 bp, Homo sapiens
ctccccagagcactggg

SEQ ID NO: 3262470 - DNA, 13 bp, Homo sapiens
ctccccagagctg

SEQ ID NO: 3262471 - DNA, 16 bp, Homo sapiens
ctccccagatctccca

SEQ ID NO: 3262472 - DNA, 12 bp, Homo sapiens
ctccccagcaag

SEQ ID NO: 3262473 - DNA, 21 bp, Homo sapiens
ctccccagcaagtgagagctg

SEQ ID NO: 3262474 - DNA, 22 bp, Homo sapiens
ctccccagcaagtgagagctgg

SEQ ID NO: 3262475 - DNA, 21 bp, Homo sapiens
ctccccagcattccagcccct

SEQ ID NO: 3262476 - DNA, 22 bp, Homo sapiens
ctccccagcattccagcccctc

SEQ ID NO: 3262477 - DNA, 16 bp, Homo sapiens
ctccccagccccaccc

SEQ ID NO: 3262478 - DNA, 17 bp, Homo sapiens
ctccccagcccctagcc

SEQ ID NO: 3262479 - DNA, 15 bp, Homo sapiens
ctccccagccctggc

SEQ ID NO: 3262480 - DNA, 13 bp, Homo sapiens
ctccccaggcctc

SEQ ID NO: 3262481 - DNA, 14 bp, Homo sapiens
ctccccaggcctcc

SEQ ID NO: 3262482 - DNA, 18 bp, Homo sapiens
ctccccaggcctccagcc

SEQ ID NO: 3262483 - DNA, 20 bp, Homo sapiens
ctccccaggcctccagcctc

SEQ ID NO: 3262484 - DNA, 12 bp, Homo sapiens
ctccccagggct

SEQ ID NO: 3262485 - DNA, 17 bp, Homo sapiens
ctccccaggtccagctc

SEQ ID NO: 3262486 - DNA, 21 bp, Homo sapiens
ctccccagtacaggggtgctg

SEQ ID NO: 3262487 - DNA, 11 bp, Homo sapiens
ctccccagtgt

SEQ ID NO: 3262488 - DNA, 15 bp, Homo sapiens
ctccccatgccacgt

SEQ ID NO: 3262489 - DNA, 12 bp, Homo sapiens
ctccccatggag

SEQ ID NO: 3262490 - DNA, 17 bp, Homo sapiens
ctccccatggagccagc

SEQ ID NO: 3262491 - DNA, 20 bp, Homo sapiens
ctccccatgtgcctgcacca

SEQ ID NO: 3262492 - DNA, 18 bp, Homo sapiens
ctccccatgtgtcctggt

SEQ ID NO: 3262493 - DNA, 20 bp, Homo sapiens
ctccccatttcccatctgca

SEQ ID NO: 3262494 - DNA, 17 bp, Homo sapiens
ctcccccaacccacctc

SEQ ID NO: 3262495 - DNA, 23 bp, Homo sapiens
ctcccccaacccccaccccacac

SEQ ID NO: 3262496 - DNA, 16 bp, Homo sapiens
ctcccccagacacagc

SEQ ID NO: 3262497 - DNA, 18 bp, Homo sapiens
ctccccccgcccacccac

SEQ ID NO: 3262498 - DNA, 16 bp, Homo sapiens
ctcccccgacactgct

SEQ ID NO: 3262499 - DNA, 18 bp, Homo sapiens
ctcccccgcagtccccag

SEQ ID NO: 3262500 - DNA, 22 bp, Homo sapiens
ctccccctaaacccctgtccca

SEQ ID NO: 3262501 - DNA, 12 bp, Homo sapiens
ctccccctcaac

SEQ ID NO: 3262502 - DNA, 13 bp, Homo sapiens
ctccccctcaacc

SEQ ID NO: 3262503 - DNA, 14 bp, Homo sapiens
ctccccctgcaact

SEQ ID NO: 3262504 - DNA, 23 bp, Homo sapiens
ctccccctgggctctgccccagc

SEQ ID NO: 3262505 - DNA, 15 bp, Homo sapiens
ctccccgcctggcca

SEQ ID NO: 3262506 - DNA, 14 bp, Homo sapiens
ctccccgcctgttc

SEQ ID NO: 3262507 - DNA, 17 bp, Homo sapiens
ctccccgcctgttcccc

SEQ ID NO: 3262508 - DNA, 18 bp, Homo sapiens
ctccccgcctgttccccc

SEQ ID NO: 3262509 - DNA, 16 bp, Homo sapiens
ctccccgctaaggaag

SEQ ID NO: 3262510 - DNA, 14 bp, Homo sapiens
ctccccgcttctgc

SEQ ID NO: 3262511 - DNA, 15 bp, Homo sapiens
ctccccggacatact

SEQ ID NO: 3262512 - DNA, 17 bp, Homo sapiens
ctccccggcaccctctg

SEQ ID NO: 3262513 - DNA, 22 bp, Homo sapiens
ctccccgtgtcctctccctgcc

SEQ ID NO: 3262514 - DNA, 15 bp, Homo sapiens
ctcccctcacagcct

SEQ ID NO: 3262515 - DNA, 18 bp, Homo sapiens
ctcccctcacagcctctg

SEQ ID NO: 3262516 - DNA, 20 bp, Homo sapiens
ctcccctcacagcctctgac

SEQ ID NO: 3262517 - DNA, 14 bp, Homo sapiens
ctcccctccagcct

SEQ ID NO: 3262518 - DNA, 13 bp, Homo sapiens
ctcccctcccctg

SEQ ID NO: 3262519 - DNA, 15 bp, Homo sapiens
ctcccctcccctgct

SEQ ID NO: 3262520 - DNA, 15 bp, Homo sapiens
ctcccctccttgtct

SEQ ID NO: 3262521 - DNA, 16 bp, Homo sapiens
ctcccctctccttcct

SEQ ID NO: 3262522 - DNA, 15 bp, Homo sapiens
ctcccctctcttgca

SEQ ID NO: 3262523 - DNA, 18 bp, Homo sapiens
ctcccctgccaccaggcc

SEQ ID NO: 3262524 - DNA, 16 bp, Homo sapiens
ctcccctgccctgctg

SEQ ID NO: 3262525 - DNA, 13 bp, Homo sapiens
ctcccctgctgca

SEQ ID NO: 3262526 - DNA, 16 bp, Homo sapiens
ctcccctgctgcaggg

SEQ ID NO: 3262527 - DNA, 14 bp, Homo sapiens
ctcccctgtacctt

SEQ ID NO: 3262528 - DNA, 19 bp, Homo sapiens
ctccccttcctcactgccc

SEQ ID NO: 3262529 - DNA, 23 bp, Homo sapiens
ctccccttgatttaaacacacag

SEQ ID NO: 3262530 - DNA, 22 bp, Homo sapiens
ctccccttgccttcccctgtct

SEQ ID NO: 3262531 - DNA, 22 bp, Homo sapiens
ctcccctttccctcgctatgtg

SEQ ID NO: 3262532 - DNA, 16 bp, Homo sapiens
ctcccgaatagctggg

SEQ ID NO: 3262533 - DNA, 17 bp, Homo sapiens
ctcccgaatagctggga

SEQ ID NO: 3262534 - DNA, 13 bp, Homo sapiens
cctgccagctgcc

SEQ ID NO: 3262535 - DNA, 15 bp, Homo sapiens
cctgccaggcagggg

SEQ ID NO: 3262536 - DNA, 19 bp, Homo sapiens
cctgccaggcaggggtggg

SEQ ID NO: 3262537 - DNA, 15 bp, Homo sapiens
cctgccatgccagga

SEQ ID NO: 3262538 - DNA, 18 bp, Homo sapiens
cctgccatgggccagcct

SEQ ID NO: 3262539 - DNA, 20 bp, Homo sapiens
cctgccatgggccagcctag

SEQ ID NO: 3262540 - DNA, 22 bp, Homo sapiens
cctgccatgggccagcctagcc

SEQ ID NO: 3262541 - DNA, 14 bp, Homo sapiens
cctgccatttaaaa

SEQ ID NO: 3262542 - DNA, 18 bp, Homo sapiens
cctgccatttaaaaagtt

SEQ ID NO: 3262543 - DNA, 23 bp, Homo sapiens
cctgccatttgcaccctccgcct

SEQ ID NO: 3262544 - DNA, 17 bp, Homo sapiens
cctgcccaaacccttaa

SEQ ID NO: 3262545 - DNA, 21 bp, Homo sapiens
cctgcccaaacccttaactga

SEQ ID NO: 3262546 - DNA, 23 bp, Homo sapiens
cctgcccaaacccttaactgaca

SEQ ID NO: 3262547 - DNA, 17 bp, Homo sapiens
cctgcccaagcccaggc

SEQ ID NO: 3262548 - DNA, 13 bp, Homo sapiens
cctgcccaatgct

SEQ ID NO: 3262549 - DNA, 22 bp, Homo sapiens
cctgcccaatgctttgggaggc

SEQ ID NO: 3262550 - DNA, 21 bp, Homo sapiens
cctgcccacaactcccttgca

SEQ ID NO: 3262551 - DNA, 15 bp, Homo sapiens
cctgcccaggccggc

SEQ ID NO: 3262552 - DNA, 23 bp, Homo sapiens
cctgcccagtgttgtttgtaaat

SEQ ID NO: 3262553 - DNA, 16 bp, Homo sapiens
cctgcccagttgcact

SEQ ID NO: 3262554 - DNA, 17 bp, Homo sapiens
cctgcccatgccccagt

SEQ ID NO: 3262555 - DNA, 22 bp, Homo sapiens
cctgcccatgtcgcgctcagca

SEQ ID NO: 3262556 - DNA, 16 bp, Homo sapiens
cctgcccatgtgtccc

SEQ ID NO: 3262557 - DNA, 19 bp, Homo sapiens
cctgcccatgtgtcccctc

SEQ ID NO: 3262558 - DNA, 22 bp, Homo sapiens
cctgcccatgtgtcccctcact

SEQ ID NO: 3262559 - DNA, 16 bp, Homo sapiens
cctgccccacacggac

SEQ ID NO: 3262560 - DNA, 14 bp, Homo sapiens
cctgccccagccca

SEQ ID NO: 3262561 - DNA, 18 bp, Homo sapiens
cctgccccagcccaagtc

SEQ ID NO: 3262562 - DNA, 18 bp, Homo sapiens
cctgcccccagccccggg

SEQ ID NO: 3262563 - DNA, 20 bp, Homo sapiens
cctgcccccatctccccagg

SEQ ID NO: 3262564 - DNA, 22 bp, Homo sapiens
cctgccccccagcctctggcat

SEQ ID NO: 3262565 - DNA, 19 bp, Homo sapiens
cctgccccccctaagagac

SEQ ID NO: 3262566 - DNA, 22 bp, Homo sapiens
cctgccccccctaagagacaca

SEQ ID NO: 3262567 - DNA, 12 bp, Homo sapiens
cctgccccctgg

SEQ ID NO: 3262568 - DNA, 14 bp, Homo sapiens
cctgccccctggct

SEQ ID NO: 3262569 - DNA, 19 bp, Homo sapiens
cctgccccctggctgactg

SEQ ID NO: 3262570 - DNA, 14 bp, Homo sapiens
cctgccccctggtg

SEQ ID NO: 3262571 - DNA, 15 bp, Homo sapiens
cctgccccctggtgg

SEQ ID NO: 3262572 - DNA, 16 bp, Homo sapiens
cctgccccgcccagct

SEQ ID NO: 3262573 - DNA, 23 bp, Homo sapiens
cctgcccctaggatgctgcagca

SEQ ID NO: 3262574 - DNA, 15 bp, Homo sapiens
cctgcccctcccttc

SEQ ID NO: 3262575 - DNA, 16 bp, Homo sapiens
cctgcccctcccttca

SEQ ID NO: 3262576 - DNA, 13 bp, Homo sapiens
cctgcccctgcaa

SEQ ID NO: 3262577 - DNA, 15 bp, Homo sapiens
cctgcccctgcaaag

SEQ ID NO: 3262578 - DNA, 21 bp, Homo sapiens
cctgcccctggtgccctgaga

SEQ ID NO: 3262579 - DNA, 16 bp, Homo sapiens
cctgccccttccttta

SEQ ID NO: 3262580 - DNA, 14 bp, Homo sapiens
cctgcccgctccca

SEQ ID NO: 3262581 - DNA, 15 bp, Homo sapiens
cctgcccgctcccaa

SEQ ID NO: 3262582 - DNA, 16 bp, Homo sapiens
cctgcccggctgcgga

SEQ ID NO: 3262583 - DNA, 20 bp, Homo sapiens
cctgccctacagaggtctct

SEQ ID NO: 3262584 - DNA, 14 bp, Homo sapiens
cctgccctccagct

SEQ ID NO: 3262585 - DNA, 20 bp, Homo sapiens
cctgccctccccagagcact

SEQ ID NO: 3262586 - DNA, 22 bp, Homo sapiens
cctgccctccccagagcactgg

SEQ ID NO: 3262587 - DNA, 12 bp, Homo sapiens
cctgccctcgtg

SEQ ID NO: 3262588 - DNA, 15 bp, Homo sapiens
cctgccctcgtggcc

SEQ ID NO: 3262589 - DNA, 16 bp, Homo sapiens
cctgccctcgtggcca

SEQ ID NO: 3262590 - DNA, 22 bp, Homo sapiens
cctgccctcgtggccagcccgg

SEQ ID NO: 3262591 - DNA, 15 bp, Homo sapiens
cctgccctctattta

SEQ ID NO: 3262592 - DNA, 13 bp, Homo sapiens
cctgccctggagg

SEQ ID NO: 3262593 - DNA, 21 bp, Homo sapiens
cctgccctgttgtgtatagat

SEQ ID NO: 3262594 - DNA, 20 bp, Homo sapiens
cctgccgagtgctctgatgc

SEQ ID NO: 3262595 - DNA, 14 bp, Homo sapiens
cctgccgcagacgg

SEQ ID NO: 3262596 - DNA, 19 bp, Homo sapiens
cctgccgcagacgggcaca

SEQ ID NO: 3262597 - DNA, 22 bp, Homo sapiens
cctgccgcagacgggcacagac

SEQ ID NO: 3262598 - DNA, 22 bp, Homo sapiens
cctgccggtgggaccctgtccg

SEQ ID NO: 3262599 - DNA, 16 bp, Homo sapiens
cctgcctaaccaggcc

SEQ ID NO: 3262600 - DNA, 19 bp, Homo sapiens
cctgcctaaccaggcccag

SEQ ID NO: 3262601 - DNA, 16 bp, Homo sapiens
cctgcctcaccctccc

SEQ ID NO: 3262602 - DNA, 11 bp, Homo sapiens
cctgcctcagt

SEQ ID NO: 3262603 - DNA, 17 bp, Homo sapiens
cctgcctcagtggcagc

SEQ ID NO: 3262604 - DNA, 18 bp, Homo sapiens
cctgcctcagtggcagca

SEQ ID NO: 3262605 - DNA, 20 bp, Homo sapiens
cctgcctcccacttcactgc

SEQ ID NO: 3262606 - DNA, 16 bp, Homo sapiens
cctgcctcccatgcct

SEQ ID NO: 3262607 - DNA, 13 bp, Homo sapiens
cctgcctcctggg

SEQ ID NO: 3262608 - DNA, 11 bp, Homo sapiens
cctgcctggcc

SEQ ID NO: 3262609 - DNA, 12 bp, Homo sapiens
cctgcctggcca

SEQ ID NO: 3262610 - DNA, 13 bp, Homo sapiens
cctgcctggccag

SEQ ID NO: 3262611 - DNA, 12 bp, Homo sapiens
cctgcctggccc

SEQ ID NO: 3262612 - DNA, 15 bp, Homo sapiens
cctgcctggcccctc

SEQ ID NO: 3262613 - DNA, 13 bp, Homo sapiens
cctgcctgggtgg

SEQ ID NO: 3262614 - DNA, 15 bp, Homo sapiens
cctgcctgggtggga

SEQ ID NO: 3262615 - DNA, 19 bp, Homo sapiens
cctgcctgggtgggacagc

SEQ ID NO: 3262616 - DNA, 21 bp, Homo sapiens
cctgcctgggtgggacagcct

SEQ ID NO: 3262617 - DNA, 12 bp, Homo sapiens
cctgcctgggtt

SEQ ID NO: 3262618 - DNA, 18 bp, Homo sapiens
cctgcctgggttgggggc

SEQ ID NO: 3262619 - DNA, 23 bp, Homo sapiens
cctgcctgtggcgccgtctccag

SEQ ID NO: 3262620 - DNA, 22 bp, Homo sapiens
cctgcctgttcccattcttgca

SEQ ID NO: 3262621 - DNA, 19 bp, Homo sapiens
cctgccttgaagccactga

SEQ ID NO: 3262622 - DNA, 22 bp, Homo sapiens
cctgccttgaagccactgaagc

SEQ ID NO: 3262623 - DNA, 15 bp, Homo sapiens
ctcactggctggggc

SEQ ID NO: 3262624 - DNA, 13 bp, Homo sapiens
ctcactgggtggg

SEQ ID NO: 3262625 - DNA, 21 bp, Homo sapiens
ctcactgtcgcccaggctgga

SEQ ID NO: 3262626 - DNA, 10 bp, Homo sapiens
ctcactgtga

SEQ ID NO: 3262627 - DNA, 23 bp, Homo sapiens
ctcactgtgggaaggccagctgc

SEQ ID NO: 3262628 - DNA, 23 bp, Homo sapiens
ctcactgtgtcacccagactgga

SEQ ID NO: 3262629 - DNA, 14 bp, Homo sapiens
ctcactgttctgca

SEQ ID NO: 3262630 - DNA, 14 bp, Homo sapiens
ctcactgttgccca

SEQ ID NO: 3262631 - DNA, 18 bp, Homo sapiens
ctcactgttgcccaggct

SEQ ID NO: 3262632 - DNA, 19 bp, Homo sapiens
ctcactgttgcccaggctg

SEQ ID NO: 3262633 - DNA, 18 bp, Homo sapiens
ctcactgttgtgaatcac

SEQ ID NO: 3262634 - DNA, 14 bp, Homo sapiens
ctcacttgccttag

SEQ ID NO: 3262635 - DNA, 16 bp, Homo sapiens
ctcactttccaccaag

SEQ ID NO: 3262636 - DNA, 20 bp, Homo sapiens
ctcactttcctcctgaggct

SEQ ID NO: 3262637 - DNA, 16 bp, Homo sapiens
ctcacttttcatctgg

SEQ ID NO: 3262638 - DNA, 19 bp, Homo sapiens
ctcacttttgaatctataa

SEQ ID NO: 3262639 - DNA, 18 bp, Homo sapiens
ctcactttttacccagaa

SEQ ID NO: 3262640 - DNA, 21 bp, Homo sapiens
ctcactttttttttttgtttg

SEQ ID NO: 3262641 - DNA, 20 bp, Homo sapiens
ctcagaaagaggtctcccca

SEQ ID NO: 3262642 - DNA, 20 bp, Homo sapiens
ctcagaaagtcaccaggact

SEQ ID NO: 3262643 - DNA, 15 bp, Homo sapiens
ctcagaaagtgcctg

SEQ ID NO: 3262644 - DNA, 18 bp, Homo sapiens
ctcagaaagtgcctgaca

SEQ ID NO: 3262645 - DNA, 22 bp, Homo sapiens
ctcagaaagtgcctgacacact

SEQ ID NO: 3262646 - DNA, 16 bp, Homo sapiens
ctcagaacccagggct

SEQ ID NO: 3262647 - DNA, 13 bp, Homo sapiens
ctcagaagaaaga

SEQ ID NO: 3262648 - DNA, 17 bp, Homo sapiens
ctcagaagacactgatg

SEQ ID NO: 3262649 - DNA, 20 bp, Homo sapiens
ctcagaagacactgatgggc

SEQ ID NO: 3262650 - DNA, 23 bp, Homo sapiens
ctcagaagacactgatgggcaac

SEQ ID NO: 3262651 - DNA, 19 bp, Homo sapiens
ctcagaaggtattcctttt

SEQ ID NO: 3262652 - DNA, 17 bp, Homo sapiens
ctcagaataaggcaggc

SEQ ID NO: 3262653 - DNA, 12 bp, Homo sapiens
ctcagaatattg

SEQ ID NO: 3262654 - DNA, 18 bp, Homo sapiens
ctcagaatattgtctgcc

SEQ ID NO: 3262655 - DNA, 16 bp, Homo sapiens
ctcagaatctcaaata

SEQ ID NO: 3262656 - DNA, 17 bp, Homo sapiens
ctcagaatctcaaataa

SEQ ID NO: 3262657 - DNA, 17 bp, Homo sapiens
ctcagaatgtaaaagaa

SEQ ID NO: 3262658 - DNA, 17 bp, Homo sapiens
ctcagaattatttttaa

SEQ ID NO: 3262659 - DNA, 23 bp, Homo sapiens
ctcagacactgccgacatcagca

SEQ ID NO: 3262660 - DNA, 23 bp, Homo sapiens
ctcagacggcggccaggcacagg

SEQ ID NO: 3262661 - DNA, 17 bp, Homo sapiens
ctcagacttttgtacat

SEQ ID NO: 3262662 - DNA, 23 bp, Homo sapiens
ctcagagaaaaatgctccccaca

SEQ ID NO: 3262663 - DNA, 23 bp, Homo sapiens
ctcagagaatttctaccatttca

SEQ ID NO: 3262664 - DNA, 21 bp, Homo sapiens
ctcagagacctgaagtgtgca

SEQ ID NO: 3262665 - DNA, 13 bp, Homo sapiens
ctcagagcagagc

SEQ ID NO: 3262666 - DNA, 17 bp, Homo sapiens
ctcagagcatctggctg

SEQ ID NO: 3262667 - DNA, 15 bp, Homo sapiens
ctcagagccaagtcc

SEQ ID NO: 3262668 - DNA, 15 bp, Homo sapiens
ctcagagccctgccc

SEQ ID NO: 3262669 - DNA, 15 bp, Homo sapiens
ctcagagcttgaaga

SEQ ID NO: 3262670 - DNA, 22 bp, Homo sapiens
ctcagaggagctctaccctgct

SEQ ID NO: 3262671 - DNA, 16 bp, Homo sapiens
ctcagaggcagcttca

SEQ ID NO: 3262672 - DNA, 17 bp, Homo sapiens
ctcagaggcagcttcaa

SEQ ID NO: 3262673 - DNA, 22 bp, Homo sapiens
ctcagaggcagcttcaagtgcc

SEQ ID NO: 3262674 - DNA, 14 bp, Homo sapiens
ctcagaggcctgct

SEQ ID NO: 3262675 - DNA, 15 bp, Homo sapiens
ctcagaggcctgctg

SEQ ID NO: 3262676 - DNA, 16 bp, Homo sapiens
ctcagagtccactgtg

SEQ ID NO: 3262677 - DNA, 12 bp, Homo sapiens
ctcagatataag

SEQ ID NO: 3262678 - DNA, 17 bp, Homo sapiens
ctcagatatttatattt

SEQ ID NO: 3262679 - DNA, 16 bp, Homo sapiens
ctcagatgaggacaga

SEQ ID NO: 3262680 - DNA, 16 bp, Homo sapiens
ctcagcaaggggctct

SEQ ID NO: 3262681 - DNA, 12 bp, Homo sapiens
ctcagcacccct

SEQ ID NO: 3262682 - DNA, 14 bp, Homo sapiens
ctcagcagtgacca

SEQ ID NO: 3262683 - DNA, 16 bp, Homo sapiens
ctcagcatcctggcac

SEQ ID NO: 3262684 - DNA, 17 bp, Homo sapiens
ctcagcatcctggcacc

SEQ ID NO: 3262685 - DNA, 12 bp, Homo sapiens
ctcagccaagct

SEQ ID NO: 3262686 - DNA, 19 bp, Homo sapiens
ctcagccacgaccagcccc

SEQ ID NO: 3262687 - DNA, 15 bp, Homo sapiens
ctcagcccacctgca

SEQ ID NO: 3262688 - DNA, 16 bp, Homo sapiens
ctcagcccacctgcac

SEQ ID NO: 3262689 - DNA, 18 bp, Homo sapiens
ctcagcccacctgcaccc

SEQ ID NO: 3262690 - DNA, 20 bp, Homo sapiens
ctcagcccacctgcacccag

SEQ ID NO: 3262691 - DNA, 22 bp, Homo sapiens
ctcagcccacctgcacccaggt

SEQ ID NO: 3262692 - DNA, 20 bp, Homo sapiens
ctcagcccagaagaaaattc

SEQ ID NO: 3262693 - DNA, 12 bp, Homo sapiens
ctcagcccctag

SEQ ID NO: 3262694 - DNA, 14 bp, Homo sapiens
ctcagcccctagga

SEQ ID NO: 3262695 - DNA, 16 bp, Homo sapiens
ctcagcccgctgagtg

SEQ ID NO: 3262696 - DNA, 13 bp, Homo sapiens
ctcagccctgagg

SEQ ID NO: 3262697 - DNA, 13 bp, Homo sapiens
ctcagcctcagag

SEQ ID NO: 3262698 - DNA, 16 bp, Homo sapiens
ctcagcctcccaaagt

SEQ ID NO: 3262699 - DNA, 21 bp, Homo sapiens
ctcagcctcccaaagtgctgg

SEQ ID NO: 3262700 - DNA, 20 bp, Homo sapiens
ctcagcctcccagagtgctg

SEQ ID NO: 3262701 - DNA, 21 bp, Homo sapiens
ctcagcctcccgaatagctgg

SEQ ID NO: 3262702 - DNA, 20 bp, Homo sapiens
ctcagcctccggagtagctg

SEQ ID NO: 3262703 - DNA, 13 bp, Homo sapiens
ctcagcctcctga

SEQ ID NO: 3262704 - DNA, 16 bp, Homo sapiens
ctcagcctcctgagcc

SEQ ID NO: 3262705 - DNA, 19 bp, Homo sapiens
ctcagcctcctgagcctgt

SEQ ID NO: 3262706 - DNA, 14 bp, Homo sapiens
ctcagcctgctgcc

SEQ ID NO: 3262707 - DNA, 16 bp, Homo sapiens
ctcagccttacatttg

SEQ ID NO: 3262708 - DNA, 17 bp, Homo sapiens
ctcagccttcagacaga

SEQ ID NO: 3262709 - DNA, 19 bp, Homo sapiens
ctcagcgctcctcctgtgt

SEQ ID NO: 3262710 - DNA, 20 bp, Homo sapiens
ctcagcggggacagctcctt

SEQ ID NO: 3262711 - DNA, 14 bp, Homo sapiens
ctcagctcaatgca

SEQ ID NO: 3262712 - DNA, 17 bp, Homo sapiens
ctcagctcagcgccagc

SEQ ID NO: 3262713 - DNA, 10 bp, Homo sapiens
ctcagctccc

SEQ ID NO: 3262714 - DNA, 15 bp, Homo sapiens
ctcagctcccaaggc

SEQ ID NO: 3262715 - DNA, 12 bp, Homo sapiens
ctcagctccccc

SEQ ID NO: 3262716 - DNA, 13 bp, Homo sapiens
ctcagctcctggg

SEQ ID NO: 3262717 - DNA, 13 bp, Homo sapiens
ctcagctctctgg

SEQ ID NO: 3262718 - DNA, 14 bp, Homo sapiens
ctcagctctctggg

SEQ ID NO: 3262719 - DNA, 14 bp, Homo sapiens
ctcagctctgggag

SEQ ID NO: 3262720 - DNA, 16 bp, Homo sapiens
ctcagctctgggagag

SEQ ID NO: 3262721 - DNA, 18 bp, Homo sapiens
ctcagctctgggagagga

SEQ ID NO: 3262722 - DNA, 16 bp, Homo sapiens
ctcagctcttccatga

SEQ ID NO: 3262723 - DNA, 16 bp, Homo sapiens
ctcagctgcctcactt

SEQ ID NO: 3262724 - DNA, 18 bp, Homo sapiens
ctcagctgcctcacttcc

SEQ ID NO: 3262725 - DNA, 13 bp, Homo sapiens
ctcagctggaagt

SEQ ID NO: 3262726 - DNA, 15 bp, Homo sapiens
ctcagctggctgtat

SEQ ID NO: 3262727 - DNA, 18 bp, Homo sapiens
ctcagctgtcctgcagca

SEQ ID NO: 3262728 - DNA, 14 bp, Homo sapiens
ctcagcttatctct

SEQ ID NO: 3262729 - DNA, 16 bp, Homo sapiens
ctcagctttgagaagc

SEQ ID NO: 3262730 - DNA, 17 bp, Homo sapiens
ctcaggaagaagagatg

SEQ ID NO: 3262731 - DNA, 14 bp, Homo sapiens
ctcaggaattcagt

SEQ ID NO: 3262732 - DNA, 17 bp, Homo sapiens
ctcaggaattccaatta

SEQ ID NO: 3262733 - DNA, 13 bp, Homo sapiens
ctcaggacccagg

SEQ ID NO: 3262734 - DNA, 16 bp, Homo sapiens
ctcaggacccaggccc

SEQ ID NO: 3262735 - DNA, 17 bp, Homo sapiens
ctcaggacccaggccct

SEQ ID NO: 3262736 - DNA, 20 bp, Homo sapiens
ctcaggagatggagggcttg

SEQ ID NO: 3262737 - DNA, 12 bp, Homo sapiens
ctcaggagcaca

SEQ ID NO: 3262738 - DNA, 14 bp, Homo sapiens
ctcaggagcacagg

SEQ ID NO: 3262739 - DNA, 17 bp, Homo sapiens
ctcaggagcacaggcag

SEQ ID NO: 3262740 - DNA, 22 bp, Homo sapiens
ctcaggagcacaggcagctgga

SEQ ID NO: 3262741 - DNA, 16 bp, Homo sapiens
ctcaggaggcaggacc

SEQ ID NO: 3262742 - DNA, 18 bp, Homo sapiens
ctcaggccaggtgcagtg

SEQ ID NO: 3262743 - DNA, 16 bp, Homo sapiens
ctcaggcctaggaggc

SEQ ID NO: 3262744 - DNA, 17 bp, Homo sapiens
ctcaggcctaggaggcc

SEQ ID NO: 3262745 - DNA, 12 bp, Homo sapiens
ctcaggcctcca

SEQ ID NO: 3262746 - DNA, 21 bp, Homo sapiens
ctcaggcgatccacctgtctc

SEQ ID NO: 3262747 - DNA, 12 bp, Homo sapiens
ctcaggctctgc

SEQ ID NO: 3262748 - DNA, 14 bp, Homo sapiens
ctcaggctctgcac

SEQ ID NO: 3262749 - DNA, 23 bp, Homo sapiens
ctcaggctctgcacagacaagca

SEQ ID NO: 3262750 - DNA, 12 bp, Homo sapiens
ctcaggctcttg

SEQ ID NO: 3262751 - DNA, 24 bp, Homo sapiens
ctcaggctgctggggcctcagacg

SEQ ID NO: 3262752 - DNA, 17 bp, Homo sapiens
ctcaggctggtgggagg

SEQ ID NO: 3262753 - DNA, 14 bp, Homo sapiens
ctcagggacagagc

SEQ ID NO: 3262754 - DNA, 17 bp, Homo sapiens
ctcagggaccggtgctg

SEQ ID NO: 3262755 - DNA, 21 bp, Homo sapiens
ctcagggaccggtgctgcagg

SEQ ID NO: 3262756 - DNA, 18 bp, Homo sapiens
ctcagggagcagggaagg

SEQ ID NO: 3262757 - DNA, 22 bp, Homo sapiens
ctcagggagcagggaaggcctg

SEQ ID NO: 3262758 - DNA, 23 bp, Homo sapiens
ctcagggagcagggaaggcctga

SEQ ID NO: 3262759 - DNA, 13 bp, Homo sapiens
ctcagggagggag

SEQ ID NO: 3262760 - DNA, 18 bp, Homo sapiens
ctcagggattctgggctt

SEQ ID NO: 3262761 - DNA, 10 bp, Homo sapiens
ctcagggcac

SEQ ID NO: 3262762 - DNA, 19 bp, Homo sapiens
ctcagggcacgcaggacca

SEQ ID NO: 3262763 - DNA, 17 bp, Homo sapiens
ctcagggccaggaagga

SEQ ID NO: 3262764 - DNA, 20 bp, Homo sapiens
ctcagggccatgctgaggcc

SEQ ID NO: 3262765 - DNA, 13 bp, Homo sapiens
ctcagggcctggc

SEQ ID NO: 3262766 - DNA, 14 bp, Homo sapiens
ctcagggcctggca

SEQ ID NO: 3262767 - DNA, 15 bp, Homo sapiens
ctcagggcctggcag

SEQ ID NO: 3262768 - DNA, 18 bp, Homo sapiens
ctcagggcctggcaggcc

SEQ ID NO: 3262769 - DNA, 15 bp, Homo sapiens
ctcagggcgctcaga

SEQ ID NO: 3262770 - DNA, 19 bp, Homo sapiens
ctcagggcgctcagacggc

SEQ ID NO: 3262771 - DNA, 13 bp, Homo sapiens
ctcagggctccca

SEQ ID NO: 3262772 - DNA, 15 bp, Homo sapiens
ctcagggctcctccc

SEQ ID NO: 3262773 - DNA, 17 bp, Homo sapiens
ctcagggctcctcccag

SEQ ID NO: 3262774 - DNA, 23 bp, Homo sapiens
ctcagggctcctgccttctgtcc

SEQ ID NO: 3262775 - DNA, 11 bp, Homo sapiens
ctcagggctgg

SEQ ID NO: 3262776 - DNA, 15 bp, Homo sapiens
ctcagggctggagtg

SEQ ID NO: 3262777 - DNA, 22 bp, Homo sapiens
ctcagggctggagtgcgctctt

SEQ ID NO: 3262778 - DNA, 18 bp, Homo sapiens
ctcaggggaaaactgtta

SEQ ID NO: 3262779 - DNA, 13 bp, Homo sapiens
ctcaggggccaga

SEQ ID NO: 3262780 - DNA, 14 bp, Homo sapiens
ctcagggtgggggg

SEQ ID NO: 3262781 - DNA, 17 bp, Homo sapiens
ctcagggtggggggtga

SEQ ID NO: 3262782 - DNA, 15 bp, Homo sapiens
ctcagggttcatctg

SEQ ID NO: 3262783 - DNA, 16 bp, Homo sapiens
ctcagggttcatctgt

SEQ ID NO: 3262784 - DNA, 17 bp, Homo sapiens
ctcaggtacggagaaga

SEQ ID NO: 3262785 - DNA, 19 bp, Homo sapiens
ctcaggtcacataaaactt

SEQ ID NO: 3262786 - DNA, 18 bp, Homo sapiens
ctcaggtccctgcagggc

SEQ ID NO: 3262787 - DNA, 20 bp, Homo sapiens
ctcaggtgatccacccacct

SEQ ID NO: 3262788 - DNA, 20 bp, Homo sapiens
ctcaggtgccactccctgag

SEQ ID NO: 3262789 - DNA, 16 bp, Homo sapiens
ctcaggtgtccctgca

SEQ ID NO: 3262790 - DNA, 18 bp, Homo sapiens
ctcaggtgtccctgcact

SEQ ID NO: 3262791 - DNA, 19 bp, Homo sapiens
ctcaggtgtccctgcactt

SEQ ID NO: 3262792 - DNA, 15 bp, Homo sapiens
ctcaggtgttgccaa

SEQ ID NO: 3262793 - DNA, 12 bp, Homo sapiens
ctcaggttccta

SEQ ID NO: 3262794 - DNA, 21 bp, Homo sapiens
ctcaggttctattttcttaaa

SEQ ID NO: 3262795 - DNA, 16 bp, Homo sapiens
ctcaggttctttccat

SEQ ID NO: 3262796 - DNA, 12 bp, Homo sapiens
ctcagtaaacgg

SEQ ID NO: 3262797 - DNA, 21 bp, Homo sapiens
ctcagtaaacgggaacatgcc

SEQ ID NO: 3262798 - DNA, 19 bp, Homo sapiens
ctcagtaacatttctgttc

SEQ ID NO: 3262799 - DNA, 14 bp, Homo sapiens
ctcagtcatgcata

SEQ ID NO: 3262800 - DNA, 15 bp, Homo sapiens
ctcagtcatgcataa

SEQ ID NO: 3262801 - DNA, 16 bp, Homo sapiens
ctcagtcatgcataaa

SEQ ID NO: 3262802 - DNA, 23 bp, Homo sapiens
ctcagtcatgcataaatatgcag

SEQ ID NO: 3262803 - DNA, 18 bp, Homo sapiens
ctcagtcctcccctcaca

SEQ ID NO: 3262804 - DNA, 19 bp, Homo sapiens
ctcagtcctcccctcacag

SEQ ID NO: 3262805 - DNA, 22 bp, Homo sapiens
ctcagtcctcccctcacagcct

SEQ ID NO: 3262806 - DNA, 18 bp, Homo sapiens
ctcagtctaaggtctcat

SEQ ID NO: 3262807 - DNA, 13 bp, Homo sapiens
ctcagtctcagga

SEQ ID NO: 3262808 - DNA, 14 bp, Homo sapiens
ctcagtctcaggag

SEQ ID NO: 3262809 - DNA, 15 bp, Homo sapiens
ctcagtctccctttc

SEQ ID NO: 3262810 - DNA, 15 bp, Homo sapiens
ctcagtctcttccac

SEQ ID NO: 3262811 - DNA, 16 bp, Homo sapiens
ctcagtctcttccaca

SEQ ID NO: 3262812 - DNA, 13 bp, Homo sapiens
ctcagtgacccat

SEQ ID NO: 3262813 - DNA, 14 bp, Homo sapiens
ctcagtgcatttgt

SEQ ID NO: 3262814 - DNA, 17 bp, Homo sapiens
ctcagtgcttgggctcc

SEQ ID NO: 3262815 - DNA, 16 bp, Homo sapiens
ctcagtggcagcatcc

SEQ ID NO: 3262816 - DNA, 12 bp, Homo sapiens
ctcagtgttttg

SEQ ID NO: 3262817 - DNA, 16 bp, Homo sapiens
ctcagttaaaatgtga

SEQ ID NO: 3262818 - DNA, 23 bp, Homo sapiens
ctcagttcaacctggtggcacca

SEQ ID NO: 3262819 - DNA, 14 bp, Homo sapiens
ctcagttcccagct

SEQ ID NO: 3262820 - DNA, 18 bp, Homo sapiens
ctcagttcccagctcccc

SEQ ID NO: 3262821 - DNA, 15 bp, Homo sapiens
ctcagttctctccct

SEQ ID NO: 3262822 - DNA, 21 bp, Homo sapiens
ctcagttggaaataataaaag

SEQ ID NO: 3262823 - DNA, 15 bp, Homo sapiens
ctcagtttcttgctt

SEQ ID NO: 3262824 - DNA, 18 bp, Homo sapiens
ctcatacctttaaaggaa

SEQ ID NO: 3262825 - DNA, 13 bp, Homo sapiens
ctcatactgtctg

SEQ ID NO: 3262826 - DNA, 16 bp, Homo sapiens
ctcatagcattaacta

SEQ ID NO: 3262827 - DNA, 23 bp, Homo sapiens
ctcataggaaaagtacatttaat

SEQ ID NO: 3262828 - DNA, 17 bp, Homo sapiens
ctcataggagactgcgt

SEQ ID NO: 3262829 - DNA, 15 bp, Homo sapiens
ctcataggttaaaaa

SEQ ID NO: 3262830 - DNA, 22 bp, Homo sapiens
ctcataggttaaaaaaaaaagt

SEQ ID NO: 3262831 - DNA, 18 bp, Homo sapiens
ctcatagtatggtggctg

SEQ ID NO: 3262832 - DNA, 13 bp, Homo sapiens
ctcatatggccca

SEQ ID NO: 3262833 - DNA, 15 bp, Homo sapiens
ctcatatttaaagac

SEQ ID NO: 3262834 - DNA, 16 bp, Homo sapiens
ctcatattttgtatat

SEQ ID NO: 3262835 - DNA, 12 bp, Homo sapiens
ctcatcaggatg

SEQ ID NO: 3262836 - DNA, 13 bp, Homo sapiens
ctcatcaggatga

SEQ ID NO: 3262837 - DNA, 24 bp, Homo sapiens
ctcatcagtgtcctcttgctcaaa

SEQ ID NO: 3262838 - DNA, 12 bp, Homo sapiens
ctcatcataaaa

SEQ ID NO: 3262839 - DNA, 14 bp, Homo sapiens
ctcatcataaaata

SEQ ID NO: 3262840 - DNA, 15 bp, Homo sapiens
ctcatccaccccatc

SEQ ID NO: 3262841 - DNA, 14 bp, Homo sapiens
ctcatcccacgcac

SEQ ID NO: 3262842 - DNA, 14 bp, Homo sapiens
ctcatccccagggg

SEQ ID NO: 3262843 - DNA, 13 bp, Homo sapiens
ctcatcctccagt

SEQ ID NO: 3262844 - DNA, 23 bp, Homo sapiens
ctcatcctccagtaccttgcttc

SEQ ID NO: 3262845 - DNA, 18 bp, Homo sapiens
ctcatcctggcacgccct

SEQ ID NO: 3262846 - DNA, 21 bp, Homo sapiens
ctcatcctggcacgccctact

SEQ ID NO: 3262847 - DNA, 20 bp, Homo sapiens
ctcatctatgaggaaaggtt

SEQ ID NO: 3262848 - DNA, 17 bp, Homo sapiens
ctcatctcttcaggttc

SEQ ID NO: 3262849 - DNA, 14 bp, Homo sapiens
ctcatctgctggtc

SEQ ID NO: 3262850 - DNA, 15 bp, Homo sapiens
ctcatctgctggtcc

SEQ ID NO: 3262851 - DNA, 23 bp, Homo sapiens
ctcatctgtggagctgccacaga

SEQ ID NO: 3262852 - DNA, 19 bp, Homo sapiens
ctcatcttgaagggcccag

SEQ ID NO: 3262853 - DNA, 20 bp, Homo sapiens
ctcatcttgaagggcccagg

SEQ ID NO: 3262854 - DNA, 13 bp, Homo sapiens
ctcatcttgtgaa

SEQ ID NO: 3262855 - DNA, 16 bp, Homo sapiens
ctcatcttgttcttcc

SEQ ID NO: 3262856 - DNA, 17 bp, Homo sapiens
ctcatcttgttcttccc

SEQ ID NO: 3262857 - DNA, 15 bp, Homo sapiens
ctcatctttaaaatg

SEQ ID NO: 3262858 - DNA, 18 bp, Homo sapiens
ctcatgataccaccttta

SEQ ID NO: 3262859 - DNA, 15 bp, Homo sapiens
cggcaggccctgcag

SEQ ID NO: 3262860 - DNA, 14 bp, Homo sapiens
cggcaggctcactg

SEQ ID NO: 3262861 - DNA, 20 bp, Homo sapiens
cggcaggctcactgccaggc

SEQ ID NO: 3262862 - DNA, 14 bp, Homo sapiens
cggcagggccaggc

SEQ ID NO: 3262863 - DNA, 14 bp, Homo sapiens
cggcatttcaaatg

SEQ ID NO: 3262864 - DNA, 20 bp, Homo sapiens
cggccaaggtgccaccaccc

SEQ ID NO: 3262865 - DNA, 14 bp, Homo sapiens
cggccaatggaaac

SEQ ID NO: 3262866 - DNA, 16 bp, Homo sapiens
cggccacacccagcgg

SEQ ID NO: 3262867 - DNA, 17 bp, Homo sapiens
cggccacacccagcggc

SEQ ID NO: 3262868 - DNA, 19 bp, Homo sapiens
cggccacacccagcggccc

SEQ ID NO: 3262869 - DNA, 21 bp, Homo sapiens
cggccacagggcggtaccttg

SEQ ID NO: 3262870 - DNA, 16 bp, Homo sapiens
cggccaccagatgctg

SEQ ID NO: 3262871 - DNA, 11 bp, Homo sapiens
cggccacctct

SEQ ID NO: 3262872 - DNA, 13 bp, Homo sapiens
cggccacctctgc

SEQ ID NO: 3262873 - DNA, 18 bp, Homo sapiens
cggccacgcactgggcca

SEQ ID NO: 3262874 - DNA, 19 bp, Homo sapiens
cggccacgcactgggccac

SEQ ID NO: 3262875 - DNA, 15 bp, Homo sapiens
cggccagcgggcaca

SEQ ID NO: 3262876 - DNA, 18 bp, Homo sapiens
cggccagcgggcacaggg

SEQ ID NO: 3262877 - DNA, 21 bp, Homo sapiens
cggccagcgggcacagggcac

SEQ ID NO: 3262878 - DNA, 14 bp, Homo sapiens
cggccaggcacagg

SEQ ID NO: 3262879 - DNA, 15 bp, Homo sapiens
cggccaggcacaggg

SEQ ID NO: 3262880 - DNA, 16 bp, Homo sapiens
cggccaggcacagggc

SEQ ID NO: 3262881 - DNA, 17 bp, Homo sapiens
cggccaggcacagggcc

SEQ ID NO: 3262882 - DNA, 18 bp, Homo sapiens
cggccaggcacagggccc

SEQ ID NO: 3262883 - DNA, 11 bp, Homo sapiens
cggccaggcat

SEQ ID NO: 3262884 - DNA, 17 bp, Homo sapiens
cggcccagtgccactgc

SEQ ID NO: 3262885 - DNA, 18 bp, Homo sapiens
cggcccagtgccactgcc

SEQ ID NO: 3262886 - DNA, 20 bp, Homo sapiens
cggcccagtgccactgcccc

SEQ ID NO: 3262887 - DNA, 16 bp, Homo sapiens
cggccccagccagagt

SEQ ID NO: 3262888 - DNA, 22 bp, Homo sapiens
cggccccccgcgctcgcccagc

SEQ ID NO: 3262889 - DNA, 15 bp, Homo sapiens
cggccccggccccag

SEQ ID NO: 3262890 - DNA, 14 bp, Homo sapiens
cggcccggccagcg

SEQ ID NO: 3262891 - DNA, 22 bp, Homo sapiens
cggcccggccagcgggcacagg

SEQ ID NO: 3262892 - DNA, 15 bp, Homo sapiens
cggccgcagagactg

SEQ ID NO: 3262893 - DNA, 12 bp, Homo sapiens
cggccgctccag

SEQ ID NO: 3262894 - DNA, 13 bp, Homo sapiens
cggccggcctggc

SEQ ID NO: 3262895 - DNA, 12 bp, Homo sapiens
cggcctcagggc

SEQ ID NO: 3262896 - DNA, 21 bp, Homo sapiens
cggcctccactcccccacctg

SEQ ID NO: 3262897 - DNA, 17 bp, Homo sapiens
cggcctccatcctgagg

SEQ ID NO: 3262898 - DNA, 15 bp, Homo sapiens
cggcctcccaaagtg

SEQ ID NO: 3262899 - DNA, 22 bp, Homo sapiens
cggcctccgtccaggagcctgg

SEQ ID NO: 3262900 - DNA, 19 bp, Homo sapiens
cggcctctctcttcccagc

SEQ ID NO: 3262901 - DNA, 13 bp, Homo sapiens
cggcctctctggc

SEQ ID NO: 3262902 - DNA, 13 bp, Homo sapiens
cggcctcttccac

SEQ ID NO: 3262903 - DNA, 17 bp, Homo sapiens
cggcctcttccacccat

SEQ ID NO: 3262904 - DNA, 22 bp, Homo sapiens
cggcctctttttttcttttctt

SEQ ID NO: 3262905 - DNA, 16 bp, Homo sapiens
cggcctgatgctccct

SEQ ID NO: 3262906 - DNA, 14 bp, Homo sapiens
cggcctgctcccag

SEQ ID NO: 3262907 - DNA, 15 bp, Homo sapiens
cggcctgctcccagc

SEQ ID NO: 3262908 - DNA, 19 bp, Homo sapiens
cggcctgctcccagcagcc

SEQ ID NO: 3262909 - DNA, 17 bp, Homo sapiens
cggcctttgttgctcag

SEQ ID NO: 3262910 - DNA, 12 bp, Homo sapiens
cggcgccctgga

SEQ ID NO: 3262911 - DNA, 15 bp, Homo sapiens
cggcgccctggactt

SEQ ID NO: 3262912 - DNA, 16 bp, Homo sapiens
cggcgccctggacttg

SEQ ID NO: 3262913 - DNA, 22 bp, Homo sapiens
cggcgggcttttctggggccca

SEQ ID NO: 3262914 - DNA, 23 bp, Homo sapiens
cggcgtggtgtgtccctggacac

SEQ ID NO: 3262915 - DNA, 19 bp, Homo sapiens
cggctaatttttatatttt

SEQ ID NO: 3262916 - DNA, 15 bp, Homo sapiens
cggctcactgcagcc

SEQ ID NO: 3262917 - DNA, 17 bp, Homo sapiens
cggctcactgcagcctc

SEQ ID NO: 3262918 - DNA, 13 bp, Homo sapiens
cggctccagctca

SEQ ID NO: 3262919 - DNA, 12 bp, Homo sapiens
cggctccaggct

SEQ ID NO: 3262920 - DNA, 13 bp, Homo sapiens
cggctccaggctc

SEQ ID NO: 3262921 - DNA, 16 bp, Homo sapiens
cggctccaggctcctt

SEQ ID NO: 3262922 - DNA, 15 bp, Homo sapiens
cggctccccatgtgt

SEQ ID NO: 3262923 - DNA, 20 bp, Homo sapiens
cggctccccatgtgtcctgg

SEQ ID NO: 3262924 - DNA, 19 bp, Homo sapiens
cggctcgtgtatttattac

SEQ ID NO: 3262925 - DNA, 11 bp, Homo sapiens
cggctgaccat

SEQ ID NO: 3262926 - DNA, 15 bp, Homo sapiens
cggctgaccatgctc

SEQ ID NO: 3262927 - DNA, 20 bp, Homo sapiens
cggctgcagaggccagaggc

SEQ ID NO: 3262928 - DNA, 19 bp, Homo sapiens
cggctgcctgacactgagc

SEQ ID NO: 3262929 - DNA, 11 bp, Homo sapiens
cggctgcctgc

SEQ ID NO: 3262930 - DNA, 17 bp, Homo sapiens
cggctgcctgccgccca

SEQ ID NO: 3262931 - DNA, 20 bp, Homo sapiens
cggctgctcgcccaggaagg

SEQ ID NO: 3262932 - DNA, 12 bp, Homo sapiens
cggctggctctg

SEQ ID NO: 3262933 - DNA, 19 bp, Homo sapiens
cggctggctctgtggaggg

SEQ ID NO: 3262934 - DNA, 14 bp, Homo sapiens
cggctgggtctgtg

SEQ ID NO: 3262935 - DNA, 23 bp, Homo sapiens
cggctgtggaccgtggacaggcc

SEQ ID NO: 3262936 - DNA, 14 bp, Homo sapiens
cggctgtggagcaa

SEQ ID NO: 3262937 - DNA, 22 bp, Homo sapiens
cggctgtggagcaaaaggcagc

SEQ ID NO: 3262938 - DNA, 18 bp, Homo sapiens
ctaggcctggccagatgc

SEQ ID NO: 3262939 - DNA, 15 bp, Homo sapiens
ctaggcgtgagaagc

SEQ ID NO: 3262940 - DNA, 17 bp, Homo sapiens
ctagggaatctggatta

SEQ ID NO: 3262941 - DNA, 17 bp, Homo sapiens
ctagggagccatttgag

SEQ ID NO: 3262942 - DNA, 21 bp, Homo sapiens
ctagggaggaccttatctgtg

SEQ ID NO: 3262943 - DNA, 18 bp, Homo sapiens
ctagggattcaggctgct

SEQ ID NO: 3262944 - DNA, 18 bp, Homo sapiens
ctagggcacaaagacttc

SEQ ID NO: 3262945 - DNA, 17 bp, Homo sapiens
ctaggggaacagaccag

SEQ ID NO: 3262946 - DNA, 19 bp, Homo sapiens
ctaggggaacagaccagtg

SEQ ID NO: 3262947 - DNA, 20 bp, Homo sapiens
ctaggggaacagaccagtga

SEQ ID NO: 3262948 - DNA, 22 bp, Homo sapiens
ctaggggaacagaccagtgacc

SEQ ID NO: 3262949 - DNA, 23 bp, Homo sapiens
ctaggggagaagagccctggaca

SEQ ID NO: 3262950 - DNA, 18 bp, Homo sapiens
ctaggggtcaggctccat

SEQ ID NO: 3262951 - DNA, 21 bp, Homo sapiens
ctagggtctgataggaacaga

SEQ ID NO: 3262952 - DNA, 17 bp, Homo sapiens
ctagggtggcccttgca

SEQ ID NO: 3262953 - DNA, 18 bp, Homo sapiens
ctagggttgctggagcct

SEQ ID NO: 3262954 - DNA, 19 bp, Homo sapiens
ctagggttgctggagcctg

SEQ ID NO: 3262955 - DNA, 15 bp, Homo sapiens
ctagggtttcttaaa

SEQ ID NO: 3262956 - DNA, 22 bp, Homo sapiens
ctatatacatgtgtgtatatat

SEQ ID NO: 3262957 - DNA, 15 bp, Homo sapiens
ctatatagagatgtt

SEQ ID NO: 3262958 - DNA, 17 bp, Homo sapiens
ctatatataattctgta

SEQ ID NO: 3262959 - DNA, 13 bp, Homo sapiens
ctatatatataaa

SEQ ID NO: 3262960 - DNA, 14 bp, Homo sapiens
ctatatatataaat

SEQ ID NO: 3262961 - DNA, 14 bp, Homo sapiens
ctatatatatatgc

SEQ ID NO: 3262962 - DNA, 13 bp, Homo sapiens
ctatatatgtgta

SEQ ID NO: 3262963 - DNA, 15 bp, Homo sapiens
ctatatatgtgtatg

SEQ ID NO: 3262964 - DNA, 16 bp, Homo sapiens
ctatatatttctatta

SEQ ID NO: 3262965 - DNA, 20 bp, Homo sapiens
ctatatcatgctttaaagtg

SEQ ID NO: 3262966 - DNA, 18 bp, Homo sapiens
ctatatccatgtactgta

SEQ ID NO: 3262967 - DNA, 20 bp, Homo sapiens
ctatatccatgtactgtagt

SEQ ID NO: 3262968 - DNA, 21 bp, Homo sapiens
ctatatccatgtactgtagtt

SEQ ID NO: 3262969 - DNA, 14 bp, Homo sapiens
ctatatctatatat

SEQ ID NO: 3262970 - DNA, 15 bp, Homo sapiens
ctatatgaatttaaa

SEQ ID NO: 3262971 - DNA, 16 bp, Homo sapiens
ctatatgatttatagt

SEQ ID NO: 3262972 - DNA, 16 bp, Homo sapiens
ctatatgtacagctct

SEQ ID NO: 3262973 - DNA, 16 bp, Homo sapiens
ctatatgtccatttaa

SEQ ID NO: 3262974 - DNA, 17 bp, Homo sapiens
ctatatgtttacacaat

SEQ ID NO: 3262975 - DNA, 13 bp, Homo sapiens
ctatattaatcac

SEQ ID NO: 3262976 - DNA, 18 bp, Homo sapiens
ctatattaatcaccttct

SEQ ID NO: 3262977 - DNA, 16 bp, Homo sapiens
ctatattatgtcttct

SEQ ID NO: 3262978 - DNA, 17 bp, Homo sapiens
ctatattatgtcttctt

SEQ ID NO: 3262979 - DNA, 14 bp, Homo sapiens
ctatattattatat

SEQ ID NO: 3262980 - DNA, 18 bp, Homo sapiens
ctatattattatatatat

SEQ ID NO: 3262981 - DNA, 23 bp, Homo sapiens
ctatattgttttcagtgtacatg

SEQ ID NO: 3262982 - DNA, 12 bp, Homo sapiens
ctatatttacag

SEQ ID NO: 3262983 - DNA, 20 bp, Homo sapiens
ctatatttgtgctatttaat

SEQ ID NO: 3262984 - DNA, 14 bp, Homo sapiens
ctatcaaaattgcc

SEQ ID NO: 3262985 - DNA, 21 bp, Homo sapiens
ctatcaagtcaatcatttctc

SEQ ID NO: 3262986 - DNA, 17 bp, Homo sapiens
ctatcagttatcctttg

SEQ ID NO: 3262987 - DNA, 19 bp, Homo sapiens
ctatcagttatcctttgtg

SEQ ID NO: 3262988 - DNA, 22 bp, Homo sapiens
ctatcatactactgaaacagat

SEQ ID NO: 3262989 - DNA, 17 bp, Homo sapiens
ctatcatttattctgct

SEQ ID NO: 3262990 - DNA, 15 bp, Homo sapiens
ctatcatttttgtac

SEQ ID NO: 3262991 - DNA, 18 bp, Homo sapiens
ctatccaaacatgtattt

SEQ ID NO: 3262992 - DNA, 20 bp, Homo sapiens
ctatccaaacatgtatttat

SEQ ID NO: 3262993 - DNA, 18 bp, Homo sapiens
ctatccaaagaacttgat

SEQ ID NO: 3262994 - DNA, 19 bp, Homo sapiens
ctatccaaagaacttgatt

SEQ ID NO: 3262995 - DNA, 20 bp, Homo sapiens
ctatccaaagaacttgattt

SEQ ID NO: 3262996 - DNA, 23 bp, Homo sapiens
ctatcccaatcaaagaattacag

SEQ ID NO: 3262997 - DNA, 17 bp, Homo sapiens
ctatccccaatcagctc

SEQ ID NO: 3262998 - DNA, 18 bp, Homo sapiens
ctatccccaatcagctcc

SEQ ID NO: 3262999 - DNA, 18 bp, Homo sapiens
ctatccccatctccctgc

SEQ ID NO: 3263000 - DNA, 14 bp, Homo sapiens
ctatcctcactgcc

SEQ ID NO: 3263001 - DNA, 13 bp, Homo sapiens
ctatctaaagttt

SEQ ID NO: 3263002 - DNA, 18 bp, Homo sapiens
ctatctcaatcctaattt

SEQ ID NO: 3263003 - DNA, 12 bp, Homo sapiens
ctatctccccca

SEQ ID NO: 3263004 - DNA, 16 bp, Homo sapiens
ctatctcccccaaccc

SEQ ID NO: 3263005 - DNA, 20 bp, Homo sapiens
ctatctcccccaacccacct

SEQ ID NO: 3263006 - DNA, 22 bp, Homo sapiens
ctatctcccccaacccacctct

SEQ ID NO: 3263007 - DNA, 14 bp, Homo sapiens
ctatctcctgacag

SEQ ID NO: 3263008 - DNA, 17 bp, Homo sapiens
ctatctctcaaaacttg

SEQ ID NO: 3263009 - DNA, 21 bp, Homo sapiens
ctatctctgtgtgcacaaata

SEQ ID NO: 3263010 - DNA, 18 bp, Homo sapiens
ctatctgattttgtgcaa

SEQ ID NO: 3263011 - DNA, 18 bp, Homo sapiens
ctatctggggagctcctg

SEQ ID NO: 3263012 - DNA, 22 bp, Homo sapiens
ctatctggggagctcctggcca

SEQ ID NO: 3263013 - DNA, 17 bp, Homo sapiens
ctatctgtattcccaaa

SEQ ID NO: 3263014 - DNA, 13 bp, Homo sapiens
ctatctgtattta

SEQ ID NO: 3263015 - DNA, 23 bp, Homo sapiens
ctatctgtatttattatttgaag

SEQ ID NO: 3263016 - DNA, 21 bp, Homo sapiens
ctatctgtcatctctctgggg

SEQ ID NO: 3263017 - DNA, 14 bp, Homo sapiens
ctatctgtgttttg

SEQ ID NO: 3263018 - DNA, 14 bp, Homo sapiens
ctatcttccaaatg

SEQ ID NO: 3263019 - DNA, 16 bp, Homo sapiens
ctatcttcttcaaata

SEQ ID NO: 3263020 - DNA, 18 bp, Homo sapiens
ctatgaagttgctgttta

SEQ ID NO: 3263021 - DNA, 16 bp, Homo sapiens
ctatgacagatatatt

SEQ ID NO: 3263022 - DNA, 21 bp, Homo sapiens
ctatgacctcgccctccacaa

SEQ ID NO: 3263023 - DNA, 16 bp, Homo sapiens
ctatgactgctcccca

SEQ ID NO: 3263024 - DNA, 17 bp, Homo sapiens
ctatgactgctccccag

SEQ ID NO: 3263025 - DNA, 21 bp, Homo sapiens
ctatgagaacaagtcacagct

SEQ ID NO: 3263026 - DNA, 22 bp, Homo sapiens
ctatgagaacaagtcacagctg

SEQ ID NO: 3263027 - DNA, 23 bp, Homo sapiens
ctatgagaacaagtcacagctgc

SEQ ID NO: 3263028 - DNA, 14 bp, Homo sapiens
ctatgagcatcctg

SEQ ID NO: 3263029 - DNA, 23 bp, Homo sapiens
ctatgaggaataattatttattt

SEQ ID NO: 3263030 - DNA, 22 bp, Homo sapiens
ctatgagggtgtttcctctaaa

SEQ ID NO: 3263031 - DNA, 23 bp, Homo sapiens
ctatgagggtgtttcctctaaac

SEQ ID NO: 3263032 - DNA, 15 bp, Homo sapiens
ctatgagtctagatg

SEQ ID NO: 3263033 - DNA, 17 bp, Homo sapiens
ctatgagtctagatgtt

SEQ ID NO: 3263034 - DNA, 22 bp, Homo sapiens
ctatgagtctttaatttttcct

SEQ ID NO: 3263035 - DNA, 14 bp, Homo sapiens
ctatgataaattat

SEQ ID NO: 3263036 - DNA, 16 bp, Homo sapiens
ctatgataaattatga

SEQ ID NO: 3263037 - DNA, 20 bp, Homo sapiens
ctatgatatggtaaaagtta

SEQ ID NO: 3263038 - DNA, 23 bp, Homo sapiens
ctatgatattttctgtgcctgaa

SEQ ID NO: 3263039 - DNA, 19 bp, Homo sapiens
ctatgatccttttttgtca

SEQ ID NO: 3263040 - DNA, 23 bp, Homo sapiens
ctatgatgaaggtaattaaagta

SEQ ID NO: 3263041 - DNA, 17 bp, Homo sapiens
ctatgatggatggcaga

SEQ ID NO: 3263042 - DNA, 18 bp, Homo sapiens
ctatgatggatggcagac

SEQ ID NO: 3263043 - DNA, 21 bp, Homo sapiens
ctatgatggatggcagactct

SEQ ID NO: 3263044 - DNA, 22 bp, Homo sapiens
ctatgatggatggcagactctt

SEQ ID NO: 3263045 - DNA, 14 bp, Homo sapiens
ctatgattattaac

SEQ ID NO: 3263046 - DNA, 20 bp, Homo sapiens
ctatgatttttttttccaaa

SEQ ID NO: 3263047 - DNA, 21 bp, Homo sapiens
ctatgcacagagcccaatgca

SEQ ID NO: 3263048 - DNA, 23 bp, Homo sapiens
ctatgcacagagcccaatgcata

SEQ ID NO: 3263049 - DNA, 18 bp, Homo sapiens
ctatgcacatatggactc

SEQ ID NO: 3263050 - DNA, 13 bp, Homo sapiens
ctatgcagcctgc

SEQ ID NO: 3263051 - DNA, 14 bp, Homo sapiens
ctatgcagcctgct

SEQ ID NO: 3263052 - DNA, 16 bp, Homo sapiens
ctatggaaaatcagct

SEQ ID NO: 3263053 - DNA, 15 bp, Homo sapiens
ctatggaaagatggc

SEQ ID NO: 3263054 - DNA, 17 bp, Homo sapiens
ctatggagaatttatcc

SEQ ID NO: 3263055 - DNA, 18 bp, Homo sapiens
ctatggagagaattaaaa

SEQ ID NO: 3263056 - DNA, 18 bp, Homo sapiens
ctatggatgtggggtccc

SEQ ID NO: 3263057 - DNA, 18 bp, Homo sapiens
ctatggctccaacagaaa

SEQ ID NO: 3263058 - DNA, 17 bp, Homo sapiens
ctatggctgagttctgg

SEQ ID NO: 3263059 - DNA, 20 bp, Homo sapiens
ctatggctgatttatttcta

SEQ ID NO: 3263060 - DNA, 23 bp, Homo sapiens
ctatggctggccactgcacagag

SEQ ID NO: 3263061 - DNA, 15 bp, Homo sapiens
ctatggctttcaaag

SEQ ID NO: 3263062 - DNA, 16 bp, Homo sapiens
ctatggctttcaaagc

SEQ ID NO: 3263063 - DNA, 18 bp, Homo sapiens
ctatgggactcaatgcac

SEQ ID NO: 3263064 - DNA, 19 bp, Homo sapiens
ctatgggagccccagggtc

SEQ ID NO: 3263065 - DNA, 19 bp, Homo sapiens
ctatgggggcactgaggac

SEQ ID NO: 3263066 - DNA, 19 bp, Homo sapiens
ctatggtatgctggccagc

SEQ ID NO: 3263067 - DNA, 17 bp, Homo sapiens
ctatggtcgggagacag

SEQ ID NO: 3263068 - DNA, 15 bp, Homo sapiens
ctatggttgccaccc

SEQ ID NO: 3263069 - DNA, 16 bp, Homo sapiens
ctatggttgccacccc

SEQ ID NO: 3263070 - DNA, 15 bp, Homo sapiens
ctatgtaagggtctt

SEQ ID NO: 3263071 - DNA, 14 bp, Homo sapiens
ctatgtatatacat

SEQ ID NO: 3263072 - DNA, 14 bp, Homo sapiens
ctatgtcctaagga

SEQ ID NO: 3263073 - DNA, 21 bp, Homo sapiens
ctatgtcctaaggacacacta

SEQ ID NO: 3263074 - DNA, 15 bp, Homo sapiens
ctatgtgctgggtgc

SEQ ID NO: 3263075 - DNA, 16 bp, Homo sapiens
ctatgtgctgggtgcc

SEQ ID NO: 3263076 - DNA, 21 bp, Homo sapiens
ctatgtggctgaaaatgcaaa

SEQ ID NO: 3263077 - DNA, 17 bp, Homo sapiens
ctatgtgtttttctcat

SEQ ID NO: 3263078 - DNA, 22 bp, Homo sapiens
ctatgtgtttttctcatatttg

SEQ ID NO: 3263079 - DNA, 14 bp, Homo sapiens
ctatgttaaatact

SEQ ID NO: 3263080 - DNA, 23 bp, Homo sapiens
ctatgttaaatactgtgcagaat

SEQ ID NO: 3263081 - DNA, 15 bp, Homo sapiens
ctatgttactatttt

SEQ ID NO: 3263082 - DNA, 16 bp, Homo sapiens
ctatgttactattttc

SEQ ID NO: 3263083 - DNA, 12 bp, Homo sapiens
ctatgttcccca

SEQ ID NO: 3263084 - DNA, 13 bp, Homo sapiens
ccccggaggaagc

SEQ ID NO: 3263085 - DNA, 14 bp, Homo sapiens
ccccggaggaagct

SEQ ID NO: 3263086 - DNA, 16 bp, Homo sapiens
ccccggaggaagcttg

SEQ ID NO: 3263087 - DNA, 17 bp, Homo sapiens
ccccggcaccctctggc

SEQ ID NO: 3263088 - DNA, 17 bp, Homo sapiens
ccccggcaggccctgca

SEQ ID NO: 3263089 - DNA, 15 bp, Homo sapiens
ccccggccacctctg

SEQ ID NO: 3263090 - DNA, 17 bp, Homo sapiens
ccccggccccagccaga

SEQ ID NO: 3263091 - DNA, 19 bp, Homo sapiens
ccccggccccagccagagt

SEQ ID NO: 3263092 - DNA, 23 bp, Homo sapiens
ccccggcctcagggcgctcagac

SEQ ID NO: 3263093 - DNA, 16 bp, Homo sapiens
ccccggcctctctctt

SEQ ID NO: 3263094 - DNA, 18 bp, Homo sapiens
ccccgggctctctgctgt

SEQ ID NO: 3263095 - DNA, 15 bp, Homo sapiens
ccccgggctggagaa

SEQ ID NO: 3263096 - DNA, 18 bp, Homo sapiens
ccccgggctggagaaaga

SEQ ID NO: 3263097 - DNA, 17 bp, Homo sapiens
ccccggggaccctgtga

SEQ ID NO: 3263098 - DNA, 20 bp, Homo sapiens
ccccgtggccatccctgtga

SEQ ID NO: 3263099 - DNA, 21 bp, Homo sapiens
cccctaaaagcactcctgctt

SEQ ID NO: 3263100 - DNA, 20 bp, Homo sapiens
cccctaaccctactttgctt

SEQ ID NO: 3263101 - DNA, 13 bp, Homo sapiens
cccctaagtgccc

SEQ ID NO: 3263102 - DNA, 14 bp, Homo sapiens
cccctaagtgccca

SEQ ID NO: 3263103 - DNA, 23 bp, Homo sapiens
cctgagccccagggtgcccagaa

SEQ ID NO: 3263104 - DNA, 20 bp, Homo sapiens
cctgagccccgccctcttcc

SEQ ID NO: 3263105 - DNA, 19 bp, Homo sapiens
cctgagccctactccctgc

SEQ ID NO: 3263106 - DNA, 21 bp, Homo sapiens
cctgagccctactccctgcag

SEQ ID NO: 3263107 - DNA, 15 bp, Homo sapiens
cctgagccttagctc

SEQ ID NO: 3263108 - DNA, 17 bp, Homo sapiens
cctgagctggggccaca

SEQ ID NO: 3263109 - DNA, 16 bp, Homo sapiens
cctgagctttggggac

SEQ ID NO: 3263110 - DNA, 13 bp, Homo sapiens
cctgaggcctaga

SEQ ID NO: 3263111 - DNA, 13 bp, Homo sapiens
cctgaggcctgag

SEQ ID NO: 3263112 - DNA, 18 bp, Homo sapiens
cctgaggcctgaggcctg

SEQ ID NO: 3263113 - DNA, 17 bp, Homo sapiens
cctgaggcctgtgcctg

SEQ ID NO: 3263114 - DNA, 20 bp, Homo sapiens
cctgaggcctgtgcctgtca

SEQ ID NO: 3263115 - DNA, 19 bp, Homo sapiens
cctgagggaagagtagctg

SEQ ID NO: 3263116 - DNA, 19 bp, Homo sapiens
cctgaggggcatctgcccc

SEQ ID NO: 3263117 - DNA, 23 bp, Homo sapiens
cctgaggtgggcccaggaccagc

SEQ ID NO: 3263118 - DNA, 21 bp, Homo sapiens
cctgagtagctgggattacag

SEQ ID NO: 3263119 - DNA, 15 bp, Homo sapiens
cctgagtcacccatg

SEQ ID NO: 3263120 - DNA, 18 bp, Homo sapiens
cctgagtcacccatgaag

SEQ ID NO: 3263121 - DNA, 23 bp, Homo sapiens
cctgagtcaccctacctgtgcct

SEQ ID NO: 3263122 - DNA, 17 bp, Homo sapiens
cctgagtcagggcccag

SEQ ID NO: 3263123 - DNA, 20 bp, Homo sapiens
cctgagtcagggcccagagg

SEQ ID NO: 3263124 - DNA, 21 bp, Homo sapiens
cctgagtcagggcccagaggc

SEQ ID NO: 3263125 - DNA, 14 bp, Homo sapiens
cctgagtcctggtc

SEQ ID NO: 3263126 - DNA, 23 bp, Homo sapiens
cctgagtcctggtccctctgagg

SEQ ID NO: 3263127 - DNA, 19 bp, Homo sapiens
cctgagtcgtacagaaagc

SEQ ID NO: 3263128 - DNA, 16 bp, Homo sapiens
cctgagtggtgccaaa

SEQ ID NO: 3263129 - DNA, 15 bp, Homo sapiens
cctgatcactcccag

SEQ ID NO: 3263130 - DNA, 16 bp, Homo sapiens
cctgatcactcccagc

SEQ ID NO: 3263131 - DNA, 18 bp, Homo sapiens
cctgatcactcccagcac

SEQ ID NO: 3263132 - DNA, 20 bp, Homo sapiens
cctgatcactcccagcactc

SEQ ID NO: 3263133 - DNA, 21 bp, Homo sapiens
cctgatcactcccagcactcc

SEQ ID NO: 3263134 - DNA, 21 bp, Homo sapiens
cctgatcccattttcctctga

SEQ ID NO: 3263135 - DNA, 14 bp, Homo sapiens
cctgatctcttcct

SEQ ID NO: 3263136 - DNA, 16 bp, Homo sapiens
cctgatctcttcctgt

SEQ ID NO: 3263137 - DNA, 17 bp, Homo sapiens
cctgatgagatttttaa

SEQ ID NO: 3263138 - DNA, 22 bp, Homo sapiens
cctgatgccttttggaccttgg

SEQ ID NO: 3263139 - DNA, 16 bp, Homo sapiens
cctgatgctccctccc

SEQ ID NO: 3263140 - DNA, 20 bp, Homo sapiens
cctgatgctccctcccctgc

SEQ ID NO: 3263141 - DNA, 16 bp, Homo sapiens
cctgatgctgccccgt

SEQ ID NO: 3263142 - DNA, 12 bp, Homo sapiens
cctgatggccaa

SEQ ID NO: 3263143 - DNA, 17 bp, Homo sapiens
cctgatggccaagagca

SEQ ID NO: 3263144 - DNA, 18 bp, Homo sapiens
cctgatggtacaggaaag

SEQ ID NO: 3263145 - DNA, 16 bp, Homo sapiens
cctgatggtcagctcc

SEQ ID NO: 3263146 - DNA, 18 bp, Homo sapiens
cctgatggtcagctccct

SEQ ID NO: 3263147 - DNA, 21 bp, Homo sapiens
cctgatggtcagctcccttct

SEQ ID NO: 3263148 - DNA, 19 bp, Homo sapiens
cctgatgtgtcctcaggga

SEQ ID NO: 3263149 - DNA, 16 bp, Homo sapiens
cctgatgttaaaattc

SEQ ID NO: 3263150 - DNA, 16 bp, Homo sapiens
cctgatgtttgaagag

SEQ ID NO: 3263151 - DNA, 14 bp, Homo sapiens
cctgattatttatc

SEQ ID NO: 3263152 - DNA, 16 bp, Homo sapiens
cctgattgacctgctc

SEQ ID NO: 3263153 - DNA, 16 bp, Homo sapiens
cctgattttttttcct

SEQ ID NO: 3263154 - DNA, 22 bp, Homo sapiens
cctgcaaaaattcagagtcctt

SEQ ID NO: 3263155 - DNA, 14 bp, Homo sapiens
cctgcaaaatttta

SEQ ID NO: 3263156 - DNA, 18 bp, Homo sapiens
cctgcaaacagaacaggg

SEQ ID NO: 3263157 - DNA, 19 bp, Homo sapiens
cctgcaaaccttcctggga

SEQ ID NO: 3263158 - DNA, 14 bp, Homo sapiens
cctgcaaactcact

SEQ ID NO: 3263159 - DNA, 17 bp, Homo sapiens
cctgcaaactcactgct

SEQ ID NO: 3263160 - DNA, 14 bp, Homo sapiens
cctgcaaagacagt

SEQ ID NO: 3263161 - DNA, 20 bp, Homo sapiens
cctgcaaagacagtatttat

SEQ ID NO: 3263162 - DNA, 21 bp, Homo sapiens
cctgcaaagacagtatttatt

SEQ ID NO: 3263163 - DNA, 17 bp, Homo sapiens
cctgcaacttccgctga

SEQ ID NO: 3263164 - DNA, 17 bp, Homo sapiens
cctgcaagccccagggc

SEQ ID NO: 3263165 - DNA, 13 bp, Homo sapiens
cctgcaaggccca

SEQ ID NO: 3263166 - DNA, 14 bp, Homo sapiens
cctgcaaggcccac

SEQ ID NO: 3263167 - DNA, 12 bp, Homo sapiens
cctgcacacaag

SEQ ID NO: 3263168 - DNA, 22 bp, Homo sapiens
cctgcacaggcacacagggccc

SEQ ID NO: 3263169 - DNA, 12 bp, Homo sapiens
cctgcaccagga

SEQ ID NO: 3263170 - DNA, 17 bp, Homo sapiens
cctgcaccaggagacag

SEQ ID NO: 3263171 - DNA, 13 bp, Homo sapiens
cctgcaccctgga

SEQ ID NO: 3263172 - DNA, 20 bp, Homo sapiens
cctgcaccctggaaagggga

SEQ ID NO: 3263173 - DNA, 23 bp, Homo sapiens
cctgcacctgctgcgtccccact

SEQ ID NO: 3263174 - DNA, 19 bp, Homo sapiens
cctgcacgtcatgggaggg

SEQ ID NO: 3263175 - DNA, 21 bp, Homo sapiens
cctgcactggggagcccgtct

SEQ ID NO: 3263176 - DNA, 17 bp, Homo sapiens
cctgcacttcagacacc

SEQ ID NO: 3263177 - DNA, 16 bp, Homo sapiens
cctgcacttgcagact

SEQ ID NO: 3263178 - DNA, 22 bp, Homo sapiens
cctgcacttgcagactctacag

SEQ ID NO: 3263179 - DNA, 18 bp, Homo sapiens
cctgcagaaggaaagaag

SEQ ID NO: 3263180 - DNA, 19 bp, Homo sapiens
cctgcagacacctggactg

SEQ ID NO: 3263181 - DNA, 22 bp, Homo sapiens
cctgcagaggaccacagtgggt

SEQ ID NO: 3263182 - DNA, 19 bp, Homo sapiens
cctgcagaggggaaaccag

SEQ ID NO: 3263183 - DNA, 13 bp, Homo sapiens
cctgctccaccag

SEQ ID NO: 3263184 - DNA, 22 bp, Homo sapiens
cctgctccaccagcagcatggc

SEQ ID NO: 3263185 - DNA, 21 bp, Homo sapiens
cctgctccagaatttggaaat

SEQ ID NO: 3263186 - DNA, 22 bp, Homo sapiens
cctgctccagaatttggaaatc

SEQ ID NO: 3263187 - DNA, 15 bp, Homo sapiens
cctgctcccagcagc

SEQ ID NO: 3263188 - DNA, 23 bp, Homo sapiens
cctgctcccagcagccctaagga

SEQ ID NO: 3263189 - DNA, 15 bp, Homo sapiens
cctgctcccagcctg

SEQ ID NO: 3263190 - DNA, 16 bp, Homo sapiens
cctgctcccagcctgc

SEQ ID NO: 3263191 - DNA, 17 bp, Homo sapiens
cctgctcccagcctgct

SEQ ID NO: 3263192 - DNA, 19 bp, Homo sapiens
cctgctcccattcctccct

SEQ ID NO: 3263193 - DNA, 20 bp, Homo sapiens
cctgctccgctgctccttgg

SEQ ID NO: 3263194 - DNA, 21 bp, Homo sapiens
cctgctccgctgctccttggc

SEQ ID NO: 3263195 - DNA, 14 bp, Homo sapiens
cctgctcctcactg

SEQ ID NO: 3263196 - DNA, 19 bp, Homo sapiens
cctgctcctcactggagga

SEQ ID NO: 3263197 - DNA, 20 bp, Homo sapiens
cctgctcctcactggaggag

SEQ ID NO: 3263198 - DNA, 12 bp, Homo sapiens
cctgctcctccc

SEQ ID NO: 3263199 - DNA, 16 bp, Homo sapiens
cctgctcctccctggc

SEQ ID NO: 3263200 - DNA, 17 bp, Homo sapiens
cctgctcctccctggct

SEQ ID NO: 3263201 - DNA, 16 bp, Homo sapiens
cctgctcctcctgccc

SEQ ID NO: 3263202 - DNA, 17 bp, Homo sapiens
cctgctcctcctgccct

SEQ ID NO: 3263203 - DNA, 20 bp, Homo sapiens
cctgctcctcctgccctgtc

SEQ ID NO: 3263204 - DNA, 15 bp, Homo sapiens
cctgctcctgcagca

SEQ ID NO: 3263205 - DNA, 17 bp, Homo sapiens
cctgctctacccatgag

SEQ ID NO: 3263206 - DNA, 19 bp, Homo sapiens
cctgctctacccatgagcc

SEQ ID NO: 3263207 - DNA, 22 bp, Homo sapiens
cctgctctacccatgagcctgc

SEQ ID NO: 3263208 - DNA, 16 bp, Homo sapiens
cctgctctcctcttgc

SEQ ID NO: 3263209 - DNA, 19 bp, Homo sapiens
cctgctctcctcttgccac

SEQ ID NO: 3263210 - DNA, 24 bp, Homo sapiens
cctgctctttctacatgactgggc

SEQ ID NO: 3263211 - DNA, 18 bp, Homo sapiens
cctgctgagagcccccac

SEQ ID NO: 3263212 - DNA, 15 bp, Homo sapiens
cctgctgcaggggct

SEQ ID NO: 3263213 - DNA, 21 bp, Homo sapiens
cctgctgcaggggctctggag

SEQ ID NO: 3263214 - DNA, 10 bp, Homo sapiens
cctgctgcat

SEQ ID NO: 3263215 - DNA, 17 bp, Homo sapiens
cctgctgccagtgcagc

SEQ ID NO: 3263216 - DNA, 20 bp, Homo sapiens
cctgctgccagtgcagccac

SEQ ID NO: 3263217 - DNA, 22 bp, Homo sapiens
cctgctgccttctgacggccct

SEQ ID NO: 3263218 - DNA, 14 bp, Homo sapiens
cctgctgcggcaga

SEQ ID NO: 3263219 - DNA, 20 bp, Homo sapiens
cctgctgctgtaactgctga

SEQ ID NO: 3263220 - DNA, 23 bp, Homo sapiens
cctgctgctgtaactgctgagcc

SEQ ID NO: 3263221 - DNA, 16 bp, Homo sapiens
cctgctggacagagac

SEQ ID NO: 3263222 - DNA, 23 bp, Homo sapiens
cctgctggacagcctccgccaag

SEQ ID NO: 3263223 - DNA, 9 bp, Homo sapiens
cctgctggc

SEQ ID NO: 3263224 - DNA, 15 bp, Homo sapiens
cctgctggcacccac

SEQ ID NO: 3263225 - DNA, 11 bp, Homo sapiens
cctgctggctg

SEQ ID NO: 3263226 - DNA, 15 bp, Homo sapiens
cctgctggcttccag

SEQ ID NO: 3263227 - DNA, 22 bp, Homo sapiens
cctgctggcttccagcttcagg

SEQ ID NO: 3263228 - DNA, 23 bp, Homo sapiens
cctgctggcttccagcttcaggc

SEQ ID NO: 3263229 - DNA, 22 bp, Homo sapiens
cctgctgggaaccccgcagccc

SEQ ID NO: 3263230 - DNA, 16 bp, Homo sapiens
cctgctggtacctgcc

SEQ ID NO: 3263231 - DNA, 19 bp, Homo sapiens
cctgctggtacctgccctc

SEQ ID NO: 3263232 - DNA, 12 bp, Homo sapiens
cctgctggtcaa

SEQ ID NO: 3263233 - DNA, 19 bp, Homo sapiens
cctgctggttcagggttgg

SEQ ID NO: 3263234 - DNA, 20 bp, Homo sapiens
cctgctgtgccatgctgggc

SEQ ID NO: 3263235 - DNA, 15 bp, Homo sapiens
cctgctgtgctgctc

SEQ ID NO: 3263236 - DNA, 16 bp, Homo sapiens
cctgctgtgctgctca

SEQ ID NO: 3263237 - DNA, 12 bp, Homo sapiens
cctgctgtggga

SEQ ID NO: 3263238 - DNA, 14 bp, Homo sapiens
cctgcttcaaatat

SEQ ID NO: 3263239 - DNA, 21 bp, Homo sapiens
cctgcttccaggaaactccac

SEQ ID NO: 3263240 - DNA, 23 bp, Homo sapiens
cctgcttcccacctccctgccca

SEQ ID NO: 3263241 - DNA, 22 bp, Homo sapiens
cctgcttctccagcctggaccc

SEQ ID NO: 3263242 - DNA, 15 bp, Homo sapiens
cctgctttggcgggc

SEQ ID NO: 3263243 - DNA, 21 bp, Homo sapiens
cctgctttggctgaggggctt

SEQ ID NO: 3263244 - DNA, 21 bp, Homo sapiens
cctgctttgggctgccctggt

SEQ ID NO: 3263245 - DNA, 23 bp, Homo sapiens
cctgctttgggctgccctggtgc

SEQ ID NO: 3263246 - DNA, 16 bp, Homo sapiens
cctgcttttccaggat

SEQ ID NO: 3263247 - DNA, 19 bp, Homo sapiens
cctgcttttccaggatcct

SEQ ID NO: 3263248 - DNA, 16 bp, Homo sapiens
cctgctttttgaaatg

SEQ ID NO: 3263249 - DNA, 17 bp, Homo sapiens
cctgctttttttcttaa

SEQ ID NO: 3263250 - DNA, 13 bp, Homo sapiens
cctggaaacagca

SEQ ID NO: 3263251 - DNA, 17 bp, Homo sapiens
cctggaaacagcatgaa

SEQ ID NO: 3263252 - DNA, 21 bp, Homo sapiens
cctggaaacagcatgaataaa

SEQ ID NO: 3263253 - DNA, 22 bp, Homo sapiens
cctggaaacagcatgaataaaa

SEQ ID NO: 3263254 - DNA, 18 bp, Homo sapiens
cctggaaccttgctgtcc

SEQ ID NO: 3263255 - DNA, 20 bp, Homo sapiens
cctggaaccttgctgtcctg

SEQ ID NO: 3263256 - DNA, 22 bp, Homo sapiens
cctggaactctatctgggcctg

SEQ ID NO: 3263257 - DNA, 18 bp, Homo sapiens
cctggaactgtagggcca

SEQ ID NO: 3263258 - DNA, 11 bp, Homo sapiens
cctggaagcag

SEQ ID NO: 3263259 - DNA, 15 bp, Homo sapiens
cctggaagccagctt

SEQ ID NO: 3263260 - DNA, 22 bp, Homo sapiens
cctggaaggacatccatgttcc

SEQ ID NO: 3263261 - DNA, 16 bp, Homo sapiens
cctggaattcagcacc

SEQ ID NO: 3263262 - DNA, 18 bp, Homo sapiens
cctggaattcagcaccct

SEQ ID NO: 3263263 - DNA, 19 bp, Homo sapiens
cctggaattcagcaccctg

SEQ ID NO: 3263264 - DNA, 21 bp, Homo sapiens
cctggaattcagcaccctggg

SEQ ID NO: 3263265 - DNA, 22 bp, Homo sapiens
cctggacaaggctaacatccca

SEQ ID NO: 3263266 - DNA, 11 bp, Homo sapiens
cctggacacag

SEQ ID NO: 3263267 - DNA, 14 bp, Homo sapiens
cctggacacagctc

SEQ ID NO: 3263268 - DNA, 16 bp, Homo sapiens
cctggacacagctctt

SEQ ID NO: 3263269 - DNA, 18 bp, Homo sapiens
cctggacacagctcttca

SEQ ID NO: 3263270 - DNA, 18 bp, Homo sapiens
cctggacacccctgctct

SEQ ID NO: 3263271 - DNA, 16 bp, Homo sapiens
cctggacactcagacc

SEQ ID NO: 3263272 - DNA, 19 bp, Homo sapiens
cctggacagtatcccacat

SEQ ID NO: 3263273 - DNA, 23 bp, Homo sapiens
cctggacagtatcccacatccaa

SEQ ID NO: 3263274 - DNA, 13 bp, Homo sapiens
cctggacctggaa

SEQ ID NO: 3263275 - DNA, 15 bp, Homo sapiens
cctggactctgcccc

SEQ ID NO: 3263276 - DNA, 21 bp, Homo sapiens
cctggactgagccaaggaggc

SEQ ID NO: 3263277 - DNA, 13 bp, Homo sapiens
cctggactgggag

SEQ ID NO: 3263278 - DNA, 13 bp, Homo sapiens
cctgggccagaga

SEQ ID NO: 3263279 - DNA, 14 bp, Homo sapiens
cctgggccagggtc

SEQ ID NO: 3263280 - DNA, 15 bp, Homo sapiens
cctgggcccctccac

SEQ ID NO: 3263281 - DNA, 21 bp, Homo sapiens
cctgggcccctccacgcctcc

SEQ ID NO: 3263282 - DNA, 12 bp, Homo sapiens
cctgggccctgg

SEQ ID NO: 3263283 - DNA, 18 bp, Homo sapiens
cctgggccctgggctgga

SEQ ID NO: 3263284 - DNA, 19 bp, Homo sapiens
cctgggccctgggctggaa

SEQ ID NO: 3263285 - DNA, 13 bp, Homo sapiens
cctgggccgctgc

SEQ ID NO: 3263286 - DNA, 17 bp, Homo sapiens
cctgggccgctgccacg

SEQ ID NO: 3263287 - DNA, 19 bp, Homo sapiens
cctgggcctctgcccctcc

SEQ ID NO: 3263288 - DNA, 13 bp, Homo sapiens
cctgggcctgccc

SEQ ID NO: 3263289 - DNA, 16 bp, Homo sapiens
cctgggcctgcccctg

SEQ ID NO: 3263290 - DNA, 12 bp, Homo sapiens
cctgggcctgct

SEQ ID NO: 3263291 - DNA, 13 bp, Homo sapiens
cctgggcctgtgc

SEQ ID NO: 3263292 - DNA, 14 bp, Homo sapiens
cctgggcctgtgca

SEQ ID NO: 3263293 - DNA, 15 bp, Homo sapiens
cctgggcctgtgcag

SEQ ID NO: 3263294 - DNA, 16 bp, Homo sapiens
cctgggcctgtgcagc

SEQ ID NO: 3263295 - DNA, 22 bp, Homo sapiens
cctgggcctgtgcagcagccca

SEQ ID NO: 3263296 - DNA, 19 bp, Homo sapiens
cctgggcctttgcaagatg

SEQ ID NO: 3263297 - DNA, 14 bp, Homo sapiens
cctgggctcagcct

SEQ ID NO: 3263298 - DNA, 11 bp, Homo sapiens
cctgtcccacc

SEQ ID NO: 3263299 - DNA, 19 bp, Homo sapiens
cctgtcccatgcaggccct

SEQ ID NO: 3263300 - DNA, 17 bp, Homo sapiens
cctgtccccaccctcca

SEQ ID NO: 3263301 - DNA, 19 bp, Homo sapiens
cctgtccccaccctccact

SEQ ID NO: 3263302 - DNA, 23 bp, Homo sapiens
cctgtccccctcccctcccagtc

SEQ ID NO: 3263303 - DNA, 14 bp, Homo sapiens
cctgtcccctcagc

SEQ ID NO: 3263304 - DNA, 16 bp, Homo sapiens
cctgtcccctcagctc

SEQ ID NO: 3263305 - DNA, 18 bp, Homo sapiens
cctgtcccctcagctcca

SEQ ID NO: 3263306 - DNA, 21 bp, Homo sapiens
cctgtcccctcagctccagac

SEQ ID NO: 3263307 - DNA, 14 bp, Homo sapiens
cctgtccctcccac

SEQ ID NO: 3263308 - DNA, 15 bp, Homo sapiens
cctgtccctcccacc

SEQ ID NO: 3263309 - DNA, 16 bp, Homo sapiens
cctgtccctcccacct

SEQ ID NO: 3263310 - DNA, 21 bp, Homo sapiens
cctgtccctcccacctctgtg

SEQ ID NO: 3263311 - DNA, 15 bp, Homo sapiens
cctgtcccttgacct

SEQ ID NO: 3263312 - DNA, 14 bp, Homo sapiens
cctgtccggcccag

SEQ ID NO: 3263313 - DNA, 21 bp, Homo sapiens
cctgtccggcccagtgccact

SEQ ID NO: 3263314 - DNA, 18 bp, Homo sapiens
cctgtcctaaggaacctt

SEQ ID NO: 3263315 - DNA, 21 bp, Homo sapiens
cctgtcctcactgctccctga

SEQ ID NO: 3263316 - DNA, 22 bp, Homo sapiens
cctgtcctgatggtcagctccc

SEQ ID NO: 3263317 - DNA, 13 bp, Homo sapiens
cctgtcctgtgaa

SEQ ID NO: 3263318 - DNA, 15 bp, Homo sapiens
cctgtcctgtgaatg

SEQ ID NO: 3263319 - DNA, 19 bp, Homo sapiens
cctgtcctgtgaatggaag

SEQ ID NO: 3263320 - DNA, 14 bp, Homo sapiens
cctgtccttccctg

SEQ ID NO: 3263321 - DNA, 15 bp, Homo sapiens
cctgtcgagacactt

SEQ ID NO: 3263322 - DNA, 17 bp, Homo sapiens
cctgtcgagacacttgc

SEQ ID NO: 3263323 - DNA, 16 bp, Homo sapiens
cctgtcgtgccagtcc

SEQ ID NO: 3263324 - DNA, 17 bp, Homo sapiens
cctgtcgtgccagtcct

SEQ ID NO: 3263325 - DNA, 14 bp, Homo sapiens
cctgtctaggtctc

SEQ ID NO: 3263326 - DNA, 17 bp, Homo sapiens
cctgtctaggtctcctc

SEQ ID NO: 3263327 - DNA, 21 bp, Homo sapiens
cctgtctagtctctcctgtaa

SEQ ID NO: 3263328 - DNA, 22 bp, Homo sapiens
cctgtctagtctctcctgtaag

SEQ ID NO: 3263329 - DNA, 20 bp, Homo sapiens
cctgtctataagagaattat

SEQ ID NO: 3263330 - DNA, 13 bp, Homo sapiens
cctgtctcagcct

SEQ ID NO: 3263331 - DNA, 14 bp, Homo sapiens
cctgtctcagctgt

SEQ ID NO: 3263332 - DNA, 17 bp, Homo sapiens
cctgtctcatccccagg

SEQ ID NO: 3263333 - DNA, 20 bp, Homo sapiens
cctgtctcatccccaggggt

SEQ ID NO: 3263334 - DNA, 15 bp, Homo sapiens
cctgtctccactgtg

SEQ ID NO: 3263335 - DNA, 20 bp, Homo sapiens
cctgtctgagactcacagga

SEQ ID NO: 3263336 - DNA, 18 bp, Homo sapiens
cctgtctgctaggcgctg

SEQ ID NO: 3263337 - DNA, 22 bp, Homo sapiens
cctgtctgctaggcgctgggga

SEQ ID NO: 3263338 - DNA, 18 bp, Homo sapiens
cctgtcttcacctgccac

SEQ ID NO: 3263339 - DNA, 21 bp, Homo sapiens
cctgtcttcacctgccaccac

SEQ ID NO: 3263340 - DNA, 14 bp, Homo sapiens
cctgtcttctgggc

SEQ ID NO: 3263341 - DNA, 21 bp, Homo sapiens
cctgtgaatgccactgccttc

SEQ ID NO: 3263342 - DNA, 18 bp, Homo sapiens
cctgtgacatggtgcctg

SEQ ID NO: 3263343 - DNA, 21 bp, Homo sapiens
cctgtgacatggtgcctgaga

SEQ ID NO: 3263344 - DNA, 22 bp, Homo sapiens
cctgtgacatggtgcctgagag

SEQ ID NO: 3263345 - DNA, 16 bp, Homo sapiens
cctgtgactgtctcac

SEQ ID NO: 3263346 - DNA, 18 bp, Homo sapiens
cctgtgacttcagctctg

SEQ ID NO: 3263347 - DNA, 12 bp, Homo sapiens
cctgtgcacaca

SEQ ID NO: 3263348 - DNA, 14 bp, Homo sapiens
cctgtgcacacaca

SEQ ID NO: 3263349 - DNA, 13 bp, Homo sapiens
cctgtgcagcagc

SEQ ID NO: 3263350 - DNA, 14 bp, Homo sapiens
cctgtgcagcagcc

SEQ ID NO: 3263351 - DNA, 16 bp, Homo sapiens
cctgtgcagcagccca

SEQ ID NO: 3263352 - DNA, 17 bp, Homo sapiens
cctgtgcagcagcccag

SEQ ID NO: 3263353 - DNA, 20 bp, Homo sapiens
cctgtgcagcagcccagctt

SEQ ID NO: 3263354 - DNA, 20 bp, Homo sapiens
cctgtgcatgtatgtcttgg

SEQ ID NO: 3263355 - DNA, 17 bp, Homo sapiens
cctgtgccaggctgaat

SEQ ID NO: 3263356 - DNA, 14 bp, Homo sapiens
cctgtgccctcacc

SEQ ID NO: 3263357 - DNA, 16 bp, Homo sapiens
cctgtgccctcaccac

SEQ ID NO: 3263358 - DNA, 20 bp, Homo sapiens
cctgtgccctgcacgtatac

SEQ ID NO: 3263359 - DNA, 18 bp, Homo sapiens
cctgtgcctaacaccagc

SEQ ID NO: 3263360 - DNA, 15 bp, Homo sapiens
cctgtgcctcctcac

SEQ ID NO: 3263361 - DNA, 15 bp, Homo sapiens
cctgtgcctctggga

SEQ ID NO: 3263362 - DNA, 13 bp, Homo sapiens
cctgtgcctgcca

SEQ ID NO: 3263363 - DNA, 20 bp, Homo sapiens
cctgtgcctgccatgggcca

SEQ ID NO: 3263364 - DNA, 23 bp, Homo sapiens
cctgtgcctgccatgggccagcc

SEQ ID NO: 3263365 - DNA, 11 bp, Homo sapiens
cctgtgcctgt

SEQ ID NO: 3263366 - DNA, 21 bp, Homo sapiens
cctgtgcctgtcaggctctgg

SEQ ID NO: 3263367 - DNA, 15 bp, Homo sapiens
cctgtgcgtcccagc

SEQ ID NO: 3263368 - DNA, 21 bp, Homo sapiens
cctgtgctccgtgcctccacc

SEQ ID NO: 3263369 - DNA, 13 bp, Homo sapiens
cctgtgctctgga

SEQ ID NO: 3263370 - DNA, 21 bp, Homo sapiens
cctgtgctggtgtcctgacca

SEQ ID NO: 3263371 - DNA, 24 bp, Homo sapiens
cctgtgctggtgtcctgaccaccc

SEQ ID NO: 3263372 - DNA, 12 bp, Homo sapiens
cctgtgctgtgg

SEQ ID NO: 3263373 - DNA, 13 bp, Homo sapiens
cctgtgctgtggc

SEQ ID NO: 3263374 - DNA, 19 bp, Homo sapiens
cctgtggaagagtgtgtgt

SEQ ID NO: 3263375 - DNA, 21 bp, Homo sapiens
cctgtggaatgagtgtgcatg

SEQ ID NO: 3263376 - DNA, 17 bp, Homo sapiens
cctgtggagctcagccc

SEQ ID NO: 3263377 - DNA, 18 bp, Homo sapiens
cctgtggagctcagcccc

SEQ ID NO: 3263378 - DNA, 16 bp, Homo sapiens
cctgtggcagaaaaga

SEQ ID NO: 3263379 - DNA, 18 bp, Homo sapiens
cctgtggcaggcagcgcc

SEQ ID NO: 3263380 - DNA, 18 bp, Homo sapiens
cctgtggcagtaaagaga

SEQ ID NO: 3263381 - DNA, 22 bp, Homo sapiens
cctgtggcagtaaagagaaact

SEQ ID NO: 3263382 - DNA, 15 bp, Homo sapiens
cctgtggccccaccc

SEQ ID NO: 3263383 - DNA, 16 bp, Homo sapiens
cctgtggccccaccct

SEQ ID NO: 3263384 - DNA, 14 bp, Homo sapiens
cctgtggcctgtgt

SEQ ID NO: 3263385 - DNA, 23 bp, Homo sapiens
cctgtggcctgtgtcccatgacc

SEQ ID NO: 3263386 - DNA, 22 bp, Homo sapiens
cctgtggcgccgtctccagggg

SEQ ID NO: 3263387 - DNA, 18 bp, Homo sapiens
cctgtggggatctcaggg

SEQ ID NO: 3263388 - DNA, 14 bp, Homo sapiens
cctgtgggggtggc

SEQ ID NO: 3263389 - DNA, 15 bp, Homo sapiens
cctgtgggggtggcc

SEQ ID NO: 3263390 - DNA, 17 bp, Homo sapiens
cctgtgggggtggccat

SEQ ID NO: 3263391 - DNA, 13 bp, Homo sapiens
cctgtgggtcccc

SEQ ID NO: 3263392 - DNA, 18 bp, Homo sapiens
cctgtgggtccccactca

SEQ ID NO: 3263393 - DNA, 17 bp, Homo sapiens
cctgtgtatacagccct

SEQ ID NO: 3263394 - DNA, 14 bp, Homo sapiens
cctgtgtatggaaa

SEQ ID NO: 3263395 - DNA, 18 bp, Homo sapiens
cctgtgtccacctgtggg

SEQ ID NO: 3263396 - DNA, 15 bp, Homo sapiens
cctgtgtccagcagc

SEQ ID NO: 3263397 - DNA, 20 bp, Homo sapiens
cctgtgtcccatgacccacc

SEQ ID NO: 3263398 - DNA, 17 bp, Homo sapiens
cctgtgtcttgcaatgg

SEQ ID NO: 3263399 - DNA, 19 bp, Homo sapiens
cctgtgtcttgcaatggca

SEQ ID NO: 3263400 - DNA, 21 bp, Homo sapiens
cctgtgtcttgcaatggcagc

SEQ ID NO: 3263401 - DNA, 21 bp, Homo sapiens
cctgtgtgtgaaaggaagctc

SEQ ID NO: 3263402 - DNA, 22 bp, Homo sapiens
cctgtgttgtctctagagcagg

SEQ ID NO: 3263403 - DNA, 20 bp, Homo sapiens
cctgttaatgtatttgttca

SEQ ID NO: 3263404 - DNA, 17 bp, Homo sapiens
cctgttacctactttga

SEQ ID NO: 3263405 - DNA, 18 bp, Homo sapiens
cctgttacctactttgac

SEQ ID NO: 3263406 - DNA, 19 bp, Homo sapiens
cctgttacctactttgact

SEQ ID NO: 3263407 - DNA, 14 bp, Homo sapiens
cctgttacttacct

SEQ ID NO: 3263408 - DNA, 17 bp, Homo sapiens
cctgttatgtatgaagg

SEQ ID NO: 3263409 - DNA, 15 bp, Homo sapiens
cctgttattttatgt

SEQ ID NO: 3263410 - DNA, 15 bp, Homo sapiens
cctgttcagcattct

SEQ ID NO: 3263411 - DNA, 16 bp, Homo sapiens
cctgttcagctccagc

SEQ ID NO: 3263412 - DNA, 19 bp, Homo sapiens
cctgttcagctccagctca

SEQ ID NO: 3263413 - DNA, 23 bp, Homo sapiens
cctgttcagctccagctcaccag

SEQ ID NO: 3263414 - DNA, 18 bp, Homo sapiens
cctgttcatgtgcctctg

SEQ ID NO: 3263415 - DNA, 16 bp, Homo sapiens
cctgttctaaggggga

SEQ ID NO: 3263416 - DNA, 12 bp, Homo sapiens
cctgttctccct

SEQ ID NO: 3263417 - DNA, 19 bp, Homo sapiens
cctgttctccctttctctc

SEQ ID NO: 3263418 - DNA, 22 bp, Homo sapiens
cctgttctccctttctctctcc

SEQ ID NO: 3263419 - DNA, 24 bp, Homo sapiens
cctgttctccctttctctctcctc

SEQ ID NO: 3263420 - DNA, 13 bp, Homo sapiens
cctgttctcttca

SEQ ID NO: 3263421 - DNA, 14 bp, Homo sapiens
cctgttctgcccac

SEQ ID NO: 3263422 - DNA, 19 bp, Homo sapiens
cctgttctgggtgcagctg

SEQ ID NO: 3263423 - DNA, 16 bp, Homo sapiens
cctgttcttagagtgt

SEQ ID NO: 3263424 - DNA, 21 bp, Homo sapiens
cctgttcttagagtgtagctg

SEQ ID NO: 3263425 - DNA, 13 bp, Homo sapiens
cctgttcttcctc

SEQ ID NO: 3263426 - DNA, 24 bp, Homo sapiens
cctgttcttcctccagctgcacca

SEQ ID NO: 3263427 - DNA, 17 bp, Homo sapiens
cctgttgctgtgtttaa

SEQ ID NO: 3263428 - DNA, 17 bp, Homo sapiens
cctgttggcagctctag

SEQ ID NO: 3263429 - DNA, 22 bp, Homo sapiens
cctgttggttccaagccctgga

SEQ ID NO: 3263430 - DNA, 15 bp, Homo sapiens
cctgtttaatattta

SEQ ID NO: 3263431 - DNA, 21 bp, Homo sapiens
cctgtttataatctgaagata

SEQ ID NO: 3263432 - DNA, 22 bp, Homo sapiens
cctgtttctctttgtctgcctt

SEQ ID NO: 3263433 - DNA, 13 bp, Homo sapiens
cctgtttcttcct

SEQ ID NO: 3263434 - DNA, 23 bp, Homo sapiens
cctgtttgaagcctgcccttgtc

SEQ ID NO: 3263435 - DNA, 11 bp, Homo sapiens
cctgtttgatg

SEQ ID NO: 3263436 - DNA, 13 bp, Homo sapiens
cctgtttgatgta

SEQ ID NO: 3263437 - DNA, 16 bp, Homo sapiens
cctgtttgatgtatgt

SEQ ID NO: 3263438 - DNA, 17 bp, Homo sapiens
cctgtttgatgtatgtg

SEQ ID NO: 3263439 - DNA, 23 bp, Homo sapiens
cctgttttcccacgaggaatctg

SEQ ID NO: 3263440 - DNA, 17 bp, Homo sapiens
cctgttttctgagcccg

SEQ ID NO: 3263441 - DNA, 16 bp, Homo sapiens
cctgttttgtacatag

SEQ ID NO: 3263442 - DNA, 19 bp, Homo sapiens
cctgtttttaagctgtttc

SEQ ID NO: 3263443 - DNA, 14 bp, Homo sapiens
ccttaaaaaggact

SEQ ID NO: 3263444 - DNA, 14 bp, Homo sapiens
ccttaaaacagctg

SEQ ID NO: 3263445 - DNA, 17 bp, Homo sapiens
ccttaaaaccaaagagg

SEQ ID NO: 3263446 - DNA, 22 bp, Homo sapiens
ccttaaaggcaccatctaatag

SEQ ID NO: 3263447 - DNA, 22 bp, Homo sapiens
ccttaaatacagataattcatt

SEQ ID NO: 3263448 - DNA, 13 bp, Homo sapiens
ccttaaatttaat

SEQ ID NO: 3263449 - DNA, 18 bp, Homo sapiens
ccttaacccaaggagcac

SEQ ID NO: 3263450 - DNA, 20 bp, Homo sapiens
ccttaacccaaggagcacag

SEQ ID NO: 3263451 - DNA, 13 bp, Homo sapiens
ccttaactgacat

SEQ ID NO: 3263452 - DNA, 19 bp, Homo sapiens
ccttaagaacacaaagcgg

SEQ ID NO: 3263453 - DNA, 20 bp, Homo sapiens
ccttaaggacaaaaatgaac

SEQ ID NO: 3263454 - DNA, 20 bp, Homo sapiens
ccttaaggcacagtgggagc

SEQ ID NO: 3263455 - DNA, 19 bp, Homo sapiens
ccttaagggttgaaggcag

SEQ ID NO: 3263456 - DNA, 22 bp, Homo sapiens
ccttaagggttgaaggcagtct

SEQ ID NO: 3263457 - DNA, 23 bp, Homo sapiens
ccttaatcaggtcctcagagaat

SEQ ID NO: 3263458 - DNA, 16 bp, Homo sapiens
ccttaatgacaacact

SEQ ID NO: 3263459 - DNA, 19 bp, Homo sapiens
ccttaatttttttttcata

SEQ ID NO: 3263460 - DNA, 19 bp, Homo sapiens
ccttacatttgtgagattc

SEQ ID NO: 3263461 - DNA, 16 bp, Homo sapiens
ccttaccccttagcct

SEQ ID NO: 3263462 - DNA, 14 bp, Homo sapiens
ccttacctcttccg

SEQ ID NO: 3263463 - DNA, 14 bp, Homo sapiens
ccttactaattata

SEQ ID NO: 3263464 - DNA, 14 bp, Homo sapiens
ccttactctgagcc

SEQ ID NO: 3263465 - DNA, 16 bp, Homo sapiens
ccttactctgagccca

SEQ ID NO: 3263466 - DNA, 13 bp, Homo sapiens
ccttactggctta

SEQ ID NO: 3263467 - DNA, 21 bp, Homo sapiens
ccttagaaatcattgtagaaa

SEQ ID NO: 3263468 - DNA, 23 bp, Homo sapiens
ccttagaaatgtaaactgccata

SEQ ID NO: 3263469 - DNA, 18 bp, Homo sapiens
ccttagaacctttcttac

SEQ ID NO: 3263470 - DNA, 20 bp, Homo sapiens
ccttagaggtcctctggagc

SEQ ID NO: 3263471 - DNA, 19 bp, Homo sapiens
ccttagcatgtttgctgaa

SEQ ID NO: 3263472 - DNA, 20 bp, Homo sapiens
ccttagccctgtctgctagg

SEQ ID NO: 3263473 - DNA, 14 bp, Homo sapiens
ccttagcctccctg

SEQ ID NO: 3263474 - DNA, 14 bp, Homo sapiens
ccttagctcccagc

SEQ ID NO: 3263475 - DNA, 16 bp, Homo sapiens
ccttagctcccagcta

SEQ ID NO: 3263476 - DNA, 14 bp, Homo sapiens
ccttagctttccct

SEQ ID NO: 3263477 - DNA, 18 bp, Homo sapiens
ccttaggagacgctgcac

SEQ ID NO: 3263478 - DNA, 20 bp, Homo sapiens
ccttaggagacgctgcactt

SEQ ID NO: 3263479 - DNA, 18 bp, Homo sapiens
ccttaggatggggctccc

SEQ ID NO: 3263480 - DNA, 12 bp, Homo sapiens
ccttaggccccg

SEQ ID NO: 3263481 - DNA, 17 bp, Homo sapiens
ccttaggccccgtggtg

SEQ ID NO: 3263482 - DNA, 20 bp, Homo sapiens
ccttaggccccgtggtgaca

SEQ ID NO: 3263483 - DNA, 14 bp, Homo sapiens
ccttaggccttcct

SEQ ID NO: 3263484 - DNA, 21 bp, Homo sapiens
ccttagggaagctggcctgag

SEQ ID NO: 3263485 - DNA, 13 bp, Homo sapiens
ccttagtcttctc

SEQ ID NO: 3263486 - DNA, 15 bp, Homo sapiens
ccttagtgggccagg

SEQ ID NO: 3263487 - DNA, 22 bp, Homo sapiens
ccttatacccccattaaattca

SEQ ID NO: 3263488 - DNA, 14 bp, Homo sapiens
ccttatcaagtgtc

SEQ ID NO: 3263489 - DNA, 16 bp, Homo sapiens
ccttattcttctcata

SEQ ID NO: 3263490 - DNA, 19 bp, Homo sapiens
ccttattgctgtcctggag

SEQ ID NO: 3263491 - DNA, 17 bp, Homo sapiens
ccttcaaagaaacttga

SEQ ID NO: 3263492 - DNA, 23 bp, Homo sapiens
ccttcaagccagcaacacagagc

SEQ ID NO: 3263493 - DNA, 16 bp, Homo sapiens
ccttcaagtgccaaac

SEQ ID NO: 3263494 - DNA, 16 bp, Homo sapiens
ccttcaattcctgggc

SEQ ID NO: 3263495 - DNA, 14 bp, Homo sapiens
ccttcacaccccag

SEQ ID NO: 3263496 - DNA, 15 bp, Homo sapiens
ccttcacaccccagg

SEQ ID NO: 3263497 - DNA, 18 bp, Homo sapiens
ccttcacaggcagtgcat

SEQ ID NO: 3263498 - DNA, 18 bp, Homo sapiens
ccttcacattttttatgg

SEQ ID NO: 3263499 - DNA, 12 bp, Homo sapiens
ccttcactgcca

SEQ ID NO: 3263500 - DNA, 14 bp, Homo sapiens
ccttcactgttccc

SEQ ID NO: 3263501 - DNA, 20 bp, Homo sapiens
ccttcactgttccctctggc

SEQ ID NO: 3263502 - DNA, 18 bp, Homo sapiens
ccttcagaagctattttt

SEQ ID NO: 3263503 - DNA, 13 bp, Homo sapiens
ccttcagccccca

SEQ ID NO: 3263504 - DNA, 18 bp, Homo sapiens
ccttcaggaactggggct

SEQ ID NO: 3263505 - DNA, 17 bp, Homo sapiens
ccttcaggaagcaggtg

SEQ ID NO: 3263506 - DNA, 15 bp, Homo sapiens
ccttcagggccagaa

SEQ ID NO: 3263507 - DNA, 22 bp, Homo sapiens
ccttcagggccagaaggagggc

SEQ ID NO: 3263508 - DNA, 19 bp, Homo sapiens
ccttcagtaccctctcagc

SEQ ID NO: 3263509 - DNA, 22 bp, Homo sapiens
ccttccacagttatcttagctg

SEQ ID NO: 3263510 - DNA, 12 bp, Homo sapiens
ccttccacctcc

SEQ ID NO: 3263511 - DNA, 14 bp, Homo sapiens
ccttccagacatac

SEQ ID NO: 3263512 - DNA, 15 bp, Homo sapiens
ccttccagctcctgt

SEQ ID NO: 3263513 - DNA, 13 bp, Homo sapiens
ccttccagggccc

SEQ ID NO: 3263514 - DNA, 13 bp, Homo sapiens
ccttccaggtcag

SEQ ID NO: 3263515 - DNA, 22 bp, Homo sapiens
ccttccagtgtccttagaacat

SEQ ID NO: 3263516 - DNA, 11 bp, Homo sapiens
ccttccataat

SEQ ID NO: 3263517 - DNA, 23 bp, Homo sapiens
ccttccatagcctaatccctggg

SEQ ID NO: 3263518 - DNA, 19 bp, Homo sapiens
ccttccatgtcgcctctgc

SEQ ID NO: 3263519 - DNA, 20 bp, Homo sapiens
ccttccatgtcgcctctgca

SEQ ID NO: 3263520 - DNA, 21 bp, Homo sapiens
ccttccatgtcgcctctgcat

SEQ ID NO: 3263521 - DNA, 16 bp, Homo sapiens
ccttccattcacacca

SEQ ID NO: 3263522 - DNA, 19 bp, Homo sapiens
ccttccattttcccccact

SEQ ID NO: 3263523 - DNA, 20 bp, Homo sapiens
ccttccattttcccccacta

SEQ ID NO: 3263524 - DNA, 17 bp, Homo sapiens
ccttcccaatcagcact

SEQ ID NO: 3263525 - DNA, 21 bp, Homo sapiens
ccttccccaacttccctagtc

SEQ ID NO: 3263526 - DNA, 13 bp, Homo sapiens
ccttccccaggat

SEQ ID NO: 3263527 - DNA, 14 bp, Homo sapiens
ccttccccaggatg

SEQ ID NO: 3263528 - DNA, 14 bp, Homo sapiens
ccttccccaggccc

SEQ ID NO: 3263529 - DNA, 16 bp, Homo sapiens
ccttccccctcccagg

SEQ ID NO: 3263530 - DNA, 17 bp, Homo sapiens
ccttccccctcccaggg

SEQ ID NO: 3263531 - DNA, 15 bp, Homo sapiens
ccttcccctacacct

SEQ ID NO: 3263532 - DNA, 23 bp, Homo sapiens
ccttcccctcagccacacccagg

SEQ ID NO: 3263533 - DNA, 17 bp, Homo sapiens
ccttcccctcccctcct

SEQ ID NO: 3263534 - DNA, 20 bp, Homo sapiens
ccttcccctcccctccttgt

SEQ ID NO: 3263535 - DNA, 16 bp, Homo sapiens
ccttcccctgtcttca

SEQ ID NO: 3263536 - DNA, 18 bp, Homo sapiens
ccttccccttctgtgtca

SEQ ID NO: 3263537 - DNA, 20 bp, Homo sapiens
ccttccccttttgcctggct

SEQ ID NO: 3263538 - DNA, 22 bp, Homo sapiens
ccttcccttttctgttctagtt

SEQ ID NO: 3263539 - DNA, 18 bp, Homo sapiens
ccttcctaaatatccaaa

SEQ ID NO: 3263540 - DNA, 17 bp, Homo sapiens
ccttgctgatggcttga

SEQ ID NO: 3263541 - DNA, 11 bp, Homo sapiens
ccttgctgccc

SEQ ID NO: 3263542 - DNA, 12 bp, Homo sapiens
ccttgctgcccg

SEQ ID NO: 3263543 - DNA, 13 bp, Homo sapiens
ccttgctgctgct

SEQ ID NO: 3263544 - DNA, 17 bp, Homo sapiens
ccttgctggaaaaccca

SEQ ID NO: 3263545 - DNA, 17 bp, Homo sapiens
ccttgctggccccagcc

SEQ ID NO: 3263546 - DNA, 21 bp, Homo sapiens
ccttgctggccccagccctgc

SEQ ID NO: 3263547 - DNA, 20 bp, Homo sapiens
ccttgctgtatgctgatcat

SEQ ID NO: 3263548 - DNA, 14 bp, Homo sapiens
ccttgctgtcctga

SEQ ID NO: 3263549 - DNA, 17 bp, Homo sapiens
ccttgctgtcctgatct

SEQ ID NO: 3263550 - DNA, 19 bp, Homo sapiens
ccttgctgtttgtcctgag

SEQ ID NO: 3263551 - DNA, 18 bp, Homo sapiens
ccttgcttatgacatcac

SEQ ID NO: 3263552 - DNA, 12 bp, Homo sapiens
ccttgcttgtta

SEQ ID NO: 3263553 - DNA, 18 bp, Homo sapiens
ccttgctttgggctttgc

SEQ ID NO: 3263554 - DNA, 22 bp, Homo sapiens
ccttgctttgggctttgcaggc

SEQ ID NO: 3263555 - DNA, 16 bp, Homo sapiens
ccttggacatcctcct

SEQ ID NO: 3263556 - DNA, 19 bp, Homo sapiens
ccttggagagacacagcgt

SEQ ID NO: 3263557 - DNA, 16 bp, Homo sapiens
ccttggagcttacata

SEQ ID NO: 3263558 - DNA, 15 bp, Homo sapiens
ccttggaggagagag

SEQ ID NO: 3263559 - DNA, 22 bp, Homo sapiens
ccttggatcctgaatctgtgca

SEQ ID NO: 3263560 - DNA, 19 bp, Homo sapiens
ccttggcatcacagggcag

SEQ ID NO: 3263561 - DNA, 23 bp, Homo sapiens
ccttggccggctgtgctcagaga

SEQ ID NO: 3263562 - DNA, 20 bp, Homo sapiens
ccttggcctagcccaccctg

SEQ ID NO: 3263563 - DNA, 22 bp, Homo sapiens
ccttggcctagcccaccctgct

SEQ ID NO: 3263564 - DNA, 11 bp, Homo sapiens
ccttggcctca

SEQ ID NO: 3263565 - DNA, 13 bp, Homo sapiens
ccttggcctcaga

SEQ ID NO: 3263566 - DNA, 18 bp, Homo sapiens
ccttggcctctccttgga

SEQ ID NO: 3263567 - DNA, 14 bp, Homo sapiens
ccttggctgcaggg

SEQ ID NO: 3263568 - DNA, 21 bp, Homo sapiens
ccttggctgtgaggcccctgg

SEQ ID NO: 3263569 - DNA, 17 bp, Homo sapiens
ccttggcttacctgacc

SEQ ID NO: 3263570 - DNA, 21 bp, Homo sapiens
ccttgggacagccagagctgg

SEQ ID NO: 3263571 - DNA, 20 bp, Homo sapiens
ccttgggatcagatcaagag

SEQ ID NO: 3263572 - DNA, 19 bp, Homo sapiens
ccttgggcatccacccagt

SEQ ID NO: 3263573 - DNA, 18 bp, Homo sapiens
ccttgggcctgggcctct

SEQ ID NO: 3263574 - DNA, 12 bp, Homo sapiens
ccttgggctcct

SEQ ID NO: 3263575 - DNA, 20 bp, Homo sapiens
ccttgggctcctggctgcca

SEQ ID NO: 3263576 - DNA, 23 bp, Homo sapiens
ccttggggaatttcctctattga

SEQ ID NO: 3263577 - DNA, 19 bp, Homo sapiens
ccttggggaggacaaaact

SEQ ID NO: 3263578 - DNA, 13 bp, Homo sapiens
ccttggggcctgg

SEQ ID NO: 3263579 - DNA, 16 bp, Homo sapiens
ccttggggcctggctt

SEQ ID NO: 3263580 - DNA, 22 bp, Homo sapiens
ccttggggcctggcttgctcca

SEQ ID NO: 3263581 - DNA, 21 bp, Homo sapiens
ccttggggtaagccagagcct

SEQ ID NO: 3263582 - DNA, 23 bp, Homo sapiens
ccttggggtaagccagagcctgg

SEQ ID NO: 3263583 - DNA, 20 bp, Homo sapiens
ccttggggtccctccacccc

SEQ ID NO: 3263584 - DNA, 21 bp, Homo sapiens
ccttgggtatttgcaatattc

SEQ ID NO: 3263585 - DNA, 22 bp, Homo sapiens
ccttgggtcattgacctctcag

SEQ ID NO: 3263586 - DNA, 21 bp, Homo sapiens
ccttgggtgagtggcctgcta

SEQ ID NO: 3263587 - DNA, 21 bp, Homo sapiens
ccttgggttccaaccaggcag

SEQ ID NO: 3263588 - DNA, 21 bp, Homo sapiens
ccttgggttgctggttggatt

SEQ ID NO: 3263589 - DNA, 17 bp, Homo sapiens
ccttggtggcaagagcc

SEQ ID NO: 3263590 - DNA, 19 bp, Homo sapiens
ccttgtaattctaaatgaa

SEQ ID NO: 3263591 - DNA, 16 bp, Homo sapiens
ccttgtacagtgtctg

SEQ ID NO: 3263592 - DNA, 22 bp, Homo sapiens
ccttgtacagtgtctgtgccat

SEQ ID NO: 3263593 - DNA, 11 bp, Homo sapiens
ccttgtataaa

SEQ ID NO: 3263594 - DNA, 19 bp, Homo sapiens
ccttgtattttgttaaagc

SEQ ID NO: 3263595 - DNA, 20 bp, Homo sapiens
ccttgtattttgttaaagct

SEQ ID NO: 3263596 - DNA, 16 bp, Homo sapiens
ccttgtcctgccagct

SEQ ID NO: 3263597 - DNA, 18 bp, Homo sapiens
ccttgtctagtttcccac

SEQ ID NO: 3263598 - DNA, 20 bp, Homo sapiens
ccttgtctagtttcccacat

SEQ ID NO: 3263599 - DNA, 19 bp, Homo sapiens
ccttgtctgaatgtattta

SEQ ID NO: 3263600 - DNA, 18 bp, Homo sapiens
ccttgtctgggtctacca

SEQ ID NO: 3263601 - DNA, 16 bp, Homo sapiens
ccttgtggcagaggat

SEQ ID NO: 3263602 - DNA, 15 bp, Homo sapiens
ccttgtgtatatttg

SEQ ID NO: 3263603 - DNA, 15 bp, Homo sapiens
ccttgttacttctga

SEQ ID NO: 3263604 - DNA, 20 bp, Homo sapiens
ccttgtttatcagatacatc

SEQ ID NO: 3263605 - DNA, 15 bp, Homo sapiens
cctttaaaaaagaaa

SEQ ID NO: 3263606 - DNA, 19 bp, Homo sapiens
cctttaagatatccatctt

SEQ ID NO: 3263607 - DNA, 20 bp, Homo sapiens
cctttaagatatccatcttt

SEQ ID NO: 3263608 - DNA, 15 bp, Homo sapiens
cctttacaatgtgaa

SEQ ID NO: 3263609 - DNA, 18 bp, Homo sapiens
cctttactatcattctca

SEQ ID NO: 3263610 - DNA, 20 bp, Homo sapiens
cctttagcacgtttaaagtt

SEQ ID NO: 3263611 - DNA, 15 bp, Homo sapiens
cctttagggcagctt

SEQ ID NO: 3263612 - DNA, 15 bp, Homo sapiens
cctttaggtctggtt

SEQ ID NO: 3263613 - DNA, 13 bp, Homo sapiens
cctttaggttctt

SEQ ID NO: 3263614 - DNA, 18 bp, Homo sapiens
cctttagtacctgaaaag

SEQ ID NO: 3263615 - DNA, 19 bp, Homo sapiens
cctttatgtggaaaacaga

SEQ ID NO: 3263616 - DNA, 23 bp, Homo sapiens
cctttatgtggaaaacagaacat

SEQ ID NO: 3263617 - DNA, 14 bp, Homo sapiens
cctttattctcact

SEQ ID NO: 3263618 - DNA, 21 bp, Homo sapiens
cctttcacagagcagagtctg

SEQ ID NO: 3263619 - DNA, 23 bp, Homo sapiens
cctttccaccacagccagcacct

SEQ ID NO: 3263620 - DNA, 13 bp, Homo sapiens
cctttccagcctc

SEQ ID NO: 3263621 - DNA, 11 bp, Homo sapiens
cctttccataa

SEQ ID NO: 3263622 - DNA, 15 bp, Homo sapiens
cctttcccaccattc

SEQ ID NO: 3263623 - DNA, 19 bp, Homo sapiens
cctttcccaccattcctgc

SEQ ID NO: 3263624 - DNA, 12 bp, Homo sapiens
cctttccccagc

SEQ ID NO: 3263625 - DNA, 14 bp, Homo sapiens
cctttccccagcat

SEQ ID NO: 3263626 - DNA, 16 bp, Homo sapiens
cctttccccagcatca

SEQ ID NO: 3263627 - DNA, 15 bp, Homo sapiens
cctttccccagccca

SEQ ID NO: 3263628 - DNA, 17 bp, Homo sapiens
cctttccccagcccagg

SEQ ID NO: 3263629 - DNA, 12 bp, Homo sapiens
cctttcccctct

SEQ ID NO: 3263630 - DNA, 19 bp, Homo sapiens
cctttcccctctctgcccc

SEQ ID NO: 3263631 - DNA, 20 bp, Homo sapiens
cctttcccctctctgcccct

SEQ ID NO: 3263632 - DNA, 13 bp, Homo sapiens
cctttccccttcc

SEQ ID NO: 3263633 - DNA, 15 bp, Homo sapiens
cctttccccttcccc

SEQ ID NO: 3263634 - DNA, 12 bp, Homo sapiens
cctttcccttct

SEQ ID NO: 3263635 - DNA, 13 bp, Homo sapiens
cctttcccttggt

SEQ ID NO: 3263636 - DNA, 16 bp, Homo sapiens
cctttccgctgtcgcc

SEQ ID NO: 3263637 - DNA, 17 bp, Homo sapiens
cctttccggcacactgc

SEQ ID NO: 3263638 - DNA, 18 bp, Homo sapiens
cctttccggcacactgcc

SEQ ID NO: 3263639 - DNA, 19 bp, Homo sapiens
cctttccggcacactgcca

SEQ ID NO: 3263640 - DNA, 10 bp, Homo sapiens
cctttctcac

SEQ ID NO: 3263641 - DNA, 15 bp, Homo sapiens
cctttctccagccag

SEQ ID NO: 3263642 - DNA, 20 bp, Homo sapiens
cctttctccagccagcaatg

SEQ ID NO: 3263643 - DNA, 15 bp, Homo sapiens
cctttctctctcctc

SEQ ID NO: 3263644 - DNA, 15 bp, Homo sapiens
cctttctctctctaa

SEQ ID NO: 3263645 - DNA, 12 bp, Homo sapiens
cctttctctttc

SEQ ID NO: 3263646 - DNA, 14 bp, Homo sapiens
cctttctctttctc

SEQ ID NO: 3263647 - DNA, 17 bp, Homo sapiens
cctttctctttctctct

SEQ ID NO: 3263648 - DNA, 18 bp, Homo sapiens
cctttctctttctctctt

SEQ ID NO: 3263649 - DNA, 21 bp, Homo sapiens
cctttctctttctctcttccc

SEQ ID NO: 3263650 - DNA, 14 bp, Homo sapiens
cctttctgccttgg

SEQ ID NO: 3263651 - DNA, 15 bp, Homo sapiens
cctttctgccttggc

SEQ ID NO: 3263652 - DNA, 21 bp, Homo sapiens
cctttctgccttggcctcggc

SEQ ID NO: 3263653 - DNA, 22 bp, Homo sapiens
cctttctggaagtttctggtgc

SEQ ID NO: 3263654 - DNA, 18 bp, Homo sapiens
cctttctgggagcagaaa

SEQ ID NO: 3263655 - DNA, 16 bp, Homo sapiens
cctttctgtaccattt

SEQ ID NO: 3263656 - DNA, 12 bp, Homo sapiens
cgaccacctgcc

SEQ ID NO: 3263657 - DNA, 14 bp, Homo sapiens
cgaccacttccagg

SEQ ID NO: 3263658 - DNA, 23 bp, Homo sapiens
cgaccagacaccttgacagggca

SEQ ID NO: 3263659 - DNA, 16 bp, Homo sapiens
cgaccagggccgagga

SEQ ID NO: 3263660 - DNA, 20 bp, Homo sapiens
cgacccagaatggagcctgc

SEQ ID NO: 3263661 - DNA, 19 bp, Homo sapiens
cgacccctagttccctctg

SEQ ID NO: 3263662 - DNA, 14 bp, Homo sapiens
cgaccctctgggaa

SEQ ID NO: 3263663 - DNA, 18 bp, Homo sapiens
cgaccctctgggaacctc

SEQ ID NO: 3263664 - DNA, 13 bp, Homo sapiens
cgaccgccccctc

SEQ ID NO: 3263665 - DNA, 15 bp, Homo sapiens
cgacgcgtctcctgt

SEQ ID NO: 3263666 - DNA, 14 bp, Homo sapiens
cgactctaagctgt

SEQ ID NO: 3263667 - DNA, 17 bp, Homo sapiens
cgactctaagctgtgtg

SEQ ID NO: 3263668 - DNA, 21 bp, Homo sapiens
cgactctaagctgtgtgcagg

SEQ ID NO: 3263669 - DNA, 12 bp, Homo sapiens
cgactctgcact

SEQ ID NO: 3263670 - DNA, 16 bp, Homo sapiens
cgactgcacagcggcc

SEQ ID NO: 3263671 - DNA, 15 bp, Homo sapiens
cgactggccagggcc

SEQ ID NO: 3263672 - DNA, 13 bp, Homo sapiens
cgactttattttc

SEQ ID NO: 3263673 - DNA, 15 bp, Homo sapiens
cgactttctgcctgg

SEQ ID NO: 3263674 - DNA, 14 bp, Homo sapiens
cgagaccagcctcg

SEQ ID NO: 3263675 - DNA, 16 bp, Homo sapiens
cgagaccagcctggcc

SEQ ID NO: 3263676 - DNA, 16 bp, Homo sapiens
cgagaccatcctggct

SEQ ID NO: 3263677 - DNA, 17 bp, Homo sapiens
cgagaccatcctggcta

SEQ ID NO: 3263678 - DNA, 15 bp, Homo sapiens
cgagacctcaagccc

SEQ ID NO: 3263679 - DNA, 17 bp, Homo sapiens
cgcagacaccttggaca

SEQ ID NO: 3263680 - DNA, 18 bp, Homo sapiens
cgcagacctccccagccc

SEQ ID NO: 3263681 - DNA, 20 bp, Homo sapiens
cgcagacctccccagcccct

SEQ ID NO: 3263682 - DNA, 18 bp, Homo sapiens
cgcagacgggcacagaca

SEQ ID NO: 3263683 - DNA, 19 bp, Homo sapiens
cgcagacgggcacagacac

SEQ ID NO: 3263684 - DNA, 13 bp, Homo sapiens
cgcagaggacgca

SEQ ID NO: 3263685 - DNA, 19 bp, Homo sapiens
cgcagcccgtgaagcagtg

SEQ ID NO: 3263686 - DNA, 22 bp, Homo sapiens
cgcagcccgtgaagcagtgcct

SEQ ID NO: 3263687 - DNA, 19 bp, Homo sapiens
cgcagctcttgcccttccc

SEQ ID NO: 3263688 - DNA, 23 bp, Homo sapiens
cgcagctcttgcccttccctgtc

SEQ ID NO: 3263689 - DNA, 20 bp, Homo sapiens
cgcaggaactgggctgggcc

SEQ ID NO: 3263690 - DNA, 21 bp, Homo sapiens
cgcaggaactgggctgggcct

SEQ ID NO: 3263691 - DNA, 21 bp, Homo sapiens
cgcaggagaatcactgcagcc

SEQ ID NO: 3263692 - DNA, 22 bp, Homo sapiens
cgcaggagtctctgccacccac

SEQ ID NO: 3263693 - DNA, 15 bp, Homo sapiens
cgcaggatccgctgc

SEQ ID NO: 3263694 - DNA, 17 bp, Homo sapiens
cgcaggatccgctgcca

SEQ ID NO: 3263695 - DNA, 14 bp, Homo sapiens
cgcagggacaagcc

SEQ ID NO: 3263696 - DNA, 13 bp, Homo sapiens
cgcagtccccagc

SEQ ID NO: 3263697 - DNA, 16 bp, Homo sapiens
cgcagtcgtcgcacag

SEQ ID NO: 3263698 - DNA, 15 bp, Homo sapiens
cgcagtgctgggacc

SEQ ID NO: 3263699 - DNA, 17 bp, Homo sapiens
cgcagtgctgggaccag

SEQ ID NO: 3263700 - DNA, 18 bp, Homo sapiens
cgcagtgctgggaccaga

SEQ ID NO: 3263701 - DNA, 20 bp, Homo sapiens
cgcagtgctgggaccagagc

SEQ ID NO: 3263702 - DNA, 13 bp, Homo sapiens
cgcatagactgag

SEQ ID NO: 3263703 - DNA, 12 bp, Homo sapiens
cgcatccagcaa

SEQ ID NO: 3263704 - DNA, 16 bp, Homo sapiens
cgcatggtcacacact

SEQ ID NO: 3263705 - DNA, 14 bp, Homo sapiens
cgccaaatgttcat

SEQ ID NO: 3263706 - DNA, 15 bp, Homo sapiens
cgccaaatgttcatc

SEQ ID NO: 3263707 - DNA, 20 bp, Homo sapiens
cgccaacgttcgatttctac

SEQ ID NO: 3263708 - DNA, 13 bp, Homo sapiens
cgccaagatctac

SEQ ID NO: 3263709 - DNA, 21 bp, Homo sapiens
cgccttgtctcctactcctga

SEQ ID NO: 3263710 - DNA, 13 bp, Homo sapiens
cgccttttgtata

SEQ ID NO: 3263711 - DNA, 16 bp, Homo sapiens
cgccttttgtatacat

SEQ ID NO: 3263712 - DNA, 22 bp, Homo sapiens
cgcgactaatttcaaaatgctt

SEQ ID NO: 3263713 - DNA, 22 bp, Homo sapiens
cgcgccactacactccagcctg

SEQ ID NO: 3263714 - DNA, 18 bp, Homo sapiens
cgcgccactcgcttcccc

SEQ ID NO: 3263715 - DNA, 16 bp, Homo sapiens
cgcgcccgcccctgca

SEQ ID NO: 3263716 - DNA, 14 bp, Homo sapiens
cgcgcgcacacaca

SEQ ID NO: 3263717 - DNA, 13 bp, Homo sapiens
cgcgcgcgcacac

SEQ ID NO: 3263718 - DNA, 15 bp, Homo sapiens
cgcgctcgcccagca

SEQ ID NO: 3263719 - DNA, 17 bp, Homo sapiens
cgcgctcgcccagcagg

SEQ ID NO: 3263720 - DNA, 12 bp, Homo sapiens
cgcgctctttct

SEQ ID NO: 3263721 - DNA, 22 bp, Homo sapiens
cgcgctctttcttccctcgtga

SEQ ID NO: 3263722 - DNA, 21 bp, Homo sapiens
cgcggaggagctagcctgaag

SEQ ID NO: 3263723 - DNA, 20 bp, Homo sapiens
cgcggaggaggagggaggcc

SEQ ID NO: 3263724 - DNA, 11 bp, Homo sapiens
cgcggcctccc

SEQ ID NO: 3263725 - DNA, 18 bp, Homo sapiens
cgcggctcaaaaggaaac

SEQ ID NO: 3263726 - DNA, 14 bp, Homo sapiens
cgcggctggctctg

SEQ ID NO: 3263727 - DNA, 22 bp, Homo sapiens
cgcggctggctctgtggagggg

SEQ ID NO: 3263728 - DNA, 22 bp, Homo sapiens
cgcgggagacagcttctctgca

SEQ ID NO: 3263729 - DNA, 21 bp, Homo sapiens
cgcgggaggcaccagctctgt

SEQ ID NO: 3263730 - DNA, 14 bp, Homo sapiens
cgcgggagggggcg

SEQ ID NO: 3263731 - DNA, 20 bp, Homo sapiens
cgcgggcagcgggccaggcc

SEQ ID NO: 3263732 - DNA, 21 bp, Homo sapiens
cgcgggcagcgggccaggccc

SEQ ID NO: 3263733 - DNA, 18 bp, Homo sapiens
cgcggtgctctggcggct

SEQ ID NO: 3263734 - DNA, 12 bp, Homo sapiens
cgcgtctcctgt

SEQ ID NO: 3263735 - DNA, 16 bp, Homo sapiens
cgcgtgcacacaccag

SEQ ID NO: 3263736 - DNA, 21 bp, Homo sapiens
cgctaaagagcccttgcctcc

SEQ ID NO: 3263737 - DNA, 14 bp, Homo sapiens
cgctaacaatttct

SEQ ID NO: 3263738 - DNA, 17 bp, Homo sapiens
cgctagagcagcccaaa

SEQ ID NO: 3263739 - DNA, 14 bp, Homo sapiens
cgctatcttcacat

SEQ ID NO: 3263740 - DNA, 20 bp, Homo sapiens
cgctcagacggcggccaggc

SEQ ID NO: 3263741 - DNA, 21 bp, Homo sapiens
cgctcagccctccctgcccct

SEQ ID NO: 3263742 - DNA, 15 bp, Homo sapiens
cgctcaggacccagg

SEQ ID NO: 3263743 - DNA, 17 bp, Homo sapiens
cgctcaggacccaggcc

SEQ ID NO: 3263744 - DNA, 19 bp, Homo sapiens
cgctcaggacccaggccct

SEQ ID NO: 3263745 - DNA, 19 bp, Homo sapiens
cgctcagggccatgctgag

SEQ ID NO: 3263746 - DNA, 12 bp, Homo sapiens
cccagccctggc

SEQ ID NO: 3263747 - DNA, 14 bp, Homo sapiens
cccagccctgggaa

SEQ ID NO: 3263748 - DNA, 18 bp, Homo sapiens
cccagcccttctgccttt

SEQ ID NO: 3263749 - DNA, 14 bp, Homo sapiens
cccagccgctcgga

SEQ ID NO: 3263750 - DNA, 18 bp, Homo sapiens
cccagccggccaatggaa

SEQ ID NO: 3263751 - DNA, 14 bp, Homo sapiens
cccagccggcctct

SEQ ID NO: 3263752 - DNA, 15 bp, Homo sapiens
cccagccggcctctc

SEQ ID NO: 3263753 - DNA, 14 bp, Homo sapiens
ccccaagcagccag

SEQ ID NO: 3263754 - DNA, 15 bp, Homo sapiens
ccccaagcagccagc

SEQ ID NO: 3263755 - DNA, 22 bp, Homo sapiens
cccacagatgtctctggggcag

SEQ ID NO: 3263756 - DNA, 18 bp, Homo sapiens
cccacagcgtccctggcg

SEQ ID NO: 3263757 - DNA, 11 bp, Homo sapiens
cccacagtttt

SEQ ID NO: 3263758 - DNA, 18 bp, Homo sapiens
cccacatccaactccagc

SEQ ID NO: 3263759 - DNA, 19 bp, Homo sapiens
cccacatccaactccagca

SEQ ID NO: 3263760 - DNA, 18 bp, Homo sapiens
cccacatgaggacatgat

SEQ ID NO: 3263761 - DNA, 14 bp, Homo sapiens
cccacatgaggcca

SEQ ID NO: 3263762 - DNA, 16 bp, Homo sapiens
cccacatgtgacacat

SEQ ID NO: 3263763 - DNA, 16 bp, Homo sapiens
cccaccaaactgcaca

SEQ ID NO: 3263764 - DNA, 13 bp, Homo sapiens
cccaccagggtcc

SEQ ID NO: 3263765 - DNA, 16 bp, Homo sapiens
cccaccatatgaattg

SEQ ID NO: 3263766 - DNA, 12 bp, Homo sapiens
cccaccattcct

SEQ ID NO: 3263767 - DNA, 12 bp, Homo sapiens
cccacccacccc

SEQ ID NO: 3263768 - DNA, 13 bp, Homo sapiens
cccacccacccca

SEQ ID NO: 3263769 - DNA, 14 bp, Homo sapiens
cccacccaccccac

SEQ ID NO: 3263770 - DNA, 16 bp, Homo sapiens
cccacccaccccacag

SEQ ID NO: 3263771 - DNA, 14 bp, Homo sapiens
cccacccacccgcc

SEQ ID NO: 3263772 - DNA, 12 bp, Homo sapiens
cccacccacgca

SEQ ID NO: 3263773 - DNA, 20 bp, Homo sapiens
cccacccacgcatacacaca

SEQ ID NO: 3263774 - DNA, 21 bp, Homo sapiens
cccacccatcttcctgctgct

SEQ ID NO: 3263775 - DNA, 15 bp, Homo sapiens
cccaccccacctgca

SEQ ID NO: 3263776 - DNA, 13 bp, Homo sapiens
cccaccccacgcc

SEQ ID NO: 3263777 - DNA, 23 bp, Homo sapiens
cccaccccacgcccgcacccccg

SEQ ID NO: 3263778 - DNA, 15 bp, Homo sapiens
cccacccccagccag

SEQ ID NO: 3263779 - DNA, 16 bp, Homo sapiens
cccacccccagccagg

SEQ ID NO: 3263780 - DNA, 12 bp, Homo sapiens
cccaccccctca

SEQ ID NO: 3263781 - DNA, 13 bp, Homo sapiens
cccaccccctcaa

SEQ ID NO: 3263782 - DNA, 15 bp, Homo sapiens
cccaccccctgccct

SEQ ID NO: 3263783 - DNA, 17 bp, Homo sapiens
cccaccccctgccctgc

SEQ ID NO: 3263784 - DNA, 19 bp, Homo sapiens
cccaccccctgccctgcac

SEQ ID NO: 3263785 - DNA, 16 bp, Homo sapiens
cccacccctaagtgcc

SEQ ID NO: 3263786 - DNA, 20 bp, Homo sapiens
cccacccctaagtgcccaaa

SEQ ID NO: 3263787 - DNA, 12 bp, Homo sapiens
cccacccctgca

SEQ ID NO: 3263788 - DNA, 16 bp, Homo sapiens
cccaccccttaggccc

SEQ ID NO: 3263789 - DNA, 15 bp, Homo sapiens
cccaccccttcccca

SEQ ID NO: 3263790 - DNA, 16 bp, Homo sapiens
cccacccgatgctgct

SEQ ID NO: 3263791 - DNA, 12 bp, Homo sapiens
cccaccctcagc

SEQ ID NO: 3263792 - DNA, 14 bp, Homo sapiens
cccaccctcagcac

SEQ ID NO: 3263793 - DNA, 21 bp, Homo sapiens
cccaccctcagcaccccttcc

SEQ ID NO: 3263794 - DNA, 14 bp, Homo sapiens
cccaccctccactc

SEQ ID NO: 3263795 - DNA, 18 bp, Homo sapiens
cccaccctccttgagact

SEQ ID NO: 3263796 - DNA, 21 bp, Homo sapiens
cccaccctgctcctcctgccc

SEQ ID NO: 3263797 - DNA, 13 bp, Homo sapiens
cccaccctgggcc

SEQ ID NO: 3263798 - DNA, 15 bp, Homo sapiens
cccaccgatggagcc

SEQ ID NO: 3263799 - DNA, 15 bp, Homo sapiens
cccaccgcagtcacc

SEQ ID NO: 3263800 - DNA, 21 bp, Homo sapiens
cccaccggtccagctggcctg

SEQ ID NO: 3263801 - DNA, 17 bp, Homo sapiens
cccaccgtccgccctgc

SEQ ID NO: 3263802 - DNA, 18 bp, Homo sapiens
cccacctacttgtgactg

SEQ ID NO: 3263803 - DNA, 14 bp, Homo sapiens
cccacctagcccag

SEQ ID NO: 3263804 - DNA, 18 bp, Homo sapiens
cccacctcagcctcccaa

SEQ ID NO: 3263805 - DNA, 21 bp, Homo sapiens
cccacctcagcctcccaaagt

SEQ ID NO: 3263806 - DNA, 12 bp, Homo sapiens
cccacctccacc

SEQ ID NO: 3263807 - DNA, 20 bp, Homo sapiens
cccacctccacccagcccct

SEQ ID NO: 3263808 - DNA, 12 bp, Homo sapiens
cccacctccagc

SEQ ID NO: 3263809 - DNA, 13 bp, Homo sapiens
cccacctccagcc

SEQ ID NO: 3263810 - DNA, 14 bp, Homo sapiens
cccacctccagccc

SEQ ID NO: 3263811 - DNA, 10 bp, Homo sapiens
cccacctccc

SEQ ID NO: 3263812 - DNA, 13 bp, Homo sapiens
cccacctccccac

SEQ ID NO: 3263813 - DNA, 13 bp, Homo sapiens
cccacctcctgca

SEQ ID NO: 3263814 - DNA, 12 bp, Homo sapiens
cccacctctggc

SEQ ID NO: 3263815 - DNA, 14 bp, Homo sapiens
cccacctctggccc

SEQ ID NO: 3263816 - DNA, 15 bp, Homo sapiens
cccacctctgtgacc

SEQ ID NO: 3263817 - DNA, 17 bp, Homo sapiens
cccacctgacaatggca

SEQ ID NO: 3263818 - DNA, 21 bp, Homo sapiens
cccacctgacaatggcagcta

SEQ ID NO: 3263819 - DNA, 18 bp, Homo sapiens
cccacctgacacaccagg

SEQ ID NO: 3263820 - DNA, 13 bp, Homo sapiens
cccacctgcccat

SEQ ID NO: 3263821 - DNA, 23 bp, Homo sapiens
cccacctgcccatcacagggttg

SEQ ID NO: 3263822 - DNA, 13 bp, Homo sapiens
cccacctggccac

SEQ ID NO: 3263823 - DNA, 17 bp, Homo sapiens
cccacctggccacctga

SEQ ID NO: 3263824 - DNA, 13 bp, Homo sapiens
cccacctgggacc

SEQ ID NO: 3263825 - DNA, 19 bp, Homo sapiens
cccaccttcaattcctggg

SEQ ID NO: 3263826 - DNA, 22 bp, Homo sapiens
cccaccttcaattcctgggccc

SEQ ID NO: 3263827 - DNA, 13 bp, Homo sapiens
cccaccttgacca

SEQ ID NO: 3263828 - DNA, 22 bp, Homo sapiens
cccaccttggctcaagtcctct

SEQ ID NO: 3263829 - DNA, 13 bp, Homo sapiens
cccacgagggctg

SEQ ID NO: 3263830 - DNA, 14 bp, Homo sapiens
cccacgagtcacct

SEQ ID NO: 3263831 - DNA, 18 bp, Homo sapiens
cccacgattttctccagc

SEQ ID NO: 3263832 - DNA, 20 bp, Homo sapiens
cccacgattttctccagctc

SEQ ID NO: 3263833 - DNA, 13 bp, Homo sapiens
cccacgcagagga

SEQ ID NO: 3263834 - DNA, 21 bp, Homo sapiens
cccacgcatacacacatgccc

SEQ ID NO: 3263835 - DNA, 16 bp, Homo sapiens
cccacgccgggaacca

SEQ ID NO: 3263836 - DNA, 16 bp, Homo sapiens
cccacgctcaccccct

SEQ ID NO: 3263837 - DNA, 15 bp, Homo sapiens
cccacggagccctcc

SEQ ID NO: 3263838 - DNA, 19 bp, Homo sapiens
ccaggctggcgtgcagtgg

SEQ ID NO: 3263839 - DNA, 16 bp, Homo sapiens
ccaggctggcttgccc

SEQ ID NO: 3263840 - DNA, 17 bp, Homo sapiens
ccaggctggcttgcccg

SEQ ID NO: 3263841 - DNA, 20 bp, Homo sapiens
ccaggctggtccgagctgag

SEQ ID NO: 3263842 - DNA, 22 bp, Homo sapiens
ccaggctggtccgagctgagga

SEQ ID NO: 3263843 - DNA, 14 bp, Homo sapiens
ccaggctggtctca

SEQ ID NO: 3263844 - DNA, 21 bp, Homo sapiens
ccaggctggtttcgaactcct

SEQ ID NO: 3263845 - DNA, 17 bp, Homo sapiens
ccaggctgtgggcctca

SEQ ID NO: 3263846 - DNA, 22 bp, Homo sapiens
ccagggaaggtggggccctgcc

SEQ ID NO: 3263847 - DNA, 17 bp, Homo sapiens
ccagggaatccaagcct

SEQ ID NO: 3263848 - DNA, 18 bp, Homo sapiens
ccagggaatccaagcctc

SEQ ID NO: 3263849 - DNA, 22 bp, Homo sapiens
ccagggactcagcgtcccctgc

SEQ ID NO: 3263850 - DNA, 16 bp, Homo sapiens
ccagggagcctagaag

SEQ ID NO: 3263851 - DNA, 12 bp, Homo sapiens
ccagggagcctt

SEQ ID NO: 3263852 - DNA, 13 bp, Homo sapiens
ccagggaggagag

SEQ ID NO: 3263853 - DNA, 15 bp, Homo sapiens
ccagggatgctgggc

SEQ ID NO: 3263854 - DNA, 19 bp, Homo sapiens
ccagggatgctgggctggg

SEQ ID NO: 3263855 - DNA, 22 bp, Homo sapiens
ccagggatgggggatgggccag

SEQ ID NO: 3263856 - DNA, 13 bp, Homo sapiens
ccagggcagggcc

SEQ ID NO: 3263857 - DNA, 12 bp, Homo sapiens
ccagggcagtgc

SEQ ID NO: 3263858 - DNA, 16 bp, Homo sapiens
ccagggcatgtgtatg

SEQ ID NO: 3263859 - DNA, 18 bp, Homo sapiens
ccagggcatgtgtatgtg

SEQ ID NO: 3263860 - DNA, 21 bp, Homo sapiens
ccagggcatgtgtatgtgtct

SEQ ID NO: 3263861 - DNA, 22 bp, Homo sapiens
ccagggcatgtgtatgtgtctg

SEQ ID NO: 3263862 - DNA, 23 bp, Homo sapiens
ccagggcatgtgtatgtgtctgc

SEQ ID NO: 3263863 - DNA, 20 bp, Homo sapiens
ccagggcattcgggccacag

SEQ ID NO: 3263864 - DNA, 18 bp, Homo sapiens
ccagggccacgctccagc

SEQ ID NO: 3263865 - DNA, 14 bp, Homo sapiens
ccagggccagggcc

SEQ ID NO: 3263866 - DNA, 21 bp, Homo sapiens
ccagggcccctcaccctgcct

SEQ ID NO: 3263867 - DNA, 19 bp, Homo sapiens
ccagggcccctccctctgc

SEQ ID NO: 3263868 - DNA, 22 bp, Homo sapiens
ccagggcctgcttccccttcct

SEQ ID NO: 3263869 - DNA, 13 bp, Homo sapiens
ccagggcctgggg

SEQ ID NO: 3263870 - DNA, 16 bp, Homo sapiens
ccagggcctgggggca

SEQ ID NO: 3263871 - DNA, 16 bp, Homo sapiens
ccagggctagtgactt

SEQ ID NO: 3263872 - DNA, 19 bp, Homo sapiens
ccagggctagtgacttgtg

SEQ ID NO: 3263873 - DNA, 22 bp, Homo sapiens
ccagggctcccttatgtccacc

SEQ ID NO: 3263874 - DNA, 13 bp, Homo sapiens
ccagggctcctgc

SEQ ID NO: 3263875 - DNA, 14 bp, Homo sapiens
ccagggctcctgca

SEQ ID NO: 3263876 - DNA, 18 bp, Homo sapiens
ccagggctctgccccagt

SEQ ID NO: 3263877 - DNA, 19 bp, Homo sapiens
ccagggctctgccccagtc

SEQ ID NO: 3263878 - DNA, 15 bp, Homo sapiens
ccagggctgccctga

SEQ ID NO: 3263879 - DNA, 17 bp, Homo sapiens
ccagggctgccctgaga

SEQ ID NO: 3263880 - DNA, 14 bp, Homo sapiens
ccagggctggctct

SEQ ID NO: 3263881 - DNA, 13 bp, Homo sapiens
ccagggctgggga

SEQ ID NO: 3263882 - DNA, 20 bp, Homo sapiens
ccagggcttcctcttccggg

SEQ ID NO: 3263883 - DNA, 15 bp, Homo sapiens
ccaggggaacctgcc

SEQ ID NO: 3263884 - DNA, 16 bp, Homo sapiens
ccaggggaacctgcca

SEQ ID NO: 3263885 - DNA, 24 bp, Homo sapiens
ccaggggaacctgccatgccagga

SEQ ID NO: 3263886 - DNA, 14 bp, Homo sapiens
ccaggggcaggact

SEQ ID NO: 3263887 - DNA, 14 bp, Homo sapiens
ccaggggcccttgg

SEQ ID NO: 3263888 - DNA, 13 bp, Homo sapiens
ccaggggcctgca

SEQ ID NO: 3263889 - DNA, 21 bp, Homo sapiens
ccaggggcctgcagaaggaaa

SEQ ID NO: 3263890 - DNA, 15 bp, Homo sapiens
ccagagcaggaagca

SEQ ID NO: 3263891 - DNA, 12 bp, Homo sapiens
ccagagcagggt

SEQ ID NO: 3263892 - DNA, 18 bp, Homo sapiens
ccagagcatttccaacac

SEQ ID NO: 3263893 - DNA, 21 bp, Homo sapiens
ccagagcatttccaacaccac

SEQ ID NO: 3263894 - DNA, 23 bp, Homo sapiens
ccagagcatttccaacaccacag

SEQ ID NO: 3263895 - DNA, 12 bp, Homo sapiens
ccagagccagat

SEQ ID NO: 3263896 - DNA, 17 bp, Homo sapiens
ccagagccagatgcagg

SEQ ID NO: 3263897 - DNA, 18 bp, Homo sapiens
ccagagccagatgcagga

SEQ ID NO: 3263898 - DNA, 22 bp, Homo sapiens
ccagagccagatgcaggacagg

SEQ ID NO: 3263899 - DNA, 23 bp, Homo sapiens
ccagagccagatgcaggacagga

SEQ ID NO: 3263900 - DNA, 16 bp, Homo sapiens
ccagagccagcctggg

SEQ ID NO: 3263901 - DNA, 18 bp, Homo sapiens
ccagagccagcctgggac

SEQ ID NO: 3263902 - DNA, 19 bp, Homo sapiens
ccagagccagcctgggact

SEQ ID NO: 3263903 - DNA, 20 bp, Homo sapiens
ccagagccagcctgggactc

SEQ ID NO: 3263904 - DNA, 17 bp, Homo sapiens
ccagagcccttcactgc

SEQ ID NO: 3263905 - DNA, 22 bp, Homo sapiens
ccagagcggaggctgtgtgcct

SEQ ID NO: 3263906 - DNA, 20 bp, Homo sapiens
ccagagctggaaggcagggc

SEQ ID NO: 3263907 - DNA, 22 bp, Homo sapiens
ccagagctggaaggcagggcag

SEQ ID NO: 3263908 - DNA, 21 bp, Homo sapiens
ccagagctgggaggcatggcc

SEQ ID NO: 3263909 - DNA, 18 bp, Homo sapiens
ccagagctgtgccagcag

SEQ ID NO: 3263910 - DNA, 23 bp, Homo sapiens
ccagaggaactgtccagagagca

SEQ ID NO: 3263911 - DNA, 18 bp, Homo sapiens
ccagaggaatcctggcag

SEQ ID NO: 3263912 - DNA, 23 bp, Homo sapiens
ccagaggaatcctggcagcccag

SEQ ID NO: 3263913 - DNA, 19 bp, Homo sapiens
ccagaggagccaccagttc

SEQ ID NO: 3263914 - DNA, 12 bp, Homo sapiens
ccagaggcagcc

SEQ ID NO: 3263915 - DNA, 14 bp, Homo sapiens
ccagaggcccccag

SEQ ID NO: 3263916 - DNA, 18 bp, Homo sapiens
ccagaggcccccagccca

SEQ ID NO: 3263917 - DNA, 19 bp, Homo sapiens
ccagaggcccccagcccag

SEQ ID NO: 3263918 - DNA, 21 bp, Homo sapiens
ccagaggcccccagcccaggg

SEQ ID NO: 3263919 - DNA, 12 bp, Homo sapiens
ccagaggccctg

SEQ ID NO: 3263920 - DNA, 18 bp, Homo sapiens
ccagaggccgaaggtgcc

SEQ ID NO: 3263921 - DNA, 22 bp, Homo sapiens
ccagagggagtgacagaggcag

SEQ ID NO: 3263922 - DNA, 13 bp, Homo sapiens
ccagagggcccag

SEQ ID NO: 3263923 - DNA, 23 bp, Homo sapiens
ccagaggggtgggttcctcttcc

SEQ ID NO: 3263924 - DNA, 19 bp, Homo sapiens
ccagaggtgggatcctccc

SEQ ID NO: 3263925 - DNA, 22 bp, Homo sapiens
ccagaggtgggatcctccctca

SEQ ID NO: 3263926 - DNA, 14 bp, Homo sapiens
ccagaggtgggcag

SEQ ID NO: 3263927 - DNA, 16 bp, Homo sapiens
ccagaggtgggcaggt

SEQ ID NO: 3263928 - DNA, 19 bp, Homo sapiens
ccagaggtgggcaggtggt

SEQ ID NO: 3263929 - DNA, 19 bp, Homo sapiens
ccagaggttatctgcctgg

SEQ ID NO: 3263930 - DNA, 16 bp, Homo sapiens
ccagagtcctttccaa

SEQ ID NO: 3263931 - DNA, 14 bp, Homo sapiens
ccagagtctgagcc

SEQ ID NO: 3263932 - DNA, 21 bp, Homo sapiens
ccagagtgaaagggctatggc

SEQ ID NO: 3263933 - DNA, 20 bp, Homo sapiens
ccagagtggagtctgagtct

SEQ ID NO: 3263934 - DNA, 17 bp, Homo sapiens
ccagagtggcctggcca

SEQ ID NO: 3263935 - DNA, 21 bp, Homo sapiens
ccagagtggcctggccaggag

SEQ ID NO: 3263936 - DNA, 22 bp, Homo sapiens
ccagagtggcctggccaggagc

SEQ ID NO: 3263937 - DNA, 12 bp, Homo sapiens
ccagagtggctg

SEQ ID NO: 3263938 - DNA, 14 bp, Homo sapiens
ccagatagagaaat

SEQ ID NO: 3263939 - DNA, 15 bp, Homo sapiens
ccagatagagctggg

SEQ ID NO: 3263940 - DNA, 16 bp, Homo sapiens
ccagatcactgccaca

SEQ ID NO: 3263941 - DNA, 18 bp, Homo sapiens
ccagatcactgccacact

SEQ ID NO: 3263942 - DNA, 20 bp, Homo sapiens
ccagatcactgccacactct

SEQ ID NO: 3263943 - DNA, 18 bp, Homo sapiens
ccagatccagactgtaag

SEQ ID NO: 3263944 - DNA, 14 bp, Homo sapiens
ccagatctgcctgg

SEQ ID NO: 3263945 - DNA, 16 bp, Homo sapiens
ccagatctgcctgggc

SEQ ID NO: 3263946 - DNA, 20 bp, Homo sapiens
ccagatctgcctgggcctgt

SEQ ID NO: 3263947 - DNA, 22 bp, Homo sapiens
ccagatctgcctgggcctgtgc

SEQ ID NO: 3263948 - DNA, 13 bp, Homo sapiens
ccagatctggtcc

SEQ ID NO: 3263949 - DNA, 16 bp, Homo sapiens
ccagatctttcagaaa

SEQ ID NO: 3263950 - DNA, 21 bp, Homo sapiens
ccagatctttcagaaatataa

SEQ ID NO: 3263951 - DNA, 19 bp, Homo sapiens
ccagatgaggctggccaag

SEQ ID NO: 3263952 - DNA, 17 bp, Homo sapiens
ccagatgcaccagccct

SEQ ID NO: 3263953 - DNA, 13 bp, Homo sapiens
ccagatgcaggac

SEQ ID NO: 3263954 - DNA, 18 bp, Homo sapiens
ccagatgcaggacaggag

SEQ ID NO: 3263955 - DNA, 22 bp, Homo sapiens
ccagatgccctttggaaagcca

SEQ ID NO: 3263956 - DNA, 23 bp, Homo sapiens
ccagatgcctacaaccatccctg

SEQ ID NO: 3263957 - DNA, 17 bp, Homo sapiens
ccagatgctactggact

SEQ ID NO: 3263958 - DNA, 16 bp, Homo sapiens
ccagatggactccagc

SEQ ID NO: 3263959 - DNA, 12 bp, Homo sapiens
ccagatggcccc

SEQ ID NO: 3263960 - DNA, 13 bp, Homo sapiens
ccagatggcccct

SEQ ID NO: 3263961 - DNA, 22 bp, Homo sapiens
ccagatggctggaaggggtcca

SEQ ID NO: 3263962 - DNA, 21 bp, Homo sapiens
ccagattgacgacaagtgctg

SEQ ID NO: 3263963 - DNA, 14 bp, Homo sapiens
ccagattgcaacag

SEQ ID NO: 3263964 - DNA, 21 bp, Homo sapiens
ccagattgcaacaggctgggc

SEQ ID NO: 3263965 - DNA, 21 bp, Homo sapiens
ccagatttgctaatttatcct

SEQ ID NO: 3263966 - DNA, 13 bp, Homo sapiens
ccagcaagacctc

SEQ ID NO: 3263967 - DNA, 23 bp, Homo sapiens
ccagcaaggcaggttggatggga

SEQ ID NO: 3263968 - DNA, 15 bp, Homo sapiens
ccagcaagtgagagc

SEQ ID NO: 3263969 - DNA, 16 bp, Homo sapiens
ccagcaagtgagagct

SEQ ID NO: 3263970 - DNA, 21 bp, Homo sapiens
ccagcaagtgagagctgggtg

SEQ ID NO: 3263971 - DNA, 14 bp, Homo sapiens
ccagcacaaagcag

SEQ ID NO: 3263972 - DNA, 20 bp, Homo sapiens
ccagcacagcttagatttca

SEQ ID NO: 3263973 - DNA, 13 bp, Homo sapiens
ccagcacagcttg

SEQ ID NO: 3263974 - DNA, 13 bp, Homo sapiens
ccagcacaggggc

SEQ ID NO: 3263975 - DNA, 20 bp, Homo sapiens
ccagcacaggggccccagat

SEQ ID NO: 3263976 - DNA, 24 bp, Homo sapiens
ccagcacaggggccccagatctgc

SEQ ID NO: 3263977 - DNA, 12 bp, Homo sapiens
ccagcaccctct

SEQ ID NO: 3263978 - DNA, 18 bp, Homo sapiens
ccagcaccctctcctggg

SEQ ID NO: 3263979 - DNA, 21 bp, Homo sapiens
ccagcaccttctttctggact

SEQ ID NO: 3263980 - DNA, 14 bp, Homo sapiens
ccagcactcccctt

SEQ ID NO: 3263981 - DNA, 16 bp, Homo sapiens
ccagcactttgggagg

SEQ ID NO: 3263982 - DNA, 13 bp, Homo sapiens
ccagcagaactga

SEQ ID NO: 3263983 - DNA, 14 bp, Homo sapiens
ccagcagaactgaa

SEQ ID NO: 3263984 - DNA, 23 bp, Homo sapiens
ccagcagcatggcatagccccgg

SEQ ID NO: 3263985 - DNA, 21 bp, Homo sapiens
ccagcagccctaaggatctct

SEQ ID NO: 3263986 - DNA, 13 bp, Homo sapiens
ccagcagccctca

SEQ ID NO: 3263987 - DNA, 21 bp, Homo sapiens
ccagcagggggagaaaccctt

SEQ ID NO: 3263988 - DNA, 17 bp, Homo sapiens
ccagcaggtgtggtggc

SEQ ID NO: 3263989 - DNA, 13 bp, Homo sapiens
ccagcagttctgt

SEQ ID NO: 3263990 - DNA, 14 bp, Homo sapiens
ccagcagttctgtt

SEQ ID NO: 3263991 - DNA, 14 bp, Homo sapiens
ccagcatcactccc

SEQ ID NO: 3263992 - DNA, 16 bp, Homo sapiens
ccagcatcactcccca

SEQ ID NO: 3263993 - DNA, 21 bp, Homo sapiens
ccagcatcactccccaaggaa

SEQ ID NO: 3263994 - DNA, 14 bp, Homo sapiens
ccagcatccagcct

SEQ ID NO: 3263995 - DNA, 15 bp, Homo sapiens
ccagcatccagcctg

SEQ ID NO: 3263996 - DNA, 19 bp, Homo sapiens
ccagcatccagcctgtgtg

SEQ ID NO: 3263997 - DNA, 14 bp, Homo sapiens
ccagcatccctgga

SEQ ID NO: 3263998 - DNA, 17 bp, Homo sapiens
ccagcatccctggagca

SEQ ID NO: 3263999 - DNA, 19 bp, Homo sapiens
ccagcatccctggagcagg

SEQ ID NO: 3264000 - DNA, 18 bp, Homo sapiens
ccagcatctcagcgccag

SEQ ID NO: 3264001 - DNA, 12 bp, Homo sapiens
ccagcattccag

SEQ ID NO: 3264002 - DNA, 19 bp, Homo sapiens
ccagcattccagacttcaa

SEQ ID NO: 3264003 - DNA, 16 bp, Homo sapiens
ccagcattccagcccc

SEQ ID NO: 3264004 - DNA, 17 bp, Homo sapiens
ccagcattccagcccct

SEQ ID NO: 3264005 - DNA, 22 bp, Homo sapiens
ccagcattccagcccctctggt

SEQ ID NO: 3264006 - DNA, 18 bp, Homo sapiens
ccagccaagggtcctcac

SEQ ID NO: 3264007 - DNA, 15 bp, Homo sapiens
ccagccacagacccc

SEQ ID NO: 3264008 - DNA, 19 bp, Homo sapiens
ccagccacagacccctggg

SEQ ID NO: 3264009 - DNA, 21 bp, Homo sapiens
ccagccaccccgggctctctg

SEQ ID NO: 3264010 - DNA, 16 bp, Homo sapiens
ccagccacttccccct

SEQ ID NO: 3264011 - DNA, 10 bp, Homo sapiens
ccagccaggc

SEQ ID NO: 3264012 - DNA, 21 bp, Homo sapiens
ccagccaggcaggtccacaga

SEQ ID NO: 3264013 - DNA, 17 bp, Homo sapiens
ccagccaggccaacagc

SEQ ID NO: 3264014 - DNA, 20 bp, Homo sapiens
ccagccaggccaacagcacc

SEQ ID NO: 3264015 - DNA, 12 bp, Homo sapiens
ccagccaggcgg

SEQ ID NO: 3264016 - DNA, 21 bp, Homo sapiens
ccagccaggcgggctcaagga

SEQ ID NO: 3264017 - DNA, 22 bp, Homo sapiens
ccagccaggctatggttgccac

SEQ ID NO: 3264018 - DNA, 14 bp, Homo sapiens
ccagccagtcttgc

SEQ ID NO: 3264019 - DNA, 23 bp, Homo sapiens
ccagccataaaagcattgtctct

SEQ ID NO: 3264020 - DNA, 15 bp, Homo sapiens
ccagccatctgccca

SEQ ID NO: 3264021 - DNA, 13 bp, Homo sapiens
ccagccatgccca

SEQ ID NO: 3264022 - DNA, 14 bp, Homo sapiens
ccagccatgcccag

SEQ ID NO: 3264023 - DNA, 15 bp, Homo sapiens
ccagccatgcctgag

SEQ ID NO: 3264024 - DNA, 12 bp, Homo sapiens
ccagcccacatt

SEQ ID NO: 3264025 - DNA, 14 bp, Homo sapiens
ccagcccagggctc

SEQ ID NO: 3264026 - DNA, 22 bp, Homo sapiens
ccagcccatccattaggccagc

SEQ ID NO: 3264027 - DNA, 17 bp, Homo sapiens
ccagcccatggccccca

SEQ ID NO: 3264028 - DNA, 23 bp, Homo sapiens
ccagcccatggcccccaataaag

SEQ ID NO: 3264029 - DNA, 14 bp, Homo sapiens
ccagccccacacag

SEQ ID NO: 3264030 - DNA, 15 bp, Homo sapiens
ccagccccacacagc

SEQ ID NO: 3264031 - DNA, 16 bp, Homo sapiens
ccagccccacacagct

SEQ ID NO: 3264032 - DNA, 14 bp, Homo sapiens
ccagccccacccag

SEQ ID NO: 3264033 - DNA, 16 bp, Homo sapiens
ccagccccacccagga

SEQ ID NO: 3264034 - DNA, 20 bp, Homo sapiens
ccagccccacccccagccag

SEQ ID NO: 3264035 - DNA, 21 bp, Homo sapiens
ccagccccacccccagccagg

SEQ ID NO: 3264036 - DNA, 17 bp, Homo sapiens
ccagccccactgccagc

SEQ ID NO: 3264037 - DNA, 15 bp, Homo sapiens
ccagccccagtgccc

SEQ ID NO: 3264038 - DNA, 13 bp, Homo sapiens
ccagccccctgga

SEQ ID NO: 3264039 - DNA, 22 bp, Homo sapiens
ccagccccctggatgggcattg

SEQ ID NO: 3264040 - DNA, 18 bp, Homo sapiens
ccagccccggtggctggg

SEQ ID NO: 3264041 - DNA, 21 bp, Homo sapiens
ccagcccctagaaacccaagc

SEQ ID NO: 3264042 - DNA, 23 bp, Homo sapiens
ccagcccctagaaacccaagctc

SEQ ID NO: 3264043 - DNA, 17 bp, Homo sapiens
ccagcccctagcccagg

SEQ ID NO: 3264044 - DNA, 13 bp, Homo sapiens
ccagcccctctgg

SEQ ID NO: 3264045 - DNA, 14 bp, Homo sapiens
ccagcccctctggt

SEQ ID NO: 3264046 - DNA, 15 bp, Homo sapiens
ccagcccctctggtc

SEQ ID NO: 3264047 - DNA, 23 bp, Homo sapiens
ccagcccctctggtcgctcctgc

SEQ ID NO: 3264048 - DNA, 17 bp, Homo sapiens
ccagcccctcttcccca

SEQ ID NO: 3264049 - DNA, 15 bp, Homo sapiens
ccagcccctgcctgg

SEQ ID NO: 3264050 - DNA, 18 bp, Homo sapiens
ccagcccctgcctgggtt

SEQ ID NO: 3264051 - DNA, 14 bp, Homo sapiens
ccagcccggcctgc

SEQ ID NO: 3264052 - DNA, 14 bp, Homo sapiens
ccagcccgggagcc

SEQ ID NO: 3264053 - DNA, 16 bp, Homo sapiens
ccagcccgggagccta

SEQ ID NO: 3264054 - DNA, 17 bp, Homo sapiens
ccagcccgggagcctag

SEQ ID NO: 3264055 - DNA, 16 bp, Homo sapiens
ccagccctgctgggga

SEQ ID NO: 3264056 - DNA, 20 bp, Homo sapiens
ccagccctgctggggatccc

SEQ ID NO: 3264057 - DNA, 15 bp, Homo sapiens
ccagccctgggaacc

SEQ ID NO: 3264058 - DNA, 22 bp, Homo sapiens
ccagccctgggaaccactccca

SEQ ID NO: 3264059 - DNA, 19 bp, Homo sapiens
ccagccctggggctgggcc

SEQ ID NO: 3264060 - DNA, 12 bp, Homo sapiens
ccagccctgtcc

SEQ ID NO: 3264061 - DNA, 17 bp, Homo sapiens
ccagcccttcaggaagc

SEQ ID NO: 3264062 - DNA, 17 bp, Homo sapiens
ccagcccttcctctcac

SEQ ID NO: 3264063 - DNA, 13 bp, Homo sapiens
ccagcccttctgc

SEQ ID NO: 3264064 - DNA, 21 bp, Homo sapiens
ccagcccttttgttgagccag

SEQ ID NO: 3264065 - DNA, 20 bp, Homo sapiens
ccagccgaagctgcaggggc

SEQ ID NO: 3264066 - DNA, 20 bp, Homo sapiens
ccagccgccattgccaccag

SEQ ID NO: 3264067 - DNA, 17 bp, Homo sapiens
ccagccgccccagcccc

SEQ ID NO: 3264068 - DNA, 15 bp, Homo sapiens
ccagccgccctgggc

SEQ ID NO: 3264069 - DNA, 14 bp, Homo sapiens
ccagccgctgcagg

SEQ ID NO: 3264070 - DNA, 21 bp, Homo sapiens
ccagccgctgcagggctccca

SEQ ID NO: 3264071 - DNA, 17 bp, Homo sapiens
ccagccggccaatggaa

SEQ ID NO: 3264072 - DNA, 22 bp, Homo sapiens
ccagccggcctctctggcctcc

SEQ ID NO: 3264073 - DNA, 15 bp, Homo sapiens
ccagccggtgcctgg

SEQ ID NO: 3264074 - DNA, 18 bp, Homo sapiens
ccagccgtgatgctcagg

SEQ ID NO: 3264075 - DNA, 20 bp, Homo sapiens
ccagccgtgatgctcaggct

SEQ ID NO: 3264076 - DNA, 13 bp, Homo sapiens
ccagcctagccct

SEQ ID NO: 3264077 - DNA, 20 bp, Homo sapiens
ccagcctagcccttgtccct

SEQ ID NO: 3264078 - DNA, 20 bp, Homo sapiens
ccagcctatgagcatcctga

SEQ ID NO: 3264079 - DNA, 22 bp, Homo sapiens
ccagcctatgagcatcctgagc

SEQ ID NO: 3264080 - DNA, 20 bp, Homo sapiens
ccagcctcagtcctcccctc

SEQ ID NO: 3264081 - DNA, 15 bp, Homo sapiens
ccagcctccatgctg

SEQ ID NO: 3264082 - DNA, 16 bp, Homo sapiens
ccagcctccatgctgc

SEQ ID NO: 3264083 - DNA, 11 bp, Homo sapiens
ccagcctccct

SEQ ID NO: 3264084 - DNA, 18 bp, Homo sapiens
ccagcctccgagagggag

SEQ ID NO: 3264085 - DNA, 21 bp, Homo sapiens
ccagcctccgagagggagaga

SEQ ID NO: 3264086 - DNA, 11 bp, Homo sapiens
ccagcctcctc

SEQ ID NO: 3264087 - DNA, 21 bp, Homo sapiens
ccagcctctcccggctgcctg

SEQ ID NO: 3264088 - DNA, 14 bp, Homo sapiens
ccagcctgacctga

SEQ ID NO: 3264089 - DNA, 18 bp, Homo sapiens
ccagcctgacctgagact

SEQ ID NO: 3264090 - DNA, 12 bp, Homo sapiens
ccagcctgagca

SEQ ID NO: 3264091 - DNA, 19 bp, Homo sapiens
ccagcctgcccaagcccag

SEQ ID NO: 3264092 - DNA, 22 bp, Homo sapiens
ccagcctgcccaagcccaggcc

SEQ ID NO: 3264093 - DNA, 22 bp, Homo sapiens
ccagcctgccctccagctgctg

SEQ ID NO: 3264094 - DNA, 20 bp, Homo sapiens
ccagcctgcctggcaggctg

SEQ ID NO: 3264095 - DNA, 21 bp, Homo sapiens
ccagcctgcctggcaggctgt

SEQ ID NO: 3264096 - DNA, 17 bp, Homo sapiens
ccagcctgctgagagcc

SEQ ID NO: 3264097 - DNA, 20 bp, Homo sapiens
ccagcctgctgagagccccc

SEQ ID NO: 3264098 - DNA, 21 bp, Homo sapiens
ccagcctgctgagagccccca

SEQ ID NO: 3264099 - DNA, 17 bp, Homo sapiens
ccagcctggcttctgga

SEQ ID NO: 3264100 - DNA, 16 bp, Homo sapiens
ccagcctgggagccca

SEQ ID NO: 3264101 - DNA, 17 bp, Homo sapiens
ccagcctgggagcccag

SEQ ID NO: 3264102 - DNA, 16 bp, Homo sapiens
ccagcctggggctccc

SEQ ID NO: 3264103 - DNA, 19 bp, Homo sapiens
ccagcctggggctccctct

SEQ ID NO: 3264104 - DNA, 20 bp, Homo sapiens
ccagcctggggctccctctc

SEQ ID NO: 3264105 - DNA, 21 bp, Homo sapiens
ccagcctggggctccctctct

SEQ ID NO: 3264106 - DNA, 23 bp, Homo sapiens
ccagcctggggctccctctctgg

SEQ ID NO: 3264107 - DNA, 13 bp, Homo sapiens
ccagcctgtggtt

SEQ ID NO: 3264108 - DNA, 19 bp, Homo sapiens
ccagcctgtggttacagtg

SEQ ID NO: 3264109 - DNA, 15 bp, Homo sapiens
ccagcctgtgtgttc

SEQ ID NO: 3264110 - DNA, 22 bp, Homo sapiens
ccagccttcttccatcccagga

SEQ ID NO: 3264111 - DNA, 21 bp, Homo sapiens
ccagccttgagccctggctgt

SEQ ID NO: 3264112 - DNA, 14 bp, Homo sapiens
ccagcgagccctgg

SEQ ID NO: 3264113 - DNA, 15 bp, Homo sapiens
ccagcgagccctggt

SEQ ID NO: 3264114 - DNA, 16 bp, Homo sapiens
ccagcgagccctggtg

SEQ ID NO: 3264115 - DNA, 21 bp, Homo sapiens
ccagcgagccctggtggcagt

SEQ ID NO: 3264116 - DNA, 23 bp, Homo sapiens
ccagcgccaaatgttcatcctca

SEQ ID NO: 3264117 - DNA, 24 bp, Homo sapiens
ccagcgccaagtaaacagggtacc

SEQ ID NO: 3264118 - DNA, 14 bp, Homo sapiens
ccagcgcggccagc

SEQ ID NO: 3264119 - DNA, 15 bp, Homo sapiens
ccagcgcggccagcg

SEQ ID NO: 3264120 - DNA, 18 bp, Homo sapiens
ccagcgcggccagcgtcc

SEQ ID NO: 3264121 - DNA, 14 bp, Homo sapiens
ccagcgctctgcct

SEQ ID NO: 3264122 - DNA, 21 bp, Homo sapiens
ccagcggccccccgcacagcc

SEQ ID NO: 3264123 - DNA, 22 bp, Homo sapiens
ccagcggccccccgcacagcca

SEQ ID NO: 3264124 - DNA, 17 bp, Homo sapiens
ccagcgggcacagggca

SEQ ID NO: 3264125 - DNA, 18 bp, Homo sapiens
ccagcgggcacagggcac

SEQ ID NO: 3264126 - DNA, 13 bp, Homo sapiens
ccagcgggcagat

SEQ ID NO: 3264127 - DNA, 17 bp, Homo sapiens
ccagcgtcccagggtac

SEQ ID NO: 3264128 - DNA, 14 bp, Homo sapiens
ccagcgtgtgtatc

SEQ ID NO: 3264129 - DNA, 19 bp, Homo sapiens
ccagcgtgtgtatccgact

SEQ ID NO: 3264130 - DNA, 17 bp, Homo sapiens
ccagcgtttgaggggct

SEQ ID NO: 3264131 - DNA, 22 bp, Homo sapiens
ccagcgtttgaggggctggcct

SEQ ID NO: 3264132 - DNA, 21 bp, Homo sapiens
ccagctaaggacatttcccag

SEQ ID NO: 3264133 - DNA, 20 bp, Homo sapiens
ccagctaccccttctttgca

SEQ ID NO: 3264134 - DNA, 15 bp, Homo sapiens
ccagctaccctgtgt

SEQ ID NO: 3264135 - DNA, 16 bp, Homo sapiens
ccagctaccctttttc

SEQ ID NO: 3264136 - DNA, 16 bp, Homo sapiens
ccagctactcagaagc

SEQ ID NO: 3264137 - DNA, 20 bp, Homo sapiens
ccagctactcgggaggctga

SEQ ID NO: 3264138 - DNA, 19 bp, Homo sapiens
ccagctactctgtccaggc

SEQ ID NO: 3264139 - DNA, 22 bp, Homo sapiens
ccagctactctgtccaggccac

SEQ ID NO: 3264140 - DNA, 15 bp, Homo sapiens
ccagctacttcctcc

SEQ ID NO: 3264141 - DNA, 17 bp, Homo sapiens
ccagctacttcctcctc

SEQ ID NO: 3264142 - DNA, 16 bp, Homo sapiens
ccagctacttgggaag

SEQ ID NO: 3264143 - DNA, 20 bp, Homo sapiens
ccagctacttgggaggctga

SEQ ID NO: 3264144 - DNA, 23 bp, Homo sapiens
ccagctaggaagagcaggactcc

SEQ ID NO: 3264145 - DNA, 21 bp, Homo sapiens
ccagctagggggcgttattta

SEQ ID NO: 3264146 - DNA, 15 bp, Homo sapiens
ccagagaggagcacc

SEQ ID NO: 3264147 - DNA, 17 bp, Homo sapiens
ccagagaggagcacctg

SEQ ID NO: 3264148 - DNA, 19 bp, Homo sapiens
ccagagaggagcacctgaa

SEQ ID NO: 3264149 - DNA, 14 bp, Homo sapiens
ccagagagggccca

SEQ ID NO: 3264150 - DNA, 16 bp, Homo sapiens
ccagagagggcccagc

SEQ ID NO: 3264151 - DNA, 18 bp, Homo sapiens
ccagagagggcccagctg

SEQ ID NO: 3264152 - DNA, 18 bp, Homo sapiens
ccagagaggggctgctct

SEQ ID NO: 3264153 - DNA, 19 bp, Homo sapiens
ccagagaggggctgctctc

SEQ ID NO: 3264154 - DNA, 23 bp, Homo sapiens
ccagagagggtggtgacctctgc

SEQ ID NO: 3264155 - DNA, 14 bp, Homo sapiens
ccagagagtcctgt

SEQ ID NO: 3264156 - DNA, 15 bp, Homo sapiens
ccagagagtggctcc

SEQ ID NO: 3264157 - DNA, 18 bp, Homo sapiens
ccagagagtggctcctcc

SEQ ID NO: 3264158 - DNA, 13 bp, Homo sapiens
ccagagatgccag

SEQ ID NO: 3264159 - DNA, 17 bp, Homo sapiens
ccagagatgccagccct

SEQ ID NO: 3264160 - DNA, 13 bp, Homo sapiens
ccagagcacttta

SEQ ID NO: 3264161 - DNA, 20 bp, Homo sapiens
ccagagcactttagcagatg

SEQ ID NO: 3264162 - DNA, 22 bp, Homo sapiens
ccagagcagagtttacgggtct

SEQ ID NO: 3264163 - DNA, 15 bp, Homo sapiens
ccagagcagatgcag

SEQ ID NO: 3264164 - DNA, 17 bp, Homo sapiens
ccagagcagatgcagag

SEQ ID NO: 3264165 - DNA, 21 bp, Homo sapiens
ccagctatctgtcatctctct

SEQ ID NO: 3264166 - DNA, 16 bp, Homo sapiens
ccagctcaccagcccc

SEQ ID NO: 3264167 - DNA, 14 bp, Homo sapiens
ccagctcaggggca

SEQ ID NO: 3264168 - DNA, 19 bp, Homo sapiens
ccagctcataaaatggaag

SEQ ID NO: 3264169 - DNA, 17 bp, Homo sapiens
ccagctcatctccaagg

SEQ ID NO: 3264170 - DNA, 20 bp, Homo sapiens
ccagctccaggggcccttgg

SEQ ID NO: 3264171 - DNA, 18 bp, Homo sapiens
ccagctcctttctcctgt

SEQ ID NO: 3264172 - DNA, 20 bp, Homo sapiens
ccagctccttttgtccccag

SEQ ID NO: 3264173 - DNA, 22 bp, Homo sapiens
ccagctccttttgtccccaggg

SEQ ID NO: 3264174 - DNA, 23 bp, Homo sapiens
ccagctccttttgtccccagggc

SEQ ID NO: 3264175 - DNA, 20 bp, Homo sapiens
ccagctcgtttttcagcacc

SEQ ID NO: 3264176 - DNA, 13 bp, Homo sapiens
ccagctctgacat

SEQ ID NO: 3264177 - DNA, 18 bp, Homo sapiens
ccagctctgacatccctt

SEQ ID NO: 3264178 - DNA, 21 bp, Homo sapiens
ccagctctgacatcccttcct

SEQ ID NO: 3264179 - DNA, 12 bp, Homo sapiens
ccagctctgagg

SEQ ID NO: 3264180 - DNA, 15 bp, Homo sapiens
ccagctctgagggga

SEQ ID NO: 3264181 - DNA, 18 bp, Homo sapiens
ccagctctgaggggaggg

SEQ ID NO: 3264182 - DNA, 14 bp, Homo sapiens
ccagctctggaggg

SEQ ID NO: 3264183 - DNA, 13 bp, Homo sapiens
ccagctctgtggc

SEQ ID NO: 3264184 - DNA, 15 bp, Homo sapiens
ccagctctgtggcct

SEQ ID NO: 3264185 - DNA, 16 bp, Homo sapiens
ccagctctgtggcctg

SEQ ID NO: 3264186 - DNA, 17 bp, Homo sapiens
ccagctctgtggcctgt

SEQ ID NO: 3264187 - DNA, 13 bp, Homo sapiens
ccagctgaaggca

SEQ ID NO: 3264188 - DNA, 20 bp, Homo sapiens
ccagctgactgtggccccct

SEQ ID NO: 3264189 - DNA, 16 bp, Homo sapiens
ccagctgcaccagagc

SEQ ID NO: 3264190 - DNA, 12 bp, Homo sapiens
ccagctgcagat

SEQ ID NO: 3264191 - DNA, 19 bp, Homo sapiens
ccagctgccgaccagagcc

SEQ ID NO: 3264192 - DNA, 11 bp, Homo sapiens
ccagctgcctg

SEQ ID NO: 3264193 - DNA, 19 bp, Homo sapiens
ccagctgcctggagagggt

SEQ ID NO: 3264194 - DNA, 22 bp, Homo sapiens
ccagctgcctggagagggtctc

SEQ ID NO: 3264195 - DNA, 21 bp, Homo sapiens
ccagctgcctgtgcctgccat

SEQ ID NO: 3264196 - DNA, 13 bp, Homo sapiens
ccagctgccttcc

SEQ ID NO: 3264197 - DNA, 17 bp, Homo sapiens
ccagctgcgcttgcttt

SEQ ID NO: 3264198 - DNA, 19 bp, Homo sapiens
ccagctgcgcttgcttttc

SEQ ID NO: 3264199 - DNA, 12 bp, Homo sapiens
ccagctgctctg

SEQ ID NO: 3264200 - DNA, 14 bp, Homo sapiens
ccagctgctctgcc

SEQ ID NO: 3264201 - DNA, 19 bp, Homo sapiens
ccagctgctgctctcccct

SEQ ID NO: 3264202 - DNA, 12 bp, Homo sapiens
ccagctggaagg

SEQ ID NO: 3264203 - DNA, 16 bp, Homo sapiens
ccagctggcctggaca

SEQ ID NO: 3264204 - DNA, 17 bp, Homo sapiens
ccagctgggaagccctt

SEQ ID NO: 3264205 - DNA, 20 bp, Homo sapiens
ccagctgggaagcccttttt

SEQ ID NO: 3264206 - DNA, 18 bp, Homo sapiens
ccagctgggagcactggt

SEQ ID NO: 3264207 - DNA, 16 bp, Homo sapiens
ccagctgggaggcaag

SEQ ID NO: 3264208 - DNA, 22 bp, Homo sapiens
ccagctgggaggcaagaggggt

SEQ ID NO: 3264209 - DNA, 16 bp, Homo sapiens
ccagctgggctctgca

SEQ ID NO: 3264210 - DNA, 18 bp, Homo sapiens
ccagctgggctctgcaat

SEQ ID NO: 3264211 - DNA, 21 bp, Homo sapiens
ccagctggggcgtggggaggg

SEQ ID NO: 3264212 - DNA, 16 bp, Homo sapiens
ccagctgtagccatgg

SEQ ID NO: 3264213 - DNA, 20 bp, Homo sapiens
ccagctgtagccatggctca

SEQ ID NO: 3264214 - DNA, 24 bp, Homo sapiens
ccagctgtagccatggctcaggca

SEQ ID NO: 3264215 - DNA, 17 bp, Homo sapiens
ccagctgtgagccttgg

SEQ ID NO: 3264216 - DNA, 20 bp, Homo sapiens
ccagctgtgagccttggctg

SEQ ID NO: 3264217 - DNA, 18 bp, Homo sapiens
ccagctgtgctctggaca

SEQ ID NO: 3264218 - DNA, 23 bp, Homo sapiens
ccagctgtgctctggacaggcat

SEQ ID NO: 3264219 - DNA, 14 bp, Homo sapiens
ccagctgtgctgtg

SEQ ID NO: 3264220 - DNA, 16 bp, Homo sapiens
ccagctgtgctgtgga

SEQ ID NO: 3264221 - DNA, 16 bp, Homo sapiens
ccagcttcaggcacca

SEQ ID NO: 3264222 - DNA, 19 bp, Homo sapiens
ccagcttcaggcaccagca

SEQ ID NO: 3264223 - DNA, 24 bp, Homo sapiens
ccagcttcaggcaccagcatccac

SEQ ID NO: 3264224 - DNA, 14 bp, Homo sapiens
ccagcttcctggtg

SEQ ID NO: 3264225 - DNA, 15 bp, Homo sapiens
ccagcttcctggtgt

SEQ ID NO: 3264226 - DNA, 13 bp, Homo sapiens
ccagcttctcctg

SEQ ID NO: 3264227 - DNA, 14 bp, Homo sapiens
ccagcttctcctgc

SEQ ID NO: 3264228 - DNA, 18 bp, Homo sapiens
ccagcttctcctgcgccc

SEQ ID NO: 3264229 - DNA, 22 bp, Homo sapiens
ccagcttctggtactctcctag

SEQ ID NO: 3264230 - DNA, 22 bp, Homo sapiens
ccagcttggggccaccaaagct

SEQ ID NO: 3264231 - DNA, 17 bp, Homo sapiens
ccagcttgttctgggct

SEQ ID NO: 3264232 - DNA, 18 bp, Homo sapiens
ccagcttgttctgggctc

SEQ ID NO: 3264233 - DNA, 18 bp, Homo sapiens
ccagctttccctgcctct

SEQ ID NO: 3264234 - DNA, 15 bp, Homo sapiens
ccagctttgcccaac

SEQ ID NO: 3264235 - DNA, 19 bp, Homo sapiens
ccagctttgcccaacacca

SEQ ID NO: 3264236 - DNA, 21 bp, Homo sapiens
ccaggaaactccacatctgcc

SEQ ID NO: 3264237 - DNA, 23 bp, Homo sapiens
ccaggaaactctgcattctagta

SEQ ID NO: 3264238 - DNA, 14 bp, Homo sapiens
ccaggaactgggcc

SEQ ID NO: 3264239 - DNA, 13 bp, Homo sapiens
ccaggaagcccac

SEQ ID NO: 3264240 - DNA, 16 bp, Homo sapiens
ccaggaaggcagctgc

SEQ ID NO: 3264241 - DNA, 18 bp, Homo sapiens
ccaggaaggcagctgctc

SEQ ID NO: 3264242 - DNA, 20 bp, Homo sapiens
ccaggaattagagaagctga

SEQ ID NO: 3264243 - DNA, 19 bp, Homo sapiens
ccaggacaccacacccagc

SEQ ID NO: 3264244 - DNA, 20 bp, Homo sapiens
ccaggacatgcaataaaatt

SEQ ID NO: 3264245 - DNA, 14 bp, Homo sapiens
ccaggaccaagcca

SEQ ID NO: 3264246 - DNA, 12 bp, Homo sapiens
ccaggaccacac

SEQ ID NO: 3264247 - DNA, 21 bp, Homo sapiens
ccaggaccacacagtccccag

SEQ ID NO: 3264248 - DNA, 14 bp, Homo sapiens
ccaggaccagctgg

SEQ ID NO: 3264249 - DNA, 17 bp, Homo sapiens
ccaggacgcttctgaat

SEQ ID NO: 3264250 - DNA, 20 bp, Homo sapiens
catttatggtcaacacttaa

SEQ ID NO: 3264251 - DNA, 14 bp, Homo sapiens
catttattctgctc

SEQ ID NO: 3264252 - DNA, 15 bp, Homo sapiens
catttattctgctca

SEQ ID NO: 3264253 - DNA, 22 bp, Homo sapiens
catttattgcactcagcttttt

SEQ ID NO: 3264254 - DNA, 16 bp, Homo sapiens
catttcaaagctgagt

SEQ ID NO: 3264255 - DNA, 15 bp, Homo sapiens
catttcaactgtttg

SEQ ID NO: 3264256 - DNA, 16 bp, Homo sapiens
catttcaatcattgaa

SEQ ID NO: 3264257 - DNA, 19 bp, Homo sapiens
catttcacacataagaaaa

SEQ ID NO: 3264258 - DNA, 16 bp, Homo sapiens
catttcacctgtgaca

SEQ ID NO: 3264259 - DNA, 13 bp, Homo sapiens
catttcaggaggg

SEQ ID NO: 3264260 - DNA, 23 bp, Homo sapiens
catttcagggagaaactccaaag

SEQ ID NO: 3264261 - DNA, 22 bp, Homo sapiens
catttcataatttgtttccagc

SEQ ID NO: 3264262 - DNA, 23 bp, Homo sapiens
catttcatacaacagaaaccaga

SEQ ID NO: 3264263 - DNA, 19 bp, Homo sapiens
catttcatcattgtttctg

SEQ ID NO: 3264264 - DNA, 21 bp, Homo sapiens
catttcattcaaatcagtgat

SEQ ID NO: 3264265 - DNA, 21 bp, Homo sapiens
catttcattcctaacacagca

SEQ ID NO: 3264266 - DNA, 18 bp, Homo sapiens
catttcattgtatgatgt

SEQ ID NO: 3264267 - DNA, 20 bp, Homo sapiens
catttccaacaccacagaca

SEQ ID NO: 3264268 - DNA, 21 bp, Homo sapiens
catttccaacaccacagacac

SEQ ID NO: 3264269 - DNA, 17 bp, Homo sapiens
catttcccatctgcacc

SEQ ID NO: 3264270 - DNA, 15 bp, Homo sapiens
catttccccctcctc

SEQ ID NO: 3264271 - DNA, 16 bp, Homo sapiens
catttccccctcctca

SEQ ID NO: 3264272 - DNA, 15 bp, Homo sapiens
catttccggctgctg

SEQ ID NO: 3264273 - DNA, 20 bp, Homo sapiens
catttcctcagcttatctct

SEQ ID NO: 3264274 - DNA, 19 bp, Homo sapiens
catttcctgagaccacaga

SEQ ID NO: 3264275 - DNA, 20 bp, Homo sapiens
catttcgttccctgattatt

SEQ ID NO: 3264276 - DNA, 13 bp, Homo sapiens
catttctatactt

SEQ ID NO: 3264277 - DNA, 18 bp, Homo sapiens
catttctatttatttact

SEQ ID NO: 3264278 - DNA, 21 bp, Homo sapiens
catttctcttctcagctcttc

SEQ ID NO: 3264279 - DNA, 18 bp, Homo sapiens
catttctgaactgttaca

SEQ ID NO: 3264280 - DNA, 18 bp, Homo sapiens
catttctgatcagaggtg

SEQ ID NO: 3264281 - DNA, 15 bp, Homo sapiens
catttctgatgtctc

SEQ ID NO: 3264282 - DNA, 17 bp, Homo sapiens
catttctgtaaatacca

SEQ ID NO: 3264283 - DNA, 12 bp, Homo sapiens
catttcttagac

SEQ ID NO: 3264284 - DNA, 13 bp, Homo sapiens
catttcttcctca

SEQ ID NO: 3264285 - DNA, 14 bp, Homo sapiens
catttcttcctcag

SEQ ID NO: 3264286 - DNA, 18 bp, Homo sapiens
catttcttcctcagctgg

SEQ ID NO: 3264287 - DNA, 23 bp, Homo sapiens
catttcttgtgatgttttgagag

SEQ ID NO: 3264288 - DNA, 21 bp, Homo sapiens
catttctttcttgctggctct

SEQ ID NO: 3264289 - DNA, 15 bp, Homo sapiens
catttctttgcttat

SEQ ID NO: 3264290 - DNA, 23 bp, Homo sapiens
catttgactgttcaatgattatt

SEQ ID NO: 3264291 - DNA, 16 bp, Homo sapiens
catttgagagaagcca

SEQ ID NO: 3264292 - DNA, 17 bp, Homo sapiens
catttgagcagggctca

SEQ ID NO: 3264293 - DNA, 20 bp, Homo sapiens
catttgagcagggctcagcg

SEQ ID NO: 3264294 - DNA, 22 bp, Homo sapiens
catttgagttattttaattatc

SEQ ID NO: 3264295 - DNA, 19 bp, Homo sapiens
catttgatacccctgggga

SEQ ID NO: 3264296 - DNA, 13 bp, Homo sapiens
catttgatagaaa

SEQ ID NO: 3264297 - DNA, 16 bp, Homo sapiens
catttgatattatcta

SEQ ID NO: 3264298 - DNA, 13 bp, Homo sapiens
catttgatatttt

SEQ ID NO: 3264299 - DNA, 20 bp, Homo sapiens
catttgatgcatgtctttta

SEQ ID NO: 3264300 - DNA, 14 bp, Homo sapiens
catttgatgctaaa

SEQ ID NO: 3264301 - DNA, 15 bp, Homo sapiens
catttgattctgtgt

SEQ ID NO: 3264302 - DNA, 20 bp, Homo sapiens
catttgcactggagttctat

SEQ ID NO: 3264303 - DNA, 21 bp, Homo sapiens
catttgcactggagttctatg

SEQ ID NO: 3264304 - DNA, 19 bp, Homo sapiens
catttgcagggtcctcttc

SEQ ID NO: 3264305 - DNA, 16 bp, Homo sapiens
catttgccttgcagaa

SEQ ID NO: 3264306 - DNA, 22 bp, Homo sapiens
catttgccttgcagaactgcca

SEQ ID NO: 3264307 - DNA, 18 bp, Homo sapiens
catttgctactgttgtaa

SEQ ID NO: 3264308 - DNA, 22 bp, Homo sapiens
catttgctactgttgtaagaat

SEQ ID NO: 3264309 - DNA, 17 bp, Homo sapiens
catttgctgttttaaac

SEQ ID NO: 3264310 - DNA, 18 bp, Homo sapiens
catttgcttgtactggga

SEQ ID NO: 3264311 - DNA, 15 bp, Homo sapiens
catttggaatacttt

SEQ ID NO: 3264312 - DNA, 17 bp, Homo sapiens
catttggaatacttttt

SEQ ID NO: 3264313 - DNA, 20 bp, Homo sapiens
catttgggagacatgtgaca

SEQ ID NO: 3264314 - DNA, 18 bp, Homo sapiens
catttggtgttcctggaa

SEQ ID NO: 3264315 - DNA, 22 bp, Homo sapiens
catttggtgttcctggaagcag

SEQ ID NO: 3264316 - DNA, 21 bp, Homo sapiens
catttggttcattaattctat

SEQ ID NO: 3264317 - DNA, 19 bp, Homo sapiens
catttggttctaagaaacc

SEQ ID NO: 3264318 - DNA, 18 bp, Homo sapiens
catttgtaaatgctgtgt

SEQ ID NO: 3264319 - DNA, 12 bp, Homo sapiens
catttgtaataa

SEQ ID NO: 3264320 - DNA, 14 bp, Homo sapiens
catttgtaataaag

SEQ ID NO: 3264321 - DNA, 17 bp, Homo sapiens
catttgtacaaggtaat

SEQ ID NO: 3264322 - DNA, 21 bp, Homo sapiens
catttgtacaaggtaattgtt

SEQ ID NO: 3264323 - DNA, 12 bp, Homo sapiens
catttgtatatt

SEQ ID NO: 3264324 - DNA, 13 bp, Homo sapiens
catttgtattgct

SEQ ID NO: 3264325 - DNA, 20 bp, Homo sapiens
catttgtattgcttatttta

SEQ ID NO: 3264326 - DNA, 21 bp, Homo sapiens
catttgtattgtacataaaat

SEQ ID NO: 3264327 - DNA, 17 bp, Homo sapiens
cataattacattcctaa

SEQ ID NO: 3264328 - DNA, 19 bp, Homo sapiens
cataattatgacagttata

SEQ ID NO: 3264329 - DNA, 21 bp, Homo sapiens
cataattctaagttatttact

SEQ ID NO: 3264330 - DNA, 16 bp, Homo sapiens
cataattcttgtatat

SEQ ID NO: 3264331 - DNA, 12 bp, Homo sapiens
cataattggaat

SEQ ID NO: 3264332 - DNA, 23 bp, Homo sapiens
cataatttgctggagaagtgtgt

SEQ ID NO: 3264333 - DNA, 16 bp, Homo sapiens
cataatttgtttccag

SEQ ID NO: 3264334 - DNA, 18 bp, Homo sapiens
cataatttgtttccagca

SEQ ID NO: 3264335 - DNA, 20 bp, Homo sapiens
cataattttcttcatgcaat

SEQ ID NO: 3264336 - DNA, 12 bp, Homo sapiens
cataattttgca

SEQ ID NO: 3264337 - DNA, 13 bp, Homo sapiens
cataattttgcat

SEQ ID NO: 3264338 - DNA, 20 bp, Homo sapiens
cataattttgcatactgaaa

SEQ ID NO: 3264339 - DNA, 22 bp, Homo sapiens
cataattttgcatactgaaaat

SEQ ID NO: 3264340 - DNA, 20 bp, Homo sapiens
cataattttgtgttgtacaa

SEQ ID NO: 3264341 - DNA, 21 bp, Homo sapiens
cataattttgtgttgtacaat

SEQ ID NO: 3264342 - DNA, 16 bp, Homo sapiens
catacaaaataaatgg

SEQ ID NO: 3264343 - DNA, 16 bp, Homo sapiens
catacaacagaaacca

SEQ ID NO: 3264344 - DNA, 22 bp, Homo sapiens
catacaacagaaaccagaaaag

SEQ ID NO: 3264345 - DNA, 15 bp, Homo sapiens
catacaattccaaac

SEQ ID NO: 3264346 - DNA, 18 bp, Homo sapiens
catacacttgtataaatg

SEQ ID NO: 3264347 - DNA, 19 bp, Homo sapiens
catacacttgtataaatgt

SEQ ID NO: 3264348 - DNA, 21 bp, Homo sapiens
catacacttgtataaatgtat

SEQ ID NO: 3264349 - DNA, 20 bp, Homo sapiens
catacagatcaggcagtgtt

SEQ ID NO: 3264350 - DNA, 12 bp, Homo sapiens
catacagctcta

SEQ ID NO: 3264351 - DNA, 13 bp, Homo sapiens
catacaggtgctc

SEQ ID NO: 3264352 - DNA, 21 bp, Homo sapiens
catacagttttatgctctttt

SEQ ID NO: 3264353 - DNA, 22 bp, Homo sapiens
catacataatgtttttcctttc

SEQ ID NO: 3264354 - DNA, 15 bp, Homo sapiens
catacatgctacttt

SEQ ID NO: 3264355 - DNA, 23 bp, Homo sapiens
catacatttataatgtttgctat

SEQ ID NO: 3264356 - DNA, 24 bp, Homo sapiens
catacatttataatgtttgctatt

SEQ ID NO: 3264357 - DNA, 22 bp, Homo sapiens
cataccagctcgcacccccctg

SEQ ID NO: 3264358 - DNA, 16 bp, Homo sapiens
catacgaaacacaaac

SEQ ID NO: 3264359 - DNA, 19 bp, Homo sapiens
catacgcctcttgttcatg

SEQ ID NO: 3264360 - DNA, 23 bp, Homo sapiens
catacggtcaggtttaacatttg

SEQ ID NO: 3264361 - DNA, 15 bp, Homo sapiens
catacgtgcacaggg

SEQ ID NO: 3264362 - DNA, 16 bp, Homo sapiens
catacgtgcacagggt

SEQ ID NO: 3264363 - DNA, 18 bp, Homo sapiens
catactactgaaacagat

SEQ ID NO: 3264364 - DNA, 17 bp, Homo sapiens
catactcagcctgctgc

SEQ ID NO: 3264365 - DNA, 18 bp, Homo sapiens
catactcagcctgctgcc

SEQ ID NO: 3264366 - DNA, 20 bp, Homo sapiens
catactcagcctgctgccca

SEQ ID NO: 3264367 - DNA, 16 bp, Homo sapiens
catactctctgcctgg

SEQ ID NO: 3264368 - DNA, 15 bp, Homo sapiens
catactgaaaatcca

SEQ ID NO: 3264369 - DNA, 19 bp, Homo sapiens
catactgagccaagtataa

SEQ ID NO: 3264370 - DNA, 22 bp, Homo sapiens
catactgagccaagtataattt

SEQ ID NO: 3264371 - DNA, 15 bp, Homo sapiens
catactgagggacca

SEQ ID NO: 3264372 - DNA, 22 bp, Homo sapiens
catactggcctggactgttttc

SEQ ID NO: 3264373 - DNA, 15 bp, Homo sapiens
catactgtctgggat

SEQ ID NO: 3264374 - DNA, 16 bp, Homo sapiens
catacttagaaacaaa

SEQ ID NO: 3264375 - DNA, 17 bp, Homo sapiens
catactttatcaatgtg

SEQ ID NO: 3264376 - DNA, 22 bp, Homo sapiens
catactttgtaaataggatttt

SEQ ID NO: 3264377 - DNA, 13 bp, Homo sapiens
catactttgtctg

SEQ ID NO: 3264378 - DNA, 16 bp, Homo sapiens
catactttgtctgaaa

SEQ ID NO: 3264379 - DNA, 11 bp, Homo sapiens
catagaaaaat

SEQ ID NO: 3264380 - DNA, 15 bp, Homo sapiens
catagaaacatgaca

SEQ ID NO: 3264381 - DNA, 18 bp, Homo sapiens
catagaaacatgacactg

SEQ ID NO: 3264382 - DNA, 20 bp, Homo sapiens
catagaaacatgacactgac

SEQ ID NO: 3264383 - DNA, 14 bp, Homo sapiens
catagaactgggta

SEQ ID NO: 3264384 - DNA, 15 bp, Homo sapiens
catagaactgggtaa

SEQ ID NO: 3264385 - DNA, 16 bp, Homo sapiens
catagaactgggtaaa

SEQ ID NO: 3264386 - DNA, 20 bp, Homo sapiens
catagaactgggtaaatgca

SEQ ID NO: 3264387 - DNA, 15 bp, Homo sapiens
catagactagagaaa

SEQ ID NO: 3264388 - DNA, 16 bp, Homo sapiens
catagactagagaaac

SEQ ID NO: 3264389 - DNA, 23 bp, Homo sapiens
catagactgaggtataaagacaa

SEQ ID NO: 3264390 - DNA, 16 bp, Homo sapiens
catagagctctatttc

SEQ ID NO: 3264391 - DNA, 15 bp, Homo sapiens
catagagtttaacac

SEQ ID NO: 3264392 - DNA, 16 bp, Homo sapiens
catagataatattgtt

SEQ ID NO: 3264393 - DNA, 17 bp, Homo sapiens
catagataatattgttt

SEQ ID NO: 3264394 - DNA, 19 bp, Homo sapiens
catagataatattgtttgg

SEQ ID NO: 3264395 - DNA, 14 bp, Homo sapiens
catagatcttctga

SEQ ID NO: 3264396 - DNA, 20 bp, Homo sapiens
catagatttatttttcagtt

SEQ ID NO: 3264397 - DNA, 13 bp, Homo sapiens
catagcaaacttc

SEQ ID NO: 3264398 - DNA, 19 bp, Homo sapiens
catagcagagaatgaaagg

SEQ ID NO: 3264399 - DNA, 22 bp, Homo sapiens
catagcagaggggccaggccca

SEQ ID NO: 3264400 - DNA, 16 bp, Homo sapiens
catagcagatctgttt

SEQ ID NO: 3264401 - DNA, 18 bp, Homo sapiens
catagcagattttaattt

SEQ ID NO: 3264402 - DNA, 14 bp, Homo sapiens
catagcagtatatg

SEQ ID NO: 3264403 - DNA, 19 bp, Homo sapiens
catagcatccaagtggcat

SEQ ID NO: 3264404 - DNA, 15 bp, Homo sapiens
catagccaggaaact

SEQ ID NO: 3264405 - DNA, 16 bp, Homo sapiens
catagcccatccctgc

SEQ ID NO: 3264406 - DNA, 17 bp, Homo sapiens
catagcccatccctgcc

SEQ ID NO: 3264407 - DNA, 18 bp, Homo sapiens
catagcccatccctgcct

SEQ ID NO: 3264408 - DNA, 13 bp, Homo sapiens
catagcctatatt

SEQ ID NO: 3264409 - DNA, 15 bp, Homo sapiens
catagcgccgtgctg

SEQ ID NO: 3264410 - DNA, 20 bp, Homo sapiens
catagcgccgtgctgtaaat

SEQ ID NO: 3264411 - DNA, 21 bp, Homo sapiens
catagcgccgtgctgtaaata

SEQ ID NO: 3264412 - DNA, 23 bp, Homo sapiens
catagcgccgtgctgtaaataag

SEQ ID NO: 3264413 - DNA, 16 bp, Homo sapiens
catagctaataagtag

SEQ ID NO: 3264414 - DNA, 19 bp, Homo sapiens
catagctacatcagtttga

SEQ ID NO: 3264415 - DNA, 21 bp, Homo sapiens
catagctacccaaaagagaaa

SEQ ID NO: 3264416 - DNA, 22 bp, Homo sapiens
catagctacccaaaagagaaaa

SEQ ID NO: 3264417 - DNA, 20 bp, Homo sapiens
catagctatcaagtgtgctt

SEQ ID NO: 3264418 - DNA, 14 bp, Homo sapiens
catagctccttgga

SEQ ID NO: 3264419 - DNA, 20 bp, Homo sapiens
catagctctggggtgggcag

SEQ ID NO: 3264420 - DNA, 14 bp, Homo sapiens
catagctggttaac

SEQ ID NO: 3264421 - DNA, 21 bp, Homo sapiens
catagctgtacttcttgaata

SEQ ID NO: 3264422 - DNA, 14 bp, Homo sapiens
catagctgtctaga

SEQ ID NO: 3264423 - DNA, 13 bp, Homo sapiens
catagcttccatg

SEQ ID NO: 3264424 - DNA, 23 bp, Homo sapiens
cataggaaaagtacatttaatac

SEQ ID NO: 3264425 - DNA, 18 bp, Homo sapiens
cataggacctttccacca

SEQ ID NO: 3264426 - DNA, 15 bp, Homo sapiens
cataggcctgggtgc

SEQ ID NO: 3264427 - DNA, 17 bp, Homo sapiens
cataggcctgggtgctg

SEQ ID NO: 3264428 - DNA, 17 bp, Homo sapiens
catagggtctcttcagg

SEQ ID NO: 3264429 - DNA, 14 bp, Homo sapiens
catcatttcccagg

SEQ ID NO: 3264430 - DNA, 21 bp, Homo sapiens
catccaaaatattttttgcaa

SEQ ID NO: 3264431 - DNA, 13 bp, Homo sapiens
catccaaagttcc

SEQ ID NO: 3264432 - DNA, 18 bp, Homo sapiens
catccaaataagaaacct

SEQ ID NO: 3264433 - DNA, 16 bp, Homo sapiens
catccaactccagcaa

SEQ ID NO: 3264434 - DNA, 17 bp, Homo sapiens
catccaactccagcaac

SEQ ID NO: 3264435 - DNA, 15 bp, Homo sapiens
catccaactccagga

SEQ ID NO: 3264436 - DNA, 14 bp, Homo sapiens
catccaaggagaaa

SEQ ID NO: 3264437 - DNA, 22 bp, Homo sapiens
catccaaggagaaacagagaca

SEQ ID NO: 3264438 - DNA, 17 bp, Homo sapiens
catccaaggcaaacaat

SEQ ID NO: 3264439 - DNA, 13 bp, Homo sapiens
catccaatcctca

SEQ ID NO: 3264440 - DNA, 19 bp, Homo sapiens
catccacccagtgctgcca

SEQ ID NO: 3264441 - DNA, 21 bp, Homo sapiens
catccacccagtgctgccatg

SEQ ID NO: 3264442 - DNA, 12 bp, Homo sapiens
catccaccccat

SEQ ID NO: 3264443 - DNA, 22 bp, Homo sapiens
catccacccgggggagcccagt

SEQ ID NO: 3264444 - DNA, 16 bp, Homo sapiens
catccaccttggctct

SEQ ID NO: 3264445 - DNA, 23 bp, Homo sapiens
catccaccttggctctgccagtg

SEQ ID NO: 3264446 - DNA, 17 bp, Homo sapiens
catccactctaccctcc

SEQ ID NO: 3264447 - DNA, 17 bp, Homo sapiens
catccagattgggtgcc

SEQ ID NO: 3264448 - DNA, 12 bp, Homo sapiens
catccagcaaga

SEQ ID NO: 3264449 - DNA, 13 bp, Homo sapiens
catccagcctgtg

SEQ ID NO: 3264450 - DNA, 23 bp, Homo sapiens
catccagtctcccaacttgtatt

SEQ ID NO: 3264451 - DNA, 13 bp, Homo sapiens
catccagttcatg

SEQ ID NO: 3264452 - DNA, 21 bp, Homo sapiens
catccagtttgttctccgggt

SEQ ID NO: 3264453 - DNA, 12 bp, Homo sapiens
catccataaatc

SEQ ID NO: 3264454 - DNA, 17 bp, Homo sapiens
catccataaatccagtt

SEQ ID NO: 3264455 - DNA, 19 bp, Homo sapiens
catccatagtaactgacat

SEQ ID NO: 3264456 - DNA, 16 bp, Homo sapiens
catccatagtagtatg

SEQ ID NO: 3264457 - DNA, 18 bp, Homo sapiens
catccatagtagtatgat

SEQ ID NO: 3264458 - DNA, 16 bp, Homo sapiens
catccatgtgtggact

SEQ ID NO: 3264459 - DNA, 17 bp, Homo sapiens
catccatgtgtggactc

SEQ ID NO: 3264460 - DNA, 18 bp, Homo sapiens
catccatgtgtggactca

SEQ ID NO: 3264461 - DNA, 15 bp, Homo sapiens
catccatgtttgtaa

SEQ ID NO: 3264462 - DNA, 18 bp, Homo sapiens
catccatgtttgtaaaac

SEQ ID NO: 3264463 - DNA, 13 bp, Homo sapiens
catccattaggcc

SEQ ID NO: 3264464 - DNA, 14 bp, Homo sapiens
catccattcccaag

SEQ ID NO: 3264465 - DNA, 18 bp, Homo sapiens
catcccaaccaggcacct

SEQ ID NO: 3264466 - DNA, 13 bp, Homo sapiens
catcccaactgtc

SEQ ID NO: 3264467 - DNA, 11 bp, Homo sapiens
catcccactta

SEQ ID NO: 3264468 - DNA, 23 bp, Homo sapiens
catcccagacaggtccctcccct

SEQ ID NO: 3264469 - DNA, 19 bp, Homo sapiens
catcccaggacaccacacc

SEQ ID NO: 3264470 - DNA, 21 bp, Homo sapiens
catcccaggacaccacaccca

SEQ ID NO: 3264471 - DNA, 13 bp, Homo sapiens
catcccaggggac

SEQ ID NO: 3264472 - DNA, 19 bp, Homo sapiens
catcccaggggaccacacc

SEQ ID NO: 3264473 - DNA, 15 bp, Homo sapiens
catcccatgtattta

SEQ ID NO: 3264474 - DNA, 21 bp, Homo sapiens
catcccattcacttctgcatt

SEQ ID NO: 3264475 - DNA, 14 bp, Homo sapiens
catccccaccagct

SEQ ID NO: 3264476 - DNA, 11 bp, Homo sapiens
catccccaggg

SEQ ID NO: 3264477 - DNA, 18 bp, Homo sapiens
catccccaggggtcccag

SEQ ID NO: 3264478 - DNA, 13 bp, Homo sapiens
catccccctgccc

SEQ ID NO: 3264479 - DNA, 14 bp, Homo sapiens
catccccctgccct

SEQ ID NO: 3264480 - DNA, 19 bp, Homo sapiens
catccccctgccctcgtgg

SEQ ID NO: 3264481 - DNA, 18 bp, Homo sapiens
catcccctcgtcctgtcc

SEQ ID NO: 3264482 - DNA, 19 bp, Homo sapiens
catcccctcgtcctgtccc

SEQ ID NO: 3264483 - DNA, 21 bp, Homo sapiens
catcccctcgtcctgtcccag

SEQ ID NO: 3264484 - DNA, 22 bp, Homo sapiens
catcccctcgtcctgtcccaga

SEQ ID NO: 3264485 - DNA, 12 bp, Homo sapiens
catcccggcctc

SEQ ID NO: 3264486 - DNA, 18 bp, Homo sapiens
catcccggcctcttccac

SEQ ID NO: 3264487 - DNA, 21 bp, Homo sapiens
catcccgtgttctccttttcc

SEQ ID NO: 3264488 - DNA, 16 bp, Homo sapiens
catccctgactggcca

SEQ ID NO: 3264489 - DNA, 20 bp, Homo sapiens
catccctgactggccaaacc

SEQ ID NO: 3264490 - DNA, 14 bp, Homo sapiens
catccctgccacat

SEQ ID NO: 3264491 - DNA, 20 bp, Homo sapiens
catccctggagcaggagccc

SEQ ID NO: 3264492 - DNA, 22 bp, Homo sapiens
catccctggccccctccctgga

SEQ ID NO: 3264493 - DNA, 17 bp, Homo sapiens
catccctgggcccctcc

SEQ ID NO: 3264494 - DNA, 19 bp, Homo sapiens
catccctgggcccctccac

SEQ ID NO: 3264495 - DNA, 20 bp, Homo sapiens
catccctgggggccttgggt

SEQ ID NO: 3264496 - DNA, 13 bp, Homo sapiens
catcccttcctgg

SEQ ID NO: 3264497 - DNA, 22 bp, Homo sapiens
catcccttcctggaaacagcat

SEQ ID NO: 3264498 - DNA, 21 bp, Homo sapiens
catccctttctcccagtgaaa

SEQ ID NO: 3264499 - DNA, 16 bp, Homo sapiens
catccctttgcccaga

SEQ ID NO: 3264500 - DNA, 15 bp, Homo sapiens
catcccttttcctgt

SEQ ID NO: 3264501 - DNA, 18 bp, Homo sapiens
catccctttttttacatt

SEQ ID NO: 3264502 - DNA, 15 bp, Homo sapiens
catccgactgcccct

SEQ ID NO: 3264503 - DNA, 13 bp, Homo sapiens
catccgcaggtgc

SEQ ID NO: 3264504 - DNA, 20 bp, Homo sapiens
catccgcaggtgctggtccc

SEQ ID NO: 3264505 - DNA, 16 bp, Homo sapiens
catccgccttttgtat

SEQ ID NO: 3264506 - DNA, 16 bp, Homo sapiens
catccggtcccctgcc

SEQ ID NO: 3264507 - DNA, 19 bp, Homo sapiens
catccgtcattgctgctgc

SEQ ID NO: 3264508 - DNA, 13 bp, Homo sapiens
catcctcatccct

SEQ ID NO: 3264509 - DNA, 19 bp, Homo sapiens
catcctcattgcctcctgt

SEQ ID NO: 3264510 - DNA, 19 bp, Homo sapiens
catcctcctcagcccccag

SEQ ID NO: 3264511 - DNA, 22 bp, Homo sapiens
catcctcctggaaccttgctgt

SEQ ID NO: 3264512 - DNA, 14 bp, Homo sapiens
catcctcttctgct

SEQ ID NO: 3264513 - DNA, 15 bp, Homo sapiens
catcctcttctgctt

SEQ ID NO: 3264514 - DNA, 18 bp, Homo sapiens
catcctcttctgcttagg

SEQ ID NO: 3264515 - DNA, 13 bp, Homo sapiens
catcctgagcccc

SEQ ID NO: 3264516 - DNA, 19 bp, Homo sapiens
catcctgaggctccacttg

SEQ ID NO: 3264517 - DNA, 14 bp, Homo sapiens
catcctgccagccc

SEQ ID NO: 3264518 - DNA, 11 bp, Homo sapiens
catcctgcctg

SEQ ID NO: 3264519 - DNA, 16 bp, Homo sapiens
catcctgcctgggtgg

SEQ ID NO: 3264520 - DNA, 21 bp, Homo sapiens
catcctggaggggtgttgtat

SEQ ID NO: 3264521 - DNA, 15 bp, Homo sapiens
catcctggcacccgg

SEQ ID NO: 3264522 - DNA, 21 bp, Homo sapiens
catgtgcctgcaccaggagac

SEQ ID NO: 3264523 - DNA, 23 bp, Homo sapiens
catgtgcctgcaccaggagacag

SEQ ID NO: 3264524 - DNA, 16 bp, Homo sapiens
catgtgccttttctga

SEQ ID NO: 3264525 - DNA, 18 bp, Homo sapiens
catgtgctcagaagagga

SEQ ID NO: 3264526 - DNA, 17 bp, Homo sapiens
catgtggaaagtgaatt

SEQ ID NO: 3264527 - DNA, 20 bp, Homo sapiens
catgtggaaagtgaatttga

SEQ ID NO: 3264528 - DNA, 21 bp, Homo sapiens
catgtggaaagtgaatttgaa

SEQ ID NO: 3264529 - DNA, 23 bp, Homo sapiens
catgtggaaagtgaatttgaatg

SEQ ID NO: 3264530 - DNA, 17 bp, Homo sapiens
catgtggcaaaatatgg

SEQ ID NO: 3264531 - DNA, 21 bp, Homo sapiens
catgtggcaaaatatggtttg

SEQ ID NO: 3264532 - DNA, 15 bp, Homo sapiens
catgtggccccaccc

SEQ ID NO: 3264533 - DNA, 14 bp, Homo sapiens
catgtggcctgtgg

SEQ ID NO: 3264534 - DNA, 15 bp, Homo sapiens
catgtgggcacggag

SEQ ID NO: 3264535 - DNA, 18 bp, Homo sapiens
catgtggggccaggtcac

SEQ ID NO: 3264536 - DNA, 23 bp, Homo sapiens
catgtggggccaggtcacccttt

SEQ ID NO: 3264537 - DNA, 23 bp, Homo sapiens
catgtgggtgagccagtggaaca

SEQ ID NO: 3264538 - DNA, 15 bp, Homo sapiens
catgtgggtgagtta

SEQ ID NO: 3264539 - DNA, 22 bp, Homo sapiens
catgtggtggcacaggccccct

SEQ ID NO: 3264540 - DNA, 20 bp, Homo sapiens
catgtggtttggttcctctc

SEQ ID NO: 3264541 - DNA, 15 bp, Homo sapiens
catgtgtacattctg

SEQ ID NO: 3264542 - DNA, 14 bp, Homo sapiens
catgtgtagcctgt

SEQ ID NO: 3264543 - DNA, 12 bp, Homo sapiens
catgtgtatgtg

SEQ ID NO: 3264544 - DNA, 15 bp, Homo sapiens
catgtgtatgtgtct

SEQ ID NO: 3264545 - DNA, 16 bp, Homo sapiens
catgtgtatgtgtctg

SEQ ID NO: 3264546 - DNA, 16 bp, Homo sapiens
catgtgtcccctcact

SEQ ID NO: 3264547 - DNA, 21 bp, Homo sapiens
catgtgtcctggttcccgttt

SEQ ID NO: 3264548 - DNA, 16 bp, Homo sapiens
catgtgtgaacacata

SEQ ID NO: 3264549 - DNA, 16 bp, Homo sapiens
catgtgtgcctgtggc

SEQ ID NO: 3264550 - DNA, 13 bp, Homo sapiens
catgtgtggaagt

SEQ ID NO: 3264551 - DNA, 14 bp, Homo sapiens
catgtgtggactca

SEQ ID NO: 3264552 - DNA, 11 bp, Homo sapiens
catgtgtgtat

SEQ ID NO: 3264553 - DNA, 14 bp, Homo sapiens
catgtgtgtataag

SEQ ID NO: 3264554 - DNA, 15 bp, Homo sapiens
catgtgtgtatatat

SEQ ID NO: 3264555 - DNA, 20 bp, Homo sapiens
catgtgtgtatatatgtgta

SEQ ID NO: 3264556 - DNA, 14 bp, Homo sapiens
catgtgttgaaaaa

SEQ ID NO: 3264557 - DNA, 16 bp, Homo sapiens
catgttacataagata

SEQ ID NO: 3264558 - DNA, 12 bp, Homo sapiens
catgttaccatc

SEQ ID NO: 3264559 - DNA, 17 bp, Homo sapiens
catgttacctcctataa

SEQ ID NO: 3264560 - DNA, 23 bp, Homo sapiens
catgttactaaattacgtatgca

SEQ ID NO: 3264561 - DNA, 15 bp, Homo sapiens
catgttactcagtgt

SEQ ID NO: 3264562 - DNA, 18 bp, Homo sapiens
catgttagcaaacgcagc

SEQ ID NO: 3264563 - DNA, 21 bp, Homo sapiens
catgttagttaccttatagtt

SEQ ID NO: 3264564 - DNA, 24 bp, Homo sapiens
catgttagttaccttatagttact

SEQ ID NO: 3264565 - DNA, 14 bp, Homo sapiens
catgttattttatt

SEQ ID NO: 3264566 - DNA, 22 bp, Homo sapiens
catgttcattataatctcaaag

SEQ ID NO: 3264567 - DNA, 13 bp, Homo sapiens
catgttctgcccc

SEQ ID NO: 3264568 - DNA, 19 bp, Homo sapiens
catgttctgcccccagccc

SEQ ID NO: 3264569 - DNA, 13 bp, Homo sapiens
catgttgacgaga

SEQ ID NO: 3264570 - DNA, 15 bp, Homo sapiens
catgttgctgaggag

SEQ ID NO: 3264571 - DNA, 17 bp, Homo sapiens
catgttgtaatgctgca

SEQ ID NO: 3264572 - DNA, 21 bp, Homo sapiens
catgtttagtgaatgactttt

SEQ ID NO: 3264573 - DNA, 12 bp, Homo sapiens
catgtttataaa

SEQ ID NO: 3264574 - DNA, 14 bp, Homo sapiens
catgtttatgaaaa

SEQ ID NO: 3264575 - DNA, 20 bp, Homo sapiens
catgtttatgaaaataaata

SEQ ID NO: 3264576 - DNA, 15 bp, Homo sapiens
catgtttatttttct

SEQ ID NO: 3264577 - DNA, 18 bp, Homo sapiens
catgtttatttttcttgt

SEQ ID NO: 3264578 - DNA, 14 bp, Homo sapiens
catgtttccagcag

SEQ ID NO: 3264579 - DNA, 13 bp, Homo sapiens
catgtttcctcta

SEQ ID NO: 3264580 - DNA, 23 bp, Homo sapiens
catgtttgatgtatctgagcagg

SEQ ID NO: 3264581 - DNA, 16 bp, Homo sapiens
catgtttgctgaacac

SEQ ID NO: 3264582 - DNA, 21 bp, Homo sapiens
catgtttggtgcatagaactg

SEQ ID NO: 3264583 - DNA, 20 bp, Homo sapiens
cattagggatgcctcctttc

SEQ ID NO: 3264584 - DNA, 13 bp, Homo sapiens
cattataaacgtg

SEQ ID NO: 3264585 - DNA, 20 bp, Homo sapiens
cattataatctcaaaggaga

SEQ ID NO: 3264586 - DNA, 13 bp, Homo sapiens
cattatactttat

SEQ ID NO: 3264587 - DNA, 16 bp, Homo sapiens
cattatactttatatc

SEQ ID NO: 3264588 - DNA, 18 bp, Homo sapiens
cattatactttatatctg

SEQ ID NO: 3264589 - DNA, 13 bp, Homo sapiens
cattatattctaa

SEQ ID NO: 3264590 - DNA, 18 bp, Homo sapiens
cattatattctaattaaa

SEQ ID NO: 3264591 - DNA, 20 bp, Homo sapiens
cattatattctaattaaaat

SEQ ID NO: 3264592 - DNA, 16 bp, Homo sapiens
cattatattgcaatga

SEQ ID NO: 3264593 - DNA, 21 bp, Homo sapiens
cattatcgagcagcattttat

SEQ ID NO: 3264594 - DNA, 18 bp, Homo sapiens
cattatcgggagcagtgt

SEQ ID NO: 3264595 - DNA, 23 bp, Homo sapiens
cattatcgggagcagtgtcttcc

SEQ ID NO: 3264596 - DNA, 16 bp, Homo sapiens
cattatctcacttagt

SEQ ID NO: 3264597 - DNA, 22 bp, Homo sapiens
cattatgagaggcaatgattgt

SEQ ID NO: 3264598 - DNA, 20 bp, Homo sapiens
cattatgtccactgtgtata

SEQ ID NO: 3264599 - DNA, 22 bp, Homo sapiens
cattatgtccactgtgtataga

SEQ ID NO: 3264600 - DNA, 21 bp, Homo sapiens
cattatgtggttttagatttt

SEQ ID NO: 3264601 - DNA, 12 bp, Homo sapiens
cattatgtgtgc

SEQ ID NO: 3264602 - DNA, 13 bp, Homo sapiens
cattatgtgtgca

SEQ ID NO: 3264603 - DNA, 19 bp, Homo sapiens
cattatgtgtgcatgtgtg

SEQ ID NO: 3264604 - DNA, 13 bp, Homo sapiens
cattattaaattg

SEQ ID NO: 3264605 - DNA, 17 bp, Homo sapiens
cattattaaattgtaaa

SEQ ID NO: 3264606 - DNA, 13 bp, Homo sapiens
cattattatcaac

SEQ ID NO: 3264607 - DNA, 15 bp, Homo sapiens
cattattatcattga

SEQ ID NO: 3264608 - DNA, 19 bp, Homo sapiens
cattattctcataatcctt

SEQ ID NO: 3264609 - DNA, 14 bp, Homo sapiens
cattatttatatgg

SEQ ID NO: 3264610 - DNA, 22 bp, Homo sapiens
cattatttattcagcttcattt

SEQ ID NO: 3264611 - DNA, 14 bp, Homo sapiens
cattatttgcatgt

SEQ ID NO: 3264612 - DNA, 19 bp, Homo sapiens
cattatttgcatgttacct

SEQ ID NO: 3264613 - DNA, 18 bp, Homo sapiens
cattattttctgtcagat

SEQ ID NO: 3264614 - DNA, 13 bp, Homo sapiens
cattattttgtgg

SEQ ID NO: 3264615 - DNA, 23 bp, Homo sapiens
cattattttgtggttctatttta

SEQ ID NO: 3264616 - DNA, 22 bp, Homo sapiens
cattatttttccactttgttct

SEQ ID NO: 3264617 - DNA, 20 bp, Homo sapiens
cattcaaactgcacttttag

SEQ ID NO: 3264618 - DNA, 22 bp, Homo sapiens
cattcaaatcagtgatctatgt

SEQ ID NO: 3264619 - DNA, 16 bp, Homo sapiens
cattcaatacaagtgt

SEQ ID NO: 3264620 - DNA, 13 bp, Homo sapiens
cattcacaagcct

SEQ ID NO: 3264621 - DNA, 15 bp, Homo sapiens
cattcacaagcctcc

SEQ ID NO: 3264622 - DNA, 22 bp, Homo sapiens
cattcacactttttatttaatt

SEQ ID NO: 3264623 - DNA, 22 bp, Homo sapiens
cattcaccaaatgatgccactt

SEQ ID NO: 3264624 - DNA, 14 bp, Homo sapiens
cattcacttctgca

SEQ ID NO: 3264625 - DNA, 18 bp, Homo sapiens
cattcacttgcatttctt

SEQ ID NO: 3264626 - DNA, 12 bp, Homo sapiens
cattcagaaatg

SEQ ID NO: 3264627 - DNA, 15 bp, Homo sapiens
cattcagaaatgttg

SEQ ID NO: 3264628 - DNA, 12 bp, Homo sapiens
cattcagagagc

SEQ ID NO: 3264629 - DNA, 23 bp, Homo sapiens
cattcagatcactgaatttataa

SEQ ID NO: 3264630 - DNA, 15 bp, Homo sapiens
cattcagctaacaaa

SEQ ID NO: 3264631 - DNA, 20 bp, Homo sapiens
cattcagctaacaaactaga

SEQ ID NO: 3264632 - DNA, 19 bp, Homo sapiens
cattcagtgattactgtca

SEQ ID NO: 3264633 - DNA, 21 bp, Homo sapiens
cattcatattaagacagtgta

SEQ ID NO: 3264634 - DNA, 22 bp, Homo sapiens
cattcatattaagacagtgtac

SEQ ID NO: 3264635 - DNA, 23 bp, Homo sapiens
cattcatcaatatccctcttgta

SEQ ID NO: 3264636 - DNA, 20 bp, Homo sapiens
cattcatttagctaaacgga

SEQ ID NO: 3264637 - DNA, 16 bp, Homo sapiens
cattcattttctgaca

SEQ ID NO: 3264638 - DNA, 18 bp, Homo sapiens
cattccaagactctagag

SEQ ID NO: 3264639 - DNA, 12 bp, Homo sapiens
cattccactcca

SEQ ID NO: 3264640 - DNA, 14 bp, Homo sapiens
cattccactccact

SEQ ID NO: 3264641 - DNA, 18 bp, Homo sapiens
cattccactgttggtatt

SEQ ID NO: 3264642 - DNA, 13 bp, Homo sapiens
cattccagcccct

SEQ ID NO: 3264643 - DNA, 19 bp, Homo sapiens
cattccagcccctctggtc

SEQ ID NO: 3264644 - DNA, 15 bp, Homo sapiens
cattccagtaacttt

SEQ ID NO: 3264645 - DNA, 18 bp, Homo sapiens
cattccagtaactttttt

SEQ ID NO: 3264646 - DNA, 23 bp, Homo sapiens
cattccagtaacttttttgtgta

SEQ ID NO: 3264647 - DNA, 19 bp, Homo sapiens
cattccagtgctagaaaat

SEQ ID NO: 3264648 - DNA, 20 bp, Homo sapiens
cattccagtgctagaaaatt

SEQ ID NO: 3264649 - DNA, 16 bp, Homo sapiens
cataataagtttcata

SEQ ID NO: 3264650 - DNA, 18 bp, Homo sapiens
cataataataatttgcac

SEQ ID NO: 3264651 - DNA, 16 bp, Homo sapiens
cataatcactctaatt

SEQ ID NO: 3264652 - DNA, 20 bp, Homo sapiens
cataatcagtatatttggtt

SEQ ID NO: 3264653 - DNA, 15 bp, Homo sapiens
cataatccttctgca

SEQ ID NO: 3264654 - DNA, 22 bp, Homo sapiens
cataatctagtttacagaaaaa

SEQ ID NO: 3264655 - DNA, 19 bp, Homo sapiens
cataatctggactcctctg

SEQ ID NO: 3264656 - DNA, 21 bp, Homo sapiens
cataatctggactcctctgtc

SEQ ID NO: 3264657 - DNA, 14 bp, Homo sapiens
cataatcttagaga

SEQ ID NO: 3264658 - DNA, 16 bp, Homo sapiens
cataatcttagagaca

SEQ ID NO: 3264659 - DNA, 20 bp, Homo sapiens
cataatgcattcttctctgt

SEQ ID NO: 3264660 - DNA, 22 bp, Homo sapiens
cataatgcattcttctctgttg

SEQ ID NO: 3264661 - DNA, 15 bp, Homo sapiens
cataatgctttggaa

SEQ ID NO: 3264662 - DNA, 19 bp, Homo sapiens
cataatggggattaattag

SEQ ID NO: 3264663 - DNA, 20 bp, Homo sapiens
cataatgtactgatttcagt

SEQ ID NO: 3264664 - DNA, 12 bp, Homo sapiens
cataatgtgaaa

SEQ ID NO: 3264665 - DNA, 18 bp, Homo sapiens
cataatgtttctggattt

SEQ ID NO: 3264666 - DNA, 14 bp, Homo sapiens
catctatcgagttt

SEQ ID NO: 3264667 - DNA, 20 bp, Homo sapiens
catctatcgagtttgcaatg

SEQ ID NO: 3264668 - DNA, 13 bp, Homo sapiens
catctatctagtt

SEQ ID NO: 3264669 - DNA, 16 bp, Homo sapiens
catctatctcaatcct

SEQ ID NO: 3264670 - DNA, 18 bp, Homo sapiens
catctattataaaaccat

SEQ ID NO: 3264671 - DNA, 16 bp, Homo sapiens
catctcaaaacagagg

SEQ ID NO: 3264672 - DNA, 18 bp, Homo sapiens
catctcaaaacagagggc

SEQ ID NO: 3264673 - DNA, 13 bp, Homo sapiens
catctcagagtcc

SEQ ID NO: 3264674 - DNA, 17 bp, Homo sapiens
catctcagcctcctgag

SEQ ID NO: 3264675 - DNA, 13 bp, Homo sapiens
catctcaggagat

SEQ ID NO: 3264676 - DNA, 17 bp, Homo sapiens
catctcaggagatggag

SEQ ID NO: 3264677 - DNA, 22 bp, Homo sapiens
catctcaggagatggagggctt

SEQ ID NO: 3264678 - DNA, 15 bp, Homo sapiens
catctcaggggccag

SEQ ID NO: 3264679 - DNA, 14 bp, Homo sapiens
catctcaggtgcca

SEQ ID NO: 3264680 - DNA, 17 bp, Homo sapiens
catctcaggtgccactc

SEQ ID NO: 3264681 - DNA, 11 bp, Homo sapiens
catctcatcct

SEQ ID NO: 3264682 - DNA, 18 bp, Homo sapiens
catctcatcctggcacgc

SEQ ID NO: 3264683 - DNA, 20 bp, Homo sapiens
catctccaagataagcctga

SEQ ID NO: 3264684 - DNA, 18 bp, Homo sapiens
catctccaaggatcctct

SEQ ID NO: 3264685 - DNA, 15 bp, Homo sapiens
catctccatcagctg

SEQ ID NO: 3264686 - DNA, 14 bp, Homo sapiens
catctcccaccctg

SEQ ID NO: 3264687 - DNA, 15 bp, Homo sapiens
catctcccaccctgt

SEQ ID NO: 3264688 - DNA, 21 bp, Homo sapiens
catctcccaccctgtacctca

SEQ ID NO: 3264689 - DNA, 15 bp, Homo sapiens
catctccccaggcct

SEQ ID NO: 3264690 - DNA, 17 bp, Homo sapiens
catctccccaggcctcc

SEQ ID NO: 3264691 - DNA, 20 bp, Homo sapiens
catctccccaggcctccagc

SEQ ID NO: 3264692 - DNA, 22 bp, Homo sapiens
catctccccaggcctccagcct

SEQ ID NO: 3264693 - DNA, 21 bp, Homo sapiens
catctccctccccagaaacag

SEQ ID NO: 3264694 - DNA, 13 bp, Homo sapiens
catctccctgcct

SEQ ID NO: 3264695 - DNA, 15 bp, Homo sapiens
catctccctgcctgg

SEQ ID NO: 3264696 - DNA, 19 bp, Homo sapiens
catctccctgcctggcccc

SEQ ID NO: 3264697 - DNA, 21 bp, Homo sapiens
catctccctgcctggccccca

SEQ ID NO: 3264698 - DNA, 15 bp, Homo sapiens
catctcccttcatta

SEQ ID NO: 3264699 - DNA, 20 bp, Homo sapiens
catctccggggtggccacag

SEQ ID NO: 3264700 - DNA, 22 bp, Homo sapiens
catctcctaatttgtttcttct

SEQ ID NO: 3264701 - DNA, 18 bp, Homo sapiens
catctcctataatctgtc

SEQ ID NO: 3264702 - DNA, 12 bp, Homo sapiens
catctcctggct

SEQ ID NO: 3264703 - DNA, 14 bp, Homo sapiens
catctcctgtcctg

SEQ ID NO: 3264704 - DNA, 14 bp, Homo sapiens
catctcggagcatc

SEQ ID NO: 3264705 - DNA, 16 bp, Homo sapiens
catctctaattttgga

SEQ ID NO: 3264706 - DNA, 20 bp, Homo sapiens
catctctccctcccctgcca

SEQ ID NO: 3264707 - DNA, 23 bp, Homo sapiens
catctctccctcccctgccattt

SEQ ID NO: 3264708 - DNA, 23 bp, Homo sapiens
catctctctactcctacctcagc

SEQ ID NO: 3264709 - DNA, 11 bp, Homo sapiens
catctcttcag

SEQ ID NO: 3264710 - DNA, 15 bp, Homo sapiens
catctcttcaggttc

SEQ ID NO: 3264711 - DNA, 15 bp, Homo sapiens
catctgacacaaaaa

SEQ ID NO: 3264712 - DNA, 12 bp, Homo sapiens
catctgactgcc

SEQ ID NO: 3264713 - DNA, 13 bp, Homo sapiens
catctgactgcca

SEQ ID NO: 3264714 - DNA, 16 bp, Homo sapiens
catctgactgccaagc

SEQ ID NO: 3264715 - DNA, 20 bp, Homo sapiens
catctgatcacttcatgttt

SEQ ID NO: 3264716 - DNA, 17 bp, Homo sapiens
catctgatgtttcatat

SEQ ID NO: 3264717 - DNA, 17 bp, Homo sapiens
catctgcaccccttctc

SEQ ID NO: 3264718 - DNA, 22 bp, Homo sapiens
catctgcaccccttctctcctc

SEQ ID NO: 3264719 - DNA, 12 bp, Homo sapiens
catctgccagac

SEQ ID NO: 3264720 - DNA, 11 bp, Homo sapiens
catctgcccct

SEQ ID NO: 3264721 - DNA, 14 bp, Homo sapiens
catctgcccctccc

SEQ ID NO: 3264722 - DNA, 17 bp, Homo sapiens
catctgcccctccccca

SEQ ID NO: 3264723 - DNA, 19 bp, Homo sapiens
catctgcccctcccccaac

SEQ ID NO: 3264724 - DNA, 21 bp, Homo sapiens
catctggaatctggagaccag

SEQ ID NO: 3264725 - DNA, 21 bp, Homo sapiens
catctggagggttctaagtgg

SEQ ID NO: 3264726 - DNA, 15 bp, Homo sapiens
catctggcctggcct

SEQ ID NO: 3264727 - DNA, 18 bp, Homo sapiens
catctggcctggcctggc

SEQ ID NO: 3264728 - DNA, 21 bp, Homo sapiens
catctggcctggcctggccct

SEQ ID NO: 3264729 - DNA, 23 bp, Homo sapiens
catctggcctggcctggccctgc

SEQ ID NO: 3264730 - DNA, 14 bp, Homo sapiens
catctggctctaat

SEQ ID NO: 3264731 - DNA, 21 bp, Homo sapiens
catctggctgtttagcagaac

SEQ ID NO: 3264732 - DNA, 22 bp, Homo sapiens
catctggcttattttaatgtga

SEQ ID NO: 3264733 - DNA, 17 bp, Homo sapiens
catctgggacaaaactg

SEQ ID NO: 3264734 - DNA, 22 bp, Homo sapiens
catctggggttggcaacaggac

SEQ ID NO: 3264735 - DNA, 24 bp, Homo sapiens
catctggggttggcaacaggacag

SEQ ID NO: 3264736 - DNA, 15 bp, Homo sapiens
catctgggtccttgc

SEQ ID NO: 3264737 - DNA, 20 bp, Homo sapiens
catctggtcttccaggcact

SEQ ID NO: 3264738 - DNA, 21 bp, Homo sapiens
catctgtataccctctgtttc

SEQ ID NO: 3264739 - DNA, 15 bp, Homo sapiens
catctgtcattatat

SEQ ID NO: 3264740 - DNA, 14 bp, Homo sapiens
catctgtccatggc

SEQ ID NO: 3264741 - DNA, 18 bp, Homo sapiens
catctgtccatggccttt

SEQ ID NO: 3264742 - DNA, 21 bp, Homo sapiens
catctgtccatggcctttcta

SEQ ID NO: 3264743 - DNA, 14 bp, Homo sapiens
catctgtgatggga

SEQ ID NO: 3264744 - DNA, 12 bp, Homo sapiens
catctgttctgg

SEQ ID NO: 3264745 - DNA, 14 bp, Homo sapiens
catcttaaaaatat

SEQ ID NO: 3264746 - DNA, 23 bp, Homo sapiens
catcttacatttctcaccctact

SEQ ID NO: 3264747 - DNA, 22 bp, Homo sapiens
catcttactgtacctgttcctt

SEQ ID NO: 3264748 - DNA, 21 bp, Homo sapiens
catcttccacctgtgccctca

SEQ ID NO: 3264749 - DNA, 22 bp, Homo sapiens
catcttccctagagggttcctg

SEQ ID NO: 3264750 - DNA, 13 bp, Homo sapiens
catcttcctgctg

SEQ ID NO: 3264751 - DNA, 15 bp, Homo sapiens
catcttcctgctgct

SEQ ID NO: 3264752 - DNA, 15 bp, Homo sapiens
catcttcgtcttcac

SEQ ID NO: 3264753 - DNA, 17 bp, Homo sapiens
catcttcgtcttcactc

SEQ ID NO: 3264754 - DNA, 23 bp, Homo sapiens
catcttcgtcttcactcttaggc

SEQ ID NO: 3264755 - DNA, 13 bp, Homo sapiens
catcttctcccca

SEQ ID NO: 3264756 - DNA, 17 bp, Homo sapiens
catcttctccccacagc

SEQ ID NO: 3264757 - DNA, 20 bp, Homo sapiens
catcttctccccacagcctc

SEQ ID NO: 3264758 - DNA, 13 bp, Homo sapiens
catcttctgcctt

SEQ ID NO: 3264759 - DNA, 17 bp, Homo sapiens
catcttctgccttagtc

SEQ ID NO: 3264760 - DNA, 17 bp, Homo sapiens
catcttctggcttgact

SEQ ID NO: 3264761 - DNA, 17 bp, Homo sapiens
catcttctgtgaaatat

SEQ ID NO: 3264762 - DNA, 14 bp, Homo sapiens
catcttgctaccag

SEQ ID NO: 3264763 - DNA, 16 bp, Homo sapiens
catcttgctaccagta

SEQ ID NO: 3264764 - DNA, 20 bp, Homo sapiens
catcttgctaccagtattta

SEQ ID NO: 3264765 - DNA, 15 bp, Homo sapiens
catcttgctctgctg

SEQ ID NO: 3264766 - DNA, 16 bp, Homo sapiens
catcttgctctgctga

SEQ ID NO: 3264767 - DNA, 17 bp, Homo sapiens
catcttgctctgctgac

SEQ ID NO: 3264768 - DNA, 19 bp, Homo sapiens
catcttgctctgctgacag

SEQ ID NO: 3264769 - DNA, 11 bp, Homo sapiens
catcttggggg

SEQ ID NO: 3264770 - DNA, 17 bp, Homo sapiens
catcttgtatacacata

SEQ ID NO: 3264771 - DNA, 12 bp, Homo sapiens
catcttgtgaaa

SEQ ID NO: 3264772 - DNA, 13 bp, Homo sapiens
catcttgtgaaat

SEQ ID NO: 3264773 - DNA, 19 bp, Homo sapiens
catctttgacactctgcag

SEQ ID NO: 3264774 - DNA, 17 bp, Homo sapiens
catctttgcgaaaagat

SEQ ID NO: 3264775 - DNA, 12 bp, Homo sapiens
catctttgggga

SEQ ID NO: 3264776 - DNA, 12 bp, Homo sapiens
catcttttattc

SEQ ID NO: 3264777 - DNA, 15 bp, Homo sapiens
catcttttattcttt

SEQ ID NO: 3264778 - DNA, 15 bp, Homo sapiens
catcttttctacttc

SEQ ID NO: 3264779 - DNA, 16 bp, Homo sapiens
catcttttgtgagatg

SEQ ID NO: 3264780 - DNA, 15 bp, Homo sapiens
catgaaaaagcagct

SEQ ID NO: 3264781 - DNA, 18 bp, Homo sapiens
catgaaaaagcagctacc

SEQ ID NO: 3264782 - DNA, 23 bp, Homo sapiens
catgaaaaagcagctaccaggtg

SEQ ID NO: 3264783 - DNA, 20 bp, Homo sapiens
catgaaaaatcatgggccag

SEQ ID NO: 3264784 - DNA, 18 bp, Homo sapiens
catgaaaacacacataca

SEQ ID NO: 3264785 - DNA, 16 bp, Homo sapiens
catgaaaacgttttat

SEQ ID NO: 3264786 - DNA, 14 bp, Homo sapiens
catgaaaattttaa

SEQ ID NO: 3264787 - DNA, 15 bp, Homo sapiens
catgaaacagaaaca

SEQ ID NO: 3264788 - DNA, 23 bp, Homo sapiens
catgaaagaacccaagacatcat

SEQ ID NO: 3264789 - DNA, 17 bp, Homo sapiens
catgaaattgtatctca

SEQ ID NO: 3264790 - DNA, 12 bp, Homo sapiens
catgaaattttg

SEQ ID NO: 3264791 - DNA, 16 bp, Homo sapiens
catgaacatgttcctg

SEQ ID NO: 3264792 - DNA, 12 bp, Homo sapiens
catgaaccaaat

SEQ ID NO: 3264793 - DNA, 16 bp, Homo sapiens
catgaagacaggacag

SEQ ID NO: 3264794 - DNA, 14 bp, Homo sapiens
catgaagacaggat

SEQ ID NO: 3264795 - DNA, 12 bp, Homo sapiens
catgaagagaag

SEQ ID NO: 3264796 - DNA, 15 bp, Homo sapiens
catgaagctgttgtg

SEQ ID NO: 3264797 - DNA, 16 bp, Homo sapiens
catgaagtaaattatg

SEQ ID NO: 3264798 - DNA, 21 bp, Homo sapiens
catgaagtaaattatgtaact

SEQ ID NO: 3264799 - DNA, 13 bp, Homo sapiens
catgaataaaaca

SEQ ID NO: 3264800 - DNA, 16 bp, Homo sapiens
catgaataaaacactc

SEQ ID NO: 3264801 - DNA, 21 bp, Homo sapiens
catgaatcccacccacatgtg

SEQ ID NO: 3264802 - DNA, 16 bp, Homo sapiens
catgaatgcacactag

SEQ ID NO: 3264803 - DNA, 13 bp, Homo sapiens
catgaatgctttt

SEQ ID NO: 3264804 - DNA, 13 bp, Homo sapiens
catgaatgtatca

SEQ ID NO: 3264805 - DNA, 17 bp, Homo sapiens
catgaatgtatcaggaa

SEQ ID NO: 3264806 - DNA, 18 bp, Homo sapiens
catgaattactgtatata

SEQ ID NO: 3264807 - DNA, 18 bp, Homo sapiens
catgaattcttatgctta

SEQ ID NO: 3264808 - DNA, 17 bp, Homo sapiens
catgaattttaaagtat

SEQ ID NO: 3264809 - DNA, 19 bp, Homo sapiens
catgacaactttgccagct

SEQ ID NO: 3264810 - DNA, 23 bp, Homo sapiens
catgacacccgtgagcgcctgtg

SEQ ID NO: 3264811 - DNA, 15 bp, Homo sapiens
catgacactgacctt

SEQ ID NO: 3264812 - DNA, 18 bp, Homo sapiens
catgacaggcctgaagat

SEQ ID NO: 3264813 - DNA, 12 bp, Homo sapiens
catgacatgtta

SEQ ID NO: 3264814 - DNA, 17 bp, Homo sapiens
catgacatgttatatat

SEQ ID NO: 3264815 - DNA, 19 bp, Homo sapiens
catgacatgttatatattt

SEQ ID NO: 3264816 - DNA, 14 bp, Homo sapiens
catgacccacccct

SEQ ID NO: 3264817 - DNA, 18 bp, Homo sapiens
catgacccacccctgtgc

SEQ ID NO: 3264818 - DNA, 19 bp, Homo sapiens
catgacctagttttccatg

SEQ ID NO: 3264819 - DNA, 22 bp, Homo sapiens
catgacgccagataaaatgttc

SEQ ID NO: 3264820 - DNA, 21 bp, Homo sapiens
catgacggcttttgtcagtat

SEQ ID NO: 3264821 - DNA, 17 bp, Homo sapiens
catgactatgtattttt

SEQ ID NO: 3264822 - DNA, 16 bp, Homo sapiens
catgactgcacccagc

SEQ ID NO: 3264823 - DNA, 18 bp, Homo sapiens
catgactgcacccagctc

SEQ ID NO: 3264824 - DNA, 19 bp, Homo sapiens
catgactgcacccagctcc

SEQ ID NO: 3264825 - DNA, 13 bp, Homo sapiens
catgactggctgt

SEQ ID NO: 3264826 - DNA, 22 bp, Homo sapiens
catgactggctgtctgcctgta

SEQ ID NO: 3264827 - DNA, 15 bp, Homo sapiens
catgactgggcctcc

SEQ ID NO: 3264828 - DNA, 17 bp, Homo sapiens
catgactgggcctccct

SEQ ID NO: 3264829 - DNA, 19 bp, Homo sapiens
catgactgtgaccaccttc

SEQ ID NO: 3264830 - DNA, 16 bp, Homo sapiens
catgagaacaaacaga

SEQ ID NO: 3264831 - DNA, 14 bp, Homo sapiens
catgagaagagggc

SEQ ID NO: 3264832 - DNA, 16 bp, Homo sapiens
catgagaagagggcct

SEQ ID NO: 3264833 - DNA, 17 bp, Homo sapiens
catgagaagagggcctg

SEQ ID NO: 3264834 - DNA, 18 bp, Homo sapiens
catgagaagagggcctgt

SEQ ID NO: 3264835 - DNA, 17 bp, Homo sapiens
catgagaccactgttat

SEQ ID NO: 3264836 - DNA, 19 bp, Homo sapiens
catgagaccactgttatca

SEQ ID NO: 3264837 - DNA, 22 bp, Homo sapiens
catgagaccctggtgcctggct

SEQ ID NO: 3264838 - DNA, 23 bp, Homo sapiens
catgagagaattgtatcatttga

SEQ ID NO: 3264839 - DNA, 15 bp, Homo sapiens
catgagcctcagcat

SEQ ID NO: 3264840 - DNA, 19 bp, Homo sapiens
catgagcctcagcatcctg

SEQ ID NO: 3264841 - DNA, 21 bp, Homo sapiens
catgagcctcagcatcctggc

SEQ ID NO: 3264842 - DNA, 12 bp, Homo sapiens
catgagcctgcc

SEQ ID NO: 3264843 - DNA, 13 bp, Homo sapiens
catgagcctgccc

SEQ ID NO: 3264844 - DNA, 22 bp, Homo sapiens
catgagctatttccattccaga

SEQ ID NO: 3264845 - DNA, 22 bp, Homo sapiens
catgaggacatgatggagcgca

SEQ ID NO: 3264846 - DNA, 14 bp, Homo sapiens
catgagggacaggg

SEQ ID NO: 3264847 - DNA, 15 bp, Homo sapiens
catgagggacagggt

SEQ ID NO: 3264848 - DNA, 16 bp, Homo sapiens
catgagggacagggtc

SEQ ID NO: 3264849 - DNA, 19 bp, Homo sapiens
catgagggacagggtcttt

SEQ ID NO: 3264850 - DNA, 14 bp, Homo sapiens
catgaggtatctaa

SEQ ID NO: 3264851 - DNA, 19 bp, Homo sapiens
catgagttatcatgaattt

SEQ ID NO: 3264852 - DNA, 23 bp, Homo sapiens
catgagttatcatgaattttaaa

SEQ ID NO: 3264853 - DNA, 14 bp, Homo sapiens
catgagttattcat

SEQ ID NO: 3264854 - DNA, 23 bp, Homo sapiens
catgagttattcataaagagaaa

SEQ ID NO: 3264855 - DNA, 16 bp, Homo sapiens
catgagtttgccctgg

SEQ ID NO: 3264856 - DNA, 23 bp, Homo sapiens
catgatctgtatttaatggtttt

SEQ ID NO: 3264857 - DNA, 19 bp, Homo sapiens
catgatgatagttgaatgt

SEQ ID NO: 3264858 - DNA, 15 bp, Homo sapiens
catgatgatctgcct

SEQ ID NO: 3264859 - DNA, 14 bp, Homo sapiens
catgatggaatttc

SEQ ID NO: 3264860 - DNA, 18 bp, Homo sapiens
catgatggagcgcacctg

SEQ ID NO: 3264861 - DNA, 19 bp, Homo sapiens
catgatgggaaaatatttc

SEQ ID NO: 3264862 - DNA, 22 bp, Homo sapiens
catgatgggaaaatatttcctg

SEQ ID NO: 3264863 - DNA, 19 bp, Homo sapiens
catgatgttaaccagaata

SEQ ID NO: 3264864 - DNA, 15 bp, Homo sapiens
catgattctctgagt

SEQ ID NO: 3264865 - DNA, 12 bp, Homo sapiens
catgatttcaaa

SEQ ID NO: 3264866 - DNA, 17 bp, Homo sapiens
catgatttccttgaatg

SEQ ID NO: 3264867 - DNA, 18 bp, Homo sapiens
catgatttgtcccagcct

SEQ ID NO: 3264868 - DNA, 22 bp, Homo sapiens
catgatttgtcccagcctgggg

SEQ ID NO: 3264869 - DNA, 12 bp, Homo sapiens
catgcaccaaac

SEQ ID NO: 3264870 - DNA, 20 bp, Homo sapiens
catgcaccctcatacacaga

SEQ ID NO: 3264871 - DNA, 12 bp, Homo sapiens
catgcactgacc

SEQ ID NO: 3264872 - DNA, 18 bp, Homo sapiens
catgcactgacccttcca

SEQ ID NO: 3264873 - DNA, 14 bp, Homo sapiens
catgcactgatgtt

SEQ ID NO: 3264874 - DNA, 20 bp, Homo sapiens
catgcactgatgttgtgttt

SEQ ID NO: 3264875 - DNA, 19 bp, Homo sapiens
catgcagactcctcagatc

SEQ ID NO: 3264876 - DNA, 16 bp, Homo sapiens
catgcagcccatgccc

SEQ ID NO: 3264877 - DNA, 13 bp, Homo sapiens
catgcaggccctt

SEQ ID NO: 3264878 - DNA, 15 bp, Homo sapiens
catgcagtacttttg

SEQ ID NO: 3264879 - DNA, 16 bp, Homo sapiens
catgcagtacttttgt

SEQ ID NO: 3264880 - DNA, 23 bp, Homo sapiens
catgcagttcattattttgtggt

SEQ ID NO: 3264881 - DNA, 19 bp, Homo sapiens
catgcatgcaaatgagctc

SEQ ID NO: 3264882 - DNA, 16 bp, Homo sapiens
catgcatgtcctgtaa

SEQ ID NO: 3264883 - DNA, 21 bp, Homo sapiens
catgcatgtcctgtaaaggtt

SEQ ID NO: 3264884 - DNA, 17 bp, Homo sapiens
catgcattgttgaggtg

SEQ ID NO: 3264885 - DNA, 17 bp, Homo sapiens
catgcattgttggctat

SEQ ID NO: 3264886 - DNA, 19 bp, Homo sapiens
catgcattgttggctattt

SEQ ID NO: 3264887 - DNA, 21 bp, Homo sapiens
catgcattgttggctatttga

SEQ ID NO: 3264888 - DNA, 14 bp, Homo sapiens
catgcattttgcag

SEQ ID NO: 3264889 - DNA, 12 bp, Homo sapiens
catgccaccctc

SEQ ID NO: 3264890 - DNA, 15 bp, Homo sapiens
catgccactgccagg

SEQ ID NO: 3264891 - DNA, 17 bp, Homo sapiens
catgccactgccaggca

SEQ ID NO: 3264892 - DNA, 18 bp, Homo sapiens
catgccactgccaggcac

SEQ ID NO: 3264893 - DNA, 19 bp, Homo sapiens
catgccactgccaggcacc

SEQ ID NO: 3264894 - DNA, 22 bp, Homo sapiens
catgccccagtcggccccatct

SEQ ID NO: 3264895 - DNA, 14 bp, Homo sapiens
catgcccccctcaa

SEQ ID NO: 3264896 - DNA, 19 bp, Homo sapiens
catgcccccctcaaacctc

SEQ ID NO: 3264897 - DNA, 21 bp, Homo sapiens
catgcccccctcaaacctcct

SEQ ID NO: 3264898 - DNA, 16 bp, Homo sapiens
catgccccctgcagac

SEQ ID NO: 3264899 - DNA, 14 bp, Homo sapiens
catgccccgatgtc

SEQ ID NO: 3264900 - DNA, 18 bp, Homo sapiens
catgccccggccacctct

SEQ ID NO: 3264901 - DNA, 20 bp, Homo sapiens
catgccccggccacctctgc

SEQ ID NO: 3264902 - DNA, 21 bp, Homo sapiens
catgccccggccacctctgcg

SEQ ID NO: 3264903 - DNA, 15 bp, Homo sapiens
catgccccttggctg

SEQ ID NO: 3264904 - DNA, 13 bp, Homo sapiens
catgccctcctgg

SEQ ID NO: 3264905 - DNA, 14 bp, Homo sapiens
catgccctcctgga

SEQ ID NO: 3264906 - DNA, 13 bp, Homo sapiens
catgcccttctga

SEQ ID NO: 3264907 - DNA, 14 bp, Homo sapiens
catgcccttctgat

SEQ ID NO: 3264908 - DNA, 14 bp, Homo sapiens
catgcctcatgcca

SEQ ID NO: 3264909 - DNA, 19 bp, Homo sapiens
catgcctcatgccacacct

SEQ ID NO: 3264910 - DNA, 12 bp, Homo sapiens
catgcctctgat

SEQ ID NO: 3264911 - DNA, 17 bp, Homo sapiens
catgcctctggaggcct

SEQ ID NO: 3264912 - DNA, 19 bp, Homo sapiens
catgcctctggaggcctct

SEQ ID NO: 3264913 - DNA, 22 bp, Homo sapiens
catgcctctggaggcctctggc

SEQ ID NO: 3264914 - DNA, 20 bp, Homo sapiens
catgcctgagggtggagact

SEQ ID NO: 3264915 - DNA, 20 bp, Homo sapiens
catgcctgccccaaacaaat

SEQ ID NO: 3264916 - DNA, 20 bp, Homo sapiens
catgcctgtagctttcctgg

SEQ ID NO: 3264917 - DNA, 20 bp, Homo sapiens
catgcctgtccagcctgggc

SEQ ID NO: 3264918 - DNA, 21 bp, Homo sapiens
catgcctgtccagcctgggca

SEQ ID NO: 3264919 - DNA, 15 bp, Homo sapiens
catgccttaaatttg

SEQ ID NO: 3264920 - DNA, 23 bp, Homo sapiens
catgccttaaatttgtttaatta

SEQ ID NO: 3264921 - DNA, 13 bp, Homo sapiens
catgccttgataa

SEQ ID NO: 3264922 - DNA, 13 bp, Homo sapiens
catgcctttgtaa

SEQ ID NO: 3264923 - DNA, 23 bp, Homo sapiens
catgcgccccctccgccctgcca

SEQ ID NO: 3264924 - DNA, 19 bp, Homo sapiens
catgcgtgccgcctgctcc

SEQ ID NO: 3264925 - DNA, 22 bp, Homo sapiens
cagcatcactccccaaggaaga

SEQ ID NO: 3264926 - DNA, 17 bp, Homo sapiens
cagcatccaccttggct

SEQ ID NO: 3264927 - DNA, 18 bp, Homo sapiens
cagcatccaccttggctc

SEQ ID NO: 3264928 - DNA, 14 bp, Homo sapiens
cagcatccagcctg

SEQ ID NO: 3264929 - DNA, 15 bp, Homo sapiens
cagcatccagcctgt

SEQ ID NO: 3264930 - DNA, 20 bp, Homo sapiens
cagcatccctggagcaggag

SEQ ID NO: 3264931 - DNA, 19 bp, Homo sapiens
cagcatcctggcacccggc

SEQ ID NO: 3264932 - DNA, 20 bp, Homo sapiens
cagcatcctggcacccggcc

SEQ ID NO: 3264933 - DNA, 21 bp, Homo sapiens
cagcatcggacaagaccccca

SEQ ID NO: 3264934 - DNA, 22 bp, Homo sapiens
cagcatcggacaagacccccag

SEQ ID NO: 3264935 - DNA, 15 bp, Homo sapiens
cagcatgaataaaac

SEQ ID NO: 3264936 - DNA, 24 bp, Homo sapiens
cagcatgaataaaacactcatccc

SEQ ID NO: 3264937 - DNA, 21 bp, Homo sapiens
cagcatgacctgtgaccagca

SEQ ID NO: 3264938 - DNA, 15 bp, Homo sapiens
cagcatgactatgta

SEQ ID NO: 3264939 - DNA, 16 bp, Homo sapiens
cagcatgccccttggc

SEQ ID NO: 3264940 - DNA, 19 bp, Homo sapiens
cagcatgcttcccagaggg

SEQ ID NO: 3264941 - DNA, 17 bp, Homo sapiens
cagcatgcttgggctga

SEQ ID NO: 3264942 - DNA, 23 bp, Homo sapiens
cagcatgcttgggctgacccagc

SEQ ID NO: 3264943 - DNA, 13 bp, Homo sapiens
cagcatggaaaaa

SEQ ID NO: 3264944 - DNA, 14 bp, Homo sapiens
cagcatggaaaaat

SEQ ID NO: 3264945 - DNA, 15 bp, Homo sapiens
cagcatggaaaaatg

SEQ ID NO: 3264946 - DNA, 20 bp, Homo sapiens
cagcatgtacggattttcag

SEQ ID NO: 3264947 - DNA, 18 bp, Homo sapiens
cagcatgtctattcagct

SEQ ID NO: 3264948 - DNA, 15 bp, Homo sapiens
cagcatgtgccaaga

SEQ ID NO: 3264949 - DNA, 13 bp, Homo sapiens
cagcatgtgcctt

SEQ ID NO: 3264950 - DNA, 17 bp, Homo sapiens
cagcattattcctccag

SEQ ID NO: 3264951 - DNA, 18 bp, Homo sapiens
cagcattattcctccagg

SEQ ID NO: 3264952 - DNA, 15 bp, Homo sapiens
cagcattcatttgtt

SEQ ID NO: 3264953 - DNA, 21 bp, Homo sapiens
cagcattcatttgttttttca

SEQ ID NO: 3264954 - DNA, 17 bp, Homo sapiens
cagcattccagacttca

SEQ ID NO: 3264955 - DNA, 17 bp, Homo sapiens
cagtaatttgaggacaa

SEQ ID NO: 3264956 - DNA, 16 bp, Homo sapiens
cagtacaggggtgctg

SEQ ID NO: 3264957 - DNA, 16 bp, Homo sapiens
cagtacatcaaaggaa

SEQ ID NO: 3264958 - DNA, 18 bp, Homo sapiens
cagtaccataatcttaga

SEQ ID NO: 3264959 - DNA, 22 bp, Homo sapiens
cagtacccctggtaaaccaagc

SEQ ID NO: 3264960 - DNA, 19 bp, Homo sapiens
cagtaccctctcagctcca

SEQ ID NO: 3264961 - DNA, 20 bp, Homo sapiens
cagtaccctctcagctccag

SEQ ID NO: 3264962 - DNA, 22 bp, Homo sapiens
cagtaccctctcagctccaggt

SEQ ID NO: 3264963 - DNA, 15 bp, Homo sapiens
cagtacctccaagca

SEQ ID NO: 3264964 - DNA, 16 bp, Homo sapiens
cagtacctccaagcaa

SEQ ID NO: 3264965 - DNA, 20 bp, Homo sapiens
cagtacctgattgtattttt

SEQ ID NO: 3264966 - DNA, 13 bp, Homo sapiens
cagtacctgggaa

SEQ ID NO: 3264967 - DNA, 21 bp, Homo sapiens
cagtacctgggaaaggaccca

SEQ ID NO: 3264968 - DNA, 17 bp, Homo sapiens
cagtacctttgtcacaa

SEQ ID NO: 3264969 - DNA, 22 bp, Homo sapiens
cagtactattcaggtaacacta

SEQ ID NO: 3264970 - DNA, 19 bp, Homo sapiens
cagtactgactttctgatt

SEQ ID NO: 3264971 - DNA, 21 bp, Homo sapiens
cagtacttgtgaaacacagct

SEQ ID NO: 3264972 - DNA, 22 bp, Homo sapiens
cagtacttgtgaaacacagctg

SEQ ID NO: 3264973 - DNA, 15 bp, Homo sapiens
cagtactttattgta

SEQ ID NO: 3264974 - DNA, 16 bp, Homo sapiens
cagtacttttgttgta

SEQ ID NO: 3264975 - DNA, 20 bp, Homo sapiens
cagtacttttgttgtatggg

SEQ ID NO: 3264976 - DNA, 18 bp, Homo sapiens
cagtagaaataatatgca

SEQ ID NO: 3264977 - DNA, 14 bp, Homo sapiens
cagtagagccagct

SEQ ID NO: 3264978 - DNA, 23 bp, Homo sapiens
cagtagaggctatggacagggca

SEQ ID NO: 3264979 - DNA, 15 bp, Homo sapiens
cagtagagtcatctc

SEQ ID NO: 3264980 - DNA, 16 bp, Homo sapiens
cagtagagtcatctcc

SEQ ID NO: 3264981 - DNA, 16 bp, Homo sapiens
cagtagattttccaaa

SEQ ID NO: 3264982 - DNA, 23 bp, Homo sapiens
cagtagctccaacactttgagca

SEQ ID NO: 3264983 - DNA, 19 bp, Homo sapiens
cagtagctgtggcctcacc

SEQ ID NO: 3264984 - DNA, 23 bp, Homo sapiens
cagtaggcttttaccattagcat

SEQ ID NO: 3264985 - DNA, 12 bp, Homo sapiens
cagtaggggagg

SEQ ID NO: 3264986 - DNA, 21 bp, Homo sapiens
cagtatacctcatttttcata

SEQ ID NO: 3264987 - DNA, 14 bp, Homo sapiens
cagtatactgtgtg

SEQ ID NO: 3264988 - DNA, 17 bp, Homo sapiens
cagtatactgtgtggga

SEQ ID NO: 3264989 - DNA, 13 bp, Homo sapiens
cagtatatttata

SEQ ID NO: 3264990 - DNA, 14 bp, Homo sapiens
cagtatatttatag

SEQ ID NO: 3264991 - DNA, 15 bp, Homo sapiens
cagtatatttatagt

SEQ ID NO: 3264992 - DNA, 13 bp, Homo sapiens
cagtatatttggt

SEQ ID NO: 3264993 - DNA, 13 bp, Homo sapiens
cagtatcatctcc

SEQ ID NO: 3264994 - DNA, 12 bp, Homo sapiens
cagtatcccaca

SEQ ID NO: 3264995 - DNA, 14 bp, Homo sapiens
cagtatcccacatc

SEQ ID NO: 3264996 - DNA, 16 bp, Homo sapiens
cagtatcccacatcca

SEQ ID NO: 3264997 - DNA, 18 bp, Homo sapiens
cagtatctatatatgtgt

SEQ ID NO: 3264998 - DNA, 23 bp, Homo sapiens
cagtatctatatatgtgtatgta

SEQ ID NO: 3264999 - DNA, 18 bp, Homo sapiens
cagtatgatatcatgctt

SEQ ID NO: 3265000 - DNA, 17 bp, Homo sapiens
cagtatgtattcttttg

SEQ ID NO: 3265001 - DNA, 19 bp, Homo sapiens
cagtattaatactaaaata

SEQ ID NO: 3265002 - DNA, 18 bp, Homo sapiens
cagtattacttctgctac

SEQ ID NO: 3265003 - DNA, 19 bp, Homo sapiens
cagtattatgcatatataa

SEQ ID NO: 3265004 - DNA, 20 bp, Homo sapiens
cagtattctcagagcatgtg

SEQ ID NO: 3265005 - DNA, 12 bp, Homo sapiens
cagtattgaaaa

SEQ ID NO: 3265006 - DNA, 23 bp, Homo sapiens
cagtattgaaaaattatcagtta

SEQ ID NO: 3265007 - DNA, 17 bp, Homo sapiens
cagtattgaaaacttca

SEQ ID NO: 3265008 - DNA, 23 bp, Homo sapiens
cagtattgaaaacttcaaagctg

SEQ ID NO: 3265009 - DNA, 13 bp, Homo sapiens
cagtattgctgat

SEQ ID NO: 3265010 - DNA, 16 bp, Homo sapiens
cagtattgctgatttt

SEQ ID NO: 3265011 - DNA, 17 bp, Homo sapiens
cagtattgctgatttta

SEQ ID NO: 3265012 - DNA, 20 bp, Homo sapiens
cagtatttaatgaaacccta

SEQ ID NO: 3265013 - DNA, 21 bp, Homo sapiens
cagtatttattggtgggttga

SEQ ID NO: 3265014 - DNA, 21 bp, Homo sapiens
cagtatttcaactgctgtaaa

SEQ ID NO: 3265015 - DNA, 15 bp, Homo sapiens
cagtatttcagactg

SEQ ID NO: 3265016 - DNA, 19 bp, Homo sapiens
cagtatttcattgcctgtg

SEQ ID NO: 3265017 - DNA, 19 bp, Homo sapiens
cagtattttggagaaatta

SEQ ID NO: 3265018 - DNA, 20 bp, Homo sapiens
cagtattttggagaaattat

SEQ ID NO: 3265019 - DNA, 21 bp, Homo sapiens
cagtattttggagaaattatt

SEQ ID NO: 3265020 - DNA, 13 bp, Homo sapiens
cagtatttttgcc

SEQ ID NO: 3265021 - DNA, 20 bp, Homo sapiens
cagtatttttttttaatttt

SEQ ID NO: 3265022 - DNA, 22 bp, Homo sapiens
cagtatttttttttaattttga

SEQ ID NO: 3265023 - DNA, 17 bp, Homo sapiens
cagtcaaatttacattt

SEQ ID NO: 3265024 - DNA, 19 bp, Homo sapiens
cagtcaaatttacatttat

SEQ ID NO: 3265025 - DNA, 14 bp, Homo sapiens
cagtcaagaagaaa

SEQ ID NO: 3265026 - DNA, 15 bp, Homo sapiens
cagtcaattttacaa

SEQ ID NO: 3265027 - DNA, 20 bp, Homo sapiens
cagtcagcatgcttcccaga

SEQ ID NO: 3265028 - DNA, 20 bp, Homo sapiens
cagtcaggctgcagaggcac

SEQ ID NO: 3265029 - DNA, 15 bp, Homo sapiens
cagtcagttcccgga

SEQ ID NO: 3265030 - DNA, 17 bp, Homo sapiens
cagtcagttcccggagc

SEQ ID NO: 3265031 - DNA, 19 bp, Homo sapiens
cagtcagttcccggagcac

SEQ ID NO: 3265032 - DNA, 15 bp, Homo sapiens
cagtcataactaaat

SEQ ID NO: 3265033 - DNA, 20 bp, Homo sapiens
cagtcatcatcagggcctgg

SEQ ID NO: 3265034 - DNA, 23 bp, Homo sapiens
cagtcatcatcagggcctggggc

SEQ ID NO: 3265035 - DNA, 20 bp, Homo sapiens
cagtcatgcataaatatgca

SEQ ID NO: 3265036 - DNA, 23 bp, Homo sapiens
cagtcattatgagaggcaatgat

SEQ ID NO: 3265037 - DNA, 17 bp, Homo sapiens
cagtccaaatgtcctcc

SEQ ID NO: 3265038 - DNA, 21 bp, Homo sapiens
cagtccaaatgtcctccagaa

SEQ ID NO: 3265039 - DNA, 18 bp, Homo sapiens
cagtccaggctgccgtgg

SEQ ID NO: 3265040 - DNA, 15 bp, Homo sapiens
cagtcccaaaaccct

SEQ ID NO: 3265041 - DNA, 16 bp, Homo sapiens
cagtcccaatgcacat

SEQ ID NO: 3265042 - DNA, 18 bp, Homo sapiens
cagtcccaggtttagtga

SEQ ID NO: 3265043 - DNA, 13 bp, Homo sapiens
cagtccccacccc

SEQ ID NO: 3265044 - DNA, 14 bp, Homo sapiens
cagtccccacccct

SEQ ID NO: 3265045 - DNA, 20 bp, Homo sapiens
cagtccccacccctgccccc

SEQ ID NO: 3265046 - DNA, 16 bp, Homo sapiens
cagtccccagactcag

SEQ ID NO: 3265047 - DNA, 15 bp, Homo sapiens
cagtccccagccctt

SEQ ID NO: 3265048 - DNA, 17 bp, Homo sapiens
cagtccccagcccttct

SEQ ID NO: 3265049 - DNA, 14 bp, Homo sapiens
cagtcccctcccat

SEQ ID NO: 3265050 - DNA, 16 bp, Homo sapiens
cagtcccctcccatct

SEQ ID NO: 3265051 - DNA, 22 bp, Homo sapiens
cagtcccctcccatctgggagt

SEQ ID NO: 3265052 - DNA, 14 bp, Homo sapiens
cagtccctaaagaa

SEQ ID NO: 3265053 - DNA, 22 bp, Homo sapiens
cagtcctccagaccaccagccg

SEQ ID NO: 3265054 - DNA, 14 bp, Homo sapiens
cagtcctcccctca

SEQ ID NO: 3265055 - DNA, 20 bp, Homo sapiens
cagtcctgcaggagtgctgg

SEQ ID NO: 3265056 - DNA, 17 bp, Homo sapiens
cagtcctgcctcagcct

SEQ ID NO: 3265057 - DNA, 13 bp, Homo sapiens
cagtcctgcctgg

SEQ ID NO: 3265058 - DNA, 15 bp, Homo sapiens
cagtcctgctccaga

SEQ ID NO: 3265059 - DNA, 17 bp, Homo sapiens
cagtcctggaagccagc

SEQ ID NO: 3265060 - DNA, 22 bp, Homo sapiens
cagtcctggaagccagctttcc

SEQ ID NO: 3265061 - DNA, 22 bp, Homo sapiens
cagtcctgggagaacctcaggc

SEQ ID NO: 3265062 - DNA, 22 bp, Homo sapiens
cagtcctttcccaccattcctg

SEQ ID NO: 3265063 - DNA, 23 bp, Homo sapiens
cagtcctttcccaccattcctgc

SEQ ID NO: 3265064 - DNA, 17 bp, Homo sapiens
cagtcgaccgcacttat

SEQ ID NO: 3265065 - DNA, 19 bp, Homo sapiens
cagtcgaccgcacttatgg

SEQ ID NO: 3265066 - DNA, 20 bp, Homo sapiens
cagtcgcaggatccgctgcc

SEQ ID NO: 3265067 - DNA, 21 bp, Homo sapiens
cagtcgcaggatccgctgcca

SEQ ID NO: 3265068 - DNA, 17 bp, Homo sapiens
cagtcggaaaagcgtct

SEQ ID NO: 3265069 - DNA, 22 bp, Homo sapiens
cagtcggaaaagcgtctttaag

SEQ ID NO: 3265070 - DNA, 14 bp, Homo sapiens
cagtcggccccatc

SEQ ID NO: 3265071 - DNA, 14 bp, Homo sapiens
cagtcgggggctgg

SEQ ID NO: 3265072 - DNA, 16 bp, Homo sapiens
cagtcgggggctggcc

SEQ ID NO: 3265073 - DNA, 19 bp, Homo sapiens
cagtcgggggctggcctag

SEQ ID NO: 3265074 - DNA, 14 bp, Homo sapiens
cagtcgtgcctgtg

SEQ ID NO: 3265075 - DNA, 15 bp, Homo sapiens
cagtcgttagaatat

SEQ ID NO: 3265076 - DNA, 19 bp, Homo sapiens
cagtctaaaatgcttcagt

SEQ ID NO: 3265077 - DNA, 21 bp, Homo sapiens
cagtctaaacagagtccggga

SEQ ID NO: 3265078 - DNA, 16 bp, Homo sapiens
cagtctagtacttatt

SEQ ID NO: 3265079 - DNA, 15 bp, Homo sapiens
cagtctatccacaga

SEQ ID NO: 3265080 - DNA, 19 bp, Homo sapiens
cagtctcaggagcatgggg

SEQ ID NO: 3265081 - DNA, 18 bp, Homo sapiens
cagtctccctttcccttc

SEQ ID NO: 3265082 - DNA, 22 bp, Homo sapiens
cagtctccctttcccttcttgg

SEQ ID NO: 3265083 - DNA, 15 bp, Homo sapiens
cagtctcctcactct

SEQ ID NO: 3265084 - DNA, 20 bp, Homo sapiens
cagtctcctcactctgtccc

SEQ ID NO: 3265085 - DNA, 17 bp, Homo sapiens
cagtctccttcagcacg

SEQ ID NO: 3265086 - DNA, 18 bp, Homo sapiens
cagtctctcttaaagttg

SEQ ID NO: 3265087 - DNA, 14 bp, Homo sapiens
cagtctctcttctc

SEQ ID NO: 3265088 - DNA, 17 bp, Homo sapiens
cagtctctcttctctcc

SEQ ID NO: 3265089 - DNA, 12 bp, Homo sapiens
cagtctcttcca

SEQ ID NO: 3265090 - DNA, 15 bp, Homo sapiens
cagtctctttaatct

SEQ ID NO: 3265091 - DNA, 16 bp, Homo sapiens
cagtctctttcttcct

SEQ ID NO: 3265092 - DNA, 19 bp, Homo sapiens
cagtctgaacccttgtgct

SEQ ID NO: 3265093 - DNA, 22 bp, Homo sapiens
cagtctgaacccttgtgcttgg

SEQ ID NO: 3265094 - DNA, 20 bp, Homo sapiens
cagtctgaatgctgccacaa

SEQ ID NO: 3265095 - DNA, 15 bp, Homo sapiens
cagtctggagaaggt

SEQ ID NO: 3265096 - DNA, 15 bp, Homo sapiens
cagtctggcctgggc

SEQ ID NO: 3265097 - DNA, 12 bp, Homo sapiens
cagtctgtcatg

SEQ ID NO: 3265098 - DNA, 23 bp, Homo sapiens
cagtctgtcatgaacatgttcct

SEQ ID NO: 3265099 - DNA, 16 bp, Homo sapiens
cagtctgtctactgtg

SEQ ID NO: 3265100 - DNA, 21 bp, Homo sapiens
cagtctgttccccatggccac

SEQ ID NO: 3265101 - DNA, 18 bp, Homo sapiens
cagtcttcctgacacttt

SEQ ID NO: 3265102 - DNA, 21 bp, Homo sapiens
cagtcttcctgacactttaat

SEQ ID NO: 3265103 - DNA, 17 bp, Homo sapiens
cagtcttgcctaggcca

SEQ ID NO: 3265104 - DNA, 11 bp, Homo sapiens
cagtcttgctc

SEQ ID NO: 3265105 - DNA, 18 bp, Homo sapiens
cagtctttaaaggcccag

SEQ ID NO: 3265106 - DNA, 17 bp, Homo sapiens
cagtgaacttggctttc

SEQ ID NO: 3265107 - DNA, 14 bp, Homo sapiens
cagtgaagatgttt

SEQ ID NO: 3265108 - DNA, 22 bp, Homo sapiens
cagtgaaggagccacgtgaatg

SEQ ID NO: 3265109 - DNA, 23 bp, Homo sapiens
cagtgaaggtggggagaagctga

SEQ ID NO: 3265110 - DNA, 15 bp, Homo sapiens
cagtgaattgtcttt

SEQ ID NO: 3265111 - DNA, 16 bp, Homo sapiens
cagtgaattgtctttt

SEQ ID NO: 3265112 - DNA, 21 bp, Homo sapiens
cagtgacaaagactcctctgg

SEQ ID NO: 3265113 - DNA, 13 bp, Homo sapiens
cagtgacaacatc

SEQ ID NO: 3265114 - DNA, 18 bp, Homo sapiens
cagtgacacttcagagag

SEQ ID NO: 3265115 - DNA, 15 bp, Homo sapiens
cagtgacagacaggc

SEQ ID NO: 3265116 - DNA, 17 bp, Homo sapiens
cagtgacagacaggctc

SEQ ID NO: 3265117 - DNA, 20 bp, Homo sapiens
cagtgacagagttcactata

SEQ ID NO: 3265118 - DNA, 14 bp, Homo sapiens
cagtgaccttttct

SEQ ID NO: 3265119 - DNA, 18 bp, Homo sapiens
cagtgaccttttcttcat

SEQ ID NO: 3265120 - DNA, 21 bp, Homo sapiens
cagtgaccttttcttcatttt

SEQ ID NO: 3265121 - DNA, 17 bp, Homo sapiens
cagtgacgtgcacctgt

SEQ ID NO: 3265122 - DNA, 15 bp, Homo sapiens
cagtgactcctgctg

SEQ ID NO: 3265123 - DNA, 20 bp, Homo sapiens
cagtgactcctgctggtacc

SEQ ID NO: 3265124 - DNA, 14 bp, Homo sapiens
cagtgactgaaacc

SEQ ID NO: 3265125 - DNA, 17 bp, Homo sapiens
cagtgactggcaggtgc

SEQ ID NO: 3265126 - DNA, 22 bp, Homo sapiens
cagtgactttgtatagagaatt

SEQ ID NO: 3265127 - DNA, 19 bp, Homo sapiens
cagtgagaaaaagctcctg

SEQ ID NO: 3265128 - DNA, 21 bp, Homo sapiens
cagtgagaaaaagctcctgtc

SEQ ID NO: 3265129 - DNA, 22 bp, Homo sapiens
cagtgagaaaaagctcctgtcc

SEQ ID NO: 3265130 - DNA, 19 bp, Homo sapiens
cagtgagattacagaggaa

SEQ ID NO: 3265131 - DNA, 12 bp, Homo sapiens
cagtgagcctga

SEQ ID NO: 3265132 - DNA, 16 bp, Homo sapiens
cagtgagctctagcaa

SEQ ID NO: 3265133 - DNA, 17 bp, Homo sapiens
cagtgagtctcttcaga

SEQ ID NO: 3265134 - DNA, 15 bp, Homo sapiens
cagtgagtgagcctg

SEQ ID NO: 3265135 - DNA, 16 bp, Homo sapiens
cagtgagtgagcctgg

SEQ ID NO: 3265136 - DNA, 17 bp, Homo sapiens
cagtgagtgagcctggc

SEQ ID NO: 3265137 - DNA, 18 bp, Homo sapiens
cagtgagtgagcctggct

SEQ ID NO: 3265138 - DNA, 15 bp, Homo sapiens
cagtgataggcccaa

SEQ ID NO: 3265139 - DNA, 14 bp, Homo sapiens
cagtgatctatgtt

SEQ ID NO: 3265140 - DNA, 16 bp, Homo sapiens
cagtgatctccatatg

SEQ ID NO: 3265141 - DNA, 22 bp, Homo sapiens
cagtgatgcttttagttttaaa

SEQ ID NO: 3265142 - DNA, 23 bp, Homo sapiens
cagtgatggcgcgggaggcacca

SEQ ID NO: 3265143 - DNA, 23 bp, Homo sapiens
cagtgatgtaccatgaaacaaag

SEQ ID NO: 3265144 - DNA, 20 bp, Homo sapiens
cagtgcaaattgtatcttat

SEQ ID NO: 3265145 - DNA, 12 bp, Homo sapiens
cagtgcagacag

SEQ ID NO: 3265146 - DNA, 14 bp, Homo sapiens
cagtgcagacaggc

SEQ ID NO: 3265147 - DNA, 12 bp, Homo sapiens
cagtgcagccac

SEQ ID NO: 3265148 - DNA, 13 bp, Homo sapiens
cagtgcagccact

SEQ ID NO: 3265149 - DNA, 14 bp, Homo sapiens
cagtgcagccactg

SEQ ID NO: 3265150 - DNA, 16 bp, Homo sapiens
cagtgcagccactggc

SEQ ID NO: 3265151 - DNA, 10 bp, Homo sapiens
cagtgcatca

SEQ ID NO: 3265152 - DNA, 16 bp, Homo sapiens
cagtgcatgtgaagca

SEQ ID NO: 3265153 - DNA, 19 bp, Homo sapiens
cagtgcatgtgaagcatgc

SEQ ID NO: 3265154 - DNA, 14 bp, Homo sapiens
cagtgccactgccc

SEQ ID NO: 3265155 - DNA, 17 bp, Homo sapiens
cagtgccactgcccccc

SEQ ID NO: 3265156 - DNA, 19 bp, Homo sapiens
cagtgccactgccccccga

SEQ ID NO: 3265157 - DNA, 14 bp, Homo sapiens
cagtgccagcaatg

SEQ ID NO: 3265158 - DNA, 15 bp, Homo sapiens
cagtgccagcaatga

SEQ ID NO: 3265159 - DNA, 13 bp, Homo sapiens
cagtgccatcccc

SEQ ID NO: 3265160 - DNA, 18 bp, Homo sapiens
cagtgccatccccacctt

SEQ ID NO: 3265161 - DNA, 20 bp, Homo sapiens
cagtgccatccccaccttca

SEQ ID NO: 3265162 - DNA, 21 bp, Homo sapiens
cagtgccattccactccactc

SEQ ID NO: 3265163 - DNA, 18 bp, Homo sapiens
cagtgccattgtctttat

SEQ ID NO: 3265164 - DNA, 21 bp, Homo sapiens
cagtgcccacaggatcagtct

SEQ ID NO: 3265165 - DNA, 22 bp, Homo sapiens
cagtgcccacaggatcagtctg

SEQ ID NO: 3265166 - DNA, 15 bp, Homo sapiens
cagtgcccatgtgta

SEQ ID NO: 3265167 - DNA, 14 bp, Homo sapiens
cagtgcctcgaggc

SEQ ID NO: 3265168 - DNA, 15 bp, Homo sapiens
cagtgcctcgaggca

SEQ ID NO: 3265169 - DNA, 20 bp, Homo sapiens
cagtgcctcgaggcaccggc

SEQ ID NO: 3265170 - DNA, 15 bp, Homo sapiens
cagtgcctctttgaa

SEQ ID NO: 3265171 - DNA, 20 bp, Homo sapiens
cagtgcctgggaatgtatta

SEQ ID NO: 3265172 - DNA, 16 bp, Homo sapiens
cagtgccttccataat

SEQ ID NO: 3265173 - DNA, 22 bp, Homo sapiens
cagtgccttcctgtttttcaca

SEQ ID NO: 3265174 - DNA, 11 bp, Homo sapiens
cagtgccttct

SEQ ID NO: 3265175 - DNA, 14 bp, Homo sapiens
cagtgccttgggga

SEQ ID NO: 3265176 - DNA, 22 bp, Homo sapiens
cagtgccttggggaatttcctc

SEQ ID NO: 3265177 - DNA, 12 bp, Homo sapiens
cagtgctgccat

SEQ ID NO: 3265178 - DNA, 16 bp, Homo sapiens
cagtgctgccatgcca

SEQ ID NO: 3265179 - DNA, 23 bp, Homo sapiens
cagtgctgctgtaaatacaggaa

SEQ ID NO: 3265180 - DNA, 14 bp, Homo sapiens
cagtgctgcttctc

SEQ ID NO: 3265181 - DNA, 19 bp, Homo sapiens
cagtgctgcttctcttggg

SEQ ID NO: 3265182 - DNA, 21 bp, Homo sapiens
cagtgctggatttgatgagtt

SEQ ID NO: 3265183 - DNA, 18 bp, Homo sapiens
cagtgctgggaccagagc

SEQ ID NO: 3265184 - DNA, 23 bp, Homo sapiens
cagtgctgggaccagagccagat

SEQ ID NO: 3265185 - DNA, 17 bp, Homo sapiens
cagtgctgtggcctggg

SEQ ID NO: 3265186 - DNA, 18 bp, Homo sapiens
cagtgctgtggcctgggc

SEQ ID NO: 3265187 - DNA, 19 bp, Homo sapiens
cagtgctgtggcctgggca

SEQ ID NO: 3265188 - DNA, 17 bp, Homo sapiens
cagtgcttctctacaga

SEQ ID NO: 3265189 - DNA, 18 bp, Homo sapiens
cagtggaaattcaggtga

SEQ ID NO: 3265190 - DNA, 19 bp, Homo sapiens
cagtggaacagcgggagac

SEQ ID NO: 3265191 - DNA, 15 bp, Homo sapiens
cagtggaagaaacac

SEQ ID NO: 3265192 - DNA, 14 bp, Homo sapiens
cagtggagaattat

SEQ ID NO: 3265193 - DNA, 23 bp, Homo sapiens
cagtggatcttcagaactgccct

SEQ ID NO: 3265194 - DNA, 16 bp, Homo sapiens
cagtggattgcatttc

SEQ ID NO: 3265195 - DNA, 23 bp, Homo sapiens
cagtggcacaaaaaaatatcaga

SEQ ID NO: 3265196 - DNA, 12 bp, Homo sapiens
cagtggcagctg

SEQ ID NO: 3265197 - DNA, 14 bp, Homo sapiens
cagtggcagctgct

SEQ ID NO: 3265198 - DNA, 16 bp, Homo sapiens
cagtggcagctgcttt

SEQ ID NO: 3265199 - DNA, 14 bp, Homo sapiens
cagtggcagggctc

SEQ ID NO: 3265200 - DNA, 17 bp, Homo sapiens
cagtggcagggctcagg

SEQ ID NO: 3265201 - DNA, 14 bp, Homo sapiens
cagtggcaggggag

SEQ ID NO: 3265202 - DNA, 18 bp, Homo sapiens
cagtggcaggggagcagg

SEQ ID NO: 3265203 - DNA, 20 bp, Homo sapiens
cagtggcgcattctaggctc

SEQ ID NO: 3265204 - DNA, 20 bp, Homo sapiens
cagtggctcacgcctatgat

SEQ ID NO: 3265205 - DNA, 17 bp, Homo sapiens
cagtggctcataaaaat

SEQ ID NO: 3265206 - DNA, 20 bp, Homo sapiens
cagtggctcgctccctgtag

SEQ ID NO: 3265207 - DNA, 12 bp, Homo sapiens
cagtggctgggt

SEQ ID NO: 3265208 - DNA, 13 bp, Homo sapiens
cagtggctgggtg

SEQ ID NO: 3265209 - DNA, 14 bp, Homo sapiens
cagtggctgggtgg

SEQ ID NO: 3265210 - DNA, 18 bp, Homo sapiens
cagtggctggtccagggc

SEQ ID NO: 3265211 - DNA, 19 bp, Homo sapiens
cagtggctggtccagggct

SEQ ID NO: 3265212 - DNA, 18 bp, Homo sapiens
cagtggctggtttctgag

SEQ ID NO: 3265213 - DNA, 13 bp, Homo sapiens
cagggccaggaag

SEQ ID NO: 3265214 - DNA, 15 bp, Homo sapiens
cagggccaggaagga

SEQ ID NO: 3265215 - DNA, 16 bp, Homo sapiens
cagggccaggaaggac

SEQ ID NO: 3265216 - DNA, 20 bp, Homo sapiens
cagggccaggaaggacagac

SEQ ID NO: 3265217 - DNA, 13 bp, Homo sapiens
cagggccaggact

SEQ ID NO: 3265218 - DNA, 15 bp, Homo sapiens
cagggccaggactga

SEQ ID NO: 3265219 - DNA, 20 bp, Homo sapiens
cagggccaggactgagcccc

SEQ ID NO: 3265220 - DNA, 18 bp, Homo sapiens
cagggccagggccctgca

SEQ ID NO: 3265221 - DNA, 19 bp, Homo sapiens
cagggccagggccctgcag

SEQ ID NO: 3265222 - DNA, 21 bp, Homo sapiens
cagggccagtggggcctgtgg

SEQ ID NO: 3265223 - DNA, 18 bp, Homo sapiens
cagggccatgctgaggcc

SEQ ID NO: 3265224 - DNA, 21 bp, Homo sapiens
cagggccatgctgaggcctgg

SEQ ID NO: 3265225 - DNA, 17 bp, Homo sapiens
cagggcccaagtccctg

SEQ ID NO: 3265226 - DNA, 21 bp, Homo sapiens
cagggcccctcaccctgcctt

SEQ ID NO: 3265227 - DNA, 20 bp, Homo sapiens
cagggcccctccctctgccc

SEQ ID NO: 3265228 - DNA, 20 bp, Homo sapiens
cagggcccgcagtgctggga

SEQ ID NO: 3265229 - DNA, 20 bp, Homo sapiens
cagggccctaggcccctcct

SEQ ID NO: 3265230 - DNA, 23 bp, Homo sapiens
cagggcctactgccacccgcttc

SEQ ID NO: 3265231 - DNA, 16 bp, Homo sapiens
cagggcctggagcccc

SEQ ID NO: 3265232 - DNA, 18 bp, Homo sapiens
cagggcctggagccccat

SEQ ID NO: 3265233 - DNA, 14 bp, Homo sapiens
cagggcctggcagg

SEQ ID NO: 3265234 - DNA, 15 bp, Homo sapiens
cagggcctggcaggc

SEQ ID NO: 3265235 - DNA, 13 bp, Homo sapiens
cagggcctggggc

SEQ ID NO: 3265236 - DNA, 14 bp, Homo sapiens
cagggcctggggcc

SEQ ID NO: 3265237 - DNA, 20 bp, Homo sapiens
cagggcctggggcctgagag

SEQ ID NO: 3265238 - DNA, 22 bp, Homo sapiens
cagggcctggggcctgagagaa

SEQ ID NO: 3265239 - DNA, 18 bp, Homo sapiens
cagggcctgggggcagtg

SEQ ID NO: 3265240 - DNA, 21 bp, Homo sapiens
cagggcctgggggcagtgact

SEQ ID NO: 3265241 - DNA, 20 bp, Homo sapiens
cagggcgcccctgggagaca

SEQ ID NO: 3265242 - DNA, 16 bp, Homo sapiens
cagggcgctcagacgg

SEQ ID NO: 3265243 - DNA, 20 bp, Homo sapiens
cagggcgctcagacggcggc

SEQ ID NO: 3265244 - DNA, 22 bp, Homo sapiens
cagggcgctcagacggcggcca

SEQ ID NO: 3265245 - DNA, 16 bp, Homo sapiens
cagggcgctgggaagg

SEQ ID NO: 3265246 - DNA, 19 bp, Homo sapiens
cagggcgggcagagggctg

SEQ ID NO: 3265247 - DNA, 21 bp, Homo sapiens
cagggcgggcagagggctgga

SEQ ID NO: 3265248 - DNA, 14 bp, Homo sapiens
cagggctagtgact

SEQ ID NO: 3265249 - DNA, 15 bp, Homo sapiens
cagggctagtgactt

SEQ ID NO: 3265250 - DNA, 20 bp, Homo sapiens
cagggctcagcggggacagc

SEQ ID NO: 3265251 - DNA, 12 bp, Homo sapiens
cagggctcagga

SEQ ID NO: 3265252 - DNA, 14 bp, Homo sapiens
cagggctcccaggg

SEQ ID NO: 3265253 - DNA, 11 bp, Homo sapiens
cagggctcctg

SEQ ID NO: 3265254 - DNA, 18 bp, Homo sapiens
cagggctctttgatggac

SEQ ID NO: 3265255 - DNA, 19 bp, Homo sapiens
cagggctggccccagggca

SEQ ID NO: 3265256 - DNA, 11 bp, Homo sapiens
cagggctggct

SEQ ID NO: 3265257 - DNA, 12 bp, Homo sapiens
cagggctggctc

SEQ ID NO: 3265258 - DNA, 10 bp, Homo sapiens
cagggctggg

SEQ ID NO: 3265259 - DNA, 14 bp, Homo sapiens
caggggaacctgcc

SEQ ID NO: 3265260 - DNA, 16 bp, Homo sapiens
caggggaacctgccat

SEQ ID NO: 3265261 - DNA, 16 bp, Homo sapiens
caggggagacaggagc

SEQ ID NO: 3265262 - DNA, 17 bp, Homo sapiens
caggggagacaggagcc

SEQ ID NO: 3265263 - DNA, 21 bp, Homo sapiens
caggggagacaggagcctagc

SEQ ID NO: 3265264 - DNA, 18 bp, Homo sapiens
caggggaggaaaaaagaa

SEQ ID NO: 3265265 - DNA, 13 bp, Homo sapiens
caggggaggagcc

SEQ ID NO: 3265266 - DNA, 14 bp, Homo sapiens
caggggaggagcct

SEQ ID NO: 3265267 - DNA, 17 bp, Homo sapiens
caggggaggagcctgtg

SEQ ID NO: 3265268 - DNA, 14 bp, Homo sapiens
caggggattgaagc

SEQ ID NO: 3265269 - DNA, 11 bp, Homo sapiens
caggggcagga

SEQ ID NO: 3265270 - DNA, 17 bp, Homo sapiens
caggggcaggagaggct

SEQ ID NO: 3265271 - DNA, 16 bp, Homo sapiens
caggggcaggcctggg

SEQ ID NO: 3265272 - DNA, 14 bp, Homo sapiens
caggggccagagga

SEQ ID NO: 3265273 - DNA, 12 bp, Homo sapiens
caggggccccag

SEQ ID NO: 3265274 - DNA, 15 bp, Homo sapiens
caggggccccagatc

SEQ ID NO: 3265275 - DNA, 23 bp, Homo sapiens
caggggccccagatctgcctggg

SEQ ID NO: 3265276 - DNA, 24 bp, Homo sapiens
caggggccccagatctgcctgggc

SEQ ID NO: 3265277 - DNA, 18 bp, Homo sapiens
caggggcccttgggacag

SEQ ID NO: 3265278 - DNA, 14 bp, Homo sapiens
caggggcctgcaga

SEQ ID NO: 3265279 - DNA, 22 bp, Homo sapiens
caggggcctgcagaaggaaaga

SEQ ID NO: 3265280 - DNA, 23 bp, Homo sapiens
caggggcctggagatcctcctgc

SEQ ID NO: 3265281 - DNA, 13 bp, Homo sapiens
caggggcggggca

SEQ ID NO: 3265282 - DNA, 14 bp, Homo sapiens
caggggcggggcag

SEQ ID NO: 3265283 - DNA, 17 bp, Homo sapiens
caggggcggggcaggaa

SEQ ID NO: 3265284 - DNA, 22 bp, Homo sapiens
caggggcgtgaggtcccaggaa

SEQ ID NO: 3265285 - DNA, 11 bp, Homo sapiens
caggggctcca

SEQ ID NO: 3265286 - DNA, 14 bp, Homo sapiens
caggggctccagca

SEQ ID NO: 3265287 - DNA, 13 bp, Homo sapiens
caggggctctgga

SEQ ID NO: 3265288 - DNA, 18 bp, Homo sapiens
caggggctctggagagaa

SEQ ID NO: 3265289 - DNA, 20 bp, Homo sapiens
caggggctctggagagaaac

SEQ ID NO: 3265290 - DNA, 22 bp, Homo sapiens
caggggctgactctccagggag

SEQ ID NO: 3265291 - DNA, 23 bp, Homo sapiens
caggggctgggggtgctggatgg

SEQ ID NO: 3265292 - DNA, 20 bp, Homo sapiens
caggggctgtggccgtctcc

SEQ ID NO: 3265293 - DNA, 16 bp, Homo sapiens
cagggggagaatgggt

SEQ ID NO: 3265294 - DNA, 21 bp, Homo sapiens
cagggggccccgccagggctg

SEQ ID NO: 3265295 - DNA, 13 bp, Homo sapiens
caggggggagaag

SEQ ID NO: 3265296 - DNA, 22 bp, Homo sapiens
caggggggctgtgccaacctgt

SEQ ID NO: 3265297 - DNA, 15 bp, Homo sapiens
caggggtcagtgcag

SEQ ID NO: 3265298 - DNA, 14 bp, Homo sapiens
caggggtcccccct

SEQ ID NO: 3265299 - DNA, 16 bp, Homo sapiens
caggggtcccccctca

SEQ ID NO: 3265300 - DNA, 14 bp, Homo sapiens
caggggtccctgct

SEQ ID NO: 3265301 - DNA, 13 bp, Homo sapiens
caggggtctccct

SEQ ID NO: 3265302 - DNA, 20 bp, Homo sapiens
caggggtctccctggctccc

SEQ ID NO: 3265303 - DNA, 21 bp, Homo sapiens
caggggtctccctggctccct

SEQ ID NO: 3265304 - DNA, 20 bp, Homo sapiens
caggggtgccccctcctctc

SEQ ID NO: 3265305 - DNA, 19 bp, Homo sapiens
caggggtggagtttctgac

SEQ ID NO: 3265306 - DNA, 22 bp, Homo sapiens
caggggtggggggtgcaggtgg

SEQ ID NO: 3265307 - DNA, 20 bp, Homo sapiens
caggggtgggggtggaggct

SEQ ID NO: 3265308 - DNA, 15 bp, Homo sapiens
caggggtggtggagg

SEQ ID NO: 3265309 - DNA, 22 bp, Homo sapiens
caggggtggtggagggggctgg

SEQ ID NO: 3265310 - DNA, 21 bp, Homo sapiens
caggggttcgagaccagtctg

SEQ ID NO: 3265311 - DNA, 15 bp, Homo sapiens
caggggttgcagtga

SEQ ID NO: 3265312 - DNA, 18 bp, Homo sapiens
cagggtacccgcctgagc

SEQ ID NO: 3265313 - DNA, 14 bp, Homo sapiens
cagggtacctcaag

SEQ ID NO: 3265314 - DNA, 17 bp, Homo sapiens
cagggtacctcaagccc

SEQ ID NO: 3265315 - DNA, 19 bp, Homo sapiens
cagggtacctcaagcccca

SEQ ID NO: 3265316 - DNA, 23 bp, Homo sapiens
cagggtagataacctgtacttca

SEQ ID NO: 3265317 - DNA, 15 bp, Homo sapiens
cagggtaggaaaggg

SEQ ID NO: 3265318 - DNA, 20 bp, Homo sapiens
cagggtccccgagtgcctag

SEQ ID NO: 3265319 - DNA, 21 bp, Homo sapiens
cagggtccccgagtgcctagg

SEQ ID NO: 3265320 - DNA, 20 bp, Homo sapiens
cagggtccgcaccagctgct

SEQ ID NO: 3265321 - DNA, 22 bp, Homo sapiens
cagggtccgcaccagctgctct

SEQ ID NO: 3265322 - DNA, 22 bp, Homo sapiens
cagggtccttttgacactgctc

SEQ ID NO: 3265323 - DNA, 23 bp, Homo sapiens
cagggtctcactatgttgcccag

SEQ ID NO: 3265324 - DNA, 22 bp, Homo sapiens
cagggtctcactctgtcgccca

SEQ ID NO: 3265325 - DNA, 18 bp, Homo sapiens
cagggtctctccctcagg

SEQ ID NO: 3265326 - DNA, 15 bp, Homo sapiens
cagggtctcttcctt

SEQ ID NO: 3265327 - DNA, 16 bp, Homo sapiens
cagggtctgagtgcaa

SEQ ID NO: 3265328 - DNA, 22 bp, Homo sapiens
cagggtctgagtgcaagttcat

SEQ ID NO: 3265329 - DNA, 13 bp, Homo sapiens
cagggtctgctct

SEQ ID NO: 3265330 - DNA, 14 bp, Homo sapiens
cagggtctgctctt

SEQ ID NO: 3265331 - DNA, 17 bp, Homo sapiens
cagggtctgctctttct

SEQ ID NO: 3265332 - DNA, 19 bp, Homo sapiens
cagggtctgtgtgaatgtg

SEQ ID NO: 3265333 - DNA, 20 bp, Homo sapiens
cagggtctgtgtgaatgtgg

SEQ ID NO: 3265334 - DNA, 17 bp, Homo sapiens
cagggtcttccctacct

SEQ ID NO: 3265335 - DNA, 22 bp, Homo sapiens
cagggtcttccctacctcaggc

SEQ ID NO: 3265336 - DNA, 13 bp, Homo sapiens
cagggtcttgggc

SEQ ID NO: 3265337 - DNA, 14 bp, Homo sapiens
cagggtcttgggct

SEQ ID NO: 3265338 - DNA, 17 bp, Homo sapiens
cagggtcttgggctact

SEQ ID NO: 3265339 - DNA, 23 bp, Homo sapiens
cagggtcttgggctactggcagc

SEQ ID NO: 3265340 - DNA, 15 bp, Homo sapiens
cagggtcttttttca

SEQ ID NO: 3265341 - DNA, 20 bp, Homo sapiens
cagggtgggaagaaagaatg

SEQ ID NO: 3265342 - DNA, 13 bp, Homo sapiens
cagggtggggggt

SEQ ID NO: 3265343 - DNA, 16 bp, Homo sapiens
cagggtggggggtgac

SEQ ID NO: 3265344 - DNA, 23 bp, Homo sapiens
cagggtgttgggatactgcaggg

SEQ ID NO: 3265345 - DNA, 15 bp, Homo sapiens
cagggttcatctgtc

SEQ ID NO: 3265346 - DNA, 16 bp, Homo sapiens
cagggttcatctgtcc

SEQ ID NO: 3265347 - DNA, 17 bp, Homo sapiens
cagggttcatctgtcca

SEQ ID NO: 3265348 - DNA, 21 bp, Homo sapiens
cagggttggcccctgcccggc

SEQ ID NO: 3265349 - DNA, 13 bp, Homo sapiens
cagggttgggccc

SEQ ID NO: 3265350 - DNA, 14 bp, Homo sapiens
cagggtttaataga

SEQ ID NO: 3265351 - DNA, 23 bp, Homo sapiens
cagggttttgccccaagtcctca

SEQ ID NO: 3265352 - DNA, 14 bp, Homo sapiens
caggtaaaacaggg

SEQ ID NO: 3265353 - DNA, 23 bp, Homo sapiens
caggtaaaacagggccacataga

SEQ ID NO: 3265354 - DNA, 17 bp, Homo sapiens
caggtaaattaagacat

SEQ ID NO: 3265355 - DNA, 16 bp, Homo sapiens
caggtaacaggcagat

SEQ ID NO: 3265356 - DNA, 17 bp, Homo sapiens
caggtaacaggcagata

SEQ ID NO: 3265357 - DNA, 13 bp, Homo sapiens
caggtacaggaga

SEQ ID NO: 3265358 - DNA, 17 bp, Homo sapiens
caggtacaggagaggca

SEQ ID NO: 3265359 - DNA, 13 bp, Homo sapiens
caggtaccagctg

SEQ ID NO: 3265360 - DNA, 17 bp, Homo sapiens
caggtaccagctgcgct

SEQ ID NO: 3265361 - DNA, 19 bp, Homo sapiens
caggtaccagctgcgcttg

SEQ ID NO: 3265362 - DNA, 24 bp, Homo sapiens
caggtacggagaagaatagaggtc

SEQ ID NO: 3265363 - DNA, 21 bp, Homo sapiens
caggtacttcctcctgatggc

SEQ ID NO: 3265364 - DNA, 20 bp, Homo sapiens
caggtagaattatctaattt

SEQ ID NO: 3265365 - DNA, 23 bp, Homo sapiens
caggtagaattatctaatttata

SEQ ID NO: 3265366 - DNA, 21 bp, Homo sapiens
caggtagatcgcttgagccca

SEQ ID NO: 3265367 - DNA, 13 bp, Homo sapiens
caggtaggccctt

SEQ ID NO: 3265368 - DNA, 14 bp, Homo sapiens
caggtaggcccttg

SEQ ID NO: 3265369 - DNA, 19 bp, Homo sapiens
caggtaggcccttgtcctg

SEQ ID NO: 3265370 - DNA, 20 bp, Homo sapiens
caggtaggcccttgtcctgc

SEQ ID NO: 3265371 - DNA, 21 bp, Homo sapiens
caggtaggcccttgtcctgcc

SEQ ID NO: 3265372 - DNA, 23 bp, Homo sapiens
caggtaggcccttgtcctgccag

SEQ ID NO: 3265373 - DNA, 17 bp, Homo sapiens
caggtagtttgtaccat

SEQ ID NO: 3265374 - DNA, 16 bp, Homo sapiens
caggtatgttgccttt

SEQ ID NO: 3265375 - DNA, 21 bp, Homo sapiens
caggtcaataaacttagagga

SEQ ID NO: 3265376 - DNA, 16 bp, Homo sapiens
caggtcagggacttgg

SEQ ID NO: 3265377 - DNA, 20 bp, Homo sapiens
caggtcatgcagttcctggc

SEQ ID NO: 3265378 - DNA, 13 bp, Homo sapiens
caggtccagctct

SEQ ID NO: 3265379 - DNA, 16 bp, Homo sapiens
caggtccagctctgga

SEQ ID NO: 3265380 - DNA, 20 bp, Homo sapiens
caggtcccacctccagcccg

SEQ ID NO: 3265381 - DNA, 20 bp, Homo sapiens
caggtcctcagagaatttct

SEQ ID NO: 3265382 - DNA, 22 bp, Homo sapiens
caggtcctgcccatgtgtcccc

SEQ ID NO: 3265383 - DNA, 20 bp, Homo sapiens
caggtctcccacgtgggaga

SEQ ID NO: 3265384 - DNA, 20 bp, Homo sapiens
caggtcttcatcgaatctac

SEQ ID NO: 3265385 - DNA, 13 bp, Homo sapiens
caggtcttccaga

SEQ ID NO: 3265386 - DNA, 16 bp, Homo sapiens
caggtcttccagacct

SEQ ID NO: 3265387 - DNA, 19 bp, Homo sapiens
caggtcttccagacctgct

SEQ ID NO: 3265388 - DNA, 18 bp, Homo sapiens
caggtcttgaactcctgg

SEQ ID NO: 3265389 - DNA, 13 bp, Homo sapiens
caggtgaacactt

SEQ ID NO: 3265390 - DNA, 16 bp, Homo sapiens
caggtgacatgtgaaa

SEQ ID NO: 3265391 - DNA, 17 bp, Homo sapiens
caggtgacatgtgaaac

SEQ ID NO: 3265392 - DNA, 22 bp, Homo sapiens
caggtgagctctgacccttggg

SEQ ID NO: 3265393 - DNA, 17 bp, Homo sapiens
caggtgatccacccacc

SEQ ID NO: 3265394 - DNA, 20 bp, Homo sapiens
caggtgatccacccacctca

SEQ ID NO: 3265395 - DNA, 22 bp, Homo sapiens
caggtgatccacccacctcagc

SEQ ID NO: 3265396 - DNA, 18 bp, Homo sapiens
caggtgccagcctgaggc

SEQ ID NO: 3265397 - DNA, 11 bp, Homo sapiens
caggtgcctcc

SEQ ID NO: 3265398 - DNA, 17 bp, Homo sapiens
caggtgcctccaggtgt

SEQ ID NO: 3265399 - DNA, 12 bp, Homo sapiens
caggtgcctgga

SEQ ID NO: 3265400 - DNA, 15 bp, Homo sapiens
caggtgcctggacat

SEQ ID NO: 3265401 - DNA, 14 bp, Homo sapiens
caggtgctacaaca

SEQ ID NO: 3265402 - DNA, 15 bp, Homo sapiens
caggtgctggtcccg

SEQ ID NO: 3265403 - DNA, 16 bp, Homo sapiens
caggtggaaggcagac

SEQ ID NO: 3265404 - DNA, 18 bp, Homo sapiens
caggtggaaggcagacag

SEQ ID NO: 3265405 - DNA, 17 bp, Homo sapiens
caggtggagggcacagc

SEQ ID NO: 3265406 - DNA, 19 bp, Homo sapiens
caggtggagggcacagccc

SEQ ID NO: 3265407 - DNA, 21 bp, Homo sapiens
caggtggagggcacagccctc

SEQ ID NO: 3265408 - DNA, 17 bp, Homo sapiens
caggtggatgaggagac

SEQ ID NO: 3265409 - DNA, 19 bp, Homo sapiens
caggtggccactccagacc

SEQ ID NO: 3265410 - DNA, 12 bp, Homo sapiens
caggtgggcact

SEQ ID NO: 3265411 - DNA, 15 bp, Homo sapiens
caggtgggcactgga

SEQ ID NO: 3265412 - DNA, 17 bp, Homo sapiens
caggtgggcgtggtcac

SEQ ID NO: 3265413 - DNA, 22 bp, Homo sapiens
caggtgggctggacttctacct

SEQ ID NO: 3265414 - DNA, 14 bp, Homo sapiens
caggtggggcagct

SEQ ID NO: 3265415 - DNA, 18 bp, Homo sapiens
caggtgggtgctgccctg

SEQ ID NO: 3265416 - DNA, 19 bp, Homo sapiens
caggtggtggcactgagcc

SEQ ID NO: 3265417 - DNA, 22 bp, Homo sapiens
caggtggtggcactgagccccc

SEQ ID NO: 3265418 - DNA, 13 bp, Homo sapiens
caggtggttttta

SEQ ID NO: 3265419 - DNA, 19 bp, Homo sapiens
caggtgtccctgcacttgc

SEQ ID NO: 3265420 - DNA, 14 bp, Homo sapiens
caggtgtcctttcc

SEQ ID NO: 3265421 - DNA, 12 bp, Homo sapiens
caggtgtgaacc

SEQ ID NO: 3265422 - DNA, 16 bp, Homo sapiens
caggtgtgaaccacca

SEQ ID NO: 3265423 - DNA, 22 bp, Homo sapiens
caggtgtgaaccaccacaccca

SEQ ID NO: 3265424 - DNA, 23 bp, Homo sapiens
caggtgtgaaccaccacacccag

SEQ ID NO: 3265425 - DNA, 22 bp, Homo sapiens
caggtgtgagtcaccaagccca

SEQ ID NO: 3265426 - DNA, 15 bp, Homo sapiens
caggtgtgcacgtgg

SEQ ID NO: 3265427 - DNA, 23 bp, Homo sapiens
caggtgtgcacgtggcatgtggc

SEQ ID NO: 3265428 - DNA, 12 bp, Homo sapiens
caggtgtgcctg

SEQ ID NO: 3265429 - DNA, 19 bp, Homo sapiens
caggtgtggtggctcatgg

SEQ ID NO: 3265430 - DNA, 20 bp, Homo sapiens
caggtgtgtccacctgggca

SEQ ID NO: 3265431 - DNA, 21 bp, Homo sapiens
caggtgtgtccacctgggcat

SEQ ID NO: 3265432 - DNA, 18 bp, Homo sapiens
caggtgttaacattccaa

SEQ ID NO: 3265433 - DNA, 13 bp, Homo sapiens
caggtgttgccaa

SEQ ID NO: 3265434 - DNA, 12 bp, Homo sapiens
caggtgtttgac

SEQ ID NO: 3265435 - DNA, 17 bp, Homo sapiens
caggttacgaagacaaa

SEQ ID NO: 3265436 - DNA, 20 bp, Homo sapiens
caggttagcctttgccctgt

SEQ ID NO: 3265437 - DNA, 17 bp, Homo sapiens
caggttatactcctcct

SEQ ID NO: 3265438 - DNA, 19 bp, Homo sapiens
caggttatcgaaataacaa

SEQ ID NO: 3265439 - DNA, 21 bp, Homo sapiens
caggttattgcaataaagtat

SEQ ID NO: 3265440 - DNA, 17 bp, Homo sapiens
caggttcaacccacagc

SEQ ID NO: 3265441 - DNA, 22 bp, Homo sapiens
caggttctccgttagctcctgt

SEQ ID NO: 3265442 - DNA, 23 bp, Homo sapiens
caggttgacaccattctcctgcc

SEQ ID NO: 3265443 - DNA, 15 bp, Homo sapiens
caggttgaccgggac

SEQ ID NO: 3265444 - DNA, 18 bp, Homo sapiens
caggttgctggttgctgt

SEQ ID NO: 3265445 - DNA, 19 bp, Homo sapiens
caggttgctggttgctgtg

SEQ ID NO: 3265446 - DNA, 22 bp, Homo sapiens
caggttgctggttgctgtgtgg

SEQ ID NO: 3265447 - DNA, 18 bp, Homo sapiens
caggttggaagagaatca

SEQ ID NO: 3265448 - DNA, 20 bp, Homo sapiens
caggttggaagagaatcacc

SEQ ID NO: 3265449 - DNA, 13 bp, Homo sapiens
caggttggacccc

SEQ ID NO: 3265450 - DNA, 17 bp, Homo sapiens
caggttggaccccagag

SEQ ID NO: 3265451 - DNA, 22 bp, Homo sapiens
caggttgtctgaagtcactgca

SEQ ID NO: 3265452 - DNA, 17 bp, Homo sapiens
caggtttgaattaggct

SEQ ID NO: 3265453 - DNA, 19 bp, Homo sapiens
caggtttgagaaaaaggaa

SEQ ID NO: 3265454 - DNA, 21 bp, Homo sapiens
caggtttggggagggggaaga

SEQ ID NO: 3265455 - DNA, 13 bp, Homo sapiens
caggtttgttaca

SEQ ID NO: 3265456 - DNA, 23 bp, Homo sapiens
caggtttttggtctgacccactg

SEQ ID NO: 3265457 - DNA, 16 bp, Homo sapiens
cagtaaagagaaactt

SEQ ID NO: 3265458 - DNA, 18 bp, Homo sapiens
cagtaaagagaaactttg

SEQ ID NO: 3265459 - DNA, 17 bp, Homo sapiens
cagtaacatttctgttc

SEQ ID NO: 3265460 - DNA, 21 bp, Homo sapiens
cagtaacccccttaaatttaa

SEQ ID NO: 3265461 - DNA, 14 bp, Homo sapiens
cagtaactaatttt

SEQ ID NO: 3265462 - DNA, 18 bp, Homo sapiens
cagtaactgttttttaag

SEQ ID NO: 3265463 - DNA, 16 bp, Homo sapiens
cagtaactttatgtgt

SEQ ID NO: 3265464 - DNA, 17 bp, Homo sapiens
cagtaacttttttgtgt

SEQ ID NO: 3265465 - DNA, 15 bp, Homo sapiens
cagtaataaaacatc

SEQ ID NO: 3265466 - DNA, 17 bp, Homo sapiens
cagtaataaaacatctt

SEQ ID NO: 3265467 - DNA, 18 bp, Homo sapiens
cagtaataaaacatcttt

SEQ ID NO: 3265468 - DNA, 20 bp, Homo sapiens
cagtaatatttatatattta

SEQ ID NO: 3265469 - DNA, 21 bp, Homo sapiens
cagtaattggtccgatctttg

SEQ ID NO: 3265470 - DNA, 20 bp, Homo sapiens
caggctcctttagcgcccag

SEQ ID NO: 3265471 - DNA, 21 bp, Homo sapiens
caggctctgcacagacaagca

SEQ ID NO: 3265472 - DNA, 13 bp, Homo sapiens
caggctctgctgg

SEQ ID NO: 3265473 - DNA, 14 bp, Homo sapiens
caggctctgctggt

SEQ ID NO: 3265474 - DNA, 19 bp, Homo sapiens
caggctctgctggtggaaa

SEQ ID NO: 3265475 - DNA, 12 bp, Homo sapiens
caggctcttagc

SEQ ID NO: 3265476 - DNA, 13 bp, Homo sapiens
caggctcttcctg

SEQ ID NO: 3265477 - DNA, 16 bp, Homo sapiens
caggctcttcctggac

SEQ ID NO: 3265478 - DNA, 18 bp, Homo sapiens
caggctcttcctggacct

SEQ ID NO: 3265479 - DNA, 23 bp, Homo sapiens
caggctcttcctggacctgagtc

SEQ ID NO: 3265480 - DNA, 12 bp, Homo sapiens
caggctcttctc

SEQ ID NO: 3265481 - DNA, 15 bp, Homo sapiens
caggctcttctcctt

SEQ ID NO: 3265482 - DNA, 22 bp, Homo sapiens
caggctcttctcctttcacaac

SEQ ID NO: 3265483 - DNA, 20 bp, Homo sapiens
caggctgaagagagggacag

SEQ ID NO: 3265484 - DNA, 23 bp, Homo sapiens
caggctgatgcttgaagtaactg

SEQ ID NO: 3265485 - DNA, 20 bp, Homo sapiens
caggctgcactgcagtgatg

SEQ ID NO: 3265486 - DNA, 20 bp, Homo sapiens
caggctgcagaggcacctca

SEQ ID NO: 3265487 - DNA, 22 bp, Homo sapiens
caggctgcccccaacactccag

SEQ ID NO: 3265488 - DNA, 16 bp, Homo sapiens
caggctgccgtggggc

SEQ ID NO: 3265489 - DNA, 12 bp, Homo sapiens
caggctgctaac

SEQ ID NO: 3265490 - DNA, 22 bp, Homo sapiens
caggctgcttcaatcccagcct

SEQ ID NO: 3265491 - DNA, 22 bp, Homo sapiens
caggctggacatgctgactgtc

SEQ ID NO: 3265492 - DNA, 20 bp, Homo sapiens
caggctggaggtaaggcctt

SEQ ID NO: 3265493 - DNA, 21 bp, Homo sapiens
caggctggaggtaaggccttt

SEQ ID NO: 3265494 - DNA, 15 bp, Homo sapiens
caggctggcagctct

SEQ ID NO: 3265495 - DNA, 18 bp, Homo sapiens
caggctggcagctctcca

SEQ ID NO: 3265496 - DNA, 19 bp, Homo sapiens
caggctggcagctctccag

SEQ ID NO: 3265497 - DNA, 20 bp, Homo sapiens
caggctggcagctctccagt

SEQ ID NO: 3265498 - DNA, 12 bp, Homo sapiens
caggctggccag

SEQ ID NO: 3265499 - DNA, 16 bp, Homo sapiens
caggctggccagtcca

SEQ ID NO: 3265500 - DNA, 18 bp, Homo sapiens
caggctggccagtccagg

SEQ ID NO: 3265501 - DNA, 15 bp, Homo sapiens
caggctggcgcagcc

SEQ ID NO: 3265502 - DNA, 17 bp, Homo sapiens
caggctggcgcagccaa

SEQ ID NO: 3265503 - DNA, 21 bp, Homo sapiens
caggctggcgcagccaaggcc

SEQ ID NO: 3265504 - DNA, 12 bp, Homo sapiens
caggctgggaac

SEQ ID NO: 3265505 - DNA, 13 bp, Homo sapiens
caggctgggcagc

SEQ ID NO: 3265506 - DNA, 16 bp, Homo sapiens
caggctgggcagcccc

SEQ ID NO: 3265507 - DNA, 13 bp, Homo sapiens
caggctgggccat

SEQ ID NO: 3265508 - DNA, 20 bp, Homo sapiens
caggctgggccatgtccaaa

SEQ ID NO: 3265509 - DNA, 22 bp, Homo sapiens
caggctgggccatgtccaaaga

SEQ ID NO: 3265510 - DNA, 16 bp, Homo sapiens
caggctgggcttcagt

SEQ ID NO: 3265511 - DNA, 21 bp, Homo sapiens
caggctggtccgagctgagga

SEQ ID NO: 3265512 - DNA, 18 bp, Homo sapiens
caggctggtctaaaactc

SEQ ID NO: 3265513 - DNA, 21 bp, Homo sapiens
caggctgtaggaaatctagtt

SEQ ID NO: 3265514 - DNA, 17 bp, Homo sapiens
caggctgtctggccagg

SEQ ID NO: 3265515 - DNA, 18 bp, Homo sapiens
caggctgttctgcactga

SEQ ID NO: 3265516 - DNA, 19 bp, Homo sapiens
caggctgttctgcactgaa

SEQ ID NO: 3265517 - DNA, 20 bp, Homo sapiens
caggctgttctgcactgaaa

SEQ ID NO: 3265518 - DNA, 16 bp, Homo sapiens
caggcttaataaaaat

SEQ ID NO: 3265519 - DNA, 20 bp, Homo sapiens
caggcttaataaaaatgaca

SEQ ID NO: 3265520 - DNA, 21 bp, Homo sapiens
caggcttaataaaaatgacag

SEQ ID NO: 3265521 - DNA, 22 bp, Homo sapiens
caggcttcctgcaattttctaa

SEQ ID NO: 3265522 - DNA, 15 bp, Homo sapiens
cagggaaaataggca

SEQ ID NO: 3265523 - DNA, 16 bp, Homo sapiens
cagggaaacagctaat

SEQ ID NO: 3265524 - DNA, 22 bp, Homo sapiens
cagggaaacagctaatgggaca

SEQ ID NO: 3265525 - DNA, 14 bp, Homo sapiens
cagggaaaggctct

SEQ ID NO: 3265526 - DNA, 23 bp, Homo sapiens
cagggaaaggctctgaaagccag

SEQ ID NO: 3265527 - DNA, 12 bp, Homo sapiens
cagggaacaaaa

SEQ ID NO: 3265528 - DNA, 17 bp, Homo sapiens
cagggaagagcagaacg

SEQ ID NO: 3265529 - DNA, 14 bp, Homo sapiens
cagggaagagggca

SEQ ID NO: 3265530 - DNA, 22 bp, Homo sapiens
cagggaagcatgtgacacccac

SEQ ID NO: 3265531 - DNA, 23 bp, Homo sapiens
cagggaagcatgtgacacccaca

SEQ ID NO: 3265532 - DNA, 16 bp, Homo sapiens
cagggaaggacaggac

SEQ ID NO: 3265533 - DNA, 21 bp, Homo sapiens
cagggaaggacaggaccctca

SEQ ID NO: 3265534 - DNA, 17 bp, Homo sapiens
cagggaaggtggggccc

SEQ ID NO: 3265535 - DNA, 18 bp, Homo sapiens
cagggaaggtggggccct

SEQ ID NO: 3265536 - DNA, 18 bp, Homo sapiens
cagggaatcagggaccag

SEQ ID NO: 3265537 - DNA, 15 bp, Homo sapiens
cagggaatccagctc

SEQ ID NO: 3265538 - DNA, 14 bp, Homo sapiens
cagggacagagcca

SEQ ID NO: 3265539 - DNA, 17 bp, Homo sapiens
cagggacagagccatgc

SEQ ID NO: 3265540 - DNA, 22 bp, Homo sapiens
cagggaccacaccctgtactgt

SEQ ID NO: 3265541 - DNA, 24 bp, Homo sapiens
cagggaccactgggtgagagagga

SEQ ID NO: 3265542 - DNA, 13 bp, Homo sapiens
cagggaccagctt

SEQ ID NO: 3265543 - DNA, 16 bp, Homo sapiens
cagggaccagctttac

SEQ ID NO: 3265544 - DNA, 18 bp, Homo sapiens
cagggaccggtgctgcag

SEQ ID NO: 3265545 - DNA, 22 bp, Homo sapiens
cagggaccggtgctgcaggagt

SEQ ID NO: 3265546 - DNA, 20 bp, Homo sapiens
cagggagaaactccaaagtc

SEQ ID NO: 3265547 - DNA, 19 bp, Homo sapiens
cagggagcaagacagagac

SEQ ID NO: 3265548 - DNA, 20 bp, Homo sapiens
cagggagcagggaaggcctg

SEQ ID NO: 3265549 - DNA, 14 bp, Homo sapiens
cagggagcctcctg

SEQ ID NO: 3265550 - DNA, 16 bp, Homo sapiens
cagggagcctcctgcc

SEQ ID NO: 3265551 - DNA, 18 bp, Homo sapiens
cagggagcctcctgccca

SEQ ID NO: 3265552 - DNA, 15 bp, Homo sapiens
cagggagctgggaca

SEQ ID NO: 3265553 - DNA, 12 bp, Homo sapiens
cagggaggagag

SEQ ID NO: 3265554 - DNA, 23 bp, Homo sapiens
cagggaggaggtggcagccctgt

SEQ ID NO: 3265555 - DNA, 14 bp, Homo sapiens
cagggaggagtcag

SEQ ID NO: 3265556 - DNA, 16 bp, Homo sapiens
cagggagggaagtgtg

SEQ ID NO: 3265557 - DNA, 22 bp, Homo sapiens
cagggagggaagtgtgagcgcc

SEQ ID NO: 3265558 - DNA, 19 bp, Homo sapiens
cagggagggagggcggtgg

SEQ ID NO: 3265559 - DNA, 12 bp, Homo sapiens
cagggaggggac

SEQ ID NO: 3265560 - DNA, 13 bp, Homo sapiens
cagggaggggact

SEQ ID NO: 3265561 - DNA, 17 bp, Homo sapiens
cagggaggggaggcaga

SEQ ID NO: 3265562 - DNA, 18 bp, Homo sapiens
cagggaggggaggcagat

SEQ ID NO: 3265563 - DNA, 14 bp, Homo sapiens
cagggaggtcaggc

SEQ ID NO: 3265564 - DNA, 23 bp, Homo sapiens
cagggaggtcaggccctggaact

SEQ ID NO: 3265565 - DNA, 17 bp, Homo sapiens
cagggagtgctggctca

SEQ ID NO: 3265566 - DNA, 19 bp, Homo sapiens
cagggatcactggctggcc

SEQ ID NO: 3265567 - DNA, 22 bp, Homo sapiens
cagggatctgtttgaacactta

SEQ ID NO: 3265568 - DNA, 13 bp, Homo sapiens
cagggatggggga

SEQ ID NO: 3265569 - DNA, 17 bp, Homo sapiens
cagggatgggggatggg

SEQ ID NO: 3265570 - DNA, 21 bp, Homo sapiens
cagggatgggggatgggccag

SEQ ID NO: 3265571 - DNA, 23 bp, Homo sapiens
cagggatgggggatgggccaggg

SEQ ID NO: 3265572 - DNA, 16 bp, Homo sapiens
cagggatgggggtggc

SEQ ID NO: 3265573 - DNA, 19 bp, Homo sapiens
cagggatgggggtggctgg

SEQ ID NO: 3265574 - DNA, 19 bp, Homo sapiens
cagggattaacctctgcac

SEQ ID NO: 3265575 - DNA, 23 bp, Homo sapiens
cagggattctgggcttggggtgt

SEQ ID NO: 3265576 - DNA, 15 bp, Homo sapiens
cagggcaaggccatt

SEQ ID NO: 3265577 - DNA, 19 bp, Homo sapiens
cagggcacaccgggcactc

SEQ ID NO: 3265578 - DNA, 16 bp, Homo sapiens
cagggcaccagaggcc

SEQ ID NO: 3265579 - DNA, 17 bp, Homo sapiens
cagggcacgcaggacca

SEQ ID NO: 3265580 - DNA, 12 bp, Homo sapiens
cagggcagagcc

SEQ ID NO: 3265581 - DNA, 13 bp, Homo sapiens
cagggcagggcca

SEQ ID NO: 3265582 - DNA, 22 bp, Homo sapiens
cagggcagggccaccccactct

SEQ ID NO: 3265583 - DNA, 16 bp, Homo sapiens
cagggcaggggtggtg

SEQ ID NO: 3265584 - DNA, 22 bp, Homo sapiens
cagggcagggtgggcagcctat

SEQ ID NO: 3265585 - DNA, 15 bp, Homo sapiens
cagggcatctcctgt

SEQ ID NO: 3265586 - DNA, 22 bp, Homo sapiens
cagggcatgccccggccacctc

SEQ ID NO: 3265587 - DNA, 20 bp, Homo sapiens
cagggcatggccaggtggcc

SEQ ID NO: 3265588 - DNA, 16 bp, Homo sapiens
cagggcattcgggcca

SEQ ID NO: 3265589 - DNA, 18 bp, Homo sapiens
cagggcattcgggccaca

SEQ ID NO: 3265590 - DNA, 20 bp, Homo sapiens
cagggcattcgggccacagg

SEQ ID NO: 3265591 - DNA, 16 bp, Homo sapiens
cagggccaatccccag

SEQ ID NO: 3265592 - DNA, 17 bp, Homo sapiens
cagggccaccccactct

SEQ ID NO: 3265593 - DNA, 20 bp, Homo sapiens
cagggccacgctccagctgc

SEQ ID NO: 3265594 - DNA, 14 bp, Homo sapiens
cagggccagaagga

SEQ ID NO: 3265595 - DNA, 19 bp, Homo sapiens
cagggccagaaggagggca

SEQ ID NO: 3265596 - DNA, 18 bp, Homo sapiens
cagggccagactggaaga

SEQ ID NO: 3265597 - DNA, 12 bp, Homo sapiens
cagggccaggaa

SEQ ID NO: 3265598 - DNA, 18 bp, Homo sapiens
caggcatagaggcttctc

SEQ ID NO: 3265599 - DNA, 15 bp, Homo sapiens
caggcataggcctgg

SEQ ID NO: 3265600 - DNA, 16 bp, Homo sapiens
caggcatccgtggggg

SEQ ID NO: 3265601 - DNA, 12 bp, Homo sapiens
caggcatctcct

SEQ ID NO: 3265602 - DNA, 15 bp, Homo sapiens
caggcatctccttgg

SEQ ID NO: 3265603 - DNA, 22 bp, Homo sapiens
caggcatgaggaatctgggagg

SEQ ID NO: 3265604 - DNA, 17 bp, Homo sapiens
caggcatggctcagagc

SEQ ID NO: 3265605 - DNA, 22 bp, Homo sapiens
caggcatggtcccttaaggcac

SEQ ID NO: 3265606 - DNA, 18 bp, Homo sapiens
caggcattggctcagccc

SEQ ID NO: 3265607 - DNA, 18 bp, Homo sapiens
caggccaagagcagaggc

SEQ ID NO: 3265608 - DNA, 23 bp, Homo sapiens
caggccaagagcagaggcagcga

SEQ ID NO: 3265609 - DNA, 13 bp, Homo sapiens
caggccacagccg

SEQ ID NO: 3265610 - DNA, 15 bp, Homo sapiens
caggccacagccgcc

SEQ ID NO: 3265611 - DNA, 16 bp, Homo sapiens
caggccacctccccag

SEQ ID NO: 3265612 - DNA, 17 bp, Homo sapiens
caggccactgtggccag

SEQ ID NO: 3265613 - DNA, 18 bp, Homo sapiens
caggccactgtggccaga

SEQ ID NO: 3265614 - DNA, 15 bp, Homo sapiens
caggccacttgatga

SEQ ID NO: 3265615 - DNA, 13 bp, Homo sapiens
caggccagaggga

SEQ ID NO: 3265616 - DNA, 15 bp, Homo sapiens
caggccagagggagt

SEQ ID NO: 3265617 - DNA, 19 bp, Homo sapiens
caggccagagggagtgaca

SEQ ID NO: 3265618 - DNA, 23 bp, Homo sapiens
caggccagagggagtgacagagg

SEQ ID NO: 3265619 - DNA, 16 bp, Homo sapiens
caggccagagggcagt

SEQ ID NO: 3265620 - DNA, 20 bp, Homo sapiens
caggccagagggcagtggcc

SEQ ID NO: 3265621 - DNA, 17 bp, Homo sapiens
caggccagatggcccct

SEQ ID NO: 3265622 - DNA, 13 bp, Homo sapiens
caggccagcccag

SEQ ID NO: 3265623 - DNA, 17 bp, Homo sapiens
caggccagcccagccag

SEQ ID NO: 3265624 - DNA, 15 bp, Homo sapiens
caggccagcctccga

SEQ ID NO: 3265625 - DNA, 13 bp, Homo sapiens
caggccaggacca

SEQ ID NO: 3265626 - DNA, 21 bp, Homo sapiens
caggccaggaccacacagtcc

SEQ ID NO: 3265627 - DNA, 15 bp, Homo sapiens
caggccaggtgcagt

SEQ ID NO: 3265628 - DNA, 12 bp, Homo sapiens
caggccagtgtc

SEQ ID NO: 3265629 - DNA, 15 bp, Homo sapiens
caggccatttttggt

SEQ ID NO: 3265630 - DNA, 22 bp, Homo sapiens
caggcccaactgtgagcaagga

SEQ ID NO: 3265631 - DNA, 18 bp, Homo sapiens
caggcccaagagatgaag

SEQ ID NO: 3265632 - DNA, 23 bp, Homo sapiens
caggcccaccatcaccaccgcct

SEQ ID NO: 3265633 - DNA, 12 bp, Homo sapiens
caggcccagaag

SEQ ID NO: 3265634 - DNA, 13 bp, Homo sapiens
caggcccagaagg

SEQ ID NO: 3265635 - DNA, 11 bp, Homo sapiens
caggcccagca

SEQ ID NO: 3265636 - DNA, 21 bp, Homo sapiens
caggcccagcattgctggttc

SEQ ID NO: 3265637 - DNA, 22 bp, Homo sapiens
caggcccagcattgctggttct

SEQ ID NO: 3265638 - DNA, 18 bp, Homo sapiens
caggcccagcgcggccag

SEQ ID NO: 3265639 - DNA, 16 bp, Homo sapiens
caggcccaggcagagc

SEQ ID NO: 3265640 - DNA, 13 bp, Homo sapiens
caggcccagggag

SEQ ID NO: 3265641 - DNA, 17 bp, Homo sapiens
caggcccagggagggaa

SEQ ID NO: 3265642 - DNA, 13 bp, Homo sapiens
caggcccctgagg

SEQ ID NO: 3265643 - DNA, 16 bp, Homo sapiens
caggcccctgaggact

SEQ ID NO: 3265644 - DNA, 17 bp, Homo sapiens
caggcccctgaggactg

SEQ ID NO: 3265645 - DNA, 18 bp, Homo sapiens
caggcccctgaggactgg

SEQ ID NO: 3265646 - DNA, 13 bp, Homo sapiens
caggcccctgcca

SEQ ID NO: 3265647 - DNA, 17 bp, Homo sapiens
caggcccctgccaccct

SEQ ID NO: 3265648 - DNA, 19 bp, Homo sapiens
caggcccctgccaccctgg

SEQ ID NO: 3265649 - DNA, 16 bp, Homo sapiens
caggcccggcagggcg

SEQ ID NO: 3265650 - DNA, 18 bp, Homo sapiens
caggcccggctccaggct

SEQ ID NO: 3265651 - DNA, 19 bp, Homo sapiens
caggcccggctccaggctc

SEQ ID NO: 3265652 - DNA, 14 bp, Homo sapiens
caggccctccagtg

SEQ ID NO: 3265653 - DNA, 14 bp, Homo sapiens
caggccctccatgg

SEQ ID NO: 3265654 - DNA, 18 bp, Homo sapiens
caggccctccatgggcta

SEQ ID NO: 3265655 - DNA, 21 bp, Homo sapiens
caggccctccatgggctagtg

SEQ ID NO: 3265656 - DNA, 22 bp, Homo sapiens
caggccctccctgactccctgt

SEQ ID NO: 3265657 - DNA, 12 bp, Homo sapiens
caggccctgcag

SEQ ID NO: 3265658 - DNA, 16 bp, Homo sapiens
caggccctgcagtgtt

SEQ ID NO: 3265659 - DNA, 14 bp, Homo sapiens
caggccctgctcct

SEQ ID NO: 3265660 - DNA, 16 bp, Homo sapiens
caggccctgctcctgc

SEQ ID NO: 3265661 - DNA, 19 bp, Homo sapiens
caggccctgctcctgcagc

SEQ ID NO: 3265662 - DNA, 20 bp, Homo sapiens
caggccctgctcctgcagca

SEQ ID NO: 3265663 - DNA, 15 bp, Homo sapiens
caggccctggaactc

SEQ ID NO: 3265664 - DNA, 11 bp, Homo sapiens
caggccctggc

SEQ ID NO: 3265665 - DNA, 15 bp, Homo sapiens
caggccctggcctcc

SEQ ID NO: 3265666 - DNA, 21 bp, Homo sapiens
caggcccttattttcaagaaa

SEQ ID NO: 3265667 - DNA, 21 bp, Homo sapiens
caggcccttcctctccactgc

SEQ ID NO: 3265668 - DNA, 19 bp, Homo sapiens
caggccctttgaagcctca

SEQ ID NO: 3265669 - DNA, 15 bp, Homo sapiens
caggccgcagctctt

SEQ ID NO: 3265670 - DNA, 22 bp, Homo sapiens
caggccgcagctcttgcccttc

SEQ ID NO: 3265671 - DNA, 22 bp, Homo sapiens
caggccggaaccacagggccag

SEQ ID NO: 3265672 - DNA, 22 bp, Homo sapiens
caggccggtgtgggctgtgtcg

SEQ ID NO: 3265673 - DNA, 20 bp, Homo sapiens
caggccgttccccttggctt

SEQ ID NO: 3265674 - DNA, 23 bp, Homo sapiens
caggccgttccccttggcttcct

SEQ ID NO: 3265675 - DNA, 19 bp, Homo sapiens
caggcctaggtgcagctcc

SEQ ID NO: 3265676 - DNA, 23 bp, Homo sapiens
caggcctaggtgcagctcctcag

SEQ ID NO: 3265677 - DNA, 12 bp, Homo sapiens
caggcctcacct

SEQ ID NO: 3265678 - DNA, 17 bp, Homo sapiens
caggcctcacctctacc

SEQ ID NO: 3265679 - DNA, 19 bp, Homo sapiens
caggcctcacctctaccca

SEQ ID NO: 3265680 - DNA, 11 bp, Homo sapiens
caggcctccag

SEQ ID NO: 3265681 - DNA, 15 bp, Homo sapiens
caggcctccagcctc

SEQ ID NO: 3265682 - DNA, 19 bp, Homo sapiens
caggcctccagcctctccc

SEQ ID NO: 3265683 - DNA, 13 bp, Homo sapiens
caggcctccctct

SEQ ID NO: 3265684 - DNA, 14 bp, Homo sapiens
caggcctccctctc

SEQ ID NO: 3265685 - DNA, 20 bp, Homo sapiens
caggcctctcttttccccgc

SEQ ID NO: 3265686 - DNA, 17 bp, Homo sapiens
caggcctctgtgtcctt

SEQ ID NO: 3265687 - DNA, 15 bp, Homo sapiens
caggcctcttggcag

SEQ ID NO: 3265688 - DNA, 15 bp, Homo sapiens
caggcctgaaagagg

SEQ ID NO: 3265689 - DNA, 12 bp, Homo sapiens
caggcctgcagc

SEQ ID NO: 3265690 - DNA, 13 bp, Homo sapiens
caggcctgcctcc

SEQ ID NO: 3265691 - DNA, 15 bp, Homo sapiens
caggcctgcctccca

SEQ ID NO: 3265692 - DNA, 20 bp, Homo sapiens
caggcctggcaagtgggtga

SEQ ID NO: 3265693 - DNA, 11 bp, Homo sapiens
caggcctggga

SEQ ID NO: 3265694 - DNA, 12 bp, Homo sapiens
caggcctgggac

SEQ ID NO: 3265695 - DNA, 17 bp, Homo sapiens
caggcctgggacccagc

SEQ ID NO: 3265696 - DNA, 18 bp, Homo sapiens
caggcctgggacccagct

SEQ ID NO: 3265697 - DNA, 24 bp, Homo sapiens
caggcctgggacccagctactctg

SEQ ID NO: 3265698 - DNA, 20 bp, Homo sapiens
caggcctgggtctgtgtctc

SEQ ID NO: 3265699 - DNA, 15 bp, Homo sapiens
caggcgaccgggcct

SEQ ID NO: 3265700 - DNA, 18 bp, Homo sapiens
caggcgcctggcacattt

SEQ ID NO: 3265701 - DNA, 20 bp, Homo sapiens
caggcgcctggcacatttca

SEQ ID NO: 3265702 - DNA, 15 bp, Homo sapiens
caggcgctaattcaa

SEQ ID NO: 3265703 - DNA, 17 bp, Homo sapiens
caggcgctgagtatgga

SEQ ID NO: 3265704 - DNA, 20 bp, Homo sapiens
caggcgctgtgctatcatga

SEQ ID NO: 3265705 - DNA, 16 bp, Homo sapiens
caggcgggaggaggtg

SEQ ID NO: 3265706 - DNA, 15 bp, Homo sapiens
caggcgggctcaagg

SEQ ID NO: 3265707 - DNA, 19 bp, Homo sapiens
caggcggggggggcgcctg

SEQ ID NO: 3265708 - DNA, 22 bp, Homo sapiens
caggcggtccccatccccacca

SEQ ID NO: 3265709 - DNA, 23 bp, Homo sapiens
caggcggtccccatccccaccag

SEQ ID NO: 3265710 - DNA, 20 bp, Homo sapiens
caggcgtgactcagcagcct

SEQ ID NO: 3265711 - DNA, 23 bp, Homo sapiens
caggctaaacatccaatattttc

SEQ ID NO: 3265712 - DNA, 14 bp, Homo sapiens
caggctactctcct

SEQ ID NO: 3265713 - DNA, 15 bp, Homo sapiens
caggctactctcctc

SEQ ID NO: 3265714 - DNA, 23 bp, Homo sapiens
caggctagtccggacccacctca

SEQ ID NO: 3265715 - DNA, 19 bp, Homo sapiens
caggctatggttgccaccc

SEQ ID NO: 3265716 - DNA, 20 bp, Homo sapiens
caggctatggttgccacccc

SEQ ID NO: 3265717 - DNA, 20 bp, Homo sapiens
caggctatttgttcagagag

SEQ ID NO: 3265718 - DNA, 14 bp, Homo sapiens
caggctcactgcca

SEQ ID NO: 3265719 - DNA, 15 bp, Homo sapiens
caggctcactgccag

SEQ ID NO: 3265720 - DNA, 21 bp, Homo sapiens
caggctcactgccaggccagc

SEQ ID NO: 3265721 - DNA, 23 bp, Homo sapiens
caggctcactgccaggccagcct

SEQ ID NO: 3265722 - DNA, 16 bp, Homo sapiens
caggctccctttctct

SEQ ID NO: 3265723 - DNA, 20 bp, Homo sapiens
caggctccctttctcttctt

SEQ ID NO: 3265724 - DNA, 12 bp, Homo sapiens
caggctccgccc

SEQ ID NO: 3265725 - DNA, 16 bp, Homo sapiens
caggctccgcccttag

SEQ ID NO: 3265726 - DNA, 18 bp, Homo sapiens
caggctccgcccttagtc

SEQ ID NO: 3265727 - DNA, 19 bp, Homo sapiens
caggctcctttagcgccca

SEQ ID NO: 3265728 - DNA, 10 bp, Homo sapiens
cagcctgctg

SEQ ID NO: 3265729 - DNA, 20 bp, Homo sapiens
cagcctgctgagagccccca

SEQ ID NO: 3265730 - DNA, 22 bp, Homo sapiens
cagcctgctgagagcccccacc

SEQ ID NO: 3265731 - DNA, 15 bp, Homo sapiens
cagcctgctgcccag

SEQ ID NO: 3265732 - DNA, 13 bp, Homo sapiens
cagcctggacccc

SEQ ID NO: 3265733 - DNA, 18 bp, Homo sapiens
cagcctggacccccagct

SEQ ID NO: 3265734 - DNA, 10 bp, Homo sapiens
cagcctggca

SEQ ID NO: 3265735 - DNA, 21 bp, Homo sapiens
cagcctggcacagggcagtgg

SEQ ID NO: 3265736 - DNA, 19 bp, Homo sapiens
cagcctggcttctggagcc

SEQ ID NO: 3265737 - DNA, 20 bp, Homo sapiens
cagcctggcttctggagccc

SEQ ID NO: 3265738 - DNA, 21 bp, Homo sapiens
cagcctggcttctggagccct

SEQ ID NO: 3265739 - DNA, 20 bp, Homo sapiens
cagcctgggactcccagtga

SEQ ID NO: 3265740 - DNA, 21 bp, Homo sapiens
cagcctgggactcccagtgaa

SEQ ID NO: 3265741 - DNA, 16 bp, Homo sapiens
cagccccctccacacc

SEQ ID NO: 3265742 - DNA, 14 bp, Homo sapiens
cagccccctggatg

SEQ ID NO: 3265743 - DNA, 15 bp, Homo sapiens
cagccccctggatgg

SEQ ID NO: 3265744 - DNA, 16 bp, Homo sapiens
cagccccgcgcctcct

SEQ ID NO: 3265745 - DNA, 16 bp, Homo sapiens
cagccccgctcaggcc

SEQ ID NO: 3265746 - DNA, 22 bp, Homo sapiens
cagccccgctcaggcctaggag

SEQ ID NO: 3265747 - DNA, 16 bp, Homo sapiens
cagcccctagaaaccc

SEQ ID NO: 3265748 - DNA, 24 bp, Homo sapiens
cagcccctagaaacccaagctcct

SEQ ID NO: 3265749 - DNA, 13 bp, Homo sapiens
cagcccctaggag

SEQ ID NO: 3265750 - DNA, 13 bp, Homo sapiens
cagcccctctggt

SEQ ID NO: 3265751 - DNA, 18 bp, Homo sapiens
cagcccctctggtcgctc

SEQ ID NO: 3265752 - DNA, 11 bp, Homo sapiens
cagcccctgcc

SEQ ID NO: 3265753 - DNA, 20 bp, Homo sapiens
cagcccctgtatggcactgg

SEQ ID NO: 3265754 - DNA, 14 bp, Homo sapiens
cagcccctgtccca

SEQ ID NO: 3265755 - DNA, 18 bp, Homo sapiens
cagccccttctcccagca

SEQ ID NO: 3265756 - DNA, 18 bp, Homo sapiens
cagcccgacagtgccatc

SEQ ID NO: 3265757 - DNA, 17 bp, Homo sapiens
cagcccgcaactctcca

SEQ ID NO: 3265758 - DNA, 19 bp, Homo sapiens
cagcccgcaactctccagc

SEQ ID NO: 3265759 - DNA, 14 bp, Homo sapiens
cagcccgcacacct

SEQ ID NO: 3265760 - DNA, 14 bp, Homo sapiens
cagcccggcctgct

SEQ ID NO: 3265761 - DNA, 23 bp, Homo sapiens
cagcccggcggggaccttggtct

SEQ ID NO: 3265762 - DNA, 21 bp, Homo sapiens
cagcccgggagcctaggacca

SEQ ID NO: 3265763 - DNA, 19 bp, Homo sapiens
cagcccgtgaagcagtgcc

SEQ ID NO: 3265764 - DNA, 21 bp, Homo sapiens
cagcccgtgaagcagtgcctc

SEQ ID NO: 3265765 - DNA, 22 bp, Homo sapiens
cagcccgtgaagcagtgcctcg

SEQ ID NO: 3265766 - DNA, 18 bp, Homo sapiens
cagccctaaggatctctc

SEQ ID NO: 3265767 - DNA, 21 bp, Homo sapiens
cagccctaaggatctctcagg

SEQ ID NO: 3265768 - DNA, 14 bp, Homo sapiens
cagccctatggatg

SEQ ID NO: 3265769 - DNA, 20 bp, Homo sapiens
cagccctatggatgtggggt

SEQ ID NO: 3265770 - DNA, 19 bp, Homo sapiens
cagccctcaacaggcccag

SEQ ID NO: 3265771 - DNA, 17 bp, Homo sapiens
cagccctccgaccctca

SEQ ID NO: 3265772 - DNA, 16 bp, Homo sapiens
cagccctgcagcccaa

SEQ ID NO: 3265773 - DNA, 15 bp, Homo sapiens
cagccctgctgggga

SEQ ID NO: 3265774 - DNA, 23 bp, Homo sapiens
cagccctgctttgggctgccctg

SEQ ID NO: 3265775 - DNA, 20 bp, Homo sapiens
cagccctgggaaccactccc

SEQ ID NO: 3265776 - DNA, 12 bp, Homo sapiens
cagccctgggag

SEQ ID NO: 3265777 - DNA, 18 bp, Homo sapiens
cagccctgtcacgccggg

SEQ ID NO: 3265778 - DNA, 13 bp, Homo sapiens
cagccctgtcctg

SEQ ID NO: 3265779 - DNA, 16 bp, Homo sapiens
cagccctgtcctggtt

SEQ ID NO: 3265780 - DNA, 16 bp, Homo sapiens
cagcccttagcaggga

SEQ ID NO: 3265781 - DNA, 21 bp, Homo sapiens
cagcccttagcagggaaacag

SEQ ID NO: 3265782 - DNA, 23 bp, Homo sapiens
cagcccttatgcggttaattttg

SEQ ID NO: 3265783 - DNA, 17 bp, Homo sapiens
cagcccttcaggaagca

SEQ ID NO: 3265784 - DNA, 20 bp, Homo sapiens
cagcccttcctccctgtctc

SEQ ID NO: 3265785 - DNA, 22 bp, Homo sapiens
cagcccttcctccctgtctctg

SEQ ID NO: 3265786 - DNA, 15 bp, Homo sapiens
cagcccttcctctca

SEQ ID NO: 3265787 - DNA, 18 bp, Homo sapiens
cagcccttcctctcactc

SEQ ID NO: 3265788 - DNA, 23 bp, Homo sapiens
cagcccttcctctcactcctgcc

SEQ ID NO: 3265789 - DNA, 12 bp, Homo sapiens
cagcccttctgc

SEQ ID NO: 3265790 - DNA, 12 bp, Homo sapiens
cagcccttgccc

SEQ ID NO: 3265791 - DNA, 14 bp, Homo sapiens
cagcccttgcttgt

SEQ ID NO: 3265792 - DNA, 15 bp, Homo sapiens
cagcccttgcttgtt

SEQ ID NO: 3265793 - DNA, 13 bp, Homo sapiens
cagcccttgggca

SEQ ID NO: 3265794 - DNA, 14 bp, Homo sapiens
cagcccttgggcag

SEQ ID NO: 3265795 - DNA, 15 bp, Homo sapiens
cagcccttgggcagt

SEQ ID NO: 3265796 - DNA, 16 bp, Homo sapiens
cagccgaagctgcagg

SEQ ID NO: 3265797 - DNA, 14 bp, Homo sapiens
cagccgagccgggc

SEQ ID NO: 3265798 - DNA, 18 bp, Homo sapiens
cagccgagccgggcctgg

SEQ ID NO: 3265799 - DNA, 16 bp, Homo sapiens
cagccgcaaggatcct

SEQ ID NO: 3265800 - DNA, 19 bp, Homo sapiens
cagccgcagcctccctctg

SEQ ID NO: 3265801 - DNA, 13 bp, Homo sapiens
cagccgccctggg

SEQ ID NO: 3265802 - DNA, 15 bp, Homo sapiens
cagccgccctgggct

SEQ ID NO: 3265803 - DNA, 14 bp, Homo sapiens
cagccgccttcctt

SEQ ID NO: 3265804 - DNA, 15 bp, Homo sapiens
cagccgccttccttg

SEQ ID NO: 3265805 - DNA, 18 bp, Homo sapiens
cagccgccttccttgacc

SEQ ID NO: 3265806 - DNA, 22 bp, Homo sapiens
cagccgccttccttgaccttcc

SEQ ID NO: 3265807 - DNA, 23 bp, Homo sapiens
cagccgccttccttgaccttcct

SEQ ID NO: 3265808 - DNA, 14 bp, Homo sapiens
cagccgctaggaga

SEQ ID NO: 3265809 - DNA, 21 bp, Homo sapiens
cagccgctaggagagactgaa

SEQ ID NO: 3265810 - DNA, 21 bp, Homo sapiens
cagccgctcggaggccccaaa

SEQ ID NO: 3265811 - DNA, 23 bp, Homo sapiens
cagccgctcggaggccccaaagg

SEQ ID NO: 3265812 - DNA, 20 bp, Homo sapiens
cagccgctgcagggctccca

SEQ ID NO: 3265813 - DNA, 22 bp, Homo sapiens
cagccgctgcagggctcccatg

SEQ ID NO: 3265814 - DNA, 22 bp, Homo sapiens
cagccggcctctctggcctccc

SEQ ID NO: 3265815 - DNA, 15 bp, Homo sapiens
cagccggtgcctggc

SEQ ID NO: 3265816 - DNA, 19 bp, Homo sapiens
cagccgtcagccaaatgta

SEQ ID NO: 3265817 - DNA, 16 bp, Homo sapiens
cagccgtgatgctcag

SEQ ID NO: 3265818 - DNA, 9 bp, Homo sapiens
cagccgtgc

SEQ ID NO: 3265819 - DNA, 14 bp, Homo sapiens
cagccgtgccttca

SEQ ID NO: 3265820 - DNA, 18 bp, Homo sapiens
cagccgtgccttcagctc

SEQ ID NO: 3265821 - DNA, 11 bp, Homo sapiens
cagcctagccc

SEQ ID NO: 3265822 - DNA, 14 bp, Homo sapiens
cagcctatgggggc

SEQ ID NO: 3265823 - DNA, 17 bp, Homo sapiens
cagcctatgggggctct

SEQ ID NO: 3265824 - DNA, 18 bp, Homo sapiens
cagcctcaacctcctggg

SEQ ID NO: 3265825 - DNA, 16 bp, Homo sapiens
cagcctcacccttgcg

SEQ ID NO: 3265826 - DNA, 23 bp, Homo sapiens
cagcctcagagcatttaaggaaa

SEQ ID NO: 3265827 - DNA, 15 bp, Homo sapiens
cagcctcagtcctcc

SEQ ID NO: 3265828 - DNA, 22 bp, Homo sapiens
cagcctcagtcctcccctcaca

SEQ ID NO: 3265829 - DNA, 23 bp, Homo sapiens
cagcctcagtcctcccctcacag

SEQ ID NO: 3265830 - DNA, 20 bp, Homo sapiens
cagcctcattctgaggcctg

SEQ ID NO: 3265831 - DNA, 20 bp, Homo sapiens
cagcctccaacacaaggctc

SEQ ID NO: 3265832 - DNA, 14 bp, Homo sapiens
cagcctccagagcc

SEQ ID NO: 3265833 - DNA, 18 bp, Homo sapiens
cagcctccagagccagcc

SEQ ID NO: 3265834 - DNA, 15 bp, Homo sapiens
cagcctccagcctgc

SEQ ID NO: 3265835 - DNA, 15 bp, Homo sapiens
cagcctccatgctgc

SEQ ID NO: 3265836 - DNA, 18 bp, Homo sapiens
cagcctccatgctgcctc

SEQ ID NO: 3265837 - DNA, 22 bp, Homo sapiens
cagcctcccaaagtgctgagat

SEQ ID NO: 3265838 - DNA, 12 bp, Homo sapiens
cagcctcccaca

SEQ ID NO: 3265839 - DNA, 13 bp, Homo sapiens
cagcctcccacaa

SEQ ID NO: 3265840 - DNA, 20 bp, Homo sapiens
cagcctcccgagtagctggg

SEQ ID NO: 3265841 - DNA, 17 bp, Homo sapiens
cagcctccgagagggag

SEQ ID NO: 3265842 - DNA, 19 bp, Homo sapiens
cagcctccgagagggagag

SEQ ID NO: 3265843 - DNA, 18 bp, Homo sapiens
cagcctcgttggaagagg

SEQ ID NO: 3265844 - DNA, 23 bp, Homo sapiens
cagcctctccaggcaccatctcc

SEQ ID NO: 3265845 - DNA, 16 bp, Homo sapiens
cagcctctccccaggt

SEQ ID NO: 3265846 - DNA, 23 bp, Homo sapiens
cagcctctccccaggtccagctc

SEQ ID NO: 3265847 - DNA, 13 bp, Homo sapiens
cagcctctcccgg

SEQ ID NO: 3265848 - DNA, 20 bp, Homo sapiens
cagcctctcccggctgcctg

SEQ ID NO: 3265849 - DNA, 21 bp, Homo sapiens
cagcctctcccggctgcctgc

SEQ ID NO: 3265850 - DNA, 22 bp, Homo sapiens
cagcctctcccggctgcctgcc

SEQ ID NO: 3265851 - DNA, 23 bp, Homo sapiens
cagcctctgacccctcctcactg

SEQ ID NO: 3265852 - DNA, 23 bp, Homo sapiens
cagcctctgcactcccacgcctg

SEQ ID NO: 3265853 - DNA, 14 bp, Homo sapiens
cagcctctggctcc

SEQ ID NO: 3265854 - DNA, 15 bp, Homo sapiens
cagcctctggctcca

SEQ ID NO: 3265855 - DNA, 20 bp, Homo sapiens
cagcctctggctccacacct

SEQ ID NO: 3265856 - DNA, 13 bp, Homo sapiens
cagcctcttactt

SEQ ID NO: 3265857 - DNA, 19 bp, Homo sapiens
cagcctgacctgagactgt

SEQ ID NO: 3265858 - DNA, 16 bp, Homo sapiens
cagcctgagcaactct

SEQ ID NO: 3265859 - DNA, 20 bp, Homo sapiens
cagcctgagcaactcttgat

SEQ ID NO: 3265860 - DNA, 15 bp, Homo sapiens
cagcctgaggctgag

SEQ ID NO: 3265861 - DNA, 16 bp, Homo sapiens
cagcctgagtctcctg

SEQ ID NO: 3265862 - DNA, 17 bp, Homo sapiens
cagcctgagtctcctgt

SEQ ID NO: 3265863 - DNA, 22 bp, Homo sapiens
cagcctgagtctcctgtgccca

SEQ ID NO: 3265864 - DNA, 11 bp, Homo sapiens
cagcctgattg

SEQ ID NO: 3265865 - DNA, 15 bp, Homo sapiens
cagcctgattgaaaa

SEQ ID NO: 3265866 - DNA, 14 bp, Homo sapiens
cagcctgccctcca

SEQ ID NO: 3265867 - DNA, 15 bp, Homo sapiens
cagcctgcctggcag

SEQ ID NO: 3265868 - DNA, 21 bp, Homo sapiens
cagcctgcgctcggcaggaag

SEQ ID NO: 3265869 - DNA, 22 bp, Homo sapiens
cagcctgcgctcggcaggaagg

SEQ ID NO: 3265870 - DNA, 21 bp, Homo sapiens
cacttattccctcatcctttc

SEQ ID NO: 3265871 - DNA, 22 bp, Homo sapiens
cacttattggaactctgcttga

SEQ ID NO: 3265872 - DNA, 19 bp, Homo sapiens
cacttatttcactatcttc

SEQ ID NO: 3265873 - DNA, 14 bp, Homo sapiens
cacttatttcataa

SEQ ID NO: 3265874 - DNA, 17 bp, Homo sapiens
cacttcaaggtgacaga

SEQ ID NO: 3265875 - DNA, 14 bp, Homo sapiens
cacttcaccctgga

SEQ ID NO: 3265876 - DNA, 17 bp, Homo sapiens
cacttcacgcccttggc

SEQ ID NO: 3265877 - DNA, 20 bp, Homo sapiens
cacttcacgcccttggccat

SEQ ID NO: 3265878 - DNA, 21 bp, Homo sapiens
cacttcacgcccttggccatg

SEQ ID NO: 3265879 - DNA, 16 bp, Homo sapiens
cacttcagaattccat

SEQ ID NO: 3265880 - DNA, 13 bp, Homo sapiens
cacttcagagagc

SEQ ID NO: 3265881 - DNA, 16 bp, Homo sapiens
cacttcagagagctgg

SEQ ID NO: 3265882 - DNA, 18 bp, Homo sapiens
cacttcagagagctggta

SEQ ID NO: 3265883 - DNA, 15 bp, Homo sapiens
cacttcaggctcttc

SEQ ID NO: 3265884 - DNA, 16 bp, Homo sapiens
cacttcaggctcttct

SEQ ID NO: 3265885 - DNA, 14 bp, Homo sapiens
cacttcataatcca

SEQ ID NO: 3265886 - DNA, 17 bp, Homo sapiens
cacttccaggggaacct

SEQ ID NO: 3265887 - DNA, 20 bp, Homo sapiens
cacttcccctccaagaccct

SEQ ID NO: 3265888 - DNA, 16 bp, Homo sapiens
cacttcccgtctcaga

SEQ ID NO: 3265889 - DNA, 18 bp, Homo sapiens
cacttcccgtctcagaat

SEQ ID NO: 3265890 - DNA, 19 bp, Homo sapiens
cacttcctgctacaggagg

SEQ ID NO: 3265891 - DNA, 20 bp, Homo sapiens
cacttcctgctacaggaggg

SEQ ID NO: 3265892 - DNA, 15 bp, Homo sapiens
cacttcctttgtgtt

SEQ ID NO: 3265893 - DNA, 18 bp, Homo sapiens
cacttcctttgtgtttat

SEQ ID NO: 3265894 - DNA, 19 bp, Homo sapiens
cacttcctttgtgtttata

SEQ ID NO: 3265895 - DNA, 21 bp, Homo sapiens
cacttcctttgtgtttatatg

SEQ ID NO: 3265896 - DNA, 21 bp, Homo sapiens
cacttcggccaggtcacacga

SEQ ID NO: 3265897 - DNA, 23 bp, Homo sapiens
cacttcgggctgtgtaaacacag

SEQ ID NO: 3265898 - DNA, 13 bp, Homo sapiens
cacttctatgcaa

SEQ ID NO: 3265899 - DNA, 20 bp, Homo sapiens
cacttctgtgagacccccac

SEQ ID NO: 3265900 - DNA, 21 bp, Homo sapiens
cacttcttaaaggcctggaac

SEQ ID NO: 3265901 - DNA, 13 bp, Homo sapiens
cacttcttccttt

SEQ ID NO: 3265902 - DNA, 15 bp, Homo sapiens
cacttcttcctttct

SEQ ID NO: 3265903 - DNA, 19 bp, Homo sapiens
cacttcttcctttctcttt

SEQ ID NO: 3265904 - DNA, 15 bp, Homo sapiens
cacttcttttgaaca

SEQ ID NO: 3265905 - DNA, 19 bp, Homo sapiens
cacttgaaagattttattg

SEQ ID NO: 3265906 - DNA, 22 bp, Homo sapiens
cacttgacaccaaccagacagc

SEQ ID NO: 3265907 - DNA, 21 bp, Homo sapiens
cacttgagaaccagtctcctc

SEQ ID NO: 3265908 - DNA, 22 bp, Homo sapiens
cacttgagaaccagtctcctca

SEQ ID NO: 3265909 - DNA, 23 bp, Homo sapiens
cacttgagaaccagtctcctcac

SEQ ID NO: 3265910 - DNA, 19 bp, Homo sapiens
cacttgatgacccccaacc

SEQ ID NO: 3265911 - DNA, 19 bp, Homo sapiens
cacttgcagactctacaga

SEQ ID NO: 3265912 - DNA, 22 bp, Homo sapiens
cacttgcagactctacagaggc

SEQ ID NO: 3265913 - DNA, 24 bp, Homo sapiens
cacttgcagactctacagaggcca

SEQ ID NO: 3265914 - DNA, 12 bp, Homo sapiens
cacttgcatttc

SEQ ID NO: 3265915 - DNA, 12 bp, Homo sapiens
cacttgcctctt

SEQ ID NO: 3265916 - DNA, 17 bp, Homo sapiens
cacttgcctcttccttg

SEQ ID NO: 3265917 - DNA, 21 bp, Homo sapiens
cacttgcctcttccttgaaga

SEQ ID NO: 3265918 - DNA, 17 bp, Homo sapiens
cacttgcgtcctgcaga

SEQ ID NO: 3265919 - DNA, 14 bp, Homo sapiens
cacttgctggggct

SEQ ID NO: 3265920 - DNA, 12 bp, Homo sapiens
cacttggagccc

SEQ ID NO: 3265921 - DNA, 17 bp, Homo sapiens
cacttggcctcagctgg

SEQ ID NO: 3265922 - DNA, 19 bp, Homo sapiens
cacttggcctcagctggct

SEQ ID NO: 3265923 - DNA, 17 bp, Homo sapiens
cacttggcctcatgctg

SEQ ID NO: 3265924 - DNA, 20 bp, Homo sapiens
cacttgggggttcaggcccg

SEQ ID NO: 3265925 - DNA, 17 bp, Homo sapiens
cacttggtctgtgagat

SEQ ID NO: 3265926 - DNA, 20 bp, Homo sapiens
cacttggtctgtgagatgct

SEQ ID NO: 3265927 - DNA, 17 bp, Homo sapiens
cacttggttagacgcct

SEQ ID NO: 3265928 - DNA, 17 bp, Homo sapiens
cagaattgaagaaaatc

SEQ ID NO: 3265929 - DNA, 17 bp, Homo sapiens
cagaatttatctccctt

SEQ ID NO: 3265930 - DNA, 22 bp, Homo sapiens
cagaatttggaaatcctagttt

SEQ ID NO: 3265931 - DNA, 23 bp, Homo sapiens
cagaattttaatgtgaagacatt

SEQ ID NO: 3265932 - DNA, 17 bp, Homo sapiens
cagaatttttccctcca

SEQ ID NO: 3265933 - DNA, 22 bp, Homo sapiens
cagacaacaccttcctcctgca

SEQ ID NO: 3265934 - DNA, 17 bp, Homo sapiens
cagacaacagcccaggc

SEQ ID NO: 3265935 - DNA, 13 bp, Homo sapiens
cagacaaccaaaa

SEQ ID NO: 3265936 - DNA, 20 bp, Homo sapiens
cagacaagcactattttata

SEQ ID NO: 3265937 - DNA, 20 bp, Homo sapiens
cagacaagcagcccttgctt

SEQ ID NO: 3265938 - DNA, 12 bp, Homo sapiens
cagacaaggagg

SEQ ID NO: 3265939 - DNA, 13 bp, Homo sapiens
cagacaaggagga

SEQ ID NO: 3265940 - DNA, 20 bp, Homo sapiens
cagacacaacccaataggag

SEQ ID NO: 3265941 - DNA, 11 bp, Homo sapiens
cagacacacac

SEQ ID NO: 3265942 - DNA, 12 bp, Homo sapiens
cagacacacaca

SEQ ID NO: 3265943 - DNA, 15 bp, Homo sapiens
cagacacacacacgc

SEQ ID NO: 3265944 - DNA, 16 bp, Homo sapiens
cagacacacacacgca

SEQ ID NO: 3265945 - DNA, 18 bp, Homo sapiens
cagacacacacacgcacg

SEQ ID NO: 3265946 - DNA, 22 bp, Homo sapiens
cagacacacacacgcacgcaca

SEQ ID NO: 3265947 - DNA, 15 bp, Homo sapiens
cagacacaggcccgg

SEQ ID NO: 3265948 - DNA, 17 bp, Homo sapiens
cagacacaggcccggct

SEQ ID NO: 3265949 - DNA, 22 bp, Homo sapiens
cagacacaggcccggctccagg

SEQ ID NO: 3265950 - DNA, 23 bp, Homo sapiens
cagacaccgtttgtcccccgggg

SEQ ID NO: 3265951 - DNA, 19 bp, Homo sapiens
cagacacctgttcacagaa

SEQ ID NO: 3265952 - DNA, 20 bp, Homo sapiens
cagacaccttgacagggcac

SEQ ID NO: 3265953 - DNA, 22 bp, Homo sapiens
cagacaccttgacagggcacac

SEQ ID NO: 3265954 - DNA, 18 bp, Homo sapiens
cagacacgccttcccctc

SEQ ID NO: 3265955 - DNA, 23 bp, Homo sapiens
cagacacgctcgcgggcagcggg

SEQ ID NO: 3265956 - DNA, 12 bp, Homo sapiens
cagacactaagt

SEQ ID NO: 3265957 - DNA, 18 bp, Homo sapiens
cagacactaagttatagt

SEQ ID NO: 3265958 - DNA, 18 bp, Homo sapiens
cagacacttaactcaatt

SEQ ID NO: 3265959 - DNA, 15 bp, Homo sapiens
cagacagacacacac

SEQ ID NO: 3265960 - DNA, 16 bp, Homo sapiens
cagacagacacacaca

SEQ ID NO: 3265961 - DNA, 13 bp, Homo sapiens
cagacagagggga

SEQ ID NO: 3265962 - DNA, 22 bp, Homo sapiens
cagacagatgtcagcttcccag

SEQ ID NO: 3265963 - DNA, 16 bp, Homo sapiens
cagacagcaggcagcg

SEQ ID NO: 3265964 - DNA, 17 bp, Homo sapiens
cagacagcaggcagcgc

SEQ ID NO: 3265965 - DNA, 18 bp, Homo sapiens
cagacaggcaagcacctc

SEQ ID NO: 3265966 - DNA, 21 bp, Homo sapiens
cagacaggcaagcacctcctg

SEQ ID NO: 3265967 - DNA, 15 bp, Homo sapiens
cagacagggtctgaa

SEQ ID NO: 3265968 - DNA, 16 bp, Homo sapiens
cagacaggtccctccc

SEQ ID NO: 3265969 - DNA, 15 bp, Homo sapiens
cagacataaagccat

SEQ ID NO: 3265970 - DNA, 22 bp, Homo sapiens
cagacataaagccatgtttcct

SEQ ID NO: 3265971 - DNA, 19 bp, Homo sapiens
cagacatacgaaacacaaa

SEQ ID NO: 3265972 - DNA, 15 bp, Homo sapiens
cagacatcatgaatt

SEQ ID NO: 3265973 - DNA, 22 bp, Homo sapiens
cagacatccatgtttgtaaaac

SEQ ID NO: 3265974 - DNA, 18 bp, Homo sapiens
cagacatgttttccgtga

SEQ ID NO: 3265975 - DNA, 17 bp, Homo sapiens
cagaccaccagccgccc

SEQ ID NO: 3265976 - DNA, 21 bp, Homo sapiens
cagaccaccagccgccccagc

SEQ ID NO: 3265977 - DNA, 23 bp, Homo sapiens
cagaccaccagccgccccagccc

SEQ ID NO: 3265978 - DNA, 15 bp, Homo sapiens
cagaccaccccgcct

SEQ ID NO: 3265979 - DNA, 19 bp, Homo sapiens
cagaccaccccgcctgccc

SEQ ID NO: 3265980 - DNA, 18 bp, Homo sapiens
cagaccacttgccacgct

SEQ ID NO: 3265981 - DNA, 17 bp, Homo sapiens
cagaccagagctgtctg

SEQ ID NO: 3265982 - DNA, 22 bp, Homo sapiens
cagaccagagctgtctgaactc

SEQ ID NO: 3265983 - DNA, 17 bp, Homo sapiens
cagaccagtgaccccag

SEQ ID NO: 3265984 - DNA, 14 bp, Homo sapiens
cagaccatgaagta

SEQ ID NO: 3265985 - DNA, 12 bp, Homo sapiens
cagacccaggtc

SEQ ID NO: 3265986 - DNA, 15 bp, Homo sapiens
cagacccaggtcttc

SEQ ID NO: 3265987 - DNA, 18 bp, Homo sapiens
cagacccaggtcttccag

SEQ ID NO: 3265988 - DNA, 19 bp, Homo sapiens
cagacccaggtcttccaga

SEQ ID NO: 3265989 - DNA, 13 bp, Homo sapiens
cagaccccaggct

SEQ ID NO: 3265990 - DNA, 18 bp, Homo sapiens
cagacccctcccctcgtg

SEQ ID NO: 3265991 - DNA, 16 bp, Homo sapiens
cagacccctctggcca

SEQ ID NO: 3265992 - DNA, 20 bp, Homo sapiens
cagacccctctggccaggat

SEQ ID NO: 3265993 - DNA, 13 bp, Homo sapiens
cagacccctggct

SEQ ID NO: 3265994 - DNA, 15 bp, Homo sapiens
cagacccctggcttt

SEQ ID NO: 3265995 - DNA, 22 bp, Homo sapiens
cagacccctggcttttcactgc

SEQ ID NO: 3265996 - DNA, 19 bp, Homo sapiens
cagacccctgggagcttcc

SEQ ID NO: 3265997 - DNA, 18 bp, Homo sapiens
cagacctccccagcccct

SEQ ID NO: 3265998 - DNA, 22 bp, Homo sapiens
cagacctccccagcccctagcc

SEQ ID NO: 3265999 - DNA, 20 bp, Homo sapiens
cagacctgctttttgaaatg

SEQ ID NO: 3266000 - DNA, 21 bp, Homo sapiens
cagacctgctttttgaaatga

SEQ ID NO: 3266001 - DNA, 15 bp, Homo sapiens
cagacctggagcccc

SEQ ID NO: 3266002 - DNA, 16 bp, Homo sapiens
cagacctggagcccct

SEQ ID NO: 3266003 - DNA, 19 bp, Homo sapiens
cagacctggagcccctggg

SEQ ID NO: 3266004 - DNA, 21 bp, Homo sapiens
cagacctggagcccctgggtg

SEQ ID NO: 3266005 - DNA, 19 bp, Homo sapiens
cagacctgtcttccaagga

SEQ ID NO: 3266006 - DNA, 12 bp, Homo sapiens
cagacggcggcc

SEQ ID NO: 3266007 - DNA, 16 bp, Homo sapiens
cagacggcggccaggc

SEQ ID NO: 3266008 - DNA, 18 bp, Homo sapiens
cagacggcggccaggcac

SEQ ID NO: 3266009 - DNA, 19 bp, Homo sapiens
cagacggcggccaggcaca

SEQ ID NO: 3266010 - DNA, 23 bp, Homo sapiens
cagacggcggccaggcacagggc

SEQ ID NO: 3266011 - DNA, 21 bp, Homo sapiens
cagacgtggtggctcacacct

SEQ ID NO: 3266012 - DNA, 14 bp, Homo sapiens
cagactccgccctc

SEQ ID NO: 3266013 - DNA, 16 bp, Homo sapiens
cagactccgccctcct

SEQ ID NO: 3266014 - DNA, 18 bp, Homo sapiens
cagactccgccctcctcg

SEQ ID NO: 3266015 - DNA, 14 bp, Homo sapiens
cagactcctcagat

SEQ ID NO: 3266016 - DNA, 17 bp, Homo sapiens
cagactctacagaggcc

SEQ ID NO: 3266017 - DNA, 19 bp, Homo sapiens
cagactctacagaggccat

SEQ ID NO: 3266018 - DNA, 20 bp, Homo sapiens
cagactctacagaggccatg

SEQ ID NO: 3266019 - DNA, 18 bp, Homo sapiens
cagactctaggttataca

SEQ ID NO: 3266020 - DNA, 15 bp, Homo sapiens
cagactctcagccca

SEQ ID NO: 3266021 - DNA, 18 bp, Homo sapiens
cagactctcagcccagaa

SEQ ID NO: 3266022 - DNA, 21 bp, Homo sapiens
cagactctcagcccagaagaa

SEQ ID NO: 3266023 - DNA, 18 bp, Homo sapiens
cagactctgagctgctca

SEQ ID NO: 3266024 - DNA, 21 bp, Homo sapiens
cagactctgagctgctcaccg

SEQ ID NO: 3266025 - DNA, 23 bp, Homo sapiens
cagactctttaataaattgctta

SEQ ID NO: 3266026 - DNA, 16 bp, Homo sapiens
cagactgctgggactg

SEQ ID NO: 3266027 - DNA, 12 bp, Homo sapiens
cagactggaaga

SEQ ID NO: 3266028 - DNA, 21 bp, Homo sapiens
cagactggaagacacttcaga

SEQ ID NO: 3266029 - DNA, 22 bp, Homo sapiens
cagactggaagacacttcagat

SEQ ID NO: 3266030 - DNA, 18 bp, Homo sapiens
cagactggaagcacagct

SEQ ID NO: 3266031 - DNA, 16 bp, Homo sapiens
cagactggcaataaac

SEQ ID NO: 3266032 - DNA, 18 bp, Homo sapiens
cagactggcaataaactc

SEQ ID NO: 3266033 - DNA, 15 bp, Homo sapiens
cagactggccgggca

SEQ ID NO: 3266034 - DNA, 16 bp, Homo sapiens
cagactggccgggcag

SEQ ID NO: 3266035 - DNA, 17 bp, Homo sapiens
cagactggccgggcagg

SEQ ID NO: 3266036 - DNA, 19 bp, Homo sapiens
cagactggccgggcaggcg

SEQ ID NO: 3266037 - DNA, 16 bp, Homo sapiens
cagactggggcatcct

SEQ ID NO: 3266038 - DNA, 18 bp, Homo sapiens
cagactggggcatcctgt

SEQ ID NO: 3266039 - DNA, 23 bp, Homo sapiens
cagactgtaagatgttgttttag

SEQ ID NO: 3266040 - DNA, 21 bp, Homo sapiens
cagactgtgaacttgactggg

SEQ ID NO: 3266041 - DNA, 16 bp, Homo sapiens
cagactgttaattata

SEQ ID NO: 3266042 - DNA, 14 bp, Homo sapiens
cagactgttttact

SEQ ID NO: 3266043 - DNA, 14 bp, Homo sapiens
cagacttcccagct

SEQ ID NO: 3266044 - DNA, 15 bp, Homo sapiens
cagacttcccagcta

SEQ ID NO: 3266045 - DNA, 15 bp, Homo sapiens
cagacttctggaagg

SEQ ID NO: 3266046 - DNA, 19 bp, Homo sapiens
cagacttctggaaggctgg

SEQ ID NO: 3266047 - DNA, 20 bp, Homo sapiens
cagacttctggaaggctggc

SEQ ID NO: 3266048 - DNA, 15 bp, Homo sapiens
cagactttagtgccc

SEQ ID NO: 3266049 - DNA, 19 bp, Homo sapiens
cagactttagtgccctgcc

SEQ ID NO: 3266050 - DNA, 23 bp, Homo sapiens
cagactttagtgccctgccccct

SEQ ID NO: 3266051 - DNA, 20 bp, Homo sapiens
cagactttgcttcccattgt

SEQ ID NO: 3266052 - DNA, 21 bp, Homo sapiens
cagagaaaatgaattttttcc

SEQ ID NO: 3266053 - DNA, 17 bp, Homo sapiens
cagagaagcatcctcca

SEQ ID NO: 3266054 - DNA, 21 bp, Homo sapiens
cagagaagcatcctccacatc

SEQ ID NO: 3266055 - DNA, 14 bp, Homo sapiens
cagagaagctggac

SEQ ID NO: 3266056 - DNA, 15 bp, Homo sapiens
cagagaagctggact

SEQ ID NO: 3266057 - DNA, 22 bp, Homo sapiens
cagagaagctggacttctgtgg

SEQ ID NO: 3266058 - DNA, 14 bp, Homo sapiens
cagagaaggaaaag

SEQ ID NO: 3266059 - DNA, 15 bp, Homo sapiens
cagagaaggcagcag

SEQ ID NO: 3266060 - DNA, 14 bp, Homo sapiens
cagagaaggcctct

SEQ ID NO: 3266061 - DNA, 15 bp, Homo sapiens
cagagaaggcctctt

SEQ ID NO: 3266062 - DNA, 21 bp, Homo sapiens
cagagaaggcctcttgtgctc

SEQ ID NO: 3266063 - DNA, 14 bp, Homo sapiens
cagagaagggaaga

SEQ ID NO: 3266064 - DNA, 11 bp, Homo sapiens
cagagaagttc

SEQ ID NO: 3266065 - DNA, 22 bp, Homo sapiens
cagagaagttctcaaagttaat

SEQ ID NO: 3266066 - DNA, 18 bp, Homo sapiens
cagagaagtttgtagcca

SEQ ID NO: 3266067 - DNA, 11 bp, Homo sapiens
cagagaatata

SEQ ID NO: 3266068 - DNA, 19 bp, Homo sapiens
cagagaatgaaagggccca

SEQ ID NO: 3266069 - DNA, 20 bp, Homo sapiens
cagagaatgaaagggcccag

SEQ ID NO: 3266070 - DNA, 21 bp, Homo sapiens
cagagaatgaaagggcccaga

SEQ ID NO: 3266071 - DNA, 18 bp, Homo sapiens
cagagaatggctgggtca

SEQ ID NO: 3266072 - DNA, 19 bp, Homo sapiens
cagagaatggctgggtcag

SEQ ID NO: 3266073 - DNA, 14 bp, Homo sapiens
cagagaattcttag

SEQ ID NO: 3266074 - DNA, 20 bp, Homo sapiens
cagagacaaaatatttccca

SEQ ID NO: 3266075 - DNA, 14 bp, Homo sapiens
cagagacaacaggt

SEQ ID NO: 3266076 - DNA, 15 bp, Homo sapiens
cagagacaagtaatt

SEQ ID NO: 3266077 - DNA, 21 bp, Homo sapiens
cagagacagctgatacttcat

SEQ ID NO: 3266078 - DNA, 19 bp, Homo sapiens
cagagacaggcccaagaga

SEQ ID NO: 3266079 - DNA, 16 bp, Homo sapiens
cagagaccgtcctcac

SEQ ID NO: 3266080 - DNA, 17 bp, Homo sapiens
cagagaccgtcctcacc

SEQ ID NO: 3266081 - DNA, 19 bp, Homo sapiens
cagagaccgtcctcacccc

SEQ ID NO: 3266082 - DNA, 12 bp, Homo sapiens
cagagacctcca

SEQ ID NO: 3266083 - DNA, 15 bp, Homo sapiens
cagagacctccaata

SEQ ID NO: 3266084 - DNA, 12 bp, Homo sapiens
cagagactcaga

SEQ ID NO: 3266085 - DNA, 21 bp, Homo sapiens
cagagactcagcgctcctcct

SEQ ID NO: 3266086 - DNA, 22 bp, Homo sapiens
cagagactcagcgctcctcctg

SEQ ID NO: 3266087 - DNA, 21 bp, Homo sapiens
cagagactgtccctgaaacct

SEQ ID NO: 3266088 - DNA, 11 bp, Homo sapiens
cagagagacag

SEQ ID NO: 3266089 - DNA, 15 bp, Homo sapiens
cagagagacagactt

SEQ ID NO: 3266090 - DNA, 22 bp, Homo sapiens
cagagagacagacttgagaact

SEQ ID NO: 3266091 - DNA, 12 bp, Homo sapiens
cagagagagggg

SEQ ID NO: 3266092 - DNA, 20 bp, Homo sapiens
cagagagcaactctgagatc

SEQ ID NO: 3266093 - DNA, 15 bp, Homo sapiens
cagagagcaaggcat

SEQ ID NO: 3266094 - DNA, 20 bp, Homo sapiens
cagagagccattttgtgaat

SEQ ID NO: 3266095 - DNA, 21 bp, Homo sapiens
cagagagccattttgtgaatg

SEQ ID NO: 3266096 - DNA, 23 bp, Homo sapiens
cagagagccattttgtgaatgga

SEQ ID NO: 3266097 - DNA, 19 bp, Homo sapiens
cagagagcctggtgctgct

SEQ ID NO: 3266098 - DNA, 20 bp, Homo sapiens
cagagagcctggtgctgctg

SEQ ID NO: 3266099 - DNA, 16 bp, Homo sapiens
cagagaggagaaacac

SEQ ID NO: 3266100 - DNA, 18 bp, Homo sapiens
cagagaggagaaacacat

SEQ ID NO: 3266101 - DNA, 12 bp, Homo sapiens
cagagaggagca

SEQ ID NO: 3266102 - DNA, 14 bp, Homo sapiens
cagagaggagcacc

SEQ ID NO: 3266103 - DNA, 13 bp, Homo sapiens
cagagaggccttt

SEQ ID NO: 3266104 - DNA, 14 bp, Homo sapiens
cagagagggcccag

SEQ ID NO: 3266105 - DNA, 15 bp, Homo sapiens
cagagagggcccagc

SEQ ID NO: 3266106 - DNA, 17 bp, Homo sapiens
cagagagggcccagctg

SEQ ID NO: 3266107 - DNA, 18 bp, Homo sapiens
cagagagggcccagctgt

SEQ ID NO: 3266108 - DNA, 20 bp, Homo sapiens
cagagagggcccagctgtag

SEQ ID NO: 3266109 - DNA, 23 bp, Homo sapiens
cagagagggcccagctgtagcca

SEQ ID NO: 3266110 - DNA, 17 bp, Homo sapiens
cagagaggggctgctct

SEQ ID NO: 3266111 - DNA, 20 bp, Homo sapiens
cagagagtcccactgcctca

SEQ ID NO: 3266112 - DNA, 20 bp, Homo sapiens
cagagataaaccaataaatc

SEQ ID NO: 3266113 - DNA, 14 bp, Homo sapiens
cagagatgccagcc

SEQ ID NO: 3266114 - DNA, 18 bp, Homo sapiens
cagagatgccagcccttc

SEQ ID NO: 3266115 - DNA, 17 bp, Homo sapiens
cagagattgaactccaa

SEQ ID NO: 3266116 - DNA, 20 bp, Homo sapiens
cagagatttctcattgactt

SEQ ID NO: 3266117 - DNA, 19 bp, Homo sapiens
cagagcaaatgagggaggg

SEQ ID NO: 3266118 - DNA, 20 bp, Homo sapiens
cagagcaagactctgtctca

SEQ ID NO: 3266119 - DNA, 13 bp, Homo sapiens
cagagcaccccct

SEQ ID NO: 3266120 - DNA, 19 bp, Homo sapiens
cagagcaccccctgctcca

SEQ ID NO: 3266121 - DNA, 14 bp, Homo sapiens
cagagcacctcacc

SEQ ID NO: 3266122 - DNA, 23 bp, Homo sapiens
cagagcacctttgcacaggatgc

SEQ ID NO: 3266123 - DNA, 22 bp, Homo sapiens
cagagcactaggttcaattccc

SEQ ID NO: 3266124 - DNA, 22 bp, Homo sapiens
cagagcactttagcagatgtgg

SEQ ID NO: 3266125 - DNA, 19 bp, Homo sapiens
cagaaacccggcttcctgt

SEQ ID NO: 3266126 - DNA, 22 bp, Homo sapiens
cagaaacccggcttcctgtgct

SEQ ID NO: 3266127 - DNA, 17 bp, Homo sapiens
cagaaaccctggtctcc

SEQ ID NO: 3266128 - DNA, 21 bp, Homo sapiens
cagaaacctatcctcactgcc

SEQ ID NO: 3266129 - DNA, 20 bp, Homo sapiens
cagaaacgtgttaaaggttt

SEQ ID NO: 3266130 - DNA, 12 bp, Homo sapiens
cagaaactagaa

SEQ ID NO: 3266131 - DNA, 17 bp, Homo sapiens
cagaaactcccctgggg

SEQ ID NO: 3266132 - DNA, 12 bp, Homo sapiens
cagaaactgatg

SEQ ID NO: 3266133 - DNA, 15 bp, Homo sapiens
cagaaagaggtctcc

SEQ ID NO: 3266134 - DNA, 19 bp, Homo sapiens
cagaaagatggatgtgctt

SEQ ID NO: 3266135 - DNA, 15 bp, Homo sapiens
cagaaaggaaaacct

SEQ ID NO: 3266136 - DNA, 12 bp, Homo sapiens
cagaaaggagac

SEQ ID NO: 3266137 - DNA, 20 bp, Homo sapiens
cagaaaggatatttaagaaa

SEQ ID NO: 3266138 - DNA, 22 bp, Homo sapiens
cagaaaggatatttaagaaaat

SEQ ID NO: 3266139 - DNA, 21 bp, Homo sapiens
cagaaagtcattccttctttt

SEQ ID NO: 3266140 - DNA, 12 bp, Homo sapiens
cagaaagtgcct

SEQ ID NO: 3266141 - DNA, 16 bp, Homo sapiens
cagaaagtgcctgaca

SEQ ID NO: 3266142 - DNA, 20 bp, Homo sapiens
cagaaatagacaaaaagtat

SEQ ID NO: 3266143 - DNA, 17 bp, Homo sapiens
cagaaatatatatacat

SEQ ID NO: 3266144 - DNA, 18 bp, Homo sapiens
cagaaatcagaggagaga

SEQ ID NO: 3266145 - DNA, 20 bp, Homo sapiens
cagaaatcagtaatatttat

SEQ ID NO: 3266146 - DNA, 17 bp, Homo sapiens
cagaaatggaaagcaga

SEQ ID NO: 3266147 - DNA, 23 bp, Homo sapiens
cagaaattagaaaccttaatatg

SEQ ID NO: 3266148 - DNA, 14 bp, Homo sapiens
cagaaatttttatt

SEQ ID NO: 3266149 - DNA, 14 bp, Homo sapiens
cagaacaaaaagaa

SEQ ID NO: 3266150 - DNA, 13 bp, Homo sapiens
cagaacacacaga

SEQ ID NO: 3266151 - DNA, 14 bp, Homo sapiens
cagaacagcagagg

SEQ ID NO: 3266152 - DNA, 12 bp, Homo sapiens
cagaacagcttc

SEQ ID NO: 3266153 - DNA, 19 bp, Homo sapiens
cagaacagcttcaggttat

SEQ ID NO: 3266154 - DNA, 13 bp, Homo sapiens
cagaacagggtca

SEQ ID NO: 3266155 - DNA, 15 bp, Homo sapiens
cagaacatcattaga

SEQ ID NO: 3266156 - DNA, 18 bp, Homo sapiens
cagaacatcattagaaca

SEQ ID NO: 3266157 - DNA, 14 bp, Homo sapiens
cagaacatgttaag

SEQ ID NO: 3266158 - DNA, 21 bp, Homo sapiens
cagaacattcagctctggaga

SEQ ID NO: 3266159 - DNA, 16 bp, Homo sapiens
cagaaccacacttgaa

SEQ ID NO: 3266160 - DNA, 13 bp, Homo sapiens
cagaacccagggc

SEQ ID NO: 3266161 - DNA, 19 bp, Homo sapiens
cagaacctactgttccttt

SEQ ID NO: 3266162 - DNA, 12 bp, Homo sapiens
cagaacctcttc

SEQ ID NO: 3266163 - DNA, 14 bp, Homo sapiens
cagaacctcttccc

SEQ ID NO: 3266164 - DNA, 15 bp, Homo sapiens
cagaacctcttcccc

SEQ ID NO: 3266165 - DNA, 16 bp, Homo sapiens
cagaacctcttcccca

SEQ ID NO: 3266166 - DNA, 17 bp, Homo sapiens
cagaaccttcaacccag

SEQ ID NO: 3266167 - DNA, 20 bp, Homo sapiens
cagaaccttcaacccagtgg

SEQ ID NO: 3266168 - DNA, 21 bp, Homo sapiens
cagaacggagccccaggcctc

SEQ ID NO: 3266169 - DNA, 15 bp, Homo sapiens
cagaactgaaataaa

SEQ ID NO: 3266170 - DNA, 19 bp, Homo sapiens
cagaactgccattattttc

SEQ ID NO: 3266171 - DNA, 13 bp, Homo sapiens
cagaactgccccc

SEQ ID NO: 3266172 - DNA, 14 bp, Homo sapiens
cagaactgccccca

SEQ ID NO: 3266173 - DNA, 17 bp, Homo sapiens
cagaactgcccccactg

SEQ ID NO: 3266174 - DNA, 18 bp, Homo sapiens
cagaactgcccccactgt

SEQ ID NO: 3266175 - DNA, 14 bp, Homo sapiens
cagaactgcccttg

SEQ ID NO: 3266176 - DNA, 17 bp, Homo sapiens
cagaactgcccttgctg

SEQ ID NO: 3266177 - DNA, 18 bp, Homo sapiens
cagaactgcccttgctgc

SEQ ID NO: 3266178 - DNA, 19 bp, Homo sapiens
cagaactgcccttgctgcc

SEQ ID NO: 3266179 - DNA, 16 bp, Homo sapiens
cagaacttcagaaaga

SEQ ID NO: 3266180 - DNA, 9 bp, Homo sapiens
cagaacttg

SEQ ID NO: 3266181 - DNA, 16 bp, Homo sapiens
cagaacttgaatgtgt

SEQ ID NO: 3266182 - DNA, 11 bp, Homo sapiens
cagaagaaaga

SEQ ID NO: 3266183 - DNA, 12 bp, Homo sapiens
cagaagaatatt

SEQ ID NO: 3266184 - DNA, 14 bp, Homo sapiens
cagaagaatattca

SEQ ID NO: 3266185 - DNA, 20 bp, Homo sapiens
cagaagaatattcaggactt

SEQ ID NO: 3266186 - DNA, 19 bp, Homo sapiens
cagaagacaccagagcaga

SEQ ID NO: 3266187 - DNA, 21 bp, Homo sapiens
cagaagacactgatgggcaac

SEQ ID NO: 3266188 - DNA, 18 bp, Homo sapiens
cagaagacttcccagctt

SEQ ID NO: 3266189 - DNA, 12 bp, Homo sapiens
cagagctgtgcc

SEQ ID NO: 3266190 - DNA, 16 bp, Homo sapiens
cagagctgtgccagca

SEQ ID NO: 3266191 - DNA, 19 bp, Homo sapiens
cagagctgtttatggcctc

SEQ ID NO: 3266192 - DNA, 22 bp, Homo sapiens
cagagctgtttatggcctcagc

SEQ ID NO: 3266193 - DNA, 15 bp, Homo sapiens
cagagcttgaagatt

SEQ ID NO: 3266194 - DNA, 19 bp, Homo sapiens
cagaggaactgtccagaga

SEQ ID NO: 3266195 - DNA, 20 bp, Homo sapiens
cagaggaatcctggcagccc

SEQ ID NO: 3266196 - DNA, 21 bp, Homo sapiens
cagaggaccacagtgggtggc

SEQ ID NO: 3266197 - DNA, 19 bp, Homo sapiens
cagaggactcccaaccctg

SEQ ID NO: 3266198 - DNA, 12 bp, Homo sapiens
cagaggagaaga

SEQ ID NO: 3266199 - DNA, 16 bp, Homo sapiens
cagaggagagacggtg

SEQ ID NO: 3266200 - DNA, 17 bp, Homo sapiens
cagaggagcaaggttta

SEQ ID NO: 3266201 - DNA, 13 bp, Homo sapiens
cagaggagctcta

SEQ ID NO: 3266202 - DNA, 17 bp, Homo sapiens
cagaggatggccagtgt

SEQ ID NO: 3266203 - DNA, 19 bp, Homo sapiens
cagaggcagcttcaagtgc

SEQ ID NO: 3266204 - DNA, 21 bp, Homo sapiens
cagaggcagcttcaagtgcct

SEQ ID NO: 3266205 - DNA, 21 bp, Homo sapiens
cagaggccatgggcctcctgt

SEQ ID NO: 3266206 - DNA, 19 bp, Homo sapiens
cagaggcccccagcccagg

SEQ ID NO: 3266207 - DNA, 22 bp, Homo sapiens
cagaggcccccagcccagggct

SEQ ID NO: 3266208 - DNA, 13 bp, Homo sapiens
cagaggccctgga

SEQ ID NO: 3266209 - DNA, 14 bp, Homo sapiens
cagaggccctggag

SEQ ID NO: 3266210 - DNA, 19 bp, Homo sapiens
cagaggccgaaggtgcctc

SEQ ID NO: 3266211 - DNA, 20 bp, Homo sapiens
cagaggcctataatgaagct

SEQ ID NO: 3266212 - DNA, 16 bp, Homo sapiens
cagaggcctgctgcca

SEQ ID NO: 3266213 - DNA, 23 bp, Homo sapiens
cagaggcctgctgccagtgcagc

SEQ ID NO: 3266214 - DNA, 23 bp, Homo sapiens
cagaggctgcctctcccatcact

SEQ ID NO: 3266215 - DNA, 13 bp, Homo sapiens
cagaggctgggag

SEQ ID NO: 3266216 - DNA, 15 bp, Homo sapiens
cagaggctgggagca

SEQ ID NO: 3266217 - DNA, 18 bp, Homo sapiens
cagaggctgggagcatag

SEQ ID NO: 3266218 - DNA, 19 bp, Homo sapiens
cagagggaatgttccctgc

SEQ ID NO: 3266219 - DNA, 21 bp, Homo sapiens
cagagggaatgttccctgcac

SEQ ID NO: 3266220 - DNA, 12 bp, Homo sapiens
cagagggagcag

SEQ ID NO: 3266221 - DNA, 14 bp, Homo sapiens
cagagggagcaggc

SEQ ID NO: 3266222 - DNA, 16 bp, Homo sapiens
cagagggagtgacaga

SEQ ID NO: 3266223 - DNA, 18 bp, Homo sapiens
cagagggagtgacagagg

SEQ ID NO: 3266224 - DNA, 19 bp, Homo sapiens
cagagggagtgacagaggc

SEQ ID NO: 3266225 - DNA, 22 bp, Homo sapiens
cagagggagtgacagaggcagc

SEQ ID NO: 3266226 - DNA, 16 bp, Homo sapiens
cagagggcccaggcag

SEQ ID NO: 3266227 - DNA, 18 bp, Homo sapiens
cagagggcccaggcaggc

SEQ ID NO: 3266228 - DNA, 13 bp, Homo sapiens
cagagggctaggg

SEQ ID NO: 3266229 - DNA, 20 bp, Homo sapiens
cagagggctggaggcccagg

SEQ ID NO: 3266230 - DNA, 21 bp, Homo sapiens
cagagggctggaggcccaggc

SEQ ID NO: 3266231 - DNA, 13 bp, Homo sapiens
cagaggggcagcc

SEQ ID NO: 3266232 - DNA, 18 bp, Homo sapiens
cagaggggcagccgctag

SEQ ID NO: 3266233 - DNA, 14 bp, Homo sapiens
cagaggggccaggc

SEQ ID NO: 3266234 - DNA, 16 bp, Homo sapiens
cagaggggccaggccc

SEQ ID NO: 3266235 - DNA, 17 bp, Homo sapiens
cagaggggccaggccca

SEQ ID NO: 3266236 - DNA, 19 bp, Homo sapiens
cagaggggctttctggaga

SEQ ID NO: 3266237 - DNA, 20 bp, Homo sapiens
cagagggggagtagccaagc

SEQ ID NO: 3266238 - DNA, 23 bp, Homo sapiens
cagaggggtgggttcctcttccc

SEQ ID NO: 3266239 - DNA, 16 bp, Homo sapiens
cagagggttaggagtg

SEQ ID NO: 3266240 - DNA, 19 bp, Homo sapiens
cagaggtcagactaagaaa

SEQ ID NO: 3266241 - DNA, 17 bp, Homo sapiens
cagaggtccagcccatc

SEQ ID NO: 3266242 - DNA, 21 bp, Homo sapiens
cagaggtgcttcaccctgagt

SEQ ID NO: 3266243 - DNA, 14 bp, Homo sapiens
cagaggtggccaga

SEQ ID NO: 3266244 - DNA, 17 bp, Homo sapiens
cagaggtggccagagct

SEQ ID NO: 3266245 - DNA, 19 bp, Homo sapiens
cagaggtgggatcctccct

SEQ ID NO: 3266246 - DNA, 15 bp, Homo sapiens
cagaggtgggcaggt

SEQ ID NO: 3266247 - DNA, 16 bp, Homo sapiens
cagaggtgggcaggtg

SEQ ID NO: 3266248 - DNA, 20 bp, Homo sapiens
cagaggtgggcaggtggtgg

SEQ ID NO: 3266249 - DNA, 20 bp, Homo sapiens
cagaggtgtacactaacatt

SEQ ID NO: 3266250 - DNA, 19 bp, Homo sapiens
cagaggttatctgcctggc

SEQ ID NO: 3266251 - DNA, 13 bp, Homo sapiens
cagagtatgaaca

SEQ ID NO: 3266252 - DNA, 20 bp, Homo sapiens
cagagtatttgaaaaatgta

SEQ ID NO: 3266253 - DNA, 18 bp, Homo sapiens
cagagtcagaggagaaga

SEQ ID NO: 3266254 - DNA, 15 bp, Homo sapiens
cagagtcagcacagg

SEQ ID NO: 3266255 - DNA, 18 bp, Homo sapiens
cagagtccaatttaagga

SEQ ID NO: 3266256 - DNA, 15 bp, Homo sapiens
cagagtccactgtgg

SEQ ID NO: 3266257 - DNA, 14 bp, Homo sapiens
cagagtcctttcca

SEQ ID NO: 3266258 - DNA, 18 bp, Homo sapiens
cagagtcgttggagactg

SEQ ID NO: 3266259 - DNA, 22 bp, Homo sapiens
cagagtcgttggagactgaaga

SEQ ID NO: 3266260 - DNA, 18 bp, Homo sapiens
cagagtctataacagaaa

SEQ ID NO: 3266261 - DNA, 13 bp, Homo sapiens
cagagtctcactg

SEQ ID NO: 3266262 - DNA, 13 bp, Homo sapiens
cagagtctgagcc

SEQ ID NO: 3266263 - DNA, 14 bp, Homo sapiens
cagagtctgagccc

SEQ ID NO: 3266264 - DNA, 14 bp, Homo sapiens
cagagtctgggcct

SEQ ID NO: 3266265 - DNA, 24 bp, Homo sapiens
cagagtctgggcctctgactctga

SEQ ID NO: 3266266 - DNA, 16 bp, Homo sapiens
cagagtgcacagctgt

SEQ ID NO: 3266267 - DNA, 15 bp, Homo sapiens
cagagtggactgcat

SEQ ID NO: 3266268 - DNA, 18 bp, Homo sapiens
aaagaaaaaataattgat

SEQ ID NO: 3266269 - DNA, 14 bp, Homo sapiens
aaagaaaacaaaaa

SEQ ID NO: 3266270 - DNA, 19 bp, Homo sapiens
aaagaaaacaaaaaacgaa

SEQ ID NO: 3266271 - DNA, 13 bp, Homo sapiens
aaagaaaaccatt

SEQ ID NO: 3266272 - DNA, 14 bp, Homo sapiens
aaagaaaaccattt

SEQ ID NO: 3266273 - DNA, 14 bp, Homo sapiens
aaagaaaagataaa

SEQ ID NO: 3266274 - DNA, 15 bp, Homo sapiens
aaagaaaagccaagc

SEQ ID NO: 3266275 - DNA, 13 bp, Homo sapiens
aaagaaacaagct

SEQ ID NO: 3266276 - DNA, 18 bp, Homo sapiens
aaagaaacaagctgtgca

SEQ ID NO: 3266277 - DNA, 13 bp, Homo sapiens
aaagaaacagctt

SEQ ID NO: 3266278 - DNA, 18 bp, Homo sapiens
aaagaaacttgtgcttta

SEQ ID NO: 3266279 - DNA, 12 bp, Homo sapiens
aaagaaaggaaa

SEQ ID NO: 3266280 - DNA, 11 bp, Homo sapiens
aaagaaatctt

SEQ ID NO: 3266281 - DNA, 14 bp, Homo sapiens
aaagaaatgaacat

SEQ ID NO: 3266282 - DNA, 16 bp, Homo sapiens
aaagaaatgactaatt

SEQ ID NO: 3266283 - DNA, 19 bp, Homo sapiens
aaagaaatgtctattaagg

SEQ ID NO: 3266284 - DNA, 17 bp, Homo sapiens
aaagaaatttactatat

SEQ ID NO: 3266285 - DNA, 21 bp, Homo sapiens
aaagaaatttactatatatat

SEQ ID NO: 3266286 - DNA, 18 bp, Homo sapiens
aaagaacaaacaaaactt

SEQ ID NO: 3266287 - DNA, 16 bp, Homo sapiens
aaagaaccatgcagga

SEQ ID NO: 3266288 - DNA, 21 bp, Homo sapiens
aaagaactccttattttgtat

SEQ ID NO: 3266289 - DNA, 11 bp, Homo sapiens
aaagaagaaac

SEQ ID NO: 3266290 - DNA, 17 bp, Homo sapiens
aaagaagaacttgcatg

SEQ ID NO: 3266291 - DNA, 19 bp, Homo sapiens
aaagaagaagaagaaggag

SEQ ID NO: 3266292 - DNA, 22 bp, Homo sapiens
aaagaagagcgagagatcaaag

SEQ ID NO: 3266293 - DNA, 22 bp, Homo sapiens
aaagaagagtgacttattttgt

SEQ ID NO: 3266294 - DNA, 19 bp, Homo sapiens
aaagaagagttttagagaa

SEQ ID NO: 3266295 - DNA, 20 bp, Homo sapiens
aaagaagctcgccccacctc

SEQ ID NO: 3266296 - DNA, 21 bp, Homo sapiens
aaagaagctcgccccacctcc

SEQ ID NO: 3266297 - DNA, 19 bp, Homo sapiens
aaagaagtgtccgagaact

SEQ ID NO: 3266298 - DNA, 19 bp, Homo sapiens
aaagaagttactttgtaat

SEQ ID NO: 3266299 - DNA, 18 bp, Homo sapiens
aaagaatatatttattta

SEQ ID NO: 3266300 - DNA, 22 bp, Homo sapiens
aaagaatattcagagaatatca

SEQ ID NO: 3266301 - DNA, 13 bp, Homo sapiens
aaagaatgactat

SEQ ID NO: 3266302 - DNA, 18 bp, Homo sapiens
aaagacaaaagtctgtct

SEQ ID NO: 3266303 - DNA, 18 bp, Homo sapiens
aaagacacagaacacaga

SEQ ID NO: 3266304 - DNA, 17 bp, Homo sapiens
aaagacaccatttatct

SEQ ID NO: 3266305 - DNA, 11 bp, Homo sapiens
aaagaccaaac

SEQ ID NO: 3266306 - DNA, 16 bp, Homo sapiens
aaagacccagggggag

SEQ ID NO: 3266307 - DNA, 22 bp, Homo sapiens
aaagaccctcctattctataaa

SEQ ID NO: 3266308 - DNA, 20 bp, Homo sapiens
aaagaccctgagactccaga

SEQ ID NO: 3266309 - DNA, 20 bp, Homo sapiens
aaagactaatttaaaaaata

SEQ ID NO: 3266310 - DNA, 16 bp, Homo sapiens
aaagactgaacatgtt

SEQ ID NO: 3266311 - DNA, 16 bp, Homo sapiens
aaagactggttttctg

SEQ ID NO: 3266312 - DNA, 17 bp, Homo sapiens
aaagactggttttctgc

SEQ ID NO: 3266313 - DNA, 13 bp, Homo sapiens
aaagactgtacaa

SEQ ID NO: 3266314 - DNA, 14 bp, Homo sapiens
aaagactgtactgg

SEQ ID NO: 3266315 - DNA, 13 bp, Homo sapiens
aaagacttaaagg

SEQ ID NO: 3266316 - DNA, 20 bp, Homo sapiens
aaagacttggttggtagggt

SEQ ID NO: 3266317 - DNA, 12 bp, Homo sapiens
aaagagaaaaaa

SEQ ID NO: 3266318 - DNA, 15 bp, Homo sapiens
aaagagaaaaaccaa

SEQ ID NO: 3266319 - DNA, 12 bp, Homo sapiens
aaagagaaactt

SEQ ID NO: 3266320 - DNA, 13 bp, Homo sapiens
aaagagaaacttt

SEQ ID NO: 3266321 - DNA, 21 bp, Homo sapiens
aaagagaaactttgtgctaca

SEQ ID NO: 3266322 - DNA, 23 bp, Homo sapiens
aaagagaaactttgtgctacatg

SEQ ID NO: 3266323 - DNA, 21 bp, Homo sapiens
aaagagaattgggggcttagg

SEQ ID NO: 3266324 - DNA, 15 bp, Homo sapiens
aaagagacagtgata

SEQ ID NO: 3266325 - DNA, 21 bp, Homo sapiens
aaagagacagtgatattggaa

SEQ ID NO: 3266326 - DNA, 17 bp, Homo sapiens
aaagagacctacctcag

SEQ ID NO: 3266327 - DNA, 20 bp, Homo sapiens
aaagagagaagccagccaca

SEQ ID NO: 3266328 - DNA, 13 bp, Homo sapiens
aaagagagaatgt

SEQ ID NO: 3266329 - DNA, 20 bp, Homo sapiens
aaagagagagagagaaaaaa

SEQ ID NO: 3266330 - DNA, 11 bp, Homo sapiens
aaagagaggtt

SEQ ID NO: 3266331 - DNA, 21 bp, Homo sapiens
aaagagataccaagatgccat

SEQ ID NO: 3266332 - DNA, 20 bp, Homo sapiens
aaagagattagaacatttaa

SEQ ID NO: 3266333 - DNA, 12 bp, Homo sapiens
aaagagcacaaa

SEQ ID NO: 3266334 - DNA, 18 bp, Homo sapiens
aaagagcacaaacatttt

SEQ ID NO: 3266335 - DNA, 18 bp, Homo sapiens
aaagagccttcagaatgc

SEQ ID NO: 3266336 - DNA, 21 bp, Homo sapiens
aaagaggactcgcttgtaaat

SEQ ID NO: 3266337 - DNA, 16 bp, Homo sapiens
aaagaggagaccctgg

SEQ ID NO: 3266338 - DNA, 14 bp, Homo sapiens
aaagaggctgcccc

SEQ ID NO: 3266339 - DNA, 19 bp, Homo sapiens
aaagagggcttcctctaga

SEQ ID NO: 3266340 - DNA, 15 bp, Homo sapiens
aaagaggtctcccca

SEQ ID NO: 3266341 - DNA, 16 bp, Homo sapiens
aaagaggtctccccat

SEQ ID NO: 3266342 - DNA, 13 bp, Homo sapiens
aaagagtagaaag

SEQ ID NO: 3266343 - DNA, 13 bp, Homo sapiens
aaagagtagaatt

SEQ ID NO: 3266344 - DNA, 14 bp, Homo sapiens
aaagagtcacacaa

SEQ ID NO: 3266345 - DNA, 13 bp, Homo sapiens
aaagagtctagat

SEQ ID NO: 3266346 - DNA, 14 bp, Homo sapiens
aaagagtctagatt

SEQ ID NO: 3266347 - DNA, 16 bp, Homo sapiens
aaagagttcttaagga

SEQ ID NO: 3266348 - DNA, 21 bp, Homo sapiens
aaagataaacctggagatatt

SEQ ID NO: 3266349 - DNA, 20 bp, Homo sapiens
aaagataacaagatctttca

SEQ ID NO: 3266350 - DNA, 15 bp, Homo sapiens
aaagatcaaaataaa

SEQ ID NO: 3266351 - DNA, 16 bp, Homo sapiens
aaagatctgttttgaa

SEQ ID NO: 3266352 - DNA, 12 bp, Homo sapiens
aaagatgagttg

SEQ ID NO: 3266353 - DNA, 21 bp, Homo sapiens
aaagatgcagccgccttcctt

SEQ ID NO: 3266354 - DNA, 18 bp, Homo sapiens
aaagatgctagaaaaatg

SEQ ID NO: 3266355 - DNA, 19 bp, Homo sapiens
aaagatggagtttctaagg

SEQ ID NO: 3266356 - DNA, 12 bp, Homo sapiens
aaagatggcctt

SEQ ID NO: 3266357 - DNA, 21 bp, Homo sapiens
aaagatggctgtgcctctgcc

SEQ ID NO: 3266358 - DNA, 22 bp, Homo sapiens
aaagatggctgtgcctctgcct

SEQ ID NO: 3266359 - DNA, 18 bp, Homo sapiens
aaagatgttaagcattta

SEQ ID NO: 3266360 - DNA, 19 bp, Homo sapiens
aaagatgttaagcatttat

SEQ ID NO: 3266361 - DNA, 13 bp, Homo sapiens
aaagattaaacag

SEQ ID NO: 3266362 - DNA, 21 bp, Homo sapiens
aaagattctatagttctagac

SEQ ID NO: 3266363 - DNA, 22 bp, Homo sapiens
aaagattctctttaaaaaagac

SEQ ID NO: 3266364 - DNA, 19 bp, Homo sapiens
aaagattgctgaaatttta

SEQ ID NO: 3266365 - DNA, 21 bp, Homo sapiens
aaagattgctgaaattttata

SEQ ID NO: 3266366 - DNA, 13 bp, Homo sapiens
aaagattgtactt

SEQ ID NO: 3266367 - DNA, 17 bp, Homo sapiens
aaagatttaagcacaaa

SEQ ID NO: 3266368 - DNA, 18 bp, Homo sapiens
aaagatttgtgaactgga

SEQ ID NO: 3266369 - DNA, 15 bp, Homo sapiens
aaagatttgttgaca

SEQ ID NO: 3266370 - DNA, 14 bp, Homo sapiens
aaagattttaatca

SEQ ID NO: 3266371 - DNA, 15 bp, Homo sapiens
aaagattttattgta

SEQ ID NO: 3266372 - DNA, 14 bp, Homo sapiens
aaagattttcagaa

SEQ ID NO: 3266373 - DNA, 15 bp, Homo sapiens
aaagattttcagaaa

SEQ ID NO: 3266374 - DNA, 19 bp, Homo sapiens
aaagattttttttaatcta

SEQ ID NO: 3266375 - DNA, 14 bp, Homo sapiens
aaagcaaaacaaaa

SEQ ID NO: 3266376 - DNA, 23 bp, Homo sapiens
aaagcaaacttaagaaacactga

SEQ ID NO: 3266377 - DNA, 21 bp, Homo sapiens
aaagcaactgttatgaaataa

SEQ ID NO: 3266378 - DNA, 20 bp, Homo sapiens
aaagcaagggctccagcatc

SEQ ID NO: 3266379 - DNA, 22 bp, Homo sapiens
aaagcaataatggtcccatcca

SEQ ID NO: 3266380 - DNA, 14 bp, Homo sapiens
aaagcaatattgta

SEQ ID NO: 3266381 - DNA, 16 bp, Homo sapiens
aaagcacaagaagcgt

SEQ ID NO: 3266382 - DNA, 19 bp, Homo sapiens
aaagcacaggagacactgt

SEQ ID NO: 3266383 - DNA, 20 bp, Homo sapiens
aaagcacagtgttaaatgaa

SEQ ID NO: 3266384 - DNA, 15 bp, Homo sapiens
aaagcacagtttgaa

SEQ ID NO: 3266385 - DNA, 13 bp, Homo sapiens
aaagcacatacat

SEQ ID NO: 3266386 - DNA, 21 bp, Homo sapiens
aaagcacatacattaaaacta

SEQ ID NO: 3266387 - DNA, 16 bp, Homo sapiens
aaagcacttggactct

SEQ ID NO: 3266388 - DNA, 21 bp, Homo sapiens
aaagcacttggactcttgctc

SEQ ID NO: 3266389 - DNA, 13 bp, Homo sapiens
aaaaaaaaagtca

SEQ ID NO: 3266390 - DNA, 12 bp, Homo sapiens
aaaaaaaacagt

SEQ ID NO: 3266391 - DNA, 10 bp, Homo sapiens
aaaaaaactg

SEQ ID NO: 3266392 - DNA, 12 bp, Homo sapiens
aaaaaaatacaa

SEQ ID NO: 3266393 - DNA, 12 bp, Homo sapiens
aaaaaaatcttc

SEQ ID NO: 3266394 - DNA, 13 bp, Homo sapiens
aaaaaaatgaatg

SEQ ID NO: 3266395 - DNA, 11 bp, Homo sapiens
aaaaaaatgcc

SEQ ID NO: 3266396 - DNA, 11 bp, Homo sapiens
aaaaaaatttg

SEQ ID NO: 3266397 - DNA, 16 bp, Homo sapiens
aaaaaaccacaaaggc

SEQ ID NO: 3266398 - DNA, 12 bp, Homo sapiens
aaaaaagaaaat

SEQ ID NO: 3266399 - DNA, 12 bp, Homo sapiens
aaaaaagaagtt

SEQ ID NO: 3266400 - DNA, 11 bp, Homo sapiens
aaaaaagcaaa

SEQ ID NO: 3266401 - DNA, 10 bp, Homo sapiens
aaaaaagcac

SEQ ID NO: 3266402 - DNA, 13 bp, Homo sapiens
aaaaaaggaaaaa

SEQ ID NO: 3266403 - DNA, 16 bp, Homo sapiens
aaaaaagtcaccaaat

SEQ ID NO: 3266404 - DNA, 12 bp, Homo sapiens
aaaaaagtttta

SEQ ID NO: 3266405 - DNA, 16 bp, Homo sapiens
aaaaaatagacatgta

SEQ ID NO: 3266406 - DNA, 12 bp, Homo sapiens
aaaaaatttgtc

SEQ ID NO: 3266407 - DNA, 17 bp, Homo sapiens
aaaaacacctagcttta

SEQ ID NO: 3266408 - DNA, 15 bp, Homo sapiens
aaaaacagcattgct

SEQ ID NO: 3266409 - DNA, 19 bp, Homo sapiens
aaaaacagcattgctttct

SEQ ID NO: 3266410 - DNA, 20 bp, Homo sapiens
aaaaacagcattgctttctg

SEQ ID NO: 3266411 - DNA, 21 bp, Homo sapiens
aaaaacaggtatatactttga

SEQ ID NO: 3266412 - DNA, 14 bp, Homo sapiens
aaaaaccgttcaaa

SEQ ID NO: 3266413 - DNA, 20 bp, Homo sapiens
aaaaactaaatctctaatat

SEQ ID NO: 3266414 - DNA, 14 bp, Homo sapiens
aaaaactaaattgt

SEQ ID NO: 3266415 - DNA, 23 bp, Homo sapiens
aaaaactgggataactgatttct

SEQ ID NO: 3266416 - DNA, 19 bp, Homo sapiens
aaaaacttcagtaagtacg

SEQ ID NO: 3266417 - DNA, 14 bp, Homo sapiens
aaaaacttggcact

SEQ ID NO: 3266418 - DNA, 12 bp, Homo sapiens
aaaaacttgtaa

SEQ ID NO: 3266419 - DNA, 15 bp, Homo sapiens
aaaaagaaaggaggg

SEQ ID NO: 3266420 - DNA, 12 bp, Homo sapiens
aaaaagaaatct

SEQ ID NO: 3266421 - DNA, 11 bp, Homo sapiens
aaaaagaacca

SEQ ID NO: 3266422 - DNA, 13 bp, Homo sapiens
aaaaagaagttac

SEQ ID NO: 3266423 - DNA, 16 bp, Homo sapiens
aaaaagaagttacttt

SEQ ID NO: 3266424 - DNA, 20 bp, Homo sapiens
aaaaagaagttactttgtaa

SEQ ID NO: 3266425 - DNA, 23 bp, Homo sapiens
aaaaagaagttactttgtaattt

SEQ ID NO: 3266426 - DNA, 21 bp, Homo sapiens
aaaaagaatctgcatttagca

SEQ ID NO: 3266427 - DNA, 21 bp, Homo sapiens
aaaaagactgaacatgtttac

SEQ ID NO: 3266428 - DNA, 20 bp, Homo sapiens
aaaaagagaaaaaccaatga

SEQ ID NO: 3266429 - DNA, 16 bp, Homo sapiens
aaaaagagttttcttt

SEQ ID NO: 3266430 - DNA, 13 bp, Homo sapiens
aaaaagattcttt

SEQ ID NO: 3266431 - DNA, 15 bp, Homo sapiens
aaaaagcaaaaatga

SEQ ID NO: 3266432 - DNA, 13 bp, Homo sapiens
aaaaagcacaaga

SEQ ID NO: 3266433 - DNA, 15 bp, Homo sapiens
aaaaagcacaagaag

SEQ ID NO: 3266434 - DNA, 11 bp, Homo sapiens
aaaaagcacat

SEQ ID NO: 3266435 - DNA, 14 bp, Homo sapiens
aaaaagcacataca

SEQ ID NO: 3266436 - DNA, 17 bp, Homo sapiens
aaaaagcacatacatta

SEQ ID NO: 3266437 - DNA, 22 bp, Homo sapiens
aaaaagcagaattttaatgtga

SEQ ID NO: 3266438 - DNA, 13 bp, Homo sapiens
aaaaagcagacag

SEQ ID NO: 3266439 - DNA, 21 bp, Homo sapiens
aaaaagcagctaccaggtgtt

SEQ ID NO: 3266440 - DNA, 18 bp, Homo sapiens
aaaaagcatgatgggaaa

SEQ ID NO: 3266441 - DNA, 12 bp, Homo sapiens
aaaaagcctcca

SEQ ID NO: 3266442 - DNA, 23 bp, Homo sapiens
aaaaagcctccaagggtttcgac

SEQ ID NO: 3266443 - DNA, 12 bp, Homo sapiens
aaaaagccttcc

SEQ ID NO: 3266444 - DNA, 14 bp, Homo sapiens
aaaaagctcactgc

SEQ ID NO: 3266445 - DNA, 17 bp, Homo sapiens
aaaaagctcactgctga

SEQ ID NO: 3266446 - DNA, 18 bp, Homo sapiens
aaaaagctcatattttgt

SEQ ID NO: 3266447 - DNA, 20 bp, Homo sapiens
aaaaaggaaatttgtttgta

SEQ ID NO: 3266448 - DNA, 21 bp, Homo sapiens
aaaaaggccagtggaaattca

SEQ ID NO: 3266449 - DNA, 17 bp, Homo sapiens
aaaaaggctagtttatt

SEQ ID NO: 3266450 - DNA, 20 bp, Homo sapiens
aaaaaggctagtttattttg

SEQ ID NO: 3266451 - DNA, 19 bp, Homo sapiens
aaaaagtaagttaataatg

SEQ ID NO: 3266452 - DNA, 19 bp, Homo sapiens
aaaaagtacaatgaactgc

SEQ ID NO: 3266453 - DNA, 21 bp, Homo sapiens
aaaaagtacaatgaactgctt

SEQ ID NO: 3266454 - DNA, 22 bp, Homo sapiens
aaaaagtctctatttaaattct

SEQ ID NO: 3266455 - DNA, 15 bp, Homo sapiens
aaaaagtgacacagc

SEQ ID NO: 3266456 - DNA, 14 bp, Homo sapiens
aaaaagtgcatgat

SEQ ID NO: 3266457 - DNA, 23 bp, Homo sapiens
aaaaagtgtttatttttcatatt

SEQ ID NO: 3266458 - DNA, 21 bp, Homo sapiens
aaaaagttgaaccattatact

SEQ ID NO: 3266459 - DNA, 13 bp, Homo sapiens
aaaaagttgaagg

SEQ ID NO: 3266460 - DNA, 17 bp, Homo sapiens
aaaaagtttacaagtgt

SEQ ID NO: 3266461 - DNA, 16 bp, Homo sapiens
aaaaagttttagtttt

SEQ ID NO: 3266462 - DNA, 22 bp, Homo sapiens
aaaatacttttactctgcctac

SEQ ID NO: 3266463 - DNA, 16 bp, Homo sapiens
aaaatagagcttttaa

SEQ ID NO: 3266464 - DNA, 16 bp, Homo sapiens
aaaatagctctgtgtg

SEQ ID NO: 3266465 - DNA, 12 bp, Homo sapiens
aaaataggcagg

SEQ ID NO: 3266466 - DNA, 13 bp, Homo sapiens
aaaataggcagga

SEQ ID NO: 3266467 - DNA, 16 bp, Homo sapiens
aaaataggctttttaa

SEQ ID NO: 3266468 - DNA, 21 bp, Homo sapiens
aaaataggctttttaatcatg

SEQ ID NO: 3266469 - DNA, 16 bp, Homo sapiens
aaaatagttgtccata

SEQ ID NO: 3266470 - DNA, 22 bp, Homo sapiens
aaaatatacttgactctaatat

SEQ ID NO: 3266471 - DNA, 18 bp, Homo sapiens
aaaatatagcctttaaat

SEQ ID NO: 3266472 - DNA, 18 bp, Homo sapiens
aaaatatataccccccca

SEQ ID NO: 3266473 - DNA, 19 bp, Homo sapiens
aaaatatatatagtgctat

SEQ ID NO: 3266474 - DNA, 14 bp, Homo sapiens
aaaatatatttaat

SEQ ID NO: 3266475 - DNA, 19 bp, Homo sapiens
aaaatatcagacaagcact

SEQ ID NO: 3266476 - DNA, 18 bp, Homo sapiens
aaaatatctatattctat

SEQ ID NO: 3266477 - DNA, 12 bp, Homo sapiens
aaaatatcttgg

SEQ ID NO: 3266478 - DNA, 21 bp, Homo sapiens
aaaatatgaacctattttcat

SEQ ID NO: 3266479 - DNA, 20 bp, Homo sapiens
aaaatatggaacttctaata

SEQ ID NO: 3266480 - DNA, 23 bp, Homo sapiens
aaaatatgtctcgctagtgatgt

SEQ ID NO: 3266481 - DNA, 16 bp, Homo sapiens
aaaatattataactta

SEQ ID NO: 3266482 - DNA, 14 bp, Homo sapiens
aaaatattatgtgt

SEQ ID NO: 3266483 - DNA, 14 bp, Homo sapiens
aaaatattctctat

SEQ ID NO: 3266484 - DNA, 11 bp, Homo sapiens
aaaatatttcc

SEQ ID NO: 3266485 - DNA, 15 bp, Homo sapiens
aaaatatttcctgac

SEQ ID NO: 3266486 - DNA, 15 bp, Homo sapiens
aaaatatttgtacat

SEQ ID NO: 3266487 - DNA, 19 bp, Homo sapiens
aaaatatttgtctttaaac

SEQ ID NO: 3266488 - DNA, 12 bp, Homo sapiens
aaaatattttgg

SEQ ID NO: 3266489 - DNA, 13 bp, Homo sapiens
aaaatattttttg

SEQ ID NO: 3266490 - DNA, 15 bp, Homo sapiens
aaaatattttttgca

SEQ ID NO: 3266491 - DNA, 16 bp, Homo sapiens
aaaatcaaagctgagg

SEQ ID NO: 3266492 - DNA, 16 bp, Homo sapiens
aaaatcaacttgtgta

SEQ ID NO: 3266493 - DNA, 13 bp, Homo sapiens
aaaatcacaaaaa

SEQ ID NO: 3266494 - DNA, 23 bp, Homo sapiens
aaaatcacactgtaaatatgaat

SEQ ID NO: 3266495 - DNA, 14 bp, Homo sapiens
aaaatcacgttaaa

SEQ ID NO: 3266496 - DNA, 17 bp, Homo sapiens
aaaatcactttcataat

SEQ ID NO: 3266497 - DNA, 21 bp, Homo sapiens
aaaatcactttgtctaactca

SEQ ID NO: 3266498 - DNA, 14 bp, Homo sapiens
aaaatccatgaaca

SEQ ID NO: 3266499 - DNA, 14 bp, Homo sapiens
aaaatccctattta

SEQ ID NO: 3266500 - DNA, 22 bp, Homo sapiens
aaaatctaaaacaaaatctgaa

SEQ ID NO: 3266501 - DNA, 14 bp, Homo sapiens
aaaatctagttttt

SEQ ID NO: 3266502 - DNA, 19 bp, Homo sapiens
aaaatctagttttttttgt

SEQ ID NO: 3266503 - DNA, 13 bp, Homo sapiens
aaaatctattctg

SEQ ID NO: 3266504 - DNA, 23 bp, Homo sapiens
aaaatctgaaaatgtgaataaaa

SEQ ID NO: 3266505 - DNA, 20 bp, Homo sapiens
aaaatcttatagttctaggc

SEQ ID NO: 3266506 - DNA, 15 bp, Homo sapiens
aaaatgaaaattgta

SEQ ID NO: 3266507 - DNA, 16 bp, Homo sapiens
aaaatgaaaattgtat

SEQ ID NO: 3266508 - DNA, 23 bp, Homo sapiens
aaaatgaaagtgactttaaaaga

SEQ ID NO: 3266509 - DNA, 20 bp, Homo sapiens
aaaatgaaggttaggattta

SEQ ID NO: 3266510 - DNA, 14 bp, Homo sapiens
aaaatgaatatcta

SEQ ID NO: 3266511 - DNA, 14 bp, Homo sapiens
aaaatgacaacaga

SEQ ID NO: 3266512 - DNA, 17 bp, Homo sapiens
aaaatgacaacagaaaa

SEQ ID NO: 3266513 - DNA, 13 bp, Homo sapiens
aaaatgacagatg

SEQ ID NO: 3266514 - DNA, 18 bp, Homo sapiens
aaaatgaggttcaactgt

SEQ ID NO: 3266515 - DNA, 23 bp, Homo sapiens
aaaatgatgtgtacccaaacgtg

SEQ ID NO: 3266516 - DNA, 16 bp, Homo sapiens
aaaatgattgtaaaat

SEQ ID NO: 3266517 - DNA, 20 bp, Homo sapiens
aaaatgattgtaaaatagct

SEQ ID NO: 3266518 - DNA, 11 bp, Homo sapiens
aaaatgcaaag

SEQ ID NO: 3266519 - DNA, 19 bp, Homo sapiens
aaaatgcattgaaagaatt

SEQ ID NO: 3266520 - DNA, 20 bp, Homo sapiens
aaaatgcattgaaagaatta

SEQ ID NO: 3266521 - DNA, 15 bp, Homo sapiens
aaaatgcctttgaga

SEQ ID NO: 3266522 - DNA, 22 bp, Homo sapiens
aaaatgcggttataaaaaatgg

SEQ ID NO: 3266523 - DNA, 13 bp, Homo sapiens
aaaatgcttttta

SEQ ID NO: 3266524 - DNA, 18 bp, Homo sapiens
aaaatgctttttatttct

SEQ ID NO: 3266525 - DNA, 20 bp, Homo sapiens
aaaatggaaaaaaacataaa

SEQ ID NO: 3266526 - DNA, 12 bp, Homo sapiens
aaaatggaaaga

SEQ ID NO: 3266527 - DNA, 16 bp, Homo sapiens
aaaatggacacaaatt

SEQ ID NO: 3266528 - DNA, 17 bp, Homo sapiens
aaaatggacacaaattt

SEQ ID NO: 3266529 - DNA, 22 bp, Homo sapiens
aaaatggaggccattgtgtgag

SEQ ID NO: 3266530 - DNA, 21 bp, Homo sapiens
aaaatggatattattagaaat

SEQ ID NO: 3266531 - DNA, 22 bp, Homo sapiens
aaaatggatattattagaaatt

SEQ ID NO: 3266532 - DNA, 18 bp, Homo sapiens
aaaatggctaataaactg

SEQ ID NO: 3266533 - DNA, 19 bp, Homo sapiens
aaaatggctaataaactgt

SEQ ID NO: 3266534 - DNA, 17 bp, Homo sapiens
aaaatgggaaaaataaa

SEQ ID NO: 3266535 - DNA, 15 bp, Homo sapiens
aaaatgggaagactg

SEQ ID NO: 3266536 - DNA, 23 bp, Homo sapiens
aaaatggggtttgggcccctcag

SEQ ID NO: 3266537 - DNA, 24 bp, Homo sapiens
aaaatggtatcaaaattacatata

SEQ ID NO: 3266538 - DNA, 22 bp, Homo sapiens
aaaatggtccaattagtttcct

SEQ ID NO: 3266539 - DNA, 18 bp, Homo sapiens
aaaatggtttattttgta

SEQ ID NO: 3266540 - DNA, 22 bp, Homo sapiens
aaaatggtttattttgtattgt

SEQ ID NO: 3266541 - DNA, 16 bp, Homo sapiens
aaaatgtaaaggaggg

SEQ ID NO: 3266542 - DNA, 20 bp, Homo sapiens
aaaatgtaaatattctatat

SEQ ID NO: 3266543 - DNA, 11 bp, Homo sapiens
aaaatgtaaca

SEQ ID NO: 3266544 - DNA, 23 bp, Homo sapiens
aaaatgtaacatcataattacat

SEQ ID NO: 3266545 - DNA, 23 bp, Homo sapiens
aaaatgtaagattatagattcta

SEQ ID NO: 3266546 - DNA, 21 bp, Homo sapiens
aaaatgtaagctgtttatttt

SEQ ID NO: 3266547 - DNA, 16 bp, Homo sapiens
aaaatgtaatttagaa

SEQ ID NO: 3266548 - DNA, 19 bp, Homo sapiens
aaaatgtaatttagaaact

SEQ ID NO: 3266549 - DNA, 21 bp, Homo sapiens
aaaatgtaggcttagtttgtg

SEQ ID NO: 3266550 - DNA, 18 bp, Homo sapiens
aaaatgtaggctttcatg

SEQ ID NO: 3266551 - DNA, 21 bp, Homo sapiens
aaaatgtagggttataataat

SEQ ID NO: 3266552 - DNA, 14 bp, Homo sapiens
aaaatgtatatatt

SEQ ID NO: 3266553 - DNA, 17 bp, Homo sapiens
aaaatgtcacattctat

SEQ ID NO: 3266554 - DNA, 23 bp, Homo sapiens
aaaatgtgaaaaaaattattcat

SEQ ID NO: 3266555 - DNA, 12 bp, Homo sapiens
aaaatgtgaagt

SEQ ID NO: 3266556 - DNA, 18 bp, Homo sapiens
aaaatgtgaataaaatta

SEQ ID NO: 3266557 - DNA, 20 bp, Homo sapiens
aaaatgtgatgttctaaggc

SEQ ID NO: 3266558 - DNA, 20 bp, Homo sapiens
aaaatgtgctatactgcata

SEQ ID NO: 3266559 - DNA, 13 bp, Homo sapiens
aaaatgtgtacag

SEQ ID NO: 3266560 - DNA, 16 bp, Homo sapiens
aaaatgtgttgaaact

SEQ ID NO: 3266561 - DNA, 22 bp, Homo sapiens
aaaatgttcatcaattcccatt

SEQ ID NO: 3266562 - DNA, 15 bp, Homo sapiens
aaaatgttctgtttg

SEQ ID NO: 3266563 - DNA, 14 bp, Homo sapiens
aaaatgttgagaat

SEQ ID NO: 3266564 - DNA, 21 bp, Homo sapiens
aaaatgttggtcattttatgt

SEQ ID NO: 3266565 - DNA, 16 bp, Homo sapiens
aaaatgtttaagtatt

SEQ ID NO: 3266566 - DNA, 18 bp, Homo sapiens
aaaattaaacacaaagtg

SEQ ID NO: 3266567 - DNA, 17 bp, Homo sapiens
aaaattaaatgccttgt

SEQ ID NO: 3266568 - DNA, 20 bp, Homo sapiens
aaaattaagcaaatgttaaa

SEQ ID NO: 3266569 - DNA, 18 bp, Homo sapiens
aatgtctaaatgctgaaa

SEQ ID NO: 3266570 - DNA, 14 bp, Homo sapiens
aatgtctcactgtt

SEQ ID NO: 3266571 - DNA, 15 bp, Homo sapiens
aatgtctcactgttc

SEQ ID NO: 3266572 - DNA, 15 bp, Homo sapiens
aatgtctcctttgct

SEQ ID NO: 3266573 - DNA, 16 bp, Homo sapiens
aatgtctcctttgctc

SEQ ID NO: 3266574 - DNA, 15 bp, Homo sapiens
aatgtctgctgagga

SEQ ID NO: 3266575 - DNA, 21 bp, Homo sapiens
aatgtcttcatttcattgtat

SEQ ID NO: 3266576 - DNA, 15 bp, Homo sapiens
aatgtctttccaaat

SEQ ID NO: 3266577 - DNA, 23 bp, Homo sapiens
aatgtctttccaaattatttctt

SEQ ID NO: 3266578 - DNA, 13 bp, Homo sapiens
aatgtcttttgaa

SEQ ID NO: 3266579 - DNA, 18 bp, Homo sapiens
aatgtgaaaaaaattatt

SEQ ID NO: 3266580 - DNA, 18 bp, Homo sapiens
aatgtgaaaaatctgctg

SEQ ID NO: 3266581 - DNA, 20 bp, Homo sapiens
aatgtgaactttattaaata

SEQ ID NO: 3266582 - DNA, 17 bp, Homo sapiens
aatgtgaataaaattat

SEQ ID NO: 3266583 - DNA, 12 bp, Homo sapiens
aatgtgaatttt

SEQ ID NO: 3266584 - DNA, 12 bp, Homo sapiens
aatgtgacattt

SEQ ID NO: 3266585 - DNA, 18 bp, Homo sapiens
aatgtgatcaactgttca

SEQ ID NO: 3266586 - DNA, 21 bp, Homo sapiens
aatgtgatggatggcacaatg

SEQ ID NO: 3266587 - DNA, 17 bp, Homo sapiens
aatgtgattactgctct

SEQ ID NO: 3266588 - DNA, 14 bp, Homo sapiens
aatgtgattctaat

SEQ ID NO: 3266589 - DNA, 12 bp, Homo sapiens
aatgtgcccctg

SEQ ID NO: 3266590 - DNA, 18 bp, Homo sapiens
aatgtgctatactgcata

SEQ ID NO: 3266591 - DNA, 21 bp, Homo sapiens
aatgtggactcaatccctagg

SEQ ID NO: 3266592 - DNA, 12 bp, Homo sapiens
aattatgacagt

SEQ ID NO: 3266593 - DNA, 13 bp, Homo sapiens
aattatgacagtt

SEQ ID NO: 3266594 - DNA, 14 bp, Homo sapiens
aattatgagatttt

SEQ ID NO: 3266595 - DNA, 18 bp, Homo sapiens
aattatggaaatatagtt

SEQ ID NO: 3266596 - DNA, 23 bp, Homo sapiens
aattatggaatatcatctgtcat

SEQ ID NO: 3266597 - DNA, 23 bp, Homo sapiens
aattatggagtattttaagtcta

SEQ ID NO: 3266598 - DNA, 18 bp, Homo sapiens
aattatgtatgtttacat

SEQ ID NO: 3266599 - DNA, 18 bp, Homo sapiens
aattatgtcgtaagtcac

SEQ ID NO: 3266600 - DNA, 16 bp, Homo sapiens
aattattaactacatt

SEQ ID NO: 3266601 - DNA, 18 bp, Homo sapiens
aattattaactacattta

SEQ ID NO: 3266602 - DNA, 23 bp, Homo sapiens
aattattaactacatttatgagt

SEQ ID NO: 3266603 - DNA, 13 bp, Homo sapiens
aattattataaaa

SEQ ID NO: 3266604 - DNA, 16 bp, Homo sapiens
aattattatttatata

SEQ ID NO: 3266605 - DNA, 18 bp, Homo sapiens
aattattatttatatatg

SEQ ID NO: 3266606 - DNA, 13 bp, Homo sapiens
aattattctgatt

SEQ ID NO: 3266607 - DNA, 13 bp, Homo sapiens
aattattgatata

SEQ ID NO: 3266608 - DNA, 19 bp, Homo sapiens
aattatttaaataaaatca

SEQ ID NO: 3266609 - DNA, 21 bp, Homo sapiens
aattatttaaataaaatcacc

SEQ ID NO: 3266610 - DNA, 15 bp, Homo sapiens
aattattttaaaata

SEQ ID NO: 3266611 - DNA, 18 bp, Homo sapiens
aattattttaaacaaaat

SEQ ID NO: 3266612 - DNA, 22 bp, Homo sapiens
aattattttgaatgtcacaaat

SEQ ID NO: 3266613 - DNA, 23 bp, Homo sapiens
aattcaaaagttccaagagtcta

SEQ ID NO: 3266614 - DNA, 13 bp, Homo sapiens
aattcaaagcttg

SEQ ID NO: 3266615 - DNA, 15 bp, Homo sapiens
aattcaactttgtaa

SEQ ID NO: 3266616 - DNA, 13 bp, Homo sapiens
aattcaaggcctt

SEQ ID NO: 3266617 - DNA, 17 bp, Homo sapiens
aattcaatttggattta

SEQ ID NO: 3266618 - DNA, 13 bp, Homo sapiens
aattcacaaactt

SEQ ID NO: 3266619 - DNA, 14 bp, Homo sapiens
aattcacctatgtt

SEQ ID NO: 3266620 - DNA, 17 bp, Homo sapiens
aattcacctatgttatt

SEQ ID NO: 3266621 - DNA, 14 bp, Homo sapiens
aattcagagtcctt

SEQ ID NO: 3266622 - DNA, 14 bp, Homo sapiens
aattcagcaccctg

SEQ ID NO: 3266623 - DNA, 20 bp, Homo sapiens
aattcaggcatattttaact

SEQ ID NO: 3266624 - DNA, 21 bp, Homo sapiens
aattcaggtgaaaatgttcat

SEQ ID NO: 3266625 - DNA, 21 bp, Homo sapiens
aattcagtcctgggcaaaggt

SEQ ID NO: 3266626 - DNA, 16 bp, Homo sapiens
aattcagtgccttcaa

SEQ ID NO: 3266627 - DNA, 19 bp, Homo sapiens
aattcagtttttgtatctt

SEQ ID NO: 3266628 - DNA, 19 bp, Homo sapiens
aattcatttgtattgctta

SEQ ID NO: 3266629 - DNA, 18 bp, Homo sapiens
aattcattttttaaattc

SEQ ID NO: 3266630 - DNA, 14 bp, Homo sapiens
aattccaaaggaat

SEQ ID NO: 3266631 - DNA, 12 bp, Homo sapiens
aattccaaagtc

SEQ ID NO: 3266632 - DNA, 13 bp, Homo sapiens
aattccaaagtct

SEQ ID NO: 3266633 - DNA, 16 bp, Homo sapiens
aattccaatatgatga

SEQ ID NO: 3266634 - DNA, 16 bp, Homo sapiens
aattccaattaaattt

SEQ ID NO: 3266635 - DNA, 16 bp, Homo sapiens
aattccacacctttta

SEQ ID NO: 3266636 - DNA, 14 bp, Homo sapiens
aattccactgtcaa

SEQ ID NO: 3266637 - DNA, 21 bp, Homo sapiens
aattcccattttgcaaaattt

SEQ ID NO: 3266638 - DNA, 22 bp, Homo sapiens
aattcccattttgcaaaatttc

SEQ ID NO: 3266639 - DNA, 12 bp, Homo sapiens
aattccccagat

SEQ ID NO: 3266640 - DNA, 14 bp, Homo sapiens
aattcctacaactt

SEQ ID NO: 3266641 - DNA, 17 bp, Homo sapiens
aattcctacaacttaat

SEQ ID NO: 3266642 - DNA, 20 bp, Homo sapiens
aattcctactccctcttcca

SEQ ID NO: 3266643 - DNA, 21 bp, Homo sapiens
aattcctatatcctgtgactg

SEQ ID NO: 3266644 - DNA, 21 bp, Homo sapiens
aattcctctcactaaacttta

SEQ ID NO: 3266645 - DNA, 16 bp, Homo sapiens
aattcctcttcattgt

SEQ ID NO: 3266646 - DNA, 22 bp, Homo sapiens
aattcgtgtgtttttttatgaa

SEQ ID NO: 3266647 - DNA, 13 bp, Homo sapiens
aattctaaatgaa

SEQ ID NO: 3266648 - DNA, 15 bp, Homo sapiens
aattctaatctaaca

SEQ ID NO: 3266649 - DNA, 22 bp, Homo sapiens
aattctaatctaacaatggaag

SEQ ID NO: 3266650 - DNA, 18 bp, Homo sapiens
aattctactaagttattt

SEQ ID NO: 3266651 - DNA, 22 bp, Homo sapiens
aattctatgttaaatactgtgc

SEQ ID NO: 3266652 - DNA, 23 bp, Homo sapiens
aattctattaaagtgctaaggtt

SEQ ID NO: 3266653 - DNA, 13 bp, Homo sapiens
aattctcctggag

SEQ ID NO: 3266654 - DNA, 15 bp, Homo sapiens
aattctcctggaggt

SEQ ID NO: 3266655 - DNA, 15 bp, Homo sapiens
aattctcttatccaa

SEQ ID NO: 3266656 - DNA, 10 bp, Homo sapiens
aattctgaat

SEQ ID NO: 3266657 - DNA, 20 bp, Homo sapiens
aattctgtacatagcctata

SEQ ID NO: 3266658 - DNA, 21 bp, Homo sapiens
aattctgtacttccaatttat

SEQ ID NO: 3266659 - DNA, 11 bp, Homo sapiens
aattctgtccc

SEQ ID NO: 3266660 - DNA, 15 bp, Homo sapiens
aattctgttaaaatc

SEQ ID NO: 3266661 - DNA, 11 bp, Homo sapiens
aattcttaaaa

SEQ ID NO: 3266662 - DNA, 14 bp, Homo sapiens
aattcttaaaatat

SEQ ID NO: 3266663 - DNA, 14 bp, Homo sapiens
aattcttaagtctt

SEQ ID NO: 3266664 - DNA, 12 bp, Homo sapiens
aattcttatttt

SEQ ID NO: 3266665 - DNA, 13 bp, Homo sapiens
aattcttctgaac

SEQ ID NO: 3266666 - DNA, 15 bp, Homo sapiens
aattcttctgaactc

SEQ ID NO: 3266667 - DNA, 18 bp, Homo sapiens
aattcttctgaactcaaa

SEQ ID NO: 3266668 - DNA, 13 bp, Homo sapiens
aattcttgaagtt

SEQ ID NO: 3266669 - DNA, 18 bp, Homo sapiens
aattcttgtaatttttat

SEQ ID NO: 3266670 - DNA, 17 bp, Homo sapiens
aattctttctattttca

SEQ ID NO: 3266671 - DNA, 23 bp, Homo sapiens
aattcttttatctttattttagt

SEQ ID NO: 3266672 - DNA, 14 bp, Homo sapiens
aattgaaaagtaca

SEQ ID NO: 3266673 - DNA, 17 bp, Homo sapiens
aattgaagtaaactttt

SEQ ID NO: 3266674 - DNA, 18 bp, Homo sapiens
aattgaagtaaacttttt

SEQ ID NO: 3266675 - DNA, 19 bp, Homo sapiens
aattgaatggtcagcgttg

SEQ ID NO: 3266676 - DNA, 17 bp, Homo sapiens
aattgaccctagccaga

SEQ ID NO: 3266677 - DNA, 21 bp, Homo sapiens
aattgaccctagccagagaat

SEQ ID NO: 3266678 - DNA, 24 bp, Homo sapiens
aattgacggttttttattattgtg

SEQ ID NO: 3266679 - DNA, 11 bp, Homo sapiens
aattgactacc

SEQ ID NO: 3266680 - DNA, 22 bp, Homo sapiens
aattgaggtttggaagagtgaa

SEQ ID NO: 3266681 - DNA, 16 bp, Homo sapiens
aattgagtaatggtgt

SEQ ID NO: 3266682 - DNA, 20 bp, Homo sapiens
aattgatgtatatgtttata

SEQ ID NO: 3266683 - DNA, 13 bp, Homo sapiens
aattgatttgcat

SEQ ID NO: 3266684 - DNA, 16 bp, Homo sapiens
aattgatttgcattga

SEQ ID NO: 3266685 - DNA, 20 bp, Homo sapiens
aattgatttgcattgaacac

SEQ ID NO: 3266686 - DNA, 19 bp, Homo sapiens
aattgatttttctcttcat

SEQ ID NO: 3266687 - DNA, 18 bp, Homo sapiens
aattgcaaatcttgaaat

SEQ ID NO: 3266688 - DNA, 15 bp, Homo sapiens
aattgcactgaagtt

SEQ ID NO: 3266689 - DNA, 20 bp, Homo sapiens
aattgcactgaagtttttga

SEQ ID NO: 3266690 - DNA, 15 bp, Homo sapiens
aattgcataaagcat

SEQ ID NO: 3266691 - DNA, 16 bp, Homo sapiens
aattgcatactttgta

SEQ ID NO: 3266692 - DNA, 14 bp, Homo sapiens
aattgcctgatttg

SEQ ID NO: 3266693 - DNA, 14 bp, Homo sapiens
aattgctcaagttc

SEQ ID NO: 3266694 - DNA, 18 bp, Homo sapiens
aattgctcataagcaata

SEQ ID NO: 3266695 - DNA, 19 bp, Homo sapiens
aattgctctgtgtatatct

SEQ ID NO: 3266696 - DNA, 20 bp, Homo sapiens
aattgctctgtgtatatctc

SEQ ID NO: 3266697 - DNA, 21 bp, Homo sapiens
aattgctgaagggcattcttt

SEQ ID NO: 3266698 - DNA, 19 bp, Homo sapiens
aattgcttactcattaaaa

SEQ ID NO: 3266699 - DNA, 21 bp, Homo sapiens
aattgcttactgatattatct

SEQ ID NO: 3266700 - DNA, 16 bp, Homo sapiens
aattgctttgccaaaa

SEQ ID NO: 3266701 - DNA, 16 bp, Homo sapiens
aattgcttttgttgtg

SEQ ID NO: 3266702 - DNA, 16 bp, Homo sapiens
aattggaaaagagtta

SEQ ID NO: 3266703 - DNA, 16 bp, Homo sapiens
aattggaacaaagtga

SEQ ID NO: 3266704 - DNA, 12 bp, Homo sapiens
aattggaatcaa

SEQ ID NO: 3266705 - DNA, 23 bp, Homo sapiens
aattggaatggaactactgtact

SEQ ID NO: 3266706 - DNA, 11 bp, Homo sapiens
aattggatttc

SEQ ID NO: 3266707 - DNA, 15 bp, Homo sapiens
aattggatttcctaa

SEQ ID NO: 3266708 - DNA, 16 bp, Homo sapiens
aattggcagtgacttt

SEQ ID NO: 3266709 - DNA, 17 bp, Homo sapiens
aattggcagtgactttg

SEQ ID NO: 3266710 - DNA, 20 bp, Homo sapiens
aattggcagtgactttgtat

SEQ ID NO: 3266711 - DNA, 20 bp, Homo sapiens
aattggtgataagtggaaaa

SEQ ID NO: 3266712 - DNA, 20 bp, Homo sapiens
aattggtgctatttgaagaa

SEQ ID NO: 3266713 - DNA, 21 bp, Homo sapiens
aattggtgctatttgaagaaa

SEQ ID NO: 3266714 - DNA, 13 bp, Homo sapiens
aattgtaaactgt

SEQ ID NO: 3266715 - DNA, 24 bp, Homo sapiens
aattgtaaattgaatcagtataaa

SEQ ID NO: 3266716 - DNA, 13 bp, Homo sapiens
aattgtaacctgc

SEQ ID NO: 3266717 - DNA, 19 bp, Homo sapiens
aattgtaacctgcattttt

SEQ ID NO: 3266718 - DNA, 12 bp, Homo sapiens
aattgtacaaaa

SEQ ID NO: 3266719 - DNA, 21 bp, Homo sapiens
aattgtagttctgtgtacttt

SEQ ID NO: 3266720 - DNA, 14 bp, Homo sapiens
aattgtatacattt

SEQ ID NO: 3266721 - DNA, 17 bp, Homo sapiens
aattgtatcagaggcct

SEQ ID NO: 3266722 - DNA, 16 bp, Homo sapiens
aaaattaagtagaaca

SEQ ID NO: 3266723 - DNA, 19 bp, Homo sapiens
aaaattaagtagaacaaaa

SEQ ID NO: 3266724 - DNA, 18 bp, Homo sapiens
aaaattacagatgtgaaa

SEQ ID NO: 3266725 - DNA, 16 bp, Homo sapiens
aaaattataaactttt

SEQ ID NO: 3266726 - DNA, 12 bp, Homo sapiens
aaaattatcagt

SEQ ID NO: 3266727 - DNA, 15 bp, Homo sapiens
aaaattatggaatat

SEQ ID NO: 3266728 - DNA, 20 bp, Homo sapiens
aaaattatggaatatcatct

SEQ ID NO: 3266729 - DNA, 17 bp, Homo sapiens
aaaattattttaaacaa

SEQ ID NO: 3266730 - DNA, 13 bp, Homo sapiens
aaaattattttgg

SEQ ID NO: 3266731 - DNA, 14 bp, Homo sapiens
aaaattcaaaaagt

SEQ ID NO: 3266732 - DNA, 17 bp, Homo sapiens
aaaattcagtttttgta

SEQ ID NO: 3266733 - DNA, 18 bp, Homo sapiens
aaaattcagtttttgtat

SEQ ID NO: 3266734 - DNA, 17 bp, Homo sapiens
aaaattccaaattcatg

SEQ ID NO: 3266735 - DNA, 12 bp, Homo sapiens
aaaattccagaa

SEQ ID NO: 3266736 - DNA, 16 bp, Homo sapiens
aaaattccagaaagga

SEQ ID NO: 3266737 - DNA, 16 bp, Homo sapiens
aaaattctagctgtat

SEQ ID NO: 3266738 - DNA, 20 bp, Homo sapiens
aaaattctcagtcagtaatt

SEQ ID NO: 3266739 - DNA, 15 bp, Homo sapiens
aatcagagtagaaat

SEQ ID NO: 3266740 - DNA, 18 bp, Homo sapiens
aatcagagtagaaataaa

SEQ ID NO: 3266741 - DNA, 18 bp, Homo sapiens
aatcagatgcctcagagg

SEQ ID NO: 3266742 - DNA, 13 bp, Homo sapiens
aatcagcactgaa

SEQ ID NO: 3266743 - DNA, 12 bp, Homo sapiens
aatcagcattct

SEQ ID NO: 3266744 - DNA, 12 bp, Homo sapiens
aatcagcctctt

SEQ ID NO: 3266745 - DNA, 23 bp, Homo sapiens
aatcagctatttactgccaaagg

SEQ ID NO: 3266746 - DNA, 21 bp, Homo sapiens
aatcagctccttttccgttct

SEQ ID NO: 3266747 - DNA, 23 bp, Homo sapiens
aatcagctccttttccgttctgt

SEQ ID NO: 3266748 - DNA, 24 bp, Homo sapiens
aatcaggaaagagattagaacatt

SEQ ID NO: 3266749 - DNA, 18 bp, Homo sapiens
aatcaggaatattttcca

SEQ ID NO: 3266750 - DNA, 22 bp, Homo sapiens
aatcaggcccctgttatgctta

SEQ ID NO: 3266751 - DNA, 13 bp, Homo sapiens
aatcagggaccag

SEQ ID NO: 3266752 - DNA, 14 bp, Homo sapiens
aatcagtaagaggt

SEQ ID NO: 3266753 - DNA, 15 bp, Homo sapiens
aatcagtataaacaa

SEQ ID NO: 3266754 - DNA, 21 bp, Homo sapiens
aatcagtatatttggtttcta

SEQ ID NO: 3266755 - DNA, 14 bp, Homo sapiens
aatcagtcccctcc

SEQ ID NO: 3266756 - DNA, 17 bp, Homo sapiens
aatcagtcccctcccat

SEQ ID NO: 3266757 - DNA, 18 bp, Homo sapiens
aatcagtgtgtctaaatt

SEQ ID NO: 3266758 - DNA, 18 bp, Homo sapiens
aatcatataataaatgta

SEQ ID NO: 3266759 - DNA, 18 bp, Homo sapiens
aatcatattgatgaaaag

SEQ ID NO: 3266760 - DNA, 19 bp, Homo sapiens
aatcatattgatgaaaaga

SEQ ID NO: 3266761 - DNA, 22 bp, Homo sapiens
aatcatatttgaaaaccatatt

SEQ ID NO: 3266762 - DNA, 22 bp, Homo sapiens
aatcatcaaaaagtaattataa

SEQ ID NO: 3266763 - DNA, 14 bp, Homo sapiens
aatcatcgaaaatt

SEQ ID NO: 3266764 - DNA, 18 bp, Homo sapiens
aatcatctataaagaaga

SEQ ID NO: 3266765 - DNA, 16 bp, Homo sapiens
aatcatctgcattcct

SEQ ID NO: 3266766 - DNA, 16 bp, Homo sapiens
aatcatgaaatatgca

SEQ ID NO: 3266767 - DNA, 17 bp, Homo sapiens
aatcatgaaatatgcat

SEQ ID NO: 3266768 - DNA, 15 bp, Homo sapiens
aatcatgaagagact

SEQ ID NO: 3266769 - DNA, 17 bp, Homo sapiens
aatcatgtatgttatga

SEQ ID NO: 3266770 - DNA, 19 bp, Homo sapiens
aatcatgtgggtgagccag

SEQ ID NO: 3266771 - DNA, 23 bp, Homo sapiens
aatcatgttgatcatgtactttt

SEQ ID NO: 3266772 - DNA, 12 bp, Homo sapiens
aatcattccagt

SEQ ID NO: 3266773 - DNA, 16 bp, Homo sapiens
aatcattccagtgcta

SEQ ID NO: 3266774 - DNA, 20 bp, Homo sapiens
aatcattccagtgctagaaa

SEQ ID NO: 3266775 - DNA, 14 bp, Homo sapiens
aatcattgaagtat

SEQ ID NO: 3266776 - DNA, 22 bp, Homo sapiens
aatcattgaagtatattcttat

SEQ ID NO: 3266777 - DNA, 23 bp, Homo sapiens
aatcattgaagtatattcttatt

SEQ ID NO: 3266778 - DNA, 19 bp, Homo sapiens
aatcattgctttgaagcag

SEQ ID NO: 3266779 - DNA, 21 bp, Homo sapiens
aatcattgctttgaagcagtt

SEQ ID NO: 3266780 - DNA, 23 bp, Homo sapiens
aatcattggcctggcaaaataaa

SEQ ID NO: 3266781 - DNA, 21 bp, Homo sapiens
aatcatttcagtatcatctcc

SEQ ID NO: 3266782 - DNA, 17 bp, Homo sapiens
aatcattttaattatta

SEQ ID NO: 3266783 - DNA, 19 bp, Homo sapiens
aatcattttaattattatt

SEQ ID NO: 3266784 - DNA, 13 bp, Homo sapiens
aatcattttcatt

SEQ ID NO: 3266785 - DNA, 17 bp, Homo sapiens
aatcattttcattccta

SEQ ID NO: 3266786 - DNA, 18 bp, Homo sapiens
aatcattttcattcctaa

SEQ ID NO: 3266787 - DNA, 20 bp, Homo sapiens
aatcatttttatattataac

SEQ ID NO: 3266788 - DNA, 20 bp, Homo sapiens
aatcatttttcactgtacat

SEQ ID NO: 3266789 - DNA, 14 bp, Homo sapiens
aatccaaacttgga

SEQ ID NO: 3266790 - DNA, 18 bp, Homo sapiens
aatccaaccattttcatt

SEQ ID NO: 3266791 - DNA, 16 bp, Homo sapiens
aatccaagattctgct

SEQ ID NO: 3266792 - DNA, 18 bp, Homo sapiens
aatccaagcctccacagc

SEQ ID NO: 3266793 - DNA, 23 bp, Homo sapiens
aatccaagcctccacagcgaggg

SEQ ID NO: 3266794 - DNA, 14 bp, Homo sapiens
aatccaagctccct

SEQ ID NO: 3266795 - DNA, 19 bp, Homo sapiens
aatccaagctccctgcccc

SEQ ID NO: 3266796 - DNA, 22 bp, Homo sapiens
aatccaataaaaacattttgaa

SEQ ID NO: 3266797 - DNA, 16 bp, Homo sapiens
aatccacatttctaaa

SEQ ID NO: 3266798 - DNA, 22 bp, Homo sapiens
aatccagaattgaccttttgac

SEQ ID NO: 3266799 - DNA, 12 bp, Homo sapiens
aatccagctccc

SEQ ID NO: 3266800 - DNA, 13 bp, Homo sapiens
aatccagtattgc

SEQ ID NO: 3266801 - DNA, 21 bp, Homo sapiens
aatccagtattgctgatttta

SEQ ID NO: 3266802 - DNA, 14 bp, Homo sapiens
aatccataaatgtg

SEQ ID NO: 3266803 - DNA, 17 bp, Homo sapiens
aatccatgttagttttt

SEQ ID NO: 3266804 - DNA, 22 bp, Homo sapiens
aatccatgttagtttttacttt

SEQ ID NO: 3266805 - DNA, 11 bp, Homo sapiens
aatcccaaatt

SEQ ID NO: 3266806 - DNA, 18 bp, Homo sapiens
aatcccaaatttgattga

SEQ ID NO: 3266807 - DNA, 18 bp, Homo sapiens
aatcccaatctttctata

SEQ ID NO: 3266808 - DNA, 22 bp, Homo sapiens
aatcccaatctttctatataaa

SEQ ID NO: 3266809 - DNA, 17 bp, Homo sapiens
aatcccacccacatgtg

SEQ ID NO: 3266810 - DNA, 18 bp, Homo sapiens
aatcccacccacatgtga

SEQ ID NO: 3266811 - DNA, 18 bp, Homo sapiens
aatcccacctagcccagg

SEQ ID NO: 3266812 - DNA, 19 bp, Homo sapiens
aatcccacctagcccagga

SEQ ID NO: 3266813 - DNA, 17 bp, Homo sapiens
aatcccagggctggctc

SEQ ID NO: 3266814 - DNA, 18 bp, Homo sapiens
aatcccctccttgggcac

SEQ ID NO: 3266815 - DNA, 19 bp, Homo sapiens
aatcccctccttgggcact

SEQ ID NO: 3266816 - DNA, 17 bp, Homo sapiens
aatccccttatgacttg

SEQ ID NO: 3266817 - DNA, 23 bp, Homo sapiens
aatccctgtttaatatttaaaca

SEQ ID NO: 3266818 - DNA, 13 bp, Homo sapiens
aatcccttaaaat

SEQ ID NO: 3266819 - DNA, 14 bp, Homo sapiens
aatcccttaaaatt

SEQ ID NO: 3266820 - DNA, 19 bp, Homo sapiens
aatccctttattaccccct

SEQ ID NO: 3266821 - DNA, 21 bp, Homo sapiens
aatccgaccactaattgccaa

SEQ ID NO: 3266822 - DNA, 15 bp, Homo sapiens
aatcctaaaagaagc

SEQ ID NO: 3266823 - DNA, 15 bp, Homo sapiens
aatcctaagacacaa

SEQ ID NO: 3266824 - DNA, 17 bp, Homo sapiens
aatcctaagacacaaat

SEQ ID NO: 3266825 - DNA, 19 bp, Homo sapiens
aatcctaatttctcctccc

SEQ ID NO: 3266826 - DNA, 21 bp, Homo sapiens
aatcctaatttctcctccctt

SEQ ID NO: 3266827 - DNA, 15 bp, Homo sapiens
aatcctacctgtttt

SEQ ID NO: 3266828 - DNA, 17 bp, Homo sapiens
aatcctacctgttttgt

SEQ ID NO: 3266829 - DNA, 21 bp, Homo sapiens
aatcctatctggggagctcct

SEQ ID NO: 3266830 - DNA, 15 bp, Homo sapiens
aatcctcactgggtg

SEQ ID NO: 3266831 - DNA, 9 bp, Homo sapiens
aatcctcct

SEQ ID NO: 3266832 - DNA, 12 bp, Homo sapiens
aatcctgtcttt

SEQ ID NO: 3266833 - DNA, 14 bp, Homo sapiens
aatcctgtttataa

SEQ ID NO: 3266834 - DNA, 21 bp, Homo sapiens
aatccttccaaaaattattat

SEQ ID NO: 3266835 - DNA, 20 bp, Homo sapiens
aatccttcctaaacccaatg

SEQ ID NO: 3266836 - DNA, 15 bp, Homo sapiens
aatccttctgcaact

SEQ ID NO: 3266837 - DNA, 17 bp, Homo sapiens
aatccttgataatatat

SEQ ID NO: 3266838 - DNA, 16 bp, Homo sapiens
aatcctttctgcccac

SEQ ID NO: 3266839 - DNA, 20 bp, Homo sapiens
aatcgagatttgggagctga

SEQ ID NO: 3266840 - DNA, 19 bp, Homo sapiens
aatcgagtgagacaaaatt

SEQ ID NO: 3266841 - DNA, 20 bp, Homo sapiens
aatcgagtgagacaaaattt

SEQ ID NO: 3266842 - DNA, 22 bp, Homo sapiens
aatcgcttatatgtccttgggt

SEQ ID NO: 3266843 - DNA, 20 bp, Homo sapiens
aatctaaaccttacatgtgt

SEQ ID NO: 3266844 - DNA, 17 bp, Homo sapiens
aatctaaatttcttttg

SEQ ID NO: 3266845 - DNA, 20 bp, Homo sapiens
aatctaaatttcttttgcta

SEQ ID NO: 3266846 - DNA, 20 bp, Homo sapiens
aatctaacaataatatttca

SEQ ID NO: 3266847 - DNA, 15 bp, Homo sapiens
aatctaagtgatata

SEQ ID NO: 3266848 - DNA, 18 bp, Homo sapiens
aatctaatatccccaaat

SEQ ID NO: 3266849 - DNA, 20 bp, Homo sapiens
aatctacaatctctttttgt

SEQ ID NO: 3266850 - DNA, 15 bp, Homo sapiens
aatctactaattcca

SEQ ID NO: 3266851 - DNA, 13 bp, Homo sapiens
aatctagacaata

SEQ ID NO: 3266852 - DNA, 21 bp, Homo sapiens
aatctagttttttttgtaaac

SEQ ID NO: 3266853 - DNA, 23 bp, Homo sapiens
aatctattacttttgcaaactgt

SEQ ID NO: 3266854 - DNA, 13 bp, Homo sapiens
aatctattctgtg

SEQ ID NO: 3266855 - DNA, 17 bp, Homo sapiens
aatctatttattaatat

SEQ ID NO: 3266856 - DNA, 21 bp, Homo sapiens
aatctatttattaatatttaa

SEQ ID NO: 3266857 - DNA, 14 bp, Homo sapiens
aatctcaaaattag

SEQ ID NO: 3266858 - DNA, 18 bp, Homo sapiens
aatctcaaaggagaaaaa

SEQ ID NO: 3266859 - DNA, 20 bp, Homo sapiens
aatctcaaaggagaaaaaaa

SEQ ID NO: 3266860 - DNA, 18 bp, Homo sapiens
aatgaatatctattaata

SEQ ID NO: 3266861 - DNA, 19 bp, Homo sapiens
aatgaatatctattaatat

SEQ ID NO: 3266862 - DNA, 13 bp, Homo sapiens
aatgaatattgaa

SEQ ID NO: 3266863 - DNA, 14 bp, Homo sapiens
aatgaatgtatatt

SEQ ID NO: 3266864 - DNA, 12 bp, Homo sapiens
aatgaatgtcta

SEQ ID NO: 3266865 - DNA, 23 bp, Homo sapiens
aatgaatgtttacactctttgta

SEQ ID NO: 3266866 - DNA, 18 bp, Homo sapiens
aatgaattataacagtta

SEQ ID NO: 3266867 - DNA, 19 bp, Homo sapiens
aatgaattataacagttat

SEQ ID NO: 3266868 - DNA, 19 bp, Homo sapiens
aatgacaaatgtattaatg

SEQ ID NO: 3266869 - DNA, 15 bp, Homo sapiens
aatgacaacacttaa

SEQ ID NO: 3266870 - DNA, 17 bp, Homo sapiens
aatgacaacagaaaaac

SEQ ID NO: 3266871 - DNA, 19 bp, Homo sapiens
aatgacaacagaaaaacaa

SEQ ID NO: 3266872 - DNA, 20 bp, Homo sapiens
aatgacaacagaaaaacaat

SEQ ID NO: 3266873 - DNA, 11 bp, Homo sapiens
acacagtgagt

SEQ ID NO: 3266874 - DNA, 20 bp, Homo sapiens
acacagtgggaactctgaca

SEQ ID NO: 3266875 - DNA, 15 bp, Homo sapiens
acacagttcctggga

SEQ ID NO: 3266876 - DNA, 13 bp, Homo sapiens
acacataaattat

SEQ ID NO: 3266877 - DNA, 16 bp, Homo sapiens
acacataactagaaac

SEQ ID NO: 3266878 - DNA, 13 bp, Homo sapiens
acacataagaaaa

SEQ ID NO: 3266879 - DNA, 17 bp, Homo sapiens
acacatacgtgcacagg

SEQ ID NO: 3266880 - DNA, 22 bp, Homo sapiens
acacatagattaatggcactga

SEQ ID NO: 3266881 - DNA, 22 bp, Homo sapiens
acacatagcaggggcaccttcc

SEQ ID NO: 3266882 - DNA, 16 bp, Homo sapiens
acacatagcgccgtgc

SEQ ID NO: 3266883 - DNA, 21 bp, Homo sapiens
acacatatacctataatgtgt

SEQ ID NO: 3266884 - DNA, 16 bp, Homo sapiens
acacatcaaataaact

SEQ ID NO: 3266885 - DNA, 21 bp, Homo sapiens
acacatcaagcttttctgtag

SEQ ID NO: 3266886 - DNA, 17 bp, Homo sapiens
acacatccctaatgtgt

SEQ ID NO: 3266887 - DNA, 16 bp, Homo sapiens
acacatccgccttttg

SEQ ID NO: 3266888 - DNA, 18 bp, Homo sapiens
acacatccgccttttgta

SEQ ID NO: 3266889 - DNA, 14 bp, Homo sapiens
acacatcttcccta

SEQ ID NO: 3266890 - DNA, 15 bp, Homo sapiens
acacatgcacacaca

SEQ ID NO: 3266891 - DNA, 18 bp, Homo sapiens
acacatgccctcctggac

SEQ ID NO: 3266892 - DNA, 22 bp, Homo sapiens
acacattgaatgcgctttattg

SEQ ID NO: 3266893 - DNA, 19 bp, Homo sapiens
acacatttgctactgttgt

SEQ ID NO: 3266894 - DNA, 20 bp, Homo sapiens
acacatttgctactgttgta

SEQ ID NO: 3266895 - DNA, 21 bp, Homo sapiens
acacatttgggatgttccttt

SEQ ID NO: 3266896 - DNA, 13 bp, Homo sapiens
acacatttgtaca

SEQ ID NO: 3266897 - DNA, 15 bp, Homo sapiens
acacatttgtacaga

SEQ ID NO: 3266898 - DNA, 14 bp, Homo sapiens
acaccaaagttcta

SEQ ID NO: 3266899 - DNA, 14 bp, Homo sapiens
acaccaaccagaca

SEQ ID NO: 3266900 - DNA, 12 bp, Homo sapiens
acaccaaggaag

SEQ ID NO: 3266901 - DNA, 14 bp, Homo sapiens
acaccaatcccagg

SEQ ID NO: 3266902 - DNA, 15 bp, Homo sapiens
acaccaatcccaggg

SEQ ID NO: 3266903 - DNA, 16 bp, Homo sapiens
acaccacacccagcct

SEQ ID NO: 3266904 - DNA, 17 bp, Homo sapiens
acaccacacccagcctc

SEQ ID NO: 3266905 - DNA, 12 bp, Homo sapiens
acaccacagaca

SEQ ID NO: 3266906 - DNA, 15 bp, Homo sapiens
acaccacagacacac

SEQ ID NO: 3266907 - DNA, 18 bp, Homo sapiens
acaccacctcactcctgt

SEQ ID NO: 3266908 - DNA, 11 bp, Homo sapiens
acaccactgcc

SEQ ID NO: 3266909 - DNA, 14 bp, Homo sapiens
acaccactgccctg

SEQ ID NO: 3266910 - DNA, 16 bp, Homo sapiens
acaccactgccctgcc

SEQ ID NO: 3266911 - DNA, 17 bp, Homo sapiens
acaccactgccctgcct

SEQ ID NO: 3266912 - DNA, 19 bp, Homo sapiens
acaccactgccctgcctgc

SEQ ID NO: 3266913 - DNA, 21 bp, Homo sapiens
acaccactgccctgcctgccc

SEQ ID NO: 3266914 - DNA, 22 bp, Homo sapiens
acaccactgccctgcctgccca

SEQ ID NO: 3266915 - DNA, 13 bp, Homo sapiens
acaccagagcaga

SEQ ID NO: 3266916 - DNA, 20 bp, Homo sapiens
acaccagagcagatgcagag

SEQ ID NO: 3266917 - DNA, 12 bp, Homo sapiens
acaccagagctg

SEQ ID NO: 3266918 - DNA, 13 bp, Homo sapiens
acaccagagctgc

SEQ ID NO: 3266919 - DNA, 13 bp, Homo sapiens
acaccagcccctg

SEQ ID NO: 3266920 - DNA, 15 bp, Homo sapiens
acaccagcccctgcc

SEQ ID NO: 3266921 - DNA, 15 bp, Homo sapiens
acaccatcttttatt

SEQ ID NO: 3266922 - DNA, 21 bp, Homo sapiens
acaccatcttttattcttttt

SEQ ID NO: 3266923 - DNA, 14 bp, Homo sapiens
acaccatcttttgt

SEQ ID NO: 3266924 - DNA, 20 bp, Homo sapiens
acaccattaccaaaataata

SEQ ID NO: 3266925 - DNA, 21 bp, Homo sapiens
acaccattaccaaaataataa

SEQ ID NO: 3266926 - DNA, 20 bp, Homo sapiens
acacccaaagaggtatttat

SEQ ID NO: 3266927 - DNA, 22 bp, Homo sapiens
acacccacaatcccacctagcc

SEQ ID NO: 3266928 - DNA, 17 bp, Homo sapiens
acacccaccgtccgccc

SEQ ID NO: 3266929 - DNA, 21 bp, Homo sapiens
acacccaccgtccgccctgct

SEQ ID NO: 3266930 - DNA, 22 bp, Homo sapiens
acacccaccgtccgccctgctc

SEQ ID NO: 3266931 - DNA, 13 bp, Homo sapiens
acacccagcccac

SEQ ID NO: 3266932 - DNA, 19 bp, Homo sapiens
acacccagcccacttctgc

SEQ ID NO: 3266933 - DNA, 12 bp, Homo sapiens
acacccagcctc

SEQ ID NO: 3266934 - DNA, 20 bp, Homo sapiens
acacccagcctcagtcctcc

SEQ ID NO: 3266935 - DNA, 15 bp, Homo sapiens
acacccagttctgaa

SEQ ID NO: 3266936 - DNA, 11 bp, Homo sapiens
acaccccagcc

SEQ ID NO: 3266937 - DNA, 13 bp, Homo sapiens
acaccccagccca

SEQ ID NO: 3266938 - DNA, 20 bp, Homo sapiens
acaccccattggtggactac

SEQ ID NO: 3266939 - DNA, 19 bp, Homo sapiens
acacccccatccctcggga

SEQ ID NO: 3266940 - DNA, 19 bp, Homo sapiens
acaccctcactctgccagg

SEQ ID NO: 3266941 - DNA, 20 bp, Homo sapiens
acaccctcactctgccaggg

SEQ ID NO: 3266942 - DNA, 20 bp, Homo sapiens
acaccctcggggggtcacag

SEQ ID NO: 3266943 - DNA, 22 bp, Homo sapiens
acaccctcggggggtcacaggc

SEQ ID NO: 3266944 - DNA, 11 bp, Homo sapiens
acaccctggcc

SEQ ID NO: 3266945 - DNA, 12 bp, Homo sapiens
acaccctggcct

SEQ ID NO: 3266946 - DNA, 13 bp, Homo sapiens
acaccctggcctg

SEQ ID NO: 3266947 - DNA, 17 bp, Homo sapiens
acaccctggcctgaact

SEQ ID NO: 3266948 - DNA, 13 bp, Homo sapiens
acaccctgtactg

SEQ ID NO: 3266949 - DNA, 13 bp, Homo sapiens
acacccttagaaa

SEQ ID NO: 3266950 - DNA, 20 bp, Homo sapiens
acacccttcacataccctcc

SEQ ID NO: 3266951 - DNA, 16 bp, Homo sapiens
acaccctttcatctca

SEQ ID NO: 3266952 - DNA, 20 bp, Homo sapiens
acaccggctggcagggctgg

SEQ ID NO: 3266953 - DNA, 19 bp, Homo sapiens
acaccggggtggtgggaac

SEQ ID NO: 3266954 - DNA, 18 bp, Homo sapiens
acaccgttcattcaggca

SEQ ID NO: 3266955 - DNA, 21 bp, Homo sapiens
acacctaaaggtgtatttaaa

SEQ ID NO: 3266956 - DNA, 18 bp, Homo sapiens
acacctaccatgctgctt

SEQ ID NO: 3266957 - DNA, 21 bp, Homo sapiens
acacctagctttattcttcag

SEQ ID NO: 3266958 - DNA, 22 bp, Homo sapiens
acacctagctttattcttcaga

SEQ ID NO: 3266959 - DNA, 15 bp, Homo sapiens
acacctcacttttga

SEQ ID NO: 3266960 - DNA, 22 bp, Homo sapiens
acacctcagttcccttggcctc

SEQ ID NO: 3266961 - DNA, 23 bp, Homo sapiens
acacctcagttcccttggcctca

SEQ ID NO: 3266962 - DNA, 20 bp, Homo sapiens
acacctccacagttcagtgg

SEQ ID NO: 3266963 - DNA, 12 bp, Homo sapiens
acacctcccagg

SEQ ID NO: 3266964 - DNA, 19 bp, Homo sapiens
acacctcccaggagacagt

SEQ ID NO: 3266965 - DNA, 22 bp, Homo sapiens
acacctccgagacagtccagtg

SEQ ID NO: 3266966 - DNA, 20 bp, Homo sapiens
acacctgcaatcccagcacc

SEQ ID NO: 3266967 - DNA, 14 bp, Homo sapiens
acacctgccctgcc

SEQ ID NO: 3266968 - DNA, 19 bp, Homo sapiens
acacctggccttaaagagg

SEQ ID NO: 3266969 - DNA, 19 bp, Homo sapiens
acacctggctgaggttcct

SEQ ID NO: 3266970 - DNA, 20 bp, Homo sapiens
acacctgtagcacttactgg

SEQ ID NO: 3266971 - DNA, 16 bp, Homo sapiens
acacctgttcacagaa

SEQ ID NO: 3266972 - DNA, 14 bp, Homo sapiens
acaccttccagctc

SEQ ID NO: 3266973 - DNA, 16 bp, Homo sapiens
acaccttccagctcct

SEQ ID NO: 3266974 - DNA, 17 bp, Homo sapiens
acaccttccagggccct

SEQ ID NO: 3266975 - DNA, 20 bp, Homo sapiens
acaccttcctcctgcagaca

SEQ ID NO: 3266976 - DNA, 21 bp, Homo sapiens
acaccttgtgaccttctctat

SEQ ID NO: 3266977 - DNA, 17 bp, Homo sapiens
acaccttttaactcacc

SEQ ID NO: 3266978 - DNA, 14 bp, Homo sapiens
acacgaaacttgtt

SEQ ID NO: 3266979 - DNA, 23 bp, Homo sapiens
acacgaaacttgttattgtgaat

SEQ ID NO: 3266980 - DNA, 22 bp, Homo sapiens
acacgaccggggccagcaccac

SEQ ID NO: 3266981 - DNA, 20 bp, Homo sapiens
acacgatgcatttaataaag

SEQ ID NO: 3266982 - DNA, 21 bp, Homo sapiens
acacgatgcatttaataaaga

SEQ ID NO: 3266983 - DNA, 14 bp, Homo sapiens
acacgattagcttt

SEQ ID NO: 3266984 - DNA, 15 bp, Homo sapiens
acacgattagcttta

SEQ ID NO: 3266985 - DNA, 22 bp, Homo sapiens
acacgcaagggcatcaggcact

SEQ ID NO: 3266986 - DNA, 20 bp, Homo sapiens
acacgcacgcacacacacaa

SEQ ID NO: 3266987 - DNA, 14 bp, Homo sapiens
acacgcgctctcca

SEQ ID NO: 3266988 - DNA, 22 bp, Homo sapiens
acacgctcgcgggcagcgggcc

SEQ ID NO: 3266989 - DNA, 16 bp, Homo sapiens
acacgtacttaaatga

SEQ ID NO: 3266990 - DNA, 23 bp, Homo sapiens
acacgtacttaaatgaaagcatg

SEQ ID NO: 3266991 - DNA, 16 bp, Homo sapiens
acacgtggcctgcacc

SEQ ID NO: 3266992 - DNA, 22 bp, Homo sapiens
acacgtgtgcacatgcgcactc

SEQ ID NO: 3266993 - DNA, 15 bp, Homo sapiens
acactaaccacgctg

SEQ ID NO: 3266994 - DNA, 16 bp, Homo sapiens
acactaaccacgctgg

SEQ ID NO: 3266995 - DNA, 20 bp, Homo sapiens
acactaaccacgctggacct

SEQ ID NO: 3266996 - DNA, 17 bp, Homo sapiens
acactaactcaccagcc

SEQ ID NO: 3266997 - DNA, 19 bp, Homo sapiens
acactaactcaccagcccc

SEQ ID NO: 3266998 - DNA, 19 bp, Homo sapiens
acactaagttatagtatat

SEQ ID NO: 3266999 - DNA, 13 bp, Homo sapiens
acactaattcata

SEQ ID NO: 3267000 - DNA, 17 bp, Homo sapiens
acactaattcctttcta

SEQ ID NO: 3267001 - DNA, 14 bp, Homo sapiens
acactacattagaa

SEQ ID NO: 3267002 - DNA, 18 bp, Homo sapiens
acaagagcagcctgtggc

SEQ ID NO: 3267003 - DNA, 13 bp, Homo sapiens
acaagagcccagc

SEQ ID NO: 3267004 - DNA, 23 bp, Homo sapiens
acaagaggttaaggtgggtccag

SEQ ID NO: 3267005 - DNA, 18 bp, Homo sapiens
acaagagtttatttccaa

SEQ ID NO: 3267006 - DNA, 14 bp, Homo sapiens
acaagatccatttg

SEQ ID NO: 3267007 - DNA, 15 bp, Homo sapiens
acaagatccatttgc

SEQ ID NO: 3267008 - DNA, 20 bp, Homo sapiens
acaagatccatttgcctttc

SEQ ID NO: 3267009 - DNA, 21 bp, Homo sapiens
acaagatccatttgcctttct

SEQ ID NO: 3267010 - DNA, 13 bp, Homo sapiens
acaagatctttca

SEQ ID NO: 3267011 - DNA, 14 bp, Homo sapiens
acaagatctttcag

SEQ ID NO: 3267012 - DNA, 14 bp, Homo sapiens
acaagatttagaaa

SEQ ID NO: 3267013 - DNA, 16 bp, Homo sapiens
acaagatttagaaaaa

SEQ ID NO: 3267014 - DNA, 12 bp, Homo sapiens
acaagatttcct

SEQ ID NO: 3267015 - DNA, 18 bp, Homo sapiens
acaagatttccttgtgca

SEQ ID NO: 3267016 - DNA, 18 bp, Homo sapiens
acaagatttgtaattaca

SEQ ID NO: 3267017 - DNA, 14 bp, Homo sapiens
acaagcaatgcaag

SEQ ID NO: 3267018 - DNA, 21 bp, Homo sapiens
acaagcactattttatattta

SEQ ID NO: 3267019 - DNA, 13 bp, Homo sapiens
acaagcagccctt

SEQ ID NO: 3267020 - DNA, 14 bp, Homo sapiens
acaagcagcccttg

SEQ ID NO: 3267021 - DNA, 13 bp, Homo sapiens
acaagcccacagc

SEQ ID NO: 3267022 - DNA, 18 bp, Homo sapiens
acaagccctgcttttgca

SEQ ID NO: 3267023 - DNA, 20 bp, Homo sapiens
acaagccctgcttttgcata

SEQ ID NO: 3267024 - DNA, 14 bp, Homo sapiens
acaagcctcctgta

SEQ ID NO: 3267025 - DNA, 13 bp, Homo sapiens
acaagcctgagaa

SEQ ID NO: 3267026 - DNA, 14 bp, Homo sapiens
acaagcgctcccag

SEQ ID NO: 3267027 - DNA, 16 bp, Homo sapiens
acaagcgctcccagcc

SEQ ID NO: 3267028 - DNA, 17 bp, Homo sapiens
acaagcgctcccagcct

SEQ ID NO: 3267029 - DNA, 19 bp, Homo sapiens
acaagcgctcccagcctgc

SEQ ID NO: 3267030 - DNA, 20 bp, Homo sapiens
acaagcgctcccagcctgcc

SEQ ID NO: 3267031 - DNA, 20 bp, Homo sapiens
acaagcgtgagccactgcac

SEQ ID NO: 3267032 - DNA, 21 bp, Homo sapiens
acaagcgtgagccactgcacc

SEQ ID NO: 3267033 - DNA, 14 bp, Homo sapiens
acaagctaaaatta

SEQ ID NO: 3267034 - DNA, 13 bp, Homo sapiens
acaagctgtccct

SEQ ID NO: 3267035 - DNA, 12 bp, Homo sapiens
acaagctgtgca

SEQ ID NO: 3267036 - DNA, 22 bp, Homo sapiens
acaaggaaatacccttctttta

SEQ ID NO: 3267037 - DNA, 15 bp, Homo sapiens
acaaggagctcaccc

SEQ ID NO: 3267038 - DNA, 19 bp, Homo sapiens
acaaggagctcaccctgcc

SEQ ID NO: 3267039 - DNA, 13 bp, Homo sapiens
acaaggattgaaa

SEQ ID NO: 3267040 - DNA, 16 bp, Homo sapiens
acaaggattgctactg

SEQ ID NO: 3267041 - DNA, 18 bp, Homo sapiens
acaagggagagacctcat

SEQ ID NO: 3267042 - DNA, 14 bp, Homo sapiens
acaaggtccactcc

SEQ ID NO: 3267043 - DNA, 18 bp, Homo sapiens
acaaggttcttctaaaat

SEQ ID NO: 3267044 - DNA, 15 bp, Homo sapiens
acaagtaagaaaaat

SEQ ID NO: 3267045 - DNA, 13 bp, Homo sapiens
acaagtaatgtat

SEQ ID NO: 3267046 - DNA, 16 bp, Homo sapiens
acaagtaatttcagtg

SEQ ID NO: 3267047 - DNA, 22 bp, Homo sapiens
acaagtatatacttttaaatta

SEQ ID NO: 3267048 - DNA, 21 bp, Homo sapiens
acaagtatgaataaagacacc

SEQ ID NO: 3267049 - DNA, 15 bp, Homo sapiens
acaagtattttatat

SEQ ID NO: 3267050 - DNA, 16 bp, Homo sapiens
acaagtcacagctgca

SEQ ID NO: 3267051 - DNA, 18 bp, Homo sapiens
acaagtcacagctgcagc

SEQ ID NO: 3267052 - DNA, 19 bp, Homo sapiens
acaagtcacagctgcagct

SEQ ID NO: 3267053 - DNA, 22 bp, Homo sapiens
acaagtcagctccagctttctg

SEQ ID NO: 3267054 - DNA, 15 bp, Homo sapiens
acaagtcctgtgaat

SEQ ID NO: 3267055 - DNA, 22 bp, Homo sapiens
acaagtgaagaacactactgct

SEQ ID NO: 3267056 - DNA, 12 bp, Homo sapiens
acaagtgccact

SEQ ID NO: 3267057 - DNA, 14 bp, Homo sapiens
acaagtgcctcctg

SEQ ID NO: 3267058 - DNA, 14 bp, Homo sapiens
acaagtgctgaaca

SEQ ID NO: 3267059 - DNA, 18 bp, Homo sapiens
acaagtgtatatcagaaa

SEQ ID NO: 3267060 - DNA, 13 bp, Homo sapiens
acaagttccatgg

SEQ ID NO: 3267061 - DNA, 22 bp, Homo sapiens
acaagttgcgacggagagaaaa

SEQ ID NO: 3267062 - DNA, 13 bp, Homo sapiens
acaagttgttatt

SEQ ID NO: 3267063 - DNA, 12 bp, Homo sapiens
acaagtttcaga

SEQ ID NO: 3267064 - DNA, 17 bp, Homo sapiens
acaagtttcagacaggg

SEQ ID NO: 3267065 - DNA, 15 bp, Homo sapiens
acaagttttaatgta

SEQ ID NO: 3267066 - DNA, 16 bp, Homo sapiens
acaagtttttctgtca

SEQ ID NO: 3267067 - DNA, 13 bp, Homo sapiens
acaataaaagctt

SEQ ID NO: 3267068 - DNA, 14 bp, Homo sapiens
acaataaaattttt

SEQ ID NO: 3267069 - DNA, 10 bp, Homo sapiens
acaataaact

SEQ ID NO: 3267070 - DNA, 14 bp, Homo sapiens
acaataaataatct

SEQ ID NO: 3267071 - DNA, 20 bp, Homo sapiens
acaataaatgtattcaaata

SEQ ID NO: 3267072 - DNA, 21 bp, Homo sapiens
acaataacactaaaattttag

SEQ ID NO: 3267073 - DNA, 18 bp, Homo sapiens
acaataacccagttactt

SEQ ID NO: 3267074 - DNA, 22 bp, Homo sapiens
acaataactactgtgttcctgg

SEQ ID NO: 3267075 - DNA, 23 bp, Homo sapiens
acaataatattgttgtataattt

SEQ ID NO: 3267076 - DNA, 20 bp, Homo sapiens
acaaaccacaactgacacag

SEQ ID NO: 3267077 - DNA, 23 bp, Homo sapiens
acaaaccacaactgacacaggaa

SEQ ID NO: 3267078 - DNA, 19 bp, Homo sapiens
acaaaccttaaaacagctg

SEQ ID NO: 3267079 - DNA, 21 bp, Homo sapiens
acaaactacagacctgctttt

SEQ ID NO: 3267080 - DNA, 14 bp, Homo sapiens
acaaactagaaaag

SEQ ID NO: 3267081 - DNA, 14 bp, Homo sapiens
acaaactgcaatag

SEQ ID NO: 3267082 - DNA, 16 bp, Homo sapiens
acaaactgtgtacata

SEQ ID NO: 3267083 - DNA, 21 bp, Homo sapiens
acaaactttagggtaaaaatt

SEQ ID NO: 3267084 - DNA, 22 bp, Homo sapiens
acaaactttagggtaaaaattg

SEQ ID NO: 3267085 - DNA, 13 bp, Homo sapiens
acaaacttttata

SEQ ID NO: 3267086 - DNA, 20 bp, Homo sapiens
acaaagaaacaaagatgtta

SEQ ID NO: 3267087 - DNA, 23 bp, Homo sapiens
acaaagaaccatgcaggaaggaa

SEQ ID NO: 3267088 - DNA, 17 bp, Homo sapiens
acaaagactcctctggg

SEQ ID NO: 3267089 - DNA, 23 bp, Homo sapiens
acaaagatgtttgtcagatatga

SEQ ID NO: 3267090 - DNA, 16 bp, Homo sapiens
acaaagattgagaagc

SEQ ID NO: 3267091 - DNA, 13 bp, Homo sapiens
acaaagattttct

SEQ ID NO: 3267092 - DNA, 16 bp, Homo sapiens
acaaagattttctaag

SEQ ID NO: 3267093 - DNA, 17 bp, Homo sapiens
acaaagattttctaagg

SEQ ID NO: 3267094 - DNA, 15 bp, Homo sapiens
acaaagcactagaga

SEQ ID NO: 3267095 - DNA, 17 bp, Homo sapiens
acaaagccaaacaaaac

SEQ ID NO: 3267096 - DNA, 18 bp, Homo sapiens
acaaagcgtttctttact

SEQ ID NO: 3267097 - DNA, 23 bp, Homo sapiens
acaaagctgctaaatctcctatt

SEQ ID NO: 3267098 - DNA, 20 bp, Homo sapiens
acaaagctgttaaactgtta

SEQ ID NO: 3267099 - DNA, 22 bp, Homo sapiens
acaaagcttctatcccaggagg

SEQ ID NO: 3267100 - DNA, 14 bp, Homo sapiens
acaaagctttgcta

SEQ ID NO: 3267101 - DNA, 22 bp, Homo sapiens
acaaaggatgaagaacacagca

SEQ ID NO: 3267102 - DNA, 19 bp, Homo sapiens
acaaaggtggaataaacat

SEQ ID NO: 3267103 - DNA, 22 bp, Homo sapiens
acaaaggtggaataaacattaa

SEQ ID NO: 3267104 - DNA, 21 bp, Homo sapiens
acaaagtaaatacaagactgt

SEQ ID NO: 3267105 - DNA, 22 bp, Homo sapiens
acaaagtaaatacaagactgtt

SEQ ID NO: 3267106 - DNA, 14 bp, Homo sapiens
acaaagtaattcct

SEQ ID NO: 3267107 - DNA, 21 bp, Homo sapiens
acaaagtgactgtttggctta

SEQ ID NO: 3267108 - DNA, 21 bp, Homo sapiens
acaaagttactaggtaacttc

SEQ ID NO: 3267109 - DNA, 19 bp, Homo sapiens
acaaagtttcagagtatat

SEQ ID NO: 3267110 - DNA, 15 bp, Homo sapiens
acaaataaataaata

SEQ ID NO: 3267111 - DNA, 12 bp, Homo sapiens
acaaataatcac

SEQ ID NO: 3267112 - DNA, 12 bp, Homo sapiens
acaaatacctcc

SEQ ID NO: 3267113 - DNA, 15 bp, Homo sapiens
acaaatagaaaatgg

SEQ ID NO: 3267114 - DNA, 16 bp, Homo sapiens
acaaatagaaaatggt

SEQ ID NO: 3267115 - DNA, 13 bp, Homo sapiens
acaaatagatgat

SEQ ID NO: 3267116 - DNA, 15 bp, Homo sapiens
acaaatataaatctt

SEQ ID NO: 3267117 - DNA, 15 bp, Homo sapiens
acaaatatattgtta

SEQ ID NO: 3267118 - DNA, 21 bp, Homo sapiens
acaaatatggctagttttcaa

SEQ ID NO: 3267119 - DNA, 19 bp, Homo sapiens
acaaatattcactggcccc

SEQ ID NO: 3267120 - DNA, 19 bp, Homo sapiens
acaaatattttagaagcta

SEQ ID NO: 3267121 - DNA, 15 bp, Homo sapiens
acaaatattttcatg

SEQ ID NO: 3267122 - DNA, 16 bp, Homo sapiens
acaaatcaaattgctt

SEQ ID NO: 3267123 - DNA, 19 bp, Homo sapiens
acaaatcaaattgcttaaa

SEQ ID NO: 3267124 - DNA, 15 bp, Homo sapiens
acaaatcagaagtca

SEQ ID NO: 3267125 - DNA, 16 bp, Homo sapiens
acaaatcagaagtcat

SEQ ID NO: 3267126 - DNA, 23 bp, Homo sapiens
acaaatcagaagtcatcttgcta

SEQ ID NO: 3267127 - DNA, 17 bp, Homo sapiens
acaaatcagttagtttt

SEQ ID NO: 3267128 - DNA, 17 bp, Homo sapiens
acaaatctaatctctta

SEQ ID NO: 3267129 - DNA, 19 bp, Homo sapiens
acaaatctgtgtatattat

SEQ ID NO: 3267130 - DNA, 17 bp, Homo sapiens
acaaatgcatgaacaag

SEQ ID NO: 3267131 - DNA, 18 bp, Homo sapiens
acaaatgcatgaacaagt

SEQ ID NO: 3267132 - DNA, 17 bp, Homo sapiens
acaaatggtgaatggat

SEQ ID NO: 3267133 - DNA, 17 bp, Homo sapiens
acaaatgtaagcaaagg

SEQ ID NO: 3267134 - DNA, 21 bp, Homo sapiens
acaaatgtattttgaagaata

SEQ ID NO: 3267135 - DNA, 19 bp, Homo sapiens
acaaatgtgatttttgtaa

SEQ ID NO: 3267136 - DNA, 15 bp, Homo sapiens
acaaatgtgtatgtg

SEQ ID NO: 3267137 - DNA, 14 bp, Homo sapiens
acaaattatttttg

SEQ ID NO: 3267138 - DNA, 17 bp, Homo sapiens
acaaattgaaaacacac

SEQ ID NO: 3267139 - DNA, 13 bp, Homo sapiens
acaaatttatgca

SEQ ID NO: 3267140 - DNA, 18 bp, Homo sapiens
acaaatttatgcatttca

SEQ ID NO: 3267141 - DNA, 22 bp, Homo sapiens
acaaatttatgcatttcattca

SEQ ID NO: 3267142 - DNA, 12 bp, Homo sapiens
acaaattttcaa

SEQ ID NO: 3267143 - DNA, 19 bp, Homo sapiens
acaaattttcaagtttaca

SEQ ID NO: 3267144 - DNA, 23 bp, Homo sapiens
acaacaaactgaattaaacatga

SEQ ID NO: 3267145 - DNA, 12 bp, Homo sapiens
acaacactcaca

SEQ ID NO: 3267146 - DNA, 16 bp, Homo sapiens
acaacacttcattttc

SEQ ID NO: 3267147 - DNA, 18 bp, Homo sapiens
acaacacttcattttcag

SEQ ID NO: 3267148 - DNA, 16 bp, Homo sapiens
acaacagaataaagca

SEQ ID NO: 3267149 - DNA, 18 bp, Homo sapiens
acaacagcaaaccctgat

SEQ ID NO: 3267150 - DNA, 14 bp, Homo sapiens
acaacagcagatgg

SEQ ID NO: 3267151 - DNA, 13 bp, Homo sapiens
acaacagcagtct

SEQ ID NO: 3267152 - DNA, 12 bp, Homo sapiens
acaacagcccag

SEQ ID NO: 3267153 - DNA, 22 bp, Homo sapiens
acaacagctcgatccaaattgt

SEQ ID NO: 3267154 - DNA, 18 bp, Homo sapiens
acaacagttctcttctag

SEQ ID NO: 3267155 - DNA, 22 bp, Homo sapiens
acaacatagcagatctgttttg

SEQ ID NO: 3267156 - DNA, 16 bp, Homo sapiens
acaacatccatgtcct

SEQ ID NO: 3267157 - DNA, 22 bp, Homo sapiens
acaacatccatgtcctatgtgt

SEQ ID NO: 3267158 - DNA, 23 bp, Homo sapiens
acaacatccatgtcctatgtgtg

SEQ ID NO: 3267159 - DNA, 21 bp, Homo sapiens
acaacatcgcaatagtttttt

SEQ ID NO: 3267160 - DNA, 17 bp, Homo sapiens
acaacatttatatgtag

SEQ ID NO: 3267161 - DNA, 21 bp, Homo sapiens
acaaccaagcgcatccaatct

SEQ ID NO: 3267162 - DNA, 17 bp, Homo sapiens
acaaccatccctgccac

SEQ ID NO: 3267163 - DNA, 14 bp, Homo sapiens
acaaccattccaga

SEQ ID NO: 3267164 - DNA, 21 bp, Homo sapiens
acaacccacaccgtcttcctt

SEQ ID NO: 3267165 - DNA, 23 bp, Homo sapiens
acaacccctgatgtttgaagagt

SEQ ID NO: 3267166 - DNA, 17 bp, Homo sapiens
acaaccctgttttatac

SEQ ID NO: 3267167 - DNA, 18 bp, Homo sapiens
acaaccctgttttatact

SEQ ID NO: 3267168 - DNA, 16 bp, Homo sapiens
acaacctcaactgcct

SEQ ID NO: 3267169 - DNA, 16 bp, Homo sapiens
acaacctctctgatct

SEQ ID NO: 3267170 - DNA, 14 bp, Homo sapiens
acaacctgaaagac

SEQ ID NO: 3267171 - DNA, 23 bp, Homo sapiens
acaacctgtgtgagagaatttat

SEQ ID NO: 3267172 - DNA, 18 bp, Homo sapiens
acaaccttcggctccggg

SEQ ID NO: 3267173 - DNA, 22 bp, Homo sapiens
acaacgatgaatttcttctaat

SEQ ID NO: 3267174 - DNA, 18 bp, Homo sapiens
acaacgtaaaaataaaag

SEQ ID NO: 3267175 - DNA, 18 bp, Homo sapiens
acaactagatttgtcctt

SEQ ID NO: 3267176 - DNA, 16 bp, Homo sapiens
acaactaggcttcagc

SEQ ID NO: 3267177 - DNA, 18 bp, Homo sapiens
acaactatcctgacttct

SEQ ID NO: 3267178 - DNA, 16 bp, Homo sapiens
acaactatttttccaa

SEQ ID NO: 3267179 - DNA, 14 bp, Homo sapiens
acaactatttttgt

SEQ ID NO: 3267180 - DNA, 21 bp, Homo sapiens
acaactgcctcgaaacacaga

SEQ ID NO: 3267181 - DNA, 13 bp, Homo sapiens
acaactgtgactg

SEQ ID NO: 3267182 - DNA, 14 bp, Homo sapiens
acaactgtgactgt

SEQ ID NO: 3267183 - DNA, 13 bp, Homo sapiens
acaactgttcccg

SEQ ID NO: 3267184 - DNA, 18 bp, Homo sapiens
acaacttatttaaaaata

SEQ ID NO: 3267185 - DNA, 20 bp, Homo sapiens
acaacttatttaaaaatatt

SEQ ID NO: 3267186 - DNA, 13 bp, Homo sapiens
acaacttggcatt

SEQ ID NO: 3267187 - DNA, 14 bp, Homo sapiens
acaacttgggttct

SEQ ID NO: 3267188 - DNA, 15 bp, Homo sapiens
acaacttgtatttcc

SEQ ID NO: 3267189 - DNA, 16 bp, Homo sapiens
acaactttctcttgta

SEQ ID NO: 3267190 - DNA, 18 bp, Homo sapiens
acaactttctcttgtaaa

SEQ ID NO: 3267191 - DNA, 23 bp, Homo sapiens
acaactttgtcgtggttcttaaa

SEQ ID NO: 3267192 - DNA, 17 bp, Homo sapiens
acaacttttaaagaaaa

SEQ ID NO: 3267193 - DNA, 20 bp, Homo sapiens
acaacttttaaccaaacaat

SEQ ID NO: 3267194 - DNA, 16 bp, Homo sapiens
acaagaaaaagataag

SEQ ID NO: 3267195 - DNA, 16 bp, Homo sapiens
acaagaaatccctgtt

SEQ ID NO: 3267196 - DNA, 17 bp, Homo sapiens
acaagaaccatttgcaa

SEQ ID NO: 3267197 - DNA, 20 bp, Homo sapiens
acaagaagccacagacctag

SEQ ID NO: 3267198 - DNA, 14 bp, Homo sapiens
acaagaagtttatt

SEQ ID NO: 3267199 - DNA, 23 bp, Homo sapiens
acaagaatggatcacaagatgga

SEQ ID NO: 3267200 - DNA, 15 bp, Homo sapiens
acaagacccccagca

SEQ ID NO: 3267201 - DNA, 13 bp, Homo sapiens
acaagactgttgt

SEQ ID NO: 3267202 - DNA, 16 bp, Homo sapiens
acaagactgttgtgat

SEQ ID NO: 3267203 - DNA, 21 bp, Homo sapiens
acaagagcactacattcattt

SEQ ID NO: 3267204 - DNA, 16 bp, Homo sapiens
acaagagcagcctgtg

SEQ ID NO: 3267205 - DNA, 20 bp, Homo sapiens
aattgtatcagaggcctata

SEQ ID NO: 3267206 - DNA, 22 bp, Homo sapiens
aattgtatctcatactgtctgg

SEQ ID NO: 3267207 - DNA, 18 bp, Homo sapiens
aattgtatgaaaatcctt

SEQ ID NO: 3267208 - DNA, 16 bp, Homo sapiens
aattgtcacctctgtt

SEQ ID NO: 3267209 - DNA, 23 bp, Homo sapiens
aattgtcatggttacaaactaca

SEQ ID NO: 3267210 - DNA, 19 bp, Homo sapiens
aattgtcattatttttgtt

SEQ ID NO: 3267211 - DNA, 23 bp, Homo sapiens
aattgtcgaaaagagtcttccaa

SEQ ID NO: 3267212 - DNA, 17 bp, Homo sapiens
aattgtctaaaatgtca

SEQ ID NO: 3267213 - DNA, 18 bp, Homo sapiens
aattgtctaaaatgtcag

SEQ ID NO: 3267214 - DNA, 12 bp, Homo sapiens
aattgtctattt

SEQ ID NO: 3267215 - DNA, 18 bp, Homo sapiens
aattgtctatttatcttt

SEQ ID NO: 3267216 - DNA, 15 bp, Homo sapiens
aattgtctttaaaaa

SEQ ID NO: 3267217 - DNA, 19 bp, Homo sapiens
aattgtctttaatttctgt

SEQ ID NO: 3267218 - DNA, 17 bp, Homo sapiens
aattgtcttttagacaa

SEQ ID NO: 3267219 - DNA, 15 bp, Homo sapiens
aattgtgaactcatt

SEQ ID NO: 3267220 - DNA, 12 bp, Homo sapiens
aattgtgcttct

SEQ ID NO: 3267221 - DNA, 13 bp, Homo sapiens
aattgtgcttctc

SEQ ID NO: 3267222 - DNA, 15 bp, Homo sapiens
aattgtggattataa

SEQ ID NO: 3267223 - DNA, 17 bp, Homo sapiens
aattgtggattataaaa

SEQ ID NO: 3267224 - DNA, 18 bp, Homo sapiens
aattgtgggcataaactg

SEQ ID NO: 3267225 - DNA, 21 bp, Homo sapiens
aattgtgtagcctttttgtat

SEQ ID NO: 3267226 - DNA, 15 bp, Homo sapiens
aattgtgtggattct

SEQ ID NO: 3267227 - DNA, 16 bp, Homo sapiens
aattgttaatgtgatg

SEQ ID NO: 3267228 - DNA, 16 bp, Homo sapiens
aattgttgaaattttg

SEQ ID NO: 3267229 - DNA, 20 bp, Homo sapiens
aattgttgaaattttgcaaa

SEQ ID NO: 3267230 - DNA, 23 bp, Homo sapiens
aattgttgaaattttgcaaatat

SEQ ID NO: 3267231 - DNA, 18 bp, Homo sapiens
aattgttgacagttctga

SEQ ID NO: 3267232 - DNA, 20 bp, Homo sapiens
aattgttgacagttctgaag

SEQ ID NO: 3267233 - DNA, 19 bp, Homo sapiens
aattgttgtggtttaaata

SEQ ID NO: 3267234 - DNA, 13 bp, Homo sapiens
aattgttgtttct

SEQ ID NO: 3267235 - DNA, 19 bp, Homo sapiens
aattgttgtttctttctag

SEQ ID NO: 3267236 - DNA, 21 bp, Homo sapiens
aattgttgtttctttctagtg

SEQ ID NO: 3267237 - DNA, 11 bp, Homo sapiens
aattgtttctt

SEQ ID NO: 3267238 - DNA, 21 bp, Homo sapiens
aattgtttggcttcctcctga

SEQ ID NO: 3267239 - DNA, 14 bp, Homo sapiens
aattgttttcactt

SEQ ID NO: 3267240 - DNA, 19 bp, Homo sapiens
aattgttttcacttgtatt

SEQ ID NO: 3267241 - DNA, 19 bp, Homo sapiens
aattgttttctttaaagat

SEQ ID NO: 3267242 - DNA, 17 bp, Homo sapiens
aattgttttttaaagca

SEQ ID NO: 3267243 - DNA, 13 bp, Homo sapiens
aatttaaaaaata

SEQ ID NO: 3267244 - DNA, 18 bp, Homo sapiens
aatttaaaaaataaataa

SEQ ID NO: 3267245 - DNA, 16 bp, Homo sapiens
aatttaaaattacgtt

SEQ ID NO: 3267246 - DNA, 9 bp, Homo sapiens
aatttaaac

SEQ ID NO: 3267247 - DNA, 22 bp, Homo sapiens
aatttaaagggtgtacttatat

SEQ ID NO: 3267248 - DNA, 20 bp, Homo sapiens
aatttaaatataattctgta

SEQ ID NO: 3267249 - DNA, 17 bp, Homo sapiens
aatttaaatttaaagat

SEQ ID NO: 3267250 - DNA, 18 bp, Homo sapiens
aatttaaatttaaagata

SEQ ID NO: 3267251 - DNA, 14 bp, Homo sapiens
aatttaacaaacta

SEQ ID NO: 3267252 - DNA, 19 bp, Homo sapiens
aatttaacaccctttagaa

SEQ ID NO: 3267253 - DNA, 14 bp, Homo sapiens
aatttaagtgcgtg

SEQ ID NO: 3267254 - DNA, 20 bp, Homo sapiens
aatttaataccagatacctt

SEQ ID NO: 3267255 - DNA, 20 bp, Homo sapiens
aatttaattcctctttttag

SEQ ID NO: 3267256 - DNA, 21 bp, Homo sapiens
aatttacctaagattacaaat

SEQ ID NO: 3267257 - DNA, 19 bp, Homo sapiens
aatttactatatatatatg

SEQ ID NO: 3267258 - DNA, 21 bp, Homo sapiens
aatttactcacagcacttgtt

SEQ ID NO: 3267259 - DNA, 16 bp, Homo sapiens
aatttacttgttttgg

SEQ ID NO: 3267260 - DNA, 20 bp, Homo sapiens
aatttagaaactgatttctt

SEQ ID NO: 3267261 - DNA, 17 bp, Homo sapiens
aatttagaaatataatt

SEQ ID NO: 3267262 - DNA, 20 bp, Homo sapiens
aatttagacaacctgaaatt

SEQ ID NO: 3267263 - DNA, 15 bp, Homo sapiens
aatttagatcttata

SEQ ID NO: 3267264 - DNA, 16 bp, Homo sapiens
aatttagatcttatat

SEQ ID NO: 3267265 - DNA, 18 bp, Homo sapiens
aatttagcagtccaaaga

SEQ ID NO: 3267266 - DNA, 18 bp, Homo sapiens
aatttagccctttaaaac

SEQ ID NO: 3267267 - DNA, 21 bp, Homo sapiens
aatttagggtactaaatttaa

SEQ ID NO: 3267268 - DNA, 22 bp, Homo sapiens
aatttagggtactaaatttaaa

SEQ ID NO: 3267269 - DNA, 18 bp, Homo sapiens
aatttaggtttttattag

SEQ ID NO: 3267270 - DNA, 16 bp, Homo sapiens
aatttagtttttgttc

SEQ ID NO: 3267271 - DNA, 22 bp, Homo sapiens
aatttataaaaaggtgttttga

SEQ ID NO: 3267272 - DNA, 15 bp, Homo sapiens
aatttataacaaata

SEQ ID NO: 3267273 - DNA, 19 bp, Homo sapiens
aatttataatgaatacttt

SEQ ID NO: 3267274 - DNA, 16 bp, Homo sapiens
aatttatatgtatatt

SEQ ID NO: 3267275 - DNA, 22 bp, Homo sapiens
aatttatcaaagcatagatgtt

SEQ ID NO: 3267276 - DNA, 17 bp, Homo sapiens
aatttatcacacttctg

SEQ ID NO: 3267277 - DNA, 23 bp, Homo sapiens
aatttatccctttacaatgtgaa

SEQ ID NO: 3267278 - DNA, 19 bp, Homo sapiens
aatttatcctgaaatttca

SEQ ID NO: 3267279 - DNA, 21 bp, Homo sapiens
aatttatctaaattaaagcct

SEQ ID NO: 3267280 - DNA, 20 bp, Homo sapiens
aatttatcttgtctctgggc

SEQ ID NO: 3267281 - DNA, 19 bp, Homo sapiens
aatttatgaagcagattta

SEQ ID NO: 3267282 - DNA, 23 bp, Homo sapiens
aatttatgaattgaattatcttg

SEQ ID NO: 3267283 - DNA, 19 bp, Homo sapiens
aatttatgagtttttgata

SEQ ID NO: 3267284 - DNA, 14 bp, Homo sapiens
aatttatgcatttc

SEQ ID NO: 3267285 - DNA, 15 bp, Homo sapiens
aatttatgcatttca

SEQ ID NO: 3267286 - DNA, 20 bp, Homo sapiens
aatttatgcatttcattcaa

SEQ ID NO: 3267287 - DNA, 17 bp, Homo sapiens
aatttattagttaatat

SEQ ID NO: 3267288 - DNA, 21 bp, Homo sapiens
aatttattcaattcctctggg

SEQ ID NO: 3267289 - DNA, 13 bp, Homo sapiens
aatttattctgat

SEQ ID NO: 3267290 - DNA, 14 bp, Homo sapiens
aatttattctgata

SEQ ID NO: 3267291 - DNA, 19 bp, Homo sapiens
aatttattgtctgtctaca

SEQ ID NO: 3267292 - DNA, 16 bp, Homo sapiens
aatttatttattaaga

SEQ ID NO: 3267293 - DNA, 20 bp, Homo sapiens
aatttatttccactaaaaat

SEQ ID NO: 3267294 - DNA, 13 bp, Homo sapiens
aatttatttgttt

SEQ ID NO: 3267295 - DNA, 16 bp, Homo sapiens
aatttatttgtttccc

SEQ ID NO: 3267296 - DNA, 16 bp, Homo sapiens
aatttcaaaaatataa

SEQ ID NO: 3267297 - DNA, 19 bp, Homo sapiens
acctcagtgtcatttatga

SEQ ID NO: 3267298 - DNA, 18 bp, Homo sapiens
acctcagttttatcattt

SEQ ID NO: 3267299 - DNA, 14 bp, Homo sapiens
acctcatcaggatg

SEQ ID NO: 3267300 - DNA, 21 bp, Homo sapiens
acctcatctgtggagctgcca

SEQ ID NO: 3267301 - DNA, 22 bp, Homo sapiens
acctcatctgtggagctgccac

SEQ ID NO: 3267302 - DNA, 19 bp, Homo sapiens
acctcatctttctccttca

SEQ ID NO: 3267303 - DNA, 18 bp, Homo sapiens
acctcattggccagctca

SEQ ID NO: 3267304 - DNA, 13 bp, Homo sapiens
acctcatttttca

SEQ ID NO: 3267305 - DNA, 14 bp, Homo sapiens
acctcatttttcat

SEQ ID NO: 3267306 - DNA, 17 bp, Homo sapiens
acctcatttttcatact

SEQ ID NO: 3267307 - DNA, 22 bp, Homo sapiens
acctccaataaagtgccttctg

SEQ ID NO: 3267308 - DNA, 11 bp, Homo sapiens
acctccaccca

SEQ ID NO: 3267309 - DNA, 14 bp, Homo sapiens
acctccacccagcc

SEQ ID NO: 3267310 - DNA, 15 bp, Homo sapiens
acctccacccagccc

SEQ ID NO: 3267311 - DNA, 16 bp, Homo sapiens
acctccacccagcccc

SEQ ID NO: 3267312 - DNA, 13 bp, Homo sapiens
acctccacctgtg

SEQ ID NO: 3267313 - DNA, 16 bp, Homo sapiens
acctccagcccgggag

SEQ ID NO: 3267314 - DNA, 18 bp, Homo sapiens
acctccagtccccctatc

SEQ ID NO: 3267315 - DNA, 18 bp, Homo sapiens
acctccattaaagtctga

SEQ ID NO: 3267316 - DNA, 14 bp, Homo sapiens
acctcccagaggtc

SEQ ID NO: 3267317 - DNA, 16 bp, Homo sapiens
acctcccagaggtcca

SEQ ID NO: 3267318 - DNA, 17 bp, Homo sapiens
acctcccagaggtccag

SEQ ID NO: 3267319 - DNA, 23 bp, Homo sapiens
acctcccagaggtccagcccatc

SEQ ID NO: 3267320 - DNA, 14 bp, Homo sapiens
acctcccagcccta

SEQ ID NO: 3267321 - DNA, 20 bp, Homo sapiens
acctcccagccctatggatg

SEQ ID NO: 3267322 - DNA, 11 bp, Homo sapiens
acctccccacg

SEQ ID NO: 3267323 - DNA, 20 bp, Homo sapiens
acctccccacgccctcccct

SEQ ID NO: 3267324 - DNA, 23 bp, Homo sapiens
acctccccagcattccagcccct

SEQ ID NO: 3267325 - DNA, 15 bp, Homo sapiens
acctccccagcccct

SEQ ID NO: 3267326 - DNA, 23 bp, Homo sapiens
acctccccagcccctagcccagg

SEQ ID NO: 3267327 - DNA, 11 bp, Homo sapiens
acctccctccc

SEQ ID NO: 3267328 - DNA, 14 bp, Homo sapiens
acctccgcccctgc

SEQ ID NO: 3267329 - DNA, 15 bp, Homo sapiens
acctccgcccctgcc

SEQ ID NO: 3267330 - DNA, 15 bp, Homo sapiens
acctcctagaggtgg

SEQ ID NO: 3267331 - DNA, 19 bp, Homo sapiens
acctcctagaggtgggcag

SEQ ID NO: 3267332 - DNA, 12 bp, Homo sapiens
acctcctccccc

SEQ ID NO: 3267333 - DNA, 18 bp, Homo sapiens
acctcctccccctgttct

SEQ ID NO: 3267334 - DNA, 20 bp, Homo sapiens
acctcctctgtgatttcttt

SEQ ID NO: 3267335 - DNA, 14 bp, Homo sapiens
acctcctcttcccc

SEQ ID NO: 3267336 - DNA, 19 bp, Homo sapiens
acctcctgagaaggcgagg

SEQ ID NO: 3267337 - DNA, 23 bp, Homo sapiens
acctcctgcctcgaactggctgc

SEQ ID NO: 3267338 - DNA, 13 bp, Homo sapiens
acctcctgggcta

SEQ ID NO: 3267339 - DNA, 15 bp, Homo sapiens
acctcctgtggaacc

SEQ ID NO: 3267340 - DNA, 19 bp, Homo sapiens
acctccttgtcactttatt

SEQ ID NO: 3267341 - DNA, 14 bp, Homo sapiens
acctcgctgagggc

SEQ ID NO: 3267342 - DNA, 18 bp, Homo sapiens
acctcggagcatggtgtt

SEQ ID NO: 3267343 - DNA, 22 bp, Homo sapiens
acctcggagggatggagaaaga

SEQ ID NO: 3267344 - DNA, 23 bp, Homo sapiens
acctcggagggatggagaaagaa

SEQ ID NO: 3267345 - DNA, 18 bp, Homo sapiens
acctcggggacaccagag

SEQ ID NO: 3267346 - DNA, 23 bp, Homo sapiens
acctcggggacaccagagctgcc

SEQ ID NO: 3267347 - DNA, 23 bp, Homo sapiens
acctcgtgatccgcctgcctctg

SEQ ID NO: 3267348 - DNA, 21 bp, Homo sapiens
acctctacccaaaccctaggt

SEQ ID NO: 3267349 - DNA, 19 bp, Homo sapiens
acctctagccttaaggggg

SEQ ID NO: 3267350 - DNA, 13 bp, Homo sapiens
acctctcagcaga

SEQ ID NO: 3267351 - DNA, 15 bp, Homo sapiens
acctctcagggcctg

SEQ ID NO: 3267352 - DNA, 10 bp, Homo sapiens
acctctccaa

SEQ ID NO: 3267353 - DNA, 16 bp, Homo sapiens
acctctccaagtctct

SEQ ID NO: 3267354 - DNA, 12 bp, Homo sapiens
acctctccctca

SEQ ID NO: 3267355 - DNA, 20 bp, Homo sapiens
acctctcctttggccattcc

SEQ ID NO: 3267356 - DNA, 15 bp, Homo sapiens
acctctctcagagca

SEQ ID NO: 3267357 - DNA, 17 bp, Homo sapiens
acctctctcagagcatc

SEQ ID NO: 3267358 - DNA, 19 bp, Homo sapiens
acctctctgtagtttatgg

SEQ ID NO: 3267359 - DNA, 15 bp, Homo sapiens
acctctctgtccctt

SEQ ID NO: 3267360 - DNA, 23 bp, Homo sapiens
acctctcttatagaatatttatt

SEQ ID NO: 3267361 - DNA, 14 bp, Homo sapiens
acctctgagaagac

SEQ ID NO: 3267362 - DNA, 18 bp, Homo sapiens
acctctgcctcccaggtt

SEQ ID NO: 3267363 - DNA, 17 bp, Homo sapiens
acctctgcggaccccag

SEQ ID NO: 3267364 - DNA, 24 bp, Homo sapiens
acctctgcttttatctcagatgtt

SEQ ID NO: 3267365 - DNA, 14 bp, Homo sapiens
acctctggactggc

SEQ ID NO: 3267366 - DNA, 16 bp, Homo sapiens
acctctggactggcta

SEQ ID NO: 3267367 - DNA, 18 bp, Homo sapiens
acctctggattcattgtc

SEQ ID NO: 3267368 - DNA, 13 bp, Homo sapiens
acctctggccctg

SEQ ID NO: 3267369 - DNA, 15 bp, Homo sapiens
acctctggccctgtg

SEQ ID NO: 3267370 - DNA, 16 bp, Homo sapiens
acctctggccctgtgt

SEQ ID NO: 3267371 - DNA, 17 bp, Homo sapiens
acctctggccctgtgta

SEQ ID NO: 3267372 - DNA, 17 bp, Homo sapiens
acctctgtatagaaatc

SEQ ID NO: 3267373 - DNA, 22 bp, Homo sapiens
acctctgtatagaaatctaaaa

SEQ ID NO: 3267374 - DNA, 15 bp, Homo sapiens
acctctgtgacctca

SEQ ID NO: 3267375 - DNA, 15 bp, Homo sapiens
acctctgttcatttc

SEQ ID NO: 3267376 - DNA, 15 bp, Homo sapiens
acctcttcccatgac

SEQ ID NO: 3267377 - DNA, 15 bp, Homo sapiens
acctcttctatgcaa

SEQ ID NO: 3267378 - DNA, 22 bp, Homo sapiens
acctcttctatgcaagccttgc

SEQ ID NO: 3267379 - DNA, 23 bp, Homo sapiens
acctcttctatgcaagccttgct

SEQ ID NO: 3267380 - DNA, 16 bp, Homo sapiens
acctcttgctgtctct

SEQ ID NO: 3267381 - DNA, 22 bp, Homo sapiens
acctcttttgcttgccaaagta

SEQ ID NO: 3267382 - DNA, 15 bp, Homo sapiens
acctgaaaaaaagtt

SEQ ID NO: 3267383 - DNA, 21 bp, Homo sapiens
acctgaaaaaaagtttacaag

SEQ ID NO: 3267384 - DNA, 19 bp, Homo sapiens
acctgaaattccaaagtct

SEQ ID NO: 3267385 - DNA, 17 bp, Homo sapiens
acctgaaatttaaactg

SEQ ID NO: 3267386 - DNA, 14 bp, Homo sapiens
acctgaacttgcct

SEQ ID NO: 3267387 - DNA, 18 bp, Homo sapiens
acctgaagactcattctt

SEQ ID NO: 3267388 - DNA, 19 bp, Homo sapiens
acctgacacaccaggcgct

SEQ ID NO: 3267389 - DNA, 15 bp, Homo sapiens
acctgacccctgctc

SEQ ID NO: 3267390 - DNA, 23 bp, Homo sapiens
acctgacccctgctcagtaaagc

SEQ ID NO: 3267391 - DNA, 16 bp, Homo sapiens
acctgacctcttgctg

SEQ ID NO: 3267392 - DNA, 17 bp, Homo sapiens
acctgactctgaaatct

SEQ ID NO: 3267393 - DNA, 18 bp, Homo sapiens
acctgactctgaaatctg

SEQ ID NO: 3267394 - DNA, 20 bp, Homo sapiens
acctgagaccctgggagaga

SEQ ID NO: 3267395 - DNA, 21 bp, Homo sapiens
acctgagaccctgggagagaa

SEQ ID NO: 3267396 - DNA, 23 bp, Homo sapiens
acctgagacgggcatcgcaggag

SEQ ID NO: 3267397 - DNA, 22 bp, Homo sapiens
acctgagactgtcggagaggct

SEQ ID NO: 3267398 - DNA, 23 bp, Homo sapiens
acctgagcccggatgcttctcca

SEQ ID NO: 3267399 - DNA, 12 bp, Homo sapiens
acctgagctaaa

SEQ ID NO: 3267400 - DNA, 15 bp, Homo sapiens
acctgaggagacatc

SEQ ID NO: 3267401 - DNA, 23 bp, Homo sapiens
acctgaggatgcaacaaatattt

SEQ ID NO: 3267402 - DNA, 12 bp, Homo sapiens
acctgaggtggg

SEQ ID NO: 3267403 - DNA, 17 bp, Homo sapiens
acctgaggtgggcccag

SEQ ID NO: 3267404 - DNA, 19 bp, Homo sapiens
acctgaggtgggcccagga

SEQ ID NO: 3267405 - DNA, 21 bp, Homo sapiens
acctgaggtgggctggggctg

SEQ ID NO: 3267406 - DNA, 22 bp, Homo sapiens
acctgatcactagcctgtcatc

SEQ ID NO: 3267407 - DNA, 22 bp, Homo sapiens
acctgatggaagtaaagcctca

SEQ ID NO: 3267408 - DNA, 14 bp, Homo sapiens
acctgattgtaaac

SEQ ID NO: 3267409 - DNA, 15 bp, Homo sapiens
acctgattgtatttt

SEQ ID NO: 3267410 - DNA, 18 bp, Homo sapiens
acctgatttcagaagaga

SEQ ID NO: 3267411 - DNA, 11 bp, Homo sapiens
acctgattttt

SEQ ID NO: 3267412 - DNA, 16 bp, Homo sapiens
acctgattttttttcc

SEQ ID NO: 3267413 - DNA, 17 bp, Homo sapiens
acctgattttttttcct

SEQ ID NO: 3267414 - DNA, 16 bp, Homo sapiens
acctgcaagccccagg

SEQ ID NO: 3267415 - DNA, 20 bp, Homo sapiens
acctgcaagccccagggcct

SEQ ID NO: 3267416 - DNA, 18 bp, Homo sapiens
acctgcactaacagagtg

SEQ ID NO: 3267417 - DNA, 23 bp, Homo sapiens
acctgcactggggagcccgtctc

SEQ ID NO: 3267418 - DNA, 15 bp, Homo sapiens
acctgcaggccaaga

SEQ ID NO: 3267419 - DNA, 19 bp, Homo sapiens
acctgcaggccaagagcag

SEQ ID NO: 3267420 - DNA, 15 bp, Homo sapiens
acctgccaccacaca

SEQ ID NO: 3267421 - DNA, 17 bp, Homo sapiens
acctgccaccacacaca

SEQ ID NO: 3267422 - DNA, 13 bp, Homo sapiens
acctgccccctgg

SEQ ID NO: 3267423 - DNA, 23 bp, Homo sapiens
acctgccccgcccagctgcacct

SEQ ID NO: 3267424 - DNA, 14 bp, Homo sapiens
acctgccctcaagg

SEQ ID NO: 3267425 - DNA, 15 bp, Homo sapiens
acctgccctcaaggg

SEQ ID NO: 3267426 - DNA, 23 bp, Homo sapiens
accctttgcctttcttctgccct

SEQ ID NO: 3267427 - DNA, 22 bp, Homo sapiens
accctttgctgtgaggctgtcc

SEQ ID NO: 3267428 - DNA, 23 bp, Homo sapiens
accctttggtttttttcttctgt

SEQ ID NO: 3267429 - DNA, 15 bp, Homo sapiens
acccttttttctaag

SEQ ID NO: 3267430 - DNA, 17 bp, Homo sapiens
accgacgcgtctcctgt

SEQ ID NO: 3267431 - DNA, 18 bp, Homo sapiens
accgacgcgtctcctgtt

SEQ ID NO: 3267432 - DNA, 19 bp, Homo sapiens
accgagcaaagatcaaaat

SEQ ID NO: 3267433 - DNA, 16 bp, Homo sapiens
accgagtctcttctcc

SEQ ID NO: 3267434 - DNA, 17 bp, Homo sapiens
accgagtctcttctcca

SEQ ID NO: 3267435 - DNA, 14 bp, Homo sapiens
accgagtgaaccta

SEQ ID NO: 3267436 - DNA, 15 bp, Homo sapiens
accgagtgatttcca

SEQ ID NO: 3267437 - DNA, 20 bp, Homo sapiens
accgagtgatttccatctct

SEQ ID NO: 3267438 - DNA, 19 bp, Homo sapiens
accgatggagcccccagat

SEQ ID NO: 3267439 - DNA, 11 bp, Homo sapiens
accgcacttat

SEQ ID NO: 3267440 - DNA, 23 bp, Homo sapiens
accgcagccagccggtgcctggc

SEQ ID NO: 3267441 - DNA, 22 bp, Homo sapiens
accgcagtcgtcgcacagtctc

SEQ ID NO: 3267442 - DNA, 17 bp, Homo sapiens
accgccacgtcccagca

SEQ ID NO: 3267443 - DNA, 13 bp, Homo sapiens
accgcccccaccc

SEQ ID NO: 3267444 - DNA, 18 bp, Homo sapiens
accgccctgggctggact

SEQ ID NO: 3267445 - DNA, 20 bp, Homo sapiens
accgccctgggctggactgg

SEQ ID NO: 3267446 - DNA, 21 bp, Homo sapiens
accgccgactttgtacccccc

SEQ ID NO: 3267447 - DNA, 17 bp, Homo sapiens
accgccgccaccagccc

SEQ ID NO: 3267448 - DNA, 16 bp, Homo sapiens
accgcctgtctcttta

SEQ ID NO: 3267449 - DNA, 16 bp, Homo sapiens
accgcgactaatttca

SEQ ID NO: 3267450 - DNA, 15 bp, Homo sapiens
accgctcacctagag

SEQ ID NO: 3267451 - DNA, 15 bp, Homo sapiens
accgcttccctcctg

SEQ ID NO: 3267452 - DNA, 22 bp, Homo sapiens
accgcttgtggggacccaggct

SEQ ID NO: 3267453 - DNA, 23 bp, Homo sapiens
accggaaggaggccaaccagccc

SEQ ID NO: 3267454 - DNA, 19 bp, Homo sapiens
accggacagtcggaaaagc

SEQ ID NO: 3267455 - DNA, 16 bp, Homo sapiens
accggacttttctgca

SEQ ID NO: 3267456 - DNA, 18 bp, Homo sapiens
accggccgatggagacac

SEQ ID NO: 3267457 - DNA, 11 bp, Homo sapiens
accggcgcgct

SEQ ID NO: 3267458 - DNA, 22 bp, Homo sapiens
accggctggcagggctggcccc

SEQ ID NO: 3267459 - DNA, 19 bp, Homo sapiens
accgggagaaggcatgaga

SEQ ID NO: 3267460 - DNA, 12 bp, Homo sapiens
accgggcactca

SEQ ID NO: 3267461 - DNA, 20 bp, Homo sapiens
accgggcactcagaagacac

SEQ ID NO: 3267462 - DNA, 20 bp, Homo sapiens
accgggccacagagaaagta

SEQ ID NO: 3267463 - DNA, 19 bp, Homo sapiens
accgggcctcccctccatg

SEQ ID NO: 3267464 - DNA, 23 bp, Homo sapiens
accgggctgggagctctgcagag

SEQ ID NO: 3267465 - DNA, 16 bp, Homo sapiens
accgggtgggcctggc

SEQ ID NO: 3267466 - DNA, 18 bp, Homo sapiens
accgggtgggcctggcct

SEQ ID NO: 3267467 - DNA, 22 bp, Homo sapiens
accggtcagtgccttttggaac

SEQ ID NO: 3267468 - DNA, 15 bp, Homo sapiens
accggtccagctggc

SEQ ID NO: 3267469 - DNA, 17 bp, Homo sapiens
accggtgctgcaggagt

SEQ ID NO: 3267470 - DNA, 13 bp, Homo sapiens
accgtactctcac

SEQ ID NO: 3267471 - DNA, 13 bp, Homo sapiens
accgtagcctccg

SEQ ID NO: 3267472 - DNA, 22 bp, Homo sapiens
accgtcatggcttaatgtttat

SEQ ID NO: 3267473 - DNA, 12 bp, Homo sapiens
accgtcctcacc

SEQ ID NO: 3267474 - DNA, 15 bp, Homo sapiens
accgtcctcacccct

SEQ ID NO: 3267475 - DNA, 15 bp, Homo sapiens
accgtcctctttttc

SEQ ID NO: 3267476 - DNA, 16 bp, Homo sapiens
accgtctgtttttaaa

SEQ ID NO: 3267477 - DNA, 14 bp, Homo sapiens
accgtgatggagag

SEQ ID NO: 3267478 - DNA, 22 bp, Homo sapiens
accgtgcagagctgcacttggc

SEQ ID NO: 3267479 - DNA, 21 bp, Homo sapiens
accgtgctgtcttctggtctg

SEQ ID NO: 3267480 - DNA, 17 bp, Homo sapiens
accgtggacaggcccag

SEQ ID NO: 3267481 - DNA, 15 bp, Homo sapiens
accgtggaggaggaa

SEQ ID NO: 3267482 - DNA, 19 bp, Homo sapiens
accgtggccctgccctctc

SEQ ID NO: 3267483 - DNA, 18 bp, Homo sapiens
accgtgggcagtgccacc

SEQ ID NO: 3267484 - DNA, 18 bp, Homo sapiens
accgttcaaattctcttc

SEQ ID NO: 3267485 - DNA, 22 bp, Homo sapiens
accgttcagtgtcccaggcagc

SEQ ID NO: 3267486 - DNA, 16 bp, Homo sapiens
acctaaaacaatctgt

SEQ ID NO: 3267487 - DNA, 16 bp, Homo sapiens
acctaaaggtgtattt

SEQ ID NO: 3267488 - DNA, 19 bp, Homo sapiens
acctaacgccctatttttg

SEQ ID NO: 3267489 - DNA, 20 bp, Homo sapiens
acctaactcttttctatttt

SEQ ID NO: 3267490 - DNA, 14 bp, Homo sapiens
acctaagtactgta

SEQ ID NO: 3267491 - DNA, 21 bp, Homo sapiens
acctaatgtctcactgttctg

SEQ ID NO: 3267492 - DNA, 12 bp, Homo sapiens
acctaatgttta

SEQ ID NO: 3267493 - DNA, 15 bp, Homo sapiens
acctaattaatatat

SEQ ID NO: 3267494 - DNA, 15 bp, Homo sapiens
acctacaagatttcc

SEQ ID NO: 3267495 - DNA, 14 bp, Homo sapiens
acctacaataaact

SEQ ID NO: 3267496 - DNA, 15 bp, Homo sapiens
acctacaataaactg

SEQ ID NO: 3267497 - DNA, 22 bp, Homo sapiens
acctacaccattatcttggaaa

SEQ ID NO: 3267498 - DNA, 23 bp, Homo sapiens
acctacattccctctcctgccca

SEQ ID NO: 3267499 - DNA, 14 bp, Homo sapiens
acctaccaaaaaat

SEQ ID NO: 3267500 - DNA, 13 bp, Homo sapiens
acctacctcaggt

SEQ ID NO: 3267501 - DNA, 14 bp, Homo sapiens
acctactgttcctt

SEQ ID NO: 3267502 - DNA, 21 bp, Homo sapiens
acctactgttctaaagctctg

SEQ ID NO: 3267503 - DNA, 20 bp, Homo sapiens
acctacttgtgactgaaggg

SEQ ID NO: 3267504 - DNA, 22 bp, Homo sapiens
acctagaaattgacacaagtgg

SEQ ID NO: 3267505 - DNA, 14 bp, Homo sapiens
acctagcaattcca

SEQ ID NO: 3267506 - DNA, 18 bp, Homo sapiens
acctagcaattccatcac

SEQ ID NO: 3267507 - DNA, 12 bp, Homo sapiens
acctagcccagg

SEQ ID NO: 3267508 - DNA, 18 bp, Homo sapiens
acctagctggctctgtga

SEQ ID NO: 3267509 - DNA, 17 bp, Homo sapiens
acctagggaggacctta

SEQ ID NO: 3267510 - DNA, 15 bp, Homo sapiens
acctaggtctccagt

SEQ ID NO: 3267511 - DNA, 18 bp, Homo sapiens
acctagtactctctgctc

SEQ ID NO: 3267512 - DNA, 23 bp, Homo sapiens
acctagtactctctgctctagcc

SEQ ID NO: 3267513 - DNA, 19 bp, Homo sapiens
acctagtgcatttggcact

SEQ ID NO: 3267514 - DNA, 18 bp, Homo sapiens
acctataaagtaaagcta

SEQ ID NO: 3267515 - DNA, 16 bp, Homo sapiens
acctataatgtgtgta

SEQ ID NO: 3267516 - DNA, 17 bp, Homo sapiens
acctataatgtgtgtat

SEQ ID NO: 3267517 - DNA, 16 bp, Homo sapiens
acctatagtcccagct

SEQ ID NO: 3267518 - DNA, 17 bp, Homo sapiens
acctatctcgtgggaga

SEQ ID NO: 3267519 - DNA, 23 bp, Homo sapiens
acctatggaagtggttctatgtc

SEQ ID NO: 3267520 - DNA, 16 bp, Homo sapiens
acctattcaccctcca

SEQ ID NO: 3267521 - DNA, 12 bp, Homo sapiens
acctatttccac

SEQ ID NO: 3267522 - DNA, 12 bp, Homo sapiens
acctatttccat

SEQ ID NO: 3267523 - DNA, 14 bp, Homo sapiens
acctatttgacata

SEQ ID NO: 3267524 - DNA, 15 bp, Homo sapiens
acctattttcatttg

SEQ ID NO: 3267525 - DNA, 17 bp, Homo sapiens
acctattttcatttgta

SEQ ID NO: 3267526 - DNA, 18 bp, Homo sapiens
acctattttcatttgtac

SEQ ID NO: 3267527 - DNA, 16 bp, Homo sapiens
acctcaaaatgtctaa

SEQ ID NO: 3267528 - DNA, 19 bp, Homo sapiens
acctcaaaatgtctaagat

SEQ ID NO: 3267529 - DNA, 14 bp, Homo sapiens
acctcaagccccat

SEQ ID NO: 3267530 - DNA, 20 bp, Homo sapiens
acctcaagccccatttcctc

SEQ ID NO: 3267531 - DNA, 21 bp, Homo sapiens
acctcaagggggactgtcttt

SEQ ID NO: 3267532 - DNA, 20 bp, Homo sapiens
acctcaccccgttacagctc

SEQ ID NO: 3267533 - DNA, 18 bp, Homo sapiens
acctcacccttgcaccgt

SEQ ID NO: 3267534 - DNA, 21 bp, Homo sapiens
acctcacctcccgaagccacc

SEQ ID NO: 3267535 - DNA, 14 bp, Homo sapiens
acctcactcctgtt

SEQ ID NO: 3267536 - DNA, 14 bp, Homo sapiens
acccctgtgctccg

SEQ ID NO: 3267537 - DNA, 13 bp, Homo sapiens
acccctgtttctg

SEQ ID NO: 3267538 - DNA, 17 bp, Homo sapiens
accccttaggccccgtg

SEQ ID NO: 3267539 - DNA, 15 bp, Homo sapiens
accccttccatgtgg

SEQ ID NO: 3267540 - DNA, 19 bp, Homo sapiens
accccttccatgtggagaa

SEQ ID NO: 3267541 - DNA, 16 bp, Homo sapiens
accccttcgctcctgt

SEQ ID NO: 3267542 - DNA, 20 bp, Homo sapiens
accccttggaggagagagac

SEQ ID NO: 3267543 - DNA, 21 bp, Homo sapiens
acccctttcttctcgggccac

SEQ ID NO: 3267544 - DNA, 13 bp, Homo sapiens
acccgatgctgct

SEQ ID NO: 3267545 - DNA, 13 bp, Homo sapiens
acccgcctctccc

SEQ ID NO: 3267546 - DNA, 21 bp, Homo sapiens
acccgcctctcccgtcagggc

SEQ ID NO: 3267547 - DNA, 13 bp, Homo sapiens
acccgcctgacac

SEQ ID NO: 3267548 - DNA, 15 bp, Homo sapiens
acccggaggggcctg

SEQ ID NO: 3267549 - DNA, 22 bp, Homo sapiens
acccggccaggaccttggtgag

SEQ ID NO: 3267550 - DNA, 14 bp, Homo sapiens
acccggcccctgct

SEQ ID NO: 3267551 - DNA, 15 bp, Homo sapiens
acccggcccctgctg

SEQ ID NO: 3267552 - DNA, 16 bp, Homo sapiens
acccggcccctgctgg

SEQ ID NO: 3267553 - DNA, 20 bp, Homo sapiens
acccggcccctgctggttca

SEQ ID NO: 3267554 - DNA, 17 bp, Homo sapiens
acccggctcgtgtattt

SEQ ID NO: 3267555 - DNA, 14 bp, Homo sapiens
acccggctgcagag

SEQ ID NO: 3267556 - DNA, 23 bp, Homo sapiens
acccggctgggtcggccctgccc

SEQ ID NO: 3267557 - DNA, 16 bp, Homo sapiens
acccggcttcctgtgc

SEQ ID NO: 3267558 - DNA, 19 bp, Homo sapiens
acccgtgagcgcctgtgca

SEQ ID NO: 3267559 - DNA, 19 bp, Homo sapiens
accctaatgtcttcataaa

SEQ ID NO: 3267560 - DNA, 13 bp, Homo sapiens
accctacctgtgc

SEQ ID NO: 3267561 - DNA, 14 bp, Homo sapiens
accctacttctttt

SEQ ID NO: 3267562 - DNA, 16 bp, Homo sapiens
accctactttgcttcc

SEQ ID NO: 3267563 - DNA, 23 bp, Homo sapiens
accctagccattcctggtaccca

SEQ ID NO: 3267564 - DNA, 15 bp, Homo sapiens
accctagccttgctt

SEQ ID NO: 3267565 - DNA, 16 bp, Homo sapiens
accctaggttccctgt

SEQ ID NO: 3267566 - DNA, 18 bp, Homo sapiens
accctaggttccctgttc

SEQ ID NO: 3267567 - DNA, 23 bp, Homo sapiens
accctagtcaaaactatttttgt

SEQ ID NO: 3267568 - DNA, 23 bp, Homo sapiens
accctatgggtctaggacacagt

SEQ ID NO: 3267569 - DNA, 13 bp, Homo sapiens
accctcacacaca

SEQ ID NO: 3267570 - DNA, 18 bp, Homo sapiens
accctcacacacacagct

SEQ ID NO: 3267571 - DNA, 21 bp, Homo sapiens
accctcacacacacagctggg

SEQ ID NO: 3267572 - DNA, 22 bp, Homo sapiens
accctcaccccctcctggcaat

SEQ ID NO: 3267573 - DNA, 14 bp, Homo sapiens
accctcactctgcc

SEQ ID NO: 3267574 - DNA, 18 bp, Homo sapiens
accctcactctgccaggg

SEQ ID NO: 3267575 - DNA, 14 bp, Homo sapiens
accctcagcacccc

SEQ ID NO: 3267576 - DNA, 20 bp, Homo sapiens
accctcaggcataggcctgg

SEQ ID NO: 3267577 - DNA, 21 bp, Homo sapiens
accctcaggggaaaactgtta

SEQ ID NO: 3267578 - DNA, 13 bp, Homo sapiens
accctcatgaaaa

SEQ ID NO: 3267579 - DNA, 17 bp, Homo sapiens
accctcatggcccccag

SEQ ID NO: 3267580 - DNA, 21 bp, Homo sapiens
accctcatggcccccaggggc

SEQ ID NO: 3267581 - DNA, 17 bp, Homo sapiens
accctcattgtgtttct

SEQ ID NO: 3267582 - DNA, 14 bp, Homo sapiens
accctccaccctgt

SEQ ID NO: 3267583 - DNA, 15 bp, Homo sapiens
accctccaccctgtc

SEQ ID NO: 3267584 - DNA, 17 bp, Homo sapiens
accctccaccctgtccc

SEQ ID NO: 3267585 - DNA, 23 bp, Homo sapiens
accctccaccctgtcccccagct

SEQ ID NO: 3267586 - DNA, 12 bp, Homo sapiens
accctccacctt

SEQ ID NO: 3267587 - DNA, 21 bp, Homo sapiens
accctccactcagctgtcctg

SEQ ID NO: 3267588 - DNA, 16 bp, Homo sapiens
accctccacttcccgt

SEQ ID NO: 3267589 - DNA, 19 bp, Homo sapiens
accctccagtgctggattt

SEQ ID NO: 3267590 - DNA, 20 bp, Homo sapiens
accctccagtgctggatttg

SEQ ID NO: 3267591 - DNA, 20 bp, Homo sapiens
accctccatgctcctcacct

SEQ ID NO: 3267592 - DNA, 19 bp, Homo sapiens
accctcccaagtagctggg

SEQ ID NO: 3267593 - DNA, 20 bp, Homo sapiens
accctcccacccccttctct

SEQ ID NO: 3267594 - DNA, 12 bp, Homo sapiens
accctcccctct

SEQ ID NO: 3267595 - DNA, 14 bp, Homo sapiens
accctcccctctct

SEQ ID NO: 3267596 - DNA, 21 bp, Homo sapiens
accctcctgtaaatggtgtac

SEQ ID NO: 3267597 - DNA, 21 bp, Homo sapiens
accctcctttcaccacatgtg

SEQ ID NO: 3267598 - DNA, 20 bp, Homo sapiens
accctcggggggtcacaggc

SEQ ID NO: 3267599 - DNA, 14 bp, Homo sapiens
accctctcctgggg

SEQ ID NO: 3267600 - DNA, 15 bp, Homo sapiens
accctctcctggggg

SEQ ID NO: 3267601 - DNA, 14 bp, Homo sapiens
accctctgccacca

SEQ ID NO: 3267602 - DNA, 19 bp, Homo sapiens
accctctgccaccagagac

SEQ ID NO: 3267603 - DNA, 20 bp, Homo sapiens
accctctgccaccagagacc

SEQ ID NO: 3267604 - DNA, 21 bp, Homo sapiens
accctctgggaacctcccaga

SEQ ID NO: 3267605 - DNA, 18 bp, Homo sapiens
accctcttgcccatcctg

SEQ ID NO: 3267606 - DNA, 22 bp, Homo sapiens
accctcttgcccatcctgactg

SEQ ID NO: 3267607 - DNA, 22 bp, Homo sapiens
accctgaagtcagcgggcccag

SEQ ID NO: 3267608 - DNA, 17 bp, Homo sapiens
accctgacctccgcccc

SEQ ID NO: 3267609 - DNA, 20 bp, Homo sapiens
accctgacctccgcccctgc

SEQ ID NO: 3267610 - DNA, 21 bp, Homo sapiens
accctgacctccgcccctgcc

SEQ ID NO: 3267611 - DNA, 22 bp, Homo sapiens
accctgaggtcagggagtgctg

SEQ ID NO: 3267612 - DNA, 20 bp, Homo sapiens
accctgatgtgacattccat

SEQ ID NO: 3267613 - DNA, 20 bp, Homo sapiens
accctgccccccctaagaga

SEQ ID NO: 3267614 - DNA, 15 bp, Homo sapiens
accctgcccctgcaa

SEQ ID NO: 3267615 - DNA, 17 bp, Homo sapiens
accctgcccctgcaaag

SEQ ID NO: 3267616 - DNA, 12 bp, Homo sapiens
accctgcccgct

SEQ ID NO: 3267617 - DNA, 13 bp, Homo sapiens
accctgcccgctc

SEQ ID NO: 3267618 - DNA, 19 bp, Homo sapiens
accctgcccgctcccaacc

SEQ ID NO: 3267619 - DNA, 14 bp, Homo sapiens
accctgctccctgc

SEQ ID NO: 3267620 - DNA, 15 bp, Homo sapiens
accctgctcctcctg

SEQ ID NO: 3267621 - DNA, 19 bp, Homo sapiens
accctgctcctcctgccct

SEQ ID NO: 3267622 - DNA, 19 bp, Homo sapiens
accctggaaaggggagttg

SEQ ID NO: 3267623 - DNA, 14 bp, Homo sapiens
accctggaaatgga

SEQ ID NO: 3267624 - DNA, 22 bp, Homo sapiens
accctggaattcagcaccctgg

SEQ ID NO: 3267625 - DNA, 13 bp, Homo sapiens
accctggagccca

SEQ ID NO: 3267626 - DNA, 16 bp, Homo sapiens
accctggccgccccct

SEQ ID NO: 3267627 - DNA, 21 bp, Homo sapiens
accctggcttgcttgccgagc

SEQ ID NO: 3267628 - DNA, 15 bp, Homo sapiens
accctgggagagaag

SEQ ID NO: 3267629 - DNA, 22 bp, Homo sapiens
accctgggagccagtcctccac

SEQ ID NO: 3267630 - DNA, 15 bp, Homo sapiens
accctgggccctggg

SEQ ID NO: 3267631 - DNA, 22 bp, Homo sapiens
accctgggccctgggctggaat

SEQ ID NO: 3267632 - DNA, 15 bp, Homo sapiens
accctggggaaggag

SEQ ID NO: 3267633 - DNA, 20 bp, Homo sapiens
accctgggtgccattcccag

SEQ ID NO: 3267634 - DNA, 17 bp, Homo sapiens
accctggtggtatttta

SEQ ID NO: 3267635 - DNA, 21 bp, Homo sapiens
accctggtggtattttatttt

SEQ ID NO: 3267636 - DNA, 15 bp, Homo sapiens
accctgtacctcatc

SEQ ID NO: 3267637 - DNA, 19 bp, Homo sapiens
accctgtccggcccagtgc

SEQ ID NO: 3267638 - DNA, 14 bp, Homo sapiens
accctgtgctggtg

SEQ ID NO: 3267639 - DNA, 15 bp, Homo sapiens
accctgtgctggtgt

SEQ ID NO: 3267640 - DNA, 20 bp, Homo sapiens
accctgtgtatacagccctg

SEQ ID NO: 3267641 - DNA, 15 bp, Homo sapiens
acccttaacccaagg

SEQ ID NO: 3267642 - DNA, 16 bp, Homo sapiens
acccttaacccaagga

SEQ ID NO: 3267643 - DNA, 23 bp, Homo sapiens
acccttaacccaaggagcacagg

SEQ ID NO: 3267644 - DNA, 15 bp, Homo sapiens
acccttaactgacat

SEQ ID NO: 3267645 - DNA, 19 bp, Homo sapiens
acccttaccccttagcctc

SEQ ID NO: 3267646 - DNA, 22 bp, Homo sapiens
acccttaccccttagcctccct

SEQ ID NO: 3267647 - DNA, 13 bp, Homo sapiens
acccttagaaaat

SEQ ID NO: 3267648 - DNA, 17 bp, Homo sapiens
acccttaggatggggct

SEQ ID NO: 3267649 - DNA, 24 bp, Homo sapiens
acccttaggatggggctcccagct

SEQ ID NO: 3267650 - DNA, 14 bp, Homo sapiens
acccttcagacccc

SEQ ID NO: 3267651 - DNA, 16 bp, Homo sapiens
acccttcagaccccag

SEQ ID NO: 3267652 - DNA, 15 bp, Homo sapiens
acccttcagggccag

SEQ ID NO: 3267653 - DNA, 13 bp, Homo sapiens
acgctgcacttga

SEQ ID NO: 3267654 - DNA, 22 bp, Homo sapiens
acgctgccgctgccgctgcacc

SEQ ID NO: 3267655 - DNA, 23 bp, Homo sapiens
acgctgccgctgccgctgcacca

SEQ ID NO: 3267656 - DNA, 20 bp, Homo sapiens
acgctggaccttgaactggg

SEQ ID NO: 3267657 - DNA, 16 bp, Homo sapiens
acgctggagtgcagtg

SEQ ID NO: 3267658 - DNA, 19 bp, Homo sapiens
acgctggagtgcagtgagc

SEQ ID NO: 3267659 - DNA, 20 bp, Homo sapiens
acgctgtcaaaagttggact

SEQ ID NO: 3267660 - DNA, 21 bp, Homo sapiens
acgctgtcctctcgagcccag

SEQ ID NO: 3267661 - DNA, 20 bp, Homo sapiens
acgcttcttatgtagagttt

SEQ ID NO: 3267662 - DNA, 12 bp, Homo sapiens
acgcttgtgaat

SEQ ID NO: 3267663 - DNA, 17 bp, Homo sapiens
acgctttctagctgttg

SEQ ID NO: 3267664 - DNA, 13 bp, Homo sapiens
acgctttgattca

SEQ ID NO: 3267665 - DNA, 11 bp, Homo sapiens
acgctttgtca

SEQ ID NO: 3267666 - DNA, 19 bp, Homo sapiens
acggacaataaacctccgc

SEQ ID NO: 3267667 - DNA, 21 bp, Homo sapiens
acggactgtccaccttttctg

SEQ ID NO: 3267668 - DNA, 14 bp, Homo sapiens
acggagagaaaaaa

SEQ ID NO: 3267669 - DNA, 20 bp, Homo sapiens
acggagcccagccctcccca

SEQ ID NO: 3267670 - DNA, 14 bp, Homo sapiens
acggagccctccct

SEQ ID NO: 3267671 - DNA, 19 bp, Homo sapiens
acggaggagggatgctgct

SEQ ID NO: 3267672 - DNA, 22 bp, Homo sapiens
acggaggagttttggcagccag

SEQ ID NO: 3267673 - DNA, 23 bp, Homo sapiens
acggagtcccaccttggctgcag

SEQ ID NO: 3267674 - DNA, 23 bp, Homo sapiens
acggagtggggggacagagactc

SEQ ID NO: 3267675 - DNA, 12 bp, Homo sapiens
acggattccaaa

SEQ ID NO: 3267676 - DNA, 15 bp, Homo sapiens
acggattttcagtta

SEQ ID NO: 3267677 - DNA, 14 bp, Homo sapiens
acggcaacagcatg

SEQ ID NO: 3267678 - DNA, 21 bp, Homo sapiens
acggcagaaaacagagcctgc

SEQ ID NO: 3267679 - DNA, 15 bp, Homo sapiens
acggcaggctcactg

SEQ ID NO: 3267680 - DNA, 12 bp, Homo sapiens
acggccctgcaa

SEQ ID NO: 3267681 - DNA, 14 bp, Homo sapiens
acggccgctccagg

SEQ ID NO: 3267682 - DNA, 22 bp, Homo sapiens
acggcctggctggtgggaaggc

SEQ ID NO: 3267683 - DNA, 23 bp, Homo sapiens
acggcctggctggtgggaaggcc

SEQ ID NO: 3267684 - DNA, 15 bp, Homo sapiens
acggcggccaggcac

SEQ ID NO: 3267685 - DNA, 21 bp, Homo sapiens
acggcgtggtgtgtccctgga

SEQ ID NO: 3267686 - DNA, 21 bp, Homo sapiens
acggctaacctggacctggaa

SEQ ID NO: 3267687 - DNA, 18 bp, Homo sapiens
acggctaagaggctgctg

SEQ ID NO: 3267688 - DNA, 15 bp, Homo sapiens
acggctcactgcagc

SEQ ID NO: 3267689 - DNA, 22 bp, Homo sapiens
acggctgggtgtttcagtttga

SEQ ID NO: 3267690 - DNA, 23 bp, Homo sapiens
acggctgtggaccgtggacaggc

SEQ ID NO: 3267691 - DNA, 23 bp, Homo sapiens
acggcttagacttcgactcagga

SEQ ID NO: 3267692 - DNA, 23 bp, Homo sapiens
acgggagctggggagaggaaaga

SEQ ID NO: 3267693 - DNA, 15 bp, Homo sapiens
acgggaggccccagc

SEQ ID NO: 3267694 - DNA, 17 bp, Homo sapiens
acgggaggccccagctc

SEQ ID NO: 3267695 - DNA, 12 bp, Homo sapiens
acgggaggctgg

SEQ ID NO: 3267696 - DNA, 18 bp, Homo sapiens
acgggtgggcggctggag

SEQ ID NO: 3267697 - DNA, 13 bp, Homo sapiens
acgggtggtcccc

SEQ ID NO: 3267698 - DNA, 15 bp, Homo sapiens
acgggttggggccgg

SEQ ID NO: 3267699 - DNA, 20 bp, Homo sapiens
acgggttgttttgggtgaat

SEQ ID NO: 3267700 - DNA, 15 bp, Homo sapiens
acggtgcccaagcca

SEQ ID NO: 3267701 - DNA, 15 bp, Homo sapiens
acggtgcgtggctgt

SEQ ID NO: 3267702 - DNA, 11 bp, Homo sapiens
acggttcctgg

SEQ ID NO: 3267703 - DNA, 19 bp, Homo sapiens
acggttcctggtgactcct

SEQ ID NO: 3267704 - DNA, 16 bp, Homo sapiens
acgtaaaaataaaagc

SEQ ID NO: 3267705 - DNA, 17 bp, Homo sapiens
acgtagctgaggccgga

SEQ ID NO: 3267706 - DNA, 13 bp, Homo sapiens
acgtatgcaagtc

SEQ ID NO: 3267707 - DNA, 21 bp, Homo sapiens
acgtcactggaccactgggca

SEQ ID NO: 3267708 - DNA, 16 bp, Homo sapiens
acgtccatagctcctc

SEQ ID NO: 3267709 - DNA, 22 bp, Homo sapiens
acgtcccagcatccctggagca

SEQ ID NO: 3267710 - DNA, 15 bp, Homo sapiens
acgtcctatctcccc

SEQ ID NO: 3267711 - DNA, 17 bp, Homo sapiens
acgtcctatctccccca

SEQ ID NO: 3267712 - DNA, 15 bp, Homo sapiens
acgtctgccaggccc

SEQ ID NO: 3267713 - DNA, 16 bp, Homo sapiens
acgtctggccaggcac

SEQ ID NO: 3267714 - DNA, 17 bp, Homo sapiens
acgtctggccaggcact

SEQ ID NO: 3267715 - DNA, 14 bp, Homo sapiens
acgtctgtcttcac

SEQ ID NO: 3267716 - DNA, 15 bp, Homo sapiens
acgtctgtcttcaca

SEQ ID NO: 3267717 - DNA, 16 bp, Homo sapiens
acgtcttggtgccttt

SEQ ID NO: 3267718 - DNA, 15 bp, Homo sapiens
acgtctttctttttt

SEQ ID NO: 3267719 - DNA, 21 bp, Homo sapiens
acgtgaccggacttttctgca

SEQ ID NO: 3267720 - DNA, 18 bp, Homo sapiens
acgtgagagaaagagaga

SEQ ID NO: 3267721 - DNA, 21 bp, Homo sapiens
acgtgagagaaagagagaagc

SEQ ID NO: 3267722 - DNA, 22 bp, Homo sapiens
acgtgagagaaagagagaagcc

SEQ ID NO: 3267723 - DNA, 20 bp, Homo sapiens
acgtgcacctgtactcagga

SEQ ID NO: 3267724 - DNA, 16 bp, Homo sapiens
acgtgccagctctagt

SEQ ID NO: 3267725 - DNA, 23 bp, Homo sapiens
acgtgcctgtgatcccagctact

SEQ ID NO: 3267726 - DNA, 20 bp, Homo sapiens
acgtgccttttgcacccctc

SEQ ID NO: 3267727 - DNA, 21 bp, Homo sapiens
acgtgccttttgcacccctcc

SEQ ID NO: 3267728 - DNA, 14 bp, Homo sapiens
acgtggaacctctg

SEQ ID NO: 3267729 - DNA, 18 bp, Homo sapiens
acgtggaacctctgtctc

SEQ ID NO: 3267730 - DNA, 14 bp, Homo sapiens
acgtggagagctgg

SEQ ID NO: 3267731 - DNA, 15 bp, Homo sapiens
acgtggagagctggt

SEQ ID NO: 3267732 - DNA, 18 bp, Homo sapiens
acgtggagagctggtgcc

SEQ ID NO: 3267733 - DNA, 22 bp, Homo sapiens
acgtggatgggcaaagcttgtc

SEQ ID NO: 3267734 - DNA, 15 bp, Homo sapiens
acgtggcatgtggcc

SEQ ID NO: 3267735 - DNA, 16 bp, Homo sapiens
acgtgggagacaagaa

SEQ ID NO: 3267736 - DNA, 19 bp, Homo sapiens
acgtgggcaaacaggcagt

SEQ ID NO: 3267737 - DNA, 21 bp, Homo sapiens
acgtggtcactgtgcactgcc

SEQ ID NO: 3267738 - DNA, 18 bp, Homo sapiens
acgtgtatagtatctgta

SEQ ID NO: 3267739 - DNA, 20 bp, Homo sapiens
acgtgtgcgcacgcgcagcg

SEQ ID NO: 3267740 - DNA, 11 bp, Homo sapiens
acgtgtttaaa

SEQ ID NO: 3267741 - DNA, 22 bp, Homo sapiens
acgtgttttattcctgtatgtt

SEQ ID NO: 3267742 - DNA, 21 bp, Homo sapiens
acgttcacccatcttatcaag

SEQ ID NO: 3267743 - DNA, 18 bp, Homo sapiens
acgttcgatttctacctc

SEQ ID NO: 3267744 - DNA, 21 bp, Homo sapiens
acgttcgatttctacctcagc

SEQ ID NO: 3267745 - DNA, 15 bp, Homo sapiens
acgttctcacaccca

SEQ ID NO: 3267746 - DNA, 16 bp, Homo sapiens
acgttgagcccctgga

SEQ ID NO: 3267747 - DNA, 13 bp, Homo sapiens
acgttgctcccca

SEQ ID NO: 3267748 - DNA, 18 bp, Homo sapiens
acgttggagaagcccgtg

SEQ ID NO: 3267749 - DNA, 19 bp, Homo sapiens
acgttggagaagcccgtgt

SEQ ID NO: 3267750 - DNA, 12 bp, Homo sapiens
acgttggtgacg

SEQ ID NO: 3267751 - DNA, 22 bp, Homo sapiens
acgtttaaagttctgtgtattt

SEQ ID NO: 3267752 - DNA, 22 bp, Homo sapiens
acgtttaactgcagttgacttt

SEQ ID NO: 3267753 - DNA, 24 bp, Homo sapiens
acgtttaactgcagttgactttct

SEQ ID NO: 3267754 - DNA, 11 bp, Homo sapiens
acgtttataaa

SEQ ID NO: 3267755 - DNA, 14 bp, Homo sapiens
acgtttataaacag

SEQ ID NO: 3267756 - DNA, 19 bp, Homo sapiens
acgtttataaacagaaatg

SEQ ID NO: 3267757 - DNA, 17 bp, Homo sapiens
acgtttcagtaataaaa

SEQ ID NO: 3267758 - DNA, 12 bp, Homo sapiens
acgtttccatca

SEQ ID NO: 3267759 - DNA, 18 bp, Homo sapiens
actaaaaaatgtctatag

SEQ ID NO: 3267760 - DNA, 13 bp, Homo sapiens
actaaaaatatag

SEQ ID NO: 3267761 - DNA, 19 bp, Homo sapiens
actaaaaatattcctccaa

SEQ ID NO: 3267762 - DNA, 13 bp, Homo sapiens
actaaaaatattg

SEQ ID NO: 3267763 - DNA, 15 bp, Homo sapiens
actaaaaatattgtt

SEQ ID NO: 3267764 - DNA, 21 bp, Homo sapiens
actaaaaatattgtttctgca

SEQ ID NO: 3267765 - DNA, 12 bp, Homo sapiens
actaaaagatcg

SEQ ID NO: 3267766 - DNA, 14 bp, Homo sapiens
actaaaatatgtct

SEQ ID NO: 3267767 - DNA, 14 bp, Homo sapiens
actaaaatatttat

SEQ ID NO: 3267768 - DNA, 18 bp, Homo sapiens
actaaacatatgatttca

SEQ ID NO: 3267769 - DNA, 14 bp, Homo sapiens
actaaacattttgt

SEQ ID NO: 3267770 - DNA, 20 bp, Homo sapiens
actaaactacattgttctta

SEQ ID NO: 3267771 - DNA, 17 bp, Homo sapiens
actaaactatctgtatt

SEQ ID NO: 3267772 - DNA, 23 bp, Homo sapiens
actaaactggtttgttgcagcca

SEQ ID NO: 3267773 - DNA, 19 bp, Homo sapiens
actaaactttatttgtaaa

SEQ ID NO: 3267774 - DNA, 17 bp, Homo sapiens
actaaactttttttctg

SEQ ID NO: 3267775 - DNA, 19 bp, Homo sapiens
actaaactttttttctgta

SEQ ID NO: 3267776 - DNA, 22 bp, Homo sapiens
actaaagatatcagagctctta

SEQ ID NO: 3267777 - DNA, 16 bp, Homo sapiens
actaaagatccaagaa

SEQ ID NO: 3267778 - DNA, 16 bp, Homo sapiens
actaaagctatgttac

SEQ ID NO: 3267779 - DNA, 16 bp, Homo sapiens
actaaagtatagagaa

SEQ ID NO: 3267780 - DNA, 12 bp, Homo sapiens
actaaataatga

SEQ ID NO: 3267781 - DNA, 13 bp, Homo sapiens
actaaatatctgt

SEQ ID NO: 3267782 - DNA, 19 bp, Homo sapiens
actaaatcagagacaaaat

SEQ ID NO: 3267783 - DNA, 17 bp, Homo sapiens
actaaatctctaatatg

SEQ ID NO: 3267784 - DNA, 14 bp, Homo sapiens
actaaatgttctat

SEQ ID NO: 3267785 - DNA, 21 bp, Homo sapiens
actaaattgtatacattttgt

SEQ ID NO: 3267786 - DNA, 12 bp, Homo sapiens
actaaatttaaa

SEQ ID NO: 3267787 - DNA, 13 bp, Homo sapiens
actaaatttgata

SEQ ID NO: 3267788 - DNA, 21 bp, Homo sapiens
actaaatttgatacttatatt

SEQ ID NO: 3267789 - DNA, 22 bp, Homo sapiens
actaacaagatttgtaattaca

SEQ ID NO: 3267790 - DNA, 23 bp, Homo sapiens
actaacaagatttgtaattacag

SEQ ID NO: 3267791 - DNA, 16 bp, Homo sapiens
actaacagataagcaa

SEQ ID NO: 3267792 - DNA, 17 bp, Homo sapiens
actaacagataagcaag

SEQ ID NO: 3267793 - DNA, 18 bp, Homo sapiens
actaacaggccaaagagt

SEQ ID NO: 3267794 - DNA, 15 bp, Homo sapiens
actaacatataatgt

SEQ ID NO: 3267795 - DNA, 17 bp, Homo sapiens
actaacatgtcctgcct

SEQ ID NO: 3267796 - DNA, 23 bp, Homo sapiens
actaacatttcccccgagctctt

SEQ ID NO: 3267797 - DNA, 15 bp, Homo sapiens
actaaccaagctgag

SEQ ID NO: 3267798 - DNA, 21 bp, Homo sapiens
actaaccaagctgagtttcct

SEQ ID NO: 3267799 - DNA, 12 bp, Homo sapiens
actaaccacgct

SEQ ID NO: 3267800 - DNA, 13 bp, Homo sapiens
actaaccacgctg

SEQ ID NO: 3267801 - DNA, 20 bp, Homo sapiens
actaactagacaccaaagtt

SEQ ID NO: 3267802 - DNA, 22 bp, Homo sapiens
actaactagacaccaaagttct

SEQ ID NO: 3267803 - DNA, 22 bp, Homo sapiens
actaactcaaatacacatttgc

SEQ ID NO: 3267804 - DNA, 17 bp, Homo sapiens
actaagaaacttttgta

SEQ ID NO: 3267805 - DNA, 23 bp, Homo sapiens
actaagaaatattccaaatgtct

SEQ ID NO: 3267806 - DNA, 16 bp, Homo sapiens
actaagaattcaaact

SEQ ID NO: 3267807 - DNA, 18 bp, Homo sapiens
actaagaattcaaactgg

SEQ ID NO: 3267808 - DNA, 18 bp, Homo sapiens
actaagagaaaattgcac

SEQ ID NO: 3267809 - DNA, 18 bp, Homo sapiens
actaagccacaagaaatt

SEQ ID NO: 3267810 - DNA, 21 bp, Homo sapiens
actaagccctcgaaccaaggc

SEQ ID NO: 3267811 - DNA, 13 bp, Homo sapiens
actaagccctgtc

SEQ ID NO: 3267812 - DNA, 22 bp, Homo sapiens
actaagccctgtcgagacactt

SEQ ID NO: 3267813 - DNA, 17 bp, Homo sapiens
actaagttatagtatat

SEQ ID NO: 3267814 - DNA, 13 bp, Homo sapiens
actaagttcacat

SEQ ID NO: 3267815 - DNA, 16 bp, Homo sapiens
actaatagaataaagg

SEQ ID NO: 3267816 - DNA, 17 bp, Homo sapiens
actaatagaataaaggc

SEQ ID NO: 3267817 - DNA, 13 bp, Homo sapiens
actaatagtttgt

SEQ ID NO: 3267818 - DNA, 15 bp, Homo sapiens
actaatatgggcatt

SEQ ID NO: 3267819 - DNA, 22 bp, Homo sapiens
actaatatgggcattgtagtta

SEQ ID NO: 3267820 - DNA, 19 bp, Homo sapiens
actaatcgaactatgaact

SEQ ID NO: 3267821 - DNA, 20 bp, Homo sapiens
actaatctattgggttcatt

SEQ ID NO: 3267822 - DNA, 19 bp, Homo sapiens
actaatctgggaagggaag

SEQ ID NO: 3267823 - DNA, 19 bp, Homo sapiens
actaatgccttactcttct

SEQ ID NO: 3267824 - DNA, 23 bp, Homo sapiens
actaatgccttactcttcttgaa

SEQ ID NO: 3267825 - DNA, 24 bp, Homo sapiens
actaatgccttactcttcttgaaa

SEQ ID NO: 3267826 - DNA, 22 bp, Homo sapiens
actaattatcacgtctgacaaa

SEQ ID NO: 3267827 - DNA, 14 bp, Homo sapiens
actaattgacttgc

SEQ ID NO: 3267828 - DNA, 15 bp, Homo sapiens
actaatttaaaaaat

SEQ ID NO: 3267829 - DNA, 19 bp, Homo sapiens
actaatttcaaaatgcttt

SEQ ID NO: 3267830 - DNA, 20 bp, Homo sapiens
actaatttcaaaatgctttt

SEQ ID NO: 3267831 - DNA, 15 bp, Homo sapiens
actaattttacatgt

SEQ ID NO: 3267832 - DNA, 16 bp, Homo sapiens
actaattttgttgaaa

SEQ ID NO: 3267833 - DNA, 18 bp, Homo sapiens
actaatttttgtattatt

SEQ ID NO: 3267834 - DNA, 21 bp, Homo sapiens
actaattttttaagaggaatt

SEQ ID NO: 3267835 - DNA, 14 bp, Homo sapiens
actacaaaatacaa

SEQ ID NO: 3267836 - DNA, 18 bp, Homo sapiens
actacaaaatttgaaatt

SEQ ID NO: 3267837 - DNA, 16 bp, Homo sapiens
actacaaagctttgct

SEQ ID NO: 3267838 - DNA, 13 bp, Homo sapiens
actacacacagta

SEQ ID NO: 3267839 - DNA, 16 bp, Homo sapiens
actacagacctgcttt

SEQ ID NO: 3267840 - DNA, 23 bp, Homo sapiens
actacataaactgactttatcct

SEQ ID NO: 3267841 - DNA, 18 bp, Homo sapiens
actacatctttaaacagt

SEQ ID NO: 3267842 - DNA, 15 bp, Homo sapiens
actacattatggaat

SEQ ID NO: 3267843 - DNA, 16 bp, Homo sapiens
actacattatggaatc

SEQ ID NO: 3267844 - DNA, 21 bp, Homo sapiens
actaccaagaggccctgtctg

SEQ ID NO: 3267845 - DNA, 13 bp, Homo sapiens
actaccacaagga

SEQ ID NO: 3267846 - DNA, 23 bp, Homo sapiens
actacccacgttctcacacccac

SEQ ID NO: 3267847 - DNA, 15 bp, Homo sapiens
actacctctggacag

SEQ ID NO: 3267848 - DNA, 18 bp, Homo sapiens
actacggaatagttggct

SEQ ID NO: 3267849 - DNA, 14 bp, Homo sapiens
actacgtgccagct

SEQ ID NO: 3267850 - DNA, 13 bp, Homo sapiens
actactaaagtgc

SEQ ID NO: 3267851 - DNA, 13 bp, Homo sapiens
actactacctctt

SEQ ID NO: 3267852 - DNA, 22 bp, Homo sapiens
actactacctcttaagtcccag

SEQ ID NO: 3267853 - DNA, 18 bp, Homo sapiens
actactcaatactacctc

SEQ ID NO: 3267854 - DNA, 15 bp, Homo sapiens
actactcagttatta

SEQ ID NO: 3267855 - DNA, 19 bp, Homo sapiens
actactcctctgcagtgcc

SEQ ID NO: 3267856 - DNA, 21 bp, Homo sapiens
actactcctctgcagtgcctt

SEQ ID NO: 3267857 - DNA, 13 bp, Homo sapiens
actactgtgttcc

SEQ ID NO: 3267858 - DNA, 15 bp, Homo sapiens
actagaaatctgcca

SEQ ID NO: 3267859 - DNA, 19 bp, Homo sapiens
actagaagaaaagcccatt

SEQ ID NO: 3267860 - DNA, 20 bp, Homo sapiens
actagaattagtatgtctgt

SEQ ID NO: 3267861 - DNA, 15 bp, Homo sapiens
actagaatttattca

SEQ ID NO: 3267862 - DNA, 17 bp, Homo sapiens
actagaatttgtatttt

SEQ ID NO: 3267863 - DNA, 17 bp, Homo sapiens
actagacaccaaagttc

SEQ ID NO: 3267864 - DNA, 18 bp, Homo sapiens
actagacaccaaagttct

SEQ ID NO: 3267865 - DNA, 13 bp, Homo sapiens
actagacatgtca

SEQ ID NO: 3267866 - DNA, 15 bp, Homo sapiens
actagacattctgtc

SEQ ID NO: 3267867 - DNA, 16 bp, Homo sapiens
actagacgttcatttg

SEQ ID NO: 3267868 - DNA, 11 bp, Homo sapiens
actagactctt

SEQ ID NO: 3267869 - DNA, 12 bp, Homo sapiens
actagagaaacc

SEQ ID NO: 3267870 - DNA, 12 bp, Homo sapiens
actagagaatgc

SEQ ID NO: 3267871 - DNA, 16 bp, Homo sapiens
actagagatgtgcaat

SEQ ID NO: 3267872 - DNA, 16 bp, Homo sapiens
actagaggcagggagg

SEQ ID NO: 3267873 - DNA, 13 bp, Homo sapiens
actagatactact

SEQ ID NO: 3267874 - DNA, 13 bp, Homo sapiens
actagatgatgga

SEQ ID NO: 3267875 - DNA, 14 bp, Homo sapiens
actagatttgtcct

SEQ ID NO: 3267876 - DNA, 15 bp, Homo sapiens
actagatttgtcctt

SEQ ID NO: 3267877 - DNA, 23 bp, Homo sapiens
actagcaggcaatgctgtacttt

SEQ ID NO: 3267878 - DNA, 18 bp, Homo sapiens
actagccaaaccaggacc

SEQ ID NO: 3267879 - DNA, 16 bp, Homo sapiens
actagccaaggctagt

SEQ ID NO: 3267880 - DNA, 18 bp, Homo sapiens
actagcctttggctctgg

SEQ ID NO: 3267881 - DNA, 16 bp, Homo sapiens
actagcttttcaaaca

SEQ ID NO: 3267882 - DNA, 16 bp, Homo sapiens
actaggactctgaggc

SEQ ID NO: 3267883 - DNA, 21 bp, Homo sapiens
actaggatacagaaatgcaaa

SEQ ID NO: 3267884 - DNA, 22 bp, Homo sapiens
actaggcccccacttgcctctt

SEQ ID NO: 3267885 - DNA, 23 bp, Homo sapiens
actaggcccccacttgcctcttc

SEQ ID NO: 3267886 - DNA, 22 bp, Homo sapiens
actaggctcttatgtgtgcctt

SEQ ID NO: 3267887 - DNA, 14 bp, Homo sapiens
actaggctgagcaa

SEQ ID NO: 3267888 - DNA, 23 bp, Homo sapiens
actaggctgagcaatctgaccct

SEQ ID NO: 3267889 - DNA, 21 bp, Homo sapiens
actagggattcaggctgcttg

SEQ ID NO: 3267890 - DNA, 22 bp, Homo sapiens
actaggggatataggagaggaa

SEQ ID NO: 3267891 - DNA, 13 bp, Homo sapiens
actaggtaaaatt

SEQ ID NO: 3267892 - DNA, 21 bp, Homo sapiens
actaggtaacttattagaaac

SEQ ID NO: 3267893 - DNA, 14 bp, Homo sapiens
actaggtaacttca

SEQ ID NO: 3267894 - DNA, 16 bp, Homo sapiens
actaggtaacttcata

SEQ ID NO: 3267895 - DNA, 16 bp, Homo sapiens
actaggtaatgttttg

SEQ ID NO: 3267896 - DNA, 19 bp, Homo sapiens
actaggtaatgttttgtat

SEQ ID NO: 3267897 - DNA, 18 bp, Homo sapiens
actaggtcaaaaatctgt

SEQ ID NO: 3267898 - DNA, 21 bp, Homo sapiens
actaggttcaattccctgaag

SEQ ID NO: 3267899 - DNA, 16 bp, Homo sapiens
actagtacaaattata

SEQ ID NO: 3267900 - DNA, 17 bp, Homo sapiens
actagtagatttctatg

SEQ ID NO: 3267901 - DNA, 13 bp, Homo sapiens
actagtcacccca

SEQ ID NO: 3267902 - DNA, 22 bp, Homo sapiens
actagtcaccccaagtagtctg

SEQ ID NO: 3267903 - DNA, 19 bp, Homo sapiens
actagtgaccccttccctg

SEQ ID NO: 3267904 - DNA, 15 bp, Homo sapiens
actagttacacatct

SEQ ID NO: 3267905 - DNA, 17 bp, Homo sapiens
actagttttagttttct

SEQ ID NO: 3267906 - DNA, 23 bp, Homo sapiens
actagtttttagaaaagaaagca

SEQ ID NO: 3267907 - DNA, 12 bp, Homo sapiens
actataaagaga

SEQ ID NO: 3267908 - DNA, 13 bp, Homo sapiens
actataaagagaa

SEQ ID NO: 3267909 - DNA, 17 bp, Homo sapiens
actataacatatgtaca

SEQ ID NO: 3267910 - DNA, 13 bp, Homo sapiens
actataagtagtt

SEQ ID NO: 3267911 - DNA, 21 bp, Homo sapiens
actataagtagttggtttgta

SEQ ID NO: 3267912 - DNA, 22 bp, Homo sapiens
actataagtagttggtttgtat

SEQ ID NO: 3267913 - DNA, 12 bp, Homo sapiens
actataatcaaa

SEQ ID NO: 3267914 - DNA, 14 bp, Homo sapiens
actataatcaaatg

SEQ ID NO: 3267915 - DNA, 16 bp, Homo sapiens
actataatcaaatgat

SEQ ID NO: 3267916 - DNA, 20 bp, Homo sapiens
actataatcaaatgatttca

SEQ ID NO: 3267917 - DNA, 22 bp, Homo sapiens
actataatcaaatgatttcata

SEQ ID NO: 3267918 - DNA, 21 bp, Homo sapiens
actataatgtaagctctactg

SEQ ID NO: 3267919 - DNA, 17 bp, Homo sapiens
actatagcctaggtgac

SEQ ID NO: 3267920 - DNA, 22 bp, Homo sapiens
actatagcctaggtgacagagt

SEQ ID NO: 3267921 - DNA, 20 bp, Homo sapiens
actatagcttgcagaactgt

SEQ ID NO: 3267922 - DNA, 14 bp, Homo sapiens
actatatacatata

SEQ ID NO: 3267923 - DNA, 17 bp, Homo sapiens
actatatacatatatat

SEQ ID NO: 3267924 - DNA, 14 bp, Homo sapiens
actatatacatgtg

SEQ ID NO: 3267925 - DNA, 20 bp, Homo sapiens
actatatatataaatgtata

SEQ ID NO: 3267926 - DNA, 13 bp, Homo sapiens
actatatgtgaat

SEQ ID NO: 3267927 - DNA, 15 bp, Homo sapiens
actatatgtttacac

SEQ ID NO: 3267928 - DNA, 18 bp, Homo sapiens
actatattgattgtcctt

SEQ ID NO: 3267929 - DNA, 18 bp, Homo sapiens
actatccatgcaccaaac

SEQ ID NO: 3267930 - DNA, 16 bp, Homo sapiens
actatctaaatgttga

SEQ ID NO: 3267931 - DNA, 14 bp, Homo sapiens
actatctgtattta

SEQ ID NO: 3267932 - DNA, 17 bp, Homo sapiens
actatctgtctggtggc

SEQ ID NO: 3267933 - DNA, 21 bp, Homo sapiens
actatctgttcccctgtcctg

SEQ ID NO: 3267934 - DNA, 14 bp, Homo sapiens
actatcttcttcaa

SEQ ID NO: 3267935 - DNA, 20 bp, Homo sapiens
actatcttcttcaaatacaa

SEQ ID NO: 3267936 - DNA, 16 bp, Homo sapiens
actatcttggtgaatt

SEQ ID NO: 3267937 - DNA, 18 bp, Homo sapiens
actatgaacttctctcag

SEQ ID NO: 3267938 - DNA, 14 bp, Homo sapiens
actatggaaaatca

SEQ ID NO: 3267939 - DNA, 15 bp, Homo sapiens
actatggctccaaca

SEQ ID NO: 3267940 - DNA, 14 bp, Homo sapiens
actatgggtgagca

SEQ ID NO: 3267941 - DNA, 19 bp, Homo sapiens
actatggtatgctggccag

SEQ ID NO: 3267942 - DNA, 22 bp, Homo sapiens
actatggtatgctggccagcac

SEQ ID NO: 3267943 - DNA, 15 bp, Homo sapiens
actatggtatttgag

SEQ ID NO: 3267944 - DNA, 18 bp, Homo sapiens
actatgtcgatgcacagt

SEQ ID NO: 3267945 - DNA, 11 bp, Homo sapiens
actatgtgctg

SEQ ID NO: 3267946 - DNA, 22 bp, Homo sapiens
actatgtggctgaaaatgcaaa

SEQ ID NO: 3267947 - DNA, 23 bp, Homo sapiens
actatgtggctgaaaatgcaaag

SEQ ID NO: 3267948 - DNA, 23 bp, Homo sapiens
actatgttgcccaggcaggtctt

SEQ ID NO: 3267949 - DNA, 15 bp, Homo sapiens
actattaaaatattt

SEQ ID NO: 3267950 - DNA, 18 bp, Homo sapiens
actattaaaatattttgg

SEQ ID NO: 3267951 - DNA, 14 bp, Homo sapiens
actattaagcagta

SEQ ID NO: 3267952 - DNA, 12 bp, Homo sapiens
actattattgtt

SEQ ID NO: 3267953 - DNA, 14 bp, Homo sapiens
actatttaaactta

SEQ ID NO: 3267954 - DNA, 20 bp, Homo sapiens
actatttaaagcctcctcat

SEQ ID NO: 3267955 - DNA, 22 bp, Homo sapiens
actatttctgggtcttttgcta

SEQ ID NO: 3267956 - DNA, 23 bp, Homo sapiens
actatttctgggtcttttgctac

SEQ ID NO: 3267957 - DNA, 11 bp, Homo sapiens
actatttctgt

SEQ ID NO: 3267958 - DNA, 18 bp, Homo sapiens
actatttgtctttcagga

SEQ ID NO: 3267959 - DNA, 12 bp, Homo sapiens
actattttcaga

SEQ ID NO: 3267960 - DNA, 13 bp, Homo sapiens
actattttcagaa

SEQ ID NO: 3267961 - DNA, 19 bp, Homo sapiens
actattttcagaatctgaa

SEQ ID NO: 3267962 - DNA, 14 bp, Homo sapiens
actatttttgtaaa

SEQ ID NO: 3267963 - DNA, 19 bp, Homo sapiens
actatttttgtaaaagaca

SEQ ID NO: 3267964 - DNA, 17 bp, Homo sapiens
actatttttgtgtttga

SEQ ID NO: 3267965 - DNA, 20 bp, Homo sapiens
actcaaaagctgggaaccag

SEQ ID NO: 3267966 - DNA, 17 bp, Homo sapiens
actcaaaatatttgtac

SEQ ID NO: 3267967 - DNA, 20 bp, Homo sapiens
actcaaaatatttgtacata

SEQ ID NO: 3267968 - DNA, 21 bp, Homo sapiens
actcaaactgaggaatttcac

SEQ ID NO: 3267969 - DNA, 23 bp, Homo sapiens
actcaaactgaggaatttcacct

SEQ ID NO: 3267970 - DNA, 16 bp, Homo sapiens
actcaaatacacattt

SEQ ID NO: 3267971 - DNA, 16 bp, Homo sapiens
actcaaatgagtaaca

SEQ ID NO: 3267972 - DNA, 20 bp, Homo sapiens
actcaacatgttactgacca

SEQ ID NO: 3267973 - DNA, 16 bp, Homo sapiens
actcaactctgagccc

SEQ ID NO: 3267974 - DNA, 20 bp, Homo sapiens
actcaactgggctctgtccc

SEQ ID NO: 3267975 - DNA, 12 bp, Homo sapiens
actcaagcactg

SEQ ID NO: 3267976 - DNA, 22 bp, Homo sapiens
actcaataaattgcaacatatt

SEQ ID NO: 3267977 - DNA, 14 bp, Homo sapiens
actcaatactacct

SEQ ID NO: 3267978 - DNA, 23 bp, Homo sapiens
actcaatctccccttgcactaaa

SEQ ID NO: 3267979 - DNA, 16 bp, Homo sapiens
actcaatgcactgaca

SEQ ID NO: 3267980 - DNA, 21 bp, Homo sapiens
actcacacctgaactgaacac

SEQ ID NO: 3267981 - DNA, 14 bp, Homo sapiens
actcacagacctgg

SEQ ID NO: 3267982 - DNA, 21 bp, Homo sapiens
actcacagcacttgttttcag

SEQ ID NO: 3267983 - DNA, 22 bp, Homo sapiens
actcacagcacttgttttcagg

SEQ ID NO: 3267984 - DNA, 23 bp, Homo sapiens
actcacaggttggaagagaatca

SEQ ID NO: 3267985 - DNA, 20 bp, Homo sapiens
actcacatttattctgctca

SEQ ID NO: 3267986 - DNA, 21 bp, Homo sapiens
actcaccagccccactgccag

SEQ ID NO: 3267987 - DNA, 15 bp, Homo sapiens
actcaccagggtccg

SEQ ID NO: 3267988 - DNA, 17 bp, Homo sapiens
actcaccagtgtcccct

SEQ ID NO: 3267989 - DNA, 22 bp, Homo sapiens
actcaccctgggagccagtcct

SEQ ID NO: 3267990 - DNA, 22 bp, Homo sapiens
actcaccgtgctgtcttctggt

SEQ ID NO: 3267991 - DNA, 23 bp, Homo sapiens
actcaccgtgctgtcttctggtc

SEQ ID NO: 3267992 - DNA, 20 bp, Homo sapiens
actcacctaatgtttatgag

SEQ ID NO: 3267993 - DNA, 12 bp, Homo sapiens
actcaccttcta

SEQ ID NO: 3267994 - DNA, 15 bp, Homo sapiens
actcactaggccccc

SEQ ID NO: 3267995 - DNA, 22 bp, Homo sapiens
actcactaggcccccacttgcc

SEQ ID NO: 3267996 - DNA, 16 bp, Homo sapiens
actcacttacatcttc

SEQ ID NO: 3267997 - DNA, 23 bp, Homo sapiens
actcacttcaatgtgtcatttcc

SEQ ID NO: 3267998 - DNA, 23 bp, Homo sapiens
actcactttcccttgtgtcaaga

SEQ ID NO: 3267999 - DNA, 22 bp, Homo sapiens
actcagaaagaggtctccccat

SEQ ID NO: 3268000 - DNA, 18 bp, Homo sapiens
actcagaagacactgatg

SEQ ID NO: 3268001 - DNA, 16 bp, Homo sapiens
actcagaagcctgagg

SEQ ID NO: 3268002 - DNA, 20 bp, Homo sapiens
actcagaatataacatgtaa

SEQ ID NO: 3268003 - DNA, 14 bp, Homo sapiens
actcagagcagagc

SEQ ID NO: 3268004 - DNA, 14 bp, Homo sapiens
actcagaggctggg

SEQ ID NO: 3268005 - DNA, 17 bp, Homo sapiens
actcagatgaggacaga

SEQ ID NO: 3268006 - DNA, 14 bp, Homo sapiens
actcagccaagaca

SEQ ID NO: 3268007 - DNA, 21 bp, Homo sapiens
actcagccacgaccagcccct

SEQ ID NO: 3268008 - DNA, 18 bp, Homo sapiens
actcagccatttccccct

SEQ ID NO: 3268009 - DNA, 18 bp, Homo sapiens
actcagcccacctgcacc

SEQ ID NO: 3268010 - DNA, 21 bp, Homo sapiens
actcagcccacctgcacccag

SEQ ID NO: 3268011 - DNA, 16 bp, Homo sapiens
actcagcccctaggag

SEQ ID NO: 3268012 - DNA, 17 bp, Homo sapiens
actcagcccctaggagt

SEQ ID NO: 3268013 - DNA, 15 bp, Homo sapiens
actcagccctgaggt

SEQ ID NO: 3268014 - DNA, 16 bp, Homo sapiens
actcagcctgctgccc

SEQ ID NO: 3268015 - DNA, 18 bp, Homo sapiens
actcagcctgctgcccag

SEQ ID NO: 3268016 - DNA, 14 bp, Homo sapiens
actcagcgctcctc

SEQ ID NO: 3268017 - DNA, 14 bp, Homo sapiens
actcaggcgcctgg

SEQ ID NO: 3268018 - DNA, 16 bp, Homo sapiens
actcaggcgcctggca

SEQ ID NO: 3268019 - DNA, 18 bp, Homo sapiens
actcaggcgcctggcaca

SEQ ID NO: 3268020 - DNA, 13 bp, Homo sapiens
actcagggacaga

SEQ ID NO: 3268021 - DNA, 18 bp, Homo sapiens
actcagggacagagccat

SEQ ID NO: 3268022 - DNA, 23 bp, Homo sapiens
actcagggaccggtgctgcagga

SEQ ID NO: 3268023 - DNA, 14 bp, Homo sapiens
actcagggctcctc

SEQ ID NO: 3268024 - DNA, 18 bp, Homo sapiens
actcagggctcctcccag

SEQ ID NO: 3268025 - DNA, 16 bp, Homo sapiens
actcagggttcatctg

SEQ ID NO: 3268026 - DNA, 17 bp, Homo sapiens
actcagggttcatctgt

SEQ ID NO: 3268027 - DNA, 21 bp, Homo sapiens
actcaggttcttcagggccag

SEQ ID NO: 3268028 - DNA, 19 bp, Homo sapiens
actcagtctctcttctctc

SEQ ID NO: 3268029 - DNA, 19 bp, Homo sapiens
actcagtttgtcagacttt

SEQ ID NO: 3268030 - DNA, 22 bp, Homo sapiens
actcagttttaactagaattta

SEQ ID NO: 3268031 - DNA, 21 bp, Homo sapiens
actcataaaaagcctgcaatt

SEQ ID NO: 3268032 - DNA, 18 bp, Homo sapiens
actcatagacactgatct

SEQ ID NO: 3268033 - DNA, 16 bp, Homo sapiens
actcatcataaaataa

SEQ ID NO: 3268034 - DNA, 19 bp, Homo sapiens
actcatcttactgtacctg

SEQ ID NO: 3268035 - DNA, 21 bp, Homo sapiens
actcattactgcaaattgatt

SEQ ID NO: 3268036 - DNA, 13 bp, Homo sapiens
actcattcctgta

SEQ ID NO: 3268037 - DNA, 15 bp, Homo sapiens
actcattccttcact

SEQ ID NO: 3268038 - DNA, 13 bp, Homo sapiens
actcattgaaatg

SEQ ID NO: 3268039 - DNA, 17 bp, Homo sapiens
acccagcggccccccgc

SEQ ID NO: 3268040 - DNA, 23 bp, Homo sapiens
acccagcgggcaggttctgcctg

SEQ ID NO: 3268041 - DNA, 15 bp, Homo sapiens
acccagcgtggcctc

SEQ ID NO: 3268042 - DNA, 13 bp, Homo sapiens
acccaggagcccc

SEQ ID NO: 3268043 - DNA, 15 bp, Homo sapiens
acccaggagccccga

SEQ ID NO: 3268044 - DNA, 19 bp, Homo sapiens
acccaggagccccgaggcc

SEQ ID NO: 3268045 - DNA, 17 bp, Homo sapiens
acccaggagtgtggcca

SEQ ID NO: 3268046 - DNA, 19 bp, Homo sapiens
acccaggccctccatgggc

SEQ ID NO: 3268047 - DNA, 21 bp, Homo sapiens
acccaggccctccatgggcta

SEQ ID NO: 3268048 - DNA, 15 bp, Homo sapiens
acccaggccgcagct

SEQ ID NO: 3268049 - DNA, 22 bp, Homo sapiens
acccaggccgcagctcttgccc

SEQ ID NO: 3268050 - DNA, 23 bp, Homo sapiens
acccaggctccgcccttagtccc

SEQ ID NO: 3268051 - DNA, 20 bp, Homo sapiens
acccaggctggagtgcagtg

SEQ ID NO: 3268052 - DNA, 17 bp, Homo sapiens
acccagggctctgcccc

SEQ ID NO: 3268053 - DNA, 21 bp, Homo sapiens
acccaggtcttccagacctgc

SEQ ID NO: 3268054 - DNA, 20 bp, Homo sapiens
acccaggtggagggcacagc

SEQ ID NO: 3268055 - DNA, 21 bp, Homo sapiens
acccaggtggagggcacagcc

SEQ ID NO: 3268056 - DNA, 22 bp, Homo sapiens
acccaggtggagggcacagccc

SEQ ID NO: 3268057 - DNA, 16 bp, Homo sapiens
acccagtctgttcccc

SEQ ID NO: 3268058 - DNA, 17 bp, Homo sapiens
acccagtgctgccatgc

SEQ ID NO: 3268059 - DNA, 18 bp, Homo sapiens
acccatagatcttctgaa

SEQ ID NO: 3268060 - DNA, 20 bp, Homo sapiens
acccatattgtaaaacaggt

SEQ ID NO: 3268061 - DNA, 10 bp, Homo sapiens
acccatctgt

SEQ ID NO: 3268062 - DNA, 23 bp, Homo sapiens
acccatgactttatatggatgat

SEQ ID NO: 3268063 - DNA, 12 bp, Homo sapiens
acccatgagcct

SEQ ID NO: 3268064 - DNA, 24 bp, Homo sapiens
acccatgtaaataccagactgcag

SEQ ID NO: 3268065 - DNA, 22 bp, Homo sapiens
acccatgtaatccttttgttta

SEQ ID NO: 3268066 - DNA, 20 bp, Homo sapiens
acccatgtcaccggtcagtg

SEQ ID NO: 3268067 - DNA, 21 bp, Homo sapiens
acccattaaggggaagaatga

SEQ ID NO: 3268068 - DNA, 16 bp, Homo sapiens
acccattcactacagg

SEQ ID NO: 3268069 - DNA, 21 bp, Homo sapiens
acccattcagagactgtccct

SEQ ID NO: 3268070 - DNA, 23 bp, Homo sapiens
acccattcccccatgtggctgaa

SEQ ID NO: 3268071 - DNA, 20 bp, Homo sapiens
acccatttaaatttttttcc

SEQ ID NO: 3268072 - DNA, 16 bp, Homo sapiens
accccaaagccccttg

SEQ ID NO: 3268073 - DNA, 18 bp, Homo sapiens
accccaaagctttcctgc

SEQ ID NO: 3268074 - DNA, 18 bp, Homo sapiens
accccaagagaactcgcg

SEQ ID NO: 3268075 - DNA, 16 bp, Homo sapiens
accccacaccccagcc

SEQ ID NO: 3268076 - DNA, 11 bp, Homo sapiens
accccacactt

SEQ ID NO: 3268077 - DNA, 13 bp, Homo sapiens
accccaccctcag

SEQ ID NO: 3268078 - DNA, 14 bp, Homo sapiens
accccaccctcagc

SEQ ID NO: 3268079 - DNA, 12 bp, Homo sapiens
accccacctgca

SEQ ID NO: 3268080 - DNA, 14 bp, Homo sapiens
accccactgccaag

SEQ ID NO: 3268081 - DNA, 13 bp, Homo sapiens
accccagcatcct

SEQ ID NO: 3268082 - DNA, 11 bp, Homo sapiens
accccagccca

SEQ ID NO: 3268083 - DNA, 12 bp, Homo sapiens
accccagcccac

SEQ ID NO: 3268084 - DNA, 12 bp, Homo sapiens
accccagcctga

SEQ ID NO: 3268085 - DNA, 16 bp, Homo sapiens
accccagcctgacctg

SEQ ID NO: 3268086 - DNA, 17 bp, Homo sapiens
accccagcctgacctga

SEQ ID NO: 3268087 - DNA, 17 bp, Homo sapiens
accccagctgggaggca

SEQ ID NO: 3268088 - DNA, 17 bp, Homo sapiens
accccagtcccagggaa

SEQ ID NO: 3268089 - DNA, 21 bp, Homo sapiens
accccagttctgctcctctcc

SEQ ID NO: 3268090 - DNA, 15 bp, Homo sapiens
accccagtttcttct

SEQ ID NO: 3268091 - DNA, 18 bp, Homo sapiens
accccatactctcctttt

SEQ ID NO: 3268092 - DNA, 15 bp, Homo sapiens
accccatcatccctt

SEQ ID NO: 3268093 - DNA, 14 bp, Homo sapiens
accccatgtgcctt

SEQ ID NO: 3268094 - DNA, 18 bp, Homo sapiens
accccatttgctttcttt

SEQ ID NO: 3268095 - DNA, 14 bp, Homo sapiens
acccccaagcctgg

SEQ ID NO: 3268096 - DNA, 15 bp, Homo sapiens
acccccaagcctggg

SEQ ID NO: 3268097 - DNA, 23 bp, Homo sapiens
acccccacaagctgtccctgcag

SEQ ID NO: 3268098 - DNA, 17 bp, Homo sapiens
acccccacacctcagtt

SEQ ID NO: 3268099 - DNA, 15 bp, Homo sapiens
acccccacccacctc

SEQ ID NO: 3268100 - DNA, 17 bp, Homo sapiens
acccccacccacctcca

SEQ ID NO: 3268101 - DNA, 12 bp, Homo sapiens
acccccacccca

SEQ ID NO: 3268102 - DNA, 12 bp, Homo sapiens
acccccagcact

SEQ ID NO: 3268103 - DNA, 11 bp, Homo sapiens
acccccagcca

SEQ ID NO: 3268104 - DNA, 13 bp, Homo sapiens
acccccagcctgc

SEQ ID NO: 3268105 - DNA, 21 bp, Homo sapiens
acccccagctcaatggactgg

SEQ ID NO: 3268106 - DNA, 22 bp, Homo sapiens
acccccagctttgcccaacacc

SEQ ID NO: 3268107 - DNA, 20 bp, Homo sapiens
accccccaacccctgaggaa

SEQ ID NO: 3268108 - DNA, 13 bp, Homo sapiens
accccccacctgc

SEQ ID NO: 3268109 - DNA, 12 bp, Homo sapiens
acccccctgttc

SEQ ID NO: 3268110 - DNA, 17 bp, Homo sapiens
acccccctgttctaagg

SEQ ID NO: 3268111 - DNA, 15 bp, Homo sapiens
acccccgccacctca

SEQ ID NO: 3268112 - DNA, 21 bp, Homo sapiens
acccccgccacctcagggcac

SEQ ID NO: 3268113 - DNA, 19 bp, Homo sapiens
accccctcaagccccagca

SEQ ID NO: 3268114 - DNA, 20 bp, Homo sapiens
accccctcaagccccagcag

SEQ ID NO: 3268115 - DNA, 16 bp, Homo sapiens
accccctcattgttta

SEQ ID NO: 3268116 - DNA, 14 bp, Homo sapiens
accccctcctggca

SEQ ID NO: 3268117 - DNA, 16 bp, Homo sapiens
accccctccttcagac

SEQ ID NO: 3268118 - DNA, 20 bp, Homo sapiens
accccctgagatcccctgag

SEQ ID NO: 3268119 - DNA, 14 bp, Homo sapiens
accccctgcccaca

SEQ ID NO: 3268120 - DNA, 13 bp, Homo sapiens
accccctgccctg

SEQ ID NO: 3268121 - DNA, 18 bp, Homo sapiens
accccctgctccaccagc

SEQ ID NO: 3268122 - DNA, 21 bp, Homo sapiens
accccctgctccaccagcagc

SEQ ID NO: 3268123 - DNA, 12 bp, Homo sapiens
acccccttcccc

SEQ ID NO: 3268124 - DNA, 23 bp, Homo sapiens
acccccttccccgctcttgccct

SEQ ID NO: 3268125 - DNA, 13 bp, Homo sapiens
acccccttctctg

SEQ ID NO: 3268126 - DNA, 16 bp, Homo sapiens
acccccttctgggcat

SEQ ID NO: 3268127 - DNA, 13 bp, Homo sapiens
accccctttgctg

SEQ ID NO: 3268128 - DNA, 21 bp, Homo sapiens
acccccttttcagctgagccc

SEQ ID NO: 3268129 - DNA, 22 bp, Homo sapiens
acccccttttcagctgagccct

SEQ ID NO: 3268130 - DNA, 18 bp, Homo sapiens
accccgaccacctgccca

SEQ ID NO: 3268131 - DNA, 15 bp, Homo sapiens
accccgcacccggct

SEQ ID NO: 3268132 - DNA, 16 bp, Homo sapiens
accccgcacccggctc

SEQ ID NO: 3268133 - DNA, 18 bp, Homo sapiens
accccgcagacaccttgg

SEQ ID NO: 3268134 - DNA, 14 bp, Homo sapiens
accccgcagcccgt

SEQ ID NO: 3268135 - DNA, 15 bp, Homo sapiens
accccgcagcccgtg

SEQ ID NO: 3268136 - DNA, 18 bp, Homo sapiens
accccgcggtgctctggc

SEQ ID NO: 3268137 - DNA, 19 bp, Homo sapiens
accccgcggtgctctggcg

SEQ ID NO: 3268138 - DNA, 22 bp, Homo sapiens
accccgcggtgctctggcggct

SEQ ID NO: 3268139 - DNA, 13 bp, Homo sapiens
accccggcaggcc

SEQ ID NO: 3268140 - DNA, 18 bp, Homo sapiens
accccggcaggccctgca

SEQ ID NO: 3268141 - DNA, 21 bp, Homo sapiens
accccggcaggccctgcagtg

SEQ ID NO: 3268142 - DNA, 22 bp, Homo sapiens
accccggcaggccctgcagtgt

SEQ ID NO: 3268143 - DNA, 13 bp, Homo sapiens
accccggcctcag

SEQ ID NO: 3268144 - DNA, 16 bp, Homo sapiens
accccgggctctctgc

SEQ ID NO: 3268145 - DNA, 21 bp, Homo sapiens
accccgggctctctgctgtac

SEQ ID NO: 3268146 - DNA, 20 bp, Homo sapiens
accccgtcgaggggctctca

SEQ ID NO: 3268147 - DNA, 18 bp, Homo sapiens
accccgttacagctcccc

SEQ ID NO: 3268148 - DNA, 20 bp, Homo sapiens
accccgttacagctccccaa

SEQ ID NO: 3268149 - DNA, 14 bp, Homo sapiens
acccctaagtgccc

SEQ ID NO: 3268150 - DNA, 17 bp, Homo sapiens
acccctagttccctctg

SEQ ID NO: 3268151 - DNA, 19 bp, Homo sapiens
acccctagttccctctgct

SEQ ID NO: 3268152 - DNA, 20 bp, Homo sapiens
acccctagttccctctgctc

SEQ ID NO: 3268153 - DNA, 12 bp, Homo sapiens
acccctcccctc

SEQ ID NO: 3268154 - DNA, 20 bp, Homo sapiens
acccctcccctccatccctg

SEQ ID NO: 3268155 - DNA, 18 bp, Homo sapiens
acccctccctctgtccac

SEQ ID NO: 3268156 - DNA, 14 bp, Homo sapiens
acccctcctcactg

SEQ ID NO: 3268157 - DNA, 18 bp, Homo sapiens
acccctctggccaggatg

SEQ ID NO: 3268158 - DNA, 20 bp, Homo sapiens
acccctgcccccagccccgg

SEQ ID NO: 3268159 - DNA, 15 bp, Homo sapiens
acccctgcctcccat

SEQ ID NO: 3268160 - DNA, 18 bp, Homo sapiens
acccctgctcccagcctg

SEQ ID NO: 3268161 - DNA, 19 bp, Homo sapiens
acccctggcttttcactgc

SEQ ID NO: 3268162 - DNA, 14 bp, Homo sapiens
acccctgggcaggc

SEQ ID NO: 3268163 - DNA, 15 bp, Homo sapiens
acattaaagttaata

SEQ ID NO: 3268164 - DNA, 12 bp, Homo sapiens
acattaacagtt

SEQ ID NO: 3268165 - DNA, 22 bp, Homo sapiens
acattaacagttttccatgaaa

SEQ ID NO: 3268166 - DNA, 16 bp, Homo sapiens
acattaacatctatta

SEQ ID NO: 3268167 - DNA, 13 bp, Homo sapiens
acattaagaatgt

SEQ ID NO: 3268168 - DNA, 15 bp, Homo sapiens
acattaagaatgttg

SEQ ID NO: 3268169 - DNA, 18 bp, Homo sapiens
acattaatagcagccttt

SEQ ID NO: 3268170 - DNA, 21 bp, Homo sapiens
acattaatcaatcatctgtgt

SEQ ID NO: 3268171 - DNA, 15 bp, Homo sapiens
acattaatgttaatt

SEQ ID NO: 3268172 - DNA, 16 bp, Homo sapiens
acattaattttgtgca

SEQ ID NO: 3268173 - DNA, 18 bp, Homo sapiens
acattaattttgtgcatt

SEQ ID NO: 3268174 - DNA, 15 bp, Homo sapiens
acattaccttactgt

SEQ ID NO: 3268175 - DNA, 20 bp, Homo sapiens
acattagtgaaaattctgtt

SEQ ID NO: 3268176 - DNA, 20 bp, Homo sapiens
acattataaaccttcagaag

SEQ ID NO: 3268177 - DNA, 17 bp, Homo sapiens
acattatattgcaatga

SEQ ID NO: 3268178 - DNA, 19 bp, Homo sapiens
acattatattgcaatgaag

SEQ ID NO: 3268179 - DNA, 22 bp, Homo sapiens
acattatgtggttttagatttt

SEQ ID NO: 3268180 - DNA, 13 bp, Homo sapiens
acattatgtgtgc

SEQ ID NO: 3268181 - DNA, 14 bp, Homo sapiens
acattatgtgtgca

SEQ ID NO: 3268182 - DNA, 15 bp, Homo sapiens
acattatgtgtgcat

SEQ ID NO: 3268183 - DNA, 17 bp, Homo sapiens
acattatgtgtgcatgt

SEQ ID NO: 3268184 - DNA, 22 bp, Homo sapiens
acattatgtgtgcatgtgtgta

SEQ ID NO: 3268185 - DNA, 23 bp, Homo sapiens
acattatgtgtgcatgtgtgtat

SEQ ID NO: 3268186 - DNA, 18 bp, Homo sapiens
accactgcactccagcct

SEQ ID NO: 3268187 - DNA, 20 bp, Homo sapiens
accactgcactccagcctgg

SEQ ID NO: 3268188 - DNA, 13 bp, Homo sapiens
accactgccctgc

SEQ ID NO: 3268189 - DNA, 15 bp, Homo sapiens
accactgccctgcct

SEQ ID NO: 3268190 - DNA, 18 bp, Homo sapiens
accactgccctgcctgcc

SEQ ID NO: 3268191 - DNA, 19 bp, Homo sapiens
accactgccctgcctgccc

SEQ ID NO: 3268192 - DNA, 22 bp, Homo sapiens
accactgccctgcctgcccact

SEQ ID NO: 3268193 - DNA, 18 bp, Homo sapiens
accactggccaccaggct

SEQ ID NO: 3268194 - DNA, 16 bp, Homo sapiens
accactggtctgtagg

SEQ ID NO: 3268195 - DNA, 18 bp, Homo sapiens
accactgtctttttctta

SEQ ID NO: 3268196 - DNA, 18 bp, Homo sapiens
accacttaaaaaatgtcc

SEQ ID NO: 3268197 - DNA, 16 bp, Homo sapiens
accatcctgcagcctc

SEQ ID NO: 3268198 - DNA, 13 bp, Homo sapiens
accatcctggcta

SEQ ID NO: 3268199 - DNA, 22 bp, Homo sapiens
accatcctggctaacatggtga

SEQ ID NO: 3268200 - DNA, 14 bp, Homo sapiens
accatctctcttcc

SEQ ID NO: 3268201 - DNA, 15 bp, Homo sapiens
accatctctcttcca

SEQ ID NO: 3268202 - DNA, 13 bp, Homo sapiens
accatctcttcat

SEQ ID NO: 3268203 - DNA, 23 bp, Homo sapiens
accatctcttcattcaaactgca

SEQ ID NO: 3268204 - DNA, 13 bp, Homo sapiens
accatctggcctg

SEQ ID NO: 3268205 - DNA, 22 bp, Homo sapiens
accatctggcctggcctggccc

SEQ ID NO: 3268206 - DNA, 21 bp, Homo sapiens
accatcttcactggcttccat

SEQ ID NO: 3268207 - DNA, 17 bp, Homo sapiens
accatcttttattcttt

SEQ ID NO: 3268208 - DNA, 15 bp, Homo sapiens
accatgaaacaaagc

SEQ ID NO: 3268209 - DNA, 16 bp, Homo sapiens
accatgactgtgacca

SEQ ID NO: 3268210 - DNA, 18 bp, Homo sapiens
accatgcaggaaggaaaa

SEQ ID NO: 3268211 - DNA, 20 bp, Homo sapiens
accatgctcatctgctggtc

SEQ ID NO: 3268212 - DNA, 17 bp, Homo sapiens
accatgctggtatatgg

SEQ ID NO: 3268213 - DNA, 20 bp, Homo sapiens
accatggggaagaaatctgg

SEQ ID NO: 3268214 - DNA, 11 bp, Homo sapiens
accatgtacat

SEQ ID NO: 3268215 - DNA, 15 bp, Homo sapiens
accatgtcactgtgg

SEQ ID NO: 3268216 - DNA, 19 bp, Homo sapiens
accatgtgagctcttccta

SEQ ID NO: 3268217 - DNA, 12 bp, Homo sapiens
accatgtgccat

SEQ ID NO: 3268218 - DNA, 16 bp, Homo sapiens
accatgtgtcacttgt

SEQ ID NO: 3268219 - DNA, 16 bp, Homo sapiens
accattaaaactgctt

SEQ ID NO: 3268220 - DNA, 20 bp, Homo sapiens
accattaaaactgctttttt

SEQ ID NO: 3268221 - DNA, 22 bp, Homo sapiens
accattaagtcatgtgtgaaca

SEQ ID NO: 3268222 - DNA, 13 bp, Homo sapiens
accattaattaca

SEQ ID NO: 3268223 - DNA, 22 bp, Homo sapiens
accattaattacatacagattt

SEQ ID NO: 3268224 - DNA, 14 bp, Homo sapiens
accattaccaaaat

SEQ ID NO: 3268225 - DNA, 11 bp, Homo sapiens
accattagcat

SEQ ID NO: 3268226 - DNA, 18 bp, Homo sapiens
accattatactttatatc

SEQ ID NO: 3268227 - DNA, 20 bp, Homo sapiens
accattatactttatatctg

SEQ ID NO: 3268228 - DNA, 17 bp, Homo sapiens
accattcacaataaaag

SEQ ID NO: 3268229 - DNA, 19 bp, Homo sapiens
accattcacaataaaagct

SEQ ID NO: 3268230 - DNA, 20 bp, Homo sapiens
accattcacaataaaagctt

SEQ ID NO: 3268231 - DNA, 14 bp, Homo sapiens
accattcctgcctt

SEQ ID NO: 3268232 - DNA, 21 bp, Homo sapiens
accattcctgcctttaagcca

SEQ ID NO: 3268233 - DNA, 14 bp, Homo sapiens
accattctcctgcc

SEQ ID NO: 3268234 - DNA, 16 bp, Homo sapiens
accattctcctgcctc

SEQ ID NO: 3268235 - DNA, 21 bp, Homo sapiens
accattctgactcggtttctc

SEQ ID NO: 3268236 - DNA, 16 bp, Homo sapiens
accattgaaggcttaa

SEQ ID NO: 3268237 - DNA, 13 bp, Homo sapiens
accattgacacat

SEQ ID NO: 3268238 - DNA, 18 bp, Homo sapiens
accattgatttaatgtaa

SEQ ID NO: 3268239 - DNA, 16 bp, Homo sapiens
accattgtaactatta

SEQ ID NO: 3268240 - DNA, 22 bp, Homo sapiens
accattgtaactattaaccttt

SEQ ID NO: 3268241 - DNA, 14 bp, Homo sapiens
accattgtcttgtt

SEQ ID NO: 3268242 - DNA, 11 bp, Homo sapiens
accatttataa

SEQ ID NO: 3268243 - DNA, 21 bp, Homo sapiens
accatttatacaaattagaaa

SEQ ID NO: 3268244 - DNA, 11 bp, Homo sapiens
accatttcaga

SEQ ID NO: 3268245 - DNA, 18 bp, Homo sapiens
accatttgctactgtaca

SEQ ID NO: 3268246 - DNA, 15 bp, Homo sapiens
accatttgtgttttg

SEQ ID NO: 3268247 - DNA, 18 bp, Homo sapiens
accattttaacgctgcct

SEQ ID NO: 3268248 - DNA, 23 bp, Homo sapiens
accattttggggtacccactgct

SEQ ID NO: 3268249 - DNA, 20 bp, Homo sapiens
accattttttaaggaaacaa

SEQ ID NO: 3268250 - DNA, 15 bp, Homo sapiens
acccaaaccctaggt

SEQ ID NO: 3268251 - DNA, 14 bp, Homo sapiens
acccaaagcacatg

SEQ ID NO: 3268252 - DNA, 22 bp, Homo sapiens
acccaaagcacatgcttagctt

SEQ ID NO: 3268253 - DNA, 20 bp, Homo sapiens
acccaaccctatctcctgac

SEQ ID NO: 3268254 - DNA, 15 bp, Homo sapiens
acccaacggccctgc

SEQ ID NO: 3268255 - DNA, 20 bp, Homo sapiens
acccaactactgagctgaga

SEQ ID NO: 3268256 - DNA, 17 bp, Homo sapiens
acccaagataaaagaat

SEQ ID NO: 3268257 - DNA, 20 bp, Homo sapiens
acccaagataaaagaatggc

SEQ ID NO: 3268258 - DNA, 20 bp, Homo sapiens
acccaagccctgaggcctga

SEQ ID NO: 3268259 - DNA, 21 bp, Homo sapiens
acccaagccctgaggcctgag

SEQ ID NO: 3268260 - DNA, 16 bp, Homo sapiens
acccaagcctgctggc

SEQ ID NO: 3268261 - DNA, 13 bp, Homo sapiens
acccaagctcctc

SEQ ID NO: 3268262 - DNA, 15 bp, Homo sapiens
acccaagcttagaac

SEQ ID NO: 3268263 - DNA, 19 bp, Homo sapiens
acccaaggagcacaggtcc

SEQ ID NO: 3268264 - DNA, 17 bp, Homo sapiens
acccaagggcagaaagt

SEQ ID NO: 3268265 - DNA, 20 bp, Homo sapiens
acccaagggcagaaagtaga

SEQ ID NO: 3268266 - DNA, 16 bp, Homo sapiens
acccaagtttatttct

SEQ ID NO: 3268267 - DNA, 17 bp, Homo sapiens
acccaagtttatttctc

SEQ ID NO: 3268268 - DNA, 21 bp, Homo sapiens
acccaatacagtctagtttcc

SEQ ID NO: 3268269 - DNA, 16 bp, Homo sapiens
acccaatgctgctcca

SEQ ID NO: 3268270 - DNA, 13 bp, Homo sapiens
acccacaagtgcc

SEQ ID NO: 3268271 - DNA, 17 bp, Homo sapiens
acccacaagtgccactg

SEQ ID NO: 3268272 - DNA, 20 bp, Homo sapiens
acccacagatgtctctgggg

SEQ ID NO: 3268273 - DNA, 16 bp, Homo sapiens
acccacatgtgacaca

SEQ ID NO: 3268274 - DNA, 17 bp, Homo sapiens
acccaccaaactgcaca

SEQ ID NO: 3268275 - DNA, 14 bp, Homo sapiens
acccaccagtgcct

SEQ ID NO: 3268276 - DNA, 15 bp, Homo sapiens
acccaccagtgcctt

SEQ ID NO: 3268277 - DNA, 23 bp, Homo sapiens
acccacccatcttcctgctgctg

SEQ ID NO: 3268278 - DNA, 15 bp, Homo sapiens
acccaccccacagac

SEQ ID NO: 3268279 - DNA, 15 bp, Homo sapiens
acccacccctgcaca

SEQ ID NO: 3268280 - DNA, 13 bp, Homo sapiens
acccacccctgtg

SEQ ID NO: 3268281 - DNA, 17 bp, Homo sapiens
acccacccctgtgctcc

SEQ ID NO: 3268282 - DNA, 22 bp, Homo sapiens
acccaccgtggaggaggaaggc

SEQ ID NO: 3268283 - DNA, 14 bp, Homo sapiens
acccacctcacccc

SEQ ID NO: 3268284 - DNA, 16 bp, Homo sapiens
acccacctcagcctcc

SEQ ID NO: 3268285 - DNA, 14 bp, Homo sapiens
acccacctccaccc

SEQ ID NO: 3268286 - DNA, 16 bp, Homo sapiens
acccacctccacccag

SEQ ID NO: 3268287 - DNA, 16 bp, Homo sapiens
acccacctctggccct

SEQ ID NO: 3268288 - DNA, 17 bp, Homo sapiens
acccacctctggccctg

SEQ ID NO: 3268289 - DNA, 18 bp, Homo sapiens
acccacctctggccctgt

SEQ ID NO: 3268290 - DNA, 19 bp, Homo sapiens
acccacctctggccctgtg

SEQ ID NO: 3268291 - DNA, 18 bp, Homo sapiens
acccacgaacgctcttag

SEQ ID NO: 3268292 - DNA, 12 bp, Homo sapiens
acccacgaggat

SEQ ID NO: 3268293 - DNA, 17 bp, Homo sapiens
acccacgattttctcca

SEQ ID NO: 3268294 - DNA, 18 bp, Homo sapiens
acccacgattttctccag

SEQ ID NO: 3268295 - DNA, 19 bp, Homo sapiens
acccacgattttctccagc

SEQ ID NO: 3268296 - DNA, 15 bp, Homo sapiens
acccacggagccctc

SEQ ID NO: 3268297 - DNA, 17 bp, Homo sapiens
acccacggagccctccc

SEQ ID NO: 3268298 - DNA, 18 bp, Homo sapiens
acccacggagccctccct

SEQ ID NO: 3268299 - DNA, 22 bp, Homo sapiens
acccacggagccctccctatgt

SEQ ID NO: 3268300 - DNA, 14 bp, Homo sapiens
acccactcaccagg

SEQ ID NO: 3268301 - DNA, 18 bp, Homo sapiens
acccactcaccagggtcc

SEQ ID NO: 3268302 - DNA, 13 bp, Homo sapiens
acccactcaggat

SEQ ID NO: 3268303 - DNA, 20 bp, Homo sapiens
acccactccctgtagtgaat

SEQ ID NO: 3268304 - DNA, 22 bp, Homo sapiens
acccactggttccttcttcctg

SEQ ID NO: 3268305 - DNA, 15 bp, Homo sapiens
acccacttgtcactg

SEQ ID NO: 3268306 - DNA, 19 bp, Homo sapiens
acccacttgtcactgacac

SEQ ID NO: 3268307 - DNA, 18 bp, Homo sapiens
acccagaatggagcctgc

SEQ ID NO: 3268308 - DNA, 23 bp, Homo sapiens
acccagaatggagcctgctctcc

SEQ ID NO: 3268309 - DNA, 19 bp, Homo sapiens
acccagactggaatgcagt

SEQ ID NO: 3268310 - DNA, 14 bp, Homo sapiens
acccagagaatata

SEQ ID NO: 3268311 - DNA, 18 bp, Homo sapiens
acccagatggcctgaagc

SEQ ID NO: 3268312 - DNA, 20 bp, Homo sapiens
acccagattttgctgtatat

SEQ ID NO: 3268313 - DNA, 17 bp, Homo sapiens
acccagcagttctgtta

SEQ ID NO: 3268314 - DNA, 14 bp, Homo sapiens
acccagcatctccc

SEQ ID NO: 3268315 - DNA, 22 bp, Homo sapiens
acccagcatctcccagcaagac

SEQ ID NO: 3268316 - DNA, 19 bp, Homo sapiens
acccagccatctgcccagg

SEQ ID NO: 3268317 - DNA, 21 bp, Homo sapiens
acccagccatctgcccagggg

SEQ ID NO: 3268318 - DNA, 14 bp, Homo sapiens
acccagcccctggc

SEQ ID NO: 3268319 - DNA, 23 bp, Homo sapiens
acccagccgtcgtctccctcgac

SEQ ID NO: 3268320 - DNA, 13 bp, Homo sapiens
acccagcctcagt

SEQ ID NO: 3268321 - DNA, 22 bp, Homo sapiens
acccagcctcagtcctcccctc

SEQ ID NO: 3268322 - DNA, 18 bp, Homo sapiens
acactactgctaaatcct

SEQ ID NO: 3268323 - DNA, 12 bp, Homo sapiens
acactagacaaa

SEQ ID NO: 3268324 - DNA, 15 bp, Homo sapiens
acactagcctctcca

SEQ ID NO: 3268325 - DNA, 18 bp, Homo sapiens
acactagttttgtgccag

SEQ ID NO: 3268326 - DNA, 18 bp, Homo sapiens
acactatgcacagagccc

SEQ ID NO: 3268327 - DNA, 17 bp, Homo sapiens
acactatggtatttgag

SEQ ID NO: 3268328 - DNA, 13 bp, Homo sapiens
acactattttcag

SEQ ID NO: 3268329 - DNA, 20 bp, Homo sapiens
acactcacatttattctgct

SEQ ID NO: 3268330 - DNA, 20 bp, Homo sapiens
acactcaccatgaagcgaaa

SEQ ID NO: 3268331 - DNA, 15 bp, Homo sapiens
acactccagcctgag

SEQ ID NO: 3268332 - DNA, 17 bp, Homo sapiens
acactccagcctgagca

SEQ ID NO: 3268333 - DNA, 12 bp, Homo sapiens
acactccaggcc

SEQ ID NO: 3268334 - DNA, 13 bp, Homo sapiens
acactccaggccc

SEQ ID NO: 3268335 - DNA, 17 bp, Homo sapiens
acactccaggccctgcc

SEQ ID NO: 3268336 - DNA, 21 bp, Homo sapiens
acactccaggccctgccccct

SEQ ID NO: 3268337 - DNA, 22 bp, Homo sapiens
acactccaggccctgccccctc

SEQ ID NO: 3268338 - DNA, 13 bp, Homo sapiens
acactccagtgcc

SEQ ID NO: 3268339 - DNA, 16 bp, Homo sapiens
acactctgcagactgc

SEQ ID NO: 3268340 - DNA, 17 bp, Homo sapiens
acactctgctgtttgac

SEQ ID NO: 3268341 - DNA, 21 bp, Homo sapiens
acactcttttgctttattcca

SEQ ID NO: 3268342 - DNA, 23 bp, Homo sapiens
acactgaaaaatctaagtgatat

SEQ ID NO: 3268343 - DNA, 14 bp, Homo sapiens
acactgaaaaatta

SEQ ID NO: 3268344 - DNA, 17 bp, Homo sapiens
acactgaaaccaaaaca

SEQ ID NO: 3268345 - DNA, 19 bp, Homo sapiens
acactgaagttaacagaga

SEQ ID NO: 3268346 - DNA, 17 bp, Homo sapiens
acactgaccatccactc

SEQ ID NO: 3268347 - DNA, 14 bp, Homo sapiens
acactgagccccac

SEQ ID NO: 3268348 - DNA, 21 bp, Homo sapiens
acactgagttgggcaaaaccc

SEQ ID NO: 3268349 - DNA, 15 bp, Homo sapiens
acactgatgcaagga

SEQ ID NO: 3268350 - DNA, 22 bp, Homo sapiens
acactgatgcaaggattacaga

SEQ ID NO: 3268351 - DNA, 23 bp, Homo sapiens
acactgatgcaaggattacagaa

SEQ ID NO: 3268352 - DNA, 19 bp, Homo sapiens
acactgccaaataaacagc

SEQ ID NO: 3268353 - DNA, 15 bp, Homo sapiens
acactgccctcttgt

SEQ ID NO: 3268354 - DNA, 18 bp, Homo sapiens
acactgcctgtatacttt

SEQ ID NO: 3268355 - DNA, 13 bp, Homo sapiens
acactgctctaac

SEQ ID NO: 3268356 - DNA, 11 bp, Homo sapiens
acactgctgca

SEQ ID NO: 3268357 - DNA, 14 bp, Homo sapiens
acactgctgcacca

SEQ ID NO: 3268358 - DNA, 22 bp, Homo sapiens
acactgctgtacccagatgcct

SEQ ID NO: 3268359 - DNA, 22 bp, Homo sapiens
acactggcgtagaagtttttgt

SEQ ID NO: 3268360 - DNA, 17 bp, Homo sapiens
acactggctaaagataa

SEQ ID NO: 3268361 - DNA, 16 bp, Homo sapiens
acactggtctgctgtc

SEQ ID NO: 3268362 - DNA, 16 bp, Homo sapiens
acactggtgccaacca

SEQ ID NO: 3268363 - DNA, 21 bp, Homo sapiens
acactgtcatgcttcatcatt

SEQ ID NO: 3268364 - DNA, 12 bp, Homo sapiens
acactgtgccct

SEQ ID NO: 3268365 - DNA, 17 bp, Homo sapiens
acactgttagaacacta

SEQ ID NO: 3268366 - DNA, 19 bp, Homo sapiens
acactgttagaacactatt

SEQ ID NO: 3268367 - DNA, 20 bp, Homo sapiens
acactgttctgaaagtgact

SEQ ID NO: 3268368 - DNA, 11 bp, Homo sapiens
acacttaacag

SEQ ID NO: 3268369 - DNA, 16 bp, Homo sapiens
acacttacactttatg

SEQ ID NO: 3268370 - DNA, 18 bp, Homo sapiens
acacttacactttatgca

SEQ ID NO: 3268371 - DNA, 14 bp, Homo sapiens
acacttatcttctg

SEQ ID NO: 3268372 - DNA, 17 bp, Homo sapiens
acacttcagagagctgg

SEQ ID NO: 3268373 - DNA, 18 bp, Homo sapiens
acacttcagagagctggt

SEQ ID NO: 3268374 - DNA, 16 bp, Homo sapiens
acacttcattttcagg

SEQ ID NO: 3268375 - DNA, 24 bp, Homo sapiens
acacttccacccttttttctaagt

SEQ ID NO: 3268376 - DNA, 14 bp, Homo sapiens
acacttccataatc

SEQ ID NO: 3268377 - DNA, 10 bp, Homo sapiens
acacttctta

SEQ ID NO: 3268378 - DNA, 12 bp, Homo sapiens
acatccacccca

SEQ ID NO: 3268379 - DNA, 11 bp, Homo sapiens
acatccatgtc

SEQ ID NO: 3268380 - DNA, 13 bp, Homo sapiens
acatccatgtcct

SEQ ID NO: 3268381 - DNA, 18 bp, Homo sapiens
acatcccagcctgtggtt

SEQ ID NO: 3268382 - DNA, 21 bp, Homo sapiens
acatccccagaatccataaat

SEQ ID NO: 3268383 - DNA, 20 bp, Homo sapiens
acatcccttcctggaaacag

SEQ ID NO: 3268384 - DNA, 21 bp, Homo sapiens
acatccgtcattgctgctgct

SEQ ID NO: 3268385 - DNA, 15 bp, Homo sapiens
acatcctcctcccac

SEQ ID NO: 3268386 - DNA, 15 bp, Homo sapiens
acatcctcttctgct

SEQ ID NO: 3268387 - DNA, 18 bp, Homo sapiens
acatcctgccagccccac

SEQ ID NO: 3268388 - DNA, 16 bp, Homo sapiens
acatcctgtataagca

SEQ ID NO: 3268389 - DNA, 17 bp, Homo sapiens
acatcctgtataagcac

SEQ ID NO: 3268390 - DNA, 16 bp, Homo sapiens
acatcctgtgtcagaa

SEQ ID NO: 3268391 - DNA, 18 bp, Homo sapiens
acatcctgtgtcagaaac

SEQ ID NO: 3268392 - DNA, 19 bp, Homo sapiens
acatcctttgcagggcagc

SEQ ID NO: 3268393 - DNA, 21 bp, Homo sapiens
acatcctttgcagggcagccc

SEQ ID NO: 3268394 - DNA, 22 bp, Homo sapiens
acatcgcaatagttttttactt

SEQ ID NO: 3268395 - DNA, 14 bp, Homo sapiens
acatcgtgggtcac

SEQ ID NO: 3268396 - DNA, 14 bp, Homo sapiens
acatctatgatata

SEQ ID NO: 3268397 - DNA, 18 bp, Homo sapiens
acatctattttggattgt

SEQ ID NO: 3268398 - DNA, 23 bp, Homo sapiens
acatctattttggattgtatatt

SEQ ID NO: 3268399 - DNA, 22 bp, Homo sapiens
acatctcagaccctttagccaa

SEQ ID NO: 3268400 - DNA, 12 bp, Homo sapiens
acatctcctggc

SEQ ID NO: 3268401 - DNA, 18 bp, Homo sapiens
acatctctgaaagcacag

SEQ ID NO: 3268402 - DNA, 20 bp, Homo sapiens
acatctgcaatatgaattca

SEQ ID NO: 3268403 - DNA, 14 bp, Homo sapiens
acatctgctctagg

SEQ ID NO: 3268404 - DNA, 13 bp, Homo sapiens
acatctggcttat

SEQ ID NO: 3268405 - DNA, 17 bp, Homo sapiens
acatctggcttatttta

SEQ ID NO: 3268406 - DNA, 19 bp, Homo sapiens
aattaggaggctcaacaat

SEQ ID NO: 3268407 - DNA, 15 bp, Homo sapiens
aattaggctgtaact

SEQ ID NO: 3268408 - DNA, 16 bp, Homo sapiens
aattaggctgtaacta

SEQ ID NO: 3268409 - DNA, 20 bp, Homo sapiens
aattaggggttgctaagaag

SEQ ID NO: 3268410 - DNA, 19 bp, Homo sapiens
aattagggtacatttataa

SEQ ID NO: 3268411 - DNA, 20 bp, Homo sapiens
aattagggtacatttataat

SEQ ID NO: 3268412 - DNA, 21 bp, Homo sapiens
aattagggtacatttataatt

SEQ ID NO: 3268413 - DNA, 17 bp, Homo sapiens
aattaggtttttcctta

SEQ ID NO: 3268414 - DNA, 15 bp, Homo sapiens
aattagtgccactta

SEQ ID NO: 3268415 - DNA, 23 bp, Homo sapiens
aattagttatgacagccatttgt

SEQ ID NO: 3268416 - DNA, 12 bp, Homo sapiens
aattagtttcct

SEQ ID NO: 3268417 - DNA, 15 bp, Homo sapiens
aattagtttcctttt

SEQ ID NO: 3268418 - DNA, 23 bp, Homo sapiens
aattagtttcctttttaatatgc

SEQ ID NO: 3268419 - DNA, 15 bp, Homo sapiens
aattataaactttta

SEQ ID NO: 3268420 - DNA, 13 bp, Homo sapiens
aattataaatgac

SEQ ID NO: 3268421 - DNA, 20 bp, Homo sapiens
aattataactgtaaagatgt

SEQ ID NO: 3268422 - DNA, 17 bp, Homo sapiens
aattataacttaaaata

SEQ ID NO: 3268423 - DNA, 16 bp, Homo sapiens
aattatagtttctgag

SEQ ID NO: 3268424 - DNA, 17 bp, Homo sapiens
aattatatatttctaac

SEQ ID NO: 3268425 - DNA, 13 bp, Homo sapiens
aattatatttgaa

SEQ ID NO: 3268426 - DNA, 16 bp, Homo sapiens
aattatcagcaaagaa

SEQ ID NO: 3268427 - DNA, 20 bp, Homo sapiens
aattatcagcaaagaaaaaa

SEQ ID NO: 3268428 - DNA, 21 bp, Homo sapiens
aattatcctgaactcttctgc

SEQ ID NO: 3268429 - DNA, 15 bp, Homo sapiens
aattatctaatttat

SEQ ID NO: 3268430 - DNA, 18 bp, Homo sapiens
aattatctaatttataaa

SEQ ID NO: 3268431 - DNA, 16 bp, Homo sapiens
aattatctatacatat

SEQ ID NO: 3268432 - DNA, 17 bp, Homo sapiens
aattatgaatctgattt

SEQ ID NO: 3268433 - DNA, 16 bp, Homo sapiens
acttgcgtcctgcaga

SEQ ID NO: 3268434 - DNA, 20 bp, Homo sapiens
acttgcgtcctgcagaggac

SEQ ID NO: 3268435 - DNA, 13 bp, Homo sapiens
acttgctaaagca

SEQ ID NO: 3268436 - DNA, 16 bp, Homo sapiens
acttgctaaagcactt

SEQ ID NO: 3268437 - DNA, 22 bp, Homo sapiens
acttgctaaagcactttgcact

SEQ ID NO: 3268438 - DNA, 13 bp, Homo sapiens
acttgctcccaac

SEQ ID NO: 3268439 - DNA, 15 bp, Homo sapiens
acttgctggggctca

SEQ ID NO: 3268440 - DNA, 14 bp, Homo sapiens
acttgctttcaatt

SEQ ID NO: 3268441 - DNA, 21 bp, Homo sapiens
acttgctttcaattgacaaat

SEQ ID NO: 3268442 - DNA, 21 bp, Homo sapiens
acttggagactcctggtctgt

SEQ ID NO: 3268443 - DNA, 15 bp, Homo sapiens
acttggcaacagaag

SEQ ID NO: 3268444 - DNA, 16 bp, Homo sapiens
acttggcaacagaagc

SEQ ID NO: 3268445 - DNA, 11 bp, Homo sapiens
acttggcactt

SEQ ID NO: 3268446 - DNA, 15 bp, Homo sapiens
acttggcctcagctg

SEQ ID NO: 3268447 - DNA, 16 bp, Homo sapiens
acttggcctcatgctg

SEQ ID NO: 3268448 - DNA, 20 bp, Homo sapiens
acttggctcgaatctctgtg

SEQ ID NO: 3268449 - DNA, 23 bp, Homo sapiens
acttggctcgaatctctgtgcct

SEQ ID NO: 3268450 - DNA, 19 bp, Homo sapiens
acttggctttcctgtttct

SEQ ID NO: 3268451 - DNA, 21 bp, Homo sapiens
acttgggaggctgaggcagga

SEQ ID NO: 3268452 - DNA, 15 bp, Homo sapiens
acttgggtcttccct

SEQ ID NO: 3268453 - DNA, 15 bp, Homo sapiens
acttggtcagagcca

SEQ ID NO: 3268454 - DNA, 16 bp, Homo sapiens
acttggtcagagccac

SEQ ID NO: 3268455 - DNA, 21 bp, Homo sapiens
acttggtgcggggttaacacc

SEQ ID NO: 3268456 - DNA, 14 bp, Homo sapiens
acttggtgtactgg

SEQ ID NO: 3268457 - DNA, 23 bp, Homo sapiens
acttggttagacgccttccaggt

SEQ ID NO: 3268458 - DNA, 16 bp, Homo sapiens
acttggttctgcttca

SEQ ID NO: 3268459 - DNA, 22 bp, Homo sapiens
acttggtttgttatatcaggga

SEQ ID NO: 3268460 - DNA, 14 bp, Homo sapiens
acttgtaaatacac

SEQ ID NO: 3268461 - DNA, 16 bp, Homo sapiens
acttgtaaatacacca

SEQ ID NO: 3268462 - DNA, 16 bp, Homo sapiens
acttgtagagcagatg

SEQ ID NO: 3268463 - DNA, 11 bp, Homo sapiens
acttgtagctg

SEQ ID NO: 3268464 - DNA, 14 bp, Homo sapiens
acttgtagctgtaa

SEQ ID NO: 3268465 - DNA, 21 bp, Homo sapiens
acttgtagctgtaaaacgctg

SEQ ID NO: 3268466 - DNA, 14 bp, Homo sapiens
acttgtaggataag

SEQ ID NO: 3268467 - DNA, 19 bp, Homo sapiens
acttgtataaatgtatata

SEQ ID NO: 3268468 - DNA, 20 bp, Homo sapiens
acttgtataaatgtatatac

SEQ ID NO: 3268469 - DNA, 21 bp, Homo sapiens
acttgtataaatgtatataca

SEQ ID NO: 3268470 - DNA, 16 bp, Homo sapiens
acttgtatatttgtac

SEQ ID NO: 3268471 - DNA, 18 bp, Homo sapiens
acttgtatatttgtacaa

SEQ ID NO: 3268472 - DNA, 19 bp, Homo sapiens
acttgtatatttgtacaaa

SEQ ID NO: 3268473 - DNA, 14 bp, Homo sapiens
acttgtatatttta

SEQ ID NO: 3268474 - DNA, 10 bp, Homo sapiens
acttgtattt

SEQ ID NO: 3268475 - DNA, 16 bp, Homo sapiens
acttgtcagcctcaga

SEQ ID NO: 3268476 - DNA, 13 bp, Homo sapiens
acttgtcatgtga

SEQ ID NO: 3268477 - DNA, 22 bp, Homo sapiens
acttgtctgaggcctcatccct

SEQ ID NO: 3268478 - DNA, 20 bp, Homo sapiens
acttgtctgggaattgtgtg

SEQ ID NO: 3268479 - DNA, 16 bp, Homo sapiens
acttgtctttttctgg

SEQ ID NO: 3268480 - DNA, 17 bp, Homo sapiens
acttgtctttttctgga

SEQ ID NO: 3268481 - DNA, 19 bp, Homo sapiens
acttgtgaaacacagctgt

SEQ ID NO: 3268482 - DNA, 11 bp, Homo sapiens
acttgtgaatg

SEQ ID NO: 3268483 - DNA, 12 bp, Homo sapiens
acttgtgaatgc

SEQ ID NO: 3268484 - DNA, 16 bp, Homo sapiens
acttgtgactgaaggg

SEQ ID NO: 3268485 - DNA, 16 bp, Homo sapiens
acttgtgattatttat

SEQ ID NO: 3268486 - DNA, 20 bp, Homo sapiens
acttgtgattatttattatt

SEQ ID NO: 3268487 - DNA, 17 bp, Homo sapiens
acttgtggacacagctc

SEQ ID NO: 3268488 - DNA, 18 bp, Homo sapiens
acttgtggacacagctct

SEQ ID NO: 3268489 - DNA, 19 bp, Homo sapiens
acttgtggacacagctctt

SEQ ID NO: 3268490 - DNA, 23 bp, Homo sapiens
acttgtggtgtgaccatgttcat

SEQ ID NO: 3268491 - DNA, 12 bp, Homo sapiens
acttgtgtatat

SEQ ID NO: 3268492 - DNA, 22 bp, Homo sapiens
acttgtgtccctaatgtgttta

SEQ ID NO: 3268493 - DNA, 14 bp, Homo sapiens
acttgtgtctctgt

SEQ ID NO: 3268494 - DNA, 16 bp, Homo sapiens
acttgtgtctctgtgc

SEQ ID NO: 3268495 - DNA, 11 bp, Homo sapiens
acttgtgtctg

SEQ ID NO: 3268496 - DNA, 21 bp, Homo sapiens
acttgtgtttgcttaaacaaa

SEQ ID NO: 3268497 - DNA, 22 bp, Homo sapiens
acttgtgtttgcttaaacaaag

SEQ ID NO: 3268498 - DNA, 19 bp, Homo sapiens
acttgttgtatctgctgga

SEQ ID NO: 3268499 - DNA, 19 bp, Homo sapiens
acttgtttctctgttgtaa

SEQ ID NO: 3268500 - DNA, 16 bp, Homo sapiens
acttgtttgtcttcca

SEQ ID NO: 3268501 - DNA, 15 bp, Homo sapiens
acttgtttgtgcatc

SEQ ID NO: 3268502 - DNA, 21 bp, Homo sapiens
acttgtttgtgcatcctgtga

SEQ ID NO: 3268503 - DNA, 15 bp, Homo sapiens
actttaaaaaggaaa

SEQ ID NO: 3268504 - DNA, 19 bp, Homo sapiens
actttaaaaggattaatct

SEQ ID NO: 3268505 - DNA, 18 bp, Homo sapiens
actttaaagcaattgcat

SEQ ID NO: 3268506 - DNA, 17 bp, Homo sapiens
actttaagagagaaatc

SEQ ID NO: 3268507 - DNA, 23 bp, Homo sapiens
actttaagagagaaatctgaaaa

SEQ ID NO: 3268508 - DNA, 15 bp, Homo sapiens
actttaagcactaca

SEQ ID NO: 3268509 - DNA, 23 bp, Homo sapiens
actttaagcagctcttgctaatc

SEQ ID NO: 3268510 - DNA, 14 bp, Homo sapiens
actttaagctcctt

SEQ ID NO: 3268511 - DNA, 22 bp, Homo sapiens
actttaagctccttgagtaaaa

SEQ ID NO: 3268512 - DNA, 18 bp, Homo sapiens
actttaagtttcaggata

SEQ ID NO: 3268513 - DNA, 22 bp, Homo sapiens
actttaattaccaacctgttac

SEQ ID NO: 3268514 - DNA, 20 bp, Homo sapiens
actttaattgcttaaaagac

SEQ ID NO: 3268515 - DNA, 19 bp, Homo sapiens
actttacagaaatggactg

SEQ ID NO: 3268516 - DNA, 15 bp, Homo sapiens
actttactctgtgtt

SEQ ID NO: 3268517 - DNA, 11 bp, Homo sapiens
actttactgta

SEQ ID NO: 3268518 - DNA, 15 bp, Homo sapiens
actttacttgtggtg

SEQ ID NO: 3268519 - DNA, 19 bp, Homo sapiens
actttacttgtggtgtgac

SEQ ID NO: 3268520 - DNA, 20 bp, Homo sapiens
actttagctagtatcttcaa

SEQ ID NO: 3268521 - DNA, 20 bp, Homo sapiens
actttaggtttttttaatga

SEQ ID NO: 3268522 - DNA, 14 bp, Homo sapiens
actttagtgccctg

SEQ ID NO: 3268523 - DNA, 19 bp, Homo sapiens
actttagtgccctgccccc

SEQ ID NO: 3268524 - DNA, 18 bp, Homo sapiens
actttataactaacatgt

SEQ ID NO: 3268525 - DNA, 15 bp, Homo sapiens
actttatagctgcaa

SEQ ID NO: 3268526 - DNA, 14 bp, Homo sapiens
actttatcacatta

SEQ ID NO: 3268527 - DNA, 21 bp, Homo sapiens
actttatcacattatttgcat

SEQ ID NO: 3268528 - DNA, 20 bp, Homo sapiens
actttatcactttttgaact

SEQ ID NO: 3268529 - DNA, 13 bp, Homo sapiens
actttatgtagtt

SEQ ID NO: 3268530 - DNA, 13 bp, Homo sapiens
actttatgtgtaa

SEQ ID NO: 3268531 - DNA, 21 bp, Homo sapiens
actttatgtgtaaatacataa

SEQ ID NO: 3268532 - DNA, 12 bp, Homo sapiens
actttattcttg

SEQ ID NO: 3268533 - DNA, 14 bp, Homo sapiens
actttattcttgct

SEQ ID NO: 3268534 - DNA, 19 bp, Homo sapiens
actttattctttgttcttt

SEQ ID NO: 3268535 - DNA, 13 bp, Homo sapiens
actttattgtaca

SEQ ID NO: 3268536 - DNA, 20 bp, Homo sapiens
actttattgtacagactgtt

SEQ ID NO: 3268537 - DNA, 12 bp, Homo sapiens
actttatttact

SEQ ID NO: 3268538 - DNA, 15 bp, Homo sapiens
actttatttatttct

SEQ ID NO: 3268539 - DNA, 17 bp, Homo sapiens
actttatttatttctag

SEQ ID NO: 3268540 - DNA, 24 bp, Homo sapiens
actttattttctggtagatagaaa

SEQ ID NO: 3268541 - DNA, 14 bp, Homo sapiens
actttcactttgaa

SEQ ID NO: 3268542 - DNA, 21 bp, Homo sapiens
actttcagagcccccagccct

SEQ ID NO: 3268543 - DNA, 19 bp, Homo sapiens
actttcatctggggtgggg

SEQ ID NO: 3268544 - DNA, 18 bp, Homo sapiens
actttcattccttcagat

SEQ ID NO: 3268545 - DNA, 13 bp, Homo sapiens
actttcattgcca

SEQ ID NO: 3268546 - DNA, 20 bp, Homo sapiens
actttcattgccagtgtctt

SEQ ID NO: 3268547 - DNA, 15 bp, Homo sapiens
actttccatttggta

SEQ ID NO: 3268548 - DNA, 16 bp, Homo sapiens
actttcccaggttctg

SEQ ID NO: 3268549 - DNA, 21 bp, Homo sapiens
actttcccaggttctgtttat

SEQ ID NO: 3268550 - DNA, 17 bp, Homo sapiens
actttcctttccccagc

SEQ ID NO: 3268551 - DNA, 17 bp, Homo sapiens
actttcgaaatttcatt

SEQ ID NO: 3268552 - DNA, 16 bp, Homo sapiens
actttcgtacattggc

SEQ ID NO: 3268553 - DNA, 13 bp, Homo sapiens
actttctctgtag

SEQ ID NO: 3268554 - DNA, 13 bp, Homo sapiens
actttctgcctgg

SEQ ID NO: 3268555 - DNA, 14 bp, Homo sapiens
actttctgttatgg

SEQ ID NO: 3268556 - DNA, 18 bp, Homo sapiens
actttctgttatgggctt

SEQ ID NO: 3268557 - DNA, 19 bp, Homo sapiens
actttctgttgccacaacc

SEQ ID NO: 3268558 - DNA, 15 bp, Homo sapiens
actttcttttctgga

SEQ ID NO: 3268559 - DNA, 15 bp, Homo sapiens
actttgaaatacctc

SEQ ID NO: 3268560 - DNA, 16 bp, Homo sapiens
actttgaaatacctca

SEQ ID NO: 3268561 - DNA, 17 bp, Homo sapiens
actttgaaatacctcat

SEQ ID NO: 3268562 - DNA, 16 bp, Homo sapiens
actttgagatgtgttc

SEQ ID NO: 3268563 - DNA, 20 bp, Homo sapiens
acttagtgcggacaagtttt

SEQ ID NO: 3268564 - DNA, 18 bp, Homo sapiens
acttagtggtatgtctct

SEQ ID NO: 3268565 - DNA, 19 bp, Homo sapiens
acttataaatcatattgat

SEQ ID NO: 3268566 - DNA, 20 bp, Homo sapiens
acttataaatcatattgatg

SEQ ID NO: 3268567 - DNA, 15 bp, Homo sapiens
acttatagttaatat

SEQ ID NO: 3268568 - DNA, 20 bp, Homo sapiens
acttatcaacactataattg

SEQ ID NO: 3268569 - DNA, 14 bp, Homo sapiens
acttatcttatgcc

SEQ ID NO: 3268570 - DNA, 14 bp, Homo sapiens
acttatgctgattt

SEQ ID NO: 3268571 - DNA, 16 bp, Homo sapiens
acttatgtacttgata

SEQ ID NO: 3268572 - DNA, 19 bp, Homo sapiens
acttatgtagatatttggc

SEQ ID NO: 3268573 - DNA, 14 bp, Homo sapiens
acttatgtttttaa

SEQ ID NO: 3268574 - DNA, 18 bp, Homo sapiens
acttattccctcatcctt

SEQ ID NO: 3268575 - DNA, 13 bp, Homo sapiens
acttattctgtat

SEQ ID NO: 3268576 - DNA, 14 bp, Homo sapiens
acttattcttttat

SEQ ID NO: 3268577 - DNA, 15 bp, Homo sapiens
acttattgaccattt

SEQ ID NO: 3268578 - DNA, 13 bp, Homo sapiens
acttattgtaaat

SEQ ID NO: 3268579 - DNA, 17 bp, Homo sapiens
acttattgtccaggtga

SEQ ID NO: 3268580 - DNA, 22 bp, Homo sapiens
acttatttaaaaatatttcaga

SEQ ID NO: 3268581 - DNA, 13 bp, Homo sapiens
acttatttctgct

SEQ ID NO: 3268582 - DNA, 19 bp, Homo sapiens
acttattttgtcttattct

SEQ ID NO: 3268583 - DNA, 16 bp, Homo sapiens
acttcaaaaactaaaa

SEQ ID NO: 3268584 - DNA, 21 bp, Homo sapiens
acttcaaaaactaaaatcatt

SEQ ID NO: 3268585 - DNA, 18 bp, Homo sapiens
acttcaaaaggaatgaac

SEQ ID NO: 3268586 - DNA, 13 bp, Homo sapiens
acttcaaggccca

SEQ ID NO: 3268587 - DNA, 16 bp, Homo sapiens
acttcaaggtgacaga

SEQ ID NO: 3268588 - DNA, 12 bp, Homo sapiens
acttcagaaaga

SEQ ID NO: 3268589 - DNA, 16 bp, Homo sapiens
acttcagaaagacttg

SEQ ID NO: 3268590 - DNA, 18 bp, Homo sapiens
acttcagagagctggtag

SEQ ID NO: 3268591 - DNA, 14 bp, Homo sapiens
acttcagctctgtt

SEQ ID NO: 3268592 - DNA, 19 bp, Homo sapiens
acttcagggcagggctctg

SEQ ID NO: 3268593 - DNA, 21 bp, Homo sapiens
acttcagggcagggctctgat

SEQ ID NO: 3268594 - DNA, 19 bp, Homo sapiens
acttcaggggatgggtgtg

SEQ ID NO: 3268595 - DNA, 15 bp, Homo sapiens
acttcagtcctgctc

SEQ ID NO: 3268596 - DNA, 15 bp, Homo sapiens
acttcagtcctggga

SEQ ID NO: 3268597 - DNA, 13 bp, Homo sapiens
acttcagttttat

SEQ ID NO: 3268598 - DNA, 20 bp, Homo sapiens
acttcatactggcaggaggg

SEQ ID NO: 3268599 - DNA, 24 bp, Homo sapiens
acttcatattgctgagagaaatat

SEQ ID NO: 3268600 - DNA, 19 bp, Homo sapiens
acttcatgacaagcatttt

SEQ ID NO: 3268601 - DNA, 20 bp, Homo sapiens
acttcatggaatggacatcc

SEQ ID NO: 3268602 - DNA, 15 bp, Homo sapiens
acttcattcttgaaa

SEQ ID NO: 3268603 - DNA, 13 bp, Homo sapiens
acttcattttata

SEQ ID NO: 3268604 - DNA, 15 bp, Homo sapiens
acttcattttttaaa

SEQ ID NO: 3268605 - DNA, 15 bp, Homo sapiens
acttccaaagaaagt

SEQ ID NO: 3268606 - DNA, 21 bp, Homo sapiens
acttccacctcgggcacattt

SEQ ID NO: 3268607 - DNA, 12 bp, Homo sapiens
acttccagcaag

SEQ ID NO: 3268608 - DNA, 20 bp, Homo sapiens
acttccaggggaacctgcca

SEQ ID NO: 3268609 - DNA, 14 bp, Homo sapiens
acttcccaacagcc

SEQ ID NO: 3268610 - DNA, 14 bp, Homo sapiens
acttcccacacgat

SEQ ID NO: 3268611 - DNA, 22 bp, Homo sapiens
acttcccacacgattagcttta

SEQ ID NO: 3268612 - DNA, 11 bp, Homo sapiens
acttcccagct

SEQ ID NO: 3268613 - DNA, 23 bp, Homo sapiens
acttcccagctaggaagagcagg

SEQ ID NO: 3268614 - DNA, 19 bp, Homo sapiens
acttcccattttggaagtt

SEQ ID NO: 3268615 - DNA, 22 bp, Homo sapiens
acttccccctcttcttctgaag

SEQ ID NO: 3268616 - DNA, 16 bp, Homo sapiens
acttcccgtctcagaa

SEQ ID NO: 3268617 - DNA, 15 bp, Homo sapiens
acttcctcctcccca

SEQ ID NO: 3268618 - DNA, 18 bp, Homo sapiens
acttcctcctccccactt

SEQ ID NO: 3268619 - DNA, 23 bp, Homo sapiens
acttcctcctgatggccaagagc

SEQ ID NO: 3268620 - DNA, 16 bp, Homo sapiens
acttcctgctacagga

SEQ ID NO: 3268621 - DNA, 18 bp, Homo sapiens
acttcctgctacaggagg

SEQ ID NO: 3268622 - DNA, 19 bp, Homo sapiens
acttcctgctacaggaggg

SEQ ID NO: 3268623 - DNA, 13 bp, Homo sapiens
acttcctggggcc

SEQ ID NO: 3268624 - DNA, 22 bp, Homo sapiens
acttccttactaagcatagcaa

SEQ ID NO: 3268625 - DNA, 21 bp, Homo sapiens
acttcctttgtgtttatatgg

SEQ ID NO: 3268626 - DNA, 15 bp, Homo sapiens
acttcgactcaggat

SEQ ID NO: 3268627 - DNA, 16 bp, Homo sapiens
acttcgggctgtgtaa

SEQ ID NO: 3268628 - DNA, 19 bp, Homo sapiens
acttctacccagatggaaa

SEQ ID NO: 3268629 - DNA, 22 bp, Homo sapiens
acttctacccagatggaaaaat

SEQ ID NO: 3268630 - DNA, 13 bp, Homo sapiens
acttctatatttt

SEQ ID NO: 3268631 - DNA, 17 bp, Homo sapiens
acttctcactaatttgt

SEQ ID NO: 3268632 - DNA, 14 bp, Homo sapiens
acttctcatcttaa

SEQ ID NO: 3268633 - DNA, 17 bp, Homo sapiens
acttctcatcttaaaaa

SEQ ID NO: 3268634 - DNA, 16 bp, Homo sapiens
acttctccaggtctca

SEQ ID NO: 3268635 - DNA, 12 bp, Homo sapiens
acttctccccag

SEQ ID NO: 3268636 - DNA, 21 bp, Homo sapiens
acttctctgcctttgacattt

SEQ ID NO: 3268637 - DNA, 21 bp, Homo sapiens
acttctcttaaacttgtgaat

SEQ ID NO: 3268638 - DNA, 14 bp, Homo sapiens
acttctgactttac

SEQ ID NO: 3268639 - DNA, 24 bp, Homo sapiens
acttctgcaacaagcatgcagctt

SEQ ID NO: 3268640 - DNA, 15 bp, Homo sapiens
acttctgcattcctg

SEQ ID NO: 3268641 - DNA, 18 bp, Homo sapiens
acttctgcattcctgtaa

SEQ ID NO: 3268642 - DNA, 19 bp, Homo sapiens
acttctgccatattctgtt

SEQ ID NO: 3268643 - DNA, 12 bp, Homo sapiens
acttctgcctgg

SEQ ID NO: 3268644 - DNA, 13 bp, Homo sapiens
acttctggaaggc

SEQ ID NO: 3268645 - DNA, 21 bp, Homo sapiens
acttctggaaggctggctgag

SEQ ID NO: 3268646 - DNA, 15 bp, Homo sapiens
acttctggttgtatt

SEQ ID NO: 3268647 - DNA, 23 bp, Homo sapiens
acttctgtgagacccccacacct

SEQ ID NO: 3268648 - DNA, 16 bp, Homo sapiens
acttctgtgggcccct

SEQ ID NO: 3268649 - DNA, 22 bp, Homo sapiens
acttctgtgggcccctcaacag

SEQ ID NO: 3268650 - DNA, 15 bp, Homo sapiens
acttctgtgttcatt

SEQ ID NO: 3268651 - DNA, 17 bp, Homo sapiens
acttcttatacatttga

SEQ ID NO: 3268652 - DNA, 16 bp, Homo sapiens
acttcttatggaattg

SEQ ID NO: 3268653 - DNA, 23 bp, Homo sapiens
acttcttatggaattgatttgca

SEQ ID NO: 3268654 - DNA, 14 bp, Homo sapiens
acttcttcctgctg

SEQ ID NO: 3268655 - DNA, 17 bp, Homo sapiens
acttcttcctttctctt

SEQ ID NO: 3268656 - DNA, 14 bp, Homo sapiens
acttcttctccatc

SEQ ID NO: 3268657 - DNA, 18 bp, Homo sapiens
acttcttgcttctttcta

SEQ ID NO: 3268658 - DNA, 12 bp, Homo sapiens
acttcttgtcag

SEQ ID NO: 3268659 - DNA, 13 bp, Homo sapiens
acttcttgtcaga

SEQ ID NO: 3268660 - DNA, 17 bp, Homo sapiens
acttcttgtcagacata

SEQ ID NO: 3268661 - DNA, 14 bp, Homo sapiens
acttgaaagatttt

SEQ ID NO: 3268662 - DNA, 19 bp, Homo sapiens
acttgaaagattttattgt

SEQ ID NO: 3268663 - DNA, 13 bp, Homo sapiens
acttgaaagcatc

SEQ ID NO: 3268664 - DNA, 14 bp, Homo sapiens
acttgaaagcatcc

SEQ ID NO: 3268665 - DNA, 18 bp, Homo sapiens
acttgaaagcatccatgt

SEQ ID NO: 3268666 - DNA, 20 bp, Homo sapiens
acttgaaagcatccatgtgt

SEQ ID NO: 3268667 - DNA, 19 bp, Homo sapiens
acttgaataaaaaaaatat

SEQ ID NO: 3268668 - DNA, 19 bp, Homo sapiens
acttgaatggttaataaaa

SEQ ID NO: 3268669 - DNA, 14 bp, Homo sapiens
acttgactctaata

SEQ ID NO: 3268670 - DNA, 18 bp, Homo sapiens
acttgactctaatatgat

SEQ ID NO: 3268671 - DNA, 21 bp, Homo sapiens
acttgagaactttccattttg

SEQ ID NO: 3268672 - DNA, 15 bp, Homo sapiens
acttgagtgttcctt

SEQ ID NO: 3268673 - DNA, 22 bp, Homo sapiens
acttgagttggagtactatatt

SEQ ID NO: 3268674 - DNA, 18 bp, Homo sapiens
acttgataatattagtga

SEQ ID NO: 3268675 - DNA, 21 bp, Homo sapiens
acttgataatattagtgattc

SEQ ID NO: 3268676 - DNA, 14 bp, Homo sapiens
acttgatactgaat

SEQ ID NO: 3268677 - DNA, 16 bp, Homo sapiens
acttgatactgaatgc

SEQ ID NO: 3268678 - DNA, 13 bp, Homo sapiens
acttgatgcatgt

SEQ ID NO: 3268679 - DNA, 17 bp, Homo sapiens
acttgattaagatttta

SEQ ID NO: 3268680 - DNA, 19 bp, Homo sapiens
acttgattaagattttaca

SEQ ID NO: 3268681 - DNA, 21 bp, Homo sapiens
acttgattaagattttacaaa

SEQ ID NO: 3268682 - DNA, 15 bp, Homo sapiens
acttgatttgatgtg

SEQ ID NO: 3268683 - DNA, 16 bp, Homo sapiens
acttgatttgatgtga

SEQ ID NO: 3268684 - DNA, 21 bp, Homo sapiens
acttgatttgatgtgactttt

SEQ ID NO: 3268685 - DNA, 19 bp, Homo sapiens
acttgcaaagacctacctc

SEQ ID NO: 3268686 - DNA, 23 bp, Homo sapiens
acttgcagctgatgttggaagag

SEQ ID NO: 3268687 - DNA, 13 bp, Homo sapiens
acttgcagtacat

SEQ ID NO: 3268688 - DNA, 12 bp, Homo sapiens
acttgcatgaag

SEQ ID NO: 3268689 - DNA, 19 bp, Homo sapiens
acttgcattgaatatatta

SEQ ID NO: 3268690 - DNA, 17 bp, Homo sapiens
acttgccctgttctctt

SEQ ID NO: 3268691 - DNA, 18 bp, Homo sapiens
acttgccctgttctcttc

SEQ ID NO: 3268692 - DNA, 12 bp, Homo sapiens
acttgcctcttc

SEQ ID NO: 3268693 - DNA, 16 bp, Homo sapiens
accttcaattcctggg

SEQ ID NO: 3268694 - DNA, 19 bp, Homo sapiens
accttcagttatgattttt

SEQ ID NO: 3268695 - DNA, 14 bp, Homo sapiens
accttcatccagat

SEQ ID NO: 3268696 - DNA, 16 bp, Homo sapiens
accttccaaacaaaag

SEQ ID NO: 3268697 - DNA, 12 bp, Homo sapiens
accttccagggc

SEQ ID NO: 3268698 - DNA, 13 bp, Homo sapiens
accttccagggcc

SEQ ID NO: 3268699 - DNA, 19 bp, Homo sapiens
accttccatggctcttttt

SEQ ID NO: 3268700 - DNA, 13 bp, Homo sapiens
accttccccaccc

SEQ ID NO: 3268701 - DNA, 19 bp, Homo sapiens
accttccctctcaccatcc

SEQ ID NO: 3268702 - DNA, 14 bp, Homo sapiens
accttcctcctgca

SEQ ID NO: 3268703 - DNA, 11 bp, Homo sapiens
accttcctggg

SEQ ID NO: 3268704 - DNA, 23 bp, Homo sapiens
accttcctgggaggacaggcagg

SEQ ID NO: 3268705 - DNA, 12 bp, Homo sapiens
accttccttcct

SEQ ID NO: 3268706 - DNA, 11 bp, Homo sapiens
accttcgagta

SEQ ID NO: 3268707 - DNA, 18 bp, Homo sapiens
accttcgggctgtgcccg

SEQ ID NO: 3268708 - DNA, 17 bp, Homo sapiens
accttctagaacctggg

SEQ ID NO: 3268709 - DNA, 18 bp, Homo sapiens
accttctagtcttggcca

SEQ ID NO: 3268710 - DNA, 17 bp, Homo sapiens
accttctccccattctg

SEQ ID NO: 3268711 - DNA, 17 bp, Homo sapiens
accttctgagtattctc

SEQ ID NO: 3268712 - DNA, 19 bp, Homo sapiens
accttctgcctttgatgtt

SEQ ID NO: 3268713 - DNA, 15 bp, Homo sapiens
accttctgtccccag

SEQ ID NO: 3268714 - DNA, 22 bp, Homo sapiens
accttctgtccccagccctgtc

SEQ ID NO: 3268715 - DNA, 14 bp, Homo sapiens
accttctttctgga

SEQ ID NO: 3268716 - DNA, 18 bp, Homo sapiens
accttctttctggactgg

SEQ ID NO: 3268717 - DNA, 13 bp, Homo sapiens
accttctttgtaa

SEQ ID NO: 3268718 - DNA, 20 bp, Homo sapiens
accttgaactgggtacttgt

SEQ ID NO: 3268719 - DNA, 20 bp, Homo sapiens
accttgaagtgactgttgta

SEQ ID NO: 3268720 - DNA, 20 bp, Homo sapiens
accttgaccatcgtccttcc

SEQ ID NO: 3268721 - DNA, 11 bp, Homo sapiens
accttgaggtc

SEQ ID NO: 3268722 - DNA, 22 bp, Homo sapiens
accttgctgcaagcacagccct

SEQ ID NO: 3268723 - DNA, 23 bp, Homo sapiens
accttgctgcaagcacagccctt

SEQ ID NO: 3268724 - DNA, 18 bp, Homo sapiens
actgtgccctggtggaga

SEQ ID NO: 3268725 - DNA, 14 bp, Homo sapiens
actgtgcctttgca

SEQ ID NO: 3268726 - DNA, 22 bp, Homo sapiens
actgtgcctttgcaaatcagtg

SEQ ID NO: 3268727 - DNA, 12 bp, Homo sapiens
actgtgctaata

SEQ ID NO: 3268728 - DNA, 18 bp, Homo sapiens
actgtgctaataacagtg

SEQ ID NO: 3268729 - DNA, 23 bp, Homo sapiens
actgtgctactgtctttggaaaa

SEQ ID NO: 3268730 - DNA, 20 bp, Homo sapiens
actgtgcttatttttttaag

SEQ ID NO: 3268731 - DNA, 16 bp, Homo sapiens
actgtgcttcgagcca

SEQ ID NO: 3268732 - DNA, 16 bp, Homo sapiens
actgtggaggaaggat

SEQ ID NO: 3268733 - DNA, 22 bp, Homo sapiens
actgtggaggaaggattgtaaa

SEQ ID NO: 3268734 - DNA, 21 bp, Homo sapiens
actgtggatacccttaccctt

SEQ ID NO: 3268735 - DNA, 17 bp, Homo sapiens
actgtggccacagcccc

SEQ ID NO: 3268736 - DNA, 19 bp, Homo sapiens
actgtggccacagccccct

SEQ ID NO: 3268737 - DNA, 15 bp, Homo sapiens
actgtggccagagct

SEQ ID NO: 3268738 - DNA, 21 bp, Homo sapiens
actgtggccagagctggaagg

SEQ ID NO: 3268739 - DNA, 19 bp, Homo sapiens
actgtggccccctccgtga

SEQ ID NO: 3268740 - DNA, 23 bp, Homo sapiens
actgtggccgttatctggaagta

SEQ ID NO: 3268741 - DNA, 20 bp, Homo sapiens
actgtggtgatctgtagact

SEQ ID NO: 3268742 - DNA, 13 bp, Homo sapiens
actgtgtaattag

SEQ ID NO: 3268743 - DNA, 12 bp, Homo sapiens
actgtgtacata

SEQ ID NO: 3268744 - DNA, 12 bp, Homo sapiens
actgtgtataga

SEQ ID NO: 3268745 - DNA, 21 bp, Homo sapiens
actgtgtattccaagacatgt

SEQ ID NO: 3268746 - DNA, 18 bp, Homo sapiens
actgtgtcataaacagat

SEQ ID NO: 3268747 - DNA, 18 bp, Homo sapiens
actgtgtggactgtgatg

SEQ ID NO: 3268748 - DNA, 18 bp, Homo sapiens
actgtgtgtgtgaatgaa

SEQ ID NO: 3268749 - DNA, 14 bp, Homo sapiens
actgtgttgtatta

SEQ ID NO: 3268750 - DNA, 15 bp, Homo sapiens
actgtgtttcaagtt

SEQ ID NO: 3268751 - DNA, 18 bp, Homo sapiens
actgtgtttcaagttcaa

SEQ ID NO: 3268752 - DNA, 18 bp, Homo sapiens
actgttaaccatttaagt

SEQ ID NO: 3268753 - DNA, 19 bp, Homo sapiens
actgttaactatgacagat

SEQ ID NO: 3268754 - DNA, 17 bp, Homo sapiens
actgttaatacacagta

SEQ ID NO: 3268755 - DNA, 22 bp, Homo sapiens
actgttaatacacagtacttta

SEQ ID NO: 3268756 - DNA, 13 bp, Homo sapiens
actgttactttgg

SEQ ID NO: 3268757 - DNA, 21 bp, Homo sapiens
actgttactttggcaatttcc

SEQ ID NO: 3268758 - DNA, 14 bp, Homo sapiens
actgttagaacact

SEQ ID NO: 3268759 - DNA, 17 bp, Homo sapiens
actgttagaacactatt

SEQ ID NO: 3268760 - DNA, 19 bp, Homo sapiens
actgttagaacactatttt

SEQ ID NO: 3268761 - DNA, 14 bp, Homo sapiens
actgttagcactgt

SEQ ID NO: 3268762 - DNA, 13 bp, Homo sapiens
actgttagctttt

SEQ ID NO: 3268763 - DNA, 23 bp, Homo sapiens
actgttatgaaataaagaaattg

SEQ ID NO: 3268764 - DNA, 18 bp, Homo sapiens
actgttcacggcagacca

SEQ ID NO: 3268765 - DNA, 20 bp, Homo sapiens
actgttccaggccctccagt

SEQ ID NO: 3268766 - DNA, 22 bp, Homo sapiens
actgttccctctgctcctggag

SEQ ID NO: 3268767 - DNA, 14 bp, Homo sapiens
actgttctaaagct

SEQ ID NO: 3268768 - DNA, 17 bp, Homo sapiens
actgttctaaagctctg

SEQ ID NO: 3268769 - DNA, 13 bp, Homo sapiens
actgttctgagaa

SEQ ID NO: 3268770 - DNA, 10 bp, Homo sapiens
actgttcttg

SEQ ID NO: 3268771 - DNA, 12 bp, Homo sapiens
actgttcttgct

SEQ ID NO: 3268772 - DNA, 18 bp, Homo sapiens
actgttcttgctgctaga

SEQ ID NO: 3268773 - DNA, 23 bp, Homo sapiens
actgttcttgctgctagaacttt

SEQ ID NO: 3268774 - DNA, 15 bp, Homo sapiens
actgttcttttgcat

SEQ ID NO: 3268775 - DNA, 20 bp, Homo sapiens
actgttgatgaagtatactt

SEQ ID NO: 3268776 - DNA, 22 bp, Homo sapiens
actgttgatgaagtatactttt

SEQ ID NO: 3268777 - DNA, 17 bp, Homo sapiens
actgttgatgtatctga

SEQ ID NO: 3268778 - DNA, 20 bp, Homo sapiens
actgttgatgtatctgagtt

SEQ ID NO: 3268779 - DNA, 17 bp, Homo sapiens
actgttgcatttacttt

SEQ ID NO: 3268780 - DNA, 20 bp, Homo sapiens
actgttgcatttacttttaa

SEQ ID NO: 3268781 - DNA, 21 bp, Homo sapiens
actgttgcatttacttttaat

SEQ ID NO: 3268782 - DNA, 18 bp, Homo sapiens
actgttgcccaggctggc

SEQ ID NO: 3268783 - DNA, 18 bp, Homo sapiens
actgttgcctaattggaa

SEQ ID NO: 3268784 - DNA, 22 bp, Homo sapiens
actgttgtgatcttgcattcat

SEQ ID NO: 3268785 - DNA, 19 bp, Homo sapiens
actgtttaacaacatggct

SEQ ID NO: 3268786 - DNA, 12 bp, Homo sapiens
actgtttatata

SEQ ID NO: 3268787 - DNA, 21 bp, Homo sapiens
actgtttcactgaaatgtttg

SEQ ID NO: 3268788 - DNA, 17 bp, Homo sapiens
actgtttccctgctgaa

SEQ ID NO: 3268789 - DNA, 12 bp, Homo sapiens
actgtttctctg

SEQ ID NO: 3268790 - DNA, 15 bp, Homo sapiens
actgtttctctgctg

SEQ ID NO: 3268791 - DNA, 18 bp, Homo sapiens
actgtttctcttgagctg

SEQ ID NO: 3268792 - DNA, 19 bp, Homo sapiens
actgtttctcttgagctgg

SEQ ID NO: 3268793 - DNA, 14 bp, Homo sapiens
actgtttctgtcag

SEQ ID NO: 3268794 - DNA, 16 bp, Homo sapiens
actgtttctgtcagga

SEQ ID NO: 3268795 - DNA, 22 bp, Homo sapiens
actgtttgatataccaaattaa

SEQ ID NO: 3268796 - DNA, 21 bp, Homo sapiens
actgtttgccttctactttta

SEQ ID NO: 3268797 - DNA, 17 bp, Homo sapiens
actgttttaattgtagt

SEQ ID NO: 3268798 - DNA, 22 bp, Homo sapiens
actgttttctctcggctcccca

SEQ ID NO: 3268799 - DNA, 17 bp, Homo sapiens
actgtttttaagtaact

SEQ ID NO: 3268800 - DNA, 12 bp, Homo sapiens
actgtttttaat

SEQ ID NO: 3268801 - DNA, 15 bp, Homo sapiens
acttaaaaaaatgac

SEQ ID NO: 3268802 - DNA, 17 bp, Homo sapiens
acttaaaaatgtaaata

SEQ ID NO: 3268803 - DNA, 19 bp, Homo sapiens
acttaaaaatgtaaatatt

SEQ ID NO: 3268804 - DNA, 17 bp, Homo sapiens
acttaaaagtattcata

SEQ ID NO: 3268805 - DNA, 23 bp, Homo sapiens
acttaaaataggggatatttaag

SEQ ID NO: 3268806 - DNA, 22 bp, Homo sapiens
acttaaaatattcctgcatttg

SEQ ID NO: 3268807 - DNA, 19 bp, Homo sapiens
acttaaagggcccaatgaa

SEQ ID NO: 3268808 - DNA, 13 bp, Homo sapiens
acttaaatgaaag

SEQ ID NO: 3268809 - DNA, 14 bp, Homo sapiens
acttaaattatgtt

SEQ ID NO: 3268810 - DNA, 20 bp, Homo sapiens
acttaaatttggtttgttaa

SEQ ID NO: 3268811 - DNA, 21 bp, Homo sapiens
acttaacagatgcaatgtgct

SEQ ID NO: 3268812 - DNA, 17 bp, Homo sapiens
acttaacggctccagga

SEQ ID NO: 3268813 - DNA, 23 bp, Homo sapiens
acttaactattcaggagagtaga

SEQ ID NO: 3268814 - DNA, 16 bp, Homo sapiens
acttaagaaacactga

SEQ ID NO: 3268815 - DNA, 12 bp, Homo sapiens
acttaagagaaa

SEQ ID NO: 3268816 - DNA, 13 bp, Homo sapiens
acttaagagaaat

SEQ ID NO: 3268817 - DNA, 15 bp, Homo sapiens
acttaagagaaatgg

SEQ ID NO: 3268818 - DNA, 15 bp, Homo sapiens
acttaagcaaaagaa

SEQ ID NO: 3268819 - DNA, 20 bp, Homo sapiens
acttaagcaaaagaaaaaga

SEQ ID NO: 3268820 - DNA, 15 bp, Homo sapiens
acttaagtgcacttt

SEQ ID NO: 3268821 - DNA, 16 bp, Homo sapiens
acttaagtgcactttt

SEQ ID NO: 3268822 - DNA, 15 bp, Homo sapiens
acttaataaatctgc

SEQ ID NO: 3268823 - DNA, 13 bp, Homo sapiens
acttaataaattc

SEQ ID NO: 3268824 - DNA, 21 bp, Homo sapiens
acttaatactaccttgaaaat

SEQ ID NO: 3268825 - DNA, 15 bp, Homo sapiens
acttaatagcaacag

SEQ ID NO: 3268826 - DNA, 16 bp, Homo sapiens
acttaatcaaaactca

SEQ ID NO: 3268827 - DNA, 23 bp, Homo sapiens
acttaatggctgttgagggccac

SEQ ID NO: 3268828 - DNA, 13 bp, Homo sapiens
acttaatgtatgt

SEQ ID NO: 3268829 - DNA, 15 bp, Homo sapiens
acttaatgtatgtta

SEQ ID NO: 3268830 - DNA, 16 bp, Homo sapiens
acttaatgtatgttac

SEQ ID NO: 3268831 - DNA, 21 bp, Homo sapiens
acttaatttgtaaacttctga

SEQ ID NO: 3268832 - DNA, 12 bp, Homo sapiens
acttacaaaaat

SEQ ID NO: 3268833 - DNA, 20 bp, Homo sapiens
acttacaaaaatgggaaaaa

SEQ ID NO: 3268834 - DNA, 15 bp, Homo sapiens
acttacatcatgtgt

SEQ ID NO: 3268835 - DNA, 16 bp, Homo sapiens
acttactgtatatgta

SEQ ID NO: 3268836 - DNA, 16 bp, Homo sapiens
acttactgtttctgtc

SEQ ID NO: 3268837 - DNA, 20 bp, Homo sapiens
acttactgtttctgtcagga

SEQ ID NO: 3268838 - DNA, 17 bp, Homo sapiens
acttacttgatgatttt

SEQ ID NO: 3268839 - DNA, 18 bp, Homo sapiens
acttacttgatgattttt

SEQ ID NO: 3268840 - DNA, 20 bp, Homo sapiens
acttagaggtggggagcaga

SEQ ID NO: 3268841 - DNA, 17 bp, Homo sapiens
acttagcatgcacaaag

SEQ ID NO: 3268842 - DNA, 21 bp, Homo sapiens
acttagcccaagaggtctgag

SEQ ID NO: 3268843 - DNA, 20 bp, Homo sapiens
acttagccgactgcgctgct

SEQ ID NO: 3268844 - DNA, 16 bp, Homo sapiens
acttagctagttttat

SEQ ID NO: 3268845 - DNA, 20 bp, Homo sapiens
acttagctgtactataagta

SEQ ID NO: 3268846 - DNA, 21 bp, Homo sapiens
acttaggcatgcacagctgta

SEQ ID NO: 3268847 - DNA, 16 bp, Homo sapiens
acttagggcaccaggg

SEQ ID NO: 3268848 - DNA, 21 bp, Homo sapiens
acttaggggagttcagtattt

SEQ ID NO: 3268849 - DNA, 18 bp, Homo sapiens
acttaggttattttgctt

SEQ ID NO: 3268850 - DNA, 20 bp, Homo sapiens
acttaggttattttgctttg

SEQ ID NO: 3268851 - DNA, 22 bp, Homo sapiens
acttaggttattttgctttggt

SEQ ID NO: 3268852 - DNA, 18 bp, Homo sapiens
acttagtgatcatttaaa

SEQ ID NO: 3268853 - DNA, 14 bp, Homo sapiens
actcctacctcagc

SEQ ID NO: 3268854 - DNA, 14 bp, Homo sapiens
actcctatttttgt

SEQ ID NO: 3268855 - DNA, 20 bp, Homo sapiens
actcctatttttgtaaactg

SEQ ID NO: 3268856 - DNA, 20 bp, Homo sapiens
actcctcaaaagcaaatgag

SEQ ID NO: 3268857 - DNA, 19 bp, Homo sapiens
actcctcagatctgaacac

SEQ ID NO: 3268858 - DNA, 22 bp, Homo sapiens
actcctctcccacagagtgctg

SEQ ID NO: 3268859 - DNA, 12 bp, Homo sapiens
actcctctgcag

SEQ ID NO: 3268860 - DNA, 20 bp, Homo sapiens
actcctctgcagtgccttgg

SEQ ID NO: 3268861 - DNA, 15 bp, Homo sapiens
actcctctgggcctg

SEQ ID NO: 3268862 - DNA, 17 bp, Homo sapiens
actcctctgggcctggg

SEQ ID NO: 3268863 - DNA, 19 bp, Homo sapiens
actcctgaagtgagtttta

SEQ ID NO: 3268864 - DNA, 15 bp, Homo sapiens
actcctgacagtctt

SEQ ID NO: 3268865 - DNA, 21 bp, Homo sapiens
actcctgacgtctgaagcttg

SEQ ID NO: 3268866 - DNA, 11 bp, Homo sapiens
actcctgactc

SEQ ID NO: 3268867 - DNA, 12 bp, Homo sapiens
actcctgactcc

SEQ ID NO: 3268868 - DNA, 20 bp, Homo sapiens
actcctgattttgtagttaa

SEQ ID NO: 3268869 - DNA, 21 bp, Homo sapiens
actcctgattttgtagttaat

SEQ ID NO: 3268870 - DNA, 14 bp, Homo sapiens
actcctgccctgtt

SEQ ID NO: 3268871 - DNA, 13 bp, Homo sapiens
actcctgcctccg

SEQ ID NO: 3268872 - DNA, 14 bp, Homo sapiens
actcctgcctccgc

SEQ ID NO: 3268873 - DNA, 16 bp, Homo sapiens
actcctgcctccgctg

SEQ ID NO: 3268874 - DNA, 13 bp, Homo sapiens
actcctgcttaat

SEQ ID NO: 3268875 - DNA, 13 bp, Homo sapiens
actcctgtacact

SEQ ID NO: 3268876 - DNA, 17 bp, Homo sapiens
actcctgtacactgaat

SEQ ID NO: 3268877 - DNA, 14 bp, Homo sapiens
actcctgtgctctg

SEQ ID NO: 3268878 - DNA, 20 bp, Homo sapiens
actcctgtgctctggaggct

SEQ ID NO: 3268879 - DNA, 16 bp, Homo sapiens
actcctgttacttacc

SEQ ID NO: 3268880 - DNA, 23 bp, Homo sapiens
actccttccagtgtccttagaac

SEQ ID NO: 3268881 - DNA, 21 bp, Homo sapiens
actccttttggtgtgttggac

SEQ ID NO: 3268882 - DNA, 14 bp, Homo sapiens
actcgaaaataagg

SEQ ID NO: 3268883 - DNA, 15 bp, Homo sapiens
actcgaggcctgcaa

SEQ ID NO: 3268884 - DNA, 16 bp, Homo sapiens
actcgcgctcagtaaa

SEQ ID NO: 3268885 - DNA, 23 bp, Homo sapiens
actcgctcctagtgtttctttgt

SEQ ID NO: 3268886 - DNA, 12 bp, Homo sapiens
actcgcttgtaa

SEQ ID NO: 3268887 - DNA, 13 bp, Homo sapiens
actcgcttgtaaa

SEQ ID NO: 3268888 - DNA, 17 bp, Homo sapiens
actcgcttgtaaatacc

SEQ ID NO: 3268889 - DNA, 14 bp, Homo sapiens
actcggatggggca

SEQ ID NO: 3268890 - DNA, 16 bp, Homo sapiens
actcggcaccctgcaa

SEQ ID NO: 3268891 - DNA, 19 bp, Homo sapiens
actcgggggtggagtgaga

SEQ ID NO: 3268892 - DNA, 18 bp, Homo sapiens
actctaaaaaacattttt

SEQ ID NO: 3268893 - DNA, 20 bp, Homo sapiens
actctaaaaaacatttttaa

SEQ ID NO: 3268894 - DNA, 16 bp, Homo sapiens
actctaaaaggttcag

SEQ ID NO: 3268895 - DNA, 19 bp, Homo sapiens
actctaaaaggttcaggga

SEQ ID NO: 3268896 - DNA, 15 bp, Homo sapiens
actctaaaattataa

SEQ ID NO: 3268897 - DNA, 20 bp, Homo sapiens
actctaagatcttagattct

SEQ ID NO: 3268898 - DNA, 17 bp, Homo sapiens
actctaagctgtgtgca

SEQ ID NO: 3268899 - DNA, 14 bp, Homo sapiens
actctaatagtgct

SEQ ID NO: 3268900 - DNA, 21 bp, Homo sapiens
actctaatagtgcttaaaaat

SEQ ID NO: 3268901 - DNA, 17 bp, Homo sapiens
actctaatattgcttct

SEQ ID NO: 3268902 - DNA, 12 bp, Homo sapiens
actctacattta

SEQ ID NO: 3268903 - DNA, 14 bp, Homo sapiens
actctacatttaaa

SEQ ID NO: 3268904 - DNA, 19 bp, Homo sapiens
actctacccatattacaga

SEQ ID NO: 3268905 - DNA, 23 bp, Homo sapiens
actctacccctgctcccattcct

SEQ ID NO: 3268906 - DNA, 15 bp, Homo sapiens
actctaccctcccac

SEQ ID NO: 3268907 - DNA, 18 bp, Homo sapiens
actctaccctcccacccc

SEQ ID NO: 3268908 - DNA, 19 bp, Homo sapiens
actctacctccttagcttt

SEQ ID NO: 3268909 - DNA, 21 bp, Homo sapiens
actctacttaatccaatgggt

SEQ ID NO: 3268910 - DNA, 21 bp, Homo sapiens
actctacttagcatgtcccta

SEQ ID NO: 3268911 - DNA, 14 bp, Homo sapiens
actctagagtccaa

SEQ ID NO: 3268912 - DNA, 20 bp, Homo sapiens
actctagagtccaaggttta

SEQ ID NO: 3268913 - DNA, 22 bp, Homo sapiens
actctagatgaagttttacatt

SEQ ID NO: 3268914 - DNA, 13 bp, Homo sapiens
actctagattcca

SEQ ID NO: 3268915 - DNA, 16 bp, Homo sapiens
actctaggttatacaa

SEQ ID NO: 3268916 - DNA, 19 bp, Homo sapiens
actctaggttatacaataa

SEQ ID NO: 3268917 - DNA, 20 bp, Homo sapiens
actctaggttatacaataac

SEQ ID NO: 3268918 - DNA, 22 bp, Homo sapiens
actctataagcaaattgctttt

SEQ ID NO: 3268919 - DNA, 15 bp, Homo sapiens
actctatctgggcct

SEQ ID NO: 3268920 - DNA, 17 bp, Homo sapiens
actctatgccccaaata

SEQ ID NO: 3268921 - DNA, 19 bp, Homo sapiens
actctatgccccaaatata

SEQ ID NO: 3268922 - DNA, 20 bp, Homo sapiens
actctatgccccaaatatag

SEQ ID NO: 3268923 - DNA, 19 bp, Homo sapiens
actctcaggatcaagaaag

SEQ ID NO: 3268924 - DNA, 18 bp, Homo sapiens
actctccaccctggctgg

SEQ ID NO: 3268925 - DNA, 22 bp, Homo sapiens
actctccagccgaagctgcagg

SEQ ID NO: 3268926 - DNA, 11 bp, Homo sapiens
actctccaggg

SEQ ID NO: 3268927 - DNA, 22 bp, Homo sapiens
actctccccacgagggctggct

SEQ ID NO: 3268928 - DNA, 13 bp, Homo sapiens
actctcctagaga

SEQ ID NO: 3268929 - DNA, 19 bp, Homo sapiens
actctcctcggccccctcc

SEQ ID NO: 3268930 - DNA, 19 bp, Homo sapiens
actctcggggcccttgggg

SEQ ID NO: 3268931 - DNA, 22 bp, Homo sapiens
actctcggggcccttggggcct

SEQ ID NO: 3268932 - DNA, 23 bp, Homo sapiens
actctcggggcccttggggcctg

SEQ ID NO: 3268933 - DNA, 19 bp, Homo sapiens
actctctaaactggtacaa

SEQ ID NO: 3268934 - DNA, 16 bp, Homo sapiens
actctctgctctagcc

SEQ ID NO: 3268935 - DNA, 17 bp, Homo sapiens
actctctgctctagcca

SEQ ID NO: 3268936 - DNA, 19 bp, Homo sapiens
actctctgctctagccagg

SEQ ID NO: 3268937 - DNA, 22 bp, Homo sapiens
actctcttttgaggtccctgta

SEQ ID NO: 3268938 - DNA, 23 bp, Homo sapiens
actctcttttgaggtccctgtat

SEQ ID NO: 3268939 - DNA, 17 bp, Homo sapiens
actctgaactttggaga

SEQ ID NO: 3268940 - DNA, 14 bp, Homo sapiens
actctgacaagggc

SEQ ID NO: 3268941 - DNA, 18 bp, Homo sapiens
actctgacaagggctgac

SEQ ID NO: 3268942 - DNA, 13 bp, Homo sapiens
actctgagcccag

SEQ ID NO: 3268943 - DNA, 16 bp, Homo sapiens
actctgagcccaggcc

SEQ ID NO: 3268944 - DNA, 18 bp, Homo sapiens
actctgagcgggaggcag

SEQ ID NO: 3268945 - DNA, 21 bp, Homo sapiens
actctgagcgggaggcagagt

SEQ ID NO: 3268946 - DNA, 11 bp, Homo sapiens
actctgcacat

SEQ ID NO: 3268947 - DNA, 13 bp, Homo sapiens
actctgcacatgt

SEQ ID NO: 3268948 - DNA, 22 bp, Homo sapiens
actctgcacatgtcttgtacat

SEQ ID NO: 3268949 - DNA, 21 bp, Homo sapiens
actctgcatcccagcacctgc

SEQ ID NO: 3268950 - DNA, 14 bp, Homo sapiens
actctgccagcaaa

SEQ ID NO: 3268951 - DNA, 16 bp, Homo sapiens
actctgccagcaaaga

SEQ ID NO: 3268952 - DNA, 11 bp, Homo sapiens
actctgccagg

SEQ ID NO: 3268953 - DNA, 12 bp, Homo sapiens
actctgcctcct

SEQ ID NO: 3268954 - DNA, 16 bp, Homo sapiens
actctgcctcctcttc

SEQ ID NO: 3268955 - DNA, 15 bp, Homo sapiens
actctgctatttctc

SEQ ID NO: 3268956 - DNA, 19 bp, Homo sapiens
actctgctatttctcttgc

SEQ ID NO: 3268957 - DNA, 18 bp, Homo sapiens
actctgcttctctgactt

SEQ ID NO: 3268958 - DNA, 15 bp, Homo sapiens
actctgcttgatttt

SEQ ID NO: 3268959 - DNA, 16 bp, Homo sapiens
actctgcttgattttt

SEQ ID NO: 3268960 - DNA, 17 bp, Homo sapiens
actctggacccctgggc

SEQ ID NO: 3268961 - DNA, 18 bp, Homo sapiens
actctggatatttgcact

SEQ ID NO: 3268962 - DNA, 17 bp, Homo sapiens
actctggccctggccct

SEQ ID NO: 3268963 - DNA, 21 bp, Homo sapiens
actctgtataatagagataag

SEQ ID NO: 3268964 - DNA, 16 bp, Homo sapiens
actctgtcagatggga

SEQ ID NO: 3268965 - DNA, 14 bp, Homo sapiens
actctgtccaggcc

SEQ ID NO: 3268966 - DNA, 15 bp, Homo sapiens
actctgtccaggcca

SEQ ID NO: 3268967 - DNA, 16 bp, Homo sapiens
actctgtccaggccac

SEQ ID NO: 3268968 - DNA, 18 bp, Homo sapiens
actctgtccaggccactg

SEQ ID NO: 3268969 - DNA, 19 bp, Homo sapiens
actctgtccaggccactgt

SEQ ID NO: 3268970 - DNA, 19 bp, Homo sapiens
actctgtctcaaaaaaaca

SEQ ID NO: 3268971 - DNA, 15 bp, Homo sapiens
actctgtgtgtgtat

SEQ ID NO: 3268972 - DNA, 19 bp, Homo sapiens
actctgttgtactatggaa

SEQ ID NO: 3268973 - DNA, 20 bp, Homo sapiens
actcttaaatgatctgcctc

SEQ ID NO: 3268974 - DNA, 20 bp, Homo sapiens
actcttaggaagagaaacca

SEQ ID NO: 3268975 - DNA, 16 bp, Homo sapiens
actcttaggatatttg

SEQ ID NO: 3268976 - DNA, 17 bp, Homo sapiens
actcttaggatatttga

SEQ ID NO: 3268977 - DNA, 18 bp, Homo sapiens
actcttaggatatttgag

SEQ ID NO: 3268978 - DNA, 21 bp, Homo sapiens
actcttaggcactttgggggt

SEQ ID NO: 3268979 - DNA, 19 bp, Homo sapiens
actggtgtttgaaagtagg

SEQ ID NO: 3268980 - DNA, 14 bp, Homo sapiens
actggttgtatatt

SEQ ID NO: 3268981 - DNA, 18 bp, Homo sapiens
actggtttacaggccctg

SEQ ID NO: 3268982 - DNA, 22 bp, Homo sapiens
actggtttccccagggaaggaa

SEQ ID NO: 3268983 - DNA, 14 bp, Homo sapiens
actggtttgagatt

SEQ ID NO: 3268984 - DNA, 15 bp, Homo sapiens
actggttttacttac

SEQ ID NO: 3268985 - DNA, 13 bp, Homo sapiens
actggttttctgc

SEQ ID NO: 3268986 - DNA, 16 bp, Homo sapiens
actgtaaagatttgtt

SEQ ID NO: 3268987 - DNA, 18 bp, Homo sapiens
actgtaaagatttgttga

SEQ ID NO: 3268988 - DNA, 15 bp, Homo sapiens
actgtaaataaaatg

SEQ ID NO: 3268989 - DNA, 16 bp, Homo sapiens
actgtaaatatgaatc

SEQ ID NO: 3268990 - DNA, 21 bp, Homo sapiens
actgtaagactcattccctag

SEQ ID NO: 3268991 - DNA, 12 bp, Homo sapiens
actgtaagatgt

SEQ ID NO: 3268992 - DNA, 14 bp, Homo sapiens
actgtaagatgttg

SEQ ID NO: 3268993 - DNA, 17 bp, Homo sapiens
actgtaataatacctca

SEQ ID NO: 3268994 - DNA, 18 bp, Homo sapiens
actgtaataatacctcaa

SEQ ID NO: 3268995 - DNA, 23 bp, Homo sapiens
actgtaataatacctcaatgttt

SEQ ID NO: 3268996 - DNA, 12 bp, Homo sapiens
actgtaatttag

SEQ ID NO: 3268997 - DNA, 17 bp, Homo sapiens
actgtaattttatatga

SEQ ID NO: 3268998 - DNA, 13 bp, Homo sapiens
actgtacaaagta

SEQ ID NO: 3268999 - DNA, 14 bp, Homo sapiens
actgtacaaagtag

SEQ ID NO: 3269000 - DNA, 22 bp, Homo sapiens
actgtacaaagtagaagtctta

SEQ ID NO: 3269001 - DNA, 14 bp, Homo sapiens
actgtacacacttt

SEQ ID NO: 3269002 - DNA, 20 bp, Homo sapiens
actgtacaccatagtttaca

SEQ ID NO: 3269003 - DNA, 16 bp, Homo sapiens
actgtacatttaaaat

SEQ ID NO: 3269004 - DNA, 22 bp, Homo sapiens
actgtacatttaaaattgctat

SEQ ID NO: 3269005 - DNA, 17 bp, Homo sapiens
actgtacccaaatggaa

SEQ ID NO: 3269006 - DNA, 12 bp, Homo sapiens
actgtactaatt

SEQ ID NO: 3269007 - DNA, 22 bp, Homo sapiens
actgtactaattcttacactgc

SEQ ID NO: 3269008 - DNA, 15 bp, Homo sapiens
actgtactcctccca

SEQ ID NO: 3269009 - DNA, 20 bp, Homo sapiens
actgtactcctcccaggcgc

SEQ ID NO: 3269010 - DNA, 18 bp, Homo sapiens
actgtactggccagtgtc

SEQ ID NO: 3269011 - DNA, 22 bp, Homo sapiens
actgtactttgccatttttcta

SEQ ID NO: 3269012 - DNA, 15 bp, Homo sapiens
actgtagaaatgatg

SEQ ID NO: 3269013 - DNA, 18 bp, Homo sapiens
actgtagaatgatttcat

SEQ ID NO: 3269014 - DNA, 20 bp, Homo sapiens
actgtagaatgatttcatgc

SEQ ID NO: 3269015 - DNA, 20 bp, Homo sapiens
actgtagattgcttctgtag

SEQ ID NO: 3269016 - DNA, 22 bp, Homo sapiens
actgtagattgcttctgtagta

SEQ ID NO: 3269017 - DNA, 18 bp, Homo sapiens
actgtagctcaagtttaa

SEQ ID NO: 3269018 - DNA, 20 bp, Homo sapiens
actgtagctcaagtttaaaa

SEQ ID NO: 3269019 - DNA, 15 bp, Homo sapiens
actgtagggccaggg

SEQ ID NO: 3269020 - DNA, 20 bp, Homo sapiens
actgtagtttttcttcaaca

SEQ ID NO: 3269021 - DNA, 15 bp, Homo sapiens
actgtataaatagga

SEQ ID NO: 3269022 - DNA, 21 bp, Homo sapiens
actgtataaataggagaggat

SEQ ID NO: 3269023 - DNA, 23 bp, Homo sapiens
actgtataggtagatccagatcc

SEQ ID NO: 3269024 - DNA, 13 bp, Homo sapiens
actgtatatgtat

SEQ ID NO: 3269025 - DNA, 14 bp, Homo sapiens
actgtatatgtatt

SEQ ID NO: 3269026 - DNA, 16 bp, Homo sapiens
actgtatattacagat

SEQ ID NO: 3269027 - DNA, 15 bp, Homo sapiens
actgtatcattttct

SEQ ID NO: 3269028 - DNA, 15 bp, Homo sapiens
actgtatgatttata

SEQ ID NO: 3269029 - DNA, 16 bp, Homo sapiens
actgtatgccttctgt

SEQ ID NO: 3269030 - DNA, 13 bp, Homo sapiens
actgtatgtgtgt

SEQ ID NO: 3269031 - DNA, 14 bp, Homo sapiens
actgtatttgtatc

SEQ ID NO: 3269032 - DNA, 19 bp, Homo sapiens
actgtcaaattttcaaata

SEQ ID NO: 3269033 - DNA, 20 bp, Homo sapiens
actgtcaaggctgcttagaa

SEQ ID NO: 3269034 - DNA, 22 bp, Homo sapiens
actgtcaaggctgcttagaatc

SEQ ID NO: 3269035 - DNA, 21 bp, Homo sapiens
actgtcaataaacagcttcat

SEQ ID NO: 3269036 - DNA, 23 bp, Homo sapiens
actgtcactcattgctgagcctc

SEQ ID NO: 3269037 - DNA, 20 bp, Homo sapiens
actgtcactgtttctctgct

SEQ ID NO: 3269038 - DNA, 18 bp, Homo sapiens
actgtcactttgctctgg

SEQ ID NO: 3269039 - DNA, 19 bp, Homo sapiens
actgtcactttgctctggg

SEQ ID NO: 3269040 - DNA, 15 bp, Homo sapiens
actgtcagattaaat

SEQ ID NO: 3269041 - DNA, 19 bp, Homo sapiens
actgtcagattaaattaca

SEQ ID NO: 3269042 - DNA, 22 bp, Homo sapiens
actgtcagattaaattacagct

SEQ ID NO: 3269043 - DNA, 16 bp, Homo sapiens
actgtccccctaccca

SEQ ID NO: 3269044 - DNA, 17 bp, Homo sapiens
actgtcctctcccctcc

SEQ ID NO: 3269045 - DNA, 19 bp, Homo sapiens
actgtcctctcccctccag

SEQ ID NO: 3269046 - DNA, 17 bp, Homo sapiens
actgtcggagaggctgt

SEQ ID NO: 3269047 - DNA, 20 bp, Homo sapiens
actgtctcaagagggcactg

SEQ ID NO: 3269048 - DNA, 13 bp, Homo sapiens
actgtctgggatt

SEQ ID NO: 3269049 - DNA, 13 bp, Homo sapiens
actgtctggtttt

SEQ ID NO: 3269050 - DNA, 17 bp, Homo sapiens
actgtctggttttaaca

SEQ ID NO: 3269051 - DNA, 16 bp, Homo sapiens
actgtctgttctgcac

SEQ ID NO: 3269052 - DNA, 17 bp, Homo sapiens
actgtctttttcttacc

SEQ ID NO: 3269053 - DNA, 21 bp, Homo sapiens
actgtctttttttccctacca

SEQ ID NO: 3269054 - DNA, 20 bp, Homo sapiens
actgtgaaataccacaagcc

SEQ ID NO: 3269055 - DNA, 13 bp, Homo sapiens
actgtgaacttga

SEQ ID NO: 3269056 - DNA, 22 bp, Homo sapiens
actgtgaacttgactgggtgag

SEQ ID NO: 3269057 - DNA, 17 bp, Homo sapiens
actgtgacctttgtcta

SEQ ID NO: 3269058 - DNA, 19 bp, Homo sapiens
actgtgacctttgtctaga

SEQ ID NO: 3269059 - DNA, 23 bp, Homo sapiens
actgtgatcaggctatgtatgga

SEQ ID NO: 3269060 - DNA, 13 bp, Homo sapiens
actgtgatgccac

SEQ ID NO: 3269061 - DNA, 22 bp, Homo sapiens
actgtgatgccacacagagtgg

SEQ ID NO: 3269062 - DNA, 14 bp, Homo sapiens
actgtgcactgccc

SEQ ID NO: 3269063 - DNA, 12 bp, Homo sapiens
actgtgcagaat

SEQ ID NO: 3269064 - DNA, 22 bp, Homo sapiens
actgtgcagaataatggaaaca

SEQ ID NO: 3269065 - DNA, 22 bp, Homo sapiens
agacatactccttccatcaaat

SEQ ID NO: 3269066 - DNA, 22 bp, Homo sapiens
agacatagcatccaagtggcat

SEQ ID NO: 3269067 - DNA, 19 bp, Homo sapiens
agacataggccatgaaaaa

SEQ ID NO: 3269068 - DNA, 23 bp, Homo sapiens
agacatatgggatattcccaagc

SEQ ID NO: 3269069 - DNA, 17 bp, Homo sapiens
agacatccatgtttgta

SEQ ID NO: 3269070 - DNA, 18 bp, Homo sapiens
agacatccatgtttgtaa

SEQ ID NO: 3269071 - DNA, 22 bp, Homo sapiens
agacatccatgtttgtaaaact

SEQ ID NO: 3269072 - DNA, 16 bp, Homo sapiens
agacatggaagagaga

SEQ ID NO: 3269073 - DNA, 21 bp, Homo sapiens
agacatggaagagagagccat

SEQ ID NO: 3269074 - DNA, 18 bp, Homo sapiens
agacatggatgcgaggac

SEQ ID NO: 3269075 - DNA, 18 bp, Homo sapiens
agacatgtctgttctaca

SEQ ID NO: 3269076 - DNA, 20 bp, Homo sapiens
agacatgtctgttctacata

SEQ ID NO: 3269077 - DNA, 12 bp, Homo sapiens
agacatgtgaca

SEQ ID NO: 3269078 - DNA, 14 bp, Homo sapiens
agacatgtgacatt

SEQ ID NO: 3269079 - DNA, 17 bp, Homo sapiens
agacatgtgacatttat

SEQ ID NO: 3269080 - DNA, 17 bp, Homo sapiens
agacattaagcagcctt

SEQ ID NO: 3269081 - DNA, 18 bp, Homo sapiens
agacattctgtctttcaa

SEQ ID NO: 3269082 - DNA, 22 bp, Homo sapiens
agacatttgatagaaaggaaca

SEQ ID NO: 3269083 - DNA, 17 bp, Homo sapiens
agacatttgccttttgt

SEQ ID NO: 3269084 - DNA, 22 bp, Homo sapiens
agacatttgtaaatctatagct

SEQ ID NO: 3269085 - DNA, 17 bp, Homo sapiens
agacatttgtatattgt

SEQ ID NO: 3269086 - DNA, 20 bp, Homo sapiens
agacatttgttattttggaa

SEQ ID NO: 3269087 - DNA, 17 bp, Homo sapiens
agacattttttgctata

SEQ ID NO: 3269088 - DNA, 16 bp, Homo sapiens
agaccaaaggaaggaa

SEQ ID NO: 3269089 - DNA, 20 bp, Homo sapiens
agaccaaaggaaggaacgct

SEQ ID NO: 3269090 - DNA, 21 bp, Homo sapiens
agaccaacgttactcagggct

SEQ ID NO: 3269091 - DNA, 12 bp, Homo sapiens
agaccaaggaac

SEQ ID NO: 3269092 - DNA, 14 bp, Homo sapiens
agaccaaggaacaa

SEQ ID NO: 3269093 - DNA, 20 bp, Homo sapiens
agaccacagggttcaaaatg

SEQ ID NO: 3269094 - DNA, 13 bp, Homo sapiens
agaccacatcttt

SEQ ID NO: 3269095 - DNA, 23 bp, Homo sapiens
agaccacatctttatctgttctt

SEQ ID NO: 3269096 - DNA, 16 bp, Homo sapiens
agaccaccacttcgaa

SEQ ID NO: 3269097 - DNA, 17 bp, Homo sapiens
agaccaccatccaccgc

SEQ ID NO: 3269098 - DNA, 14 bp, Homo sapiens
agaccaccccgcct

SEQ ID NO: 3269099 - DNA, 16 bp, Homo sapiens
agaccaccccgcctgc

SEQ ID NO: 3269100 - DNA, 19 bp, Homo sapiens
agaccacgcccgtcctgcc

SEQ ID NO: 3269101 - DNA, 16 bp, Homo sapiens
agaccacttgccacgc

SEQ ID NO: 3269102 - DNA, 14 bp, Homo sapiens
agaccagaaattcc

SEQ ID NO: 3269103 - DNA, 15 bp, Homo sapiens
agaccagagctgtct

SEQ ID NO: 3269104 - DNA, 13 bp, Homo sapiens
agaccagcctcgc

SEQ ID NO: 3269105 - DNA, 12 bp, Homo sapiens
agaccagcctgg

SEQ ID NO: 3269106 - DNA, 21 bp, Homo sapiens
agaccagtgtatcaggtcagg

SEQ ID NO: 3269107 - DNA, 23 bp, Homo sapiens
agaccagtgtatcaggtcaggga

SEQ ID NO: 3269108 - DNA, 13 bp, Homo sapiens
agaccagttggga

SEQ ID NO: 3269109 - DNA, 20 bp, Homo sapiens
agaccagttgggagcactgg

SEQ ID NO: 3269110 - DNA, 22 bp, Homo sapiens
agaccagttgggagcactggag

SEQ ID NO: 3269111 - DNA, 16 bp, Homo sapiens
agaccatgaagtaaat

SEQ ID NO: 3269112 - DNA, 21 bp, Homo sapiens
agaccatgaagtaaattatgt

SEQ ID NO: 3269113 - DNA, 14 bp, Homo sapiens
agaccattctgtga

SEQ ID NO: 3269114 - DNA, 16 bp, Homo sapiens
agaccatttaacatgc

SEQ ID NO: 3269115 - DNA, 16 bp, Homo sapiens
agacccaccccacctg

SEQ ID NO: 3269116 - DNA, 17 bp, Homo sapiens
agacccaccccacctgc

SEQ ID NO: 3269117 - DNA, 17 bp, Homo sapiens
agacccaggtcttccag

SEQ ID NO: 3269118 - DNA, 18 bp, Homo sapiens
agacccaggtcttccaga

SEQ ID NO: 3269119 - DNA, 22 bp, Homo sapiens
agacccaggtcttccagacctg

SEQ ID NO: 3269120 - DNA, 17 bp, Homo sapiens
agaccccacctccttgg

SEQ ID NO: 3269121 - DNA, 17 bp, Homo sapiens
agaccccagttctaggg

SEQ ID NO: 3269122 - DNA, 13 bp, Homo sapiens
agaccccatctct

SEQ ID NO: 3269123 - DNA, 15 bp, Homo sapiens
agacccccacacctc

SEQ ID NO: 3269124 - DNA, 14 bp, Homo sapiens
agacccccagcact

SEQ ID NO: 3269125 - DNA, 13 bp, Homo sapiens
agacccccaggcc

SEQ ID NO: 3269126 - DNA, 14 bp, Homo sapiens
agacccctctggcc

SEQ ID NO: 3269127 - DNA, 19 bp, Homo sapiens
agacccctctggccaggat

SEQ ID NO: 3269128 - DNA, 14 bp, Homo sapiens
agacccctgtctcc

SEQ ID NO: 3269129 - DNA, 20 bp, Homo sapiens
agaccctctgccaccagaga

SEQ ID NO: 3269130 - DNA, 14 bp, Homo sapiens
agaccctcttgccc

SEQ ID NO: 3269131 - DNA, 19 bp, Homo sapiens
agaccctcttgcccatcct

SEQ ID NO: 3269132 - DNA, 21 bp, Homo sapiens
agaccctgcaaacagaacagg

SEQ ID NO: 3269133 - DNA, 18 bp, Homo sapiens
agaccctggtgcctggct

SEQ ID NO: 3269134 - DNA, 12 bp, Homo sapiens
agaccctgtctc

SEQ ID NO: 3269135 - DNA, 13 bp, Homo sapiens
agaccctgtctct

SEQ ID NO: 3269136 - DNA, 21 bp, Homo sapiens
agacccttattgctgtcctgg

SEQ ID NO: 3269137 - DNA, 22 bp, Homo sapiens
agacccttattgctgtcctgga

SEQ ID NO: 3269138 - DNA, 16 bp, Homo sapiens
agaccgtcctcacccc

SEQ ID NO: 3269139 - DNA, 20 bp, Homo sapiens
agaccgtcctcacccctgtc

SEQ ID NO: 3269140 - DNA, 22 bp, Homo sapiens
agaccgtgtcccaaggagctga

SEQ ID NO: 3269141 - DNA, 20 bp, Homo sapiens
agacctacattccctctcct

SEQ ID NO: 3269142 - DNA, 19 bp, Homo sapiens
agacctacctcaggttgct

SEQ ID NO: 3269143 - DNA, 19 bp, Homo sapiens
agacctacctccagacttc

SEQ ID NO: 3269144 - DNA, 15 bp, Homo sapiens
agacctactgttcta

SEQ ID NO: 3269145 - DNA, 18 bp, Homo sapiens
agacctactgttctaaag

SEQ ID NO: 3269146 - DNA, 22 bp, Homo sapiens
agacctactgttctaaagctct

SEQ ID NO: 3269147 - DNA, 14 bp, Homo sapiens
agacctagcaggga

SEQ ID NO: 3269148 - DNA, 17 bp, Homo sapiens
agacctcatcaggatga

SEQ ID NO: 3269149 - DNA, 19 bp, Homo sapiens
agacctcatcaggatgaac

SEQ ID NO: 3269150 - DNA, 22 bp, Homo sapiens
agacctcatcaggatgaaccca

SEQ ID NO: 3269151 - DNA, 21 bp, Homo sapiens
agacctcatctgtggagctgc

SEQ ID NO: 3269152 - DNA, 14 bp, Homo sapiens
agacctccccagcc

SEQ ID NO: 3269153 - DNA, 15 bp, Homo sapiens
agacctgcttcctga

SEQ ID NO: 3269154 - DNA, 19 bp, Homo sapiens
agacctgcttcctgaaata

SEQ ID NO: 3269155 - DNA, 22 bp, Homo sapiens
agacctgctttttgaaatgaaa

SEQ ID NO: 3269156 - DNA, 23 bp, Homo sapiens
agacctgctttttgaaatgaaat

SEQ ID NO: 3269157 - DNA, 19 bp, Homo sapiens
agacctggagcccctgggt

SEQ ID NO: 3269158 - DNA, 20 bp, Homo sapiens
agacctggagcccctgggtg

SEQ ID NO: 3269159 - DNA, 14 bp, Homo sapiens
agacctgtcttcca

SEQ ID NO: 3269160 - DNA, 15 bp, Homo sapiens
agacctgtcttccaa

SEQ ID NO: 3269161 - DNA, 21 bp, Homo sapiens
agacctgttggttccaagccc

SEQ ID NO: 3269162 - DNA, 22 bp, Homo sapiens
agaccttaataaaggcccccac

SEQ ID NO: 3269163 - DNA, 22 bp, Homo sapiens
agaccttcggggcctgtctgaa

SEQ ID NO: 3269164 - DNA, 19 bp, Homo sapiens
agaccttctccaaatgaga

SEQ ID NO: 3269165 - DNA, 23 bp, Homo sapiens
agaccttggatcagatgaactct

SEQ ID NO: 3269166 - DNA, 19 bp, Homo sapiens
agaccttgttacttctgag

SEQ ID NO: 3269167 - DNA, 22 bp, Homo sapiens
agaccttgttacttctgaggta

SEQ ID NO: 3269168 - DNA, 13 bp, Homo sapiens
agacgacaggcga

SEQ ID NO: 3269169 - DNA, 15 bp, Homo sapiens
agacgcaccatgtgg

SEQ ID NO: 3269170 - DNA, 15 bp, Homo sapiens
agacgcctgagctca

SEQ ID NO: 3269171 - DNA, 18 bp, Homo sapiens
agacggagtcccaccttg

SEQ ID NO: 3269172 - DNA, 19 bp, Homo sapiens
agacggagtcccaccttgg

SEQ ID NO: 3269173 - DNA, 21 bp, Homo sapiens
agacgggaggggaaaggctgc

SEQ ID NO: 3269174 - DNA, 11 bp, Homo sapiens
agacgggcaca

SEQ ID NO: 3269175 - DNA, 12 bp, Homo sapiens
agacgggcacag

SEQ ID NO: 3269176 - DNA, 13 bp, Homo sapiens
agacgggcacaga

SEQ ID NO: 3269177 - DNA, 17 bp, Homo sapiens
agacgtaggggaggggt

SEQ ID NO: 3269178 - DNA, 19 bp, Homo sapiens
agacgtccatagctcctct

SEQ ID NO: 3269179 - DNA, 22 bp, Homo sapiens
agacgtccatagctcctctccc

SEQ ID NO: 3269180 - DNA, 21 bp, Homo sapiens
agacgtggaacctctgtctca

SEQ ID NO: 3269181 - DNA, 16 bp, Homo sapiens
agacgtttataaacag

SEQ ID NO: 3269182 - DNA, 19 bp, Homo sapiens
agactaagaaatattccaa

SEQ ID NO: 3269183 - DNA, 13 bp, Homo sapiens
agactaagccctg

SEQ ID NO: 3269184 - DNA, 14 bp, Homo sapiens
agactagagaaacc

SEQ ID NO: 3269185 - DNA, 15 bp, Homo sapiens
agactagagaaaccg

SEQ ID NO: 3269186 - DNA, 12 bp, Homo sapiens
agactagatgta

SEQ ID NO: 3269187 - DNA, 19 bp, Homo sapiens
agactagatgtagtatttt

SEQ ID NO: 3269188 - DNA, 16 bp, Homo sapiens
agactagattgccttt

SEQ ID NO: 3269189 - DNA, 12 bp, Homo sapiens
agactatataca

SEQ ID NO: 3269190 - DNA, 13 bp, Homo sapiens
agactatatacat

SEQ ID NO: 3269191 - DNA, 17 bp, Homo sapiens
agactatatacatgtgt

SEQ ID NO: 3269192 - DNA, 18 bp, Homo sapiens
agactatatacatgtgtg

SEQ ID NO: 3269193 - DNA, 19 bp, Homo sapiens
agactatatacatgtgtgt

SEQ ID NO: 3269194 - DNA, 15 bp, Homo sapiens
agaatgtaagaaaac

SEQ ID NO: 3269195 - DNA, 19 bp, Homo sapiens
agaatgtcagattcctttc

SEQ ID NO: 3269196 - DNA, 23 bp, Homo sapiens
agaatgttactttggaatgacta

SEQ ID NO: 3269197 - DNA, 20 bp, Homo sapiens
agaatgttggtttactttca

SEQ ID NO: 3269198 - DNA, 12 bp, Homo sapiens
agaattaaaact

SEQ ID NO: 3269199 - DNA, 21 bp, Homo sapiens
agaattaaacttttaattcat

SEQ ID NO: 3269200 - DNA, 14 bp, Homo sapiens
agaattaatttatt

SEQ ID NO: 3269201 - DNA, 17 bp, Homo sapiens
agaattagtgccagaat

SEQ ID NO: 3269202 - DNA, 22 bp, Homo sapiens
agaattagtgccagaattttag

SEQ ID NO: 3269203 - DNA, 17 bp, Homo sapiens
agaattatctaatttat

SEQ ID NO: 3269204 - DNA, 14 bp, Homo sapiens
agaattatgtaata

SEQ ID NO: 3269205 - DNA, 15 bp, Homo sapiens
agaattatgtaatat

SEQ ID NO: 3269206 - DNA, 19 bp, Homo sapiens
agaattatttttaaaaaga

SEQ ID NO: 3269207 - DNA, 18 bp, Homo sapiens
agaattcagaagacccct

SEQ ID NO: 3269208 - DNA, 14 bp, Homo sapiens
agaattcgaaggct

SEQ ID NO: 3269209 - DNA, 15 bp, Homo sapiens
agaattctgattgat

SEQ ID NO: 3269210 - DNA, 18 bp, Homo sapiens
agaattctgattgatttg

SEQ ID NO: 3269211 - DNA, 16 bp, Homo sapiens
agaattgaagaaaatc

SEQ ID NO: 3269212 - DNA, 18 bp, Homo sapiens
agaattgagtaatggtgt

SEQ ID NO: 3269213 - DNA, 20 bp, Homo sapiens
agaattgatatacacggatg

SEQ ID NO: 3269214 - DNA, 23 bp, Homo sapiens
agaattgctgaagggcattcttt

SEQ ID NO: 3269215 - DNA, 15 bp, Homo sapiens
agaattgtatcattt

SEQ ID NO: 3269216 - DNA, 11 bp, Homo sapiens
agaattgttat

SEQ ID NO: 3269217 - DNA, 19 bp, Homo sapiens
agaattgttgcatccctca

SEQ ID NO: 3269218 - DNA, 20 bp, Homo sapiens
agaatttatccctttacaat

SEQ ID NO: 3269219 - DNA, 14 bp, Homo sapiens
agaatttattcaat

SEQ ID NO: 3269220 - DNA, 22 bp, Homo sapiens
agaatttctaaaaagattagca

SEQ ID NO: 3269221 - DNA, 21 bp, Homo sapiens
agaatttctaccatttcagag

SEQ ID NO: 3269222 - DNA, 15 bp, Homo sapiens
agaatttggaaatcc

SEQ ID NO: 3269223 - DNA, 16 bp, Homo sapiens
agaatttggaaatcct

SEQ ID NO: 3269224 - DNA, 13 bp, Homo sapiens
agaattttaaatt

SEQ ID NO: 3269225 - DNA, 15 bp, Homo sapiens
agaattttaaattat

SEQ ID NO: 3269226 - DNA, 16 bp, Homo sapiens
agaattttaagtgctt

SEQ ID NO: 3269227 - DNA, 20 bp, Homo sapiens
agaattttaggaacttcaga

SEQ ID NO: 3269228 - DNA, 12 bp, Homo sapiens
agaattttggaa

SEQ ID NO: 3269229 - DNA, 21 bp, Homo sapiens
agacaaaagctgtaaattact

SEQ ID NO: 3269230 - DNA, 20 bp, Homo sapiens
agacaaaattttagtccaaa

SEQ ID NO: 3269231 - DNA, 19 bp, Homo sapiens
agacaaaccttaaaacagc

SEQ ID NO: 3269232 - DNA, 19 bp, Homo sapiens
agacaaatagaaaatggtc

SEQ ID NO: 3269233 - DNA, 16 bp, Homo sapiens
agacaaatatttggag

SEQ ID NO: 3269234 - DNA, 14 bp, Homo sapiens
agacaaatggagga

SEQ ID NO: 3269235 - DNA, 13 bp, Homo sapiens
agacaacagccca

SEQ ID NO: 3269236 - DNA, 13 bp, Homo sapiens
agacaaccaaaac

SEQ ID NO: 3269237 - DNA, 18 bp, Homo sapiens
agacaacgatgaatttct

SEQ ID NO: 3269238 - DNA, 13 bp, Homo sapiens
agacaagaaatcc

SEQ ID NO: 3269239 - DNA, 15 bp, Homo sapiens
agacaagaagcaaat

SEQ ID NO: 3269240 - DNA, 15 bp, Homo sapiens
agacaagagatggga

SEQ ID NO: 3269241 - DNA, 14 bp, Homo sapiens
agacaagcagccct

SEQ ID NO: 3269242 - DNA, 12 bp, Homo sapiens
agacaagccctg

SEQ ID NO: 3269243 - DNA, 16 bp, Homo sapiens
agacaagccctggcaa

SEQ ID NO: 3269244 - DNA, 17 bp, Homo sapiens
agacaagccctggcaac

SEQ ID NO: 3269245 - DNA, 17 bp, Homo sapiens
agacaagtatgaatatt

SEQ ID NO: 3269246 - DNA, 19 bp, Homo sapiens
agacaagtatgaatattac

SEQ ID NO: 3269247 - DNA, 20 bp, Homo sapiens
agacaatagtatttctcctt

SEQ ID NO: 3269248 - DNA, 11 bp, Homo sapiens
agacaatatac

SEQ ID NO: 3269249 - DNA, 13 bp, Homo sapiens
agacaatatacaa

SEQ ID NO: 3269250 - DNA, 15 bp, Homo sapiens
agacaatcattgttt

SEQ ID NO: 3269251 - DNA, 22 bp, Homo sapiens
agacaatcattgttttgaatat

SEQ ID NO: 3269252 - DNA, 23 bp, Homo sapiens
agacaatcattgttttgaatatt

SEQ ID NO: 3269253 - DNA, 18 bp, Homo sapiens
agacaatttgcacatctt

SEQ ID NO: 3269254 - DNA, 19 bp, Homo sapiens
agacacaactatttttcca

SEQ ID NO: 3269255 - DNA, 20 bp, Homo sapiens
agacacaactatttttccaa

SEQ ID NO: 3269256 - DNA, 13 bp, Homo sapiens
agacacacacaca

SEQ ID NO: 3269257 - DNA, 15 bp, Homo sapiens
agacacacacacgca

SEQ ID NO: 3269258 - DNA, 22 bp, Homo sapiens
agacacacacacgcacgcacac

SEQ ID NO: 3269259 - DNA, 23 bp, Homo sapiens
agacacacacacgcacgcacaca

SEQ ID NO: 3269260 - DNA, 21 bp, Homo sapiens
agacacagactggcaataaac

SEQ ID NO: 3269261 - DNA, 19 bp, Homo sapiens
agacacaggcccggctcca

SEQ ID NO: 3269262 - DNA, 21 bp, Homo sapiens
agacacaggcccggctccagg

SEQ ID NO: 3269263 - DNA, 23 bp, Homo sapiens
agacacaggtgcctcacgcctgt

SEQ ID NO: 3269264 - DNA, 13 bp, Homo sapiens
agacaccaaagtt

SEQ ID NO: 3269265 - DNA, 14 bp, Homo sapiens
agacaccaaagttc

SEQ ID NO: 3269266 - DNA, 15 bp, Homo sapiens
agacaccaaagttct

SEQ ID NO: 3269267 - DNA, 16 bp, Homo sapiens
agacaccaaagttcta

SEQ ID NO: 3269268 - DNA, 17 bp, Homo sapiens
agacaccaaagttctaa

SEQ ID NO: 3269269 - DNA, 15 bp, Homo sapiens
agacaccagagcaga

SEQ ID NO: 3269270 - DNA, 20 bp, Homo sapiens
agacaccagagcagatgcag

SEQ ID NO: 3269271 - DNA, 17 bp, Homo sapiens
agacaccgttcattcag

SEQ ID NO: 3269272 - DNA, 18 bp, Homo sapiens
agacaccttgacagggca

SEQ ID NO: 3269273 - DNA, 21 bp, Homo sapiens
agacacggagcccagccctcc

SEQ ID NO: 3269274 - DNA, 15 bp, Homo sapiens
agacactaagttata

SEQ ID NO: 3269275 - DNA, 16 bp, Homo sapiens
agacactacatatcta

SEQ ID NO: 3269276 - DNA, 22 bp, Homo sapiens
agacactccccgaagtcttttg

SEQ ID NO: 3269277 - DNA, 20 bp, Homo sapiens
agacactcctataaggagag

SEQ ID NO: 3269278 - DNA, 20 bp, Homo sapiens
agacactgccacacagggtc

SEQ ID NO: 3269279 - DNA, 21 bp, Homo sapiens
agacactgccgacatcagcat

SEQ ID NO: 3269280 - DNA, 13 bp, Homo sapiens
agacactggcccc

SEQ ID NO: 3269281 - DNA, 15 bp, Homo sapiens
agacactggcccctc

SEQ ID NO: 3269282 - DNA, 13 bp, Homo sapiens
agacacttcagat

SEQ ID NO: 3269283 - DNA, 15 bp, Homo sapiens
agacagaaactggat

SEQ ID NO: 3269284 - DNA, 19 bp, Homo sapiens
agacagaagcaggctggag

SEQ ID NO: 3269285 - DNA, 20 bp, Homo sapiens
agacagaagcaggctggagg

SEQ ID NO: 3269286 - DNA, 14 bp, Homo sapiens
agacagacacacac

SEQ ID NO: 3269287 - DNA, 16 bp, Homo sapiens
agacagaccacttgcc

SEQ ID NO: 3269288 - DNA, 17 bp, Homo sapiens
agacagagacaagtaat

SEQ ID NO: 3269289 - DNA, 16 bp, Homo sapiens
agacagagacgcagga

SEQ ID NO: 3269290 - DNA, 23 bp, Homo sapiens
agacagagtccctggctcctcta

SEQ ID NO: 3269291 - DNA, 15 bp, Homo sapiens
agacagatgccccag

SEQ ID NO: 3269292 - DNA, 16 bp, Homo sapiens
agacagatgccccaga

SEQ ID NO: 3269293 - DNA, 14 bp, Homo sapiens
agacagcacagggc

SEQ ID NO: 3269294 - DNA, 17 bp, Homo sapiens
agacagcccaggatact

SEQ ID NO: 3269295 - DNA, 22 bp, Homo sapiens
agacagcccaggatactggcac

SEQ ID NO: 3269296 - DNA, 23 bp, Homo sapiens
agacagcccaggatactggcaca

SEQ ID NO: 3269297 - DNA, 15 bp, Homo sapiens
agacagccccagagc

SEQ ID NO: 3269298 - DNA, 18 bp, Homo sapiens
agacagccccagagcagg

SEQ ID NO: 3269299 - DNA, 19 bp, Homo sapiens
agacagccccagagcaggg

SEQ ID NO: 3269300 - DNA, 18 bp, Homo sapiens
agacagcttctctgcagt

SEQ ID NO: 3269301 - DNA, 22 bp, Homo sapiens
agacagcttctctgcagtaaaa

SEQ ID NO: 3269302 - DNA, 15 bp, Homo sapiens
agacaggagcctagc

SEQ ID NO: 3269303 - DNA, 20 bp, Homo sapiens
agacaggcaagcacctcctg

SEQ ID NO: 3269304 - DNA, 22 bp, Homo sapiens
agacaggccatgtgagccaccg

SEQ ID NO: 3269305 - DNA, 18 bp, Homo sapiens
agacaggcccaagagatg

SEQ ID NO: 3269306 - DNA, 22 bp, Homo sapiens
agacaggcccaagagatgaaga

SEQ ID NO: 3269307 - DNA, 23 bp, Homo sapiens
agacagggtttcaccatgttgcc

SEQ ID NO: 3269308 - DNA, 21 bp, Homo sapiens
agacagggttttgccatgttg

SEQ ID NO: 3269309 - DNA, 17 bp, Homo sapiens
agacagtatatttatag

SEQ ID NO: 3269310 - DNA, 19 bp, Homo sapiens
agacagtatttattggtgg

SEQ ID NO: 3269311 - DNA, 13 bp, Homo sapiens
agacagtccagtg

SEQ ID NO: 3269312 - DNA, 14 bp, Homo sapiens
agacagtctggaaa

SEQ ID NO: 3269313 - DNA, 12 bp, Homo sapiens
agacagtgatct

SEQ ID NO: 3269314 - DNA, 15 bp, Homo sapiens
agacagtgatctcca

SEQ ID NO: 3269315 - DNA, 17 bp, Homo sapiens
agacagtgatctccata

SEQ ID NO: 3269316 - DNA, 20 bp, Homo sapiens
agacagtgatctccatatgt

SEQ ID NO: 3269317 - DNA, 13 bp, Homo sapiens
agacagtttctta

SEQ ID NO: 3269318 - DNA, 18 bp, Homo sapiens
agacagtttcttagcttt

SEQ ID NO: 3269319 - DNA, 20 bp, Homo sapiens
agacagtttcttagcttttt

SEQ ID NO: 3269320 - DNA, 22 bp, Homo sapiens
agacagtttcttagctttttaa

SEQ ID NO: 3269321 - DNA, 16 bp, Homo sapiens
agacatacgaaacaca

SEQ ID NO: 3269322 - DNA, 18 bp, Homo sapiens
agacatacgaaacacaaa

SEQ ID NO: 3269323 - DNA, 21 bp, Homo sapiens
actttgagatgtgttcctcct

SEQ ID NO: 3269324 - DNA, 17 bp, Homo sapiens
actttgcactgatatat

SEQ ID NO: 3269325 - DNA, 23 bp, Homo sapiens
actttgcagccggcacagggtct

SEQ ID NO: 3269326 - DNA, 23 bp, Homo sapiens
actttgccagcttttcctccctt

SEQ ID NO: 3269327 - DNA, 17 bp, Homo sapiens
actttggaagtttgtgt

SEQ ID NO: 3269328 - DNA, 21 bp, Homo sapiens
actttggagactggggtggcc

SEQ ID NO: 3269329 - DNA, 22 bp, Homo sapiens
actttggagtcccctcacctcc

SEQ ID NO: 3269330 - DNA, 21 bp, Homo sapiens
actttggcatcttttggagga

SEQ ID NO: 3269331 - DNA, 15 bp, Homo sapiens
actttggcttatgaa

SEQ ID NO: 3269332 - DNA, 19 bp, Homo sapiens
actttgggattctttccat

SEQ ID NO: 3269333 - DNA, 17 bp, Homo sapiens
actttggggctaattta

SEQ ID NO: 3269334 - DNA, 21 bp, Homo sapiens
actttggtactgctgtcttcc

SEQ ID NO: 3269335 - DNA, 23 bp, Homo sapiens
actttggtagctgggaaagcata

SEQ ID NO: 3269336 - DNA, 23 bp, Homo sapiens
actttggtgcgggcacaataaat

SEQ ID NO: 3269337 - DNA, 15 bp, Homo sapiens
actttgtaatttttg

SEQ ID NO: 3269338 - DNA, 22 bp, Homo sapiens
actttgtaccccccaacccctg

SEQ ID NO: 3269339 - DNA, 14 bp, Homo sapiens
actttgtattttga

SEQ ID NO: 3269340 - DNA, 14 bp, Homo sapiens
actttgtctgaaaa

SEQ ID NO: 3269341 - DNA, 15 bp, Homo sapiens
actttgtctgaaaaa

SEQ ID NO: 3269342 - DNA, 12 bp, Homo sapiens
actttgtgagcc

SEQ ID NO: 3269343 - DNA, 17 bp, Homo sapiens
actttgtggatgtcttc

SEQ ID NO: 3269344 - DNA, 16 bp, Homo sapiens
actttgtgttcacctt

SEQ ID NO: 3269345 - DNA, 23 bp, Homo sapiens
actttgttgtttggattcctcac

SEQ ID NO: 3269346 - DNA, 12 bp, Homo sapiens
acttttaaacag

SEQ ID NO: 3269347 - DNA, 15 bp, Homo sapiens
acttttaaacagtga

SEQ ID NO: 3269348 - DNA, 22 bp, Homo sapiens
acttttaaagaaaaatatgata

SEQ ID NO: 3269349 - DNA, 13 bp, Homo sapiens
acttttaaagctc

SEQ ID NO: 3269350 - DNA, 23 bp, Homo sapiens
acttttaaagctcatgcatttca

SEQ ID NO: 3269351 - DNA, 19 bp, Homo sapiens
acttttaaggataaatcat

SEQ ID NO: 3269352 - DNA, 14 bp, Homo sapiens
acttttaaggcagt

SEQ ID NO: 3269353 - DNA, 21 bp, Homo sapiens
acttttaatccctatgtttgt

SEQ ID NO: 3269354 - DNA, 15 bp, Homo sapiens
acttttactctgcct

SEQ ID NO: 3269355 - DNA, 16 bp, Homo sapiens
acttttactctgccta

SEQ ID NO: 3269356 - DNA, 19 bp, Homo sapiens
acttttactctgcctacag

SEQ ID NO: 3269357 - DNA, 22 bp, Homo sapiens
acttttagccagagatgcaata

SEQ ID NO: 3269358 - DNA, 16 bp, Homo sapiens
acttttataaagcatg

SEQ ID NO: 3269359 - DNA, 20 bp, Homo sapiens
acttttatgatgtatattta

SEQ ID NO: 3269360 - DNA, 21 bp, Homo sapiens
acttttcaatcccaattctgt

SEQ ID NO: 3269361 - DNA, 17 bp, Homo sapiens
acttttcccctgtcctg

SEQ ID NO: 3269362 - DNA, 18 bp, Homo sapiens
acttttcccctgttaaac

SEQ ID NO: 3269363 - DNA, 21 bp, Homo sapiens
acttttcccctgttaaacagt

SEQ ID NO: 3269364 - DNA, 21 bp, Homo sapiens
acttttcctgggtttcctgca

SEQ ID NO: 3269365 - DNA, 18 bp, Homo sapiens
acttttctaccatttctg

SEQ ID NO: 3269366 - DNA, 22 bp, Homo sapiens
acttttctgattaatatattta

SEQ ID NO: 3269367 - DNA, 16 bp, Homo sapiens
acttttcttaaacctt

SEQ ID NO: 3269368 - DNA, 14 bp, Homo sapiens
acttttctttgtgg

SEQ ID NO: 3269369 - DNA, 19 bp, Homo sapiens
acttttgcaaaataagtaa

SEQ ID NO: 3269370 - DNA, 13 bp, Homo sapiens
acttttgtacatc

SEQ ID NO: 3269371 - DNA, 20 bp, Homo sapiens
acttttgtacatctggctta

SEQ ID NO: 3269372 - DNA, 22 bp, Homo sapiens
acttttgtgaattaggctgtaa

SEQ ID NO: 3269373 - DNA, 18 bp, Homo sapiens
acttttgttattccatca

SEQ ID NO: 3269374 - DNA, 13 bp, Homo sapiens
acttttgttctgc

SEQ ID NO: 3269375 - DNA, 14 bp, Homo sapiens
acttttgttctgct

SEQ ID NO: 3269376 - DNA, 21 bp, Homo sapiens
acttttgttctgctttatctt

SEQ ID NO: 3269377 - DNA, 18 bp, Homo sapiens
actttttaattcaccaaa

SEQ ID NO: 3269378 - DNA, 10 bp, Homo sapiens
actttttagc

SEQ ID NO: 3269379 - DNA, 18 bp, Homo sapiens
actttttcatttgcctat

SEQ ID NO: 3269380 - DNA, 12 bp, Homo sapiens
actttttccccc

SEQ ID NO: 3269381 - DNA, 12 bp, Homo sapiens
actttttctgat

SEQ ID NO: 3269382 - DNA, 17 bp, Homo sapiens
actttttcttgtattca

SEQ ID NO: 3269383 - DNA, 14 bp, Homo sapiens
actttttggtggat

SEQ ID NO: 3269384 - DNA, 19 bp, Homo sapiens
actttttggtggatgtaaa

SEQ ID NO: 3269385 - DNA, 17 bp, Homo sapiens
acttttttaaataaact

SEQ ID NO: 3269386 - DNA, 21 bp, Homo sapiens
acttttttaaataaacttttt

SEQ ID NO: 3269387 - DNA, 18 bp, Homo sapiens
acttttttaaatattttc

SEQ ID NO: 3269388 - DNA, 19 bp, Homo sapiens
acttttttaaatattttct

SEQ ID NO: 3269389 - DNA, 15 bp, Homo sapiens
acttttttacactga

SEQ ID NO: 3269390 - DNA, 20 bp, Homo sapiens
acttttttatgaagaaaaag

SEQ ID NO: 3269391 - DNA, 22 bp, Homo sapiens
acttttttatgaagaaaaagta

SEQ ID NO: 3269392 - DNA, 20 bp, Homo sapiens
acttttttgagtcattgact

SEQ ID NO: 3269393 - DNA, 17 bp, Homo sapiens
acttttttgtgtatgta

SEQ ID NO: 3269394 - DNA, 19 bp, Homo sapiens
acttttttgtgtatgtact

SEQ ID NO: 3269395 - DNA, 12 bp, Homo sapiens
actttttttagt

SEQ ID NO: 3269396 - DNA, 23 bp, Homo sapiens
actttttttctgtaccagttaat

SEQ ID NO: 3269397 - DNA, 20 bp, Homo sapiens
agaaaaaaaaaaacttacac

SEQ ID NO: 3269398 - DNA, 22 bp, Homo sapiens
agaaaaaaaaaagaaatgcaaa

SEQ ID NO: 3269399 - DNA, 19 bp, Homo sapiens
agaaaaaaaataacacaga

SEQ ID NO: 3269400 - DNA, 15 bp, Homo sapiens
agaaaaaaattgctc

SEQ ID NO: 3269401 - DNA, 13 bp, Homo sapiens
agaaaaaatcaga

SEQ ID NO: 3269402 - DNA, 16 bp, Homo sapiens
agaaaaaccaatgatt

SEQ ID NO: 3269403 - DNA, 14 bp, Homo sapiens
agaaaaagtacaat

SEQ ID NO: 3269404 - DNA, 12 bp, Homo sapiens
agaaaaatcttg

SEQ ID NO: 3269405 - DNA, 21 bp, Homo sapiens
agaaaaatcttgtgctagaat

SEQ ID NO: 3269406 - DNA, 13 bp, Homo sapiens
agaaaaatgttct

SEQ ID NO: 3269407 - DNA, 20 bp, Homo sapiens
agaaaaattcagcaaaccat

SEQ ID NO: 3269408 - DNA, 12 bp, Homo sapiens
agaaaacaaaaa

SEQ ID NO: 3269409 - DNA, 13 bp, Homo sapiens
agaaaacaaaatt

SEQ ID NO: 3269410 - DNA, 14 bp, Homo sapiens
agaaaacttctttt

SEQ ID NO: 3269411 - DNA, 16 bp, Homo sapiens
agaaaagaaaaccatt

SEQ ID NO: 3269412 - DNA, 20 bp, Homo sapiens
agaaaagaacgtattttaaa

SEQ ID NO: 3269413 - DNA, 16 bp, Homo sapiens
agaaaagaccctgaga

SEQ ID NO: 3269414 - DNA, 18 bp, Homo sapiens
agaaaagaccctgagact

SEQ ID NO: 3269415 - DNA, 13 bp, Homo sapiens
agaaaagagaaac

SEQ ID NO: 3269416 - DNA, 15 bp, Homo sapiens
agaaaagataaagat

SEQ ID NO: 3269417 - DNA, 16 bp, Homo sapiens
agaaaagataaagatg

SEQ ID NO: 3269418 - DNA, 12 bp, Homo sapiens
agaaaagatttt

SEQ ID NO: 3269419 - DNA, 15 bp, Homo sapiens
agaaaagattttaat

SEQ ID NO: 3269420 - DNA, 18 bp, Homo sapiens
agaaaagattttaatcaa

SEQ ID NO: 3269421 - DNA, 20 bp, Homo sapiens
agaaaagattttaatcaagt

SEQ ID NO: 3269422 - DNA, 17 bp, Homo sapiens
agaaaagcaatactgtt

SEQ ID NO: 3269423 - DNA, 11 bp, Homo sapiens
agaaaagcact

SEQ ID NO: 3269424 - DNA, 21 bp, Homo sapiens
agaaaagcagtcccattcata

SEQ ID NO: 3269425 - DNA, 13 bp, Homo sapiens
agaaaagcatttt

SEQ ID NO: 3269426 - DNA, 15 bp, Homo sapiens
agaaaagcattttca

SEQ ID NO: 3269427 - DNA, 17 bp, Homo sapiens
agaaaagcattttcagt

SEQ ID NO: 3269428 - DNA, 23 bp, Homo sapiens
agaaaagcattttcagtcttgta

SEQ ID NO: 3269429 - DNA, 21 bp, Homo sapiens
agaaaaggctggagagagatt

SEQ ID NO: 3269430 - DNA, 22 bp, Homo sapiens
agaaaaggttatgttcattttt

SEQ ID NO: 3269431 - DNA, 14 bp, Homo sapiens
agaaaagtagacaa

SEQ ID NO: 3269432 - DNA, 19 bp, Homo sapiens
agaaaagtagacaatcatt

SEQ ID NO: 3269433 - DNA, 21 bp, Homo sapiens
agaaaagtgcatatttatcca

SEQ ID NO: 3269434 - DNA, 20 bp, Homo sapiens
agaaaagttgcagatgtatt

SEQ ID NO: 3269435 - DNA, 11 bp, Homo sapiens
agaaaatcttt

SEQ ID NO: 3269436 - DNA, 15 bp, Homo sapiens
agaaaatctttataa

SEQ ID NO: 3269437 - DNA, 12 bp, Homo sapiens
agaaaatctttg

SEQ ID NO: 3269438 - DNA, 16 bp, Homo sapiens
agaaaatgaaaaacaa

SEQ ID NO: 3269439 - DNA, 16 bp, Homo sapiens
agaaaatgaactgccc

SEQ ID NO: 3269440 - DNA, 21 bp, Homo sapiens
agaaaatgcctcaattcacat

SEQ ID NO: 3269441 - DNA, 19 bp, Homo sapiens
agaaaatgcttgacaaata

SEQ ID NO: 3269442 - DNA, 22 bp, Homo sapiens
agaaaatggctaataaactgta

SEQ ID NO: 3269443 - DNA, 20 bp, Homo sapiens
agaaaatgtaaaggagggag

SEQ ID NO: 3269444 - DNA, 13 bp, Homo sapiens
agaaaatgttatt

SEQ ID NO: 3269445 - DNA, 17 bp, Homo sapiens
agaaaatgttgagaatc

SEQ ID NO: 3269446 - DNA, 18 bp, Homo sapiens
agaaaattaaacacaaag

SEQ ID NO: 3269447 - DNA, 12 bp, Homo sapiens
agaaaattcaat

SEQ ID NO: 3269448 - DNA, 18 bp, Homo sapiens
agaaaattcaattgtaaa

SEQ ID NO: 3269449 - DNA, 15 bp, Homo sapiens
agaaaatttagccct

SEQ ID NO: 3269450 - DNA, 23 bp, Homo sapiens
agaaaatttagccctttaaaacg

SEQ ID NO: 3269451 - DNA, 15 bp, Homo sapiens
agaaaatttgcttta

SEQ ID NO: 3269452 - DNA, 18 bp, Homo sapiens
agaaaatttgctttaatt

SEQ ID NO: 3269453 - DNA, 13 bp, Homo sapiens
agaaacaaagatg

SEQ ID NO: 3269454 - DNA, 17 bp, Homo sapiens
agaaacaaagatgttat

SEQ ID NO: 3269455 - DNA, 14 bp, Homo sapiens
agaaacaagctgtg

SEQ ID NO: 3269456 - DNA, 15 bp, Homo sapiens
agaaacaagctgtgc

SEQ ID NO: 3269457 - DNA, 16 bp, Homo sapiens
agaaacaagctgtgca

SEQ ID NO: 3269458 - DNA, 14 bp, Homo sapiens
agaaacaataaaga

SEQ ID NO: 3269459 - DNA, 16 bp, Homo sapiens
agaaacaataaagaga

SEQ ID NO: 3269460 - DNA, 22 bp, Homo sapiens
agaaacacagggttttgtattc

SEQ ID NO: 3269461 - DNA, 20 bp, Homo sapiens
agaaacacatcaaataaact

SEQ ID NO: 3269462 - DNA, 16 bp, Homo sapiens
agaaacacattcttat

SEQ ID NO: 3269463 - DNA, 11 bp, Homo sapiens
agaaacactga

SEQ ID NO: 3269464 - DNA, 16 bp, Homo sapiens
agaaacactgaaaaga

SEQ ID NO: 3269465 - DNA, 15 bp, Homo sapiens
agaaacagagacagg

SEQ ID NO: 3269466 - DNA, 23 bp, Homo sapiens
agaaacagagtggcctccctgct

SEQ ID NO: 3269467 - DNA, 15 bp, Homo sapiens
agaaacagataccat

SEQ ID NO: 3269468 - DNA, 15 bp, Homo sapiens
agaaacagccagcaa

SEQ ID NO: 3269469 - DNA, 14 bp, Homo sapiens
agaaacagccattg

SEQ ID NO: 3269470 - DNA, 11 bp, Homo sapiens
agaaacagctt

SEQ ID NO: 3269471 - DNA, 18 bp, Homo sapiens
agaaacagtgggagccct

SEQ ID NO: 3269472 - DNA, 21 bp, Homo sapiens
agaaacagtgggagccctgac

SEQ ID NO: 3269473 - DNA, 12 bp, Homo sapiens
agaaacagtgtg

SEQ ID NO: 3269474 - DNA, 14 bp, Homo sapiens
agaaacagtgtgca

SEQ ID NO: 3269475 - DNA, 22 bp, Homo sapiens
agaaacagttggtaacttttgt

SEQ ID NO: 3269476 - DNA, 18 bp, Homo sapiens
agaaacatgaaatgcttc

SEQ ID NO: 3269477 - DNA, 14 bp, Homo sapiens
agaaacatgacact

SEQ ID NO: 3269478 - DNA, 18 bp, Homo sapiens
agaaacatgacactgacc

SEQ ID NO: 3269479 - DNA, 14 bp, Homo sapiens
agaaacatggtttt

SEQ ID NO: 3269480 - DNA, 15 bp, Homo sapiens
agaaacatttagatt

SEQ ID NO: 3269481 - DNA, 16 bp, Homo sapiens
agaaacccaagctcct

SEQ ID NO: 3269482 - DNA, 17 bp, Homo sapiens
agaaacccaagctcctc

SEQ ID NO: 3269483 - DNA, 18 bp, Homo sapiens
agaaacccaagctcctcc

SEQ ID NO: 3269484 - DNA, 20 bp, Homo sapiens
agaaacccaagctcctcctc

SEQ ID NO: 3269485 - DNA, 12 bp, Homo sapiens
agaaacctcatt

SEQ ID NO: 3269486 - DNA, 21 bp, Homo sapiens
agaaacctggggtgaatactt

SEQ ID NO: 3269487 - DNA, 16 bp, Homo sapiens
agaaacgtcttctaaa

SEQ ID NO: 3269488 - DNA, 17 bp, Homo sapiens
agaaacgtgtcacactt

SEQ ID NO: 3269489 - DNA, 20 bp, Homo sapiens
agaaactaaaaatatagcaa

SEQ ID NO: 3269490 - DNA, 14 bp, Homo sapiens
agaaactatttctg

SEQ ID NO: 3269491 - DNA, 22 bp, Homo sapiens
agaaactatttttgtgtttgaa

SEQ ID NO: 3269492 - DNA, 16 bp, Homo sapiens
agaaactccaaagtcc

SEQ ID NO: 3269493 - DNA, 13 bp, Homo sapiens
agaaactcccctg

SEQ ID NO: 3269494 - DNA, 19 bp, Homo sapiens
agaaactccgaagaaaaga

SEQ ID NO: 3269495 - DNA, 18 bp, Homo sapiens
agaaactgaggaattttc

SEQ ID NO: 3269496 - DNA, 18 bp, Homo sapiens
agaaactgatgccaaggg

SEQ ID NO: 3269497 - DNA, 17 bp, Homo sapiens
agaaacttagaggaaaa

SEQ ID NO: 3269498 - DNA, 12 bp, Homo sapiens
agaaacttttgt

SEQ ID NO: 3269499 - DNA, 15 bp, Homo sapiens
agaaacttttgtaaa

SEQ ID NO: 3269500 - DNA, 16 bp, Homo sapiens
agaaacttttgtaaag

SEQ ID NO: 3269501 - DNA, 17 bp, Homo sapiens
agaaacttttgtaaaga

SEQ ID NO: 3269502 - DNA, 19 bp, Homo sapiens
agaaagaaaagaccctgag

SEQ ID NO: 3269503 - DNA, 12 bp, Homo sapiens
agaaagacttgg

SEQ ID NO: 3269504 - DNA, 22 bp, Homo sapiens
agaaagacttggttggtagggt

SEQ ID NO: 3269505 - DNA, 17 bp, Homo sapiens
agaaagagctgcctgga

SEQ ID NO: 3269506 - DNA, 19 bp, Homo sapiens
agaaagagctgcctggatg

SEQ ID NO: 3269507 - DNA, 20 bp, Homo sapiens
agaaagagctgcctggatga

SEQ ID NO: 3269508 - DNA, 14 bp, Homo sapiens
agaaagcaacttat

SEQ ID NO: 3269509 - DNA, 21 bp, Homo sapiens
agaaagcaagtgtttttgtat

SEQ ID NO: 3269510 - DNA, 15 bp, Homo sapiens
agaaagccaggcagg

SEQ ID NO: 3269511 - DNA, 20 bp, Homo sapiens
agaaagcctgttcccctcac

SEQ ID NO: 3269512 - DNA, 20 bp, Homo sapiens
agaaagctggtaaactattt

SEQ ID NO: 3269513 - DNA, 16 bp, Homo sapiens
agaaaggaaaacctga

SEQ ID NO: 3269514 - DNA, 14 bp, Homo sapiens
agaaaggaacattt

SEQ ID NO: 3269515 - DNA, 11 bp, Homo sapiens
agaaaggagac

SEQ ID NO: 3269516 - DNA, 23 bp, Homo sapiens
agaaaggaggggatagagagaga

SEQ ID NO: 3269517 - DNA, 16 bp, Homo sapiens
agaaaggatatttaag

SEQ ID NO: 3269518 - DNA, 18 bp, Homo sapiens
agaaaggatatttaagaa

SEQ ID NO: 3269519 - DNA, 18 bp, Homo sapiens
agaaaggctctgaaggtc

SEQ ID NO: 3269520 - DNA, 20 bp, Homo sapiens
agaaaggttgcgtttaatat

SEQ ID NO: 3269521 - DNA, 21 bp, Homo sapiens
agaaagtagaggcatgatgat

SEQ ID NO: 3269522 - DNA, 22 bp, Homo sapiens
agaaagtgggaggtcaggaaac

SEQ ID NO: 3269523 - DNA, 18 bp, Homo sapiens
agaaataaatagctatat

SEQ ID NO: 3269524 - DNA, 19 bp, Homo sapiens
agaaataaatagctatatc

SEQ ID NO: 3269525 - DNA, 22 bp, Homo sapiens
agaaataaatagctatatccat

SEQ ID NO: 3269526 - DNA, 14 bp, Homo sapiens
agaaataaatatac

SEQ ID NO: 3269527 - DNA, 22 bp, Homo sapiens
agaaataaatcagagagcaagg

SEQ ID NO: 3269528 - DNA, 17 bp, Homo sapiens
agaaataagtggttatt

SEQ ID NO: 3269529 - DNA, 21 bp, Homo sapiens
agaaataagtggttatttctc

SEQ ID NO: 3269530 - DNA, 14 bp, Homo sapiens
agaaataatatgca

SEQ ID NO: 3269531 - DNA, 15 bp, Homo sapiens
agaaatactttcgaa

SEQ ID NO: 3269532 - DNA, 18 bp, Homo sapiens
agaaatagacaaaaagta

SEQ ID NO: 3269533 - DNA, 22 bp, Homo sapiens
agaaatagacaaaaagtatatt

SEQ ID NO: 3269534 - DNA, 18 bp, Homo sapiens
agaaatataataaaatgt

SEQ ID NO: 3269535 - DNA, 15 bp, Homo sapiens
agaaatatatataca

SEQ ID NO: 3269536 - DNA, 17 bp, Homo sapiens
agaaatatatatacata

SEQ ID NO: 3269537 - DNA, 19 bp, Homo sapiens
agaaatatctgaaaatgta

SEQ ID NO: 3269538 - DNA, 20 bp, Homo sapiens
agaaatatctgaaaatgtat

SEQ ID NO: 3269539 - DNA, 22 bp, Homo sapiens
agaaatatgattttatttgaca

SEQ ID NO: 3269540 - DNA, 20 bp, Homo sapiens
agaaatatggaacttacatt

SEQ ID NO: 3269541 - DNA, 14 bp, Homo sapiens
agaaatatgtggtt

SEQ ID NO: 3269542 - DNA, 17 bp, Homo sapiens
agaaatcaaagagagaa

SEQ ID NO: 3269543 - DNA, 19 bp, Homo sapiens
agaaatcaatagttgaatt

SEQ ID NO: 3269544 - DNA, 22 bp, Homo sapiens
agaaatcacaggggcggggcag

SEQ ID NO: 3269545 - DNA, 14 bp, Homo sapiens
agaaatcagaggag

SEQ ID NO: 3269546 - DNA, 16 bp, Homo sapiens
agaaatccatatctta

SEQ ID NO: 3269547 - DNA, 21 bp, Homo sapiens
agaaatccatatcttaaagaa

SEQ ID NO: 3269548 - DNA, 19 bp, Homo sapiens
agaaatccctgtttaatat

SEQ ID NO: 3269549 - DNA, 14 bp, Homo sapiens
agaaatctttccag

SEQ ID NO: 3269550 - DNA, 14 bp, Homo sapiens
agaaatgaaatagc

SEQ ID NO: 3269551 - DNA, 13 bp, Homo sapiens
agaaatgaacatt

SEQ ID NO: 3269552 - DNA, 17 bp, Homo sapiens
agaaatgactaattagg

SEQ ID NO: 3269553 - DNA, 16 bp, Homo sapiens
agaaatggaaagcaga

SEQ ID NO: 3269554 - DNA, 16 bp, Homo sapiens
agaaatgtaaactgcc

SEQ ID NO: 3269555 - DNA, 17 bp, Homo sapiens
agaaatgtaaactgcca

SEQ ID NO: 3269556 - DNA, 12 bp, Homo sapiens
agaaatgtattc

SEQ ID NO: 3269557 - DNA, 19 bp, Homo sapiens
agaaatgtattcctgaaaa

SEQ ID NO: 3269558 - DNA, 21 bp, Homo sapiens
agaaatgtattcctgaaaagc

SEQ ID NO: 3269559 - DNA, 22 bp, Homo sapiens
agaaatgtattcctgaaaagct

SEQ ID NO: 3269560 - DNA, 21 bp, Homo sapiens
agaaatgtgtagctgcaaaaa

SEQ ID NO: 3269561 - DNA, 16 bp, Homo sapiens
agaaatgttgttcatt

SEQ ID NO: 3269562 - DNA, 21 bp, Homo sapiens
agaaattagaaaaaaattact

SEQ ID NO: 3269563 - DNA, 15 bp, Homo sapiens
agaaattagccgggc

SEQ ID NO: 3269564 - DNA, 15 bp, Homo sapiens
agaaattagctgtgt

SEQ ID NO: 3269565 - DNA, 14 bp, Homo sapiens
agaaattatttaat

SEQ ID NO: 3269566 - DNA, 22 bp, Homo sapiens
agaaattcaatttggatttaaa

SEQ ID NO: 3269567 - DNA, 23 bp, Homo sapiens
agaaattcgtgtgtttttttatg

SEQ ID NO: 3269568 - DNA, 11 bp, Homo sapiens
agaaattctgt

SEQ ID NO: 3269569 - DNA, 13 bp, Homo sapiens
agaaattctgtta

SEQ ID NO: 3269570 - DNA, 14 bp, Homo sapiens
agaaattctgttaa

SEQ ID NO: 3269571 - DNA, 20 bp, Homo sapiens
agaaattctgttaaaatcta

SEQ ID NO: 3269572 - DNA, 21 bp, Homo sapiens
agaaattctgttaaaatctat

SEQ ID NO: 3269573 - DNA, 12 bp, Homo sapiens
agaaatttaaca

SEQ ID NO: 3269574 - DNA, 17 bp, Homo sapiens
agaaatttctgtgaaac

SEQ ID NO: 3269575 - DNA, 22 bp, Homo sapiens
agaaattttacaataggtgctt

SEQ ID NO: 3269576 - DNA, 13 bp, Homo sapiens
agaaattttcaag

SEQ ID NO: 3269577 - DNA, 17 bp, Homo sapiens
agaaatttttatcagtt

SEQ ID NO: 3269578 - DNA, 22 bp, Homo sapiens
agaaatttttcagatgcttctg

SEQ ID NO: 3269579 - DNA, 23 bp, Homo sapiens
agaaatttttcagatgcttctgg

SEQ ID NO: 3269580 - DNA, 13 bp, Homo sapiens
agaacaaaaaacc

SEQ ID NO: 3269581 - DNA, 18 bp, Homo sapiens
agaacaaacaaaacttaa

SEQ ID NO: 3269582 - DNA, 20 bp, Homo sapiens
agaacaaacacctccccagc

SEQ ID NO: 3269583 - DNA, 21 bp, Homo sapiens
agaacaaagctgttaaactgt

SEQ ID NO: 3269584 - DNA, 22 bp, Homo sapiens
agaacaaagctgttaaactgtt

SEQ ID NO: 3269585 - DNA, 22 bp, Homo sapiens
agaacaaaggacagagtatgaa

SEQ ID NO: 3269586 - DNA, 20 bp, Homo sapiens
agaacaagagtttgttctgt

SEQ ID NO: 3269587 - DNA, 19 bp, Homo sapiens
agaacaagtcacagctgca

SEQ ID NO: 3269588 - DNA, 21 bp, Homo sapiens
agaacaagtcacagctgcagc

SEQ ID NO: 3269589 - DNA, 18 bp, Homo sapiens
agaacaagtgcctcctgg

SEQ ID NO: 3269590 - DNA, 12 bp, Homo sapiens
agaacacacaga

SEQ ID NO: 3269591 - DNA, 18 bp, Homo sapiens
agaacacacagactttct

SEQ ID NO: 3269592 - DNA, 20 bp, Homo sapiens
agaacacacagactttctgt

SEQ ID NO: 3269593 - DNA, 20 bp, Homo sapiens
agaacacagcaattcctcag

SEQ ID NO: 3269594 - DNA, 11 bp, Homo sapiens
agaacactaat

SEQ ID NO: 3269595 - DNA, 19 bp, Homo sapiens
agaacactaattcataatc

SEQ ID NO: 3269596 - DNA, 21 bp, Homo sapiens
agaacactattttcagaatct

SEQ ID NO: 3269597 - DNA, 19 bp, Homo sapiens
agaacagataatcagtgtg

SEQ ID NO: 3269598 - DNA, 13 bp, Homo sapiens
agaacagcagagg

SEQ ID NO: 3269599 - DNA, 18 bp, Homo sapiens
agaacagcttcaggttat

SEQ ID NO: 3269600 - DNA, 19 bp, Homo sapiens
agaacaggaggtgtgaatg

SEQ ID NO: 3269601 - DNA, 23 bp, Homo sapiens
agaacaggaggtgtgaatgcacg

SEQ ID NO: 3269602 - DNA, 20 bp, Homo sapiens
agaacaggcttggcaaagaa

SEQ ID NO: 3269603 - DNA, 20 bp, Homo sapiens
agaacagggaaaataggcag

SEQ ID NO: 3269604 - DNA, 21 bp, Homo sapiens
agaacagggtcatgtttgcag

SEQ ID NO: 3269605 - DNA, 23 bp, Homo sapiens
agaacaggttcttaaaaaggaac

SEQ ID NO: 3269606 - DNA, 18 bp, Homo sapiens
agaacagtggaaactatg

SEQ ID NO: 3269607 - DNA, 19 bp, Homo sapiens
agaacagtggttgcctggg

SEQ ID NO: 3269608 - DNA, 20 bp, Homo sapiens
agaacagtggttgcctgggg

SEQ ID NO: 3269609 - DNA, 15 bp, Homo sapiens
agaacatcattagaa

SEQ ID NO: 3269610 - DNA, 16 bp, Homo sapiens
agaacatcattagaac

SEQ ID NO: 3269611 - DNA, 21 bp, Homo sapiens
agaacatccctgtcttaactg

SEQ ID NO: 3269612 - DNA, 19 bp, Homo sapiens
agaacattcagctctggag

SEQ ID NO: 3269613 - DNA, 20 bp, Homo sapiens
agaaccacacttgaaacctt

SEQ ID NO: 3269614 - DNA, 19 bp, Homo sapiens
agaaccaccactgcctgac

SEQ ID NO: 3269615 - DNA, 13 bp, Homo sapiens
agaaccactatga

SEQ ID NO: 3269616 - DNA, 15 bp, Homo sapiens
agaaccacttcctgc

SEQ ID NO: 3269617 - DNA, 21 bp, Homo sapiens
agaaccagccgtattttacat

SEQ ID NO: 3269618 - DNA, 18 bp, Homo sapiens
agaaccagtttcaggtgt

SEQ ID NO: 3269619 - DNA, 18 bp, Homo sapiens
agaaccatgcaggaagga

SEQ ID NO: 3269620 - DNA, 14 bp, Homo sapiens
agaaccatttgcaa

SEQ ID NO: 3269621 - DNA, 14 bp, Homo sapiens
agaacccagggctc

SEQ ID NO: 3269622 - DNA, 20 bp, Homo sapiens
agaacccagggctctgcccc

SEQ ID NO: 3269623 - DNA, 17 bp, Homo sapiens
agaacccctacatgaaa

SEQ ID NO: 3269624 - DNA, 16 bp, Homo sapiens
agaaccgagcaaagat

SEQ ID NO: 3269625 - DNA, 21 bp, Homo sapiens
agaaccgagcaaagatcaaaa

SEQ ID NO: 3269626 - DNA, 22 bp, Homo sapiens
agaacctactgttcctttcaga

SEQ ID NO: 3269627 - DNA, 19 bp, Homo sapiens
agaacctcaggcttccttg

SEQ ID NO: 3269628 - DNA, 21 bp, Homo sapiens
agaacctcaggtacggagaag

SEQ ID NO: 3269629 - DNA, 23 bp, Homo sapiens
agaacctgggctgtgctgctttt

SEQ ID NO: 3269630 - DNA, 20 bp, Homo sapiens
agaaccttaatgacaacact

SEQ ID NO: 3269631 - DNA, 22 bp, Homo sapiens
agaaccttctagaacctgggct

SEQ ID NO: 3269632 - DNA, 18 bp, Homo sapiens
agaacgccagtctcccag

SEQ ID NO: 3269633 - DNA, 20 bp, Homo sapiens
agaacgccagtctcccaggc

SEQ ID NO: 3269634 - DNA, 20 bp, Homo sapiens
agaacgtattttaaaagcca

SEQ ID NO: 3269635 - DNA, 20 bp, Homo sapiens
agaacgttttttcctcagtg

SEQ ID NO: 3269636 - DNA, 16 bp, Homo sapiens
agaactaaatgttcta

SEQ ID NO: 3269637 - DNA, 21 bp, Homo sapiens
agaactaatgataatcccacc

SEQ ID NO: 3269638 - DNA, 23 bp, Homo sapiens
agaactaatgataatcccaccac

SEQ ID NO: 3269639 - DNA, 15 bp, Homo sapiens
agaactatgaaatca

SEQ ID NO: 3269640 - DNA, 16 bp, Homo sapiens
agaactcactggggcc

SEQ ID NO: 3269641 - DNA, 19 bp, Homo sapiens
agaactcactggggcctac

SEQ ID NO: 3269642 - DNA, 15 bp, Homo sapiens
agaactccaggccct

SEQ ID NO: 3269643 - DNA, 14 bp, Homo sapiens
agaactccctttca

SEQ ID NO: 3269644 - DNA, 16 bp, Homo sapiens
agaactccctttcaac

SEQ ID NO: 3269645 - DNA, 13 bp, Homo sapiens
agaactcctgact

SEQ ID NO: 3269646 - DNA, 21 bp, Homo sapiens
agaactctctggaagcccctg

SEQ ID NO: 3269647 - DNA, 15 bp, Homo sapiens
agaactgactttctc

SEQ ID NO: 3269648 - DNA, 12 bp, Homo sapiens
agaactgcaggc

SEQ ID NO: 3269649 - DNA, 17 bp, Homo sapiens
agaactgccattatttt

SEQ ID NO: 3269650 - DNA, 20 bp, Homo sapiens
agaactgtgtttcaagttca

SEQ ID NO: 3269651 - DNA, 21 bp, Homo sapiens
agaactgtgtttcaagttcaa

SEQ ID NO: 3269652 - DNA, 22 bp, Homo sapiens
agaactgttgcctaattggaaa

SEQ ID NO: 3269653 - DNA, 20 bp, Homo sapiens
agaacttaaattatgtttta

SEQ ID NO: 3269654 - DNA, 21 bp, Homo sapiens
agaacttactgattattttct

SEQ ID NO: 3269655 - DNA, 15 bp, Homo sapiens
agaacttcagaaaga

SEQ ID NO: 3269656 - DNA, 13 bp, Homo sapiens
agaacttccctga

SEQ ID NO: 3269657 - DNA, 23 bp, Homo sapiens
agaacttccctgattgacctgct

SEQ ID NO: 3269658 - DNA, 16 bp, Homo sapiens
agaacttgatttgcat

SEQ ID NO: 3269659 - DNA, 13 bp, Homo sapiens
agaacttttttaa

SEQ ID NO: 3269660 - DNA, 20 bp, Homo sapiens
agaacttttttaaataaact

SEQ ID NO: 3269661 - DNA, 22 bp, Homo sapiens
agaacttttttaaataaacttt

SEQ ID NO: 3269662 - DNA, 11 bp, Homo sapiens
agaagaaaagc

SEQ ID NO: 3269663 - DNA, 12 bp, Homo sapiens
agaagaaaattc

SEQ ID NO: 3269664 - DNA, 13 bp, Homo sapiens
agaagaaagcaaa

SEQ ID NO: 3269665 - DNA, 22 bp, Homo sapiens
agaagaaagcaaaagcaaggga

SEQ ID NO: 3269666 - DNA, 13 bp, Homo sapiens
agaagaaattagg

SEQ ID NO: 3269667 - DNA, 15 bp, Homo sapiens
agaagaagaagaagg

SEQ ID NO: 3269668 - DNA, 13 bp, Homo sapiens
agaagaatgaaaa

SEQ ID NO: 3269669 - DNA, 13 bp, Homo sapiens
agaagacaaaaag

SEQ ID NO: 3269670 - DNA, 15 bp, Homo sapiens
agaagacaaactgct

SEQ ID NO: 3269671 - DNA, 23 bp, Homo sapiens
agaagacacaaggtgatttcaga

SEQ ID NO: 3269672 - DNA, 16 bp, Homo sapiens
agaagacaccagagca

SEQ ID NO: 3269673 - DNA, 23 bp, Homo sapiens
agaagacaccagagcagatgcag

SEQ ID NO: 3269674 - DNA, 13 bp, Homo sapiens
agaagacactgca

SEQ ID NO: 3269675 - DNA, 14 bp, Homo sapiens
agaagacactgcag

SEQ ID NO: 3269676 - DNA, 16 bp, Homo sapiens
agaagacatgaaccaa

SEQ ID NO: 3269677 - DNA, 20 bp, Homo sapiens
agaagacatggagactcctg

SEQ ID NO: 3269678 - DNA, 15 bp, Homo sapiens
agaagactttaatta

SEQ ID NO: 3269679 - DNA, 19 bp, Homo sapiens
agaagactttaattatata

SEQ ID NO: 3269680 - DNA, 18 bp, Homo sapiens
agaagagactctttgcat

SEQ ID NO: 3269681 - DNA, 19 bp, Homo sapiens
agaagagagccagtaactt

SEQ ID NO: 3269682 - DNA, 16 bp, Homo sapiens
agaagagaggagagga

SEQ ID NO: 3269683 - DNA, 20 bp, Homo sapiens
agaagagatgggcttgtttt

SEQ ID NO: 3269684 - DNA, 20 bp, Homo sapiens
agaagaggcatcctgcctgg

SEQ ID NO: 3269685 - DNA, 21 bp, Homo sapiens
agaagaggcatcctgcctggg

SEQ ID NO: 3269686 - DNA, 18 bp, Homo sapiens
agaagagggcccagccca

SEQ ID NO: 3269687 - DNA, 16 bp, Homo sapiens
agaagagggcctgtgg

SEQ ID NO: 3269688 - DNA, 18 bp, Homo sapiens
agaagagggcctgtggga

SEQ ID NO: 3269689 - DNA, 16 bp, Homo sapiens
agaagagtggtgagat

SEQ ID NO: 3269690 - DNA, 22 bp, Homo sapiens
agaagagttgaggaactgtaca

SEQ ID NO: 3269691 - DNA, 23 bp, Homo sapiens
agaagagttttagagaaaataaa

SEQ ID NO: 3269692 - DNA, 13 bp, Homo sapiens
agaagataattgt

SEQ ID NO: 3269693 - DNA, 17 bp, Homo sapiens
agaagatagtcttggaa

SEQ ID NO: 3269694 - DNA, 20 bp, Homo sapiens
agaagatcaacgcctcactg

SEQ ID NO: 3269695 - DNA, 19 bp, Homo sapiens
agaagatcacgctccccgc

SEQ ID NO: 3269696 - DNA, 16 bp, Homo sapiens
agaagatggactctga

SEQ ID NO: 3269697 - DNA, 22 bp, Homo sapiens
agaagcaagacacgtggcctcg

SEQ ID NO: 3269698 - DNA, 21 bp, Homo sapiens
agaagcagcttcttttgtctc

SEQ ID NO: 3269699 - DNA, 15 bp, Homo sapiens
agaagcagggtaccc

SEQ ID NO: 3269700 - DNA, 19 bp, Homo sapiens
agaagcatcctccacatcc

SEQ ID NO: 3269701 - DNA, 13 bp, Homo sapiens
agaagcatgaaaa

SEQ ID NO: 3269702 - DNA, 14 bp, Homo sapiens
agaagcattccttc

SEQ ID NO: 3269703 - DNA, 19 bp, Homo sapiens
agaagcattccttctttga

SEQ ID NO: 3269704 - DNA, 22 bp, Homo sapiens
agaagcattccttctttgataa

SEQ ID NO: 3269705 - DNA, 24 bp, Homo sapiens
agaagcattccttctttgataatg

SEQ ID NO: 3269706 - DNA, 23 bp, Homo sapiens
agaagccaactatgattattaac

SEQ ID NO: 3269707 - DNA, 21 bp, Homo sapiens
agaagccaagggaaaggggtg

SEQ ID NO: 3269708 - DNA, 20 bp, Homo sapiens
agaagccacgctgtcctctc

SEQ ID NO: 3269709 - DNA, 10 bp, Homo sapiens
agaagccagc

SEQ ID NO: 3269710 - DNA, 21 bp, Homo sapiens
agaagcctccaagcctgcctc

SEQ ID NO: 3269711 - DNA, 17 bp, Homo sapiens
agaagcctgaggctggg

SEQ ID NO: 3269712 - DNA, 21 bp, Homo sapiens
agaagcctgcataatgtttct

SEQ ID NO: 3269713 - DNA, 20 bp, Homo sapiens
agaagcctggactctgcccc

SEQ ID NO: 3269714 - DNA, 14 bp, Homo sapiens
agaagcctgtttca

SEQ ID NO: 3269715 - DNA, 20 bp, Homo sapiens
agaagccttaatttgcacag

SEQ ID NO: 3269716 - DNA, 13 bp, Homo sapiens
agaagccttcagc

SEQ ID NO: 3269717 - DNA, 19 bp, Homo sapiens
agaagcgtgagacgccacc

SEQ ID NO: 3269718 - DNA, 15 bp, Homo sapiens
agaagcgtttttaac

SEQ ID NO: 3269719 - DNA, 20 bp, Homo sapiens
agaagctaatgtaggactgt

SEQ ID NO: 3269720 - DNA, 23 bp, Homo sapiens
agaagctaatgtaggactgtata

SEQ ID NO: 3269721 - DNA, 23 bp, Homo sapiens
agaagctcgccccacctccacct

SEQ ID NO: 3269722 - DNA, 20 bp, Homo sapiens
agaagctgctccaggcctgc

SEQ ID NO: 3269723 - DNA, 23 bp, Homo sapiens
agaagctgctccaggcctgcagc

SEQ ID NO: 3269724 - DNA, 13 bp, Homo sapiens
agaagctggactt

SEQ ID NO: 3269725 - DNA, 14 bp, Homo sapiens
agaagctgttgtac

SEQ ID NO: 3269726 - DNA, 21 bp, Homo sapiens
agaagctgttgtacatttatg

SEQ ID NO: 3269727 - DNA, 18 bp, Homo sapiens
agaagcttccattccaag

SEQ ID NO: 3269728 - DNA, 16 bp, Homo sapiens
agaagcttctaataaa

SEQ ID NO: 3269729 - DNA, 18 bp, Homo sapiens
agaagcttctaataaatt

SEQ ID NO: 3269730 - DNA, 16 bp, Homo sapiens
agaagctttatttcta

SEQ ID NO: 3269731 - DNA, 18 bp, Homo sapiens
agaaggaaacggaagctg

SEQ ID NO: 3269732 - DNA, 19 bp, Homo sapiens
agaaggaaagatggttaaa

SEQ ID NO: 3269733 - DNA, 14 bp, Homo sapiens
agaaggaagggcag

SEQ ID NO: 3269734 - DNA, 22 bp, Homo sapiens
agaaggaattctaggcatccca

SEQ ID NO: 3269735 - DNA, 17 bp, Homo sapiens
agaaggaatttgtactt

SEQ ID NO: 3269736 - DNA, 14 bp, Homo sapiens
agaaggagagaaag

SEQ ID NO: 3269737 - DNA, 15 bp, Homo sapiens
agaaggagggcagag

SEQ ID NO: 3269738 - DNA, 19 bp, Homo sapiens
agaaggcctcttgtgctca

SEQ ID NO: 3269739 - DNA, 20 bp, Homo sapiens
agaagggccagtcctgcctg

SEQ ID NO: 3269740 - DNA, 12 bp, Homo sapiens
agaaggggccat

SEQ ID NO: 3269741 - DNA, 17 bp, Homo sapiens
agaagggggccctgcta

SEQ ID NO: 3269742 - DNA, 18 bp, Homo sapiens
agaagggggccctgctac

SEQ ID NO: 3269743 - DNA, 21 bp, Homo sapiens
agaagggttttccaccctgga

SEQ ID NO: 3269744 - DNA, 15 bp, Homo sapiens
agaaggtgccacttt

SEQ ID NO: 3269745 - DNA, 16 bp, Homo sapiens
agaaggttgctctaga

SEQ ID NO: 3269746 - DNA, 20 bp, Homo sapiens
agaaggttgctctagattga

SEQ ID NO: 3269747 - DNA, 13 bp, Homo sapiens
agaagtagattaa

SEQ ID NO: 3269748 - DNA, 13 bp, Homo sapiens
agaagtatacata

SEQ ID NO: 3269749 - DNA, 15 bp, Homo sapiens
agaagtcatcttgct

SEQ ID NO: 3269750 - DNA, 22 bp, Homo sapiens
agaagtcatcttgctaccagta

SEQ ID NO: 3269751 - DNA, 14 bp, Homo sapiens
agaagtctcattcg

SEQ ID NO: 3269752 - DNA, 19 bp, Homo sapiens
agaagtcttagatgtatat

SEQ ID NO: 3269753 - DNA, 17 bp, Homo sapiens
agaagtgaatgctggga

SEQ ID NO: 3269754 - DNA, 21 bp, Homo sapiens
agaagtgaatgctgggactca

SEQ ID NO: 3269755 - DNA, 14 bp, Homo sapiens
agaagtgagcaaaa

SEQ ID NO: 3269756 - DNA, 15 bp, Homo sapiens
agaagtgcatttctg

SEQ ID NO: 3269757 - DNA, 15 bp, Homo sapiens
agaagtggagacagt

SEQ ID NO: 3269758 - DNA, 19 bp, Homo sapiens
agaagtgtccgagaactaa

SEQ ID NO: 3269759 - DNA, 16 bp, Homo sapiens
agaagtgttgattgcc

SEQ ID NO: 3269760 - DNA, 14 bp, Homo sapiens
agaagttactttgt

SEQ ID NO: 3269761 - DNA, 17 bp, Homo sapiens
agaagtttattctcatt

SEQ ID NO: 3269762 - DNA, 19 bp, Homo sapiens
agaagtttctttaaagacg

SEQ ID NO: 3269763 - DNA, 16 bp, Homo sapiens
agaagtttgtagccag

SEQ ID NO: 3269764 - DNA, 22 bp, Homo sapiens
agaagtttgtccatttgtaaaa

SEQ ID NO: 3269765 - DNA, 15 bp, Homo sapiens
agaataaaagctata

SEQ ID NO: 3269766 - DNA, 12 bp, Homo sapiens
agaataaagcag

SEQ ID NO: 3269767 - DNA, 16 bp, Homo sapiens
agaataaagcagcctg

SEQ ID NO: 3269768 - DNA, 14 bp, Homo sapiens
agaataaaggcagt

SEQ ID NO: 3269769 - DNA, 18 bp, Homo sapiens
agaataaaggcagttttc

SEQ ID NO: 3269770 - DNA, 21 bp, Homo sapiens
agaataaaggcagttttctaa

SEQ ID NO: 3269771 - DNA, 17 bp, Homo sapiens
agaataaagttctgagt

SEQ ID NO: 3269772 - DNA, 21 bp, Homo sapiens
agaataagagaaagaaaatga

SEQ ID NO: 3269773 - DNA, 15 bp, Homo sapiens
agaataaggaggagg

SEQ ID NO: 3269774 - DNA, 16 bp, Homo sapiens
agaataaggaggagga

SEQ ID NO: 3269775 - DNA, 17 bp, Homo sapiens
agaataaggaggaggag

SEQ ID NO: 3269776 - DNA, 21 bp, Homo sapiens
agaataaggaggaggagggag

SEQ ID NO: 3269777 - DNA, 14 bp, Homo sapiens
agaataatggaaac

SEQ ID NO: 3269778 - DNA, 16 bp, Homo sapiens
agaataatggaaacat

SEQ ID NO: 3269779 - DNA, 17 bp, Homo sapiens
agaataatggaaacatt

SEQ ID NO: 3269780 - DNA, 19 bp, Homo sapiens
agaataatgttctattgtg

SEQ ID NO: 3269781 - DNA, 21 bp, Homo sapiens
agaataatttcatactgaaat

SEQ ID NO: 3269782 - DNA, 18 bp, Homo sapiens
agaatacagaaagatgga

SEQ ID NO: 3269783 - DNA, 17 bp, Homo sapiens
agaataccacatcaaat

SEQ ID NO: 3269784 - DNA, 17 bp, Homo sapiens
agaatagaacacagttt

SEQ ID NO: 3269785 - DNA, 20 bp, Homo sapiens
agaatagccacatttggaat

SEQ ID NO: 3269786 - DNA, 21 bp, Homo sapiens
agaatagccacatttggaata

SEQ ID NO: 3269787 - DNA, 20 bp, Homo sapiens
agaatagcttccaataaagc

SEQ ID NO: 3269788 - DNA, 18 bp, Homo sapiens
agaataggcattaacaca

SEQ ID NO: 3269789 - DNA, 17 bp, Homo sapiens
agaatataattatcgga

SEQ ID NO: 3269790 - DNA, 11 bp, Homo sapiens
agaatatatat

SEQ ID NO: 3269791 - DNA, 14 bp, Homo sapiens
agaatatatttatt

SEQ ID NO: 3269792 - DNA, 16 bp, Homo sapiens
agaatatatttttgat

SEQ ID NO: 3269793 - DNA, 16 bp, Homo sapiens
agaatatgacttttta

SEQ ID NO: 3269794 - DNA, 12 bp, Homo sapiens
agaatattcagg

SEQ ID NO: 3269795 - DNA, 13 bp, Homo sapiens
agaatattcagga

SEQ ID NO: 3269796 - DNA, 15 bp, Homo sapiens
agaatattcaggact

SEQ ID NO: 3269797 - DNA, 18 bp, Homo sapiens
agaatattcctacttgca

SEQ ID NO: 3269798 - DNA, 15 bp, Homo sapiens
agaatatttaagaaa

SEQ ID NO: 3269799 - DNA, 22 bp, Homo sapiens
agaatatttattacctctgata

SEQ ID NO: 3269800 - DNA, 13 bp, Homo sapiens
agaatatttctat

SEQ ID NO: 3269801 - DNA, 16 bp, Homo sapiens
agaatatttctattga

SEQ ID NO: 3269802 - DNA, 19 bp, Homo sapiens
agaatatttctattgaatt

SEQ ID NO: 3269803 - DNA, 16 bp, Homo sapiens
agaatcaatttaagtg

SEQ ID NO: 3269804 - DNA, 18 bp, Homo sapiens
agaatcactaggtaactt

SEQ ID NO: 3269805 - DNA, 15 bp, Homo sapiens
agaatcactgcagcc

SEQ ID NO: 3269806 - DNA, 19 bp, Homo sapiens
agaatcactgcagcccagg

SEQ ID NO: 3269807 - DNA, 21 bp, Homo sapiens
agaatcatgtgaacccgggac

SEQ ID NO: 3269808 - DNA, 15 bp, Homo sapiens
agaatcatttagcat

SEQ ID NO: 3269809 - DNA, 12 bp, Homo sapiens
agaatccaaact

SEQ ID NO: 3269810 - DNA, 16 bp, Homo sapiens
agaatccaaacttgga

SEQ ID NO: 3269811 - DNA, 16 bp, Homo sapiens
agaatccacatttcta

SEQ ID NO: 3269812 - DNA, 22 bp, Homo sapiens
agaatccacatttctaaaatct

SEQ ID NO: 3269813 - DNA, 21 bp, Homo sapiens
agaatcctcagttggaatcat

SEQ ID NO: 3269814 - DNA, 14 bp, Homo sapiens
agaatctaaacctt

SEQ ID NO: 3269815 - DNA, 17 bp, Homo sapiens
agaatctcaaataacta

SEQ ID NO: 3269816 - DNA, 18 bp, Homo sapiens
agaatctgaatgtaattt

SEQ ID NO: 3269817 - DNA, 17 bp, Homo sapiens
agaatctgctgcatagc

SEQ ID NO: 3269818 - DNA, 19 bp, Homo sapiens
agaatctttattcaaactt

SEQ ID NO: 3269819 - DNA, 16 bp, Homo sapiens
agaatgaaagctgttc

SEQ ID NO: 3269820 - DNA, 16 bp, Homo sapiens
agaatgaaagggccca

SEQ ID NO: 3269821 - DNA, 21 bp, Homo sapiens
agaatgactatataatttatt

SEQ ID NO: 3269822 - DNA, 12 bp, Homo sapiens
agaatgagcctc

SEQ ID NO: 3269823 - DNA, 16 bp, Homo sapiens
agaatgagggccaaga

SEQ ID NO: 3269824 - DNA, 20 bp, Homo sapiens
agaatgagtccttgatttca

SEQ ID NO: 3269825 - DNA, 22 bp, Homo sapiens
agaatgagtccttgatttcaaa

SEQ ID NO: 3269826 - DNA, 15 bp, Homo sapiens
agaatgatctattgc

SEQ ID NO: 3269827 - DNA, 16 bp, Homo sapiens
agaatgcacaagaatg

SEQ ID NO: 3269828 - DNA, 19 bp, Homo sapiens
agaatgcacaagaatggat

SEQ ID NO: 3269829 - DNA, 16 bp, Homo sapiens
agaatgcattcaaaat

SEQ ID NO: 3269830 - DNA, 22 bp, Homo sapiens
agaatgctgcaggacttgagaa

SEQ ID NO: 3269831 - DNA, 14 bp, Homo sapiens
agaatggagacaga

SEQ ID NO: 3269832 - DNA, 15 bp, Homo sapiens
agaatggagaggaac

SEQ ID NO: 3269833 - DNA, 15 bp, Homo sapiens
agaatggctgggtca

SEQ ID NO: 3269834 - DNA, 19 bp, Homo sapiens
agaatggctgggtcagggc

SEQ ID NO: 3269835 - DNA, 17 bp, Homo sapiens
agaatggtgttccattg

SEQ ID NO: 3269836 - DNA, 16 bp, Homo sapiens
agaatgtaaaagaact

SEQ ID NO: 3269837 - DNA, 19 bp, Homo sapiens
agaatgtaactccagatag

SEQ ID NO: 3269838 - DNA, 17 bp, Homo sapiens
agcagccctcaacaggc

SEQ ID NO: 3269839 - DNA, 22 bp, Homo sapiens
agcagccctcaacaggcccagg

SEQ ID NO: 3269840 - DNA, 18 bp, Homo sapiens
agcagcctctccccaggt

SEQ ID NO: 3269841 - DNA, 13 bp, Homo sapiens
agcagcctgatgg

SEQ ID NO: 3269842 - DNA, 20 bp, Homo sapiens
agcagcctgatggccaaggg

SEQ ID NO: 3269843 - DNA, 16 bp, Homo sapiens
agcagcctgcttccca

SEQ ID NO: 3269844 - DNA, 22 bp, Homo sapiens
agcagcctgcttcccacctccc

SEQ ID NO: 3269845 - DNA, 13 bp, Homo sapiens
agcagcctgtggc

SEQ ID NO: 3269846 - DNA, 14 bp, Homo sapiens
agcagcctgtggca

SEQ ID NO: 3269847 - DNA, 16 bp, Homo sapiens
agcagcctttaatgca

SEQ ID NO: 3269848 - DNA, 11 bp, Homo sapiens
agcagcctttc

SEQ ID NO: 3269849 - DNA, 18 bp, Homo sapiens
agcagcgcttcctggctg

SEQ ID NO: 3269850 - DNA, 23 bp, Homo sapiens
agcagcggtaccccagggcctac

SEQ ID NO: 3269851 - DNA, 23 bp, Homo sapiens
agcagcggtttggggagcagaga

SEQ ID NO: 3269852 - DNA, 14 bp, Homo sapiens
agcagctaggactg

SEQ ID NO: 3269853 - DNA, 16 bp, Homo sapiens
agcagctcttgctaat

SEQ ID NO: 3269854 - DNA, 18 bp, Homo sapiens
agcagctgaagaaaaaat

SEQ ID NO: 3269855 - DNA, 17 bp, Homo sapiens
agcagctgcgggtctga

SEQ ID NO: 3269856 - DNA, 21 bp, Homo sapiens
agcagcttccttctgggactg

SEQ ID NO: 3269857 - DNA, 14 bp, Homo sapiens
agcaggaaggcctg

SEQ ID NO: 3269858 - DNA, 16 bp, Homo sapiens
agcaggaaggcctggg

SEQ ID NO: 3269859 - DNA, 12 bp, Homo sapiens
agcaggacctag

SEQ ID NO: 3269860 - DNA, 17 bp, Homo sapiens
agcaggacctcccttcc

SEQ ID NO: 3269861 - DNA, 22 bp, Homo sapiens
agcaggacctcccttccgaccc

SEQ ID NO: 3269862 - DNA, 13 bp, Homo sapiens
agcaggacctggc

SEQ ID NO: 3269863 - DNA, 18 bp, Homo sapiens
agcaggactccaggccca

SEQ ID NO: 3269864 - DNA, 22 bp, Homo sapiens
agcaggacttgctaaagcactt

SEQ ID NO: 3269865 - DNA, 23 bp, Homo sapiens
agcaggacttgctaaagcacttt

SEQ ID NO: 3269866 - DNA, 19 bp, Homo sapiens
agcaggagccccgccacag

SEQ ID NO: 3269867 - DNA, 14 bp, Homo sapiens
agcaggaggccaat

SEQ ID NO: 3269868 - DNA, 23 bp, Homo sapiens
agcaggaggccaataaaaagttc

SEQ ID NO: 3269869 - DNA, 19 bp, Homo sapiens
agcaggcacatggaggagc

SEQ ID NO: 3269870 - DNA, 15 bp, Homo sapiens
agcaggcaccgccac

SEQ ID NO: 3269871 - DNA, 20 bp, Homo sapiens
agcaggcacgggtggtcccc

SEQ ID NO: 3269872 - DNA, 18 bp, Homo sapiens
agcaggccggaaccacag

SEQ ID NO: 3269873 - DNA, 21 bp, Homo sapiens
agcaggccggaaccacagggc

SEQ ID NO: 3269874 - DNA, 17 bp, Homo sapiens
agcaggcgctgtgctat

SEQ ID NO: 3269875 - DNA, 21 bp, Homo sapiens
agcaggcgctgtgctatcatg

SEQ ID NO: 3269876 - DNA, 17 bp, Homo sapiens
agcaggctactgggacc

SEQ ID NO: 3269877 - DNA, 16 bp, Homo sapiens
agcaggctggcagctc

SEQ ID NO: 3269878 - DNA, 20 bp, Homo sapiens
agcaggctggcagctctcca

SEQ ID NO: 3269879 - DNA, 13 bp, Homo sapiens
agcagggaaacag

SEQ ID NO: 3269880 - DNA, 18 bp, Homo sapiens
agcagggaaggtgaagat

SEQ ID NO: 3269881 - DNA, 13 bp, Homo sapiens
agcagggctcagc

SEQ ID NO: 3269882 - DNA, 15 bp, Homo sapiens
agcaggggcaccttc

SEQ ID NO: 3269883 - DNA, 20 bp, Homo sapiens
agcaggggctacaagaggga

SEQ ID NO: 3269884 - DNA, 20 bp, Homo sapiens
agcagggggagaaacccttc

SEQ ID NO: 3269885 - DNA, 17 bp, Homo sapiens
agcaggggggctgtgcc

SEQ ID NO: 3269886 - DNA, 21 bp, Homo sapiens
agcagggtaccctttggggag

SEQ ID NO: 3269887 - DNA, 18 bp, Homo sapiens
agcagggtagtctggttt

SEQ ID NO: 3269888 - DNA, 17 bp, Homo sapiens
agcagggtgttgggata

SEQ ID NO: 3269889 - DNA, 14 bp, Homo sapiens
agcaggtgctacaa

SEQ ID NO: 3269890 - DNA, 22 bp, Homo sapiens
agcaggtgtcctttcccctctc

SEQ ID NO: 3269891 - DNA, 22 bp, Homo sapiens
agcaggtgtggtggctcatggc

SEQ ID NO: 3269892 - DNA, 16 bp, Homo sapiens
agcaggttccccaagg

SEQ ID NO: 3269893 - DNA, 18 bp, Homo sapiens
agcaggttccccaagggc

SEQ ID NO: 3269894 - DNA, 20 bp, Homo sapiens
agcaggttccccaagggccc

SEQ ID NO: 3269895 - DNA, 15 bp, Homo sapiens
agcagtaaaaactgt

SEQ ID NO: 3269896 - DNA, 21 bp, Homo sapiens
agcagtagaaataatatgcat

SEQ ID NO: 3269897 - DNA, 22 bp, Homo sapiens
agcagtagaaataatatgcatt

SEQ ID NO: 3269898 - DNA, 16 bp, Homo sapiens
agcagtagtgagccac

SEQ ID NO: 3269899 - DNA, 20 bp, Homo sapiens
agcagtatatgttaatttgt

SEQ ID NO: 3269900 - DNA, 11 bp, Homo sapiens
agcagtatttt

SEQ ID NO: 3269901 - DNA, 13 bp, Homo sapiens
agcagtattttgg

SEQ ID NO: 3269902 - DNA, 17 bp, Homo sapiens
agcagtcactgggagag

SEQ ID NO: 3269903 - DNA, 15 bp, Homo sapiens
agcagtccaaagaac

SEQ ID NO: 3269904 - DNA, 15 bp, Homo sapiens
agcagtccctgagac

SEQ ID NO: 3269905 - DNA, 16 bp, Homo sapiens
agcagtcgtgcctgtg

SEQ ID NO: 3269906 - DNA, 23 bp, Homo sapiens
agcagtctcactgcagtcttatt

SEQ ID NO: 3269907 - DNA, 18 bp, Homo sapiens
agcagtctccttcagcac

SEQ ID NO: 3269908 - DNA, 19 bp, Homo sapiens
agcagtctccttcagcacg

SEQ ID NO: 3269909 - DNA, 15 bp, Homo sapiens
agcagtcttgctctg

SEQ ID NO: 3269910 - DNA, 21 bp, Homo sapiens
agcagtgagaaaaagctcctg

SEQ ID NO: 3269911 - DNA, 22 bp, Homo sapiens
agcagtgagaaaaagctcctgt

SEQ ID NO: 3269912 - DNA, 13 bp, Homo sapiens
agcagtgagcaga

SEQ ID NO: 3269913 - DNA, 15 bp, Homo sapiens
agcagtgcctcgagg

SEQ ID NO: 3269914 - DNA, 16 bp, Homo sapiens
agcagtgcctcgaggc

SEQ ID NO: 3269915 - DNA, 20 bp, Homo sapiens
agcagtgcctcgaggcaccg

SEQ ID NO: 3269916 - DNA, 16 bp, Homo sapiens
agcagtgccttccata

SEQ ID NO: 3269917 - DNA, 19 bp, Homo sapiens
agcagtgccttccataatt

SEQ ID NO: 3269918 - DNA, 13 bp, Homo sapiens
agcagtggctggt

SEQ ID NO: 3269919 - DNA, 19 bp, Homo sapiens
agcagtggctggtccaggg

SEQ ID NO: 3269920 - DNA, 13 bp, Homo sapiens
agcagtgtcatca

SEQ ID NO: 3269921 - DNA, 16 bp, Homo sapiens
agcagtgtcttccata

SEQ ID NO: 3269922 - DNA, 21 bp, Homo sapiens
agcagttgacatccaaatcta

SEQ ID NO: 3269923 - DNA, 22 bp, Homo sapiens
agcagttgacatccaaatctag

SEQ ID NO: 3269924 - DNA, 13 bp, Homo sapiens
agcagttgtgtca

SEQ ID NO: 3269925 - DNA, 14 bp, Homo sapiens
agcagtttgctttg

SEQ ID NO: 3269926 - DNA, 22 bp, Homo sapiens
agcagttttcaagtcaaattaa

SEQ ID NO: 3269927 - DNA, 14 bp, Homo sapiens
agcagttttcccct

SEQ ID NO: 3269928 - DNA, 13 bp, Homo sapiens
agcataaagctca

SEQ ID NO: 3269929 - DNA, 18 bp, Homo sapiens
agcataaagctcaaatga

SEQ ID NO: 3269930 - DNA, 13 bp, Homo sapiens
agcataaatgcaa

SEQ ID NO: 3269931 - DNA, 19 bp, Homo sapiens
agcataacaccaatcccag

SEQ ID NO: 3269932 - DNA, 13 bp, Homo sapiens
agcataactgtag

SEQ ID NO: 3269933 - DNA, 23 bp, Homo sapiens
agcataagtttctgggacctcag

SEQ ID NO: 3269934 - DNA, 20 bp, Homo sapiens
agcataattttgtgttgtac

SEQ ID NO: 3269935 - DNA, 13 bp, Homo sapiens
agcatacatttat

SEQ ID NO: 3269936 - DNA, 14 bp, Homo sapiens
agcatacatttata

SEQ ID NO: 3269937 - DNA, 15 bp, Homo sapiens
agcatacattttctg

SEQ ID NO: 3269938 - DNA, 14 bp, Homo sapiens
agcatactttgtaa

SEQ ID NO: 3269939 - DNA, 20 bp, Homo sapiens
agcatagaaaccactagaaa

SEQ ID NO: 3269940 - DNA, 15 bp, Homo sapiens
agcatagataatatt

SEQ ID NO: 3269941 - DNA, 20 bp, Homo sapiens
agcatagatatctatatttt

SEQ ID NO: 3269942 - DNA, 21 bp, Homo sapiens
agcatagatatctatattttt

SEQ ID NO: 3269943 - DNA, 14 bp, Homo sapiens
agcatagatgtttt

SEQ ID NO: 3269944 - DNA, 16 bp, Homo sapiens
agcatagcttattatt

SEQ ID NO: 3269945 - DNA, 18 bp, Homo sapiens
agcatagcttattattga

SEQ ID NO: 3269946 - DNA, 20 bp, Homo sapiens
agcatatttgccaataaagc

SEQ ID NO: 3269947 - DNA, 14 bp, Homo sapiens
agcatattttgctg

SEQ ID NO: 3269948 - DNA, 13 bp, Homo sapiens
agcatcacctcag

SEQ ID NO: 3269949 - DNA, 12 bp, Homo sapiens
agcatcactccc

SEQ ID NO: 3269950 - DNA, 22 bp, Homo sapiens
agcatcactccccaaggaagag

SEQ ID NO: 3269951 - DNA, 16 bp, Homo sapiens
agcatcagagagtgta

SEQ ID NO: 3269952 - DNA, 23 bp, Homo sapiens
agcatcagaggtttgcttcctca

SEQ ID NO: 3269953 - DNA, 17 bp, Homo sapiens
agcatccaccttggctc

SEQ ID NO: 3269954 - DNA, 18 bp, Homo sapiens
agcatccaccttggctct

SEQ ID NO: 3269955 - DNA, 20 bp, Homo sapiens
agcatcccggaggaaatctg

SEQ ID NO: 3269956 - DNA, 12 bp, Homo sapiens
agcatccctgga

SEQ ID NO: 3269957 - DNA, 13 bp, Homo sapiens
agcatccctggag

SEQ ID NO: 3269958 - DNA, 16 bp, Homo sapiens
agcatcctccacatcc

SEQ ID NO: 3269959 - DNA, 17 bp, Homo sapiens
agcatcctgagccccgc

SEQ ID NO: 3269960 - DNA, 17 bp, Homo sapiens
agcatcctggcacccgg

SEQ ID NO: 3269961 - DNA, 21 bp, Homo sapiens
agcatccttttctgcagaggg

SEQ ID NO: 3269962 - DNA, 12 bp, Homo sapiens
agcatcgggagc

SEQ ID NO: 3269963 - DNA, 18 bp, Homo sapiens
agcatcgggagcacccag

SEQ ID NO: 3269964 - DNA, 16 bp, Homo sapiens
agccaatcccctcctt

SEQ ID NO: 3269965 - DNA, 21 bp, Homo sapiens
agccaatcccctccttgggca

SEQ ID NO: 3269966 - DNA, 22 bp, Homo sapiens
agccaatcccctccttgggcac

SEQ ID NO: 3269967 - DNA, 14 bp, Homo sapiens
agccacaaatgcct

SEQ ID NO: 3269968 - DNA, 16 bp, Homo sapiens
agccacaaatgccttg

SEQ ID NO: 3269969 - DNA, 19 bp, Homo sapiens
agccacaagaaatttgatt

SEQ ID NO: 3269970 - DNA, 17 bp, Homo sapiens
agccacaaggctggcca

SEQ ID NO: 3269971 - DNA, 20 bp, Homo sapiens
agccacagacccctgggagc

SEQ ID NO: 3269972 - DNA, 22 bp, Homo sapiens
agccacagacccctgggagctt

SEQ ID NO: 3269973 - DNA, 22 bp, Homo sapiens
agccacatggccccatcccagt

SEQ ID NO: 3269974 - DNA, 17 bp, Homo sapiens
agccaccacgtccagct

SEQ ID NO: 3269975 - DNA, 23 bp, Homo sapiens
agccacccaagcctgctggctgc

SEQ ID NO: 3269976 - DNA, 23 bp, Homo sapiens
agccacccgtggggtgctgccct

SEQ ID NO: 3269977 - DNA, 14 bp, Homo sapiens
agccaccgctgcca

SEQ ID NO: 3269978 - DNA, 14 bp, Homo sapiens
agccacctctccct

SEQ ID NO: 3269979 - DNA, 16 bp, Homo sapiens
agccacctctccctca

SEQ ID NO: 3269980 - DNA, 18 bp, Homo sapiens
agccacgaccagcccctt

SEQ ID NO: 3269981 - DNA, 15 bp, Homo sapiens
agccacgctgtcctc

SEQ ID NO: 3269982 - DNA, 23 bp, Homo sapiens
agccacgctgtcctctcgagccc

SEQ ID NO: 3269983 - DNA, 18 bp, Homo sapiens
agccacggccaggccaga

SEQ ID NO: 3269984 - DNA, 14 bp, Homo sapiens
agccactagactct

SEQ ID NO: 3269985 - DNA, 22 bp, Homo sapiens
agccactagactcttcactgtt

SEQ ID NO: 3269986 - DNA, 16 bp, Homo sapiens
agccactcctgtcccg

SEQ ID NO: 3269987 - DNA, 17 bp, Homo sapiens
agccactcctgtcccgc

SEQ ID NO: 3269988 - DNA, 19 bp, Homo sapiens
agccactcctgtcccgcct

SEQ ID NO: 3269989 - DNA, 23 bp, Homo sapiens
agccactcctgtcccgccttcct

SEQ ID NO: 3269990 - DNA, 20 bp, Homo sapiens
agccactcgcagtcgcagga

SEQ ID NO: 3269991 - DNA, 12 bp, Homo sapiens
agccactgaagc

SEQ ID NO: 3269992 - DNA, 13 bp, Homo sapiens
agccactgcaccg

SEQ ID NO: 3269993 - DNA, 18 bp, Homo sapiens
agccactgcaccgggcca

SEQ ID NO: 3269994 - DNA, 20 bp, Homo sapiens
agccactgcaccgggccaca

SEQ ID NO: 3269995 - DNA, 22 bp, Homo sapiens
agccactgcaccgggccacaga

SEQ ID NO: 3269996 - DNA, 17 bp, Homo sapiens
agccacttcggccaggt

SEQ ID NO: 3269997 - DNA, 17 bp, Homo sapiens
agccacttctccccaga

SEQ ID NO: 3269998 - DNA, 15 bp, Homo sapiens
agccagacagaccct

SEQ ID NO: 3269999 - DNA, 19 bp, Homo sapiens
agccagagcccttcactgc

SEQ ID NO: 3270000 - DNA, 15 bp, Homo sapiens
agccagagcctgggg

SEQ ID NO: 3270001 - DNA, 16 bp, Homo sapiens
agccagagctgggtgg

SEQ ID NO: 3270002 - DNA, 14 bp, Homo sapiens
agccagagttaggt

SEQ ID NO: 3270003 - DNA, 15 bp, Homo sapiens
agccagagttcctgc

SEQ ID NO: 3270004 - DNA, 16 bp, Homo sapiens
agccagatgcaggaca

SEQ ID NO: 3270005 - DNA, 17 bp, Homo sapiens
agccagatgcaggacag

SEQ ID NO: 3270006 - DNA, 22 bp, Homo sapiens
agccagatggactccagcctgc

SEQ ID NO: 3270007 - DNA, 14 bp, Homo sapiens
agccagattacagg

SEQ ID NO: 3270008 - DNA, 22 bp, Homo sapiens
agccagcaatgatgtccagaag

SEQ ID NO: 3270009 - DNA, 15 bp, Homo sapiens
agccagcacttgtat

SEQ ID NO: 3270010 - DNA, 11 bp, Homo sapiens
agccagccaca

SEQ ID NO: 3270011 - DNA, 19 bp, Homo sapiens
agccagcccatggccccca

SEQ ID NO: 3270012 - DNA, 23 bp, Homo sapiens
agccagcccatggcccccaataa

SEQ ID NO: 3270013 - DNA, 16 bp, Homo sapiens
agccagcccctcttcc

SEQ ID NO: 3270014 - DNA, 14 bp, Homo sapiens
agccagccgccctg

SEQ ID NO: 3270015 - DNA, 15 bp, Homo sapiens
agccagccggtgcct

SEQ ID NO: 3270016 - DNA, 17 bp, Homo sapiens
agccagccggtgcctgg

SEQ ID NO: 3270017 - DNA, 14 bp, Homo sapiens
agccagcctgacct

SEQ ID NO: 3270018 - DNA, 15 bp, Homo sapiens
agccagcctgacctt

SEQ ID NO: 3270019 - DNA, 23 bp, Homo sapiens
agccagcctgaccttccttcctg

SEQ ID NO: 3270020 - DNA, 15 bp, Homo sapiens
agccagcctgggact

SEQ ID NO: 3270021 - DNA, 23 bp, Homo sapiens
agccagcctgggactcccagtga

SEQ ID NO: 3270022 - DNA, 17 bp, Homo sapiens
agccagctccctctatt

SEQ ID NO: 3270023 - DNA, 13 bp, Homo sapiens
agccagctctagg

SEQ ID NO: 3270024 - DNA, 14 bp, Homo sapiens
agccagctctaggc

SEQ ID NO: 3270025 - DNA, 18 bp, Homo sapiens
agccagctctaggcttca

SEQ ID NO: 3270026 - DNA, 13 bp, Homo sapiens
agccagctgcttt

SEQ ID NO: 3270027 - DNA, 14 bp, Homo sapiens
agccagctttccct

SEQ ID NO: 3270028 - DNA, 16 bp, Homo sapiens
agccagctttccctgc

SEQ ID NO: 3270029 - DNA, 18 bp, Homo sapiens
agccagctttccctgcct

SEQ ID NO: 3270030 - DNA, 12 bp, Homo sapiens
agccaggagcag

SEQ ID NO: 3270031 - DNA, 13 bp, Homo sapiens
agccaggagcaga

SEQ ID NO: 3270032 - DNA, 15 bp, Homo sapiens
agccaggagctgtca

SEQ ID NO: 3270033 - DNA, 17 bp, Homo sapiens
agccaggagctgtcacc

SEQ ID NO: 3270034 - DNA, 14 bp, Homo sapiens
agccaggaggcctg

SEQ ID NO: 3270035 - DNA, 20 bp, Homo sapiens
agccccacccctaagtgccc

SEQ ID NO: 3270036 - DNA, 19 bp, Homo sapiens
agccccacctctccaagtc

SEQ ID NO: 3270037 - DNA, 22 bp, Homo sapiens
agccccacctctccaagtctct

SEQ ID NO: 3270038 - DNA, 16 bp, Homo sapiens
agccccactgccagca

SEQ ID NO: 3270039 - DNA, 14 bp, Homo sapiens
agccccagaagaaa

SEQ ID NO: 3270040 - DNA, 11 bp, Homo sapiens
agccccagaga

SEQ ID NO: 3270041 - DNA, 16 bp, Homo sapiens
agccccagagagagga

SEQ ID NO: 3270042 - DNA, 17 bp, Homo sapiens
agccccagcagccctca

SEQ ID NO: 3270043 - DNA, 20 bp, Homo sapiens
agccccagcagccctcaaca

SEQ ID NO: 3270044 - DNA, 12 bp, Homo sapiens
agccccaggcct

SEQ ID NO: 3270045 - DNA, 15 bp, Homo sapiens
agccccagggcctgg

SEQ ID NO: 3270046 - DNA, 16 bp, Homo sapiens
agccccagggcctggg

SEQ ID NO: 3270047 - DNA, 18 bp, Homo sapiens
agccccaggggggcctcc

SEQ ID NO: 3270048 - DNA, 18 bp, Homo sapiens
agccccagggtcttccct

SEQ ID NO: 3270049 - DNA, 23 bp, Homo sapiens
agccccagggtcttccctacctc

SEQ ID NO: 3270050 - DNA, 13 bp, Homo sapiens
agccccagtgccc

SEQ ID NO: 3270051 - DNA, 16 bp, Homo sapiens
agccccagtgcccaca

SEQ ID NO: 3270052 - DNA, 17 bp, Homo sapiens
agccccatctcatcctg

SEQ ID NO: 3270053 - DNA, 21 bp, Homo sapiens
agccccatctcatcctggcac

SEQ ID NO: 3270054 - DNA, 17 bp, Homo sapiens
agccccattctgcctgc

SEQ ID NO: 3270055 - DNA, 18 bp, Homo sapiens
agccccattctgcctgcc

SEQ ID NO: 3270056 - DNA, 13 bp, Homo sapiens
agcccccagccct

SEQ ID NO: 3270057 - DNA, 13 bp, Homo sapiens
agcccccaggcca

SEQ ID NO: 3270058 - DNA, 15 bp, Homo sapiens
agcccccaggccagg

SEQ ID NO: 3270059 - DNA, 13 bp, Homo sapiens
agccccccagcac

SEQ ID NO: 3270060 - DNA, 14 bp, Homo sapiens
agccccccagcact

SEQ ID NO: 3270061 - DNA, 19 bp, Homo sapiens
agcccccccaacactgtgc

SEQ ID NO: 3270062 - DNA, 15 bp, Homo sapiens
agccccctccacacc

SEQ ID NO: 3270063 - DNA, 17 bp, Homo sapiens
agccccctccacaccag

SEQ ID NO: 3270064 - DNA, 15 bp, Homo sapiens
agccccctggcctct

SEQ ID NO: 3270065 - DNA, 16 bp, Homo sapiens
agcccccttgacaccg

SEQ ID NO: 3270066 - DNA, 14 bp, Homo sapiens
agccccgaggcctt

SEQ ID NO: 3270067 - DNA, 17 bp, Homo sapiens
agccccgaggccttctc

SEQ ID NO: 3270068 - DNA, 22 bp, Homo sapiens
agccccgcagacctccccagcc

SEQ ID NO: 3270069 - DNA, 14 bp, Homo sapiens
agccccgccctctt

SEQ ID NO: 3270070 - DNA, 20 bp, Homo sapiens
agccccgccctcttcctgac

SEQ ID NO: 3270071 - DNA, 14 bp, Homo sapiens
agccccgctcaggc

SEQ ID NO: 3270072 - DNA, 22 bp, Homo sapiens
agccccgctcaggcctaggagg

SEQ ID NO: 3270073 - DNA, 21 bp, Homo sapiens
agccccgctcctcccctcttg

SEQ ID NO: 3270074 - DNA, 24 bp, Homo sapiens
agccccggggtgagtccattctcc

SEQ ID NO: 3270075 - DNA, 17 bp, Homo sapiens
agccgtctgactccaga

SEQ ID NO: 3270076 - DNA, 20 bp, Homo sapiens
agccgtgatgctcaggcttg

SEQ ID NO: 3270077 - DNA, 13 bp, Homo sapiens
agccgtggcttcc

SEQ ID NO: 3270078 - DNA, 14 bp, Homo sapiens
agcctaaagggcag

SEQ ID NO: 3270079 - DNA, 15 bp, Homo sapiens
agcctaaagggcagg

SEQ ID NO: 3270080 - DNA, 22 bp, Homo sapiens
agcctaaagggcagggcccacg

SEQ ID NO: 3270081 - DNA, 12 bp, Homo sapiens
agcctaagggat

SEQ ID NO: 3270082 - DNA, 22 bp, Homo sapiens
agcctacccttcctgcatttct

SEQ ID NO: 3270083 - DNA, 23 bp, Homo sapiens
agcctacccttcctgcatttctc

SEQ ID NO: 3270084 - DNA, 14 bp, Homo sapiens
agcctacctgtatg

SEQ ID NO: 3270085 - DNA, 14 bp, Homo sapiens
agcctagaagctgg

SEQ ID NO: 3270086 - DNA, 18 bp, Homo sapiens
agcctagaagctggtggc

SEQ ID NO: 3270087 - DNA, 15 bp, Homo sapiens
agcctagaccctcct

SEQ ID NO: 3270088 - DNA, 12 bp, Homo sapiens
agcctagctcct

SEQ ID NO: 3270089 - DNA, 15 bp, Homo sapiens
agcctaggtgacaga

SEQ ID NO: 3270090 - DNA, 14 bp, Homo sapiens
agcctagttcatcc

SEQ ID NO: 3270091 - DNA, 14 bp, Homo sapiens
agcctatatttaca

SEQ ID NO: 3270092 - DNA, 16 bp, Homo sapiens
agcctatttacctgca

SEQ ID NO: 3270093 - DNA, 17 bp, Homo sapiens
agcctatttttttagat

SEQ ID NO: 3270094 - DNA, 15 bp, Homo sapiens
agcctcaacctcctg

SEQ ID NO: 3270095 - DNA, 19 bp, Homo sapiens
agcctcaacctcctgggct

SEQ ID NO: 3270096 - DNA, 20 bp, Homo sapiens
agcctcaacctcctgggcta

SEQ ID NO: 3270097 - DNA, 23 bp, Homo sapiens
agcctcaaggttttaggttctaa

SEQ ID NO: 3270098 - DNA, 16 bp, Homo sapiens
agcctcacttgaatgt

SEQ ID NO: 3270099 - DNA, 15 bp, Homo sapiens
agcctcagaccccag

SEQ ID NO: 3270100 - DNA, 23 bp, Homo sapiens
agcctcagagcatttaaggaaac

SEQ ID NO: 3270101 - DNA, 24 bp, Homo sapiens
agcctcagagcatttaaggaaact

SEQ ID NO: 3270102 - DNA, 19 bp, Homo sapiens
agcctcagcatcctggcac

SEQ ID NO: 3270103 - DNA, 22 bp, Homo sapiens
agcctcagcatcctggcacccg

SEQ ID NO: 3270104 - DNA, 15 bp, Homo sapiens
agcctcagtcctccc

SEQ ID NO: 3270105 - DNA, 16 bp, Homo sapiens
agcctcagtcctcccc

SEQ ID NO: 3270106 - DNA, 19 bp, Homo sapiens
agcctcatatttaaagaca

SEQ ID NO: 3270107 - DNA, 20 bp, Homo sapiens
agcctcatatttaaagacag

SEQ ID NO: 3270108 - DNA, 19 bp, Homo sapiens
agcctccaagcctgcctcc

SEQ ID NO: 3270109 - DNA, 12 bp, Homo sapiens
agcctccacagc

SEQ ID NO: 3270110 - DNA, 13 bp, Homo sapiens
agcctccacagcg

SEQ ID NO: 3270111 - DNA, 21 bp, Homo sapiens
agcctccacagcgagggcagc

SEQ ID NO: 3270112 - DNA, 20 bp, Homo sapiens
agcctccactgcctctggaa

SEQ ID NO: 3270113 - DNA, 20 bp, Homo sapiens
agcctccagagccagcctgg

SEQ ID NO: 3270114 - DNA, 21 bp, Homo sapiens
agcctccagagccagcctggg

SEQ ID NO: 3270115 - DNA, 22 bp, Homo sapiens
agcctccagagccagcctggga

SEQ ID NO: 3270116 - DNA, 24 bp, Homo sapiens
agcctccagagccagcctgggact

SEQ ID NO: 3270117 - DNA, 12 bp, Homo sapiens
agcctccagcct

SEQ ID NO: 3270118 - DNA, 20 bp, Homo sapiens
agcctccatgctgcctccag

SEQ ID NO: 3270119 - DNA, 20 bp, Homo sapiens
agcctccatttagttctttg

SEQ ID NO: 3270120 - DNA, 19 bp, Homo sapiens
agcctcccaaagtgctggg

SEQ ID NO: 3270121 - DNA, 20 bp, Homo sapiens
agcctcccaaagtgctggga

SEQ ID NO: 3270122 - DNA, 11 bp, Homo sapiens
agcctcccaca

SEQ ID NO: 3270123 - DNA, 15 bp, Homo sapiens
agcctcccccaaagc

SEQ ID NO: 3270124 - DNA, 13 bp, Homo sapiens
agcctccccctca

SEQ ID NO: 3270125 - DNA, 14 bp, Homo sapiens
agcctccccctcag

SEQ ID NO: 3270126 - DNA, 15 bp, Homo sapiens
agcctccccctcaga

SEQ ID NO: 3270127 - DNA, 20 bp, Homo sapiens
agcctcccgaatagctggga

SEQ ID NO: 3270128 - DNA, 22 bp, Homo sapiens
agcctcccgaatagctgggact

SEQ ID NO: 3270129 - DNA, 20 bp, Homo sapiens
agcctcccgagtagctggga

SEQ ID NO: 3270130 - DNA, 12 bp, Homo sapiens
agcctccctgaa

SEQ ID NO: 3270131 - DNA, 17 bp, Homo sapiens
agcctccgagagggaga

SEQ ID NO: 3270132 - DNA, 19 bp, Homo sapiens
agcctccgtttatgggcct

SEQ ID NO: 3270133 - DNA, 20 bp, Homo sapiens
agcctccgtttatgggcctt

SEQ ID NO: 3270134 - DNA, 21 bp, Homo sapiens
agcctccgtttatgggccttg

SEQ ID NO: 3270135 - DNA, 12 bp, Homo sapiens
agcctcctcctg

SEQ ID NO: 3270136 - DNA, 16 bp, Homo sapiens
agcctcctcctgacca

SEQ ID NO: 3270137 - DNA, 13 bp, Homo sapiens
agcctcctctgga

SEQ ID NO: 3270138 - DNA, 19 bp, Homo sapiens
agcctcctctggacggcag

SEQ ID NO: 3270139 - DNA, 17 bp, Homo sapiens
agcctcctgctgccaca

SEQ ID NO: 3270140 - DNA, 17 bp, Homo sapiens
agcctcgttttgatgcc

SEQ ID NO: 3270141 - DNA, 16 bp, Homo sapiens
agcctctccccaggtc

SEQ ID NO: 3270142 - DNA, 23 bp, Homo sapiens
agcctctccccaggtccagctct

SEQ ID NO: 3270143 - DNA, 16 bp, Homo sapiens
agcctctcccggctgc

SEQ ID NO: 3270144 - DNA, 17 bp, Homo sapiens
agcctctcccggctgcc

SEQ ID NO: 3270145 - DNA, 21 bp, Homo sapiens
agcctctcccggctgcctgcc

SEQ ID NO: 3270146 - DNA, 19 bp, Homo sapiens
agcctctgacccctcctca

SEQ ID NO: 3270147 - DNA, 20 bp, Homo sapiens
agcctctgacccctcctcac

SEQ ID NO: 3270148 - DNA, 15 bp, Homo sapiens
agcctctgctcccca

SEQ ID NO: 3270149 - DNA, 14 bp, Homo sapiens
agcctctgctgcca

SEQ ID NO: 3270150 - DNA, 19 bp, Homo sapiens
agcctctggctccacacct

SEQ ID NO: 3270151 - DNA, 20 bp, Homo sapiens
agcctcttaaagctgcctgt

SEQ ID NO: 3270152 - DNA, 22 bp, Homo sapiens
agcctcttaaagctgcctgtag

SEQ ID NO: 3270153 - DNA, 19 bp, Homo sapiens
agcctcttcagccccttct

SEQ ID NO: 3270154 - DNA, 21 bp, Homo sapiens
agcctcttgagctgaagtaat

SEQ ID NO: 3270155 - DNA, 16 bp, Homo sapiens
agcctctttttgatac

SEQ ID NO: 3270156 - DNA, 14 bp, Homo sapiens
agcctgacctgaga

SEQ ID NO: 3270157 - DNA, 16 bp, Homo sapiens
agcctgacctgagact

SEQ ID NO: 3270158 - DNA, 18 bp, Homo sapiens
agcctgacctgagactgt

SEQ ID NO: 3270159 - DNA, 19 bp, Homo sapiens
agcctgaccttccttcctg

SEQ ID NO: 3270160 - DNA, 16 bp, Homo sapiens
agcctgaggcagccac

SEQ ID NO: 3270161 - DNA, 18 bp, Homo sapiens
agcctgagtcagggccca

SEQ ID NO: 3270162 - DNA, 19 bp, Homo sapiens
agcctgagtcagggcccag

SEQ ID NO: 3270163 - DNA, 15 bp, Homo sapiens
agcctgatctcttcc

SEQ ID NO: 3270164 - DNA, 17 bp, Homo sapiens
agcctgatctcttcctg

SEQ ID NO: 3270165 - DNA, 18 bp, Homo sapiens
agcctgatctcttcctgt

SEQ ID NO: 3270166 - DNA, 19 bp, Homo sapiens
agcctgatgagatttttaa

SEQ ID NO: 3270167 - DNA, 15 bp, Homo sapiens
agcctgatggccaag

SEQ ID NO: 3270168 - DNA, 13 bp, Homo sapiens
aggaatcctggca

SEQ ID NO: 3270169 - DNA, 15 bp, Homo sapiens
aggaatcctggcagc

SEQ ID NO: 3270170 - DNA, 16 bp, Homo sapiens
aggaatcctggcagcc

SEQ ID NO: 3270171 - DNA, 17 bp, Homo sapiens
aggaatcggctggggac

SEQ ID NO: 3270172 - DNA, 19 bp, Homo sapiens
aggaatctgtgggtctggg

SEQ ID NO: 3270173 - DNA, 13 bp, Homo sapiens
aggaatctttaag

SEQ ID NO: 3270174 - DNA, 17 bp, Homo sapiens
agctggttactcagggt

SEQ ID NO: 3270175 - DNA, 15 bp, Homo sapiens
agctggtttcctcat

SEQ ID NO: 3270176 - DNA, 21 bp, Homo sapiens
agctggtttcctcattcctga

SEQ ID NO: 3270177 - DNA, 14 bp, Homo sapiens
agctgtaaaacgct

SEQ ID NO: 3270178 - DNA, 11 bp, Homo sapiens
agcgccttggt

SEQ ID NO: 3270179 - DNA, 19 bp, Homo sapiens
agcgcgccactcgcttccc

SEQ ID NO: 3270180 - DNA, 13 bp, Homo sapiens
agcgcggctggct

SEQ ID NO: 3270181 - DNA, 13 bp, Homo sapiens
agcgctcctcctg

SEQ ID NO: 3270182 - DNA, 14 bp, Homo sapiens
agcgctcctcctgt

SEQ ID NO: 3270183 - DNA, 17 bp, Homo sapiens
agcggaacaaggagtca

SEQ ID NO: 3270184 - DNA, 15 bp, Homo sapiens
agcggaggctgtgtg

SEQ ID NO: 3270185 - DNA, 20 bp, Homo sapiens
agcggccccccgcacagcca

SEQ ID NO: 3270186 - DNA, 23 bp, Homo sapiens
agcggccccccgcacagccaccc

SEQ ID NO: 3270187 - DNA, 17 bp, Homo sapiens
agcggccgcagagactg

SEQ ID NO: 3270188 - DNA, 15 bp, Homo sapiens
agcggcgaccgccct

SEQ ID NO: 3270189 - DNA, 15 bp, Homo sapiens
agcggcgccctggac

SEQ ID NO: 3270190 - DNA, 17 bp, Homo sapiens
agcggcgccctggactt

SEQ ID NO: 3270191 - DNA, 21 bp, Homo sapiens
agcggcgcgccctgcagaggg

SEQ ID NO: 3270192 - DNA, 15 bp, Homo sapiens
agcggctgttccccc

SEQ ID NO: 3270193 - DNA, 15 bp, Homo sapiens
agcgggacaaagcct

SEQ ID NO: 3270194 - DNA, 21 bp, Homo sapiens
agcgggaggcagagtttgcct

SEQ ID NO: 3270195 - DNA, 10 bp, Homo sapiens
agcgggcaca

SEQ ID NO: 3270196 - DNA, 11 bp, Homo sapiens
agcgggcacag

SEQ ID NO: 3270197 - DNA, 13 bp, Homo sapiens
agcgggcacaggg

SEQ ID NO: 3270198 - DNA, 15 bp, Homo sapiens
agcgggcacagggca

SEQ ID NO: 3270199 - DNA, 12 bp, Homo sapiens
agcgggccaggc

SEQ ID NO: 3270200 - DNA, 13 bp, Homo sapiens
agcgggccaggcc

SEQ ID NO: 3270201 - DNA, 22 bp, Homo sapiens
agcgggctaacgggaggctggg

SEQ ID NO: 3270202 - DNA, 12 bp, Homo sapiens
agctgaggcagg

SEQ ID NO: 3270203 - DNA, 18 bp, Homo sapiens
agctgaggtctcttgagg

SEQ ID NO: 3270204 - DNA, 21 bp, Homo sapiens
agctgaggtctcttgagggag

SEQ ID NO: 3270205 - DNA, 17 bp, Homo sapiens
agctgagtggccagcca

SEQ ID NO: 3270206 - DNA, 14 bp, Homo sapiens
agctgagtttccta

SEQ ID NO: 3270207 - DNA, 21 bp, Homo sapiens
agctgagtttcctatgggaac

SEQ ID NO: 3270208 - DNA, 20 bp, Homo sapiens
agctgatacttcatttaaaa

SEQ ID NO: 3270209 - DNA, 21 bp, Homo sapiens
agctgatacttcatttaaaaa

SEQ ID NO: 3270210 - DNA, 20 bp, Homo sapiens
agctgatactttgacagtgt

SEQ ID NO: 3270211 - DNA, 19 bp, Homo sapiens
agctgatataaattctgtg

SEQ ID NO: 3270212 - DNA, 12 bp, Homo sapiens
agctgatgaaac

SEQ ID NO: 3270213 - DNA, 23 bp, Homo sapiens
agctgatgaaactcacaaatgat

SEQ ID NO: 3270214 - DNA, 22 bp, Homo sapiens
agctgatgaaactcctgatttt

SEQ ID NO: 3270215 - DNA, 20 bp, Homo sapiens
agctgatgatgtctcttgta

SEQ ID NO: 3270216 - DNA, 20 bp, Homo sapiens
agctgatgttggaagagaaa

SEQ ID NO: 3270217 - DNA, 18 bp, Homo sapiens
agctgattactgtcaata

SEQ ID NO: 3270218 - DNA, 22 bp, Homo sapiens
agctgattactgtcaataaaca

SEQ ID NO: 3270219 - DNA, 19 bp, Homo sapiens
agctgatttccaggcccct

SEQ ID NO: 3270220 - DNA, 23 bp, Homo sapiens
agctgatttccaggcccctgagg

SEQ ID NO: 3270221 - DNA, 20 bp, Homo sapiens
agctgattttaacaataact

SEQ ID NO: 3270222 - DNA, 16 bp, Homo sapiens
agctgcaaaaataatc

SEQ ID NO: 3270223 - DNA, 18 bp, Homo sapiens
agctgcaaaaataatcat

SEQ ID NO: 3270224 - DNA, 15 bp, Homo sapiens
agctgcaccagagca

SEQ ID NO: 3270225 - DNA, 16 bp, Homo sapiens
agctgcacctgccagc

SEQ ID NO: 3270226 - DNA, 23 bp, Homo sapiens
agctgcacttggcctcagctggc

SEQ ID NO: 3270227 - DNA, 16 bp, Homo sapiens
agctgcagagatttct

SEQ ID NO: 3270228 - DNA, 14 bp, Homo sapiens
agctgcagctgggc

SEQ ID NO: 3270229 - DNA, 17 bp, Homo sapiens
agctgcagctgggcccc

SEQ ID NO: 3270230 - DNA, 19 bp, Homo sapiens
agctgcagctgggccccat

SEQ ID NO: 3270231 - DNA, 21 bp, Homo sapiens
agctgcagctgggccccatgc

SEQ ID NO: 3270232 - DNA, 11 bp, Homo sapiens
agctgcagctt

SEQ ID NO: 3270233 - DNA, 13 bp, Homo sapiens
agctgcagcttgg

SEQ ID NO: 3270234 - DNA, 17 bp, Homo sapiens
agctgcatttaaatcaa

SEQ ID NO: 3270235 - DNA, 14 bp, Homo sapiens
agctgccaagagtg

SEQ ID NO: 3270236 - DNA, 13 bp, Homo sapiens
agctgccacagag

SEQ ID NO: 3270237 - DNA, 14 bp, Homo sapiens
agctgccagcccag

SEQ ID NO: 3270238 - DNA, 20 bp, Homo sapiens
agctgccagcccagaacacc

SEQ ID NO: 3270239 - DNA, 13 bp, Homo sapiens
agctgccagtgct

SEQ ID NO: 3270240 - DNA, 19 bp, Homo sapiens
agctgccagtgctggtcac

SEQ ID NO: 3270241 - DNA, 16 bp, Homo sapiens
agctgccccagccaga

SEQ ID NO: 3270242 - DNA, 13 bp, Homo sapiens
agctgccgaccag

SEQ ID NO: 3270243 - DNA, 15 bp, Homo sapiens
agctgcctctgctcc

SEQ ID NO: 3270244 - DNA, 22 bp, Homo sapiens
agctgcctgaaacagccatgtc

SEQ ID NO: 3270245 - DNA, 18 bp, Homo sapiens
agctgcctgcttggcccg

SEQ ID NO: 3270246 - DNA, 19 bp, Homo sapiens
agctgcctgcttggcccgg

SEQ ID NO: 3270247 - DNA, 12 bp, Homo sapiens
agctgcctggag

SEQ ID NO: 3270248 - DNA, 13 bp, Homo sapiens
agctgcctggaga

SEQ ID NO: 3270249 - DNA, 19 bp, Homo sapiens
agctgcctggagagggtct

SEQ ID NO: 3270250 - DNA, 10 bp, Homo sapiens
agctgcctgt

SEQ ID NO: 3270251 - DNA, 14 bp, Homo sapiens
agctgcctgtagtt

SEQ ID NO: 3270252 - DNA, 15 bp, Homo sapiens
agctgcctgtagtta

SEQ ID NO: 3270253 - DNA, 18 bp, Homo sapiens
agctgcctgtagttagga

SEQ ID NO: 3270254 - DNA, 20 bp, Homo sapiens
agctgcctgtagttaggaaa

SEQ ID NO: 3270255 - DNA, 22 bp, Homo sapiens
agctgcctgtagttaggaaata

SEQ ID NO: 3270256 - DNA, 18 bp, Homo sapiens
agctgcctgtgcctgcca

SEQ ID NO: 3270257 - DNA, 20 bp, Homo sapiens
agctgcctgtgcctgccatg

SEQ ID NO: 3270258 - DNA, 24 bp, Homo sapiens
agctgcctgtgcctgccatgggcc

SEQ ID NO: 3270259 - DNA, 13 bp, Homo sapiens
agctgcctgttca

SEQ ID NO: 3270260 - DNA, 16 bp, Homo sapiens
agctgcctgttcagct

SEQ ID NO: 3270261 - DNA, 19 bp, Homo sapiens
agctgcctgttcagctcca

SEQ ID NO: 3270262 - DNA, 20 bp, Homo sapiens
agctgcctgttcagctccag

SEQ ID NO: 3270263 - DNA, 18 bp, Homo sapiens
agctgccttccctagctt

SEQ ID NO: 3270264 - DNA, 19 bp, Homo sapiens
agctgccttccctagcttt

SEQ ID NO: 3270265 - DNA, 14 bp, Homo sapiens
agctgccttggctc

SEQ ID NO: 3270266 - DNA, 19 bp, Homo sapiens
agctgccttggctcagaca

SEQ ID NO: 3270267 - DNA, 14 bp, Homo sapiens
agctgcgggtctga

SEQ ID NO: 3270268 - DNA, 18 bp, Homo sapiens
agctgcggtccacccagg

SEQ ID NO: 3270269 - DNA, 19 bp, Homo sapiens
agctgctatccccatctcc

SEQ ID NO: 3270270 - DNA, 21 bp, Homo sapiens
agctgctatttattttcctaa

SEQ ID NO: 3270271 - DNA, 14 bp, Homo sapiens
agctgctcagaatt

SEQ ID NO: 3270272 - DNA, 16 bp, Homo sapiens
agctgctcagaattca

SEQ ID NO: 3270273 - DNA, 16 bp, Homo sapiens
agctgctccaggcctg

SEQ ID NO: 3270274 - DNA, 18 bp, Homo sapiens
agctgctccaggcctgca

SEQ ID NO: 3270275 - DNA, 14 bp, Homo sapiens
agctgctctattgt

SEQ ID NO: 3270276 - DNA, 12 bp, Homo sapiens
agctgctctgag

SEQ ID NO: 3270277 - DNA, 17 bp, Homo sapiens
agctgctctgccccttg

SEQ ID NO: 3270278 - DNA, 21 bp, Homo sapiens
agctgctctgccccttgggca

SEQ ID NO: 3270279 - DNA, 24 bp, Homo sapiens
agctgcttttgtctatgggactca

SEQ ID NO: 3270280 - DNA, 14 bp, Homo sapiens
agctggaacatttg

SEQ ID NO: 3270281 - DNA, 19 bp, Homo sapiens
agctggaacatttgatatt

SEQ ID NO: 3270282 - DNA, 16 bp, Homo sapiens
agctggaaggcagggc

SEQ ID NO: 3270283 - DNA, 20 bp, Homo sapiens
agctggaagtctacctgctg

SEQ ID NO: 3270284 - DNA, 21 bp, Homo sapiens
agctggaagtctacctgctgg

SEQ ID NO: 3270285 - DNA, 15 bp, Homo sapiens
agctggactacccac

SEQ ID NO: 3270286 - DNA, 11 bp, Homo sapiens
agctggacttc

SEQ ID NO: 3270287 - DNA, 16 bp, Homo sapiens
agctggacttctgtgg

SEQ ID NO: 3270288 - DNA, 21 bp, Homo sapiens
agctggacttctgtgggcccc

SEQ ID NO: 3270289 - DNA, 15 bp, Homo sapiens
agctggagaagaccc

SEQ ID NO: 3270290 - DNA, 21 bp, Homo sapiens
agctggaggctccaggactcc

SEQ ID NO: 3270291 - DNA, 22 bp, Homo sapiens
agctggaggctccaggactcca

SEQ ID NO: 3270292 - DNA, 13 bp, Homo sapiens
agctggcaggaca

SEQ ID NO: 3270293 - DNA, 17 bp, Homo sapiens
agctggccctgcctcct

SEQ ID NO: 3270294 - DNA, 18 bp, Homo sapiens
agctggccctgcctcctg

SEQ ID NO: 3270295 - DNA, 16 bp, Homo sapiens
agctggcctctctagc

SEQ ID NO: 3270296 - DNA, 20 bp, Homo sapiens
agctggctctgagcgcctcc

SEQ ID NO: 3270297 - DNA, 20 bp, Homo sapiens
agctggctctgtgagggtgc

SEQ ID NO: 3270298 - DNA, 21 bp, Homo sapiens
agctggctctgtgagggtgct

SEQ ID NO: 3270299 - DNA, 13 bp, Homo sapiens
agctgggaggcaa

SEQ ID NO: 3270300 - DNA, 10 bp, Homo sapiens
agctgggcaa

SEQ ID NO: 3270301 - DNA, 17 bp, Homo sapiens
agctgggcatggtacca

SEQ ID NO: 3270302 - DNA, 10 bp, Homo sapiens
agctgggccc

SEQ ID NO: 3270303 - DNA, 13 bp, Homo sapiens
agctgggcccagc

SEQ ID NO: 3270304 - DNA, 14 bp, Homo sapiens
agctgggcccagcc

SEQ ID NO: 3270305 - DNA, 15 bp, Homo sapiens
agctgggcccagccc

SEQ ID NO: 3270306 - DNA, 16 bp, Homo sapiens
agctgggcccagcccc

SEQ ID NO: 3270307 - DNA, 16 bp, Homo sapiens
agctgggccccatgct

SEQ ID NO: 3270308 - DNA, 17 bp, Homo sapiens
agctgggctaagtaaat

SEQ ID NO: 3270309 - DNA, 13 bp, Homo sapiens
agctggggctgaa

SEQ ID NO: 3270310 - DNA, 22 bp, Homo sapiens
agctggggcttcaccagtctgt

SEQ ID NO: 3270311 - DNA, 23 bp, Homo sapiens
agctgggtacggtggcacgtgcc

SEQ ID NO: 3270312 - DNA, 15 bp, Homo sapiens
agctgggtggcctgt

SEQ ID NO: 3270313 - DNA, 20 bp, Homo sapiens
agctgggtggggacagtgat

SEQ ID NO: 3270314 - DNA, 17 bp, Homo sapiens
agctgggtgtcaagagg

SEQ ID NO: 3270315 - DNA, 19 bp, Homo sapiens
agctggtagttagtagcat

SEQ ID NO: 3270316 - DNA, 17 bp, Homo sapiens
agctggtcccactcagt

SEQ ID NO: 3270317 - DNA, 21 bp, Homo sapiens
agctggtcccactcagtccat

SEQ ID NO: 3270318 - DNA, 14 bp, Homo sapiens
agctggtgcccgga

SEQ ID NO: 3270319 - DNA, 12 bp, Homo sapiens
agctggtggttt

SEQ ID NO: 3270320 - DNA, 14 bp, Homo sapiens
agctggtggtttca

SEQ ID NO: 3270321 - DNA, 16 bp, Homo sapiens
aggaatctttaagcag

SEQ ID NO: 3270322 - DNA, 15 bp, Homo sapiens
aggaatgaagaactg

SEQ ID NO: 3270323 - DNA, 22 bp, Homo sapiens
aggaatgaagaactgttgccta

SEQ ID NO: 3270324 - DNA, 22 bp, Homo sapiens
aggaatgcacaaattgaaaaca

SEQ ID NO: 3270325 - DNA, 15 bp, Homo sapiens
aggaatgcctgtgcc

SEQ ID NO: 3270326 - DNA, 16 bp, Homo sapiens
aggaatgcctgtgcca

SEQ ID NO: 3270327 - DNA, 16 bp, Homo sapiens
aggaatgctctgtgcc

SEQ ID NO: 3270328 - DNA, 17 bp, Homo sapiens
aggaatgctctgtgcca

SEQ ID NO: 3270329 - DNA, 23 bp, Homo sapiens
aggaatggctgcacctttttgca

SEQ ID NO: 3270330 - DNA, 13 bp, Homo sapiens
aggaatgtctgga

SEQ ID NO: 3270331 - DNA, 15 bp, Homo sapiens
aggaatgtctggagt

SEQ ID NO: 3270332 - DNA, 16 bp, Homo sapiens
aggaatgtgtggcctg

SEQ ID NO: 3270333 - DNA, 17 bp, Homo sapiens
aggaattaagttatctt

SEQ ID NO: 3270334 - DNA, 22 bp, Homo sapiens
aggaattcccagcccaaagctg

SEQ ID NO: 3270335 - DNA, 23 bp, Homo sapiens
aggaattcccagcccaaagctgt

SEQ ID NO: 3270336 - DNA, 13 bp, Homo sapiens
aggaatttaaaat

SEQ ID NO: 3270337 - DNA, 18 bp, Homo sapiens
aggaatttcacctgtaaa

SEQ ID NO: 3270338 - DNA, 15 bp, Homo sapiens
aggaatttcttaact

SEQ ID NO: 3270339 - DNA, 19 bp, Homo sapiens
aggaatttgaagctgcagt

SEQ ID NO: 3270340 - DNA, 18 bp, Homo sapiens
aggacaaaaatgaactga

SEQ ID NO: 3270341 - DNA, 13 bp, Homo sapiens
aggacaaaacttc

SEQ ID NO: 3270342 - DNA, 23 bp, Homo sapiens
aggacaaaacttcttgtcagaca

SEQ ID NO: 3270343 - DNA, 13 bp, Homo sapiens
aggacaacacttc

SEQ ID NO: 3270344 - DNA, 18 bp, Homo sapiens
aggacaacacttcatttt

SEQ ID NO: 3270345 - DNA, 14 bp, Homo sapiens
aggacaaccattcc

SEQ ID NO: 3270346 - DNA, 18 bp, Homo sapiens
aggacaatcagtcccctc

SEQ ID NO: 3270347 - DNA, 20 bp, Homo sapiens
aggacacaccccacacccca

SEQ ID NO: 3270348 - DNA, 22 bp, Homo sapiens
aggacacaccccacaccccagc

SEQ ID NO: 3270349 - DNA, 19 bp, Homo sapiens
aggacacatcccggcctct

SEQ ID NO: 3270350 - DNA, 20 bp, Homo sapiens
aggacacatcccggcctctt

SEQ ID NO: 3270351 - DNA, 21 bp, Homo sapiens
aggacacatcccggcctcttc

SEQ ID NO: 3270352 - DNA, 15 bp, Homo sapiens
aggacaccacaccca

SEQ ID NO: 3270353 - DNA, 17 bp, Homo sapiens
aggacaccacacccagc

SEQ ID NO: 3270354 - DNA, 20 bp, Homo sapiens
aggacaccacacccagcctc

SEQ ID NO: 3270355 - DNA, 16 bp, Homo sapiens
aggacaccagtgaaag

SEQ ID NO: 3270356 - DNA, 18 bp, Homo sapiens
aggacactaaccacgctg

SEQ ID NO: 3270357 - DNA, 23 bp, Homo sapiens
aggacagaaaggagagtggccat

SEQ ID NO: 3270358 - DNA, 22 bp, Homo sapiens
aggacagactggccgggcaggc

SEQ ID NO: 3270359 - DNA, 17 bp, Homo sapiens
aggacagagcaggggct

SEQ ID NO: 3270360 - DNA, 21 bp, Homo sapiens
aggacagagttcacaggaggc

SEQ ID NO: 3270361 - DNA, 18 bp, Homo sapiens
aggacaggaccctcagga

SEQ ID NO: 3270362 - DNA, 19 bp, Homo sapiens
aggacaggaccctcaggaa

SEQ ID NO: 3270363 - DNA, 21 bp, Homo sapiens
aggacaggaggaggagatggc

SEQ ID NO: 3270364 - DNA, 12 bp, Homo sapiens
aggacaggaggc

SEQ ID NO: 3270365 - DNA, 16 bp, Homo sapiens
aggacaggaggcggcc

SEQ ID NO: 3270366 - DNA, 20 bp, Homo sapiens
aggacaggaggcggcccggc

SEQ ID NO: 3270367 - DNA, 20 bp, Homo sapiens
aggacaggcgggaggaggtg

SEQ ID NO: 3270368 - DNA, 13 bp, Homo sapiens
aggacagtctgga

SEQ ID NO: 3270369 - DNA, 14 bp, Homo sapiens
aggacagtctggag

SEQ ID NO: 3270370 - DNA, 16 bp, Homo sapiens
aggacagtctggagaa

SEQ ID NO: 3270371 - DNA, 17 bp, Homo sapiens
aggacagtctggagaag

SEQ ID NO: 3270372 - DNA, 18 bp, Homo sapiens
aggacagtctggagaagg

SEQ ID NO: 3270373 - DNA, 19 bp, Homo sapiens
aggacagtctggagaaggt

SEQ ID NO: 3270374 - DNA, 15 bp, Homo sapiens
aggacagtgcttcag

SEQ ID NO: 3270375 - DNA, 16 bp, Homo sapiens
aggacagtgcttcagc

SEQ ID NO: 3270376 - DNA, 22 bp, Homo sapiens
aggacagtgcttcagcctgagg

SEQ ID NO: 3270377 - DNA, 16 bp, Homo sapiens
aggacatgcaataaaa

SEQ ID NO: 3270378 - DNA, 17 bp, Homo sapiens
aggacattgcggacagc

SEQ ID NO: 3270379 - DNA, 19 bp, Homo sapiens
aggacattgcggacagcca

SEQ ID NO: 3270380 - DNA, 15 bp, Homo sapiens
aggacatttcccagg

SEQ ID NO: 3270381 - DNA, 19 bp, Homo sapiens
aggaccaagcatcttgggg

SEQ ID NO: 3270382 - DNA, 23 bp, Homo sapiens
aggaccaataaaatttctaagag

SEQ ID NO: 3270383 - DNA, 17 bp, Homo sapiens
aggaccacacagtcccc

SEQ ID NO: 3270384 - DNA, 22 bp, Homo sapiens
aggaccacacagtccccagact

SEQ ID NO: 3270385 - DNA, 17 bp, Homo sapiens
aggaccactcagcccct

SEQ ID NO: 3270386 - DNA, 18 bp, Homo sapiens
aggaccactcagccccta

SEQ ID NO: 3270387 - DNA, 16 bp, Homo sapiens
aggaccaggactccct

SEQ ID NO: 3270388 - DNA, 16 bp, Homo sapiens
aggacccaggccctcc

SEQ ID NO: 3270389 - DNA, 18 bp, Homo sapiens
aggacccggaggggcctg

SEQ ID NO: 3270390 - DNA, 22 bp, Homo sapiens
aggacccggaggggcctggcag

SEQ ID NO: 3270391 - DNA, 13 bp, Homo sapiens
aggaccctcagga

SEQ ID NO: 3270392 - DNA, 14 bp, Homo sapiens
aggaccctgcacct

SEQ ID NO: 3270393 - DNA, 19 bp, Homo sapiens
aggacctcctcttccccct

SEQ ID NO: 3270394 - DNA, 12 bp, Homo sapiens
aggacctgcccc

SEQ ID NO: 3270395 - DNA, 19 bp, Homo sapiens
aggacgctctctggccttc

SEQ ID NO: 3270396 - DNA, 20 bp, Homo sapiens
aggacgctctctggccttcg

SEQ ID NO: 3270397 - DNA, 13 bp, Homo sapiens
aggacgcttctga

SEQ ID NO: 3270398 - DNA, 23 bp, Homo sapiens
aggacggagtggggggacagaga

SEQ ID NO: 3270399 - DNA, 19 bp, Homo sapiens
aggacgtcctatctccccc

SEQ ID NO: 3270400 - DNA, 22 bp, Homo sapiens
aggacgtcctatctcccccaac

SEQ ID NO: 3270401 - DNA, 19 bp, Homo sapiens
aggacgtgtgtaaatatgt

SEQ ID NO: 3270402 - DNA, 15 bp, Homo sapiens
aggacgttggcctca

SEQ ID NO: 3270403 - DNA, 13 bp, Homo sapiens
aggactagatact

SEQ ID NO: 3270404 - DNA, 18 bp, Homo sapiens
aggactagatactacttt

SEQ ID NO: 3270405 - DNA, 21 bp, Homo sapiens
aggactatattaatcaccttc

SEQ ID NO: 3270406 - DNA, 22 bp, Homo sapiens
aggactcacaggttggaagaga

SEQ ID NO: 3270407 - DNA, 19 bp, Homo sapiens
aggactccactggacagac

SEQ ID NO: 3270408 - DNA, 15 bp, Homo sapiens
aggactccaggccca

SEQ ID NO: 3270409 - DNA, 12 bp, Homo sapiens
aggactccctcc

SEQ ID NO: 3270410 - DNA, 19 bp, Homo sapiens
aggactccctcctcacctc

SEQ ID NO: 3270411 - DNA, 15 bp, Homo sapiens
aggactcgcttgtaa

SEQ ID NO: 3270412 - DNA, 20 bp, Homo sapiens
aggactcgcttgtaaatacc

SEQ ID NO: 3270413 - DNA, 14 bp, Homo sapiens
aggactctgaggct

SEQ ID NO: 3270414 - DNA, 24 bp, Homo sapiens
aggactctgcaagtgtctggagcg

SEQ ID NO: 3270415 - DNA, 12 bp, Homo sapiens
aggactctgcct

SEQ ID NO: 3270416 - DNA, 17 bp, Homo sapiens
aggactctgcctcctct

SEQ ID NO: 3270417 - DNA, 15 bp, Homo sapiens
aggactgagactggc

SEQ ID NO: 3270418 - DNA, 16 bp, Homo sapiens
aggactgagccccgca

SEQ ID NO: 3270419 - DNA, 22 bp, Homo sapiens
aggactgagtcccctccaggaa

SEQ ID NO: 3270420 - DNA, 21 bp, Homo sapiens
aggactgcacagcgtcctgtc

SEQ ID NO: 3270421 - DNA, 23 bp, Homo sapiens
aggactgcacagcgtcctgtcca

SEQ ID NO: 3270422 - DNA, 22 bp, Homo sapiens
aggactggagaccgcttcaccc

SEQ ID NO: 3270423 - DNA, 12 bp, Homo sapiens
aggactgtataa

SEQ ID NO: 3270424 - DNA, 18 bp, Homo sapiens
aggactgtataggtagat

SEQ ID NO: 3270425 - DNA, 14 bp, Homo sapiens
aggactgtggctgc

SEQ ID NO: 3270426 - DNA, 17 bp, Homo sapiens
aggactgtggctgcagg

SEQ ID NO: 3270427 - DNA, 13 bp, Homo sapiens
aggactgttcttt

SEQ ID NO: 3270428 - DNA, 22 bp, Homo sapiens
aggactgttctttgctgttgtt

SEQ ID NO: 3270429 - DNA, 17 bp, Homo sapiens
aggacttaacggctcca

SEQ ID NO: 3270430 - DNA, 20 bp, Homo sapiens
aggacttagccgactgcgct

SEQ ID NO: 3270431 - DNA, 19 bp, Homo sapiens
aggacttcaggaacaagta

SEQ ID NO: 3270432 - DNA, 13 bp, Homo sapiens
aggacttctgcag

SEQ ID NO: 3270433 - DNA, 19 bp, Homo sapiens
aggacttgaaagcatccat

SEQ ID NO: 3270434 - DNA, 21 bp, Homo sapiens
aggacttgaaagcatccatgt

SEQ ID NO: 3270435 - DNA, 17 bp, Homo sapiens
aggacttgctaaagcac

SEQ ID NO: 3270436 - DNA, 23 bp, Homo sapiens
aggacttggagagaatcatgctg

SEQ ID NO: 3270437 - DNA, 16 bp, Homo sapiens
aggacttggggtcagg

SEQ ID NO: 3270438 - DNA, 14 bp, Homo sapiens
aggcgtgactcagc

SEQ ID NO: 3270439 - DNA, 16 bp, Homo sapiens
aggcgttggtgccact

SEQ ID NO: 3270440 - DNA, 18 bp, Homo sapiens
aggctaaaaggtcttgca

SEQ ID NO: 3270441 - DNA, 21 bp, Homo sapiens
aggctaagttcagttctgttt

SEQ ID NO: 3270442 - DNA, 22 bp, Homo sapiens
aggctaccagaagaggggcagc

SEQ ID NO: 3270443 - DNA, 13 bp, Homo sapiens
aggctagatcccc

SEQ ID NO: 3270444 - DNA, 18 bp, Homo sapiens
aggctagcttctgctttt

SEQ ID NO: 3270445 - DNA, 14 bp, Homo sapiens
aggctaggacgttg

SEQ ID NO: 3270446 - DNA, 19 bp, Homo sapiens
aggctaggacgttggcctc

SEQ ID NO: 3270447 - DNA, 22 bp, Homo sapiens
aggctagtccggacccacctca

SEQ ID NO: 3270448 - DNA, 20 bp, Homo sapiens
aggctatcaacatgttattc

SEQ ID NO: 3270449 - DNA, 18 bp, Homo sapiens
aggctatggttgccaccc

SEQ ID NO: 3270450 - DNA, 19 bp, Homo sapiens
aggctatggttgccacccc

SEQ ID NO: 3270451 - DNA, 16 bp, Homo sapiens
aggctattattttcac

SEQ ID NO: 3270452 - DNA, 14 bp, Homo sapiens
aggctatttgttca

SEQ ID NO: 3270453 - DNA, 17 bp, Homo sapiens
aggctcaacaataaaac

SEQ ID NO: 3270454 - DNA, 13 bp, Homo sapiens
aggctcactgcca

SEQ ID NO: 3270455 - DNA, 13 bp, Homo sapiens
aggctcaggccat

SEQ ID NO: 3270456 - DNA, 21 bp, Homo sapiens
aggctccacttggtctgtgag

SEQ ID NO: 3270457 - DNA, 12 bp, Homo sapiens
aggctccaggac

SEQ ID NO: 3270458 - DNA, 15 bp, Homo sapiens
aggctccaggactcc

SEQ ID NO: 3270459 - DNA, 16 bp, Homo sapiens
aggctccaggactcca

SEQ ID NO: 3270460 - DNA, 16 bp, Homo sapiens
aggctccccagggctc

SEQ ID NO: 3270461 - DNA, 20 bp, Homo sapiens
aggctcccgaggggaagggg

SEQ ID NO: 3270462 - DNA, 13 bp, Homo sapiens
aggctccgccctt

SEQ ID NO: 3270463 - DNA, 15 bp, Homo sapiens
aggctccgcccttag

SEQ ID NO: 3270464 - DNA, 23 bp, Homo sapiens
aggctccgggctttcccccaggc

SEQ ID NO: 3270465 - DNA, 12 bp, Homo sapiens
aggctcctcctt

SEQ ID NO: 3270466 - DNA, 14 bp, Homo sapiens
aggctcctccttgc

SEQ ID NO: 3270467 - DNA, 21 bp, Homo sapiens
aggctcctccttgcccagact

SEQ ID NO: 3270468 - DNA, 21 bp, Homo sapiens
aggctcctgccagtgtggaac

SEQ ID NO: 3270469 - DNA, 19 bp, Homo sapiens
aggctctgacccagtgaga

SEQ ID NO: 3270470 - DNA, 21 bp, Homo sapiens
aggctctgagagtctagattc

SEQ ID NO: 3270471 - DNA, 22 bp, Homo sapiens
aggctctgagagtctagattct

SEQ ID NO: 3270472 - DNA, 22 bp, Homo sapiens
aggctctgcacagacaagcagc

SEQ ID NO: 3270473 - DNA, 23 bp, Homo sapiens
aggctctgcacagacaagcagcc

SEQ ID NO: 3270474 - DNA, 15 bp, Homo sapiens
aggctctgcacagat

SEQ ID NO: 3270475 - DNA, 14 bp, Homo sapiens
aggctctgggctca

SEQ ID NO: 3270476 - DNA, 15 bp, Homo sapiens
aggctctgggctcag

SEQ ID NO: 3270477 - DNA, 19 bp, Homo sapiens
aggctctgggctcagggct

SEQ ID NO: 3270478 - DNA, 21 bp, Homo sapiens
aggctctgggctcagggctgg

SEQ ID NO: 3270479 - DNA, 22 bp, Homo sapiens
aggctcttcctggacctgagtc

SEQ ID NO: 3270480 - DNA, 17 bp, Homo sapiens
aggctgaattacagtga

SEQ ID NO: 3270481 - DNA, 15 bp, Homo sapiens
aggctgaccaagaga

SEQ ID NO: 3270482 - DNA, 13 bp, Homo sapiens
aggctgagaagga

SEQ ID NO: 3270483 - DNA, 15 bp, Homo sapiens
aggctgaggcctgga

SEQ ID NO: 3270484 - DNA, 17 bp, Homo sapiens
aggctgaggcctggact

SEQ ID NO: 3270485 - DNA, 21 bp, Homo sapiens
aggctgaggcgggtggatcac

SEQ ID NO: 3270486 - DNA, 17 bp, Homo sapiens
aggctgagttttctctt

SEQ ID NO: 3270487 - DNA, 11 bp, Homo sapiens
aggctgcactg

SEQ ID NO: 3270488 - DNA, 13 bp, Homo sapiens
aggctgcactgca

SEQ ID NO: 3270489 - DNA, 16 bp, Homo sapiens
aggctgcactgcagtg

SEQ ID NO: 3270490 - DNA, 19 bp, Homo sapiens
aggctgcactgcagtgatg

SEQ ID NO: 3270491 - DNA, 21 bp, Homo sapiens
aggctgcactgcagtgatggc

SEQ ID NO: 3270492 - DNA, 17 bp, Homo sapiens
aggctgccaaggccaga

SEQ ID NO: 3270493 - DNA, 17 bp, Homo sapiens
aggctgcccccaacact

SEQ ID NO: 3270494 - DNA, 19 bp, Homo sapiens
aggctgcccccaacactcc

SEQ ID NO: 3270495 - DNA, 20 bp, Homo sapiens
aggctgcccccaacactcca

SEQ ID NO: 3270496 - DNA, 21 bp, Homo sapiens
aggctgcccccaacactccag

SEQ ID NO: 3270497 - DNA, 23 bp, Homo sapiens
aggctgcccccaacactccaggc

SEQ ID NO: 3270498 - DNA, 18 bp, Homo sapiens
aggctgccgaggaccctc

SEQ ID NO: 3270499 - DNA, 18 bp, Homo sapiens
aggctgcctctcccatca

SEQ ID NO: 3270500 - DNA, 22 bp, Homo sapiens
aggctgcttagaatccaaactt

SEQ ID NO: 3270501 - DNA, 13 bp, Homo sapiens
aggctgcttggga

SEQ ID NO: 3270502 - DNA, 17 bp, Homo sapiens
aggctggacatgctgac

SEQ ID NO: 3270503 - DNA, 20 bp, Homo sapiens
aggctggagtgcagtggcac

SEQ ID NO: 3270504 - DNA, 17 bp, Homo sapiens
aggctggcagctctcca

SEQ ID NO: 3270505 - DNA, 19 bp, Homo sapiens
aggctggcagctctccagt

SEQ ID NO: 3270506 - DNA, 20 bp, Homo sapiens
aggctggcagctctccagtc

SEQ ID NO: 3270507 - DNA, 21 bp, Homo sapiens
aggctggcagctctccagtca

SEQ ID NO: 3270508 - DNA, 15 bp, Homo sapiens
aggctggcaggtatg

SEQ ID NO: 3270509 - DNA, 22 bp, Homo sapiens
aggctggccagcaaggcaggtt

SEQ ID NO: 3270510 - DNA, 18 bp, Homo sapiens
aggctggcgtgcagtggt

SEQ ID NO: 3270511 - DNA, 20 bp, Homo sapiens
aggctggcgtgcagtggtgc

SEQ ID NO: 3270512 - DNA, 15 bp, Homo sapiens
aggctggctgagtgg

SEQ ID NO: 3270513 - DNA, 18 bp, Homo sapiens
aggctggctgagtggaat

SEQ ID NO: 3270514 - DNA, 13 bp, Homo sapiens
aggctggctggcc

SEQ ID NO: 3270515 - DNA, 16 bp, Homo sapiens
aggctggctgtgtata

SEQ ID NO: 3270516 - DNA, 18 bp, Homo sapiens
aggctgggaactcatctg

SEQ ID NO: 3270517 - DNA, 22 bp, Homo sapiens
aggctgggagcatagcagaggg

SEQ ID NO: 3270518 - DNA, 12 bp, Homo sapiens
aggctgggcccc

SEQ ID NO: 3270519 - DNA, 14 bp, Homo sapiens
aggctgggcttcag

SEQ ID NO: 3270520 - DNA, 20 bp, Homo sapiens
aggctggggcggggcccagg

SEQ ID NO: 3270521 - DNA, 21 bp, Homo sapiens
aggctggggcggggcccagga

SEQ ID NO: 3270522 - DNA, 23 bp, Homo sapiens
aggctgggtgaccgactacccca

SEQ ID NO: 3270523 - DNA, 12 bp, Homo sapiens
aggctggtgcca

SEQ ID NO: 3270524 - DNA, 18 bp, Homo sapiens
aggctgtatcccatgagc

SEQ ID NO: 3270525 - DNA, 22 bp, Homo sapiens
aggctgtatcccatgagcctca

SEQ ID NO: 3270526 - DNA, 15 bp, Homo sapiens
aggctgtcctgtaca

SEQ ID NO: 3270527 - DNA, 16 bp, Homo sapiens
aggctgtcctgtacat

SEQ ID NO: 3270528 - DNA, 12 bp, Homo sapiens
aggctgtctggg

SEQ ID NO: 3270529 - DNA, 14 bp, Homo sapiens
aggcttaaacccat

SEQ ID NO: 3270530 - DNA, 14 bp, Homo sapiens
aggcttaagaactg

SEQ ID NO: 3270531 - DNA, 23 bp, Homo sapiens
aggcttaagaactgcttcatgtg

SEQ ID NO: 3270532 - DNA, 17 bp, Homo sapiens
aggcttaataaaaatga

SEQ ID NO: 3270533 - DNA, 21 bp, Homo sapiens
aggcttaataaaaatgacaga

SEQ ID NO: 3270534 - DNA, 14 bp, Homo sapiens
aggcttagtttgtg

SEQ ID NO: 3270535 - DNA, 15 bp, Homo sapiens
aggcttagtttgtgt

SEQ ID NO: 3270536 - DNA, 14 bp, Homo sapiens
aggcttatgagatc

SEQ ID NO: 3270537 - DNA, 19 bp, Homo sapiens
aggcttcaaaatgttatct

SEQ ID NO: 3270538 - DNA, 14 bp, Homo sapiens
aggcttccaggctc

SEQ ID NO: 3270539 - DNA, 18 bp, Homo sapiens
aggcttccaggctcttcc

SEQ ID NO: 3270540 - DNA, 20 bp, Homo sapiens
aggcttccaggctcttcctg

SEQ ID NO: 3270541 - DNA, 22 bp, Homo sapiens
aggcttcctgcgtcctcctcac

SEQ ID NO: 3270542 - DNA, 23 bp, Homo sapiens
aggcttcggacagtgcccatgca

SEQ ID NO: 3270543 - DNA, 19 bp, Homo sapiens
aggcttctccgccagcctc

SEQ ID NO: 3270544 - DNA, 20 bp, Homo sapiens
aggcttctccgccagcctcc

SEQ ID NO: 3270545 - DNA, 13 bp, Homo sapiens
aggcttctccttc

SEQ ID NO: 3270546 - DNA, 18 bp, Homo sapiens
aggcttgcataataagct

SEQ ID NO: 3270547 - DNA, 16 bp, Homo sapiens
aggcttggtcccatcg

SEQ ID NO: 3270548 - DNA, 22 bp, Homo sapiens
aggcttgtttacctttctctct

SEQ ID NO: 3270549 - DNA, 23 bp, Homo sapiens
aggctttatgataatagattctc

SEQ ID NO: 3270550 - DNA, 13 bp, Homo sapiens
aggctttcatgtt

SEQ ID NO: 3270551 - DNA, 15 bp, Homo sapiens
aggctttcctgccct

SEQ ID NO: 3270552 - DNA, 13 bp, Homo sapiens
aggcttttaccat

SEQ ID NO: 3270553 - DNA, 18 bp, Homo sapiens
aggcttttcactgcctgt

SEQ ID NO: 3270554 - DNA, 22 bp, Homo sapiens
agggaaaagataaagaccagaa

SEQ ID NO: 3270555 - DNA, 13 bp, Homo sapiens
agggaaaggaaaa

SEQ ID NO: 3270556 - DNA, 22 bp, Homo sapiens
agggaaaggctctgaaagccag

SEQ ID NO: 3270557 - DNA, 16 bp, Homo sapiens
agggaaagggaagcac

SEQ ID NO: 3270558 - DNA, 17 bp, Homo sapiens
agggaaaggttttgtat

SEQ ID NO: 3270559 - DNA, 19 bp, Homo sapiens
agggaaaggttttgtattt

SEQ ID NO: 3270560 - DNA, 21 bp, Homo sapiens
agggaaaggttttgtattttt

SEQ ID NO: 3270561 - DNA, 19 bp, Homo sapiens
agggaacggggtccttcaa

SEQ ID NO: 3270562 - DNA, 16 bp, Homo sapiens
agggaagaaggggcca

SEQ ID NO: 3270563 - DNA, 16 bp, Homo sapiens
agggccaatccccagc

SEQ ID NO: 3270564 - DNA, 18 bp, Homo sapiens
agggccacatagatgctg

SEQ ID NO: 3270565 - DNA, 14 bp, Homo sapiens
agggccagaaggag

SEQ ID NO: 3270566 - DNA, 17 bp, Homo sapiens
agggccagactggaaga

SEQ ID NO: 3270567 - DNA, 12 bp, Homo sapiens
agggccagaggg

SEQ ID NO: 3270568 - DNA, 13 bp, Homo sapiens
agggccaggaagg

SEQ ID NO: 3270569 - DNA, 12 bp, Homo sapiens
agggccaggact

SEQ ID NO: 3270570 - DNA, 12 bp, Homo sapiens
agggccaggcag

SEQ ID NO: 3270571 - DNA, 22 bp, Homo sapiens
agggccaggcaggtgcctggac

SEQ ID NO: 3270572 - DNA, 16 bp, Homo sapiens
agggccagtcctgcct

SEQ ID NO: 3270573 - DNA, 18 bp, Homo sapiens
agggccagtcctgcctgg

SEQ ID NO: 3270574 - DNA, 21 bp, Homo sapiens
agggccagtcctgcctggcca

SEQ ID NO: 3270575 - DNA, 19 bp, Homo sapiens
agggccagtggggcctgtg

SEQ ID NO: 3270576 - DNA, 19 bp, Homo sapiens
agggccagttggtgttcct

SEQ ID NO: 3270577 - DNA, 15 bp, Homo sapiens
agggccatctgactg

SEQ ID NO: 3270578 - DNA, 22 bp, Homo sapiens
agggccatctgactgccaagcc

SEQ ID NO: 3270579 - DNA, 23 bp, Homo sapiens
agggccatctgactgccaagcca

SEQ ID NO: 3270580 - DNA, 18 bp, Homo sapiens
agggcccacccatgtcac

SEQ ID NO: 3270581 - DNA, 23 bp, Homo sapiens
agggcccacttgtatcctctggt

SEQ ID NO: 3270582 - DNA, 12 bp, Homo sapiens
agggcccagaga

SEQ ID NO: 3270583 - DNA, 11 bp, Homo sapiens
agggcccagcc

SEQ ID NO: 3270584 - DNA, 14 bp, Homo sapiens
agggcccagcccag

SEQ ID NO: 3270585 - DNA, 15 bp, Homo sapiens
agggcccagcccaga

SEQ ID NO: 3270586 - DNA, 17 bp, Homo sapiens
agggcccagcccagagc

SEQ ID NO: 3270587 - DNA, 14 bp, Homo sapiens
agggcccagctgta

SEQ ID NO: 3270588 - DNA, 14 bp, Homo sapiens
agggcccaggcagg

SEQ ID NO: 3270589 - DNA, 17 bp, Homo sapiens
agggcccaggcaggcca

SEQ ID NO: 3270590 - DNA, 17 bp, Homo sapiens
agggcccgcagtgctgg

SEQ ID NO: 3270591 - DNA, 16 bp, Homo sapiens
agggcccggccacacc

SEQ ID NO: 3270592 - DNA, 20 bp, Homo sapiens
agggcccggccacacccagc

SEQ ID NO: 3270593 - DNA, 13 bp, Homo sapiens
agggccctgcaga

SEQ ID NO: 3270594 - DNA, 11 bp, Homo sapiens
agggccctggc

SEQ ID NO: 3270595 - DNA, 17 bp, Homo sapiens
agggcccttggggctgg

SEQ ID NO: 3270596 - DNA, 18 bp, Homo sapiens
agggccgtaccccaccct

SEQ ID NO: 3270597 - DNA, 16 bp, Homo sapiens
agggcctactgccacc

SEQ ID NO: 3270598 - DNA, 19 bp, Homo sapiens
agggcctcccaccagagac

SEQ ID NO: 3270599 - DNA, 23 bp, Homo sapiens
agggcctgcttccccttcctaag

SEQ ID NO: 3270600 - DNA, 14 bp, Homo sapiens
agggcctggagccc

SEQ ID NO: 3270601 - DNA, 17 bp, Homo sapiens
agggcctggagccccat

SEQ ID NO: 3270602 - DNA, 21 bp, Homo sapiens
agggcctggagccccatcggc

SEQ ID NO: 3270603 - DNA, 19 bp, Homo sapiens
agggcctggcaggccagtg

SEQ ID NO: 3270604 - DNA, 16 bp, Homo sapiens
agggcctggggcctga

SEQ ID NO: 3270605 - DNA, 18 bp, Homo sapiens
agggcctggggcctgaga

SEQ ID NO: 3270606 - DNA, 21 bp, Homo sapiens
agggcctggggcctgagagaa

SEQ ID NO: 3270607 - DNA, 21 bp, Homo sapiens
aggggcatccaaggcaaacaa

SEQ ID NO: 3270608 - DNA, 15 bp, Homo sapiens
aggggcatctgcccc

SEQ ID NO: 3270609 - DNA, 17 bp, Homo sapiens
aggggcatctgcccctc

SEQ ID NO: 3270610 - DNA, 20 bp, Homo sapiens
aggggcatctgcccctcccc

SEQ ID NO: 3270611 - DNA, 15 bp, Homo sapiens
aggggccacctcctc

SEQ ID NO: 3270612 - DNA, 21 bp, Homo sapiens
aggggccacgtggatgggcaa

SEQ ID NO: 3270613 - DNA, 12 bp, Homo sapiens
aggggccaggcc

SEQ ID NO: 3270614 - DNA, 15 bp, Homo sapiens
aggggccaggcccag

SEQ ID NO: 3270615 - DNA, 16 bp, Homo sapiens
aggggccaggcccagg

SEQ ID NO: 3270616 - DNA, 20 bp, Homo sapiens
aggggccatcacaggatgcc

SEQ ID NO: 3270617 - DNA, 19 bp, Homo sapiens
aggggcccaagccccatct

SEQ ID NO: 3270618 - DNA, 20 bp, Homo sapiens
aggggccccagatctgcctg

SEQ ID NO: 3270619 - DNA, 21 bp, Homo sapiens
aggggccccagatctgcctgg

SEQ ID NO: 3270620 - DNA, 21 bp, Homo sapiens
aggggccccggggctggcaag

SEQ ID NO: 3270621 - DNA, 22 bp, Homo sapiens
aggggccccggggctggcaagc

SEQ ID NO: 3270622 - DNA, 16 bp, Homo sapiens
aggggcccctgcttct

SEQ ID NO: 3270623 - DNA, 21 bp, Homo sapiens
aggggcccctgcttctccagc

SEQ ID NO: 3270624 - DNA, 22 bp, Homo sapiens
aggggcccgggaactcctgcca

SEQ ID NO: 3270625 - DNA, 20 bp, Homo sapiens
aggggcccggtggcggcagg

SEQ ID NO: 3270626 - DNA, 22 bp, Homo sapiens
aggggccctttgcatagctctc

SEQ ID NO: 3270627 - DNA, 15 bp, Homo sapiens
aggggccggggaagc

SEQ ID NO: 3270628 - DNA, 21 bp, Homo sapiens
aggggcctggagatcctcctg

SEQ ID NO: 3270629 - DNA, 17 bp, Homo sapiens
aggggccttagggcact

SEQ ID NO: 3270630 - DNA, 19 bp, Homo sapiens
aggggccttagggcactgg

SEQ ID NO: 3270631 - DNA, 21 bp, Homo sapiens
aggggccttagggcactgggc

SEQ ID NO: 3270632 - DNA, 22 bp, Homo sapiens
aggggccttagggcactgggct

SEQ ID NO: 3270633 - DNA, 12 bp, Homo sapiens
aggggcgcggga

SEQ ID NO: 3270634 - DNA, 18 bp, Homo sapiens
aggggcgctggcccagcc

SEQ ID NO: 3270635 - DNA, 23 bp, Homo sapiens
aggggcgctggcccagccggcct

SEQ ID NO: 3270636 - DNA, 15 bp, Homo sapiens
aggggctacaagagg

SEQ ID NO: 3270637 - DNA, 12 bp, Homo sapiens
aggggctgctgg

SEQ ID NO: 3270638 - DNA, 19 bp, Homo sapiens
aggggctggccttcctgcc

SEQ ID NO: 3270639 - DNA, 16 bp, Homo sapiens
aggggctgggctccct

SEQ ID NO: 3270640 - DNA, 13 bp, Homo sapiens
aggggcttcctgg

SEQ ID NO: 3270641 - DNA, 12 bp, Homo sapiens
aggggcttggga

SEQ ID NO: 3270642 - DNA, 15 bp, Homo sapiens
agggggaagagaaat

SEQ ID NO: 3270643 - DNA, 18 bp, Homo sapiens
agggggagtagccaagct

SEQ ID NO: 3270644 - DNA, 19 bp, Homo sapiens
agggggatccgactgcttt

SEQ ID NO: 3270645 - DNA, 23 bp, Homo sapiens
agggggatgccactcctccctcc

SEQ ID NO: 3270646 - DNA, 13 bp, Homo sapiens
agggggccccgcc

SEQ ID NO: 3270647 - DNA, 23 bp, Homo sapiens
agggggccccgccagggctgggg

SEQ ID NO: 3270648 - DNA, 16 bp, Homo sapiens
agggggcctgggatgc

SEQ ID NO: 3270649 - DNA, 19 bp, Homo sapiens
agggggcctgggatgctag

SEQ ID NO: 3270650 - DNA, 19 bp, Homo sapiens
agggggcgctcaggaccca

SEQ ID NO: 3270651 - DNA, 21 bp, Homo sapiens
agggggctctccaaaggggct

SEQ ID NO: 3270652 - DNA, 18 bp, Homo sapiens
agggggcttgaagccaaa

SEQ ID NO: 3270653 - DNA, 19 bp, Homo sapiens
agggggcttgaagccaaag

SEQ ID NO: 3270654 - DNA, 18 bp, Homo sapiens
agggggctttctggggcc

SEQ ID NO: 3270655 - DNA, 23 bp, Homo sapiens
aggggggcacatgctgagtctcc

SEQ ID NO: 3270656 - DNA, 12 bp, Homo sapiens
aggggggctgtg

SEQ ID NO: 3270657 - DNA, 13 bp, Homo sapiens
aggggggctgtgc

SEQ ID NO: 3270658 - DNA, 14 bp, Homo sapiens
aggggggctgtgcc

SEQ ID NO: 3270659 - DNA, 21 bp, Homo sapiens
aggggggggcaatctctctct

SEQ ID NO: 3270660 - DNA, 13 bp, Homo sapiens
aggggggggtggg

SEQ ID NO: 3270661 - DNA, 19 bp, Homo sapiens
aggggggtgctggccccca

SEQ ID NO: 3270662 - DNA, 15 bp, Homo sapiens
agggggtccgtggaa

SEQ ID NO: 3270663 - DNA, 20 bp, Homo sapiens
agggggtccgtggtagaggc

SEQ ID NO: 3270664 - DNA, 22 bp, Homo sapiens
aggggtatgttccctcttgtcc

SEQ ID NO: 3270665 - DNA, 23 bp, Homo sapiens
aggggtatgttccctcttgtccc

SEQ ID NO: 3270666 - DNA, 16 bp, Homo sapiens
aggggtcaaagaaatg

SEQ ID NO: 3270667 - DNA, 15 bp, Homo sapiens
aggggtctccctggc

SEQ ID NO: 3270668 - DNA, 16 bp, Homo sapiens
aggggtgacggccctc

SEQ ID NO: 3270669 - DNA, 17 bp, Homo sapiens
aggggtgccccctcctc

SEQ ID NO: 3270670 - DNA, 21 bp, Homo sapiens
aggggtgccccctcctctccc

SEQ ID NO: 3270671 - DNA, 21 bp, Homo sapiens
aggggtggggggtgcaggtgg

SEQ ID NO: 3270672 - DNA, 19 bp, Homo sapiens
aggggtgggggtggaggct

SEQ ID NO: 3270673 - DNA, 18 bp, Homo sapiens
aggggtgtggcagtggtt

SEQ ID NO: 3270674 - DNA, 13 bp, Homo sapiens
aggggtgttgtat

SEQ ID NO: 3270675 - DNA, 21 bp, Homo sapiens
aggggttaacttggtcagagc

SEQ ID NO: 3270676 - DNA, 23 bp, Homo sapiens
aggggttaacttggtcagagcca

SEQ ID NO: 3270677 - DNA, 19 bp, Homo sapiens
aggggtttgccatttgata

SEQ ID NO: 3270678 - DNA, 13 bp, Homo sapiens
agggtacagctgg

SEQ ID NO: 3270679 - DNA, 14 bp, Homo sapiens
agggtacagctggg

SEQ ID NO: 3270680 - DNA, 22 bp, Homo sapiens
agggtacccgcctgagctcctg

SEQ ID NO: 3270681 - DNA, 19 bp, Homo sapiens
agggtacttttcctgggtt

SEQ ID NO: 3270682 - DNA, 22 bp, Homo sapiens
agggtagaatgattaatcaaag

SEQ ID NO: 3270683 - DNA, 13 bp, Homo sapiens
agggtaggaaagg

SEQ ID NO: 3270684 - DNA, 21 bp, Homo sapiens
agggtaggaggtttggatggg

SEQ ID NO: 3270685 - DNA, 19 bp, Homo sapiens
agggtccccgagtgcctag

SEQ ID NO: 3270686 - DNA, 12 bp, Homo sapiens
agggtccctctg

SEQ ID NO: 3270687 - DNA, 14 bp, Homo sapiens
agggtcctgccggt

SEQ ID NO: 3270688 - DNA, 16 bp, Homo sapiens
agggtcctggctcctg

SEQ ID NO: 3270689 - DNA, 17 bp, Homo sapiens
agggtccttttgacact

SEQ ID NO: 3270690 - DNA, 14 bp, Homo sapiens
agggtcgaaagctc

SEQ ID NO: 3270691 - DNA, 17 bp, Homo sapiens
agggtcggaacccaagc

SEQ ID NO: 3270692 - DNA, 14 bp, Homo sapiens
agggtctcactctg

SEQ ID NO: 3270693 - DNA, 15 bp, Homo sapiens
agggtctcactctgt

SEQ ID NO: 3270694 - DNA, 22 bp, Homo sapiens
agggtctcactctgtcgcccag

SEQ ID NO: 3270695 - DNA, 22 bp, Homo sapiens
agggtctcgctgtcactggctg

SEQ ID NO: 3270696 - DNA, 12 bp, Homo sapiens
agggtctctccc

SEQ ID NO: 3270697 - DNA, 17 bp, Homo sapiens
agggtctctccctcagg

SEQ ID NO: 3270698 - DNA, 10 bp, Homo sapiens
agggtctgag

SEQ ID NO: 3270699 - DNA, 13 bp, Homo sapiens
agggtctgctctt

SEQ ID NO: 3270700 - DNA, 17 bp, Homo sapiens
agggtctgctctttctc

SEQ ID NO: 3270701 - DNA, 20 bp, Homo sapiens
agggtctgctctttctctgc

SEQ ID NO: 3270702 - DNA, 22 bp, Homo sapiens
agggtctgctctttctctgcca

SEQ ID NO: 3270703 - DNA, 13 bp, Homo sapiens
agggtctgtgtga

SEQ ID NO: 3270704 - DNA, 15 bp, Homo sapiens
agggtctgtgtgaat

SEQ ID NO: 3270705 - DNA, 18 bp, Homo sapiens
agggtctgtgtgaatgtg

SEQ ID NO: 3270706 - DNA, 14 bp, Homo sapiens
agggtcttgggcta

SEQ ID NO: 3270707 - DNA, 23 bp, Homo sapiens
agggtcttgggctactggcagct

SEQ ID NO: 3270708 - DNA, 18 bp, Homo sapiens
agggtctttggtgttttt

SEQ ID NO: 3270709 - DNA, 15 bp, Homo sapiens
agggtcttttgcagc

SEQ ID NO: 3270710 - DNA, 18 bp, Homo sapiens
agggtgaaaggcagggcc

SEQ ID NO: 3270711 - DNA, 17 bp, Homo sapiens
agggtgaaggaggtcag

SEQ ID NO: 3270712 - DNA, 23 bp, Homo sapiens
agggtgattttatgatcagtgtt

SEQ ID NO: 3270713 - DNA, 21 bp, Homo sapiens
agggtggacttagaaagcagg

SEQ ID NO: 3270714 - DNA, 12 bp, Homo sapiens
agggtggagact

SEQ ID NO: 3270715 - DNA, 19 bp, Homo sapiens
agggtggaggaaggtgctg

SEQ ID NO: 3270716 - DNA, 14 bp, Homo sapiens
agggtggcccttgc

SEQ ID NO: 3270717 - DNA, 16 bp, Homo sapiens
agggtggctttaattg

SEQ ID NO: 3270718 - DNA, 22 bp, Homo sapiens
agggtggctttaattgtataag

SEQ ID NO: 3270719 - DNA, 17 bp, Homo sapiens
agggtgggagagcccag

SEQ ID NO: 3270720 - DNA, 19 bp, Homo sapiens
agggtgggagagcccagcc

SEQ ID NO: 3270721 - DNA, 17 bp, Homo sapiens
agggtgggtgctcagaa

SEQ ID NO: 3270722 - DNA, 20 bp, Homo sapiens
agggtgggtgctcagaataa

SEQ ID NO: 3270723 - DNA, 17 bp, Homo sapiens
agggtggtaaatatttt

SEQ ID NO: 3270724 - DNA, 20 bp, Homo sapiens
agggtgtgtttgaaatcatc

SEQ ID NO: 3270725 - DNA, 12 bp, Homo sapiens
agggtgtttcct

SEQ ID NO: 3270726 - DNA, 16 bp, Homo sapiens
agggtgtttcctctaa

SEQ ID NO: 3270727 - DNA, 12 bp, Homo sapiens
agggttcccctg

SEQ ID NO: 3270728 - DNA, 17 bp, Homo sapiens
agggttcccctggcctt

SEQ ID NO: 3270729 - DNA, 21 bp, Homo sapiens
agggttgaaggcagtctgaac

SEQ ID NO: 3270730 - DNA, 15 bp, Homo sapiens
agggttgggcccaga

SEQ ID NO: 3270731 - DNA, 15 bp, Homo sapiens
agggttgggctggtg

SEQ ID NO: 3270732 - DNA, 16 bp, Homo sapiens
aggtgatttcagactg

SEQ ID NO: 3270733 - DNA, 21 bp, Homo sapiens
aggtgcaacagacttgaatgc

SEQ ID NO: 3270734 - DNA, 19 bp, Homo sapiens
aggtgcaatttcaaggttc

SEQ ID NO: 3270735 - DNA, 22 bp, Homo sapiens
aggtgcaatttcaaggttctaa

SEQ ID NO: 3270736 - DNA, 15 bp, Homo sapiens
aggtgcagatgggct

SEQ ID NO: 3270737 - DNA, 17 bp, Homo sapiens
aggtgcagatgggctgt

SEQ ID NO: 3270738 - DNA, 23 bp, Homo sapiens
aggtgcagttcccccaacctcag

SEQ ID NO: 3270739 - DNA, 21 bp, Homo sapiens
aggtgcatctggggaactaga

SEQ ID NO: 3270740 - DNA, 12 bp, Homo sapiens
aggtgccaccac

SEQ ID NO: 3270741 - DNA, 13 bp, Homo sapiens
aggtgccaccacc

SEQ ID NO: 3270742 - DNA, 16 bp, Homo sapiens
aggtgccactccctga

SEQ ID NO: 3270743 - DNA, 23 bp, Homo sapiens
aggtgccactttacccacctaga

SEQ ID NO: 3270744 - DNA, 18 bp, Homo sapiens
aggtgcctcacgcctgta

SEQ ID NO: 3270745 - DNA, 16 bp, Homo sapiens
aggtgcctcagactcc

SEQ ID NO: 3270746 - DNA, 17 bp, Homo sapiens
aggtgcctgtcccaccc

SEQ ID NO: 3270747 - DNA, 17 bp, Homo sapiens
aggtgctcccctgacag

SEQ ID NO: 3270748 - DNA, 17 bp, Homo sapiens
aggtgctgagcttagcc

SEQ ID NO: 3270749 - DNA, 18 bp, Homo sapiens
aggtgctgagcttagcct

SEQ ID NO: 3270750 - DNA, 20 bp, Homo sapiens
aggtgctgagcttagccttg

SEQ ID NO: 3270751 - DNA, 18 bp, Homo sapiens
aggtgctgatgtcaaagt

SEQ ID NO: 3270752 - DNA, 16 bp, Homo sapiens
aggtgctgccatccag

SEQ ID NO: 3270753 - DNA, 19 bp, Homo sapiens
aggtggaagaagggagaag

SEQ ID NO: 3270754 - DNA, 21 bp, Homo sapiens
aggtggacacaacagcagtct

SEQ ID NO: 3270755 - DNA, 16 bp, Homo sapiens
aggtggagggcacagc

SEQ ID NO: 3270756 - DNA, 17 bp, Homo sapiens
aggtggagggcacagcc

SEQ ID NO: 3270757 - DNA, 18 bp, Homo sapiens
aggtggagggcacagccc

SEQ ID NO: 3270758 - DNA, 19 bp, Homo sapiens
aggtggagggcacagccct

SEQ ID NO: 3270759 - DNA, 16 bp, Homo sapiens
aggtggatggccccag

SEQ ID NO: 3270760 - DNA, 16 bp, Homo sapiens
aggtggcaatgcttaa

SEQ ID NO: 3270761 - DNA, 18 bp, Homo sapiens
aggtggcactttttcatt

SEQ ID NO: 3270762 - DNA, 19 bp, Homo sapiens
aggtggcactttttcattt

SEQ ID NO: 3270763 - DNA, 13 bp, Homo sapiens
aggtggcgcccag

SEQ ID NO: 3270764 - DNA, 15 bp, Homo sapiens
aggtgggagcaggag

SEQ ID NO: 3270765 - DNA, 16 bp, Homo sapiens
aggtgggatcctccct

SEQ ID NO: 3270766 - DNA, 17 bp, Homo sapiens
aggtgggatcctccctc

SEQ ID NO: 3270767 - DNA, 16 bp, Homo sapiens
aggtgggcagctgggc

SEQ ID NO: 3270768 - DNA, 12 bp, Homo sapiens
aggtgggcccag

SEQ ID NO: 3270769 - DNA, 13 bp, Homo sapiens
aggtgggcccagg

SEQ ID NO: 3270770 - DNA, 19 bp, Homo sapiens
aggtgggccttgctacctc

SEQ ID NO: 3270771 - DNA, 16 bp, Homo sapiens
aggtgggctgagccct

SEQ ID NO: 3270772 - DNA, 17 bp, Homo sapiens
aggtgggctgagccctg

SEQ ID NO: 3270773 - DNA, 18 bp, Homo sapiens
aggtgggctgagccctgg

SEQ ID NO: 3270774 - DNA, 21 bp, Homo sapiens
aggtgggctgggccctctctt

SEQ ID NO: 3270775 - DNA, 22 bp, Homo sapiens
aggtgggctgggccctctcttc

SEQ ID NO: 3270776 - DNA, 15 bp, Homo sapiens
aggtgggctggggct

SEQ ID NO: 3270777 - DNA, 18 bp, Homo sapiens
aggtgggcttcagtaagt

SEQ ID NO: 3270778 - DNA, 13 bp, Homo sapiens
aggtggggcagct

SEQ ID NO: 3270779 - DNA, 16 bp, Homo sapiens
aggtggggcagcttga

SEQ ID NO: 3270780 - DNA, 18 bp, Homo sapiens
aggtggggcgaggcaggc

SEQ ID NO: 3270781 - DNA, 21 bp, Homo sapiens
aggtgggtccaggaaggcagc

SEQ ID NO: 3270782 - DNA, 17 bp, Homo sapiens
aggtgggtgctgccctg

SEQ ID NO: 3270783 - DNA, 16 bp, Homo sapiens
aggtgggtgtgggtgg

SEQ ID NO: 3270784 - DNA, 16 bp, Homo sapiens
aggtggtaggaggagg

SEQ ID NO: 3270785 - DNA, 20 bp, Homo sapiens
aggtggtatgtaatttatgc

SEQ ID NO: 3270786 - DNA, 16 bp, Homo sapiens
aggtggtctgaatgtt

SEQ ID NO: 3270787 - DNA, 13 bp, Homo sapiens
agtttctattctg

SEQ ID NO: 3270788 - DNA, 19 bp, Homo sapiens
agtttctgacgaaggtcct

SEQ ID NO: 3270789 - DNA, 23 bp, Homo sapiens
agtttctgcaaagtgtatgtgac

SEQ ID NO: 3270790 - DNA, 22 bp, Homo sapiens
agtttctggtgccatttctgaa

SEQ ID NO: 3270791 - DNA, 17 bp, Homo sapiens
agtttcttagcttttta

SEQ ID NO: 3270792 - DNA, 13 bp, Homo sapiens
agtttcttcctgc

SEQ ID NO: 3270793 - DNA, 18 bp, Homo sapiens
agtttcttgcttggaagc

SEQ ID NO: 3270794 - DNA, 18 bp, Homo sapiens
agtttctttcctgccttc

SEQ ID NO: 3270795 - DNA, 21 bp, Homo sapiens
agtttctttcctgccttcttc

SEQ ID NO: 3270796 - DNA, 22 bp, Homo sapiens
agtttgaacctttttttttgaa

SEQ ID NO: 3270797 - DNA, 15 bp, Homo sapiens
agtttgaagaccgcc

SEQ ID NO: 3270798 - DNA, 14 bp, Homo sapiens
agtttgaattcagt

SEQ ID NO: 3270799 - DNA, 20 bp, Homo sapiens
agtttgagacaagccctggc

SEQ ID NO: 3270800 - DNA, 16 bp, Homo sapiens
agtttgagctgccttc

SEQ ID NO: 3270801 - DNA, 23 bp, Homo sapiens
agtttgagctgccttccctagct

SEQ ID NO: 3270802 - DNA, 19 bp, Homo sapiens
agttctgtgtttaatttct

SEQ ID NO: 3270803 - DNA, 20 bp, Homo sapiens
agttctgttatatcccctgc

SEQ ID NO: 3270804 - DNA, 21 bp, Homo sapiens
agttctgtttggtgtgtccca

SEQ ID NO: 3270805 - DNA, 18 bp, Homo sapiens
agttcttcacctctatcc

SEQ ID NO: 3270806 - DNA, 12 bp, Homo sapiens
agttcttgtgcc

SEQ ID NO: 3270807 - DNA, 14 bp, Homo sapiens
agttcttgtgccat

SEQ ID NO: 3270808 - DNA, 15 bp, Homo sapiens
agttctttggattct

SEQ ID NO: 3270809 - DNA, 22 bp, Homo sapiens
agttctttggattctaaataca

SEQ ID NO: 3270810 - DNA, 17 bp, Homo sapiens
agttctttttgtacact

SEQ ID NO: 3270811 - DNA, 13 bp, Homo sapiens
agttgaacagagg

SEQ ID NO: 3270812 - DNA, 19 bp, Homo sapiens
agttgaagttagtggaaat

SEQ ID NO: 3270813 - DNA, 15 bp, Homo sapiens
agttgaagtttagga

SEQ ID NO: 3270814 - DNA, 17 bp, Homo sapiens
agttgaatataagaaaa

SEQ ID NO: 3270815 - DNA, 22 bp, Homo sapiens
agttgacggggcagtcagattt

SEQ ID NO: 3270816 - DNA, 14 bp, Homo sapiens
agttgactttctcc

SEQ ID NO: 3270817 - DNA, 17 bp, Homo sapiens
agttgactttctccctg

SEQ ID NO: 3270818 - DNA, 11 bp, Homo sapiens
agttgagcccc

SEQ ID NO: 3270819 - DNA, 21 bp, Homo sapiens
agttgagccccaagtcctgaa

SEQ ID NO: 3270820 - DNA, 18 bp, Homo sapiens
agttgaggaactgtacag

SEQ ID NO: 3270821 - DNA, 16 bp, Homo sapiens
agttgaggagtttcct

SEQ ID NO: 3270822 - DNA, 16 bp, Homo sapiens
agttgaggccaggagt

SEQ ID NO: 3270823 - DNA, 19 bp, Homo sapiens
agtggggagggacaaggga

SEQ ID NO: 3270824 - DNA, 21 bp, Homo sapiens
agtggggatgaggtcaccagg

SEQ ID NO: 3270825 - DNA, 16 bp, Homo sapiens
agtggggatggggcct

SEQ ID NO: 3270826 - DNA, 15 bp, Homo sapiens
agtggggcctgggag

SEQ ID NO: 3270827 - DNA, 16 bp, Homo sapiens
agtgggggagagcagg

SEQ ID NO: 3270828 - DNA, 21 bp, Homo sapiens
agtgggggagagcaggctggc

SEQ ID NO: 3270829 - DNA, 23 bp, Homo sapiens
agtgggggagagcaggctggcag

SEQ ID NO: 3270830 - DNA, 14 bp, Homo sapiens
agtggggtgctggg

SEQ ID NO: 3270831 - DNA, 16 bp, Homo sapiens
agtggggtgctgggag

SEQ ID NO: 3270832 - DNA, 19 bp, Homo sapiens
agtggggttatctctgtgt

SEQ ID NO: 3270833 - DNA, 21 bp, Homo sapiens
agtggggttatctctgtgtta

SEQ ID NO: 3270834 - DNA, 23 bp, Homo sapiens
agtgggtctgggatatggctgcc

SEQ ID NO: 3270835 - DNA, 15 bp, Homo sapiens
agtgggtggcacctc

SEQ ID NO: 3270836 - DNA, 15 bp, Homo sapiens
agtggtactagtgtg

SEQ ID NO: 3270837 - DNA, 15 bp, Homo sapiens
agtggtatgtctctt

SEQ ID NO: 3270838 - DNA, 15 bp, Homo sapiens
agtggtctttctgga

SEQ ID NO: 3270839 - DNA, 16 bp, Homo sapiens
agtggtctttctggag

SEQ ID NO: 3270840 - DNA, 22 bp, Homo sapiens
agtggtctttgtaagagtgtag

SEQ ID NO: 3270841 - DNA, 24 bp, Homo sapiens
agtggtctttgtaagagtgtagaa

SEQ ID NO: 3270842 - DNA, 15 bp, Homo sapiens
agtggtgatttgaaa

SEQ ID NO: 3270843 - DNA, 22 bp, Homo sapiens
agtggtgatttgaaaaatataa

SEQ ID NO: 3270844 - DNA, 16 bp, Homo sapiens
agtggtgcgatctggg

SEQ ID NO: 3270845 - DNA, 17 bp, Homo sapiens
agtggtgcgatctgggt

SEQ ID NO: 3270846 - DNA, 15 bp, Homo sapiens
agtggtgtgatctca

SEQ ID NO: 3270847 - DNA, 17 bp, Homo sapiens
agtggtgttttaaagag

SEQ ID NO: 3270848 - DNA, 22 bp, Homo sapiens
agtggtgttttaaagagaatgt

SEQ ID NO: 3270849 - DNA, 14 bp, Homo sapiens
agtggttgcctggg

SEQ ID NO: 3270850 - DNA, 17 bp, Homo sapiens
agtggttttatactgaa

SEQ ID NO: 3270851 - DNA, 20 bp, Homo sapiens
agtggttttatactgaagga

SEQ ID NO: 3270852 - DNA, 13 bp, Homo sapiens
agtgtaaaataag

SEQ ID NO: 3270853 - DNA, 17 bp, Homo sapiens
agtgtaaataattttaa

SEQ ID NO: 3270854 - DNA, 14 bp, Homo sapiens
agtgtaacagctga

SEQ ID NO: 3270855 - DNA, 13 bp, Homo sapiens
agtgtaagtgtga

SEQ ID NO: 3270856 - DNA, 17 bp, Homo sapiens
agtgtacacgtctggac

SEQ ID NO: 3270857 - DNA, 15 bp, Homo sapiens
agtcttacaatcaaa

SEQ ID NO: 3270858 - DNA, 20 bp, Homo sapiens
agtcttacaatcaaatctcc

SEQ ID NO: 3270859 - DNA, 16 bp, Homo sapiens
agtcttagatgtatat

SEQ ID NO: 3270860 - DNA, 23 bp, Homo sapiens
agtcttagatgtatatatttcct

SEQ ID NO: 3270861 - DNA, 22 bp, Homo sapiens
agtcttcaacataacccacttg

SEQ ID NO: 3270862 - DNA, 17 bp, Homo sapiens
agtcttcactctctgaa

SEQ ID NO: 3270863 - DNA, 17 bp, Homo sapiens
agtcttcctgacacttt

SEQ ID NO: 3270864 - DNA, 19 bp, Homo sapiens
agtcttccttgtctctgct

SEQ ID NO: 3270865 - DNA, 20 bp, Homo sapiens
agtcttctcatagcattaac

SEQ ID NO: 3270866 - DNA, 12 bp, Homo sapiens
agtcttgcctag

SEQ ID NO: 3270867 - DNA, 13 bp, Homo sapiens
agtcttgcctagg

SEQ ID NO: 3270868 - DNA, 16 bp, Homo sapiens
agtcttggaagctgtt

SEQ ID NO: 3270869 - DNA, 22 bp, Homo sapiens
agtcttggcggcagcagccatc

SEQ ID NO: 3270870 - DNA, 13 bp, Homo sapiens
agtcttgggcctg

SEQ ID NO: 3270871 - DNA, 17 bp, Homo sapiens
agtcttggtttctctct

SEQ ID NO: 3270872 - DNA, 12 bp, Homo sapiens
agtcttgtgctt

SEQ ID NO: 3270873 - DNA, 20 bp, Homo sapiens
agtcttgtgcttttcctatt

SEQ ID NO: 3270874 - DNA, 17 bp, Homo sapiens
agtctttaaaggcccag

SEQ ID NO: 3270875 - DNA, 17 bp, Homo sapiens
agtctttcatggctgct

SEQ ID NO: 3270876 - DNA, 16 bp, Homo sapiens
agtctttgccttctct

SEQ ID NO: 3270877 - DNA, 17 bp, Homo sapiens
agtctttggttctaagg

SEQ ID NO: 3270878 - DNA, 18 bp, Homo sapiens
agtctttggttctaagga

SEQ ID NO: 3270879 - DNA, 18 bp, Homo sapiens
agtcttttgcttttggca

SEQ ID NO: 3270880 - DNA, 20 bp, Homo sapiens
agtcttttgcttttggcaaa

SEQ ID NO: 3270881 - DNA, 17 bp, Homo sapiens
agtcttttgttcgcatg

SEQ ID NO: 3270882 - DNA, 16 bp, Homo sapiens
agtcttttttttcctg

SEQ ID NO: 3270883 - DNA, 14 bp, Homo sapiens
agtgaaaaactgct

SEQ ID NO: 3270884 - DNA, 16 bp, Homo sapiens
agtgaaaaactgctgt

SEQ ID NO: 3270885 - DNA, 17 bp, Homo sapiens
agtgaaaaactgctgta

SEQ ID NO: 3270886 - DNA, 14 bp, Homo sapiens
agtgaaaaatatgt

SEQ ID NO: 3270887 - DNA, 15 bp, Homo sapiens
agtgaaaccatgact

SEQ ID NO: 3270888 - DNA, 21 bp, Homo sapiens
agtgaaacctttagggcagct

SEQ ID NO: 3270889 - DNA, 22 bp, Homo sapiens
agtgaaacctttagggcagctt

SEQ ID NO: 3270890 - DNA, 22 bp, Homo sapiens
agtgaaataattaaaaaccact

SEQ ID NO: 3270891 - DNA, 15 bp, Homo sapiens
agtgaaatgtgaagg

SEQ ID NO: 3270892 - DNA, 21 bp, Homo sapiens
agtgaaattttggtgaatgtg

SEQ ID NO: 3270893 - DNA, 21 bp, Homo sapiens
agtgaaccatcattataaacg

SEQ ID NO: 3270894 - DNA, 17 bp, Homo sapiens
agtgaacctaccttcat

SEQ ID NO: 3270895 - DNA, 15 bp, Homo sapiens
agtgaacctgtataa

SEQ ID NO: 3270896 - DNA, 19 bp, Homo sapiens
agtgaactatttctacaca

SEQ ID NO: 3270897 - DNA, 14 bp, Homo sapiens
agtgaagaggggca

SEQ ID NO: 3270898 - DNA, 15 bp, Homo sapiens
agtgaagaggggcag

SEQ ID NO: 3270899 - DNA, 17 bp, Homo sapiens
agtgaagaggggcagcc

SEQ ID NO: 3270900 - DNA, 22 bp, Homo sapiens
agtgaaggtggggagaagctga

SEQ ID NO: 3270901 - DNA, 14 bp, Homo sapiens
agtgaataaatgtc

SEQ ID NO: 3270902 - DNA, 21 bp, Homo sapiens
agtgaatctaaggataatgaa

SEQ ID NO: 3270903 - DNA, 21 bp, Homo sapiens
agtactgtttaccatttttca

SEQ ID NO: 3270904 - DNA, 19 bp, Homo sapiens
agtacttctccaccctgct

SEQ ID NO: 3270905 - DNA, 22 bp, Homo sapiens
agtacttctccaccctgctctc

SEQ ID NO: 3270906 - DNA, 11 bp, Homo sapiens
agtacttgaaa

SEQ ID NO: 3270907 - DNA, 16 bp, Homo sapiens
agtacttgaaaaagta

SEQ ID NO: 3270908 - DNA, 23 bp, Homo sapiens
agtacttggtttttttttttctt

SEQ ID NO: 3270909 - DNA, 18 bp, Homo sapiens
agtacttgtgaaacacag

SEQ ID NO: 3270910 - DNA, 13 bp, Homo sapiens
agtactttgtgca

SEQ ID NO: 3270911 - DNA, 15 bp, Homo sapiens
agtactttgtgcatt

SEQ ID NO: 3270912 - DNA, 18 bp, Homo sapiens
agtagaaagcttgaaaag

SEQ ID NO: 3270913 - DNA, 19 bp, Homo sapiens
agtagaaataaaagtgaat

SEQ ID NO: 3270914 - DNA, 11 bp, Homo sapiens
agtagaactgt

SEQ ID NO: 3270915 - DNA, 14 bp, Homo sapiens
agtagacatttata

SEQ ID NO: 3270916 - DNA, 20 bp, Homo sapiens
agtagaccttgttacttctg

SEQ ID NO: 3270917 - DNA, 12 bp, Homo sapiens
agtagagacagg

SEQ ID NO: 3270918 - DNA, 12 bp, Homo sapiens
agtagagccagc

SEQ ID NO: 3270919 - DNA, 15 bp, Homo sapiens
agtagagccagcttg

SEQ ID NO: 3270920 - DNA, 22 bp, Homo sapiens
agtagagcttgtaataaatact

SEQ ID NO: 3270921 - DNA, 14 bp, Homo sapiens
agtagatattactt

SEQ ID NO: 3270922 - DNA, 17 bp, Homo sapiens
agtagatattactttat

SEQ ID NO: 3270923 - DNA, 18 bp, Homo sapiens
agtagatattactttatc

SEQ ID NO: 3270924 - DNA, 23 bp, Homo sapiens
agtagatctatattagatcaaat

SEQ ID NO: 3270925 - DNA, 22 bp, Homo sapiens
agtagattcaagttgtgtctga

SEQ ID NO: 3270926 - DNA, 15 bp, Homo sapiens
agtagattttccaaa

SEQ ID NO: 3270927 - DNA, 18 bp, Homo sapiens
agtagcaccctggattga

SEQ ID NO: 3270928 - DNA, 23 bp, Homo sapiens
agtagcatgagagaattgtatca

SEQ ID NO: 3270929 - DNA, 15 bp, Homo sapiens
agtagcatttcattc

SEQ ID NO: 3270930 - DNA, 21 bp, Homo sapiens
agtagcccttcagtcttaata

SEQ ID NO: 3270931 - DNA, 14 bp, Homo sapiens
agtagctgggacta

SEQ ID NO: 3270932 - DNA, 22 bp, Homo sapiens
agtagctgggactacaggcacc

SEQ ID NO: 3270933 - DNA, 21 bp, Homo sapiens
agtagctgggactacaggcgc

SEQ ID NO: 3270934 - DNA, 18 bp, Homo sapiens
agtagctgtggcctcacc

SEQ ID NO: 3270935 - DNA, 14 bp, Homo sapiens
agtagcttgctccc

SEQ ID NO: 3270936 - DNA, 23 bp, Homo sapiens
agtagcttgctccctgtgtccac

SEQ ID NO: 3270937 - DNA, 15 bp, Homo sapiens
agtagctttccacat

SEQ ID NO: 3270938 - DNA, 20 bp, Homo sapiens
agtagctttccacatttgtc

SEQ ID NO: 3270939 - DNA, 18 bp, Homo sapiens
agtaggcatatatcacta

SEQ ID NO: 3270940 - DNA, 23 bp, Homo sapiens
agtagggatgcggatcctgctgg

SEQ ID NO: 3270941 - DNA, 23 bp, Homo sapiens
agtaggggaggagcacagtttgt

SEQ ID NO: 3270942 - DNA, 17 bp, Homo sapiens
agtaggtccaagggcca

SEQ ID NO: 3270943 - DNA, 18 bp, Homo sapiens
agtagttctgtttggtgt

SEQ ID NO: 3270944 - DNA, 13 bp, Homo sapiens
agtataaaaacaa

SEQ ID NO: 3270945 - DNA, 21 bp, Homo sapiens
agtataaccatatgatactat

SEQ ID NO: 3270946 - DNA, 19 bp, Homo sapiens
agtataagactactgaatc

SEQ ID NO: 3270947 - DNA, 18 bp, Homo sapiens
agtataatgtttattaaa

SEQ ID NO: 3270948 - DNA, 17 bp, Homo sapiens
agtatacaatatataaa

SEQ ID NO: 3270949 - DNA, 16 bp, Homo sapiens
agtatacctcattttt

SEQ ID NO: 3270950 - DNA, 15 bp, Homo sapiens
agtatacctgatttt

SEQ ID NO: 3270951 - DNA, 22 bp, Homo sapiens
agtatactgtgtgggatactta

SEQ ID NO: 3270952 - DNA, 17 bp, Homo sapiens
agtatagagaaaagtgt

SEQ ID NO: 3270953 - DNA, 13 bp, Homo sapiens
agtatatctggac

SEQ ID NO: 3270954 - DNA, 14 bp, Homo sapiens
agtatattatgtat

SEQ ID NO: 3270955 - DNA, 17 bp, Homo sapiens
agtatattatgtattta

SEQ ID NO: 3270956 - DNA, 18 bp, Homo sapiens
agtatcactctaaaaaac

SEQ ID NO: 3270957 - DNA, 18 bp, Homo sapiens
agtatcaggtctcccacg

SEQ ID NO: 3270958 - DNA, 16 bp, Homo sapiens
agtatcagtgttttaa

SEQ ID NO: 3270959 - DNA, 23 bp, Homo sapiens
agtatccaggctttgtacagagt

SEQ ID NO: 3270960 - DNA, 16 bp, Homo sapiens
agtatctaacatgtat

SEQ ID NO: 3270961 - DNA, 17 bp, Homo sapiens
agtatctatatatgtgt

SEQ ID NO: 3270962 - DNA, 23 bp, Homo sapiens
agtatctatatatgtgtatgtac

SEQ ID NO: 3270963 - DNA, 20 bp, Homo sapiens
agtatctgggattattcttt

SEQ ID NO: 3270964 - DNA, 21 bp, Homo sapiens
agtatctgggattattctttg

SEQ ID NO: 3270965 - DNA, 20 bp, Homo sapiens
agtatctgtatataagttgc

SEQ ID NO: 3270966 - DNA, 15 bp, Homo sapiens
ataaaattaaaagtt

SEQ ID NO: 3270967 - DNA, 16 bp, Homo sapiens
ataaaattaaatgcct

SEQ ID NO: 3270968 - DNA, 12 bp, Homo sapiens
ataaaattttct

SEQ ID NO: 3270969 - DNA, 14 bp, Homo sapiens
ataaacaatgatgc

SEQ ID NO: 3270970 - DNA, 22 bp, Homo sapiens
ataaacacattgaatgcgcttt

SEQ ID NO: 3270971 - DNA, 17 bp, Homo sapiens
ataaacactggctctgg

SEQ ID NO: 3270972 - DNA, 17 bp, Homo sapiens
ataaacactggtgccaa

SEQ ID NO: 3270973 - DNA, 19 bp, Homo sapiens
ataaacagacaatatgtga

SEQ ID NO: 3270974 - DNA, 20 bp, Homo sapiens
ataaacaggaattttatttt

SEQ ID NO: 3270975 - DNA, 23 bp, Homo sapiens
atcagaaaagtaattttgtcaca

SEQ ID NO: 3270976 - DNA, 15 bp, Homo sapiens
atcagaaatttttat

SEQ ID NO: 3270977 - DNA, 22 bp, Homo sapiens
atcagaacattcagctctggag

SEQ ID NO: 3270978 - DNA, 15 bp, Homo sapiens
atcagaactgaaata

SEQ ID NO: 3270979 - DNA, 22 bp, Homo sapiens
atcagaagaccacaaaaattga

SEQ ID NO: 3270980 - DNA, 16 bp, Homo sapiens
atcagaagactttaat

SEQ ID NO: 3270981 - DNA, 13 bp, Homo sapiens
atcagaagataac

SEQ ID NO: 3270982 - DNA, 19 bp, Homo sapiens
atcagaagtcatcttgcta

SEQ ID NO: 3270983 - DNA, 19 bp, Homo sapiens
atcagaatagccacatttg

SEQ ID NO: 3270984 - DNA, 20 bp, Homo sapiens
atcagaatatgattcactat

SEQ ID NO: 3270985 - DNA, 13 bp, Homo sapiens
atcagacaagcac

SEQ ID NO: 3270986 - DNA, 20 bp, Homo sapiens
atcagacaagcactatttta

SEQ ID NO: 3270987 - DNA, 20 bp, Homo sapiens
atcagaccataatgttacat

SEQ ID NO: 3270988 - DNA, 16 bp, Homo sapiens
atcagacctgtcttcc

SEQ ID NO: 3270989 - DNA, 16 bp, Homo sapiens
atcagagcaggacctc

SEQ ID NO: 3270990 - DNA, 20 bp, Homo sapiens
atcagagctcctctgtcctg

SEQ ID NO: 3270991 - DNA, 21 bp, Homo sapiens
atcagagctcctctgtcctgc

SEQ ID NO: 3270992 - DNA, 14 bp, Homo sapiens
atcagaggcctata

SEQ ID NO: 3270993 - DNA, 12 bp, Homo sapiens
atcagaggtgta

SEQ ID NO: 3270994 - DNA, 22 bp, Homo sapiens
atcagaggtttgcttcctcagt

SEQ ID NO: 3270995 - DNA, 18 bp, Homo sapiens
atcagagtagaaataaaa

SEQ ID NO: 3270996 - DNA, 22 bp, Homo sapiens
atcagataagacatatctctaa

SEQ ID NO: 3270997 - DNA, 13 bp, Homo sapiens
atcagatacatca

SEQ ID NO: 3270998 - DNA, 12 bp, Homo sapiens
atcagatcaaga

SEQ ID NO: 3270999 - DNA, 21 bp, Homo sapiens
atcagatgctccaagattcta

SEQ ID NO: 3271000 - DNA, 23 bp, Homo sapiens
atcagatgctccaagattctaga

SEQ ID NO: 3271001 - DNA, 23 bp, Homo sapiens
atcagatggaaatattttgataa

SEQ ID NO: 3271002 - DNA, 14 bp, Homo sapiens
atcagcaaagaaaa

SEQ ID NO: 3271003 - DNA, 18 bp, Homo sapiens
atcagcaatactcatcag

SEQ ID NO: 3271004 - DNA, 12 bp, Homo sapiens
atcagcactgaa

SEQ ID NO: 3271005 - DNA, 14 bp, Homo sapiens
atcagcactgaaaa

SEQ ID NO: 3271006 - DNA, 15 bp, Homo sapiens
atcagcatgaaaatg

SEQ ID NO: 3271007 - DNA, 15 bp, Homo sapiens
atcagccacattcta

SEQ ID NO: 3271008 - DNA, 12 bp, Homo sapiens
atcagcctgagt

SEQ ID NO: 3271009 - DNA, 20 bp, Homo sapiens
atcagcctgagtctcctgtg

SEQ ID NO: 3271010 - DNA, 22 bp, Homo sapiens
atcagctacttaagagaaatgg

SEQ ID NO: 3271011 - DNA, 12 bp, Homo sapiens
atcagctccttt

SEQ ID NO: 3271012 - DNA, 14 bp, Homo sapiens
atcagctctcctgg

SEQ ID NO: 3271013 - DNA, 20 bp, Homo sapiens
atcaggaaatatatatgtgt

SEQ ID NO: 3271014 - DNA, 17 bp, Homo sapiens
atcaggaatataaatat

SEQ ID NO: 3271015 - DNA, 20 bp, Homo sapiens
atcaggagagggatacaaga

SEQ ID NO: 3271016 - DNA, 13 bp, Homo sapiens
atcaggcactggt

SEQ ID NO: 3271017 - DNA, 18 bp, Homo sapiens
atcaggcctaatctcata

SEQ ID NO: 3271018 - DNA, 19 bp, Homo sapiens
atcaggcctaatctcatac

SEQ ID NO: 3271019 - DNA, 21 bp, Homo sapiens
atcagggcaatcccaacacat

SEQ ID NO: 3271020 - DNA, 11 bp, Homo sapiens
atcagggcctg

SEQ ID NO: 3271021 - DNA, 15 bp, Homo sapiens
atcagggcctggggc

SEQ ID NO: 3271022 - DNA, 20 bp, Homo sapiens
atcagggcctggggcctgag

SEQ ID NO: 3271023 - DNA, 18 bp, Homo sapiens
atcaggtaccaaggaaat

SEQ ID NO: 3271024 - DNA, 20 bp, Homo sapiens
atcaggtcctcagagaattt

SEQ ID NO: 3271025 - DNA, 17 bp, Homo sapiens
atcaggtgctgccatcc

SEQ ID NO: 3271026 - DNA, 19 bp, Homo sapiens
atcaggtgctgccatccag

SEQ ID NO: 3271027 - DNA, 19 bp, Homo sapiens
atcagtaacccccttaaat

SEQ ID NO: 3271028 - DNA, 17 bp, Homo sapiens
atcagtaagaggtgtta

SEQ ID NO: 3271029 - DNA, 15 bp, Homo sapiens
atcagtatatttggt

SEQ ID NO: 3271030 - DNA, 22 bp, Homo sapiens
atcagtatatttggtttctaga

SEQ ID NO: 3271031 - DNA, 23 bp, Homo sapiens
atcagtattaatactaaaatatg

SEQ ID NO: 3271032 - DNA, 22 bp, Homo sapiens
atcagtatttttttttaatttt

SEQ ID NO: 3271033 - DNA, 13 bp, Homo sapiens
atcagtcccctcc

SEQ ID NO: 3271034 - DNA, 14 bp, Homo sapiens
atcagtcctttgat

SEQ ID NO: 3271035 - DNA, 15 bp, Homo sapiens
atcagtgaagcagtt

SEQ ID NO: 3271036 - DNA, 21 bp, Homo sapiens
atcagtgggcaggataaactg

SEQ ID NO: 3271037 - DNA, 17 bp, Homo sapiens
atcagtgtcctcttgct

SEQ ID NO: 3271038 - DNA, 20 bp, Homo sapiens
atcagtgtgtctaaatttga

SEQ ID NO: 3271039 - DNA, 14 bp, Homo sapiens
atcagtgttaaaaa

SEQ ID NO: 3271040 - DNA, 10 bp, Homo sapiens
atcagtgttg

SEQ ID NO: 3271041 - DNA, 19 bp, Homo sapiens
atcagtgttttaaattctg

SEQ ID NO: 3271042 - DNA, 15 bp, Homo sapiens
atcagttatcctttg

SEQ ID NO: 3271043 - DNA, 16 bp, Homo sapiens
atcagtttcatgaaat

SEQ ID NO: 3271044 - DNA, 18 bp, Homo sapiens
atcagtttccatgaaaga

SEQ ID NO: 3271045 - DNA, 21 bp, Homo sapiens
atcagtttccatgaaagacct

SEQ ID NO: 3271046 - DNA, 22 bp, Homo sapiens
atcagtttgctagcagaaatct

SEQ ID NO: 3271047 - DNA, 22 bp, Homo sapiens
atcataaaagtgattctttttt

SEQ ID NO: 3271048 - DNA, 14 bp, Homo sapiens
atcataaagtcagt

SEQ ID NO: 3271049 - DNA, 13 bp, Homo sapiens
atcataaggcttc

SEQ ID NO: 3271050 - DNA, 19 bp, Homo sapiens
atcataagtgaatttatac

SEQ ID NO: 3271051 - DNA, 23 bp, Homo sapiens
atcatacagatcaggcagtgttt

SEQ ID NO: 3271052 - DNA, 17 bp, Homo sapiens
atcatactgatttttaa

SEQ ID NO: 3271053 - DNA, 22 bp, Homo sapiens
atcataggaagggaccaaggca

SEQ ID NO: 3271054 - DNA, 17 bp, Homo sapiens
atcataggtatttcaaa

SEQ ID NO: 3271055 - DNA, 18 bp, Homo sapiens
atcataggtatttcaaaa

SEQ ID NO: 3271056 - DNA, 23 bp, Homo sapiens
atcatagtggcttaaaacaacac

SEQ ID NO: 3271057 - DNA, 20 bp, Homo sapiens
atcatataataaatgtacat

SEQ ID NO: 3271058 - DNA, 16 bp, Homo sapiens
atcatatccttgccct

SEQ ID NO: 3271059 - DNA, 14 bp, Homo sapiens
atcatatgcctgac

SEQ ID NO: 3271060 - DNA, 21 bp, Homo sapiens
atcatattggtattcactaat

SEQ ID NO: 3271061 - DNA, 14 bp, Homo sapiens
atcatatttgaaaa

SEQ ID NO: 3271062 - DNA, 17 bp, Homo sapiens
atcatatttgaaaacca

SEQ ID NO: 3271063 - DNA, 15 bp, Homo sapiens
atcatcaaaaagaaa

SEQ ID NO: 3271064 - DNA, 23 bp, Homo sapiens
atcatcaaaaagaaaaatcaaag

SEQ ID NO: 3271065 - DNA, 20 bp, Homo sapiens
atcatcaatgtgacatttac

SEQ ID NO: 3271066 - DNA, 13 bp, Homo sapiens
atcatcagggcct

SEQ ID NO: 3271067 - DNA, 15 bp, Homo sapiens
atcatcagggcctgg

SEQ ID NO: 3271068 - DNA, 23 bp, Homo sapiens
atcatccactgtgccatgtgcca

SEQ ID NO: 3271069 - DNA, 14 bp, Homo sapiens
atcatccagaagtt

SEQ ID NO: 3271070 - DNA, 12 bp, Homo sapiens
atcatccctttc

SEQ ID NO: 3271071 - DNA, 21 bp, Homo sapiens
atcatccctttctcccagtga

SEQ ID NO: 3271072 - DNA, 23 bp, Homo sapiens
atcatcctggaggggtgttgtat

SEQ ID NO: 3271073 - DNA, 17 bp, Homo sapiens
atcatcctgttttctct

SEQ ID NO: 3271074 - DNA, 18 bp, Homo sapiens
atcatcctgttttctctg

SEQ ID NO: 3271075 - DNA, 20 bp, Homo sapiens
atcatcctttgttctgagca

SEQ ID NO: 3271076 - DNA, 21 bp, Homo sapiens
atcatctgcagttctttttgt

SEQ ID NO: 3271077 - DNA, 18 bp, Homo sapiens
atcatctgtgtgaaaatg

SEQ ID NO: 3271078 - DNA, 14 bp, Homo sapiens
atcatgaaatatgc

SEQ ID NO: 3271079 - DNA, 19 bp, Homo sapiens
atcatgaacagctctgaga

SEQ ID NO: 3271080 - DNA, 19 bp, Homo sapiens
atcatgaattcccttttaa

SEQ ID NO: 3271081 - DNA, 20 bp, Homo sapiens
atcatgaattcccttttaat

SEQ ID NO: 3271082 - DNA, 13 bp, Homo sapiens
atcatgaatttta

SEQ ID NO: 3271083 - DNA, 17 bp, Homo sapiens
atcatgaattttaaagt

SEQ ID NO: 3271084 - DNA, 12 bp, Homo sapiens
atcatgcaaaat

SEQ ID NO: 3271085 - DNA, 19 bp, Homo sapiens
atcatgccagtatttttaa

SEQ ID NO: 3271086 - DNA, 21 bp, Homo sapiens
atcatgcccggtcccacccct

SEQ ID NO: 3271087 - DNA, 23 bp, Homo sapiens
atcatgcccggtcccacccctcc

SEQ ID NO: 3271088 - DNA, 19 bp, Homo sapiens
atcatgccttgataaatat

SEQ ID NO: 3271089 - DNA, 20 bp, Homo sapiens
atcatgccttgataaatata

SEQ ID NO: 3271090 - DNA, 22 bp, Homo sapiens
atcatgccttgataaatatata

SEQ ID NO: 3271091 - DNA, 14 bp, Homo sapiens
atcatgctgttgca

SEQ ID NO: 3271092 - DNA, 19 bp, Homo sapiens
atcatggaggtttgaagat

SEQ ID NO: 3271093 - DNA, 22 bp, Homo sapiens
atcatggtagagaatctctccc

SEQ ID NO: 3271094 - DNA, 23 bp, Homo sapiens
atcatggtggatatggtgcagag

SEQ ID NO: 3271095 - DNA, 16 bp, Homo sapiens
atcatggtgtaataag

SEQ ID NO: 3271096 - DNA, 13 bp, Homo sapiens
atcatgtactttg

SEQ ID NO: 3271097 - DNA, 17 bp, Homo sapiens
atcatgtactttttagt

SEQ ID NO: 3271098 - DNA, 18 bp, Homo sapiens
atcatgtactttttagta

SEQ ID NO: 3271099 - DNA, 16 bp, Homo sapiens
atcatgtatgttatga

SEQ ID NO: 3271100 - DNA, 17 bp, Homo sapiens
atccaagcctccacagc

SEQ ID NO: 3271101 - DNA, 23 bp, Homo sapiens
atccaagcttttttaaagtaaaa

SEQ ID NO: 3271102 - DNA, 13 bp, Homo sapiens
atccaaggagaaa

SEQ ID NO: 3271103 - DNA, 19 bp, Homo sapiens
atccaaggagaaacagaga

SEQ ID NO: 3271104 - DNA, 14 bp, Homo sapiens
atccaaggcaaaca

SEQ ID NO: 3271105 - DNA, 17 bp, Homo sapiens
atccaaggcaaacaatc

SEQ ID NO: 3271106 - DNA, 19 bp, Homo sapiens
atccaatattttctttaat

SEQ ID NO: 3271107 - DNA, 19 bp, Homo sapiens
atccaatcctcactgggtg

SEQ ID NO: 3271108 - DNA, 20 bp, Homo sapiens
atccaatcctcactgggtgg

SEQ ID NO: 3271109 - DNA, 16 bp, Homo sapiens
atccaatctcaaggaa

SEQ ID NO: 3271110 - DNA, 20 bp, Homo sapiens
atccaatgggtttttccctg

SEQ ID NO: 3271111 - DNA, 20 bp, Homo sapiens
atccacacacagaggaagag

SEQ ID NO: 3271112 - DNA, 20 bp, Homo sapiens
atccacagagagtcccactg

SEQ ID NO: 3271113 - DNA, 16 bp, Homo sapiens
atccacatttctaaaa

SEQ ID NO: 3271114 - DNA, 13 bp, Homo sapiens
atccacccacctc

SEQ ID NO: 3271115 - DNA, 16 bp, Homo sapiens
atccacccacctcagc

SEQ ID NO: 3271116 - DNA, 18 bp, Homo sapiens
atccacccacctcagcct

SEQ ID NO: 3271117 - DNA, 20 bp, Homo sapiens
atccacccacctcagcctcc

SEQ ID NO: 3271118 - DNA, 14 bp, Homo sapiens
atccacccagtgct

SEQ ID NO: 3271119 - DNA, 16 bp, Homo sapiens
atccaccccctgccca

SEQ ID NO: 3271120 - DNA, 18 bp, Homo sapiens
atccacctgtctcagcct

SEQ ID NO: 3271121 - DNA, 13 bp, Homo sapiens
atccaccttggct

SEQ ID NO: 3271122 - DNA, 22 bp, Homo sapiens
atccaccttggctctgccagtg

SEQ ID NO: 3271123 - DNA, 16 bp, Homo sapiens
atccactctaccctcc

SEQ ID NO: 3271124 - DNA, 15 bp, Homo sapiens
atccagaaagaaaaa

SEQ ID NO: 3271125 - DNA, 19 bp, Homo sapiens
atccagaagttttaacttc

SEQ ID NO: 3271126 - DNA, 20 bp, Homo sapiens
atccagaattgaccttttga

SEQ ID NO: 3271127 - DNA, 22 bp, Homo sapiens
atccagacatcatgaattttac

SEQ ID NO: 3271128 - DNA, 19 bp, Homo sapiens
atccagacccggctgcgtg

SEQ ID NO: 3271129 - DNA, 13 bp, Homo sapiens
atccagactgtaa

SEQ ID NO: 3271130 - DNA, 10 bp, Homo sapiens
atccagccac

SEQ ID NO: 3271131 - DNA, 19 bp, Homo sapiens
atccagccacttccccctc

SEQ ID NO: 3271132 - DNA, 20 bp, Homo sapiens
atccagcctgtgtgttctgt

SEQ ID NO: 3271133 - DNA, 18 bp, Homo sapiens
atccaggaatatgacaca

SEQ ID NO: 3271134 - DNA, 24 bp, Homo sapiens
atccaggcagtcgggggctggcct

SEQ ID NO: 3271135 - DNA, 16 bp, Homo sapiens
atccaggttcagcttg

SEQ ID NO: 3271136 - DNA, 17 bp, Homo sapiens
atccaggttcagcttgt

SEQ ID NO: 3271137 - DNA, 15 bp, Homo sapiens
atccaggttccctcc

SEQ ID NO: 3271138 - DNA, 16 bp, Homo sapiens
atccagtattgctgat

SEQ ID NO: 3271139 - DNA, 22 bp, Homo sapiens
atccagtattgctgattttaaa

SEQ ID NO: 3271140 - DNA, 12 bp, Homo sapiens
atccagtctgaa

SEQ ID NO: 3271141 - DNA, 18 bp, Homo sapiens
atccagttggctttttaa

SEQ ID NO: 3271142 - DNA, 17 bp, Homo sapiens
atccatagtaactgaca

SEQ ID NO: 3271143 - DNA, 18 bp, Homo sapiens
atccatagtaactgacat

SEQ ID NO: 3271144 - DNA, 15 bp, Homo sapiens
atccatccatctcca

SEQ ID NO: 3271145 - DNA, 20 bp, Homo sapiens
atccatgacctagttttcca

SEQ ID NO: 3271146 - DNA, 21 bp, Homo sapiens
atccattcacaagcctcctgt

SEQ ID NO: 3271147 - DNA, 17 bp, Homo sapiens
atccattcccaagaaat

SEQ ID NO: 3271148 - DNA, 11 bp, Homo sapiens
atccattgttg

SEQ ID NO: 3271149 - DNA, 16 bp, Homo sapiens
atccatttccattgct

SEQ ID NO: 3271150 - DNA, 17 bp, Homo sapiens
atccatttccattgctt

SEQ ID NO: 3271151 - DNA, 14 bp, Homo sapiens
atccatttgccttt

SEQ ID NO: 3271152 - DNA, 20 bp, Homo sapiens
atcccaaagttgttgtaacc

SEQ ID NO: 3271153 - DNA, 22 bp, Homo sapiens
atcccaaagttgttgtaacctg

SEQ ID NO: 3271154 - DNA, 17 bp, Homo sapiens
atcccaaccagtgccaa

SEQ ID NO: 3271155 - DNA, 15 bp, Homo sapiens
atcccaagtgccagt

SEQ ID NO: 3271156 - DNA, 17 bp, Homo sapiens
atcccaatcaaagaatt

SEQ ID NO: 3271157 - DNA, 22 bp, Homo sapiens
atcccaatcaaagaattacagt

SEQ ID NO: 3271158 - DNA, 14 bp, Homo sapiens
atcccacaccctgg

SEQ ID NO: 3271159 - DNA, 15 bp, Homo sapiens
atcccaccaaccctc

SEQ ID NO: 3271160 - DNA, 14 bp, Homo sapiens
atcccacccacatg

SEQ ID NO: 3271161 - DNA, 20 bp, Homo sapiens
atcccacccacatgtgacac

SEQ ID NO: 3271162 - DNA, 13 bp, Homo sapiens
atcccacccacct

SEQ ID NO: 3271163 - DNA, 13 bp, Homo sapiens
atcccaccctggg

SEQ ID NO: 3271164 - DNA, 22 bp, Homo sapiens
atcccacctagcccaggagaga

SEQ ID NO: 3271165 - DNA, 20 bp, Homo sapiens
atcccagaaagtatatactg

SEQ ID NO: 3271166 - DNA, 13 bp, Homo sapiens
atcccagaaatta

SEQ ID NO: 3271167 - DNA, 18 bp, Homo sapiens
atcccagaccagccaagg

SEQ ID NO: 3271168 - DNA, 14 bp, Homo sapiens
atcccagcacctgc

SEQ ID NO: 3271169 - DNA, 19 bp, Homo sapiens
atcccagcactttgggagg

SEQ ID NO: 3271170 - DNA, 22 bp, Homo sapiens
atcccagcactttgggaggctg

SEQ ID NO: 3271171 - DNA, 19 bp, Homo sapiens
atcccagccccaattttct

SEQ ID NO: 3271172 - DNA, 18 bp, Homo sapiens
atcccagctacttgggaa

SEQ ID NO: 3271173 - DNA, 22 bp, Homo sapiens
atcccagctacttgggaggctg

SEQ ID NO: 3271174 - DNA, 13 bp, Homo sapiens
atcccaggccagg

SEQ ID NO: 3271175 - DNA, 19 bp, Homo sapiens
atcccaggggaccacacct

SEQ ID NO: 3271176 - DNA, 15 bp, Homo sapiens
atcccatctgctaga

SEQ ID NO: 3271177 - DNA, 21 bp, Homo sapiens
atcccattaatcatttcccca

SEQ ID NO: 3271178 - DNA, 20 bp, Homo sapiens
atccccaacatgcactgatg

SEQ ID NO: 3271179 - DNA, 14 bp, Homo sapiens
atccccaagtgtga

SEQ ID NO: 3271180 - DNA, 15 bp, Homo sapiens
atccccaatcagctc

SEQ ID NO: 3271181 - DNA, 12 bp, Homo sapiens
atccccaccagc

SEQ ID NO: 3271182 - DNA, 13 bp, Homo sapiens
atccccaccagct

SEQ ID NO: 3271183 - DNA, 16 bp, Homo sapiens
atccccaccagctcgt

SEQ ID NO: 3271184 - DNA, 19 bp, Homo sapiens
atccccaccttcacctcgg

SEQ ID NO: 3271185 - DNA, 19 bp, Homo sapiens
atccccaggggtcccagcc

SEQ ID NO: 3271186 - DNA, 17 bp, Homo sapiens
atccccatcctccagct

SEQ ID NO: 3271187 - DNA, 20 bp, Homo sapiens
atccccatcctccagcttct

SEQ ID NO: 3271188 - DNA, 12 bp, Homo sapiens
atcccccagcct

SEQ ID NO: 3271189 - DNA, 11 bp, Homo sapiens
atcccccaggg

SEQ ID NO: 3271190 - DNA, 17 bp, Homo sapiens
atccccccatcttgctt

SEQ ID NO: 3271191 - DNA, 12 bp, Homo sapiens
atccccctgccc

SEQ ID NO: 3271192 - DNA, 17 bp, Homo sapiens
atccccgcctggccagg

SEQ ID NO: 3271193 - DNA, 20 bp, Homo sapiens
atccccgcctggccaggagc

SEQ ID NO: 3271194 - DNA, 22 bp, Homo sapiens
atccccgttcctgacatcacag

SEQ ID NO: 3271195 - DNA, 16 bp, Homo sapiens
atcccctcgtcctgtc

SEQ ID NO: 3271196 - DNA, 17 bp, Homo sapiens
atcccctcgtcctgtcc

SEQ ID NO: 3271197 - DNA, 19 bp, Homo sapiens
atcccctcgtcctgtccca

SEQ ID NO: 3271198 - DNA, 14 bp, Homo sapiens
atcccctgagcccc

SEQ ID NO: 3271199 - DNA, 19 bp, Homo sapiens
atcccctgtgccctgcacg

SEQ ID NO: 3271200 - DNA, 13 bp, Homo sapiens
atcccgaagaatg

SEQ ID NO: 3271201 - DNA, 22 bp, Homo sapiens
atcccgaagaatggagaggaac

SEQ ID NO: 3271202 - DNA, 16 bp, Homo sapiens
atcccgagtctgggac

SEQ ID NO: 3271203 - DNA, 17 bp, Homo sapiens
atcccgagtctgggaca

SEQ ID NO: 3271204 - DNA, 17 bp, Homo sapiens
atcccggaggaaatctg

SEQ ID NO: 3271205 - DNA, 14 bp, Homo sapiens
atcccggcctcttc

SEQ ID NO: 3271206 - DNA, 16 bp, Homo sapiens
atcccggcctcttcca

SEQ ID NO: 3271207 - DNA, 13 bp, Homo sapiens
atcccgtgttctc

SEQ ID NO: 3271208 - DNA, 22 bp, Homo sapiens
atccctaccccctaagagccat

SEQ ID NO: 3271209 - DNA, 17 bp, Homo sapiens
atccctatgtttgtctc

SEQ ID NO: 3271210 - DNA, 13 bp, Homo sapiens
atccctatttaat

SEQ ID NO: 3271211 - DNA, 16 bp, Homo sapiens
atccctcaattgaatg

SEQ ID NO: 3271212 - DNA, 17 bp, Homo sapiens
atccctcacctgtagca

SEQ ID NO: 3271213 - DNA, 17 bp, Homo sapiens
atccctcaccttctgag

SEQ ID NO: 3271214 - DNA, 22 bp, Homo sapiens
atccctcggaagccgtctgact

SEQ ID NO: 3271215 - DNA, 23 bp, Homo sapiens
atccctcgggaagcagccagctc

SEQ ID NO: 3271216 - DNA, 15 bp, Homo sapiens
atccctctcctaact

SEQ ID NO: 3271217 - DNA, 15 bp, Homo sapiens
atccctcttgtaagt

SEQ ID NO: 3271218 - DNA, 20 bp, Homo sapiens
atccctgatcccattttcct

SEQ ID NO: 3271219 - DNA, 19 bp, Homo sapiens
atccctgatcctaactgaa

SEQ ID NO: 3271220 - DNA, 14 bp, Homo sapiens
atccctggagcagg

SEQ ID NO: 3271221 - DNA, 18 bp, Homo sapiens
atccctgttacccagaga

SEQ ID NO: 3271222 - DNA, 14 bp, Homo sapiens
atccctgtttaata

SEQ ID NO: 3271223 - DNA, 17 bp, Homo sapiens
atccctgtttaatattt

SEQ ID NO: 3271224 - DNA, 18 bp, Homo sapiens
atccctgtttaatattta

SEQ ID NO: 3271225 - DNA, 20 bp, Homo sapiens
atccctgtttaatatttaaa

SEQ ID NO: 3271226 - DNA, 23 bp, Homo sapiens
atccctgtttaatatttaaacag

SEQ ID NO: 3271227 - DNA, 18 bp, Homo sapiens
atcccttcacagtcccag

SEQ ID NO: 3271228 - DNA, 12 bp, Homo sapiens
atcccttcctgg

SEQ ID NO: 3271229 - DNA, 19 bp, Homo sapiens
atcccttcctggaaacagc

SEQ ID NO: 3271230 - DNA, 23 bp, Homo sapiens
atcccttcctggaaacagcatga

SEQ ID NO: 3271231 - DNA, 19 bp, Homo sapiens
atcccttccttttagccta

SEQ ID NO: 3271232 - DNA, 21 bp, Homo sapiens
atcccttccttttagcctagt

SEQ ID NO: 3271233 - DNA, 19 bp, Homo sapiens
atccctttacaatgtgaat

SEQ ID NO: 3271234 - DNA, 14 bp, Homo sapiens
atccctttattacc

SEQ ID NO: 3271235 - DNA, 16 bp, Homo sapiens
atccctttcccttggt

SEQ ID NO: 3271236 - DNA, 15 bp, Homo sapiens
atcccttttcctgtc

SEQ ID NO: 3271237 - DNA, 15 bp, Homo sapiens
atccctttttcaatg

SEQ ID NO: 3271238 - DNA, 16 bp, Homo sapiens
atccctttttttacat

SEQ ID NO: 3271239 - DNA, 19 bp, Homo sapiens
atccctttttttacatttc

SEQ ID NO: 3271240 - DNA, 20 bp, Homo sapiens
atccctttttttacatttca

SEQ ID NO: 3271241 - DNA, 15 bp, Homo sapiens
atccgactctaagct

SEQ ID NO: 3271242 - DNA, 16 bp, Homo sapiens
atccgactctaagctg

SEQ ID NO: 3271243 - DNA, 23 bp, Homo sapiens
atccgactctaagctgtgtgcag

SEQ ID NO: 3271244 - DNA, 17 bp, Homo sapiens
atccgactgctttggac

SEQ ID NO: 3271245 - DNA, 18 bp, Homo sapiens
atccgcctacctcagcct

SEQ ID NO: 3271246 - DNA, 15 bp, Homo sapiens
atccgccttttgtat

SEQ ID NO: 3271247 - DNA, 12 bp, Homo sapiens
atccgctgccac

SEQ ID NO: 3271248 - DNA, 13 bp, Homo sapiens
atccgctgccacc

SEQ ID NO: 3271249 - DNA, 23 bp, Homo sapiens
atccgctgccaccacgtctgcca

SEQ ID NO: 3271250 - DNA, 20 bp, Homo sapiens
atccggtcccctgcctggaa

SEQ ID NO: 3271251 - DNA, 16 bp, Homo sapiens
atccgtcattgctgct

SEQ ID NO: 3271252 - DNA, 13 bp, Homo sapiens
atccgtgtatttg

SEQ ID NO: 3271253 - DNA, 15 bp, Homo sapiens
atcctaagacacaaa

SEQ ID NO: 3271254 - DNA, 18 bp, Homo sapiens
atcctaagatgtgttctt

SEQ ID NO: 3271255 - DNA, 17 bp, Homo sapiens
atcctaagcatctaagt

SEQ ID NO: 3271256 - DNA, 18 bp, Homo sapiens
atcctaatttctcctccc

SEQ ID NO: 3271257 - DNA, 23 bp, Homo sapiens
atcctaatttctcctcccttcct

SEQ ID NO: 3271258 - DNA, 18 bp, Homo sapiens
atcctacaatattttatt

SEQ ID NO: 3271259 - DNA, 15 bp, Homo sapiens
atcctagatcctaag

SEQ ID NO: 3271260 - DNA, 17 bp, Homo sapiens
atcctagtttcctctcc

SEQ ID NO: 3271261 - DNA, 23 bp, Homo sapiens
atcctatctggggagctcctggc

SEQ ID NO: 3271262 - DNA, 16 bp, Homo sapiens
atcctattgttgatgg

SEQ ID NO: 3271263 - DNA, 21 bp, Homo sapiens
atcctcaaagaaagtgtattg

SEQ ID NO: 3271264 - DNA, 15 bp, Homo sapiens
atcctcactgggtgg

SEQ ID NO: 3271265 - DNA, 21 bp, Homo sapiens
atcctcatatggcccagtgtc

SEQ ID NO: 3271266 - DNA, 15 bp, Homo sapiens
atcctcatccctgac

SEQ ID NO: 3271267 - DNA, 17 bp, Homo sapiens
atcctcattgcctcctg

SEQ ID NO: 3271268 - DNA, 15 bp, Homo sapiens
atcctccacatcctg

SEQ ID NO: 3271269 - DNA, 21 bp, Homo sapiens
atcctccacatcctgtgtcag

SEQ ID NO: 3271270 - DNA, 15 bp, Homo sapiens
atcctcccacctcag

SEQ ID NO: 3271271 - DNA, 19 bp, Homo sapiens
atcctccctatcaagcact

SEQ ID NO: 3271272 - DNA, 17 bp, Homo sapiens
atcctccctggcagaca

SEQ ID NO: 3271273 - DNA, 20 bp, Homo sapiens
atcctccctggcagacacaa

SEQ ID NO: 3271274 - DNA, 16 bp, Homo sapiens
atcctccgtccagccg

SEQ ID NO: 3271275 - DNA, 18 bp, Homo sapiens
atcctcctcagcccccag

SEQ ID NO: 3271276 - DNA, 23 bp, Homo sapiens
atcctcctcagcccccaggccag

SEQ ID NO: 3271277 - DNA, 13 bp, Homo sapiens
atcctcctccagg

SEQ ID NO: 3271278 - DNA, 21 bp, Homo sapiens
atcctcctggaaccttgctgt

SEQ ID NO: 3271279 - DNA, 23 bp, Homo sapiens
atcctcctggaaccttgctgtcc

SEQ ID NO: 3271280 - DNA, 12 bp, Homo sapiens
atcctctatttt

SEQ ID NO: 3271281 - DNA, 16 bp, Homo sapiens
atcctctattttgtga

SEQ ID NO: 3271282 - DNA, 22 bp, Homo sapiens
atcctctgctggttcctgactg

SEQ ID NO: 3271283 - DNA, 13 bp, Homo sapiens
atcctctggaagg

SEQ ID NO: 3271284 - DNA, 12 bp, Homo sapiens
atcctctttgta

SEQ ID NO: 3271285 - DNA, 16 bp, Homo sapiens
atcctgaaatttcaga

SEQ ID NO: 3271286 - DNA, 19 bp, Homo sapiens
atcctgaactgcttctcca

SEQ ID NO: 3271287 - DNA, 13 bp, Homo sapiens
atcctgagccccg

SEQ ID NO: 3271288 - DNA, 20 bp, Homo sapiens
atcctgagccccgccctctt

SEQ ID NO: 3271289 - DNA, 22 bp, Homo sapiens
atcctgagccccgccctcttcc

SEQ ID NO: 3271290 - DNA, 20 bp, Homo sapiens
atcctgagcttttctcctca

SEQ ID NO: 3271291 - DNA, 11 bp, Homo sapiens
atcctgaggct

SEQ ID NO: 3271292 - DNA, 13 bp, Homo sapiens
atcctgaggctcc

SEQ ID NO: 3271293 - DNA, 22 bp, Homo sapiens
atcctgaggctccacttggtct

SEQ ID NO: 3271294 - DNA, 16 bp, Homo sapiens
atcctgcagcctcctc

SEQ ID NO: 3271295 - DNA, 19 bp, Homo sapiens
atcctgcaggaacgagcac

SEQ ID NO: 3271296 - DNA, 21 bp, Homo sapiens
atcctgcaggaacgagcactg

SEQ ID NO: 3271297 - DNA, 14 bp, Homo sapiens
atcctgccaccctg

SEQ ID NO: 3271298 - DNA, 23 bp, Homo sapiens
atcctgccagccccacacagcta

SEQ ID NO: 3271299 - DNA, 10 bp, Homo sapiens
atcctgcctg

SEQ ID NO: 3271300 - DNA, 12 bp, Homo sapiens
atcctgcctggg

SEQ ID NO: 3271301 - DNA, 21 bp, Homo sapiens
atcctgcctgggtgggacagc

SEQ ID NO: 3271302 - DNA, 14 bp, Homo sapiens
atcctgcttcagtg

SEQ ID NO: 3271303 - DNA, 19 bp, Homo sapiens
atcctggaggggtgttgta

SEQ ID NO: 3271304 - DNA, 20 bp, Homo sapiens
atcctggcacccggcccctg

SEQ ID NO: 3271305 - DNA, 22 bp, Homo sapiens
atcctggctctgtggcttgcta

SEQ ID NO: 3271306 - DNA, 20 bp, Homo sapiens
atcctggggcattaaaaaaa

SEQ ID NO: 3271307 - DNA, 11 bp, Homo sapiens
atcctgggtaa

SEQ ID NO: 3271308 - DNA, 14 bp, Homo sapiens
atcctggtttcata

SEQ ID NO: 3271309 - DNA, 23 bp, Homo sapiens
atcctggtttcataacttcctgt

SEQ ID NO: 3271310 - DNA, 19 bp, Homo sapiens
atgacctgtgaccagcact

SEQ ID NO: 3271311 - DNA, 21 bp, Homo sapiens
atgacctgtgaccagcactgt

SEQ ID NO: 3271312 - DNA, 19 bp, Homo sapiens
atgacgacgacaacgatga

SEQ ID NO: 3271313 - DNA, 20 bp, Homo sapiens
atgacgccagataaaatgtt

SEQ ID NO: 3271314 - DNA, 16 bp, Homo sapiens
atgactaaaaatatta

SEQ ID NO: 3271315 - DNA, 16 bp, Homo sapiens
atgactaaagagagaa

SEQ ID NO: 3271316 - DNA, 20 bp, Homo sapiens
atgactaaagagagaatgta

SEQ ID NO: 3271317 - DNA, 14 bp, Homo sapiens
atgactaacaagat

SEQ ID NO: 3271318 - DNA, 19 bp, Homo sapiens
atgactagaggcagggagg

SEQ ID NO: 3271319 - DNA, 22 bp, Homo sapiens
atgactagaggcagggagggga

SEQ ID NO: 3271320 - DNA, 18 bp, Homo sapiens
atgactagtcacctgggg

SEQ ID NO: 3271321 - DNA, 17 bp, Homo sapiens
atgactatataatttat

SEQ ID NO: 3271322 - DNA, 20 bp, Homo sapiens
atgactccaccttctcacct

SEQ ID NO: 3271323 - DNA, 22 bp, Homo sapiens
atgactcccttaaaatagaaat

SEQ ID NO: 3271324 - DNA, 21 bp, Homo sapiens
atgactctttctgaaggaaga

SEQ ID NO: 3271325 - DNA, 22 bp, Homo sapiens
atgactgcacccagctccaggg

SEQ ID NO: 3271326 - DNA, 21 bp, Homo sapiens
atgactgctccccagccctgg

SEQ ID NO: 3271327 - DNA, 18 bp, Homo sapiens
atgactggggtgggaggt

SEQ ID NO: 3271328 - DNA, 15 bp, Homo sapiens
atgactggttgttca

SEQ ID NO: 3271329 - DNA, 18 bp, Homo sapiens
atgactgtgaccaccttc

SEQ ID NO: 3271330 - DNA, 17 bp, Homo sapiens
atgactgtttttgtagt

SEQ ID NO: 3271331 - DNA, 18 bp, Homo sapiens
atgacttaaaattggaaa

SEQ ID NO: 3271332 - DNA, 19 bp, Homo sapiens
atgacttatttctgctctg

SEQ ID NO: 3271333 - DNA, 20 bp, Homo sapiens
atgacttatttctgctctgg

SEQ ID NO: 3271334 - DNA, 20 bp, Homo sapiens
atgacttgtagcatattctt

SEQ ID NO: 3271335 - DNA, 23 bp, Homo sapiens
atgactttatatggatgattcag

SEQ ID NO: 3271336 - DNA, 13 bp, Homo sapiens
atgactttgcaga

SEQ ID NO: 3271337 - DNA, 19 bp, Homo sapiens
atgactttgcagatggaaa

SEQ ID NO: 3271338 - DNA, 16 bp, Homo sapiens
atgagaaacagctcag

SEQ ID NO: 3271339 - DNA, 21 bp, Homo sapiens
atgagaaaggttgaagcacca

SEQ ID NO: 3271340 - DNA, 22 bp, Homo sapiens
atgagaaaggttgaagcaccaa

SEQ ID NO: 3271341 - DNA, 23 bp, Homo sapiens
atgagaacaaagctgttaaactg

SEQ ID NO: 3271342 - DNA, 15 bp, Homo sapiens
atgagaagagggcct

SEQ ID NO: 3271343 - DNA, 21 bp, Homo sapiens
atgagaagagggcctgtggga

SEQ ID NO: 3271344 - DNA, 14 bp, Homo sapiens
atgagaagtacttg

SEQ ID NO: 3271345 - DNA, 13 bp, Homo sapiens
atgagaattttat

SEQ ID NO: 3271346 - DNA, 18 bp, Homo sapiens
atgagaccactgttatca

SEQ ID NO: 3271347 - DNA, 23 bp, Homo sapiens
atgagacttccaaacctgacaga

SEQ ID NO: 3271348 - DNA, 13 bp, Homo sapiens
atgagagcccaga

SEQ ID NO: 3271349 - DNA, 19 bp, Homo sapiens
atgagatattaaaataagc

SEQ ID NO: 3271350 - DNA, 20 bp, Homo sapiens
atgagatctaatgtgaaaat

SEQ ID NO: 3271351 - DNA, 20 bp, Homo sapiens
atgagattggttttcctgtg

SEQ ID NO: 3271352 - DNA, 19 bp, Homo sapiens
atgagatttgccagcacag

SEQ ID NO: 3271353 - DNA, 20 bp, Homo sapiens
atgagatttgccagcacagg

SEQ ID NO: 3271354 - DNA, 20 bp, Homo sapiens
atgagcatcctgagccccgc

SEQ ID NO: 3271355 - DNA, 17 bp, Homo sapiens
atgagccactgagcctg

SEQ ID NO: 3271356 - DNA, 14 bp, Homo sapiens
atgagccagacaaa

SEQ ID NO: 3271357 - DNA, 14 bp, Homo sapiens
atgagcccagagaa

SEQ ID NO: 3271358 - DNA, 18 bp, Homo sapiens
atgagcccagagaacagc

SEQ ID NO: 3271359 - DNA, 19 bp, Homo sapiens
atgagcctcagcatcctgg

SEQ ID NO: 3271360 - DNA, 16 bp, Homo sapiens
atgagcctgcccgctg

SEQ ID NO: 3271361 - DNA, 21 bp, Homo sapiens
atgagctacaacaaaaggact

SEQ ID NO: 3271362 - DNA, 20 bp, Homo sapiens
atgagctatttccattccag

SEQ ID NO: 3271363 - DNA, 21 bp, Homo sapiens
atgagctatttccattccaga

SEQ ID NO: 3271364 - DNA, 21 bp, Homo sapiens
atgagctcgcatttgtcaatg

SEQ ID NO: 3271365 - DNA, 18 bp, Homo sapiens
atgagctttctttgcact

SEQ ID NO: 3271366 - DNA, 17 bp, Homo sapiens
atgcaaggattacagaa

SEQ ID NO: 3271367 - DNA, 15 bp, Homo sapiens
atgcaagtctgtgag

SEQ ID NO: 3271368 - DNA, 14 bp, Homo sapiens
atgcaataaaattt

SEQ ID NO: 3271369 - DNA, 23 bp, Homo sapiens
atgcaataaaatttaaaaaataa

SEQ ID NO: 3271370 - DNA, 14 bp, Homo sapiens
atgcaatctctttt

SEQ ID NO: 3271371 - DNA, 16 bp, Homo sapiens
atgcaattcatcccag

SEQ ID NO: 3271372 - DNA, 12 bp, Homo sapiens
atgcaatttgat

SEQ ID NO: 3271373 - DNA, 20 bp, Homo sapiens
atgcacactagcctctccag

SEQ ID NO: 3271374 - DNA, 13 bp, Homo sapiens
atgcacagatata

SEQ ID NO: 3271375 - DNA, 18 bp, Homo sapiens
atgcacagatatactttg

SEQ ID NO: 3271376 - DNA, 15 bp, Homo sapiens
atgcacagtatcttt

SEQ ID NO: 3271377 - DNA, 19 bp, Homo sapiens
atgcacagttgccacattt

SEQ ID NO: 3271378 - DNA, 18 bp, Homo sapiens
atgcacatatggactctg

SEQ ID NO: 3271379 - DNA, 19 bp, Homo sapiens
atgcacatatggactctgc

SEQ ID NO: 3271380 - DNA, 12 bp, Homo sapiens
atgcacatttct

SEQ ID NO: 3271381 - DNA, 14 bp, Homo sapiens
atgcaccaccaagc

SEQ ID NO: 3271382 - DNA, 15 bp, Homo sapiens
atgcaccaccaagcc

SEQ ID NO: 3271383 - DNA, 18 bp, Homo sapiens
atgcaccctccctcctgc

SEQ ID NO: 3271384 - DNA, 21 bp, Homo sapiens
atgcaccttgtgtctgtacac

SEQ ID NO: 3271385 - DNA, 15 bp, Homo sapiens
atgcacggcctcgcg

SEQ ID NO: 3271386 - DNA, 23 bp, Homo sapiens
atgcacgtttcaaagctttcctg

SEQ ID NO: 3271387 - DNA, 15 bp, Homo sapiens
atgcactatatgttt

SEQ ID NO: 3271388 - DNA, 22 bp, Homo sapiens
atgcactgaaaacttagccaga

SEQ ID NO: 3271389 - DNA, 17 bp, Homo sapiens
atgcactgacccttcca

SEQ ID NO: 3271390 - DNA, 22 bp, Homo sapiens
atgcactgacccttccagacat

SEQ ID NO: 3271391 - DNA, 20 bp, Homo sapiens
atgcagaagcatattttgct

SEQ ID NO: 3271392 - DNA, 21 bp, Homo sapiens
atgcagactcctcagatctga

SEQ ID NO: 3271393 - DNA, 16 bp, Homo sapiens
atgcagagagccattt

SEQ ID NO: 3271394 - DNA, 19 bp, Homo sapiens
atgcagagagccattttgt

SEQ ID NO: 3271395 - DNA, 18 bp, Homo sapiens
atgcagattcctgggcct

SEQ ID NO: 3271396 - DNA, 15 bp, Homo sapiens
atgcagcccatgccc

SEQ ID NO: 3271397 - DNA, 21 bp, Homo sapiens
atgcagcccatgcccacctgc

SEQ ID NO: 3271398 - DNA, 15 bp, Homo sapiens
atgcaggaaggaaaa

SEQ ID NO: 3271399 - DNA, 18 bp, Homo sapiens
atgcaggaaggaaaacta

SEQ ID NO: 3271400 - DNA, 12 bp, Homo sapiens
atgcaggacagg

SEQ ID NO: 3271401 - DNA, 17 bp, Homo sapiens
atgcaggacaggaggcg

SEQ ID NO: 3271402 - DNA, 22 bp, Homo sapiens
atgcaggcacttattgtaaatt

SEQ ID NO: 3271403 - DNA, 24 bp, Homo sapiens
atgcaggcatgcttctcaccgtgc

SEQ ID NO: 3271404 - DNA, 19 bp, Homo sapiens
atgcagggaggggaggcag

SEQ ID NO: 3271405 - DNA, 22 bp, Homo sapiens
atgcagtaacattctacttgct

SEQ ID NO: 3271406 - DNA, 19 bp, Homo sapiens
atgcagtacttttgttgta

SEQ ID NO: 3271407 - DNA, 19 bp, Homo sapiens
atgcagtcctgaggagagg

SEQ ID NO: 3271408 - DNA, 18 bp, Homo sapiens
atgcagtgatatggcaga

SEQ ID NO: 3271409 - DNA, 19 bp, Homo sapiens
atgcagtgatatggcagaa

SEQ ID NO: 3271410 - DNA, 21 bp, Homo sapiens
atgcagtgatatggcagaaga

SEQ ID NO: 3271411 - DNA, 22 bp, Homo sapiens
atgcagtgatatggcagaagac

SEQ ID NO: 3271412 - DNA, 23 bp, Homo sapiens
atgcagtggtatgatcacggctc

SEQ ID NO: 3271413 - DNA, 20 bp, Homo sapiens
atgcagttagctgaagaatt

SEQ ID NO: 3271414 - DNA, 22 bp, Homo sapiens
atgcagttagctgaagaattga

SEQ ID NO: 3271415 - DNA, 14 bp, Homo sapiens
atgcataaatatgc

SEQ ID NO: 3271416 - DNA, 15 bp, Homo sapiens
atgcataaatatgca

SEQ ID NO: 3271417 - DNA, 21 bp, Homo sapiens
atgcataaatatgcagtgata

SEQ ID NO: 3271418 - DNA, 17 bp, Homo sapiens
atgcatacagttttcta

SEQ ID NO: 3271419 - DNA, 16 bp, Homo sapiens
atgcatagagccctgg

SEQ ID NO: 3271420 - DNA, 19 bp, Homo sapiens
atgcatagagccctggcca

SEQ ID NO: 3271421 - DNA, 21 bp, Homo sapiens
atgcatcacgtaccccactgg

SEQ ID NO: 3271422 - DNA, 20 bp, Homo sapiens
atgcatcgggaaagaagaaa

SEQ ID NO: 3271423 - DNA, 22 bp, Homo sapiens
atgcatcgggaaagaagaaact

SEQ ID NO: 3271424 - DNA, 23 bp, Homo sapiens
atgcatcgggaaagaagaaactc

SEQ ID NO: 3271425 - DNA, 14 bp, Homo sapiens
atgcatctagatta

SEQ ID NO: 3271426 - DNA, 22 bp, Homo sapiens
atgcatctcactggatgcaaag

SEQ ID NO: 3271427 - DNA, 12 bp, Homo sapiens
atgcatgaacaa

SEQ ID NO: 3271428 - DNA, 20 bp, Homo sapiens
atgcatggaaacctgaaaaa

SEQ ID NO: 3271429 - DNA, 16 bp, Homo sapiens
atgcatgtcctgtaaa

SEQ ID NO: 3271430 - DNA, 15 bp, Homo sapiens
atgcatgtcttttaa

SEQ ID NO: 3271431 - DNA, 21 bp, Homo sapiens
atgcattataggatcatttgt

SEQ ID NO: 3271432 - DNA, 16 bp, Homo sapiens
atgcattattaaattg

SEQ ID NO: 3271433 - DNA, 17 bp, Homo sapiens
atgcattcttctctgtt

SEQ ID NO: 3271434 - DNA, 18 bp, Homo sapiens
atgcattgtcttgtggag

SEQ ID NO: 3271435 - DNA, 16 bp, Homo sapiens
atgcattgttggctat

SEQ ID NO: 3271436 - DNA, 20 bp, Homo sapiens
atgcattgttggctatttga

SEQ ID NO: 3271437 - DNA, 22 bp, Homo sapiens
atgcattgttggctatttgaaa

SEQ ID NO: 3271438 - DNA, 19 bp, Homo sapiens
atgcatttaataaagatga

SEQ ID NO: 3271439 - DNA, 22 bp, Homo sapiens
atgcatttaataaagatgagtt

SEQ ID NO: 3271440 - DNA, 16 bp, Homo sapiens
atgcatttcaaatgtt

SEQ ID NO: 3271441 - DNA, 18 bp, Homo sapiens
atgcatttcattcaaatc

SEQ ID NO: 3271442 - DNA, 17 bp, Homo sapiens
atgcatttgaggtcaag

SEQ ID NO: 3271443 - DNA, 23 bp, Homo sapiens
atgcattttattttagacacaaa

SEQ ID NO: 3271444 - DNA, 16 bp, Homo sapiens
atgcattttcttgtat

SEQ ID NO: 3271445 - DNA, 12 bp, Homo sapiens
atgcattttgca

SEQ ID NO: 3271446 - DNA, 13 bp, Homo sapiens
atgcattttgcag

SEQ ID NO: 3271447 - DNA, 19 bp, Homo sapiens
atgcattttgcagcagtga

SEQ ID NO: 3271448 - DNA, 19 bp, Homo sapiens
atgccaaggggctgagtga

SEQ ID NO: 3271449 - DNA, 18 bp, Homo sapiens
atgccacatcaaaccttt

SEQ ID NO: 3271450 - DNA, 13 bp, Homo sapiens
atgccaccctcac

SEQ ID NO: 3271451 - DNA, 22 bp, Homo sapiens
atgccaccctcacacacacagc

SEQ ID NO: 3271452 - DNA, 14 bp, Homo sapiens
atgccacgttccac

SEQ ID NO: 3271453 - DNA, 14 bp, Homo sapiens
atgccactcctccc

SEQ ID NO: 3271454 - DNA, 17 bp, Homo sapiens
atgccactcctccctcc

SEQ ID NO: 3271455 - DNA, 14 bp, Homo sapiens
atgccactgccagg

SEQ ID NO: 3271456 - DNA, 16 bp, Homo sapiens
atgccactgccaggca

SEQ ID NO: 3271457 - DNA, 18 bp, Homo sapiens
atgccactgccaggcacc

SEQ ID NO: 3271458 - DNA, 20 bp, Homo sapiens
atgccactgccaggcacctg

SEQ ID NO: 3271459 - DNA, 23 bp, Homo sapiens
atgccactgccaggcacctggcc

SEQ ID NO: 3271460 - DNA, 14 bp, Homo sapiens
atgccactgccttc

SEQ ID NO: 3271461 - DNA, 18 bp, Homo sapiens
atgccagcccctgcctgg

SEQ ID NO: 3271462 - DNA, 15 bp, Homo sapiens
atgccagcccttcag

SEQ ID NO: 3271463 - DNA, 12 bp, Homo sapiens
atgccaggacac

SEQ ID NO: 3271464 - DNA, 23 bp, Homo sapiens
atgccagtaacgcgtcttcctga

SEQ ID NO: 3271465 - DNA, 20 bp, Homo sapiens
atgccagtatttttaaaggc

SEQ ID NO: 3271466 - DNA, 22 bp, Homo sapiens
atgccagtatttttaaaggcat

SEQ ID NO: 3271467 - DNA, 19 bp, Homo sapiens
atgccatctgtgtcctggt

SEQ ID NO: 3271468 - DNA, 12 bp, Homo sapiens
atgcccaccccc

SEQ ID NO: 3271469 - DNA, 15 bp, Homo sapiens
atgcccaccccctgc

SEQ ID NO: 3271470 - DNA, 15 bp, Homo sapiens
atgcccacctgccca

SEQ ID NO: 3271471 - DNA, 20 bp, Homo sapiens
atgcccagagggcccaggca

SEQ ID NO: 3271472 - DNA, 22 bp, Homo sapiens
atgcccagagggcccaggcagg

SEQ ID NO: 3271473 - DNA, 17 bp, Homo sapiens
atgccccctccaggaga

SEQ ID NO: 3271474 - DNA, 18 bp, Homo sapiens
atgccccctttcagatgt

SEQ ID NO: 3271475 - DNA, 19 bp, Homo sapiens
atgccccctttcagatgtc

SEQ ID NO: 3271476 - DNA, 16 bp, Homo sapiens
atgccccggccacctc

SEQ ID NO: 3271477 - DNA, 19 bp, Homo sapiens
atgccccggccacctctgc

SEQ ID NO: 3271478 - DNA, 20 bp, Homo sapiens
atgccccggccacctctgcg

SEQ ID NO: 3271479 - DNA, 17 bp, Homo sapiens
atgcccggctaattttt

SEQ ID NO: 3271480 - DNA, 14 bp, Homo sapiens
atgccctcagggga

SEQ ID NO: 3271481 - DNA, 12 bp, Homo sapiens
atgccctcctgg

SEQ ID NO: 3271482 - DNA, 14 bp, Homo sapiens
atgccctggatcca

SEQ ID NO: 3271483 - DNA, 23 bp, Homo sapiens
atgcccttctgattcccctccac

SEQ ID NO: 3271484 - DNA, 22 bp, Homo sapiens
atgccgtggattgcacgtggcc

SEQ ID NO: 3271485 - DNA, 23 bp, Homo sapiens
atgcctacaaccatccctgccac

SEQ ID NO: 3271486 - DNA, 16 bp, Homo sapiens
atgcctcactaatttt

SEQ ID NO: 3271487 - DNA, 20 bp, Homo sapiens
atgcctcactaatttttgta

SEQ ID NO: 3271488 - DNA, 23 bp, Homo sapiens
atgcctcactaatttttgtatta

SEQ ID NO: 3271489 - DNA, 18 bp, Homo sapiens
atgcctcagcctctcaag

SEQ ID NO: 3271490 - DNA, 18 bp, Homo sapiens
atgcctcatgccacacct

SEQ ID NO: 3271491 - DNA, 14 bp, Homo sapiens
atgcctccaagcca

SEQ ID NO: 3271492 - DNA, 21 bp, Homo sapiens
atgcctctggaggcctctggc

SEQ ID NO: 3271493 - DNA, 17 bp, Homo sapiens
atgcctgagggtggaga

SEQ ID NO: 3271494 - DNA, 16 bp, Homo sapiens
atgcctggtctttcct

SEQ ID NO: 3271495 - DNA, 18 bp, Homo sapiens
atgcctggtctttcctct

SEQ ID NO: 3271496 - DNA, 11 bp, Homo sapiens
atgcctggtgg

SEQ ID NO: 3271497 - DNA, 15 bp, Homo sapiens
atgcctggtggcagc

SEQ ID NO: 3271498 - DNA, 24 bp, Homo sapiens
atgcctgtagctttcctggtccct

SEQ ID NO: 3271499 - DNA, 18 bp, Homo sapiens
atgcctgtccagcctggg

SEQ ID NO: 3271500 - DNA, 22 bp, Homo sapiens
atgcctgtctctgttcagatgt

SEQ ID NO: 3271501 - DNA, 23 bp, Homo sapiens
atgcctgtctctgttcagatgtg

SEQ ID NO: 3271502 - DNA, 18 bp, Homo sapiens
atgccttactcttcttga

SEQ ID NO: 3271503 - DNA, 20 bp, Homo sapiens
atgccttcttattgctttta

SEQ ID NO: 3271504 - DNA, 13 bp, Homo sapiens
atgccttgaactg

SEQ ID NO: 3271505 - DNA, 17 bp, Homo sapiens
atgccttgataaatata

SEQ ID NO: 3271506 - DNA, 12 bp, Homo sapiens
atgccttgtgct

SEQ ID NO: 3271507 - DNA, 20 bp, Homo sapiens
atgcctttaaatctgtgatg

SEQ ID NO: 3271508 - DNA, 12 bp, Homo sapiens
atgcctttctct

SEQ ID NO: 3271509 - DNA, 16 bp, Homo sapiens
atgcctttctctccta

SEQ ID NO: 3271510 - DNA, 15 bp, Homo sapiens
atgcctttgagacag

SEQ ID NO: 3271511 - DNA, 16 bp, Homo sapiens
atgcctttgagacagt

SEQ ID NO: 3271512 - DNA, 22 bp, Homo sapiens
atgcctttgagacagtttctta

SEQ ID NO: 3271513 - DNA, 12 bp, Homo sapiens
atgcctttgtaa

SEQ ID NO: 3271514 - DNA, 13 bp, Homo sapiens
atgcctttgtaag

SEQ ID NO: 3271515 - DNA, 15 bp, Homo sapiens
atgcctttgtaagtt

SEQ ID NO: 3271516 - DNA, 23 bp, Homo sapiens
atgcgctcagggccatgctgagg

SEQ ID NO: 3271517 - DNA, 16 bp, Homo sapiens
atgcgtgcccagctct

SEQ ID NO: 3271518 - DNA, 16 bp, Homo sapiens
atgcgtgccgcctgct

SEQ ID NO: 3271519 - DNA, 19 bp, Homo sapiens
atgcgtgccgcctgctcct

SEQ ID NO: 3271520 - DNA, 21 bp, Homo sapiens
atgcgtgccgcctgctcctca

SEQ ID NO: 3271521 - DNA, 14 bp, Homo sapiens
atgcgttcactcca

SEQ ID NO: 3271522 - DNA, 15 bp, Homo sapiens
atgcgttcactccaa

SEQ ID NO: 3271523 - DNA, 15 bp, Homo sapiens
atgctaacaaagaca

SEQ ID NO: 3271524 - DNA, 14 bp, Homo sapiens
atgctaacatctaa

SEQ ID NO: 3271525 - DNA, 16 bp, Homo sapiens
atgctaacatctaaaa

SEQ ID NO: 3271526 - DNA, 17 bp, Homo sapiens
atgctaatcttgtccct

SEQ ID NO: 3271527 - DNA, 19 bp, Homo sapiens
atgctagaaaaatgttctt

SEQ ID NO: 3271528 - DNA, 15 bp, Homo sapiens
atgctagaactccct

SEQ ID NO: 3271529 - DNA, 19 bp, Homo sapiens
atgctagaactccctttca

SEQ ID NO: 3271530 - DNA, 20 bp, Homo sapiens
atgctagaactccctttcaa

SEQ ID NO: 3271531 - DNA, 21 bp, Homo sapiens
atgctagaactccctttcaac

SEQ ID NO: 3271532 - DNA, 17 bp, Homo sapiens
atgctagccccagagat

SEQ ID NO: 3271533 - DNA, 21 bp, Homo sapiens
atgctaggatgcggaaatccc

SEQ ID NO: 3271534 - DNA, 15 bp, Homo sapiens
atgctattgaaaatg

SEQ ID NO: 3271535 - DNA, 22 bp, Homo sapiens
atgctatttatgcaagttaggg

SEQ ID NO: 3271536 - DNA, 18 bp, Homo sapiens
atgctcacctctagcctt

SEQ ID NO: 3271537 - DNA, 16 bp, Homo sapiens
atgctcatctgctggt

SEQ ID NO: 3271538 - DNA, 16 bp, Homo sapiens
atgctccaagattcta

SEQ ID NO: 3271539 - DNA, 17 bp, Homo sapiens
atgctccaagattctag

SEQ ID NO: 3271540 - DNA, 11 bp, Homo sapiens
atgctcccagc

SEQ ID NO: 3271541 - DNA, 18 bp, Homo sapiens
atgctcccagctgtgctg

SEQ ID NO: 3271542 - DNA, 14 bp, Homo sapiens
atgctccctcagcc

SEQ ID NO: 3271543 - DNA, 17 bp, Homo sapiens
atgctccctcagcctca

SEQ ID NO: 3271544 - DNA, 22 bp, Homo sapiens
atgctccctcccctgccctggt

SEQ ID NO: 3271545 - DNA, 13 bp, Homo sapiens
atgctcctagttt

SEQ ID NO: 3271546 - DNA, 22 bp, Homo sapiens
atgctcctagtttgacctcaca

SEQ ID NO: 3271547 - DNA, 16 bp, Homo sapiens
atgctcctcactgccc

SEQ ID NO: 3271548 - DNA, 22 bp, Homo sapiens
atgctctcactgtttgttttta

SEQ ID NO: 3271549 - DNA, 23 bp, Homo sapiens
atgctctgagaagaggagccctc

SEQ ID NO: 3271550 - DNA, 15 bp, Homo sapiens
atgctctgcatgtta

SEQ ID NO: 3271551 - DNA, 21 bp, Homo sapiens
atgctctgccccaagccccca

SEQ ID NO: 3271552 - DNA, 14 bp, Homo sapiens
atgctcttctgtgg

SEQ ID NO: 3271553 - DNA, 16 bp, Homo sapiens
atgctctttacttcat

SEQ ID NO: 3271554 - DNA, 14 bp, Homo sapiens
atgctctttccctt

SEQ ID NO: 3271555 - DNA, 18 bp, Homo sapiens
atgctctttcccttttct

SEQ ID NO: 3271556 - DNA, 19 bp, Homo sapiens
atgctctttcccttttctg

SEQ ID NO: 3271557 - DNA, 16 bp, Homo sapiens
atgctgaatatctgtt

SEQ ID NO: 3271558 - DNA, 18 bp, Homo sapiens
atgctgaatatctgttca

SEQ ID NO: 3271559 - DNA, 19 bp, Homo sapiens
atgctgaatatctgttcac

SEQ ID NO: 3271560 - DNA, 15 bp, Homo sapiens
atgctgaatccacct

SEQ ID NO: 3271561 - DNA, 18 bp, Homo sapiens
atgctgaatccacctcgg

SEQ ID NO: 3271562 - DNA, 19 bp, Homo sapiens
atgctgactgtactcctcc

SEQ ID NO: 3271563 - DNA, 22 bp, Homo sapiens
atgctgagcttgtcttttctgc

SEQ ID NO: 3271564 - DNA, 20 bp, Homo sapiens
atgctgaggatataagcttt

SEQ ID NO: 3271565 - DNA, 23 bp, Homo sapiens
atgctgagggtgtttcttcctgc

SEQ ID NO: 3271566 - DNA, 14 bp, Homo sapiens
atgctgagtctccc

SEQ ID NO: 3271567 - DNA, 18 bp, Homo sapiens
atgctgagtctcccaagg

SEQ ID NO: 3271568 - DNA, 12 bp, Homo sapiens
atgctgatcatc

SEQ ID NO: 3271569 - DNA, 17 bp, Homo sapiens
atctctacccctttctt

SEQ ID NO: 3271570 - DNA, 19 bp, Homo sapiens
atctctactaccacaagga

SEQ ID NO: 3271571 - DNA, 16 bp, Homo sapiens
atctctagaattttaa

SEQ ID NO: 3271572 - DNA, 18 bp, Homo sapiens
atctctagaattttaagt

SEQ ID NO: 3271573 - DNA, 17 bp, Homo sapiens
atctctataacagatcc

SEQ ID NO: 3271574 - DNA, 19 bp, Homo sapiens
atctctatcgattgtgtag

SEQ ID NO: 3271575 - DNA, 14 bp, Homo sapiens
atctctatttaata

SEQ ID NO: 3271576 - DNA, 16 bp, Homo sapiens
atctctcagagccctc

SEQ ID NO: 3271577 - DNA, 17 bp, Homo sapiens
atctctcaggagcacag

SEQ ID NO: 3271578 - DNA, 23 bp, Homo sapiens
atctctcaggagcacaggcagct

SEQ ID NO: 3271579 - DNA, 20 bp, Homo sapiens
atctctccacggtagcactt

SEQ ID NO: 3271580 - DNA, 11 bp, Homo sapiens
atctctccctc

SEQ ID NO: 3271581 - DNA, 20 bp, Homo sapiens
atctctcggttccacgtccc

SEQ ID NO: 3271582 - DNA, 10 bp, Homo sapiens
atctctctct

SEQ ID NO: 3271583 - DNA, 22 bp, Homo sapiens
atctctctggggccctgggcct

SEQ ID NO: 3271584 - DNA, 23 bp, Homo sapiens
atctctctggggccctgggcctc

SEQ ID NO: 3271585 - DNA, 11 bp, Homo sapiens
atctctgaaag

SEQ ID NO: 3271586 - DNA, 14 bp, Homo sapiens
atctctgactaaaa

SEQ ID NO: 3271587 - DNA, 20 bp, Homo sapiens
atctctgagttctgtgtatt

SEQ ID NO: 3271588 - DNA, 19 bp, Homo sapiens
atctctgcctagaatcttt

SEQ ID NO: 3271589 - DNA, 22 bp, Homo sapiens
atctctggtgcctaaaaaccca

SEQ ID NO: 3271590 - DNA, 18 bp, Homo sapiens
atctctgtgccttcgtct

SEQ ID NO: 3271591 - DNA, 15 bp, Homo sapiens
atctctgtgtgcaca

SEQ ID NO: 3271592 - DNA, 17 bp, Homo sapiens
atctctgtgtgcacaaa

SEQ ID NO: 3271593 - DNA, 13 bp, Homo sapiens
atctctgttatgt

SEQ ID NO: 3271594 - DNA, 18 bp, Homo sapiens
atctctgttatgtactgt

SEQ ID NO: 3271595 - DNA, 19 bp, Homo sapiens
atctctgttatgtactgta

SEQ ID NO: 3271596 - DNA, 21 bp, Homo sapiens
atctctgttctgtttggcact

SEQ ID NO: 3271597 - DNA, 22 bp, Homo sapiens
atctctgttctgtttggcactt

SEQ ID NO: 3271598 - DNA, 15 bp, Homo sapiens
atctcttcattcaaa

SEQ ID NO: 3271599 - DNA, 20 bp, Homo sapiens
atctcttcttttggcttcca

SEQ ID NO: 3271600 - DNA, 16 bp, Homo sapiens
atctcttgcttgtcat

SEQ ID NO: 3271601 - DNA, 18 bp, Homo sapiens
atctcttgcttgtcattg

SEQ ID NO: 3271602 - DNA, 19 bp, Homo sapiens
atctcttgtgcttttttga

SEQ ID NO: 3271603 - DNA, 11 bp, Homo sapiens
atctcttttat

SEQ ID NO: 3271604 - DNA, 16 bp, Homo sapiens
atctctttttaagata

SEQ ID NO: 3271605 - DNA, 14 bp, Homo sapiens
atctgaaaatgtat

SEQ ID NO: 3271606 - DNA, 16 bp, Homo sapiens
atctgaaaatgtatgt

SEQ ID NO: 3271607 - DNA, 19 bp, Homo sapiens
atctgaaaatgtatgtgta

SEQ ID NO: 3271608 - DNA, 18 bp, Homo sapiens
atctgaacacagtttagt

SEQ ID NO: 3271609 - DNA, 22 bp, Homo sapiens
atctgaagagtatccttccttc

SEQ ID NO: 3271610 - DNA, 19 bp, Homo sapiens
atctgaagatatatttcac

SEQ ID NO: 3271611 - DNA, 18 bp, Homo sapiens
atctgaagccctcccagg

SEQ ID NO: 3271612 - DNA, 20 bp, Homo sapiens
atctgaagcttcactcactg

SEQ ID NO: 3271613 - DNA, 20 bp, Homo sapiens
atctgaatgaaaataactga

SEQ ID NO: 3271614 - DNA, 15 bp, Homo sapiens
atctgaatgtaattt

SEQ ID NO: 3271615 - DNA, 17 bp, Homo sapiens
atctgaatgtaatttgt

SEQ ID NO: 3271616 - DNA, 13 bp, Homo sapiens
atctgacacaaaa

SEQ ID NO: 3271617 - DNA, 16 bp, Homo sapiens
atctgactgccaagcc

SEQ ID NO: 3271618 - DNA, 18 bp, Homo sapiens
atctgactgccaagccag

SEQ ID NO: 3271619 - DNA, 19 bp, Homo sapiens
atctgactgccaagccaga

SEQ ID NO: 3271620 - DNA, 21 bp, Homo sapiens
atctgagatttttttgtgtat

SEQ ID NO: 3271621 - DNA, 21 bp, Homo sapiens
atctgagggaggaggccacct

SEQ ID NO: 3271622 - DNA, 20 bp, Homo sapiens
atctgaggttggatttgctc

SEQ ID NO: 3271623 - DNA, 13 bp, Homo sapiens
atctgagttgcat

SEQ ID NO: 3271624 - DNA, 20 bp, Homo sapiens
atctgagttgccaagacaaa

SEQ ID NO: 3271625 - DNA, 16 bp, Homo sapiens
atctgcaaacaatgaa

SEQ ID NO: 3271626 - DNA, 14 bp, Homo sapiens
atctgcaatatgaa

SEQ ID NO: 3271627 - DNA, 18 bp, Homo sapiens
atctgcacacacctccga

SEQ ID NO: 3271628 - DNA, 11 bp, Homo sapiens
atctgcagaac

SEQ ID NO: 3271629 - DNA, 15 bp, Homo sapiens
atctgcatttagcac

SEQ ID NO: 3271630 - DNA, 19 bp, Homo sapiens
atctgcattttcaccccac

SEQ ID NO: 3271631 - DNA, 16 bp, Homo sapiens
atctgccagaccttaa

SEQ ID NO: 3271632 - DNA, 17 bp, Homo sapiens
atctgccagaccttaat

SEQ ID NO: 3271633 - DNA, 15 bp, Homo sapiens
atctgcccacctcag

SEQ ID NO: 3271634 - DNA, 23 bp, Homo sapiens
atctgcccacctcagcctcccaa

SEQ ID NO: 3271635 - DNA, 12 bp, Homo sapiens
atctgcccctcc

SEQ ID NO: 3271636 - DNA, 15 bp, Homo sapiens
atctgcccctccccc

SEQ ID NO: 3271637 - DNA, 12 bp, Homo sapiens
atctgcctggcc

SEQ ID NO: 3271638 - DNA, 17 bp, Homo sapiens
atctgcctggcctggct

SEQ ID NO: 3271639 - DNA, 19 bp, Homo sapiens
atcttgccacatttctgat

SEQ ID NO: 3271640 - DNA, 22 bp, Homo sapiens
atcttgcgaatccaagctccct

SEQ ID NO: 3271641 - DNA, 23 bp, Homo sapiens
atcttgcgaatccaagctccctg

SEQ ID NO: 3271642 - DNA, 14 bp, Homo sapiens
atcttgctaataaa

SEQ ID NO: 3271643 - DNA, 16 bp, Homo sapiens
atcttgctaccagtat

SEQ ID NO: 3271644 - DNA, 21 bp, Homo sapiens
atcttgctggattaatgtttt

SEQ ID NO: 3271645 - DNA, 23 bp, Homo sapiens
atcttgcttccctaatctatggt

SEQ ID NO: 3271646 - DNA, 19 bp, Homo sapiens
atcttggactgacatttag

SEQ ID NO: 3271647 - DNA, 21 bp, Homo sapiens
atcttggcctaaacctcagtt

SEQ ID NO: 3271648 - DNA, 17 bp, Homo sapiens
atcttggctcagtttgt

SEQ ID NO: 3271649 - DNA, 18 bp, Homo sapiens
atcttgggactgggtttg

SEQ ID NO: 3271650 - DNA, 21 bp, Homo sapiens
atcttggggcaagactgcaaa

SEQ ID NO: 3271651 - DNA, 22 bp, Homo sapiens
atcttggggcaagactgcaaac

SEQ ID NO: 3271652 - DNA, 15 bp, Homo sapiens
atcttgtgaaatggc

SEQ ID NO: 3271653 - DNA, 20 bp, Homo sapiens
atcttgtgaaatggccagga

SEQ ID NO: 3271654 - DNA, 18 bp, Homo sapiens
atcttgtgctagaatact

SEQ ID NO: 3271655 - DNA, 22 bp, Homo sapiens
atcttgtgctagaatacttttt

SEQ ID NO: 3271656 - DNA, 22 bp, Homo sapiens
atcttgtgtgattaacttattt

SEQ ID NO: 3271657 - DNA, 16 bp, Homo sapiens
atcttgtgttgtcctt

SEQ ID NO: 3271658 - DNA, 19 bp, Homo sapiens
atcttgttcaggaaaaggt

SEQ ID NO: 3271659 - DNA, 14 bp, Homo sapiens
atcttgttcttccc

SEQ ID NO: 3271660 - DNA, 18 bp, Homo sapiens
atctttaaactggctggc

SEQ ID NO: 3271661 - DNA, 14 bp, Homo sapiens
atctttaagtattg

SEQ ID NO: 3271662 - DNA, 16 bp, Homo sapiens
atctttaagtattgtt

SEQ ID NO: 3271663 - DNA, 20 bp, Homo sapiens
atctttaataacaatatata

SEQ ID NO: 3271664 - DNA, 23 bp, Homo sapiens
atctttatacagattttctagaa

SEQ ID NO: 3271665 - DNA, 13 bp, Homo sapiens
atctttatgctgt

SEQ ID NO: 3271666 - DNA, 15 bp, Homo sapiens
atctttatgctgtat

SEQ ID NO: 3271667 - DNA, 19 bp, Homo sapiens
atctttattcaaactttta

SEQ ID NO: 3271668 - DNA, 22 bp, Homo sapiens
atctttattcaaacttttatta

SEQ ID NO: 3271669 - DNA, 13 bp, Homo sapiens
atctttattgaaa

SEQ ID NO: 3271670 - DNA, 15 bp, Homo sapiens
atctttattgaaatt

SEQ ID NO: 3271671 - DNA, 13 bp, Homo sapiens
atctttcaccttt

SEQ ID NO: 3271672 - DNA, 17 bp, Homo sapiens
atctttcacttgaaaga

SEQ ID NO: 3271673 - DNA, 22 bp, Homo sapiens
atctttcagaaatataacacat

SEQ ID NO: 3271674 - DNA, 17 bp, Homo sapiens
atctttccctcttcggt

SEQ ID NO: 3271675 - DNA, 22 bp, Homo sapiens
atctttccctcttcggtgttct

SEQ ID NO: 3271676 - DNA, 20 bp, Homo sapiens
atctttcctcaagtatcttc

SEQ ID NO: 3271677 - DNA, 16 bp, Homo sapiens
atctttcgcacagcag

SEQ ID NO: 3271678 - DNA, 15 bp, Homo sapiens
atctttctacagaga

SEQ ID NO: 3271679 - DNA, 21 bp, Homo sapiens
atctttctgcacacaaatatt

SEQ ID NO: 3271680 - DNA, 21 bp, Homo sapiens
atctttctttacctgagacca

SEQ ID NO: 3271681 - DNA, 13 bp, Homo sapiens
atctttctttcca

SEQ ID NO: 3271682 - DNA, 21 bp, Homo sapiens
atctttctttccatttacagt

SEQ ID NO: 3271683 - DNA, 13 bp, Homo sapiens
atctttgactgaa

SEQ ID NO: 3271684 - DNA, 20 bp, Homo sapiens
atctttgatcgtatatttct

SEQ ID NO: 3271685 - DNA, 18 bp, Homo sapiens
atctttgcagacaggcaa

SEQ ID NO: 3271686 - DNA, 14 bp, Homo sapiens
atctttgccttggg

SEQ ID NO: 3271687 - DNA, 14 bp, Homo sapiens
atctttgcgaaaag

SEQ ID NO: 3271688 - DNA, 18 bp, Homo sapiens
atctttgcgaaaagataa

SEQ ID NO: 3271689 - DNA, 10 bp, Homo sapiens
atctttgctg

SEQ ID NO: 3271690 - DNA, 19 bp, Homo sapiens
atctttgtaccaaaatttt

SEQ ID NO: 3271691 - DNA, 20 bp, Homo sapiens
atctttgtaccaaaatttta

SEQ ID NO: 3271692 - DNA, 23 bp, Homo sapiens
atctttgtataaataaatatttt

SEQ ID NO: 3271693 - DNA, 14 bp, Homo sapiens
atctttgtgataat

SEQ ID NO: 3271694 - DNA, 18 bp, Homo sapiens
atctttgttgaagtttga

SEQ ID NO: 3271695 - DNA, 11 bp, Homo sapiens
atcttttacat

SEQ ID NO: 3271696 - DNA, 23 bp, Homo sapiens
atcttttgaagggagaagacact

SEQ ID NO: 3271697 - DNA, 14 bp, Homo sapiens
atcttttgtgagat

SEQ ID NO: 3271698 - DNA, 18 bp, Homo sapiens
atctttttaaaaactctt

SEQ ID NO: 3271699 - DNA, 19 bp, Homo sapiens
atctttttaaaaactcttc

SEQ ID NO: 3271700 - DNA, 21 bp, Homo sapiens
atctttttaaaaactcttcag

SEQ ID NO: 3271701 - DNA, 14 bp, Homo sapiens
atctttttatcatg

SEQ ID NO: 3271702 - DNA, 19 bp, Homo sapiens
atctttttatcatgatcct

SEQ ID NO: 3271703 - DNA, 13 bp, Homo sapiens
atctttttcatta

SEQ ID NO: 3271704 - DNA, 19 bp, Homo sapiens
atcttttttagcataaaat

SEQ ID NO: 3271705 - DNA, 23 bp, Homo sapiens
atcttttttagcataaaattttc

SEQ ID NO: 3271706 - DNA, 13 bp, Homo sapiens
atgaaaaattctc

SEQ ID NO: 3271707 - DNA, 18 bp, Homo sapiens
atgaaaaatttaagcatt

SEQ ID NO: 3271708 - DNA, 17 bp, Homo sapiens
atgaaaactaaggattt

SEQ ID NO: 3271709 - DNA, 13 bp, Homo sapiens
atgaaaagttatt

SEQ ID NO: 3271710 - DNA, 14 bp, Homo sapiens
atgaaaataactga

SEQ ID NO: 3271711 - DNA, 18 bp, Homo sapiens
atgaaaataactgaattt

SEQ ID NO: 3271712 - DNA, 19 bp, Homo sapiens
atgaaaataactgaatttg

SEQ ID NO: 3271713 - DNA, 14 bp, Homo sapiens
atgaaaataccatt

SEQ ID NO: 3271714 - DNA, 12 bp, Homo sapiens
atgaaaatatct

SEQ ID NO: 3271715 - DNA, 20 bp, Homo sapiens
atgaaaatgagttgtgaaag

SEQ ID NO: 3271716 - DNA, 19 bp, Homo sapiens
atgaaaatttgagactatt

SEQ ID NO: 3271717 - DNA, 17 bp, Homo sapiens
atgaaaattttaaaaat

SEQ ID NO: 3271718 - DNA, 21 bp, Homo sapiens
atgaaaattttaccagcagaa

SEQ ID NO: 3271719 - DNA, 13 bp, Homo sapiens
atgaaacagaaac

SEQ ID NO: 3271720 - DNA, 22 bp, Homo sapiens
atgaaacagaaacaaaaacact

SEQ ID NO: 3271721 - DNA, 17 bp, Homo sapiens
atgaaactcctgatttt

SEQ ID NO: 3271722 - DNA, 18 bp, Homo sapiens
atgaaactcctgattttg

SEQ ID NO: 3271723 - DNA, 22 bp, Homo sapiens
atgaaactgtcataatggtgaa

SEQ ID NO: 3271724 - DNA, 14 bp, Homo sapiens
atgaaagaatatat

SEQ ID NO: 3271725 - DNA, 12 bp, Homo sapiens
atgaaagactgt

SEQ ID NO: 3271726 - DNA, 13 bp, Homo sapiens
atgaaagactgta

SEQ ID NO: 3271727 - DNA, 19 bp, Homo sapiens
atgaaagactgtacaaagt

SEQ ID NO: 3271728 - DNA, 20 bp, Homo sapiens
atgaaagatggctgtgcctc

SEQ ID NO: 3271729 - DNA, 23 bp, Homo sapiens
atgaaagatggctgtgcctctgc

SEQ ID NO: 3271730 - DNA, 19 bp, Homo sapiens
atgaaagattaaacagatg

SEQ ID NO: 3271731 - DNA, 22 bp, Homo sapiens
atgaaagctgattactgtcaat

SEQ ID NO: 3271732 - DNA, 15 bp, Homo sapiens
atgaaagggcccaga

SEQ ID NO: 3271733 - DNA, 19 bp, Homo sapiens
atgaaagggcccagagagg

SEQ ID NO: 3271734 - DNA, 16 bp, Homo sapiens
atgaaaggtttacatt

SEQ ID NO: 3271735 - DNA, 23 bp, Homo sapiens
atgaaataaaaaaaaaaggatga

SEQ ID NO: 3271736 - DNA, 17 bp, Homo sapiens
atgaaatactatttaaa

SEQ ID NO: 3271737 - DNA, 19 bp, Homo sapiens
atgaaatatcagactagtg

SEQ ID NO: 3271738 - DNA, 15 bp, Homo sapiens
atgaaattgtatctc

SEQ ID NO: 3271739 - DNA, 14 bp, Homo sapiens
atgaaatttaaaca

SEQ ID NO: 3271740 - DNA, 16 bp, Homo sapiens
atgaaatttaaacatt

SEQ ID NO: 3271741 - DNA, 18 bp, Homo sapiens
atgaaatttaaacattaa

SEQ ID NO: 3271742 - DNA, 21 bp, Homo sapiens
atgaaattttctagactttct

SEQ ID NO: 3271743 - DNA, 15 bp, Homo sapiens
atgaacaaaattatt

SEQ ID NO: 3271744 - DNA, 14 bp, Homo sapiens
atgaacaagtttta

SEQ ID NO: 3271745 - DNA, 14 bp, Homo sapiens
atgaacaatgtgtg

SEQ ID NO: 3271746 - DNA, 14 bp, Homo sapiens
atgaacactcccca

SEQ ID NO: 3271747 - DNA, 13 bp, Homo sapiens
atgaacacttata

SEQ ID NO: 3271748 - DNA, 19 bp, Homo sapiens
atgaacatgcagttcatta

SEQ ID NO: 3271749 - DNA, 15 bp, Homo sapiens
atgaacatgttcctg

SEQ ID NO: 3271750 - DNA, 20 bp, Homo sapiens
atgaaccacatcttgctctg

SEQ ID NO: 3271751 - DNA, 15 bp, Homo sapiens
atgaaccataaattc

SEQ ID NO: 3271752 - DNA, 21 bp, Homo sapiens
atgaacccaggacgcttctga

SEQ ID NO: 3271753 - DNA, 16 bp, Homo sapiens
atgaacctattttcat

SEQ ID NO: 3271754 - DNA, 16 bp, Homo sapiens
atgaactgaagtttca

SEQ ID NO: 3271755 - DNA, 23 bp, Homo sapiens
atgaactgcttttcctcaagcaa

SEQ ID NO: 3271756 - DNA, 14 bp, Homo sapiens
atgaagaaaaagta

SEQ ID NO: 3271757 - DNA, 15 bp, Homo sapiens
atgaagaaaaagtac

SEQ ID NO: 3271758 - DNA, 13 bp, Homo sapiens
atgaagagcaaaa

SEQ ID NO: 3271759 - DNA, 14 bp, Homo sapiens
atgaagcaaggaag

SEQ ID NO: 3271760 - DNA, 19 bp, Homo sapiens
atgaagcgaaacacagaga

SEQ ID NO: 3271761 - DNA, 22 bp, Homo sapiens
atgaaggaatcattccagtgct

SEQ ID NO: 3271762 - DNA, 16 bp, Homo sapiens
atgaaggcaaaaaaat

SEQ ID NO: 3271763 - DNA, 21 bp, Homo sapiens
atgaaggttaggatttaacag

SEQ ID NO: 3271764 - DNA, 20 bp, Homo sapiens
atgtaaagccaaaaccatct

SEQ ID NO: 3271765 - DNA, 20 bp, Homo sapiens
atgtaaaggagtcaaaacta

SEQ ID NO: 3271766 - DNA, 13 bp, Homo sapiens
atgtaaagtatgt

SEQ ID NO: 3271767 - DNA, 18 bp, Homo sapiens
atgtaaagtatgtaaaca

SEQ ID NO: 3271768 - DNA, 22 bp, Homo sapiens
atgtaaataaccccattctttg

SEQ ID NO: 3271769 - DNA, 12 bp, Homo sapiens
atgtaaatagtg

SEQ ID NO: 3271770 - DNA, 17 bp, Homo sapiens
atgtaaatagtgcagaa

SEQ ID NO: 3271771 - DNA, 15 bp, Homo sapiens
atgtaaatattctat

SEQ ID NO: 3271772 - DNA, 20 bp, Homo sapiens
atgtaacatcataattacat

SEQ ID NO: 3271773 - DNA, 12 bp, Homo sapiens
atgtaacattgg

SEQ ID NO: 3271774 - DNA, 19 bp, Homo sapiens
atgtaactaggtttttgct

SEQ ID NO: 3271775 - DNA, 20 bp, Homo sapiens
atgtaactccagatagagaa

SEQ ID NO: 3271776 - DNA, 22 bp, Homo sapiens
atgtaactccagatagagaaat

SEQ ID NO: 3271777 - DNA, 15 bp, Homo sapiens
atgtaacttattatt

SEQ ID NO: 3271778 - DNA, 14 bp, Homo sapiens
atgtaacttttgta

SEQ ID NO: 3271779 - DNA, 17 bp, Homo sapiens
atgtaacttttgtaaga

SEQ ID NO: 3271780 - DNA, 22 bp, Homo sapiens
atgtaagaaaacaaaatctaaa

SEQ ID NO: 3271781 - DNA, 19 bp, Homo sapiens
atgtaagaattcagaagac

SEQ ID NO: 3271782 - DNA, 15 bp, Homo sapiens
atgtaagattataga

SEQ ID NO: 3271783 - DNA, 22 bp, Homo sapiens
atgtaagattatagattctaaa

SEQ ID NO: 3271784 - DNA, 22 bp, Homo sapiens
atgtaagcaaaggctctgaaat

SEQ ID NO: 3271785 - DNA, 22 bp, Homo sapiens
atgtaagcatactttgtaaata

SEQ ID NO: 3271786 - DNA, 15 bp, Homo sapiens
atgtaagctgtttat

SEQ ID NO: 3271787 - DNA, 22 bp, Homo sapiens
atgtaagctgtttattttatat

SEQ ID NO: 3271788 - DNA, 11 bp, Homo sapiens
atgtaagggtc

SEQ ID NO: 3271789 - DNA, 21 bp, Homo sapiens
atgtaagggtctttggtgttt

SEQ ID NO: 3271790 - DNA, 19 bp, Homo sapiens
atgtaataaaaagtatatg

SEQ ID NO: 3271791 - DNA, 15 bp, Homo sapiens
atgtaataaacttta

SEQ ID NO: 3271792 - DNA, 12 bp, Homo sapiens
atgtaatatatt

SEQ ID NO: 3271793 - DNA, 15 bp, Homo sapiens
atgtaatcaatgttt

SEQ ID NO: 3271794 - DNA, 18 bp, Homo sapiens
atgtaatccttttgttta

SEQ ID NO: 3271795 - DNA, 17 bp, Homo sapiens
atgtaatcggcttgaat

SEQ ID NO: 3271796 - DNA, 22 bp, Homo sapiens
atgtaatcggcttgaattttga

SEQ ID NO: 3271797 - DNA, 15 bp, Homo sapiens
atgtcccacccaccc

SEQ ID NO: 3271798 - DNA, 19 bp, Homo sapiens
atgtcccctcaaactcatt

SEQ ID NO: 3271799 - DNA, 14 bp, Homo sapiens
atgtccctgggcca

SEQ ID NO: 3271800 - DNA, 16 bp, Homo sapiens
atgtccctgggccagg

SEQ ID NO: 3271801 - DNA, 17 bp, Homo sapiens
atgtccctgggccaggg

SEQ ID NO: 3271802 - DNA, 21 bp, Homo sapiens
atgtccctgggccagggtctg

SEQ ID NO: 3271803 - DNA, 16 bp, Homo sapiens
atgtccctttcttggc

SEQ ID NO: 3271804 - DNA, 16 bp, Homo sapiens
atgtcctaaggacaca

SEQ ID NO: 3271805 - DNA, 15 bp, Homo sapiens
atgtcctatgtgtga

SEQ ID NO: 3271806 - DNA, 16 bp, Homo sapiens
atgtcctccagaagcc

SEQ ID NO: 3271807 - DNA, 23 bp, Homo sapiens
atgtcctccagaagcctctggct

SEQ ID NO: 3271808 - DNA, 21 bp, Homo sapiens
atgtcctgcctattatctgtc

SEQ ID NO: 3271809 - DNA, 17 bp, Homo sapiens
atgtcctgctggcttcc

SEQ ID NO: 3271810 - DNA, 19 bp, Homo sapiens
atgtccttgggttgctggt

SEQ ID NO: 3271811 - DNA, 15 bp, Homo sapiens
atgtcgatgcacagt

SEQ ID NO: 3271812 - DNA, 12 bp, Homo sapiens
atgtcgcacaat

SEQ ID NO: 3271813 - DNA, 16 bp, Homo sapiens
atgtcgcacaatgttt

SEQ ID NO: 3271814 - DNA, 12 bp, Homo sapiens
atgtcgcttttg

SEQ ID NO: 3271815 - DNA, 13 bp, Homo sapiens
atgtctaaaattg

SEQ ID NO: 3271816 - DNA, 19 bp, Homo sapiens
atgtctaaatgctgaaaaa

SEQ ID NO: 3271817 - DNA, 16 bp, Homo sapiens
atgtctagaaagtaag

SEQ ID NO: 3271818 - DNA, 15 bp, Homo sapiens
atgtctattcagctt

SEQ ID NO: 3271819 - DNA, 12 bp, Homo sapiens
atgtctatttaa

SEQ ID NO: 3271820 - DNA, 15 bp, Homo sapiens
atgtctatttaagcc

SEQ ID NO: 3271821 - DNA, 19 bp, Homo sapiens
atgtctcactgttctgcaa

SEQ ID NO: 3271822 - DNA, 22 bp, Homo sapiens
atgtctcaggtccctgcagggc

SEQ ID NO: 3271823 - DNA, 16 bp, Homo sapiens
atgtctcctttgctct

SEQ ID NO: 3271824 - DNA, 13 bp, Homo sapiens
atgtctctggggc

SEQ ID NO: 3271825 - DNA, 13 bp, Homo sapiens
atgtctcttctga

SEQ ID NO: 3271826 - DNA, 15 bp, Homo sapiens
atgtctctttaagtt

SEQ ID NO: 3271827 - DNA, 23 bp, Homo sapiens
atgtctctttaatgtcacaggca

SEQ ID NO: 3271828 - DNA, 15 bp, Homo sapiens
atgtctgagtgaacc

SEQ ID NO: 3271829 - DNA, 13 bp, Homo sapiens
atgtctgcaaagt

SEQ ID NO: 3271830 - DNA, 19 bp, Homo sapiens
atgtctgtagctcctcaac

SEQ ID NO: 3271831 - DNA, 20 bp, Homo sapiens
atgtctgttaccatgtcact

SEQ ID NO: 3271832 - DNA, 16 bp, Homo sapiens
atgtctgttctacata

SEQ ID NO: 3271833 - DNA, 16 bp, Homo sapiens
atgtctgtttttgtat

SEQ ID NO: 3271834 - DNA, 19 bp, Homo sapiens
atgtctgtttttgtatctt

SEQ ID NO: 3271835 - DNA, 20 bp, Homo sapiens
atgtctgtttttgtatcttt

SEQ ID NO: 3271836 - DNA, 22 bp, Homo sapiens
atgtctgtttttgtatctttat

SEQ ID NO: 3271837 - DNA, 12 bp, Homo sapiens
atgtcttatttt

SEQ ID NO: 3271838 - DNA, 16 bp, Homo sapiens
atgtcttatttttaga

SEQ ID NO: 3271839 - DNA, 15 bp, Homo sapiens
atgtcttctgcctgt

SEQ ID NO: 3271840 - DNA, 20 bp, Homo sapiens
atgtctttgttggaaaagaa

SEQ ID NO: 3271841 - DNA, 23 bp, Homo sapiens
atgtctttgttggaaaagaatac

SEQ ID NO: 3271842 - DNA, 14 bp, Homo sapiens
atgtcttttaaaat

SEQ ID NO: 3271843 - DNA, 21 bp, Homo sapiens
atgtcttttatatttgtatcg

SEQ ID NO: 3271844 - DNA, 15 bp, Homo sapiens
atgtcttttcttggc

SEQ ID NO: 3271845 - DNA, 17 bp, Homo sapiens
atgtgaaaaaaattatt

SEQ ID NO: 3271846 - DNA, 13 bp, Homo sapiens
atgtgaaaatata

SEQ ID NO: 3271847 - DNA, 13 bp, Homo sapiens
atgtgaaaccttt

SEQ ID NO: 3271848 - DNA, 17 bp, Homo sapiens
atgtgaaagtgtaaaat

SEQ ID NO: 3271849 - DNA, 13 bp, Homo sapiens
atgtgaaatctca

SEQ ID NO: 3271850 - DNA, 16 bp, Homo sapiens
atgtgaaatctcagaa

SEQ ID NO: 3271851 - DNA, 14 bp, Homo sapiens
atgtgaacagcata

SEQ ID NO: 3271852 - DNA, 16 bp, Homo sapiens
atgtgaacccgggacg

SEQ ID NO: 3271853 - DNA, 16 bp, Homo sapiens
atgtgaacttgtagct

SEQ ID NO: 3271854 - DNA, 15 bp, Homo sapiens
atgtgaactttatta

SEQ ID NO: 3271855 - DNA, 20 bp, Homo sapiens
atgtgaagacattttttgct

SEQ ID NO: 3271856 - DNA, 19 bp, Homo sapiens
atgtgaagataatttgcat

SEQ ID NO: 3271857 - DNA, 17 bp, Homo sapiens
atgtgaagcatgctttg

SEQ ID NO: 3271858 - DNA, 14 bp, Homo sapiens
atgtgaaggcccaa

SEQ ID NO: 3271859 - DNA, 20 bp, Homo sapiens
atgtgaatgatctctctgaa

SEQ ID NO: 3271860 - DNA, 12 bp, Homo sapiens
atgtgaattttt

SEQ ID NO: 3271861 - DNA, 18 bp, Homo sapiens
atgtgaatttttatttct

SEQ ID NO: 3271862 - DNA, 18 bp, Homo sapiens
atgtgacaattttgtaca

SEQ ID NO: 3271863 - DNA, 15 bp, Homo sapiens
atgtgacaccaaagc

SEQ ID NO: 3271864 - DNA, 14 bp, Homo sapiens
atgtgacacccaca

SEQ ID NO: 3271865 - DNA, 19 bp, Homo sapiens
atgtgacattccatgacga

SEQ ID NO: 3271866 - DNA, 21 bp, Homo sapiens
atgtgacattccatgacgaca

SEQ ID NO: 3271867 - DNA, 13 bp, Homo sapiens
atgtgacatttac

SEQ ID NO: 3271868 - DNA, 16 bp, Homo sapiens
atgtgacatttacacc

SEQ ID NO: 3271869 - DNA, 16 bp, Homo sapiens
atgtgaccataatgta

SEQ ID NO: 3271870 - DNA, 18 bp, Homo sapiens
atgtgacccaccagtgcc

SEQ ID NO: 3271871 - DNA, 19 bp, Homo sapiens
atgtgactttttttggtat

SEQ ID NO: 3271872 - DNA, 17 bp, Homo sapiens
atgtgagccaccgctgc

SEQ ID NO: 3271873 - DNA, 19 bp, Homo sapiens
atgtgagccaccgctgcca

SEQ ID NO: 3271874 - DNA, 11 bp, Homo sapiens
atgtgagcccc

SEQ ID NO: 3271875 - DNA, 14 bp, Homo sapiens
atgtgaggaggaaa

SEQ ID NO: 3271876 - DNA, 20 bp, Homo sapiens
atgtgagtgacgatgatgta

SEQ ID NO: 3271877 - DNA, 19 bp, Homo sapiens
atgtgatatataagtgtac

SEQ ID NO: 3271878 - DNA, 14 bp, Homo sapiens
atgtgatattctaa

SEQ ID NO: 3271879 - DNA, 15 bp, Homo sapiens
atgtgatattctaag

SEQ ID NO: 3271880 - DNA, 18 bp, Homo sapiens
atgtgatattctaagact

SEQ ID NO: 3271881 - DNA, 13 bp, Homo sapiens
atgtgatcactga

SEQ ID NO: 3271882 - DNA, 18 bp, Homo sapiens
atgtgatggatggcacaa

SEQ ID NO: 3271883 - DNA, 15 bp, Homo sapiens
atgtgatgttctaag

SEQ ID NO: 3271884 - DNA, 19 bp, Homo sapiens
atgtgatgttctaaggctc

SEQ ID NO: 3271885 - DNA, 15 bp, Homo sapiens
atgtgattaatgttt

SEQ ID NO: 3271886 - DNA, 15 bp, Homo sapiens
atgtgattcaaaaga

SEQ ID NO: 3271887 - DNA, 15 bp, Homo sapiens
atgtgattctaatgt

SEQ ID NO: 3271888 - DNA, 17 bp, Homo sapiens
atgtgattgtggaatgg

SEQ ID NO: 3271889 - DNA, 14 bp, Homo sapiens
atgtgcaaatgcaa

SEQ ID NO: 3271890 - DNA, 21 bp, Homo sapiens
atgtgccaggtttttggtctg

SEQ ID NO: 3271891 - DNA, 22 bp, Homo sapiens
atgtgccaggtttttggtctga

SEQ ID NO: 3271892 - DNA, 19 bp, Homo sapiens
atgtgccatctgtacatat

SEQ ID NO: 3271893 - DNA, 16 bp, Homo sapiens
atgtgcccctggccca

SEQ ID NO: 3271894 - DNA, 18 bp, Homo sapiens
atgtgccgaatgtgcagg

SEQ ID NO: 3271895 - DNA, 18 bp, Homo sapiens
atgtgcctctgcggggca

SEQ ID NO: 3271896 - DNA, 20 bp, Homo sapiens
atgtgctactgattgtttca

SEQ ID NO: 3271897 - DNA, 24 bp, Homo sapiens
atgctgatcatcgccagaggtgct

SEQ ID NO: 3271898 - DNA, 18 bp, Homo sapiens
atgctgatgaatcactgt

SEQ ID NO: 3271899 - DNA, 19 bp, Homo sapiens
atgctgatgaatcactgtt

SEQ ID NO: 3271900 - DNA, 21 bp, Homo sapiens
atgctgatgaatcactgtttt

SEQ ID NO: 3271901 - DNA, 12 bp, Homo sapiens
atgctgcagtgg

SEQ ID NO: 3271902 - DNA, 21 bp, Homo sapiens
atgctgccccgttccctgtca

SEQ ID NO: 3271903 - DNA, 22 bp, Homo sapiens
atgctgccccgttccctgtcag

SEQ ID NO: 3271904 - DNA, 12 bp, Homo sapiens
atgctgcctcca

SEQ ID NO: 3271905 - DNA, 15 bp, Homo sapiens
atgctgcctccagaa

SEQ ID NO: 3271906 - DNA, 13 bp, Homo sapiens
atgctgcctgagt

SEQ ID NO: 3271907 - DNA, 18 bp, Homo sapiens
atgctgccttttctttaa

SEQ ID NO: 3271908 - DNA, 21 bp, Homo sapiens
atgctgctacttaattccttt

SEQ ID NO: 3271909 - DNA, 14 bp, Homo sapiens
atgctgctcatcca

SEQ ID NO: 3271910 - DNA, 16 bp, Homo sapiens
atgctgctccaccctc

SEQ ID NO: 3271911 - DNA, 11 bp, Homo sapiens
atgctgctctc

SEQ ID NO: 3271912 - DNA, 22 bp, Homo sapiens
atgctgctctcagcctcccaca

SEQ ID NO: 3271913 - DNA, 17 bp, Homo sapiens
atgctgcttctcctccc

SEQ ID NO: 3271914 - DNA, 20 bp, Homo sapiens
atgctgcttctcctcccagc

SEQ ID NO: 3271915 - DNA, 13 bp, Homo sapiens
atgctgctttccc

SEQ ID NO: 3271916 - DNA, 17 bp, Homo sapiens
atgctgctttcccctgt

SEQ ID NO: 3271917 - DNA, 15 bp, Homo sapiens
atgctggagaagaga

SEQ ID NO: 3271918 - DNA, 23 bp, Homo sapiens
atgctggagaagagaggagagga

SEQ ID NO: 3271919 - DNA, 13 bp, Homo sapiens
atgctggagggag

SEQ ID NO: 3271920 - DNA, 16 bp, Homo sapiens
atgctggcatctctgc

SEQ ID NO: 3271921 - DNA, 23 bp, Homo sapiens
atgctggcatttgcacctacctc

SEQ ID NO: 3271922 - DNA, 12 bp, Homo sapiens
atgctggccagc

SEQ ID NO: 3271923 - DNA, 15 bp, Homo sapiens
atgctggccagcacc

SEQ ID NO: 3271924 - DNA, 18 bp, Homo sapiens
atgctggccagcaccctc

SEQ ID NO: 3271925 - DNA, 22 bp, Homo sapiens
atgctggccagcctggggcctg

SEQ ID NO: 3271926 - DNA, 19 bp, Homo sapiens
atgctggctgttggctggg

SEQ ID NO: 3271927 - DNA, 16 bp, Homo sapiens
atgctgggactcagcc

SEQ ID NO: 3271928 - DNA, 14 bp, Homo sapiens
atgctgggctgggc

SEQ ID NO: 3271929 - DNA, 21 bp, Homo sapiens
atgctggtatatggcttcaag

SEQ ID NO: 3271930 - DNA, 22 bp, Homo sapiens
atgctggttttcctaaatgcag

SEQ ID NO: 3271931 - DNA, 16 bp, Homo sapiens
atgctgtacatctatt

SEQ ID NO: 3271932 - DNA, 19 bp, Homo sapiens
atgctgtccctatacacta

SEQ ID NO: 3271933 - DNA, 21 bp, Homo sapiens
atgctgtgacaataagtttga

SEQ ID NO: 3271934 - DNA, 22 bp, Homo sapiens
atgctgtgagtctttggttcta

SEQ ID NO: 3271935 - DNA, 17 bp, Homo sapiens
atgctgtgctatgaatt

SEQ ID NO: 3271936 - DNA, 14 bp, Homo sapiens
atgctgtgctcttt

SEQ ID NO: 3271937 - DNA, 22 bp, Homo sapiens
atgctgttgtaaacaacgtgta

SEQ ID NO: 3271938 - DNA, 16 bp, Homo sapiens
atgcttaaaataagca

SEQ ID NO: 3271939 - DNA, 15 bp, Homo sapiens
atgcttaaactaaat

SEQ ID NO: 3271940 - DNA, 13 bp, Homo sapiens
atgcttaaatttt

SEQ ID NO: 3271941 - DNA, 14 bp, Homo sapiens
atgcttaaatttta

SEQ ID NO: 3271942 - DNA, 23 bp, Homo sapiens
atgcttaagcatccgtgtatttg

SEQ ID NO: 3271943 - DNA, 14 bp, Homo sapiens
atggatttgcctgt

SEQ ID NO: 3271944 - DNA, 21 bp, Homo sapiens
atggattttctattgttactc

SEQ ID NO: 3271945 - DNA, 13 bp, Homo sapiens
atggatttttaaa

SEQ ID NO: 3271946 - DNA, 21 bp, Homo sapiens
atggatttttacaagatccat

SEQ ID NO: 3271947 - DNA, 15 bp, Homo sapiens
atggatttttcttta

SEQ ID NO: 3271948 - DNA, 23 bp, Homo sapiens
atggcaagttttgatatgagtat

SEQ ID NO: 3271949 - DNA, 17 bp, Homo sapiens
atggcacaatgaatgta

SEQ ID NO: 3271950 - DNA, 17 bp, Homo sapiens
atggcaccagccccctg

SEQ ID NO: 3271951 - DNA, 19 bp, Homo sapiens
atggcaccagccccctgga

SEQ ID NO: 3271952 - DNA, 20 bp, Homo sapiens
atggcaccagccccctggat

SEQ ID NO: 3271953 - DNA, 21 bp, Homo sapiens
atggcacttctccaaccccgg

SEQ ID NO: 3271954 - DNA, 20 bp, Homo sapiens
atggcagaagacaccagagc

SEQ ID NO: 3271955 - DNA, 13 bp, Homo sapiens
atggcagactctt

SEQ ID NO: 3271956 - DNA, 15 bp, Homo sapiens
atggcagaggagctt

SEQ ID NO: 3271957 - DNA, 15 bp, Homo sapiens
atggcaggggaagcc

SEQ ID NO: 3271958 - DNA, 19 bp, Homo sapiens
atggcaggggaagccttgc

SEQ ID NO: 3271959 - DNA, 20 bp, Homo sapiens
atggcatcttcgtcttcact

SEQ ID NO: 3271960 - DNA, 22 bp, Homo sapiens
atggccacagtagtcttgatga

SEQ ID NO: 3271961 - DNA, 14 bp, Homo sapiens
atggccacatttaa

SEQ ID NO: 3271962 - DNA, 19 bp, Homo sapiens
atggccaggatcctctcct

SEQ ID NO: 3271963 - DNA, 16 bp, Homo sapiens
atggccataggagagg

SEQ ID NO: 3271964 - DNA, 22 bp, Homo sapiens
atggccatggagtgtacaagta

SEQ ID NO: 3271965 - DNA, 14 bp, Homo sapiens
atggcccagtgtca

SEQ ID NO: 3271966 - DNA, 14 bp, Homo sapiens
atggccccagcaca

SEQ ID NO: 3271967 - DNA, 17 bp, Homo sapiens
atggccccagcacagct

SEQ ID NO: 3271968 - DNA, 16 bp, Homo sapiens
atggccccatcccagt

SEQ ID NO: 3271969 - DNA, 14 bp, Homo sapiens
atggcccccaataa

SEQ ID NO: 3271970 - DNA, 20 bp, Homo sapiens
atggcccccaataaaggcag

SEQ ID NO: 3271971 - DNA, 22 bp, Homo sapiens
atggcccccaataaaggcagct

SEQ ID NO: 3271972 - DNA, 23 bp, Homo sapiens
atggcccccaataaaggcagctg

SEQ ID NO: 3271973 - DNA, 13 bp, Homo sapiens
atggcccccaggg

SEQ ID NO: 3271974 - DNA, 14 bp, Homo sapiens
atggcccccagggg

SEQ ID NO: 3271975 - DNA, 23 bp, Homo sapiens
atggcccccaggggcaggactga

SEQ ID NO: 3271976 - DNA, 11 bp, Homo sapiens
atggcccctct

SEQ ID NO: 3271977 - DNA, 18 bp, Homo sapiens
atggcccctctgacctgc

SEQ ID NO: 3271978 - DNA, 11 bp, Homo sapiens
atggccctggg

SEQ ID NO: 3271979 - DNA, 18 bp, Homo sapiens
atggcctcagctgcctca

SEQ ID NO: 3271980 - DNA, 19 bp, Homo sapiens
atggcctcagctgcctcac

SEQ ID NO: 3271981 - DNA, 21 bp, Homo sapiens
atggcctcagctgcctcactt

SEQ ID NO: 3271982 - DNA, 23 bp, Homo sapiens
atggcctcgcctccccaccctcc

SEQ ID NO: 3271983 - DNA, 17 bp, Homo sapiens
atggcctctggccaggc

SEQ ID NO: 3271984 - DNA, 15 bp, Homo sapiens
atggcgcgggaggca

SEQ ID NO: 3271985 - DNA, 17 bp, Homo sapiens
atggcgtaatgggcctg

SEQ ID NO: 3271986 - DNA, 18 bp, Homo sapiens
atggcgtaatgggcctgc

SEQ ID NO: 3271987 - DNA, 21 bp, Homo sapiens
atggcgtaatgggcctgccca

SEQ ID NO: 3271988 - DNA, 20 bp, Homo sapiens
atggcgtgtccctctcggaa

SEQ ID NO: 3271989 - DNA, 18 bp, Homo sapiens
atggcgttttgtctgtgt

SEQ ID NO: 3271990 - DNA, 15 bp, Homo sapiens
atggctaataaactg

SEQ ID NO: 3271991 - DNA, 21 bp, Homo sapiens
atggctagtactgtattggct

SEQ ID NO: 3271992 - DNA, 13 bp, Homo sapiens
atggctataaata

SEQ ID NO: 3271993 - DNA, 16 bp, Homo sapiens
atggctataaatatat

SEQ ID NO: 3271994 - DNA, 19 bp, Homo sapiens
atggctatatggcaagaaa

SEQ ID NO: 3271995 - DNA, 18 bp, Homo sapiens
atggctatcaaaagaaat

SEQ ID NO: 3271996 - DNA, 14 bp, Homo sapiens
atggctcaagtaga

SEQ ID NO: 3271997 - DNA, 16 bp, Homo sapiens
atggctcaagtagaaa

SEQ ID NO: 3271998 - DNA, 19 bp, Homo sapiens
atggctcaggcaagcccct

SEQ ID NO: 3271999 - DNA, 22 bp, Homo sapiens
atggctcaggcaagcccctcag

SEQ ID NO: 3272000 - DNA, 16 bp, Homo sapiens
atggctccagaaatgt

SEQ ID NO: 3272001 - DNA, 17 bp, Homo sapiens
atggctcccacaggagt

SEQ ID NO: 3272002 - DNA, 14 bp, Homo sapiens
atggctctgcaccc

SEQ ID NO: 3272003 - DNA, 17 bp, Homo sapiens
atggctctgcacccctc

SEQ ID NO: 3272004 - DNA, 22 bp, Homo sapiens
atggctctgcacccctctgccc

SEQ ID NO: 3272005 - DNA, 23 bp, Homo sapiens
atggctctgcacccctctgccct

SEQ ID NO: 3272006 - DNA, 19 bp, Homo sapiens
atggctctggactctaaag

SEQ ID NO: 3272007 - DNA, 22 bp, Homo sapiens
atggctctggactctaaagacc

SEQ ID NO: 3272008 - DNA, 22 bp, Homo sapiens
atggctgaaggaaaccagtgca

SEQ ID NO: 3272009 - DNA, 14 bp, Homo sapiens
atggctgagatgga

SEQ ID NO: 3272010 - DNA, 19 bp, Homo sapiens
atggctgcacctttttgca

SEQ ID NO: 3272011 - DNA, 17 bp, Homo sapiens
atggctgcccaggagac

SEQ ID NO: 3272012 - DNA, 14 bp, Homo sapiens
atggctgcccctgc

SEQ ID NO: 3272013 - DNA, 22 bp, Homo sapiens
atggctgctagattttaattta

SEQ ID NO: 3272014 - DNA, 23 bp, Homo sapiens
atggctggccactgcacagagct

SEQ ID NO: 3272015 - DNA, 19 bp, Homo sapiens
atggctgggtcagggccag

SEQ ID NO: 3272016 - DNA, 15 bp, Homo sapiens
atggctgtgcctctg

SEQ ID NO: 3272017 - DNA, 14 bp, Homo sapiens
atggcttaatgttt

SEQ ID NO: 3272018 - DNA, 20 bp, Homo sapiens
atggcttattttttaaaata

SEQ ID NO: 3272019 - DNA, 13 bp, Homo sapiens
atggcttgacatg

SEQ ID NO: 3272020 - DNA, 18 bp, Homo sapiens
atggcttgacatgtgcaa

SEQ ID NO: 3272021 - DNA, 20 bp, Homo sapiens
atggcttgtctatactcctt

SEQ ID NO: 3272022 - DNA, 14 bp, Homo sapiens
atggcttgtgaact

SEQ ID NO: 3272023 - DNA, 13 bp, Homo sapiens
atggctttcaaag

SEQ ID NO: 3272024 - DNA, 14 bp, Homo sapiens
atggctttttttgc

SEQ ID NO: 3272025 - DNA, 24 bp, Homo sapiens
atggctttttttgcctaccatttc

SEQ ID NO: 3272026 - DNA, 18 bp, Homo sapiens
atgggaaaactgccaata

SEQ ID NO: 3272027 - DNA, 14 bp, Homo sapiens
atgggaaaatattt

SEQ ID NO: 3272028 - DNA, 18 bp, Homo sapiens
atgggaaaatatttcctg

SEQ ID NO: 3272029 - DNA, 23 bp, Homo sapiens
atgggaaagccacctctccctca

SEQ ID NO: 3272030 - DNA, 23 bp, Homo sapiens
atgggaacctagtactctctgct

SEQ ID NO: 3272031 - DNA, 18 bp, Homo sapiens
atgggaatagggagacag

SEQ ID NO: 3272032 - DNA, 19 bp, Homo sapiens
atgggaatagggagacagg

SEQ ID NO: 3272033 - DNA, 18 bp, Homo sapiens
atgggaatgaggtgggag

SEQ ID NO: 3272034 - DNA, 14 bp, Homo sapiens
atgggaatttgtca

SEQ ID NO: 3272035 - DNA, 15 bp, Homo sapiens
atgggaatttgtcag

SEQ ID NO: 3272036 - DNA, 17 bp, Homo sapiens
atgggagacccttgaca

SEQ ID NO: 3272037 - DNA, 15 bp, Homo sapiens
atgggagatggtcag

SEQ ID NO: 3272038 - DNA, 17 bp, Homo sapiens
atgggagccagctgctt

SEQ ID NO: 3272039 - DNA, 13 bp, Homo sapiens
atgggaggaaaga

SEQ ID NO: 3272040 - DNA, 16 bp, Homo sapiens
atgggagtgagacaga

SEQ ID NO: 3272041 - DNA, 14 bp, Homo sapiens
atgggagtgggcac

SEQ ID NO: 3272042 - DNA, 17 bp, Homo sapiens
atgggatacaacctccc

SEQ ID NO: 3272043 - DNA, 21 bp, Homo sapiens
atgggcaacccccagcctgct

SEQ ID NO: 3272044 - DNA, 15 bp, Homo sapiens
atgggcattgggctg

SEQ ID NO: 3272045 - DNA, 21 bp, Homo sapiens
atgggcattgggctgacacct

SEQ ID NO: 3272046 - DNA, 12 bp, Homo sapiens
atgggccaccgc

SEQ ID NO: 3272047 - DNA, 13 bp, Homo sapiens
atgggccaccgcc

SEQ ID NO: 3272048 - DNA, 15 bp, Homo sapiens
atgggccagcctagc

SEQ ID NO: 3272049 - DNA, 23 bp, Homo sapiens
atgggccagggtttacccagtgg

SEQ ID NO: 3272050 - DNA, 18 bp, Homo sapiens
atgggccccgccttcctg

SEQ ID NO: 3272051 - DNA, 18 bp, Homo sapiens
atgggcctcctgtgtgtg

SEQ ID NO: 3272052 - DNA, 14 bp, Homo sapiens
atgggcctgcccaa

SEQ ID NO: 3272053 - DNA, 15 bp, Homo sapiens
atgggcctgggcctg

SEQ ID NO: 3272054 - DNA, 16 bp, Homo sapiens
atgggcctgggcctgc

SEQ ID NO: 3272055 - DNA, 22 bp, Homo sapiens
atgggccttgctttgggctttg

SEQ ID NO: 3272056 - DNA, 20 bp, Homo sapiens
atgggcctttaagaacctta

SEQ ID NO: 3272057 - DNA, 21 bp, Homo sapiens
atgggccttttcttgaataaa

SEQ ID NO: 3272058 - DNA, 15 bp, Homo sapiens
atgggcgcaggccca

SEQ ID NO: 3272059 - DNA, 16 bp, Homo sapiens
atgggcgcaggcccag

SEQ ID NO: 3272060 - DNA, 23 bp, Homo sapiens
atgggcggaagtacttccctcag

SEQ ID NO: 3272061 - DNA, 20 bp, Homo sapiens
atgggcttcactgtataaat

SEQ ID NO: 3272062 - DNA, 23 bp, Homo sapiens
atgggcttggacttcctggggcc

SEQ ID NO: 3272063 - DNA, 15 bp, Homo sapiens
atgggctttctcttt

SEQ ID NO: 3272064 - DNA, 22 bp, Homo sapiens
atgggcttttggggagccagaa

SEQ ID NO: 3272065 - DNA, 17 bp, Homo sapiens
atggggaggcaagtgtg

SEQ ID NO: 3272066 - DNA, 16 bp, Homo sapiens
atggggatagaggaaa

SEQ ID NO: 3272067 - DNA, 17 bp, Homo sapiens
atggggatcacagagac

SEQ ID NO: 3272068 - DNA, 13 bp, Homo sapiens
atttatactttgc

SEQ ID NO: 3272069 - DNA, 15 bp, Homo sapiens
atttatagaaagctt

SEQ ID NO: 3272070 - DNA, 17 bp, Homo sapiens
atttataggccagggca

SEQ ID NO: 3272071 - DNA, 22 bp, Homo sapiens
atttataggccagggcatgtgt

SEQ ID NO: 3272072 - DNA, 19 bp, Homo sapiens
atttatagtatgtgacttt

SEQ ID NO: 3272073 - DNA, 14 bp, Homo sapiens
atttatagtttgta

SEQ ID NO: 3272074 - DNA, 16 bp, Homo sapiens
atttatagtttgtaca

SEQ ID NO: 3272075 - DNA, 15 bp, Homo sapiens
atttatataaatgta

SEQ ID NO: 3272076 - DNA, 16 bp, Homo sapiens
atttatatatgtatct

SEQ ID NO: 3272077 - DNA, 14 bp, Homo sapiens
atttatatattgaa

SEQ ID NO: 3272078 - DNA, 20 bp, Homo sapiens
atttatatatttataactca

SEQ ID NO: 3272079 - DNA, 13 bp, Homo sapiens
atttatatttcac

SEQ ID NO: 3272080 - DNA, 12 bp, Homo sapiens
atttatatttgg

SEQ ID NO: 3272081 - DNA, 16 bp, Homo sapiens
atttatatttggaaag

SEQ ID NO: 3272082 - DNA, 14 bp, Homo sapiens
atttatcaaagcat

SEQ ID NO: 3272083 - DNA, 17 bp, Homo sapiens
atttatcagtgacagag

SEQ ID NO: 3272084 - DNA, 23 bp, Homo sapiens
atttatcagtgacagagttcact

SEQ ID NO: 3272085 - DNA, 17 bp, Homo sapiens
atttatccaaaatgtgt

SEQ ID NO: 3272086 - DNA, 23 bp, Homo sapiens
atttatccctttacaatgtgaat

SEQ ID NO: 3272087 - DNA, 20 bp, Homo sapiens
atttatcctcacataaaaaa

SEQ ID NO: 3272088 - DNA, 13 bp, Homo sapiens
atttatctaaatt

SEQ ID NO: 3272089 - DNA, 10 bp, Homo sapiens
atttatctat

SEQ ID NO: 3272090 - DNA, 15 bp, Homo sapiens
atttatctataattt

SEQ ID NO: 3272091 - DNA, 19 bp, Homo sapiens
atttatctctatttaatat

SEQ ID NO: 3272092 - DNA, 17 bp, Homo sapiens
atttatctttatacaga

SEQ ID NO: 3272093 - DNA, 20 bp, Homo sapiens
atttatctttatacagattt

SEQ ID NO: 3272094 - DNA, 16 bp, Homo sapiens
atttatctttcaaaga

SEQ ID NO: 3272095 - DNA, 18 bp, Homo sapiens
atttatgaagcagattta

SEQ ID NO: 3272096 - DNA, 19 bp, Homo sapiens
atttatgagtttttgatag

SEQ ID NO: 3272097 - DNA, 17 bp, Homo sapiens
atttatgatttaataaa

SEQ ID NO: 3272098 - DNA, 19 bp, Homo sapiens
atttatgatttaataaaat

SEQ ID NO: 3272099 - DNA, 13 bp, Homo sapiens
atttatgcatttc

SEQ ID NO: 3272100 - DNA, 14 bp, Homo sapiens
atttatgcatttca

SEQ ID NO: 3272101 - DNA, 16 bp, Homo sapiens
atttatgcatttcatt

SEQ ID NO: 3272102 - DNA, 22 bp, Homo sapiens
atttatgctataaattttttga

SEQ ID NO: 3272103 - DNA, 14 bp, Homo sapiens
atttatggaccact

SEQ ID NO: 3272104 - DNA, 15 bp, Homo sapiens
atttatggttttttt

SEQ ID NO: 3272105 - DNA, 12 bp, Homo sapiens
atttatgtaaac

SEQ ID NO: 3272106 - DNA, 20 bp, Homo sapiens
atttatgtagatgtgcattt

SEQ ID NO: 3272107 - DNA, 21 bp, Homo sapiens
atttatgtagatgtgcatttt

SEQ ID NO: 3272108 - DNA, 14 bp, Homo sapiens
atttatgttaaaag

SEQ ID NO: 3272109 - DNA, 13 bp, Homo sapiens
atttatgtttgca

SEQ ID NO: 3272110 - DNA, 22 bp, Homo sapiens
atttattaaaaatgttctcaaa

SEQ ID NO: 3272111 - DNA, 13 bp, Homo sapiens
atttattaaataa

SEQ ID NO: 3272112 - DNA, 17 bp, Homo sapiens
atttattaaataaaatc

SEQ ID NO: 3272113 - DNA, 18 bp, Homo sapiens
atttattaaataaaatca

SEQ ID NO: 3272114 - DNA, 18 bp, Homo sapiens
atttattaaatgtattat

SEQ ID NO: 3272115 - DNA, 22 bp, Homo sapiens
atttattaagatggattctcag

SEQ ID NO: 3272116 - DNA, 12 bp, Homo sapiens
atttattaatat

SEQ ID NO: 3272117 - DNA, 14 bp, Homo sapiens
atttattaatattt

SEQ ID NO: 3272118 - DNA, 12 bp, Homo sapiens
atttattacaac

SEQ ID NO: 3272119 - DNA, 14 bp, Homo sapiens
atttattacctctg

SEQ ID NO: 3272120 - DNA, 16 bp, Homo sapiens
atttattagttaatat

SEQ ID NO: 3272121 - DNA, 23 bp, Homo sapiens
atttattatgctttattggaaaa

SEQ ID NO: 3272122 - DNA, 15 bp, Homo sapiens
atttattattgaaat

SEQ ID NO: 3272123 - DNA, 19 bp, Homo sapiens
atttattatttatttatta

SEQ ID NO: 3272124 - DNA, 21 bp, Homo sapiens
atttattattttttttatatt

SEQ ID NO: 3272125 - DNA, 20 bp, Homo sapiens
atttattcagcttcatttgt

SEQ ID NO: 3272126 - DNA, 16 bp, Homo sapiens
atttattcataatgaa

SEQ ID NO: 3272127 - DNA, 18 bp, Homo sapiens
atttattcataatgaatt

SEQ ID NO: 3272128 - DNA, 23 bp, Homo sapiens
atttattccatattcatgtaaac

SEQ ID NO: 3272129 - DNA, 14 bp, Homo sapiens
atttattctttatt

SEQ ID NO: 3272130 - DNA, 18 bp, Homo sapiens
atttattgactttgacaa

SEQ ID NO: 3272131 - DNA, 19 bp, Homo sapiens
atttattgactttgacaat

SEQ ID NO: 3272132 - DNA, 22 bp, Homo sapiens
atttattgcagaggatgttcat

SEQ ID NO: 3272133 - DNA, 24 bp, Homo sapiens
atttattgcagaggatgttcataa

SEQ ID NO: 3272134 - DNA, 22 bp, Homo sapiens
atttattgctgtgtaacactgt

SEQ ID NO: 3272135 - DNA, 13 bp, Homo sapiens
atttattgtctgt

SEQ ID NO: 3272136 - DNA, 19 bp, Homo sapiens
atttattgtctgtctacat

SEQ ID NO: 3272137 - DNA, 23 bp, Homo sapiens
atttattgttagaaaatgactta

SEQ ID NO: 3272138 - DNA, 16 bp, Homo sapiens
atttattgtttatgta

SEQ ID NO: 3272139 - DNA, 20 bp, Homo sapiens
atttattgtttatttatcag

SEQ ID NO: 3272140 - DNA, 15 bp, Homo sapiens
atttatttaaagcat

SEQ ID NO: 3272141 - DNA, 20 bp, Homo sapiens
atttatttaaagcattgctt

SEQ ID NO: 3272142 - DNA, 12 bp, Homo sapiens
atttatttaata

SEQ ID NO: 3272143 - DNA, 13 bp, Homo sapiens
atttatttaataa

SEQ ID NO: 3272144 - DNA, 24 bp, Homo sapiens
atttatttactgagcttctctgtg

SEQ ID NO: 3272145 - DNA, 14 bp, Homo sapiens
atttatttattaag

SEQ ID NO: 3272146 - DNA, 16 bp, Homo sapiens
atttatttattaagat

SEQ ID NO: 3272147 - DNA, 14 bp, Homo sapiens
atttatttcaaaaa

SEQ ID NO: 3272148 - DNA, 20 bp, Homo sapiens
atttatttccactaaaaata

SEQ ID NO: 3272149 - DNA, 22 bp, Homo sapiens
atttatttccactaaaaatatt

SEQ ID NO: 3272150 - DNA, 17 bp, Homo sapiens
atttatttcctccctct

SEQ ID NO: 3272151 - DNA, 13 bp, Homo sapiens
atttatttcttaa

SEQ ID NO: 3272152 - DNA, 14 bp, Homo sapiens
atttattttaagca

SEQ ID NO: 3272153 - DNA, 19 bp, Homo sapiens
atttattttattctatgta

SEQ ID NO: 3272154 - DNA, 22 bp, Homo sapiens
atttattttattctatgtatgt

SEQ ID NO: 3272155 - DNA, 14 bp, Homo sapiens
atttatttttacaa

SEQ ID NO: 3272156 - DNA, 15 bp, Homo sapiens
atttatttttcagtt

SEQ ID NO: 3272157 - DNA, 19 bp, Homo sapiens
atttatttttcagttccaa

SEQ ID NO: 3272158 - DNA, 20 bp, Homo sapiens
atttatttttcagttccaag

SEQ ID NO: 3272159 - DNA, 18 bp, Homo sapiens
atttcaaaaatataactt

SEQ ID NO: 3272160 - DNA, 19 bp, Homo sapiens
atttcaaaaatataactta

SEQ ID NO: 3272161 - DNA, 21 bp, Homo sapiens
atttcaaaatcagtttttcat

SEQ ID NO: 3272162 - DNA, 14 bp, Homo sapiens
atttcaaaatgctt

SEQ ID NO: 3272163 - DNA, 18 bp, Homo sapiens
atttcaaagttttgttgt

SEQ ID NO: 3272164 - DNA, 19 bp, Homo sapiens
atttcaaagttttgttgta

SEQ ID NO: 3272165 - DNA, 18 bp, Homo sapiens
atttcaacatgagtgtat

SEQ ID NO: 3272166 - DNA, 19 bp, Homo sapiens
atttcaacatgagtgtatt

SEQ ID NO: 3272167 - DNA, 20 bp, Homo sapiens
atttcaagaaaaaataaatg

SEQ ID NO: 3272168 - DNA, 22 bp, Homo sapiens
atttcaagaaaaaataaatgga

SEQ ID NO: 3272169 - DNA, 23 bp, Homo sapiens
atttcaagaaaaaataaatggaa

SEQ ID NO: 3272170 - DNA, 19 bp, Homo sapiens
atttcaaggaatggaatct

SEQ ID NO: 3272171 - DNA, 22 bp, Homo sapiens
atttcaaggaatggaatcttct

SEQ ID NO: 3272172 - DNA, 14 bp, Homo sapiens
atttcaaggttcta

SEQ ID NO: 3272173 - DNA, 12 bp, Homo sapiens
atttcaagtgcc

SEQ ID NO: 3272174 - DNA, 14 bp, Homo sapiens
atttcaagtgccta

SEQ ID NO: 3272175 - DNA, 22 bp, Homo sapiens
atttcaagttccaagttgctaa

SEQ ID NO: 3272176 - DNA, 19 bp, Homo sapiens
atttcaatcattgaagtat

SEQ ID NO: 3272177 - DNA, 14 bp, Homo sapiens
atttcaatgtgtat

SEQ ID NO: 3272178 - DNA, 15 bp, Homo sapiens
atttcaattctcaaa

SEQ ID NO: 3272179 - DNA, 22 bp, Homo sapiens
atttcacacagtgaaacgcaat

SEQ ID NO: 3272180 - DNA, 14 bp, Homo sapiens
atttcacaggctgt

SEQ ID NO: 3272181 - DNA, 16 bp, Homo sapiens
atttcacaggctgtaa

SEQ ID NO: 3272182 - DNA, 17 bp, Homo sapiens
atttcacaggctgtaaa

SEQ ID NO: 3272183 - DNA, 15 bp, Homo sapiens
atttcacattattct

SEQ ID NO: 3272184 - DNA, 16 bp, Homo sapiens
atttcacctgtaaacc

SEQ ID NO: 3272185 - DNA, 18 bp, Homo sapiens
atttcacctgtaaacctg

SEQ ID NO: 3272186 - DNA, 15 bp, Homo sapiens
atttcacctgtgaca

SEQ ID NO: 3272187 - DNA, 22 bp, Homo sapiens
atttcacctgtgacaaaggatg

SEQ ID NO: 3272188 - DNA, 23 bp, Homo sapiens
atttcacctgtgacaaaggatga

SEQ ID NO: 3272189 - DNA, 21 bp, Homo sapiens
atttcactatcttcttcaaat

SEQ ID NO: 3272190 - DNA, 23 bp, Homo sapiens
atttcactgtctttaattctgta

SEQ ID NO: 3272191 - DNA, 18 bp, Homo sapiens
atttcactttagatgctg

SEQ ID NO: 3272192 - DNA, 12 bp, Homo sapiens
atttcagaagag

SEQ ID NO: 3272193 - DNA, 20 bp, Homo sapiens
atttcagactgcagagggga

SEQ ID NO: 3272194 - DNA, 22 bp, Homo sapiens
atttcagagaggccttttggaa

SEQ ID NO: 3272195 - DNA, 19 bp, Homo sapiens
atttcagatatcaaaattc

SEQ ID NO: 3272196 - DNA, 16 bp, Homo sapiens
atttcaggaatttaaa

SEQ ID NO: 3272197 - DNA, 13 bp, Homo sapiens
atttaaaaatatt

SEQ ID NO: 3272198 - DNA, 16 bp, Homo sapiens
atttaaaaatatttca

SEQ ID NO: 3272199 - DNA, 18 bp, Homo sapiens
atttaaaaattgtttctt

SEQ ID NO: 3272200 - DNA, 13 bp, Homo sapiens
atttaaaactgtt

SEQ ID NO: 3272201 - DNA, 14 bp, Homo sapiens
atttaaaataaatt

SEQ ID NO: 3272202 - DNA, 15 bp, Homo sapiens
atttaaaattaagta

SEQ ID NO: 3272203 - DNA, 15 bp, Homo sapiens
atttaaacacacaga

SEQ ID NO: 3272204 - DNA, 17 bp, Homo sapiens
atttaaacattaaaaat

SEQ ID NO: 3272205 - DNA, 20 bp, Homo sapiens
atttaaacccaatcagatgc

SEQ ID NO: 3272206 - DNA, 14 bp, Homo sapiens
atttaaacctttta

SEQ ID NO: 3272207 - DNA, 16 bp, Homo sapiens
atttaaactatcttgt

SEQ ID NO: 3272208 - DNA, 17 bp, Homo sapiens
atttaaactatcttgtg

SEQ ID NO: 3272209 - DNA, 18 bp, Homo sapiens
atttaaactcaagacaat

SEQ ID NO: 3272210 - DNA, 23 bp, Homo sapiens
atttaaactgcaatgccagtcct

SEQ ID NO: 3272211 - DNA, 13 bp, Homo sapiens
atttaaatataat

SEQ ID NO: 3272212 - DNA, 18 bp, Homo sapiens
atttaaatataattctgt

SEQ ID NO: 3272213 - DNA, 22 bp, Homo sapiens
atttaaatataattctgtaaat

SEQ ID NO: 3272214 - DNA, 13 bp, Homo sapiens
atttaaatgaaag

SEQ ID NO: 3272215 - DNA, 21 bp, Homo sapiens
atttaaattacaattttatct

SEQ ID NO: 3272216 - DNA, 15 bp, Homo sapiens
atttaaatttaaaga

SEQ ID NO: 3272217 - DNA, 21 bp, Homo sapiens
atttaaatttgatttccatct

SEQ ID NO: 3272218 - DNA, 19 bp, Homo sapiens
atttaacaatttattctga

SEQ ID NO: 3272219 - DNA, 17 bp, Homo sapiens
atttaacagtcatttaa

SEQ ID NO: 3272220 - DNA, 20 bp, Homo sapiens
atttaacattatttatatgg

SEQ ID NO: 3272221 - DNA, 18 bp, Homo sapiens
atttaagaaaagcacttt

SEQ ID NO: 3272222 - DNA, 21 bp, Homo sapiens
atttaagaaaagcacttttgt

SEQ ID NO: 3272223 - DNA, 17 bp, Homo sapiens
atttaagaaaatacaat

SEQ ID NO: 3272224 - DNA, 20 bp, Homo sapiens
atttaagaaaatacaataaa

SEQ ID NO: 3272225 - DNA, 16 bp, Homo sapiens
atttaagacactgaaa

SEQ ID NO: 3272226 - DNA, 11 bp, Homo sapiens
atttaagcatt

SEQ ID NO: 3272227 - DNA, 13 bp, Homo sapiens
atttaagcattgt

SEQ ID NO: 3272228 - DNA, 15 bp, Homo sapiens
atttaagcattgttt

SEQ ID NO: 3272229 - DNA, 17 bp, Homo sapiens
atttaagcctcatattt

SEQ ID NO: 3272230 - DNA, 17 bp, Homo sapiens
atttaagccttataaac

SEQ ID NO: 3272231 - DNA, 15 bp, Homo sapiens
atttaagctgtaaat

SEQ ID NO: 3272232 - DNA, 19 bp, Homo sapiens
atttaagtgcgtgtgtaga

SEQ ID NO: 3272233 - DNA, 22 bp, Homo sapiens
atttaagtgttggaaaaaattt

SEQ ID NO: 3272234 - DNA, 19 bp, Homo sapiens
atttaataaaataattcta

SEQ ID NO: 3272235 - DNA, 16 bp, Homo sapiens
atttaataacaattgt

SEQ ID NO: 3272236 - DNA, 13 bp, Homo sapiens
atttaataacatt

SEQ ID NO: 3272237 - DNA, 14 bp, Homo sapiens
atttaataacatta

SEQ ID NO: 3272238 - DNA, 17 bp, Homo sapiens
atttaataacattacct

SEQ ID NO: 3272239 - DNA, 18 bp, Homo sapiens
atttaataacattacctt

SEQ ID NO: 3272240 - DNA, 16 bp, Homo sapiens
atttaataatgtatgt

SEQ ID NO: 3272241 - DNA, 15 bp, Homo sapiens
atttaatacagcagt

SEQ ID NO: 3272242 - DNA, 19 bp, Homo sapiens
atttaataccagatacctt

SEQ ID NO: 3272243 - DNA, 13 bp, Homo sapiens
atttaatatttat

SEQ ID NO: 3272244 - DNA, 18 bp, Homo sapiens
atttaatcttttttatgt

SEQ ID NO: 3272245 - DNA, 13 bp, Homo sapiens
atttaatgcatta

SEQ ID NO: 3272246 - DNA, 12 bp, Homo sapiens
atttaatgctgc

SEQ ID NO: 3272247 - DNA, 16 bp, Homo sapiens
atttaatggatatttc

SEQ ID NO: 3272248 - DNA, 18 bp, Homo sapiens
atttaatggatatttctc

SEQ ID NO: 3272249 - DNA, 21 bp, Homo sapiens
atttaatggcagctagtgcct

SEQ ID NO: 3272250 - DNA, 22 bp, Homo sapiens
atttaatggcagctagtgcctt

SEQ ID NO: 3272251 - DNA, 20 bp, Homo sapiens
atttaatggtttttatttct

SEQ ID NO: 3272252 - DNA, 22 bp, Homo sapiens
atttaattaccttattggatat

SEQ ID NO: 3272253 - DNA, 18 bp, Homo sapiens
atttaattcctcttttta

SEQ ID NO: 3272254 - DNA, 23 bp, Homo sapiens
atttaattcctctttttagggct

SEQ ID NO: 3272255 - DNA, 22 bp, Homo sapiens
atttaattctttctattttcac

SEQ ID NO: 3272256 - DNA, 13 bp, Homo sapiens
atttaattgtaaa

SEQ ID NO: 3272257 - DNA, 14 bp, Homo sapiens
atttaattgtaaac

SEQ ID NO: 3272258 - DNA, 17 bp, Homo sapiens
atttaattgtaaactgt

SEQ ID NO: 3272259 - DNA, 15 bp, Homo sapiens
atttaatttagtgat

SEQ ID NO: 3272260 - DNA, 13 bp, Homo sapiens
atttaatttccag

SEQ ID NO: 3272261 - DNA, 17 bp, Homo sapiens
atttacaccacactttc

SEQ ID NO: 3272262 - DNA, 12 bp, Homo sapiens
atttacactttt

SEQ ID NO: 3272263 - DNA, 19 bp, Homo sapiens
atttacagatgaatgtatt

SEQ ID NO: 3272264 - DNA, 15 bp, Homo sapiens
atttacaggaacttc

SEQ ID NO: 3272265 - DNA, 16 bp, Homo sapiens
atttacaggaacttca

SEQ ID NO: 3272266 - DNA, 16 bp, Homo sapiens
atttacagtctctttc

SEQ ID NO: 3272267 - DNA, 18 bp, Homo sapiens
atttacagtctctttctt

SEQ ID NO: 3272268 - DNA, 22 bp, Homo sapiens
atttacagtctctttcttcctt

SEQ ID NO: 3272269 - DNA, 22 bp, Homo sapiens
atttacagtgaaaatgtaagct

SEQ ID NO: 3272270 - DNA, 21 bp, Homo sapiens
atttacatgaattgcatttta

SEQ ID NO: 3272271 - DNA, 14 bp, Homo sapiens
atttacatgtatgg

SEQ ID NO: 3272272 - DNA, 19 bp, Homo sapiens
atttacatgttttaaagaa

SEQ ID NO: 3272273 - DNA, 11 bp, Homo sapiens
atttacattta

SEQ ID NO: 3272274 - DNA, 18 bp, Homo sapiens
atttacatttatctatta

SEQ ID NO: 3272275 - DNA, 22 bp, Homo sapiens
atttacatttatctattaaaat

SEQ ID NO: 3272276 - DNA, 20 bp, Homo sapiens
atttaccaaagagatattga

SEQ ID NO: 3272277 - DNA, 14 bp, Homo sapiens
atttaccctttata

SEQ ID NO: 3272278 - DNA, 18 bp, Homo sapiens
atttaccgttgcttgaaa

SEQ ID NO: 3272279 - DNA, 17 bp, Homo sapiens
atttacctaagattaca

SEQ ID NO: 3272280 - DNA, 20 bp, Homo sapiens
atttaccttttaagacattt

SEQ ID NO: 3272281 - DNA, 20 bp, Homo sapiens
atttaccttttctgttgtac

SEQ ID NO: 3272282 - DNA, 13 bp, Homo sapiens
atttactaaacat

SEQ ID NO: 3272283 - DNA, 15 bp, Homo sapiens
atttactaagccaca

SEQ ID NO: 3272284 - DNA, 12 bp, Homo sapiens
atttactgtact

SEQ ID NO: 3272285 - DNA, 15 bp, Homo sapiens
atttacttttaataa

SEQ ID NO: 3272286 - DNA, 22 bp, Homo sapiens
atttagaaaatagagcttttaa

SEQ ID NO: 3272287 - DNA, 17 bp, Homo sapiens
atttagaaactgatttc

SEQ ID NO: 3272288 - DNA, 22 bp, Homo sapiens
atttagaaagaagcccaatatt

SEQ ID NO: 3272289 - DNA, 14 bp, Homo sapiens
atttagaagaaaga

SEQ ID NO: 3272290 - DNA, 18 bp, Homo sapiens
atttagaagaaagatgtt

SEQ ID NO: 3272291 - DNA, 22 bp, Homo sapiens
atttagaagccaactatgatta

SEQ ID NO: 3272292 - DNA, 23 bp, Homo sapiens
atttagaagccaactatgattat

SEQ ID NO: 3272293 - DNA, 14 bp, Homo sapiens
atttagacaagaga

SEQ ID NO: 3272294 - DNA, 16 bp, Homo sapiens
atttagacaagagatg

SEQ ID NO: 3272295 - DNA, 20 bp, Homo sapiens
atttagacaagagatgggaa

SEQ ID NO: 3272296 - DNA, 12 bp, Homo sapiens
atttagatctta

SEQ ID NO: 3272297 - DNA, 15 bp, Homo sapiens
atttagcatgttgtt

SEQ ID NO: 3272298 - DNA, 14 bp, Homo sapiens
atttagccctttaa

SEQ ID NO: 3272299 - DNA, 18 bp, Homo sapiens
atttagccctttaaaacg

SEQ ID NO: 3272300 - DNA, 16 bp, Homo sapiens
atttagccgggcgcgg

SEQ ID NO: 3272301 - DNA, 21 bp, Homo sapiens
atttagctaaacggattccaa

SEQ ID NO: 3272302 - DNA, 22 bp, Homo sapiens
atttaggcagattgaaaaggac

SEQ ID NO: 3272303 - DNA, 20 bp, Homo sapiens
atttagggtactaaatttaa

SEQ ID NO: 3272304 - DNA, 22 bp, Homo sapiens
atttagggtactaaatttaaat

SEQ ID NO: 3272305 - DNA, 18 bp, Homo sapiens
atttagtgatcttagcat

SEQ ID NO: 3272306 - DNA, 19 bp, Homo sapiens
atttagtgatcttagcata

SEQ ID NO: 3272307 - DNA, 16 bp, Homo sapiens
atttagtgctaaacaa

SEQ ID NO: 3272308 - DNA, 13 bp, Homo sapiens
atttagttattga

SEQ ID NO: 3272309 - DNA, 12 bp, Homo sapiens
atttagttcttt

SEQ ID NO: 3272310 - DNA, 17 bp, Homo sapiens
atttagttctttgttat

SEQ ID NO: 3272311 - DNA, 12 bp, Homo sapiens
atttagtttcag

SEQ ID NO: 3272312 - DNA, 14 bp, Homo sapiens
atttataaaacttc

SEQ ID NO: 3272313 - DNA, 12 bp, Homo sapiens
atttataaacta

SEQ ID NO: 3272314 - DNA, 14 bp, Homo sapiens
atttataaatatat

SEQ ID NO: 3272315 - DNA, 23 bp, Homo sapiens
atttataaatatattcaggagtt

SEQ ID NO: 3272316 - DNA, 18 bp, Homo sapiens
atttataaccccagcctg

SEQ ID NO: 3272317 - DNA, 19 bp, Homo sapiens
atttataaccccagcctga

SEQ ID NO: 3272318 - DNA, 14 bp, Homo sapiens
atttataactcatc

SEQ ID NO: 3272319 - DNA, 16 bp, Homo sapiens
atttataactcatcat

SEQ ID NO: 3272320 - DNA, 17 bp, Homo sapiens
atttataactcatcata

SEQ ID NO: 3272321 - DNA, 20 bp, Homo sapiens
atttataactcatcataaaa

SEQ ID NO: 3272322 - DNA, 22 bp, Homo sapiens
atttataatgaatactttctta

SEQ ID NO: 3272323 - DNA, 14 bp, Homo sapiens
atttataatgttag

SEQ ID NO: 3272324 - DNA, 14 bp, Homo sapiens
atttataatgtttg

SEQ ID NO: 3272325 - DNA, 13 bp, Homo sapiens
atttatacaagat

SEQ ID NO: 3272326 - DNA, 19 bp, Homo sapiens
atttatacccccaggaaac

SEQ ID NO: 3272327 - DNA, 20 bp, Homo sapiens
attgaccttctccctcactc

SEQ ID NO: 3272328 - DNA, 21 bp, Homo sapiens
attgacgacaagtgctgaaca

SEQ ID NO: 3272329 - DNA, 20 bp, Homo sapiens
attgacgattccttctctga

SEQ ID NO: 3272330 - DNA, 22 bp, Homo sapiens
attgacggttttttattattgt

SEQ ID NO: 3272331 - DNA, 23 bp, Homo sapiens
attgactaactcaaatacacatt

SEQ ID NO: 3272332 - DNA, 22 bp, Homo sapiens
attgactggtttacaggccctg

SEQ ID NO: 3272333 - DNA, 12 bp, Homo sapiens
attgacttcatt

SEQ ID NO: 3272334 - DNA, 21 bp, Homo sapiens
attgacttcattttatattta

SEQ ID NO: 3272335 - DNA, 14 bp, Homo sapiens
attgacttgtatat

SEQ ID NO: 3272336 - DNA, 16 bp, Homo sapiens
attgagaaagaaacta

SEQ ID NO: 3272337 - DNA, 14 bp, Homo sapiens
attgagaaggagag

SEQ ID NO: 3272338 - DNA, 15 bp, Homo sapiens
attgagaaggagaga

SEQ ID NO: 3272339 - DNA, 17 bp, Homo sapiens
attgagaaggagagaaa

SEQ ID NO: 3272340 - DNA, 19 bp, Homo sapiens
attattcaaaccaatttct

SEQ ID NO: 3272341 - DNA, 12 bp, Homo sapiens
attattcattta

SEQ ID NO: 3272342 - DNA, 14 bp, Homo sapiens
attattcatttaaa

SEQ ID NO: 3272343 - DNA, 12 bp, Homo sapiens
attattccctct

SEQ ID NO: 3272344 - DNA, 16 bp, Homo sapiens
attattctgattccac

SEQ ID NO: 3272345 - DNA, 14 bp, Homo sapiens
attattctttgaaa

SEQ ID NO: 3272346 - DNA, 17 bp, Homo sapiens
attattctttgaaaaca

SEQ ID NO: 3272347 - DNA, 21 bp, Homo sapiens
attattgaaggaagccaaatt

SEQ ID NO: 3272348 - DNA, 15 bp, Homo sapiens
attattgatatatat

SEQ ID NO: 3272349 - DNA, 11 bp, Homo sapiens
attattgctta

SEQ ID NO: 3272350 - DNA, 13 bp, Homo sapiens
attattgtaagtt

SEQ ID NO: 3272351 - DNA, 18 bp, Homo sapiens
attattgtaagttgtaca

SEQ ID NO: 3272352 - DNA, 20 bp, Homo sapiens
attattgtaagttgtacaaa

SEQ ID NO: 3272353 - DNA, 21 bp, Homo sapiens
attattgttcccctaagtgga

SEQ ID NO: 3272354 - DNA, 19 bp, Homo sapiens
attatttaaactcgctcct

SEQ ID NO: 3272355 - DNA, 12 bp, Homo sapiens
attatttaataa

SEQ ID NO: 3272356 - DNA, 15 bp, Homo sapiens
attatttaataacat

SEQ ID NO: 3272357 - DNA, 21 bp, Homo sapiens
attatttaataacattacctt

SEQ ID NO: 3272358 - DNA, 12 bp, Homo sapiens
attatttataat

SEQ ID NO: 3272359 - DNA, 16 bp, Homo sapiens
attatttatatatgta

SEQ ID NO: 3272360 - DNA, 22 bp, Homo sapiens
attatttattaaaaatgttctc

SEQ ID NO: 3272361 - DNA, 13 bp, Homo sapiens
attatttattatt

SEQ ID NO: 3272362 - DNA, 21 bp, Homo sapiens
attatttcactttagatgctg

SEQ ID NO: 3272363 - DNA, 15 bp, Homo sapiens
attatttctgtcaca

SEQ ID NO: 3272364 - DNA, 14 bp, Homo sapiens
attatttgcttttc

SEQ ID NO: 3272365 - DNA, 21 bp, Homo sapiens
attatttgggggaactggaca

SEQ ID NO: 3272366 - DNA, 15 bp, Homo sapiens
attatttgtaagata

SEQ ID NO: 3272367 - DNA, 15 bp, Homo sapiens
attatttgtgtaata

SEQ ID NO: 3272368 - DNA, 14 bp, Homo sapiens
attattttaaaata

SEQ ID NO: 3272369 - DNA, 15 bp, Homo sapiens
attattttaaaatat

SEQ ID NO: 3272370 - DNA, 13 bp, Homo sapiens
attattttaaaca

SEQ ID NO: 3272371 - DNA, 15 bp, Homo sapiens
attattttaaacaaa

SEQ ID NO: 3272372 - DNA, 12 bp, Homo sapiens
attattttctcc

SEQ ID NO: 3272373 - DNA, 14 bp, Homo sapiens
attattttctgtca

SEQ ID NO: 3272374 - DNA, 19 bp, Homo sapiens
attattttggggtctcttt

SEQ ID NO: 3272375 - DNA, 21 bp, Homo sapiens
attatttttttaaaattttgt

SEQ ID NO: 3272376 - DNA, 22 bp, Homo sapiens
attattttttttatatttattg

SEQ ID NO: 3272377 - DNA, 16 bp, Homo sapiens
attcaaaaagtgttta

SEQ ID NO: 3272378 - DNA, 14 bp, Homo sapiens
attcaaaagttcca

SEQ ID NO: 3272379 - DNA, 19 bp, Homo sapiens
attcaaaatataacaggtg

SEQ ID NO: 3272380 - DNA, 20 bp, Homo sapiens
attcaaaccaatttcttcct

SEQ ID NO: 3272381 - DNA, 21 bp, Homo sapiens
attcaaaccaatttcttcctt

SEQ ID NO: 3272382 - DNA, 16 bp, Homo sapiens
attcaaactgcacttt

SEQ ID NO: 3272383 - DNA, 22 bp, Homo sapiens
attcaaactggggcctccagaa

SEQ ID NO: 3272384 - DNA, 13 bp, Homo sapiens
attcaaactttta

SEQ ID NO: 3272385 - DNA, 17 bp, Homo sapiens
attcaaagctctattaa

SEQ ID NO: 3272386 - DNA, 14 bp, Homo sapiens
attcaaatgggtga

SEQ ID NO: 3272387 - DNA, 16 bp, Homo sapiens
attcaaattgctgctt

SEQ ID NO: 3272388 - DNA, 15 bp, Homo sapiens
attcaaatttgtaca

SEQ ID NO: 3272389 - DNA, 22 bp, Homo sapiens
attcaaatttgtacaggactgt

SEQ ID NO: 3272390 - DNA, 22 bp, Homo sapiens
attcaacaatttcaataaaaga

SEQ ID NO: 3272391 - DNA, 14 bp, Homo sapiens
attcaactttgtaa

SEQ ID NO: 3272392 - DNA, 13 bp, Homo sapiens
attcaagctattt

SEQ ID NO: 3272393 - DNA, 16 bp, Homo sapiens
attcaaggaatttctt

SEQ ID NO: 3272394 - DNA, 20 bp, Homo sapiens
attcaaggaatttcttaact

SEQ ID NO: 3272395 - DNA, 21 bp, Homo sapiens
attcaaggcatttctatcaca

SEQ ID NO: 3272396 - DNA, 16 bp, Homo sapiens
attcaagttattgtac

SEQ ID NO: 3272397 - DNA, 16 bp, Homo sapiens
attcaatctgtaaact

SEQ ID NO: 3272398 - DNA, 14 bp, Homo sapiens
attcaattcctctg

SEQ ID NO: 3272399 - DNA, 16 bp, Homo sapiens
attcaattcctctggg

SEQ ID NO: 3272400 - DNA, 18 bp, Homo sapiens
attcaattcctctgggaa

SEQ ID NO: 3272401 - DNA, 13 bp, Homo sapiens
attcacaatagaa

SEQ ID NO: 3272402 - DNA, 20 bp, Homo sapiens
attcacagttttttaaaaat

SEQ ID NO: 3272403 - DNA, 16 bp, Homo sapiens
attcacatgttctaat

SEQ ID NO: 3272404 - DNA, 14 bp, Homo sapiens
attcacatttagaa

SEQ ID NO: 3272405 - DNA, 15 bp, Homo sapiens
attcacatttagaaa

SEQ ID NO: 3272406 - DNA, 22 bp, Homo sapiens
attcaccaacacagttgggacc

SEQ ID NO: 3272407 - DNA, 17 bp, Homo sapiens
attcacccgaagcgctt

SEQ ID NO: 3272408 - DNA, 19 bp, Homo sapiens
attcaccctccacttcccg

SEQ ID NO: 3272409 - DNA, 16 bp, Homo sapiens
attcactcaagcactg

SEQ ID NO: 3272410 - DNA, 13 bp, Homo sapiens
attcactggcccc

SEQ ID NO: 3272411 - DNA, 22 bp, Homo sapiens
attcagaaaatgttctgtttgc

SEQ ID NO: 3272412 - DNA, 13 bp, Homo sapiens
attcagaaattgg

SEQ ID NO: 3272413 - DNA, 13 bp, Homo sapiens
attcagacaagca

SEQ ID NO: 3272414 - DNA, 14 bp, Homo sapiens
attcagagagcagc

SEQ ID NO: 3272415 - DNA, 23 bp, Homo sapiens
attcagatcactgaatttataaa

SEQ ID NO: 3272416 - DNA, 14 bp, Homo sapiens
attcagcaaaccat

SEQ ID NO: 3272417 - DNA, 20 bp, Homo sapiens
attcagcactgatttcacaa

SEQ ID NO: 3272418 - DNA, 19 bp, Homo sapiens
attcagcatgtccaacatg

SEQ ID NO: 3272419 - DNA, 20 bp, Homo sapiens
attcagcttcatttgtgtca

SEQ ID NO: 3272420 - DNA, 14 bp, Homo sapiens
attcagctttgtcc

SEQ ID NO: 3272421 - DNA, 21 bp, Homo sapiens
attcaggaatgtgtggcctgc

SEQ ID NO: 3272422 - DNA, 22 bp, Homo sapiens
attcaggacttaacggctccag

SEQ ID NO: 3272423 - DNA, 16 bp, Homo sapiens
attcaggccagcccag

SEQ ID NO: 3272424 - DNA, 13 bp, Homo sapiens
attcaggctgctt

SEQ ID NO: 3272425 - DNA, 15 bp, Homo sapiens
attcaggggctgggg

SEQ ID NO: 3272426 - DNA, 13 bp, Homo sapiens
attcaggtatgtt

SEQ ID NO: 3272427 - DNA, 19 bp, Homo sapiens
attcagtaataactctacc

SEQ ID NO: 3272428 - DNA, 19 bp, Homo sapiens
attcagtattaaagggggg

SEQ ID NO: 3272429 - DNA, 16 bp, Homo sapiens
attcagtgagggtctt

SEQ ID NO: 3272430 - DNA, 19 bp, Homo sapiens
attcagtgattactgtcaa

SEQ ID NO: 3272431 - DNA, 22 bp, Homo sapiens
attcagtgctgtggcctgggca

SEQ ID NO: 3272432 - DNA, 15 bp, Homo sapiens
attcagttttcattt

SEQ ID NO: 3272433 - DNA, 13 bp, Homo sapiens
attcagttttttt

SEQ ID NO: 3272434 - DNA, 16 bp, Homo sapiens
attcataaaaactgct

SEQ ID NO: 3272435 - DNA, 14 bp, Homo sapiens
attcataaagagaa

SEQ ID NO: 3272436 - DNA, 18 bp, Homo sapiens
attcataaagagaaaatg

SEQ ID NO: 3272437 - DNA, 14 bp, Homo sapiens
attcataacaatgt

SEQ ID NO: 3272438 - DNA, 12 bp, Homo sapiens
attcataaccat

SEQ ID NO: 3272439 - DNA, 18 bp, Homo sapiens
attcataatgaattataa

SEQ ID NO: 3272440 - DNA, 22 bp, Homo sapiens
attcataatgaattataacagt

SEQ ID NO: 3272441 - DNA, 23 bp, Homo sapiens
attcatagggaaaggttttgtat

SEQ ID NO: 3272442 - DNA, 16 bp, Homo sapiens
attcatagtaacttct

SEQ ID NO: 3272443 - DNA, 19 bp, Homo sapiens
attcatagtaacttcttat

SEQ ID NO: 3272444 - DNA, 19 bp, Homo sapiens
attcatattaagacagtgt

SEQ ID NO: 3272445 - DNA, 20 bp, Homo sapiens
attcatatttacttcttata

SEQ ID NO: 3272446 - DNA, 23 bp, Homo sapiens
attcatcaatatccctcttgtaa

SEQ ID NO: 3272447 - DNA, 17 bp, Homo sapiens
attcatgtattttgttt

SEQ ID NO: 3272448 - DNA, 19 bp, Homo sapiens
attcattctgtgatcattt

SEQ ID NO: 3272449 - DNA, 17 bp, Homo sapiens
attcattggttaacaat

SEQ ID NO: 3272450 - DNA, 13 bp, Homo sapiens
attcatttaaaat

SEQ ID NO: 3272451 - DNA, 14 bp, Homo sapiens
attcatttaaaatg

SEQ ID NO: 3272452 - DNA, 11 bp, Homo sapiens
attcatttcta

SEQ ID NO: 3272453 - DNA, 19 bp, Homo sapiens
attcatttgagttatttta

SEQ ID NO: 3272454 - DNA, 15 bp, Homo sapiens
attcattttctgaca

SEQ ID NO: 3272455 - DNA, 13 bp, Homo sapiens
attccaaaatatt

SEQ ID NO: 3272456 - DNA, 21 bp, Homo sapiens
attccaaaccaaattttaatt

SEQ ID NO: 3272457 - DNA, 14 bp, Homo sapiens
attccaacagtgag

SEQ ID NO: 3272458 - DNA, 17 bp, Homo sapiens
attccaagactctagag

SEQ ID NO: 3272459 - DNA, 22 bp, Homo sapiens
attccaattaaatttattttac

SEQ ID NO: 3272460 - DNA, 18 bp, Homo sapiens
attccacagatatctttt

SEQ ID NO: 3272461 - DNA, 16 bp, Homo sapiens
attccacctgcaatca

SEQ ID NO: 3272462 - DNA, 18 bp, Homo sapiens
attccactacacctggct

SEQ ID NO: 3272463 - DNA, 16 bp, Homo sapiens
attccactccactcag

SEQ ID NO: 3272464 - DNA, 16 bp, Homo sapiens
attccagaaaggatat

SEQ ID NO: 3272465 - DNA, 15 bp, Homo sapiens
attccagaatgctgt

SEQ ID NO: 3272466 - DNA, 23 bp, Homo sapiens
attccagactgcttccaattttc

SEQ ID NO: 3272467 - DNA, 22 bp, Homo sapiens
attctcccaggtaccagctgcg

SEQ ID NO: 3272468 - DNA, 17 bp, Homo sapiens
attctccccacccaccc

SEQ ID NO: 3272469 - DNA, 13 bp, Homo sapiens
attctcctgcctc

SEQ ID NO: 3272470 - DNA, 17 bp, Homo sapiens
attctccttcctgtgcc

SEQ ID NO: 3272471 - DNA, 17 bp, Homo sapiens
attctccttttatgtgt

SEQ ID NO: 3272472 - DNA, 18 bp, Homo sapiens
attctccttttatgtgta

SEQ ID NO: 3272473 - DNA, 16 bp, Homo sapiens
attctcggggccctgt

SEQ ID NO: 3272474 - DNA, 16 bp, Homo sapiens
attacttatttttgac

SEQ ID NO: 3272475 - DNA, 20 bp, Homo sapiens
attacttctgtttgggagac

SEQ ID NO: 3272476 - DNA, 17 bp, Homo sapiens
attacttgctttcaatt

SEQ ID NO: 3272477 - DNA, 11 bp, Homo sapiens
attactttatc

SEQ ID NO: 3272478 - DNA, 14 bp, Homo sapiens
attactttatcact

SEQ ID NO: 3272479 - DNA, 23 bp, Homo sapiens
attactttatcactttttgaact

SEQ ID NO: 3272480 - DNA, 22 bp, Homo sapiens
attactttctctgtagttccta

SEQ ID NO: 3272481 - DNA, 22 bp, Homo sapiens
attagaaaaaaattactaattt

SEQ ID NO: 3272482 - DNA, 18 bp, Homo sapiens
attagaaaatgttattta

SEQ ID NO: 3272483 - DNA, 22 bp, Homo sapiens
attagaaatagacagtatattt

SEQ ID NO: 3272484 - DNA, 13 bp, Homo sapiens
attagaaatgaat

SEQ ID NO: 3272485 - DNA, 15 bp, Homo sapiens
attagaaattagaaa

SEQ ID NO: 3272486 - DNA, 15 bp, Homo sapiens
attagaaattagctg

SEQ ID NO: 3272487 - DNA, 23 bp, Homo sapiens
attagaaattagctgtgtgaaat

SEQ ID NO: 3272488 - DNA, 14 bp, Homo sapiens
attagaaatttaac

SEQ ID NO: 3272489 - DNA, 13 bp, Homo sapiens
attagaacattta

SEQ ID NO: 3272490 - DNA, 17 bp, Homo sapiens
attagaacatttaataa

SEQ ID NO: 3272491 - DNA, 17 bp, Homo sapiens
attagaagtctttcagt

SEQ ID NO: 3272492 - DNA, 21 bp, Homo sapiens
attagagggaggagaatgagc

SEQ ID NO: 3272493 - DNA, 15 bp, Homo sapiens
attagagtcagcctt

SEQ ID NO: 3272494 - DNA, 22 bp, Homo sapiens
attagatattaggggggaaagt

SEQ ID NO: 3272495 - DNA, 21 bp, Homo sapiens
attagatcaaatagttgcata

SEQ ID NO: 3272496 - DNA, 16 bp, Homo sapiens
attagattttatttta

SEQ ID NO: 3272497 - DNA, 22 bp, Homo sapiens
attagcaaagcaaaaggctgag

SEQ ID NO: 3272498 - DNA, 23 bp, Homo sapiens
attagcacagattttaattgtca

SEQ ID NO: 3272499 - DNA, 17 bp, Homo sapiens
attagcagtttgctttg

SEQ ID NO: 3272500 - DNA, 15 bp, Homo sapiens
attagcatgctgctt

SEQ ID NO: 3272501 - DNA, 13 bp, Homo sapiens
attagcattctgt

SEQ ID NO: 3272502 - DNA, 22 bp, Homo sapiens
attagccaactgtttccctgct

SEQ ID NO: 3272503 - DNA, 23 bp, Homo sapiens
attagccaactgtttccctgctg

SEQ ID NO: 3272504 - DNA, 15 bp, Homo sapiens
attagccaggatcat

SEQ ID NO: 3272505 - DNA, 13 bp, Homo sapiens
attagctctgggg

SEQ ID NO: 3272506 - DNA, 15 bp, Homo sapiens
attagctctgggggg

SEQ ID NO: 3272507 - DNA, 13 bp, Homo sapiens
attaggaataaat

SEQ ID NO: 3272508 - DNA, 22 bp, Homo sapiens
attaggacaatcagtcccctcc

SEQ ID NO: 3272509 - DNA, 14 bp, Homo sapiens
attaggactgtata

SEQ ID NO: 3272510 - DNA, 22 bp, Homo sapiens
attaggagaaacacattcttat

SEQ ID NO: 3272511 - DNA, 14 bp, Homo sapiens
attaggatttcatg

SEQ ID NO: 3272512 - DNA, 21 bp, Homo sapiens
attaggcaaggctatgtgatt

SEQ ID NO: 3272513 - DNA, 18 bp, Homo sapiens
attaggccagcaacgctt

SEQ ID NO: 3272514 - DNA, 14 bp, Homo sapiens
attaggctgtaact

SEQ ID NO: 3272515 - DNA, 21 bp, Homo sapiens
attaggctgtaactactttat

SEQ ID NO: 3272516 - DNA, 23 bp, Homo sapiens
attaggctgtaactactttataa

SEQ ID NO: 3272517 - DNA, 18 bp, Homo sapiens
attagggagaaaattcaa

SEQ ID NO: 3272518 - DNA, 18 bp, Homo sapiens
attagggcaattggaaca

SEQ ID NO: 3272519 - DNA, 15 bp, Homo sapiens
attaggggttgctaa

SEQ ID NO: 3272520 - DNA, 16 bp, Homo sapiens
attagtaaatgcttat

SEQ ID NO: 3272521 - DNA, 23 bp, Homo sapiens
attagtatttatttaatgttatg

SEQ ID NO: 3272522 - DNA, 23 bp, Homo sapiens
attagtgattctgatttcagttt

SEQ ID NO: 3272523 - DNA, 16 bp, Homo sapiens
attagtgccacttaat

SEQ ID NO: 3272524 - DNA, 19 bp, Homo sapiens
attagtgccacttaatgta

SEQ ID NO: 3272525 - DNA, 14 bp, Homo sapiens
attagttaatatat

SEQ ID NO: 3272526 - DNA, 20 bp, Homo sapiens
attagttttagaggcattgt

SEQ ID NO: 3272527 - DNA, 18 bp, Homo sapiens
attataaaaaatgtaaca

SEQ ID NO: 3272528 - DNA, 11 bp, Homo sapiens
attataaactt

SEQ ID NO: 3272529 - DNA, 15 bp, Homo sapiens
attataaatgacaac

SEQ ID NO: 3272530 - DNA, 14 bp, Homo sapiens
attataacagttat

SEQ ID NO: 3272531 - DNA, 15 bp, Homo sapiens
attataacagttata

SEQ ID NO: 3272532 - DNA, 17 bp, Homo sapiens
attataacagttatatt

SEQ ID NO: 3272533 - DNA, 21 bp, Homo sapiens
attataactctgtataataga

SEQ ID NO: 3272534 - DNA, 12 bp, Homo sapiens
attataagcatt

SEQ ID NO: 3272535 - DNA, 22 bp, Homo sapiens
attataagggagagctgagcca

SEQ ID NO: 3272536 - DNA, 15 bp, Homo sapiens
attataagtcacaaa

SEQ ID NO: 3272537 - DNA, 21 bp, Homo sapiens
attataataggaacaatcttt

SEQ ID NO: 3272538 - DNA, 14 bp, Homo sapiens
attataatctcaaa

SEQ ID NO: 3272539 - DNA, 15 bp, Homo sapiens
attataatctcaaag

SEQ ID NO: 3272540 - DNA, 23 bp, Homo sapiens
attataattgtatcagaggccta

SEQ ID NO: 3272541 - DNA, 12 bp, Homo sapiens
attatacaaaag

SEQ ID NO: 3272542 - DNA, 13 bp, Homo sapiens
attatacaaaaga

SEQ ID NO: 3272543 - DNA, 17 bp, Homo sapiens
attatacaaaagagcat

SEQ ID NO: 3272544 - DNA, 18 bp, Homo sapiens
attatacaaattaaaaag

SEQ ID NO: 3272545 - DNA, 12 bp, Homo sapiens
attatactttat

SEQ ID NO: 3272546 - DNA, 18 bp, Homo sapiens
attatactttatatctgt

SEQ ID NO: 3272547 - DNA, 23 bp, Homo sapiens
attatactttatatctgtaatga

SEQ ID NO: 3272548 - DNA, 15 bp, Homo sapiens
attatagattctaaa

SEQ ID NO: 3272549 - DNA, 19 bp, Homo sapiens
attataggagccttaattt

SEQ ID NO: 3272550 - DNA, 16 bp, Homo sapiens
attatagtttctgagg

SEQ ID NO: 3272551 - DNA, 20 bp, Homo sapiens
attatataggttgtgcaaat

SEQ ID NO: 3272552 - DNA, 23 bp, Homo sapiens
attatataggttgtgcaaattaa

SEQ ID NO: 3272553 - DNA, 15 bp, Homo sapiens
attatatcaaagtat

SEQ ID NO: 3272554 - DNA, 18 bp, Homo sapiens
attatatcaaagtatttg

SEQ ID NO: 3272555 - DNA, 13 bp, Homo sapiens
attatattaaaat

SEQ ID NO: 3272556 - DNA, 14 bp, Homo sapiens
attatattaaaata

SEQ ID NO: 3272557 - DNA, 14 bp, Homo sapiens
attatattgcaatg

SEQ ID NO: 3272558 - DNA, 18 bp, Homo sapiens
attatatttgaaatcgtt

SEQ ID NO: 3272559 - DNA, 20 bp, Homo sapiens
attatcagttatattttgct

SEQ ID NO: 3272560 - DNA, 15 bp, Homo sapiens
attatcctctttgta

SEQ ID NO: 3272561 - DNA, 17 bp, Homo sapiens
attatcctctttgtaat

SEQ ID NO: 3272562 - DNA, 17 bp, Homo sapiens
attatcggaagcagtgc

SEQ ID NO: 3272563 - DNA, 21 bp, Homo sapiens
attatcggaagcagtgccttc

SEQ ID NO: 3272564 - DNA, 20 bp, Homo sapiens
attatcgggagcagtgtctt

SEQ ID NO: 3272565 - DNA, 23 bp, Homo sapiens
attatctaaagtgtgttgttgct

SEQ ID NO: 3272566 - DNA, 14 bp, Homo sapiens
attatctatacata

SEQ ID NO: 3272567 - DNA, 19 bp, Homo sapiens
attatctatacatatcttt

SEQ ID NO: 3272568 - DNA, 17 bp, Homo sapiens
attatgatgcatacagt

SEQ ID NO: 3272569 - DNA, 18 bp, Homo sapiens
attatgatgcatacagtt

SEQ ID NO: 3272570 - DNA, 18 bp, Homo sapiens
attatgcactaaatatga

SEQ ID NO: 3272571 - DNA, 20 bp, Homo sapiens
attatggaaaaataaaactg

SEQ ID NO: 3272572 - DNA, 16 bp, Homo sapiens
attatggaatatcatc

SEQ ID NO: 3272573 - DNA, 18 bp, Homo sapiens
attatggaatatcatctg

SEQ ID NO: 3272574 - DNA, 15 bp, Homo sapiens
attatggcttgtgaa

SEQ ID NO: 3272575 - DNA, 20 bp, Homo sapiens
attatggcttgtgaactgct

SEQ ID NO: 3272576 - DNA, 23 bp, Homo sapiens
attatgggttaggcattaatgtt

SEQ ID NO: 3272577 - DNA, 17 bp, Homo sapiens
attatgtaatatattgt

SEQ ID NO: 3272578 - DNA, 14 bp, Homo sapiens
attatgtagctgaa

SEQ ID NO: 3272579 - DNA, 15 bp, Homo sapiens
attatgtatgtttac

SEQ ID NO: 3272580 - DNA, 17 bp, Homo sapiens
attatgtctcaaaataa

SEQ ID NO: 3272581 - DNA, 16 bp, Homo sapiens
attatgtcttcttttg

SEQ ID NO: 3272582 - DNA, 11 bp, Homo sapiens
attatgtgaag

SEQ ID NO: 3272583 - DNA, 15 bp, Homo sapiens
attatgtgaagaatt

SEQ ID NO: 3272584 - DNA, 17 bp, Homo sapiens
attatgtgaagaattta

SEQ ID NO: 3272585 - DNA, 22 bp, Homo sapiens
attatgtgaagaatttagatct

SEQ ID NO: 3272586 - DNA, 14 bp, Homo sapiens
attatgtggtttta

SEQ ID NO: 3272587 - DNA, 16 bp, Homo sapiens
attatgtggttttaga

SEQ ID NO: 3272588 - DNA, 13 bp, Homo sapiens
attatgtgtgcat

SEQ ID NO: 3272589 - DNA, 19 bp, Homo sapiens
attatgttcatgtaagaag

SEQ ID NO: 3272590 - DNA, 19 bp, Homo sapiens
attatgtttattacaattt

SEQ ID NO: 3272591 - DNA, 15 bp, Homo sapiens
attattaactacatt

SEQ ID NO: 3272592 - DNA, 18 bp, Homo sapiens
attattaatcagaatatc

SEQ ID NO: 3272593 - DNA, 14 bp, Homo sapiens
attattataaaaat

SEQ ID NO: 3272594 - DNA, 15 bp, Homo sapiens
attattataaaaggg

SEQ ID NO: 3272595 - DNA, 16 bp, Homo sapiens
atgtgtacatggcaga

SEQ ID NO: 3272596 - DNA, 15 bp, Homo sapiens
atgtgtagcctatgt

SEQ ID NO: 3272597 - DNA, 15 bp, Homo sapiens
atgtgtagcctgtgc

SEQ ID NO: 3272598 - DNA, 16 bp, Homo sapiens
atgtgtagcctgtgca

SEQ ID NO: 3272599 - DNA, 17 bp, Homo sapiens
atgtgtagcctgtgcat

SEQ ID NO: 3272600 - DNA, 19 bp, Homo sapiens
atgtgtataaattgtcttt

SEQ ID NO: 3272601 - DNA, 21 bp, Homo sapiens
atgtgtataattttaaagtaa

SEQ ID NO: 3272602 - DNA, 15 bp, Homo sapiens
atgtgtatatataca

SEQ ID NO: 3272603 - DNA, 16 bp, Homo sapiens
atgtgtatatttgtag

SEQ ID NO: 3272604 - DNA, 11 bp, Homo sapiens
atgtgtatgtg

SEQ ID NO: 3272605 - DNA, 16 bp, Homo sapiens
atgtgtatttcttata

SEQ ID NO: 3272606 - DNA, 17 bp, Homo sapiens
atgtgtcagagtgttgt

SEQ ID NO: 3272607 - DNA, 21 bp, Homo sapiens
atgtgtcatttccggctgctg

SEQ ID NO: 3272608 - DNA, 11 bp, Homo sapiens
atgtgtcccct

SEQ ID NO: 3272609 - DNA, 20 bp, Homo sapiens
atgtgtcccgaatccacagt

SEQ ID NO: 3272610 - DNA, 18 bp, Homo sapiens
atgtgtcctatctatctt

SEQ ID NO: 3272611 - DNA, 19 bp, Homo sapiens
atgtgtcctatctatcttc

SEQ ID NO: 3272612 - DNA, 14 bp, Homo sapiens
atgtgtgaaacaat

SEQ ID NO: 3272613 - DNA, 15 bp, Homo sapiens
atgtgtgaaacaatg

SEQ ID NO: 3272614 - DNA, 16 bp, Homo sapiens
atgtgtgaaacaatgt

SEQ ID NO: 3272615 - DNA, 22 bp, Homo sapiens
atgtgtgaggagctgctggctt

SEQ ID NO: 3272616 - DNA, 17 bp, Homo sapiens
atgtgtgcatgtgtgta

SEQ ID NO: 3272617 - DNA, 18 bp, Homo sapiens
atgtgtgcctgtggcaga

SEQ ID NO: 3272618 - DNA, 15 bp, Homo sapiens
atgtgtgctttccca

SEQ ID NO: 3272619 - DNA, 17 bp, Homo sapiens
atgtgtggtggcctcag

SEQ ID NO: 3272620 - DNA, 19 bp, Homo sapiens
atgtgtgtagacaaatatt

SEQ ID NO: 3272621 - DNA, 18 bp, Homo sapiens
atgtgtgtaggttatctt

SEQ ID NO: 3272622 - DNA, 19 bp, Homo sapiens
atgtgtgtaggttatcttt

SEQ ID NO: 3272623 - DNA, 15 bp, Homo sapiens
atgtgtgtatatatg

SEQ ID NO: 3272624 - DNA, 14 bp, Homo sapiens
atgtgtgtatgtgt

SEQ ID NO: 3272625 - DNA, 21 bp, Homo sapiens
atgtgtgtgtatgtttgcaca

SEQ ID NO: 3272626 - DNA, 17 bp, Homo sapiens
atgtgtgttgtcagcct

SEQ ID NO: 3272627 - DNA, 20 bp, Homo sapiens
atgtgtgttgtcagcctgtg

SEQ ID NO: 3272628 - DNA, 23 bp, Homo sapiens
atgtgtgttgtcagcctgtgctg

SEQ ID NO: 3272629 - DNA, 16 bp, Homo sapiens
atgtgttcctcctgct

SEQ ID NO: 3272630 - DNA, 18 bp, Homo sapiens
atgtgttcctcctgctgt

SEQ ID NO: 3272631 - DNA, 13 bp, Homo sapiens
atgtgttgtgata

SEQ ID NO: 3272632 - DNA, 20 bp, Homo sapiens
atgtgtttaaaacatgcacg

SEQ ID NO: 3272633 - DNA, 22 bp, Homo sapiens
atgttaaagagaatgagtcctt

SEQ ID NO: 3272634 - DNA, 12 bp, Homo sapiens
atgttaaagcat

SEQ ID NO: 3272635 - DNA, 18 bp, Homo sapiens
atgttaaagcatcagaga

SEQ ID NO: 3272636 - DNA, 19 bp, Homo sapiens
atgttaaagcatcagagat

SEQ ID NO: 3272637 - DNA, 12 bp, Homo sapiens
atgttaaatttg

SEQ ID NO: 3272638 - DNA, 21 bp, Homo sapiens
atgttaacctcagtgtcattt

SEQ ID NO: 3272639 - DNA, 16 bp, Homo sapiens
atgttaacctctgctt

SEQ ID NO: 3272640 - DNA, 12 bp, Homo sapiens
atgttaagcaga

SEQ ID NO: 3272641 - DNA, 13 bp, Homo sapiens
atgttaagcagat

SEQ ID NO: 3272642 - DNA, 14 bp, Homo sapiens
atgttaagcattta

SEQ ID NO: 3272643 - DNA, 15 bp, Homo sapiens
atgttaagcatttat

SEQ ID NO: 3272644 - DNA, 15 bp, Homo sapiens
atgttaagctcttta

SEQ ID NO: 3272645 - DNA, 23 bp, Homo sapiens
atgttaaggaaactcttatctca

SEQ ID NO: 3272646 - DNA, 20 bp, Homo sapiens
atgttaatttgtgtgttttt

SEQ ID NO: 3272647 - DNA, 16 bp, Homo sapiens
atgttacatgtagaaa

SEQ ID NO: 3272648 - DNA, 23 bp, Homo sapiens
atgttactcagtgttagagaaat

SEQ ID NO: 3272649 - DNA, 16 bp, Homo sapiens
atgttactgatcatgc

SEQ ID NO: 3272650 - DNA, 18 bp, Homo sapiens
atgttactgatcatgcat

SEQ ID NO: 3272651 - DNA, 14 bp, Homo sapiens
atgttagaataatt

SEQ ID NO: 3272652 - DNA, 21 bp, Homo sapiens
atgttagaggttttaaagtga

SEQ ID NO: 3272653 - DNA, 22 bp, Homo sapiens
atgttagtcattgttatttata

SEQ ID NO: 3272654 - DNA, 18 bp, Homo sapiens
atgttatatcatatgtat

SEQ ID NO: 3272655 - DNA, 19 bp, Homo sapiens
atgttatatcatatgtata

SEQ ID NO: 3272656 - DNA, 22 bp, Homo sapiens
atgttatatttaatgcattaaa

SEQ ID NO: 3272657 - DNA, 21 bp, Homo sapiens
atgttatcttctcaagttcta

SEQ ID NO: 3272658 - DNA, 17 bp, Homo sapiens
atgttatgatattgttt

SEQ ID NO: 3272659 - DNA, 19 bp, Homo sapiens
atgttatgatttgtaacat

SEQ ID NO: 3272660 - DNA, 18 bp, Homo sapiens
atgttatgggatgtaaac

SEQ ID NO: 3272661 - DNA, 21 bp, Homo sapiens
atgttatgggatgtaaacaat

SEQ ID NO: 3272662 - DNA, 18 bp, Homo sapiens
atgttattttctgttgaa

SEQ ID NO: 3272663 - DNA, 21 bp, Homo sapiens
atgttattttctgttgaagtt

SEQ ID NO: 3272664 - DNA, 12 bp, Homo sapiens
atgttattttgt

SEQ ID NO: 3272665 - DNA, 18 bp, Homo sapiens
atgttcaaagccacatta

SEQ ID NO: 3272666 - DNA, 12 bp, Homo sapiens
atgttcacttta

SEQ ID NO: 3272667 - DNA, 17 bp, Homo sapiens
atgttcactttaaagca

SEQ ID NO: 3272668 - DNA, 19 bp, Homo sapiens
atgttcagcactgtccctt

SEQ ID NO: 3272669 - DNA, 12 bp, Homo sapiens
atgttccccagg

SEQ ID NO: 3272670 - DNA, 11 bp, Homo sapiens
atgttccctct

SEQ ID NO: 3272671 - DNA, 12 bp, Homo sapiens
atgttccctgca

SEQ ID NO: 3272672 - DNA, 14 bp, Homo sapiens
atgttccctgcacc

SEQ ID NO: 3272673 - DNA, 18 bp, Homo sapiens
atgttccctgcaccctgg

SEQ ID NO: 3272674 - DNA, 11 bp, Homo sapiens
atgttcctaag

SEQ ID NO: 3272675 - DNA, 19 bp, Homo sapiens
atgttcctgaattctattt

SEQ ID NO: 3272676 - DNA, 16 bp, Homo sapiens
atgttctaaggctctg

SEQ ID NO: 3272677 - DNA, 16 bp, Homo sapiens
atgttctaagtttcta

SEQ ID NO: 3272678 - DNA, 19 bp, Homo sapiens
atgttctaagtttctaaga

SEQ ID NO: 3272679 - DNA, 23 bp, Homo sapiens
atgttctaggatagttgatgcat

SEQ ID NO: 3272680 - DNA, 20 bp, Homo sapiens
atgttctatggttatgaaag

SEQ ID NO: 3272681 - DNA, 18 bp, Homo sapiens
atgttctattaatcacct

SEQ ID NO: 3272682 - DNA, 14 bp, Homo sapiens
atgttctattgtgg

SEQ ID NO: 3272683 - DNA, 18 bp, Homo sapiens
atgttctctgaggacact

SEQ ID NO: 3272684 - DNA, 17 bp, Homo sapiens
atgttctgacattaaca

SEQ ID NO: 3272685 - DNA, 12 bp, Homo sapiens
atgttctgcccc

SEQ ID NO: 3272686 - DNA, 14 bp, Homo sapiens
atgttctgccccca

SEQ ID NO: 3272687 - DNA, 18 bp, Homo sapiens
atgttctgcccccagccc

SEQ ID NO: 3272688 - DNA, 13 bp, Homo sapiens
atgttctgggaca

SEQ ID NO: 3272689 - DNA, 14 bp, Homo sapiens
atgttctgggacac

SEQ ID NO: 3272690 - DNA, 17 bp, Homo sapiens
atgttctgtttgctgtg

SEQ ID NO: 3272691 - DNA, 20 bp, Homo sapiens
atgttcttagtggatgttct

SEQ ID NO: 3272692 - DNA, 18 bp, Homo sapiens
atgttcttgggtggttcc

SEQ ID NO: 3272693 - DNA, 22 bp, Homo sapiens
atgttcttgggtggttcctaag

SEQ ID NO: 3272694 - DNA, 13 bp, Homo sapiens
atgttctttggaa

SEQ ID NO: 3272695 - DNA, 18 bp, Homo sapiens
atgttgaaagatcaaaag

SEQ ID NO: 3272696 - DNA, 16 bp, Homo sapiens
atgttgaagaaaaaag

SEQ ID NO: 3272697 - DNA, 16 bp, Homo sapiens
atgttgacgagactgg

SEQ ID NO: 3272698 - DNA, 11 bp, Homo sapiens
atgttgagaag

SEQ ID NO: 3272699 - DNA, 18 bp, Homo sapiens
atgttgatcatgtacttt

SEQ ID NO: 3272700 - DNA, 20 bp, Homo sapiens
gctgtggaccgtggacaggc

SEQ ID NO: 3272701 - DNA, 14 bp, Homo sapiens
gctgtggaggcctg

SEQ ID NO: 3272702 - DNA, 15 bp, Homo sapiens
gctgtggaggcctga

SEQ ID NO: 3272703 - DNA, 12 bp, Homo sapiens
gctgtggcacag

SEQ ID NO: 3272704 - DNA, 19 bp, Homo sapiens
gctgtggcatagacatgga

SEQ ID NO: 3272705 - DNA, 16 bp, Homo sapiens
gctgtggccctggagg

SEQ ID NO: 3272706 - DNA, 14 bp, Homo sapiens
gctgtgggcagcac

SEQ ID NO: 3272707 - DNA, 21 bp, Homo sapiens
gctgtgggcaggcaagccctt

SEQ ID NO: 3272708 - DNA, 17 bp, Homo sapiens
gctgtgtgaatttttct

SEQ ID NO: 3272709 - DNA, 22 bp, Homo sapiens
gctgtgtggtttggtgtgttcc

SEQ ID NO: 3272710 - DNA, 13 bp, Homo sapiens
gctgtgtgtctgt

SEQ ID NO: 3272711 - DNA, 14 bp, Homo sapiens
gctgtgttcatggt

SEQ ID NO: 3272712 - DNA, 19 bp, Homo sapiens
gctgtgttgggtagaatag

SEQ ID NO: 3272713 - DNA, 18 bp, Homo sapiens
gctgtgtttgcagcctgc

SEQ ID NO: 3272714 - DNA, 19 bp, Homo sapiens
gctgtgtttgcagcctgct

SEQ ID NO: 3272715 - DNA, 13 bp, Homo sapiens
gctgttaaactgt

SEQ ID NO: 3272716 - DNA, 15 bp, Homo sapiens
gctgttaccattcac

SEQ ID NO: 3272717 - DNA, 18 bp, Homo sapiens
gctgttaccattcacaat

SEQ ID NO: 3272718 - DNA, 21 bp, Homo sapiens
gctgttaccgcctgtctcttt

SEQ ID NO: 3272719 - DNA, 14 bp, Homo sapiens
gctgttctgcactg

SEQ ID NO: 3272720 - DNA, 16 bp, Homo sapiens
gctgttctgcactgaa

SEQ ID NO: 3272721 - DNA, 20 bp, Homo sapiens
gctgttcttctgttctgcag

SEQ ID NO: 3272722 - DNA, 16 bp, Homo sapiens
gctgttgagctgtttt

SEQ ID NO: 3272723 - DNA, 16 bp, Homo sapiens
gctgttggcactcaca

SEQ ID NO: 3272724 - DNA, 16 bp, Homo sapiens
gctgttggcagtgagt

SEQ ID NO: 3272725 - DNA, 22 bp, Homo sapiens
gctgttggcagtgagtgagcct

SEQ ID NO: 3272726 - DNA, 16 bp, Homo sapiens
gctgttggctgggggc

SEQ ID NO: 3272727 - DNA, 22 bp, Homo sapiens
gctgttggctgggggcctcagt

SEQ ID NO: 3272728 - DNA, 14 bp, Homo sapiens
gctgttgtacattt

SEQ ID NO: 3272729 - DNA, 16 bp, Homo sapiens
gctgttgtacatttat

SEQ ID NO: 3272730 - DNA, 22 bp, Homo sapiens
gctgtttagagtaaataaactg

SEQ ID NO: 3272731 - DNA, 15 bp, Homo sapiens
gctgtttatggcctc

SEQ ID NO: 3272732 - DNA, 16 bp, Homo sapiens
gctgtttatggcctca

SEQ ID NO: 3272733 - DNA, 17 bp, Homo sapiens
gctgtttgtcctgagat

SEQ ID NO: 3272734 - DNA, 16 bp, Homo sapiens
gctgttttaaacatta

SEQ ID NO: 3272735 - DNA, 15 bp, Homo sapiens
gctgtttttgttgtg

SEQ ID NO: 3272736 - DNA, 19 bp, Homo sapiens
gcttaaaaaagagttttct

SEQ ID NO: 3272737 - DNA, 13 bp, Homo sapiens
gcttaaacaaagt

SEQ ID NO: 3272738 - DNA, 14 bp, Homo sapiens
gcttaaacaaagtg

SEQ ID NO: 3272739 - DNA, 22 bp, Homo sapiens
gcttaaacccatattgtaaaac

SEQ ID NO: 3272740 - DNA, 16 bp, Homo sapiens
gcttaaactaaataat

SEQ ID NO: 3272741 - DNA, 23 bp, Homo sapiens
gcttaaatatagttcctaagaag

SEQ ID NO: 3272742 - DNA, 17 bp, Homo sapiens
gcttaaattgcttttgt

SEQ ID NO: 3272743 - DNA, 13 bp, Homo sapiens
gcttaaattttaa

SEQ ID NO: 3272744 - DNA, 22 bp, Homo sapiens
gcttaacaatgcaacttttaat

SEQ ID NO: 3272745 - DNA, 21 bp, Homo sapiens
gcttaagcatccgtgtatttg

SEQ ID NO: 3272746 - DNA, 11 bp, Homo sapiens
gcttaagttcc

SEQ ID NO: 3272747 - DNA, 13 bp, Homo sapiens
gcttaagttccag

SEQ ID NO: 3272748 - DNA, 19 bp, Homo sapiens
gcttaatagccctccccct

SEQ ID NO: 3272749 - DNA, 15 bp, Homo sapiens
gcttaatcattttca

SEQ ID NO: 3272750 - DNA, 18 bp, Homo sapiens
gcttacaatctttattat

SEQ ID NO: 3272751 - DNA, 18 bp, Homo sapiens
gcttacacatctcagacc

SEQ ID NO: 3272752 - DNA, 17 bp, Homo sapiens
gcttacagtaactaatt

SEQ ID NO: 3272753 - DNA, 12 bp, Homo sapiens
gcttacctgaca

SEQ ID NO: 3272754 - DNA, 13 bp, Homo sapiens
gcttactatttct

SEQ ID NO: 3272755 - DNA, 14 bp, Homo sapiens
gcttactcattaaa

SEQ ID NO: 3272756 - DNA, 11 bp, Homo sapiens
gcttactctgt

SEQ ID NO: 3272757 - DNA, 17 bp, Homo sapiens
gcttactgatatatttt

SEQ ID NO: 3272758 - DNA, 15 bp, Homo sapiens
gcttagacataacaa

SEQ ID NO: 3272759 - DNA, 21 bp, Homo sapiens
gcttagacttcgactcaggat

SEQ ID NO: 3272760 - DNA, 15 bp, Homo sapiens
gcttagatttcatag

SEQ ID NO: 3272761 - DNA, 17 bp, Homo sapiens
gcttagccttgtgccct

SEQ ID NO: 3272762 - DNA, 18 bp, Homo sapiens
gcttagcggcaagaagcc

SEQ ID NO: 3272763 - DNA, 17 bp, Homo sapiens
gcttagcttatctttct

SEQ ID NO: 3272764 - DNA, 12 bp, Homo sapiens
gcttagtttgtg

SEQ ID NO: 3272765 - DNA, 14 bp, Homo sapiens
gcttatatgtcctt

SEQ ID NO: 3272766 - DNA, 13 bp, Homo sapiens
gcttatcaaaatc

SEQ ID NO: 3272767 - DNA, 17 bp, Homo sapiens
gcttatcaataaacctg

SEQ ID NO: 3272768 - DNA, 16 bp, Homo sapiens
gcttatctttctttcc

SEQ ID NO: 3272769 - DNA, 22 bp, Homo sapiens
gcttatgacatcacttgtacaa

SEQ ID NO: 3272770 - DNA, 23 bp, Homo sapiens
gcttatgacatcacttgtacaaa

SEQ ID NO: 3272771 - DNA, 19 bp, Homo sapiens
gcttatgagatctaatgtg

SEQ ID NO: 3272772 - DNA, 19 bp, Homo sapiens
gcttattacatttaaatcc

SEQ ID NO: 3272773 - DNA, 20 bp, Homo sapiens
gcttattcatctgtttttct

SEQ ID NO: 3272774 - DNA, 16 bp, Homo sapiens
gcttattctcaaagca

SEQ ID NO: 3272775 - DNA, 17 bp, Homo sapiens
gcttattgcttagtaaa

SEQ ID NO: 3272776 - DNA, 13 bp, Homo sapiens
gcttattgttcca

SEQ ID NO: 3272777 - DNA, 14 bp, Homo sapiens
gcttattgttccaa

SEQ ID NO: 3272778 - DNA, 21 bp, Homo sapiens
gcttattgttccaagacattg

SEQ ID NO: 3272779 - DNA, 19 bp, Homo sapiens
gcttatttattaacaggat

SEQ ID NO: 3272780 - DNA, 11 bp, Homo sapiens
gcttattttat

SEQ ID NO: 3272781 - DNA, 22 bp, Homo sapiens
gcttatttttttaagaaaaaag

SEQ ID NO: 3272782 - DNA, 19 bp, Homo sapiens
gcttcaaattcaaggcctt

SEQ ID NO: 3272783 - DNA, 23 bp, Homo sapiens
gcttcaaattcaaggccttccaa

SEQ ID NO: 3272784 - DNA, 19 bp, Homo sapiens
gcttcaaggatatactgca

SEQ ID NO: 3272785 - DNA, 13 bp, Homo sapiens
gcttcaagtgcct

SEQ ID NO: 3272786 - DNA, 19 bp, Homo sapiens
gcttcaagtgttgctcttg

SEQ ID NO: 3272787 - DNA, 19 bp, Homo sapiens
gcttcaagttgtaaaaatg

SEQ ID NO: 3272788 - DNA, 18 bp, Homo sapiens
gcttcacagtagagccag

SEQ ID NO: 3272789 - DNA, 21 bp, Homo sapiens
gcttcacagtagagccagctt

SEQ ID NO: 3272790 - DNA, 22 bp, Homo sapiens
gcttcacagtagagccagcttg

SEQ ID NO: 3272791 - DNA, 14 bp, Homo sapiens
gcttcacccctgca

SEQ ID NO: 3272792 - DNA, 15 bp, Homo sapiens
gcttcacccctgcac

SEQ ID NO: 3272793 - DNA, 21 bp, Homo sapiens
gcttcacccctgcacttcaga

SEQ ID NO: 3272794 - DNA, 15 bp, Homo sapiens
gcttcaccctgtcaa

SEQ ID NO: 3272795 - DNA, 15 bp, Homo sapiens
gcttcactgtataaa

SEQ ID NO: 3272796 - DNA, 14 bp, Homo sapiens
gcttcagcctgagg

SEQ ID NO: 3272797 - DNA, 23 bp, Homo sapiens
gcttcagcctgaggctgagactg

SEQ ID NO: 3272798 - DNA, 14 bp, Homo sapiens
gcttcaggccgagc

SEQ ID NO: 3272799 - DNA, 17 bp, Homo sapiens
gcttcaggccgagccag

SEQ ID NO: 3272800 - DNA, 17 bp, Homo sapiens
gcttcaggttatcgaaa

SEQ ID NO: 3272801 - DNA, 19 bp, Homo sapiens
gcttcaggttatcgaaata

SEQ ID NO: 3272802 - DNA, 20 bp, Homo sapiens
gcttcagtcatcagccagca

SEQ ID NO: 3272803 - DNA, 18 bp, Homo sapiens
gcttcagtggcagctgct

SEQ ID NO: 3272804 - DNA, 19 bp, Homo sapiens
gcttcagtggcagctgctt

SEQ ID NO: 3272805 - DNA, 15 bp, Homo sapiens
gcttcagttgcttgt

SEQ ID NO: 3272806 - DNA, 21 bp, Homo sapiens
gcttcattatctgagttgcat

SEQ ID NO: 3272807 - DNA, 11 bp, Homo sapiens
gcttcattgta

SEQ ID NO: 3272808 - DNA, 15 bp, Homo sapiens
gcttcatttcaatca

SEQ ID NO: 3272809 - DNA, 18 bp, Homo sapiens
gcttcatttcctgtgtct

SEQ ID NO: 3272810 - DNA, 22 bp, Homo sapiens
gcttcatttccttggggctgca

SEQ ID NO: 3272811 - DNA, 12 bp, Homo sapiens
gcttccaatttt

SEQ ID NO: 3272812 - DNA, 16 bp, Homo sapiens
gcttccagcttcaggc

SEQ ID NO: 3272813 - DNA, 20 bp, Homo sapiens
gcttccagcttcaggcacca

SEQ ID NO: 3272814 - DNA, 19 bp, Homo sapiens
gcttccaggaaactccaca

SEQ ID NO: 3272815 - DNA, 11 bp, Homo sapiens
gcttccaggat

SEQ ID NO: 3272816 - DNA, 22 bp, Homo sapiens
gcttccaggataaggagactga

SEQ ID NO: 3272817 - DNA, 12 bp, Homo sapiens
gcttccaggctc

SEQ ID NO: 3272818 - DNA, 13 bp, Homo sapiens
gcttccaggctct

SEQ ID NO: 3272819 - DNA, 22 bp, Homo sapiens
gcttccatcccaaccagtgcca

SEQ ID NO: 3272820 - DNA, 14 bp, Homo sapiens
gcttccatgattct

SEQ ID NO: 3272821 - DNA, 19 bp, Homo sapiens
gcttccattttaattttaa

SEQ ID NO: 3272822 - DNA, 17 bp, Homo sapiens
gcttcccagagggagca

SEQ ID NO: 3272823 - DNA, 22 bp, Homo sapiens
gcttcccagccatgcccaggac

SEQ ID NO: 3272824 - DNA, 23 bp, Homo sapiens
gcttcccagccatgcccaggacg

SEQ ID NO: 3272825 - DNA, 17 bp, Homo sapiens
gcttcccatcctaccct

SEQ ID NO: 3272826 - DNA, 15 bp, Homo sapiens
gcttcccgctcagcc

SEQ ID NO: 3272827 - DNA, 16 bp, Homo sapiens
gcttcccgctcagccc

SEQ ID NO: 3272828 - DNA, 23 bp, Homo sapiens
gcttcccgctcagccctccctgc

SEQ ID NO: 3272829 - DNA, 14 bp, Homo sapiens
gcttccctaatcta

SEQ ID NO: 3272830 - DNA, 17 bp, Homo sapiens
gcttccctgacttgctt

SEQ ID NO: 3272831 - DNA, 19 bp, Homo sapiens
gcttccctgacttgcttta

SEQ ID NO: 3272832 - DNA, 12 bp, Homo sapiens
gcttccgccact

SEQ ID NO: 3272833 - DNA, 14 bp, Homo sapiens
gcttccgccactca

SEQ ID NO: 3272834 - DNA, 18 bp, Homo sapiens
gcttccgctttgaaagaa

SEQ ID NO: 3272835 - DNA, 21 bp, Homo sapiens
gcttccggtagggaggcagcc

SEQ ID NO: 3272836 - DNA, 22 bp, Homo sapiens
gcttcctcatagtatggtggct

SEQ ID NO: 3272837 - DNA, 20 bp, Homo sapiens
gcttcctccgtccacccagg

SEQ ID NO: 3272838 - DNA, 12 bp, Homo sapiens
gcttcctcctgg

SEQ ID NO: 3272839 - DNA, 17 bp, Homo sapiens
gcttcctctagaagcca

SEQ ID NO: 3272840 - DNA, 18 bp, Homo sapiens
gcttcctgaaataaacac

SEQ ID NO: 3272841 - DNA, 21 bp, Homo sapiens
gcttcctgaaataaacactgg

SEQ ID NO: 3272842 - DNA, 23 bp, Homo sapiens
gcttcctggctgtaaatcctaga

SEQ ID NO: 3272843 - DNA, 11 bp, Homo sapiens
gcttcctgggt

SEQ ID NO: 3272844 - DNA, 13 bp, Homo sapiens
gcttcctgtccac

SEQ ID NO: 3272845 - DNA, 19 bp, Homo sapiens
gcttcctgtccactctcgg

SEQ ID NO: 3272846 - DNA, 22 bp, Homo sapiens
gcttcctgtgctaagtctttcc

SEQ ID NO: 3272847 - DNA, 16 bp, Homo sapiens
gcttcggttctccaga

SEQ ID NO: 3272848 - DNA, 16 bp, Homo sapiens
gcttcgtttattttca

SEQ ID NO: 3272849 - DNA, 17 bp, Homo sapiens
gcttcgtttattttcaa

SEQ ID NO: 3272850 - DNA, 13 bp, Homo sapiens
gcttctaatgttc

SEQ ID NO: 3272851 - DNA, 17 bp, Homo sapiens
gcttctaccatgaacag

SEQ ID NO: 3272852 - DNA, 18 bp, Homo sapiens
gcttctatcccaggaggt

SEQ ID NO: 3272853 - DNA, 19 bp, Homo sapiens
gcttctcaaagtactggga

SEQ ID NO: 3272854 - DNA, 12 bp, Homo sapiens
gcttctcatccc

SEQ ID NO: 3272855 - DNA, 14 bp, Homo sapiens
gcttctccagcctg

SEQ ID NO: 3272856 - DNA, 19 bp, Homo sapiens
gcttctccgccagcctcct

SEQ ID NO: 3272857 - DNA, 21 bp, Homo sapiens
gcttctccgccagcctcctct

SEQ ID NO: 3272858 - DNA, 23 bp, Homo sapiens
gcttctccgccagcctcctctgg

SEQ ID NO: 3272859 - DNA, 12 bp, Homo sapiens
gcttctcctgcg

SEQ ID NO: 3272860 - DNA, 21 bp, Homo sapiens
gcttctcctgttttatatatt

SEQ ID NO: 3272861 - DNA, 17 bp, Homo sapiens
gcttctccttctccttc

SEQ ID NO: 3272862 - DNA, 19 bp, Homo sapiens
gcttctctagctctctagg

SEQ ID NO: 3272863 - DNA, 21 bp, Homo sapiens
gcttctctagctctctaggcc

SEQ ID NO: 3272864 - DNA, 13 bp, Homo sapiens
gcttctctgactt

SEQ ID NO: 3272865 - DNA, 20 bp, Homo sapiens
gcttctctgacttctgcctg

SEQ ID NO: 3272866 - DNA, 21 bp, Homo sapiens
gcttctctgacttctgcctgg

SEQ ID NO: 3272867 - DNA, 13 bp, Homo sapiens
gcttctctgcagt

SEQ ID NO: 3272868 - DNA, 15 bp, Homo sapiens
gcttctctgcagtaa

SEQ ID NO: 3272869 - DNA, 23 bp, Homo sapiens
gcttctcttgggaactccactct

SEQ ID NO: 3272870 - DNA, 18 bp, Homo sapiens
gcttctgcaccctccacc

SEQ ID NO: 3272871 - DNA, 12 bp, Homo sapiens
gcttctgcctgc

SEQ ID NO: 3272872 - DNA, 13 bp, Homo sapiens
gcttctgcttttc

SEQ ID NO: 3272873 - DNA, 15 bp, Homo sapiens
gcttctgcttttctg

SEQ ID NO: 3272874 - DNA, 12 bp, Homo sapiens
gcttctggagcc

SEQ ID NO: 3272875 - DNA, 15 bp, Homo sapiens
gcttctggtactctc

SEQ ID NO: 3272876 - DNA, 18 bp, Homo sapiens
gcttctggtactctccta

SEQ ID NO: 3272877 - DNA, 12 bp, Homo sapiens
gcttctgtagct

SEQ ID NO: 3272878 - DNA, 18 bp, Homo sapiens
gcttctgtgatgagctga

SEQ ID NO: 3272879 - DNA, 16 bp, Homo sapiens
gcttcttaattaattt

SEQ ID NO: 3272880 - DNA, 18 bp, Homo sapiens
gcttcttatgtagagttt

SEQ ID NO: 3272881 - DNA, 21 bp, Homo sapiens
gcttcttatgtagagttttta

SEQ ID NO: 3272882 - DNA, 21 bp, Homo sapiens
gcttcttcctatttgccatgg

SEQ ID NO: 3272883 - DNA, 14 bp, Homo sapiens
gcttcttccttctt

SEQ ID NO: 3272884 - DNA, 16 bp, Homo sapiens
gcttcttccttcttgt

SEQ ID NO: 3272885 - DNA, 12 bp, Homo sapiens
gcttcttgcctc

SEQ ID NO: 3272886 - DNA, 21 bp, Homo sapiens
gcttctttctagaaagagaaa

SEQ ID NO: 3272887 - DNA, 11 bp, Homo sapiens
gcttgaacaca

SEQ ID NO: 3272888 - DNA, 16 bp, Homo sapiens
gcttgaacacagtatt

SEQ ID NO: 3272889 - DNA, 20 bp, Homo sapiens
gcttgaactaggctgagcaa

SEQ ID NO: 3272890 - DNA, 11 bp, Homo sapiens
gcttgaagcca

SEQ ID NO: 3272891 - DNA, 15 bp, Homo sapiens
gcttgacacagtcag

SEQ ID NO: 3272892 - DNA, 18 bp, Homo sapiens
gcttgaccgtactctcac

SEQ ID NO: 3272893 - DNA, 20 bp, Homo sapiens
gcttgaccgtactctcacat

SEQ ID NO: 3272894 - DNA, 15 bp, Homo sapiens
gcttgagccaggagg

SEQ ID NO: 3272895 - DNA, 15 bp, Homo sapiens
gcttgagcccaggag

SEQ ID NO: 3272896 - DNA, 16 bp, Homo sapiens
gcttgagcccaggagt

SEQ ID NO: 3272897 - DNA, 12 bp, Homo sapiens
gcttgagccggg

SEQ ID NO: 3272898 - DNA, 17 bp, Homo sapiens
gcttgagccgggcccct

SEQ ID NO: 3272899 - DNA, 16 bp, Homo sapiens
gcttgagggttgggct

SEQ ID NO: 3272900 - DNA, 19 bp, Homo sapiens
gcttgatgaagcaaggaag

SEQ ID NO: 3272901 - DNA, 14 bp, Homo sapiens
gcttgatttttgcc

SEQ ID NO: 3272902 - DNA, 16 bp, Homo sapiens
gcttgcaatgtagtca

SEQ ID NO: 3272903 - DNA, 15 bp, Homo sapiens
gcttgcataataagc

SEQ ID NO: 3272904 - DNA, 14 bp, Homo sapiens
gcttgctcattttt

SEQ ID NO: 3272905 - DNA, 15 bp, Homo sapiens
gcttgctccagggtc

SEQ ID NO: 3272906 - DNA, 13 bp, Homo sapiens
gcttgctccctgt

SEQ ID NO: 3272907 - DNA, 17 bp, Homo sapiens
gcttgcttgccgagcct

SEQ ID NO: 3272908 - DNA, 12 bp, Homo sapiens
gcttgcttttct

SEQ ID NO: 3272909 - DNA, 17 bp, Homo sapiens
gcttggacttcctgggg

SEQ ID NO: 3272910 - DNA, 22 bp, Homo sapiens
gcttggacttcctggggccccg

SEQ ID NO: 3272911 - DNA, 16 bp, Homo sapiens
gcttggagggatggag

SEQ ID NO: 3272912 - DNA, 21 bp, Homo sapiens
gcttggcagttgcagtgctgc

SEQ ID NO: 3272913 - DNA, 13 bp, Homo sapiens
gcttggcctgctg

SEQ ID NO: 3272914 - DNA, 14 bp, Homo sapiens
gcttggcctgctgt

SEQ ID NO: 3272915 - DNA, 16 bp, Homo sapiens
gcttggcctgctgtga

SEQ ID NO: 3272916 - DNA, 17 bp, Homo sapiens
gcttgggatttgctgtg

SEQ ID NO: 3272917 - DNA, 18 bp, Homo sapiens
gcttgggctgacccagca

SEQ ID NO: 3272918 - DNA, 23 bp, Homo sapiens
gcttgggctgacccagcatctcc

SEQ ID NO: 3272919 - DNA, 23 bp, Homo sapiens
gcttggggccaccaaagctgccc

SEQ ID NO: 3272920 - DNA, 19 bp, Homo sapiens
gcttggttttcttttttct

SEQ ID NO: 3272921 - DNA, 15 bp, Homo sapiens
gcttgtaaataccag

SEQ ID NO: 3272922 - DNA, 23 bp, Homo sapiens
gcttgtagaactcactctgggct

SEQ ID NO: 3272923 - DNA, 18 bp, Homo sapiens
gcttgtcctgggcctgcc

SEQ ID NO: 3272924 - DNA, 13 bp, Homo sapiens
gcttgtgaacaga

SEQ ID NO: 3272925 - DNA, 20 bp, Homo sapiens
gcttgtgaatgtatttttct

SEQ ID NO: 3272926 - DNA, 20 bp, Homo sapiens
gcttgtgatttccatttctg

SEQ ID NO: 3272927 - DNA, 23 bp, Homo sapiens
gcttgtgatttccatttctgatg

SEQ ID NO: 3272928 - DNA, 13 bp, Homo sapiens
gcttgtgggctgg

SEQ ID NO: 3272929 - DNA, 22 bp, Homo sapiens
gcttgtgggctggtgccccaca

SEQ ID NO: 3272930 - DNA, 17 bp, Homo sapiens
gcttgtggggacccagg

SEQ ID NO: 3272931 - DNA, 19 bp, Homo sapiens
gcttgtggggacccaggct

SEQ ID NO: 3272932 - DNA, 21 bp, Homo sapiens
gcttgtggggacccaggctcc

SEQ ID NO: 3272933 - DNA, 21 bp, Homo sapiens
gctttcagggccatggttcac

SEQ ID NO: 3272934 - DNA, 18 bp, Homo sapiens
gctttcatgattagcaag

SEQ ID NO: 3272935 - DNA, 19 bp, Homo sapiens
gctttcatgttgcaaagaa

SEQ ID NO: 3272936 - DNA, 21 bp, Homo sapiens
gctttcccatatcttgccttc

SEQ ID NO: 3272937 - DNA, 12 bp, Homo sapiens
gctttcccctgt

SEQ ID NO: 3272938 - DNA, 15 bp, Homo sapiens
gctttccctgcctct

SEQ ID NO: 3272939 - DNA, 17 bp, Homo sapiens
gctttcccttccagttc

SEQ ID NO: 3272940 - DNA, 12 bp, Homo sapiens
gctttcctgccc

SEQ ID NO: 3272941 - DNA, 19 bp, Homo sapiens
gctttcctgccccaggcct

SEQ ID NO: 3272942 - DNA, 12 bp, Homo sapiens
gctttcctgggc

SEQ ID NO: 3272943 - DNA, 14 bp, Homo sapiens
gctttcctgtttct

SEQ ID NO: 3272944 - DNA, 19 bp, Homo sapiens
gctttccttgtggcagagg

SEQ ID NO: 3272945 - DNA, 23 bp, Homo sapiens
gctttctccggggtctgtgctgt

SEQ ID NO: 3272946 - DNA, 15 bp, Homo sapiens
gctttctgccatcta

SEQ ID NO: 3272947 - DNA, 12 bp, Homo sapiens
gctttctgttcc

SEQ ID NO: 3272948 - DNA, 14 bp, Homo sapiens
gctttctgttccaa

SEQ ID NO: 3272949 - DNA, 15 bp, Homo sapiens
gctttctgttccaaa

SEQ ID NO: 3272950 - DNA, 16 bp, Homo sapiens
gctttctgttccaaat

SEQ ID NO: 3272951 - DNA, 22 bp, Homo sapiens
gctttctgtttcttaagggcac

SEQ ID NO: 3272952 - DNA, 21 bp, Homo sapiens
gctttcttgctcccttcagcc

SEQ ID NO: 3272953 - DNA, 12 bp, Homo sapiens
gctttcttgctg

SEQ ID NO: 3272954 - DNA, 13 bp, Homo sapiens
gctttcttgctgg

SEQ ID NO: 3272955 - DNA, 17 bp, Homo sapiens
gctttcttgctggttgt

SEQ ID NO: 3272956 - DNA, 17 bp, Homo sapiens
gctttgaaagaagcaag

SEQ ID NO: 3272957 - DNA, 20 bp, Homo sapiens
gctttgactctataagcaaa

SEQ ID NO: 3272958 - DNA, 12 bp, Homo sapiens
gctttgattcat

SEQ ID NO: 3272959 - DNA, 18 bp, Homo sapiens
gctttgcaggctctgggc

SEQ ID NO: 3272960 - DNA, 22 bp, Homo sapiens
gctttgcaggctctgggctcag

SEQ ID NO: 3272961 - DNA, 17 bp, Homo sapiens
gctttgccaaaatacca

SEQ ID NO: 3272962 - DNA, 13 bp, Homo sapiens
gctttgccttgca

SEQ ID NO: 3272963 - DNA, 13 bp, Homo sapiens
gctttgctacaaa

SEQ ID NO: 3272964 - DNA, 16 bp, Homo sapiens
gctttgctaccaaagc

SEQ ID NO: 3272965 - DNA, 16 bp, Homo sapiens
gctttgctccgctccc

SEQ ID NO: 3272966 - DNA, 21 bp, Homo sapiens
gctttgctcttgtcccacgtg

SEQ ID NO: 3272967 - DNA, 17 bp, Homo sapiens
gctttggacccaaggaa

SEQ ID NO: 3272968 - DNA, 19 bp, Homo sapiens
gctttggacccaaggaaaa

SEQ ID NO: 3272969 - DNA, 17 bp, Homo sapiens
gctttggatttgacatt

SEQ ID NO: 3272970 - DNA, 15 bp, Homo sapiens
gctttggcagtgcca

SEQ ID NO: 3272971 - DNA, 15 bp, Homo sapiens
gctttggctgagggg

SEQ ID NO: 3272972 - DNA, 18 bp, Homo sapiens
gctttggctgaggggctt

SEQ ID NO: 3272973 - DNA, 20 bp, Homo sapiens
gctttgggaaagcccagact

SEQ ID NO: 3272974 - DNA, 13 bp, Homo sapiens
gctttgggccgaa

SEQ ID NO: 3272975 - DNA, 22 bp, Homo sapiens
gctttgggctttgcaggctctg

SEQ ID NO: 3272976 - DNA, 23 bp, Homo sapiens
gctttggggacagttggcagaga

SEQ ID NO: 3272977 - DNA, 17 bp, Homo sapiens
gcttttaccattagcat

SEQ ID NO: 3272978 - DNA, 17 bp, Homo sapiens
gcttttacgtagtaaaa

SEQ ID NO: 3272979 - DNA, 22 bp, Homo sapiens
gcttttatctcagatgttaaaa

SEQ ID NO: 3272980 - DNA, 12 bp, Homo sapiens
gcttttatggat

SEQ ID NO: 3272981 - DNA, 19 bp, Homo sapiens
gcttttatggatgattaaa

SEQ ID NO: 3272982 - DNA, 15 bp, Homo sapiens
gcttttattttttct

SEQ ID NO: 3272983 - DNA, 20 bp, Homo sapiens
gcttttattttttcttttgt

SEQ ID NO: 3272984 - DNA, 21 bp, Homo sapiens
gcttttattttttcttttgta

SEQ ID NO: 3272985 - DNA, 18 bp, Homo sapiens
gcttttcaaacaagaatg

SEQ ID NO: 3272986 - DNA, 12 bp, Homo sapiens
gcttttcactgc

SEQ ID NO: 3272987 - DNA, 14 bp, Homo sapiens
gcttttcactgctg

SEQ ID NO: 3272988 - DNA, 23 bp, Homo sapiens
gcttttcactgctggctgcctta

SEQ ID NO: 3272989 - DNA, 22 bp, Homo sapiens
gcttttcatggcccttcaaatt

SEQ ID NO: 3272990 - DNA, 19 bp, Homo sapiens
gcttttccaggatcctgca

SEQ ID NO: 3272991 - DNA, 21 bp, Homo sapiens
gcttttccaggatcctgcagg

SEQ ID NO: 3272992 - DNA, 23 bp, Homo sapiens
gcttttccaggatcctgcaggaa

SEQ ID NO: 3272993 - DNA, 14 bp, Homo sapiens
gcttttctgccctg

SEQ ID NO: 3272994 - DNA, 22 bp, Homo sapiens
gcttttctgccctggctgctgc

SEQ ID NO: 3272995 - DNA, 14 bp, Homo sapiens
gcttttctgtattt

SEQ ID NO: 3272996 - DNA, 14 bp, Homo sapiens
gcttttgcttgcaa

SEQ ID NO: 3272997 - DNA, 11 bp, Homo sapiens
gcttttggaag

SEQ ID NO: 3272998 - DNA, 11 bp, Homo sapiens
gcttttggcaa

SEQ ID NO: 3272999 - DNA, 15 bp, Homo sapiens
gcttttggtctgtgt

SEQ ID NO: 3273000 - DNA, 18 bp, Homo sapiens
gcttttgtctatgggact

SEQ ID NO: 3273001 - DNA, 15 bp, Homo sapiens
gctttttaatattga

SEQ ID NO: 3273002 - DNA, 20 bp, Homo sapiens
gctttttaattgttgtttct

SEQ ID NO: 3273003 - DNA, 13 bp, Homo sapiens
gctttttataaaa

SEQ ID NO: 3273004 - DNA, 14 bp, Homo sapiens
gctttttattccct

SEQ ID NO: 3273005 - DNA, 19 bp, Homo sapiens
gctttttattccctgccca

SEQ ID NO: 3273006 - DNA, 15 bp, Homo sapiens
gctttttatttctgc

SEQ ID NO: 3273007 - DNA, 13 bp, Homo sapiens
gctttttcacagt

SEQ ID NO: 3273008 - DNA, 13 bp, Homo sapiens
gctttttccagag

SEQ ID NO: 3273009 - DNA, 14 bp, Homo sapiens
gctttttgaaatga

SEQ ID NO: 3273010 - DNA, 21 bp, Homo sapiens
gctttttgaggtggcactttt

SEQ ID NO: 3273011 - DNA, 12 bp, Homo sapiens
gctttttggaaa

SEQ ID NO: 3273012 - DNA, 16 bp, Homo sapiens
gcttttttttttccag

SEQ ID NO: 3273013 - DNA, 17 bp, Homo sapiens
ggaaaaaaacataaaaa

SEQ ID NO: 3273014 - DNA, 20 bp, Homo sapiens
ggaaaaaaacataaaaagca

SEQ ID NO: 3273015 - DNA, 21 bp, Homo sapiens
ggaaaaaaacataaaaagcag

SEQ ID NO: 3273016 - DNA, 18 bp, Homo sapiens
ggaaaaaaactgggataa

SEQ ID NO: 3273017 - DNA, 19 bp, Homo sapiens
ggaaaaaaacttggcactt

SEQ ID NO: 3273018 - DNA, 14 bp, Homo sapiens
ggaaaaaaatgact

SEQ ID NO: 3273019 - DNA, 12 bp, Homo sapiens
ggaaaaaagcac

SEQ ID NO: 3273020 - DNA, 13 bp, Homo sapiens
ggaaaaacacaag

SEQ ID NO: 3273021 - DNA, 16 bp, Homo sapiens
ggaaaaagcacaagaa

SEQ ID NO: 3273022 - DNA, 17 bp, Homo sapiens
ggaaaaatggttgatgg

SEQ ID NO: 3273023 - DNA, 20 bp, Homo sapiens
ggaaaacaaatcactgtatt

SEQ ID NO: 3273024 - DNA, 22 bp, Homo sapiens
ggaaaacattgcttttgaaaac

SEQ ID NO: 3273025 - DNA, 20 bp, Homo sapiens
ggaaaactccaccttcccac

SEQ ID NO: 3273026 - DNA, 16 bp, Homo sapiens
ggaaaagcgtctttaa

SEQ ID NO: 3273027 - DNA, 22 bp, Homo sapiens
ggaaaagcgtctttaagagact

SEQ ID NO: 3273028 - DNA, 20 bp, Homo sapiens
ggaaaaggttgaataatata

SEQ ID NO: 3273029 - DNA, 14 bp, Homo sapiens
ggaaaagttaaact

SEQ ID NO: 3273030 - DNA, 22 bp, Homo sapiens
ggaagcggaggttgcagggagc

SEQ ID NO: 3273031 - DNA, 14 bp, Homo sapiens
ggaagctccactgt

SEQ ID NO: 3273032 - DNA, 23 bp, Homo sapiens
ggaagctccactgtcaccctcca

SEQ ID NO: 3273033 - DNA, 14 bp, Homo sapiens
ggaagctgcagctt

SEQ ID NO: 3273034 - DNA, 18 bp, Homo sapiens
ggaagctgcagcttggga

SEQ ID NO: 3273035 - DNA, 17 bp, Homo sapiens
ggaagctgccagcccag

SEQ ID NO: 3273036 - DNA, 21 bp, Homo sapiens
ggaagctgccagcccagaaca

SEQ ID NO: 3273037 - DNA, 15 bp, Homo sapiens
ggaagctgcctggtg

SEQ ID NO: 3273038 - DNA, 18 bp, Homo sapiens
ggaagctgtactcagagc

SEQ ID NO: 3273039 - DNA, 20 bp, Homo sapiens
ggaagctgtactcagagcag

SEQ ID NO: 3273040 - DNA, 19 bp, Homo sapiens
ggaagctgtgttgaaacag

SEQ ID NO: 3273041 - DNA, 22 bp, Homo sapiens
ggaagctgtgttgaaacagaaa

SEQ ID NO: 3273042 - DNA, 23 bp, Homo sapiens
ggaagctgtgttgaaacagaaaa

SEQ ID NO: 3273043 - DNA, 15 bp, Homo sapiens
ggaagcttgagcctc

SEQ ID NO: 3273044 - DNA, 21 bp, Homo sapiens
ggaaggacaggaccctcagga

SEQ ID NO: 3273045 - DNA, 13 bp, Homo sapiens
ggaaggagagcct

SEQ ID NO: 3273046 - DNA, 16 bp, Homo sapiens
ggaaggattgtaaaaa

SEQ ID NO: 3273047 - DNA, 14 bp, Homo sapiens
ggaaggcagacagc

SEQ ID NO: 3273048 - DNA, 14 bp, Homo sapiens
ggaaggcagctgct

SEQ ID NO: 3273049 - DNA, 15 bp, Homo sapiens
ggaaggcagctgctc

SEQ ID NO: 3273050 - DNA, 16 bp, Homo sapiens
ggaaggcagctgctct

SEQ ID NO: 3273051 - DNA, 13 bp, Homo sapiens
ggaaggcagggca

SEQ ID NO: 3273052 - DNA, 18 bp, Homo sapiens
ggaaggcagggcagaggg

SEQ ID NO: 3273053 - DNA, 19 bp, Homo sapiens
ggaaggcctaggctaggac

SEQ ID NO: 3273054 - DNA, 20 bp, Homo sapiens
ggaaggcctgacttctgctg

SEQ ID NO: 3273055 - DNA, 13 bp, Homo sapiens
ggaaggcctgggt

SEQ ID NO: 3273056 - DNA, 16 bp, Homo sapiens
ggaaggccttccactg

SEQ ID NO: 3273057 - DNA, 21 bp, Homo sapiens
ggaaggctaagttcagttctg

SEQ ID NO: 3273058 - DNA, 20 bp, Homo sapiens
ggaaggctgaactcttcaga

SEQ ID NO: 3273059 - DNA, 14 bp, Homo sapiens
ggaaggctggctgg

SEQ ID NO: 3273060 - DNA, 19 bp, Homo sapiens
ggaaggcttggtcccatcg

SEQ ID NO: 3273061 - DNA, 15 bp, Homo sapiens
ggaagggaccaaggc

SEQ ID NO: 3273062 - DNA, 20 bp, Homo sapiens
ggaagggaccaaggcaaggc

SEQ ID NO: 3273063 - DNA, 23 bp, Homo sapiens
ggaagggaccaaggcaaggcagg

SEQ ID NO: 3273064 - DNA, 15 bp, Homo sapiens
ggaagggcaggaagg

SEQ ID NO: 3273065 - DNA, 21 bp, Homo sapiens
ggaagggcaggaaggagagcc

SEQ ID NO: 3273066 - DNA, 12 bp, Homo sapiens
ggagcccagtga

SEQ ID NO: 3273067 - DNA, 19 bp, Homo sapiens
ggagcccagtgaagcctct

SEQ ID NO: 3273068 - DNA, 20 bp, Homo sapiens
ggagcccagtgaagcctctg

SEQ ID NO: 3273069 - DNA, 21 bp, Homo sapiens
ggagcccataggccaccccct

SEQ ID NO: 3273070 - DNA, 17 bp, Homo sapiens
ggagccccagctaccct

SEQ ID NO: 3273071 - DNA, 20 bp, Homo sapiens
ggagccccaggcctctgtgt

SEQ ID NO: 3273072 - DNA, 12 bp, Homo sapiens
ggagccccaggg

SEQ ID NO: 3273073 - DNA, 21 bp, Homo sapiens
ggagcccccagatagagctgg

SEQ ID NO: 3273074 - DNA, 22 bp, Homo sapiens
ggagcccccagatagagctggg

SEQ ID NO: 3273075 - DNA, 23 bp, Homo sapiens
ggagcccccagatagagctgggt

SEQ ID NO: 3273076 - DNA, 11 bp, Homo sapiens
ggagccccctc

SEQ ID NO: 3273077 - DNA, 15 bp, Homo sapiens
ggagcccctgggtgg

SEQ ID NO: 3273078 - DNA, 13 bp, Homo sapiens
ggagccctcatct

SEQ ID NO: 3273079 - DNA, 22 bp, Homo sapiens
ggagccctgttggcagctctag

SEQ ID NO: 3273080 - DNA, 17 bp, Homo sapiens
ggagccgcgggacagcc

SEQ ID NO: 3273081 - DNA, 16 bp, Homo sapiens
ggagcctagaagctgg

SEQ ID NO: 3273082 - DNA, 20 bp, Homo sapiens
ggagcctagcggagcccagc

SEQ ID NO: 3273083 - DNA, 17 bp, Homo sapiens
ggagcctagctcctgcc

SEQ ID NO: 3273084 - DNA, 18 bp, Homo sapiens
ggagcctagctcctgcca

SEQ ID NO: 3273085 - DNA, 14 bp, Homo sapiens
ggagcctaggacca

SEQ ID NO: 3273086 - DNA, 21 bp, Homo sapiens
ggagcctaggaccactcagcc

SEQ ID NO: 3273087 - DNA, 22 bp, Homo sapiens
ggagcctaggaccactcagccc

SEQ ID NO: 3273088 - DNA, 22 bp, Homo sapiens
ggagcctgcaaactcactgctc

SEQ ID NO: 3273089 - DNA, 12 bp, Homo sapiens
ggagcctgctct

SEQ ID NO: 3273090 - DNA, 19 bp, Homo sapiens
ggagcctgtgcgtcccagc

SEQ ID NO: 3273091 - DNA, 21 bp, Homo sapiens
ggagcgaagccttctgcagca

SEQ ID NO: 3273092 - DNA, 23 bp, Homo sapiens
ggagcgcacctgccccctggtgg

SEQ ID NO: 3273093 - DNA, 17 bp, Homo sapiens
ggagcggcgccctggac

SEQ ID NO: 3273094 - DNA, 21 bp, Homo sapiens
ggagcggctgctcgcccagga

SEQ ID NO: 3273095 - DNA, 22 bp, Homo sapiens
ggagcggtggccctgtccctcc

SEQ ID NO: 3273096 - DNA, 16 bp, Homo sapiens
ggagcgtgaaggactt

SEQ ID NO: 3273097 - DNA, 18 bp, Homo sapiens
ggagcgttctctgtccta

SEQ ID NO: 3273098 - DNA, 12 bp, Homo sapiens
ggagctaaggct

SEQ ID NO: 3273099 - DNA, 15 bp, Homo sapiens
ggagctaaggctcta

SEQ ID NO: 3273100 - DNA, 18 bp, Homo sapiens
ggagctagcctgaaggat

SEQ ID NO: 3273101 - DNA, 12 bp, Homo sapiens
ggagctcaccct

SEQ ID NO: 3273102 - DNA, 17 bp, Homo sapiens
ggagctccactctgctt

SEQ ID NO: 3273103 - DNA, 12 bp, Homo sapiens
ggagctcctggc

SEQ ID NO: 3273104 - DNA, 18 bp, Homo sapiens
ggagctcttcaggcctcc

SEQ ID NO: 3273105 - DNA, 20 bp, Homo sapiens
ggagctgatttccaggcccc

SEQ ID NO: 3273106 - DNA, 12 bp, Homo sapiens
ggagctgccaca

SEQ ID NO: 3273107 - DNA, 18 bp, Homo sapiens
ggagctgccacagagaag

SEQ ID NO: 3273108 - DNA, 21 bp, Homo sapiens
ggagctgggacacttaacaga

SEQ ID NO: 3273109 - DNA, 18 bp, Homo sapiens
ggagctggttagaaatgc

SEQ ID NO: 3273110 - DNA, 23 bp, Homo sapiens
ggagctggttagaaatgcagaat

SEQ ID NO: 3273111 - DNA, 18 bp, Homo sapiens
ggagctgtcaccaaggaa

SEQ ID NO: 3273112 - DNA, 20 bp, Homo sapiens
ggagctgtgagttctccctg

SEQ ID NO: 3273113 - DNA, 12 bp, Homo sapiens
ggaggaaaaaag

SEQ ID NO: 3273114 - DNA, 16 bp, Homo sapiens
ggaggaaaaaagaacc

SEQ ID NO: 3273115 - DNA, 20 bp, Homo sapiens
ggaggaaaaccaagccgtgg

SEQ ID NO: 3273116 - DNA, 19 bp, Homo sapiens
ggaggaagcaggttgaggg

SEQ ID NO: 3273117 - DNA, 14 bp, Homo sapiens
ggaggacaaaactt

SEQ ID NO: 3273118 - DNA, 13 bp, Homo sapiens
ggaggacaggcag

SEQ ID NO: 3273119 - DNA, 14 bp, Homo sapiens
ggaggacaggcagg

SEQ ID NO: 3273120 - DNA, 15 bp, Homo sapiens
ggaggacaggcaggc

SEQ ID NO: 3273121 - DNA, 22 bp, Homo sapiens
ggaggacaggcgggaggaggtg

SEQ ID NO: 3273122 - DNA, 19 bp, Homo sapiens
ggaggacgctctctggcct

SEQ ID NO: 3273123 - DNA, 20 bp, Homo sapiens
ggaggacgctctctggcctt

SEQ ID NO: 3273124 - DNA, 18 bp, Homo sapiens
ggaggagaaggggagtga

SEQ ID NO: 3273125 - DNA, 17 bp, Homo sapiens
ggaggagcttgggggat

SEQ ID NO: 3273126 - DNA, 17 bp, Homo sapiens
ggaggagggagaagaga

SEQ ID NO: 3273127 - DNA, 15 bp, Homo sapiens
ggaggagggaggccg

SEQ ID NO: 3273128 - DNA, 16 bp, Homo sapiens
ggaggagggatgctgc

SEQ ID NO: 3273129 - DNA, 21 bp, Homo sapiens
ggaggatgtccctgggccagg

SEQ ID NO: 3273130 - DNA, 19 bp, Homo sapiens
ggaggcaagaaaaggacaa

SEQ ID NO: 3273131 - DNA, 16 bp, Homo sapiens
ggaggcaccagctctg

SEQ ID NO: 3273132 - DNA, 20 bp, Homo sapiens
ggaggcaccagctctgtggc

SEQ ID NO: 3273133 - DNA, 21 bp, Homo sapiens
ggaggcaccagctctgtggcc

SEQ ID NO: 3273134 - DNA, 22 bp, Homo sapiens
ggaggcaccagctctgtggcct

SEQ ID NO: 3273135 - DNA, 22 bp, Homo sapiens
ggaggcactttagggctgtaaa

SEQ ID NO: 3273136 - DNA, 15 bp, Homo sapiens
ggaggcagccccctc

SEQ ID NO: 3273137 - DNA, 16 bp, Homo sapiens
ggaggccaataaaaag

SEQ ID NO: 3273138 - DNA, 14 bp, Homo sapiens
ggaggccacctctc

SEQ ID NO: 3273139 - DNA, 17 bp, Homo sapiens
ggaggccattgtgtgag

SEQ ID NO: 3273140 - DNA, 14 bp, Homo sapiens
ggaggcccaaatga

SEQ ID NO: 3273141 - DNA, 14 bp, Homo sapiens
ggaggcccaggctg

SEQ ID NO: 3273142 - DNA, 20 bp, Homo sapiens
ggaggcccaggctgggaact

SEQ ID NO: 3273143 - DNA, 14 bp, Homo sapiens
ggacttctgtgggc

SEQ ID NO: 3273144 - DNA, 14 bp, Homo sapiens
ggacttgaatggtt

SEQ ID NO: 3273145 - DNA, 19 bp, Homo sapiens
ggacttgctaaagcacttt

SEQ ID NO: 3273146 - DNA, 14 bp, Homo sapiens
ggacttggaagctc

SEQ ID NO: 3273147 - DNA, 15 bp, Homo sapiens
ggacttggcgcgccc

SEQ ID NO: 3273148 - DNA, 18 bp, Homo sapiens
ggacttggtacagttgca

SEQ ID NO: 3273149 - DNA, 12 bp, Homo sapiens
ggacttgtgtct

SEQ ID NO: 3273150 - DNA, 18 bp, Homo sapiens
ggactttatttatttcta

SEQ ID NO: 3273151 - DNA, 20 bp, Homo sapiens
ggactttcctaaatgtttaa

SEQ ID NO: 3273152 - DNA, 22 bp, Homo sapiens
ggactttgcagccggcacaggg

SEQ ID NO: 3273153 - DNA, 22 bp, Homo sapiens
ggacttttcgttaacattgacc

SEQ ID NO: 3273154 - DNA, 13 bp, Homo sapiens
ggacttttctgca

SEQ ID NO: 3273155 - DNA, 23 bp, Homo sapiens
ggagaaaaaaaaccttgtaaaaa

SEQ ID NO: 3273156 - DNA, 12 bp, Homo sapiens
ggagaaaaacaa

SEQ ID NO: 3273157 - DNA, 18 bp, Homo sapiens
ggagaaaaagaaacacaa

SEQ ID NO: 3273158 - DNA, 17 bp, Homo sapiens
ggagaaaatccaggtca

SEQ ID NO: 3273159 - DNA, 20 bp, Homo sapiens
ggagaaaattcaattgtaaa

SEQ ID NO: 3273160 - DNA, 13 bp, Homo sapiens
ggagaaacagaga

SEQ ID NO: 3273161 - DNA, 14 bp, Homo sapiens
ggagaaacagagac

SEQ ID NO: 3273162 - DNA, 14 bp, Homo sapiens
ggagaaaccagctt

SEQ ID NO: 3273163 - DNA, 16 bp, Homo sapiens
ggagaaactccaaagt

SEQ ID NO: 3273164 - DNA, 17 bp, Homo sapiens
ggagaaactccaaagtc

SEQ ID NO: 3273165 - DNA, 13 bp, Homo sapiens
ggagaaagagctg

SEQ ID NO: 3273166 - DNA, 19 bp, Homo sapiens
ggagaaagagctgcctgga

SEQ ID NO: 3273167 - DNA, 14 bp, Homo sapiens
ggagaaatgggagc

SEQ ID NO: 3273168 - DNA, 17 bp, Homo sapiens
ggagaaatgttgttcat

SEQ ID NO: 3273169 - DNA, 22 bp, Homo sapiens
ggagaacagtggttgcctgggg

SEQ ID NO: 3273170 - DNA, 15 bp, Homo sapiens
ggagaacctcaggct

SEQ ID NO: 3273171 - DNA, 13 bp, Homo sapiens
ggagaagagagga

SEQ ID NO: 3273172 - DNA, 18 bp, Homo sapiens
ggagaagaggcatcctgc

SEQ ID NO: 3273173 - DNA, 18 bp, Homo sapiens
ggagaagcatgaaaaagc

SEQ ID NO: 3273174 - DNA, 18 bp, Homo sapiens
ggagaagcccgtgtgaga

SEQ ID NO: 3273175 - DNA, 23 bp, Homo sapiens
ggagaaggaagggcagagaatgg

SEQ ID NO: 3273176 - DNA, 21 bp, Homo sapiens
ggagaagttcttgattcagcc

SEQ ID NO: 3273177 - DNA, 19 bp, Homo sapiens
ggagaatcatgtgaacccg

SEQ ID NO: 3273178 - DNA, 22 bp, Homo sapiens
ggagaattgaattctggaaact

SEQ ID NO: 3273179 - DNA, 22 bp, Homo sapiens
ggagaattgcacacagatgtga

SEQ ID NO: 3273180 - DNA, 15 bp, Homo sapiens
ggagacaagaaatcc

SEQ ID NO: 3273181 - DNA, 18 bp, Homo sapiens
ggagacaagaaatccctg

SEQ ID NO: 3273182 - DNA, 17 bp, Homo sapiens
ggagacactggcccctc

SEQ ID NO: 3273183 - DNA, 22 bp, Homo sapiens
ggagacagccccagagcagggt

SEQ ID NO: 3273184 - DNA, 23 bp, Homo sapiens
ggagacagccccagagcagggtg

SEQ ID NO: 3273185 - DNA, 19 bp, Homo sapiens
ggagacagggtaggaaagg

SEQ ID NO: 3273186 - DNA, 18 bp, Homo sapiens
ggagacagtgatctccat

SEQ ID NO: 3273187 - DNA, 19 bp, Homo sapiens
ggagaccaagtcctggcta

SEQ ID NO: 3273188 - DNA, 16 bp, Homo sapiens
ggagaccacggggagc

SEQ ID NO: 3273189 - DNA, 16 bp, Homo sapiens
ggagaccctgcaaaca

SEQ ID NO: 3273190 - DNA, 22 bp, Homo sapiens
ggagaccgcttcacccctgcac

SEQ ID NO: 3273191 - DNA, 23 bp, Homo sapiens
ggagaccgcttcacccctgcact

SEQ ID NO: 3273192 - DNA, 16 bp, Homo sapiens
ggagacgctgcacttg

SEQ ID NO: 3273193 - DNA, 16 bp, Homo sapiens
ggagactcctggtctg

SEQ ID NO: 3273194 - DNA, 16 bp, Homo sapiens
ggagactctgtggggc

SEQ ID NO: 3273195 - DNA, 23 bp, Homo sapiens
ggagactgataacttggggaggc

SEQ ID NO: 3273196 - DNA, 14 bp, Homo sapiens
ggagactggcaggc

SEQ ID NO: 3273197 - DNA, 13 bp, Homo sapiens
ggagactggggtg

SEQ ID NO: 3273198 - DNA, 17 bp, Homo sapiens
ggagactggggtggcct

SEQ ID NO: 3273199 - DNA, 14 bp, Homo sapiens
ggagagacacagcg

SEQ ID NO: 3273200 - DNA, 18 bp, Homo sapiens
ggagagaccgagtgaacc

SEQ ID NO: 3273201 - DNA, 15 bp, Homo sapiens
ggagagactgaaagc

SEQ ID NO: 3273202 - DNA, 17 bp, Homo sapiens
ggagagactgagcagcc

SEQ ID NO: 3273203 - DNA, 10 bp, Homo sapiens
ggagagagaa

SEQ ID NO: 3273204 - DNA, 18 bp, Homo sapiens
ggagagagaaagccaggc

SEQ ID NO: 3273205 - DNA, 17 bp, Homo sapiens
ggagagcaagaaggaaa

SEQ ID NO: 3273206 - DNA, 11 bp, Homo sapiens
ggagagcagcg

SEQ ID NO: 3273207 - DNA, 14 bp, Homo sapiens
ggagagccaacctc

SEQ ID NO: 3273208 - DNA, 19 bp, Homo sapiens
ggagagccaacctcggctt

SEQ ID NO: 3273209 - DNA, 12 bp, Homo sapiens
ggagagcccagc

SEQ ID NO: 3273210 - DNA, 12 bp, Homo sapiens
ggagagcctgct

SEQ ID NO: 3273211 - DNA, 13 bp, Homo sapiens
ggagagcctgctg

SEQ ID NO: 3273212 - DNA, 14 bp, Homo sapiens
ggagagcctgctgg

SEQ ID NO: 3273213 - DNA, 16 bp, Homo sapiens
ggagagcctgctggca

SEQ ID NO: 3273214 - DNA, 17 bp, Homo sapiens
ggagagcgaggaggcgc

SEQ ID NO: 3273215 - DNA, 14 bp, Homo sapiens
ggagagctgagcca

SEQ ID NO: 3273216 - DNA, 21 bp, Homo sapiens
ggagagctgattgcagaaagg

SEQ ID NO: 3273217 - DNA, 17 bp, Homo sapiens
ggagagctggtgcccgg

SEQ ID NO: 3273218 - DNA, 15 bp, Homo sapiens
ggagaggagagaggc

SEQ ID NO: 3273219 - DNA, 20 bp, Homo sapiens
ggagaggatgagagcccaga

SEQ ID NO: 3273220 - DNA, 23 bp, Homo sapiens
ggagaggcagcatgcttgggctg

SEQ ID NO: 3273221 - DNA, 16 bp, Homo sapiens
ggagaggcggcctcgt

SEQ ID NO: 3273222 - DNA, 15 bp, Homo sapiens
ggagaggctgggctg

SEQ ID NO: 3273223 - DNA, 14 bp, Homo sapiens
ggaagggctgggtg

SEQ ID NO: 3273224 - DNA, 14 bp, Homo sapiens
ggaaggggccttgc

SEQ ID NO: 3273225 - DNA, 17 bp, Homo sapiens
ggaaggggccttgctga

SEQ ID NO: 3273226 - DNA, 20 bp, Homo sapiens
ggaaggtgaagatgaagaag

SEQ ID NO: 3273227 - DNA, 14 bp, Homo sapiens
ggaaggtggggccc

SEQ ID NO: 3273228 - DNA, 20 bp, Homo sapiens
ggaaggtggggccctgcccc

SEQ ID NO: 3273229 - DNA, 21 bp, Homo sapiens
ggaaggtggggccctgcccct

SEQ ID NO: 3273230 - DNA, 19 bp, Homo sapiens
ggaagtctacctgctggac

SEQ ID NO: 3273231 - DNA, 23 bp, Homo sapiens
ggaagtctacctgctggacagcc

SEQ ID NO: 3273232 - DNA, 15 bp, Homo sapiens
ggaagtgtggaaaaa

SEQ ID NO: 3273233 - DNA, 16 bp, Homo sapiens
ggaagtgttcaagaaa

SEQ ID NO: 3273234 - DNA, 23 bp, Homo sapiens
ggaagttcatacctaagtactgt

SEQ ID NO: 3273235 - DNA, 13 bp, Homo sapiens
ggaagtttagaga

SEQ ID NO: 3273236 - DNA, 17 bp, Homo sapiens
ggaagtttgtgttctgt

SEQ ID NO: 3273237 - DNA, 22 bp, Homo sapiens
ggaataaaaggcttgaagctgt

SEQ ID NO: 3273238 - DNA, 18 bp, Homo sapiens
ggaataaggcccagagcg

SEQ ID NO: 3273239 - DNA, 14 bp, Homo sapiens
ggaataattgcttt

SEQ ID NO: 3273240 - DNA, 12 bp, Homo sapiens
ggaatacagtgt

SEQ ID NO: 3273241 - DNA, 14 bp, Homo sapiens
ggaatagccagaga

SEQ ID NO: 3273242 - DNA, 20 bp, Homo sapiens
ggaatagccagagaggagca

SEQ ID NO: 3273243 - DNA, 21 bp, Homo sapiens
ggaatagccagagaggagcac

SEQ ID NO: 3273244 - DNA, 15 bp, Homo sapiens
ggaatagggagacag

SEQ ID NO: 3273245 - DNA, 16 bp, Homo sapiens
ggaatagggagacagg

SEQ ID NO: 3273246 - DNA, 14 bp, Homo sapiens
ggaatataaatatt

SEQ ID NO: 3273247 - DNA, 18 bp, Homo sapiens
ggaatatcatctgtcatt

SEQ ID NO: 3273248 - DNA, 20 bp, Homo sapiens
ggaatatcatctgtcattat

SEQ ID NO: 3273249 - DNA, 15 bp, Homo sapiens
ggaatattaaaaaac

SEQ ID NO: 3273250 - DNA, 22 bp, Homo sapiens
ggaatattcccctatctctaga

SEQ ID NO: 3273251 - DNA, 15 bp, Homo sapiens
ggaatatttataaat

SEQ ID NO: 3273252 - DNA, 13 bp, Homo sapiens
ggaatatttgaat

SEQ ID NO: 3273253 - DNA, 14 bp, Homo sapiens
ggaatatttgaata

SEQ ID NO: 3273254 - DNA, 13 bp, Homo sapiens
ggaatcatgtcca

SEQ ID NO: 3273255 - DNA, 19 bp, Homo sapiens
ggaatcctcctccagggtg

SEQ ID NO: 3273256 - DNA, 23 bp, Homo sapiens
ggaatcctgaaagggcacttaat

SEQ ID NO: 3273257 - DNA, 13 bp, Homo sapiens
ggaatcctggcag

SEQ ID NO: 3273258 - DNA, 23 bp, Homo sapiens
ggaatcttctcatcttttatcta

SEQ ID NO: 3273259 - DNA, 21 bp, Homo sapiens
ggaatgaacttgttacttgca

SEQ ID NO: 3273260 - DNA, 17 bp, Homo sapiens
ggaatgagcccagagaa

SEQ ID NO: 3273261 - DNA, 15 bp, Homo sapiens
ggaatgagtgtgcat

SEQ ID NO: 3273262 - DNA, 22 bp, Homo sapiens
ggaatgcatcccaccttgccaa

SEQ ID NO: 3273263 - DNA, 23 bp, Homo sapiens
ggaatgcattatttattgctgtg

SEQ ID NO: 3273264 - DNA, 16 bp, Homo sapiens
ggaatgcctgtgccaa

SEQ ID NO: 3273265 - DNA, 22 bp, Homo sapiens
ggaatggatttttctttaactg

SEQ ID NO: 3273266 - DNA, 18 bp, Homo sapiens
ggaatgtacagtattttg

SEQ ID NO: 3273267 - DNA, 13 bp, Homo sapiens
ggaatgtctggag

SEQ ID NO: 3273268 - DNA, 18 bp, Homo sapiens
ggaatgttccctgcaccc

SEQ ID NO: 3273269 - DNA, 21 bp, Homo sapiens
ggaatgttccctgcaccctgg

SEQ ID NO: 3273270 - DNA, 20 bp, Homo sapiens
ggaattaacctggtgctgga

SEQ ID NO: 3273271 - DNA, 14 bp, Homo sapiens
ggaattagaaatga

SEQ ID NO: 3273272 - DNA, 17 bp, Homo sapiens
ggaattcagcaccctgg

SEQ ID NO: 3273273 - DNA, 15 bp, Homo sapiens
ggaattcagtgcctt

SEQ ID NO: 3273274 - DNA, 18 bp, Homo sapiens
ggaattccaattaaattt

SEQ ID NO: 3273275 - DNA, 17 bp, Homo sapiens
ggaattgatttgcattg

SEQ ID NO: 3273276 - DNA, 18 bp, Homo sapiens
ggaattgatttgcattga

SEQ ID NO: 3273277 - DNA, 21 bp, Homo sapiens
ggaattggtggcagattttac

SEQ ID NO: 3273278 - DNA, 14 bp, Homo sapiens
ggaatttaaaatta

SEQ ID NO: 3273279 - DNA, 15 bp, Homo sapiens
ggaatttaaaattaa

SEQ ID NO: 3273280 - DNA, 18 bp, Homo sapiens
ggaatttgtaacctcagc

SEQ ID NO: 3273281 - DNA, 21 bp, Homo sapiens
ggaatttgttcaagttttggg

SEQ ID NO: 3273282 - DNA, 13 bp, Homo sapiens
ggacaaacctaga

SEQ ID NO: 3273283 - DNA, 16 bp, Homo sapiens
ggacaacagtgctttg

SEQ ID NO: 3273284 - DNA, 21 bp, Homo sapiens
ggacaacttatttaaaaatat

SEQ ID NO: 3273285 - DNA, 20 bp, Homo sapiens
ggacaagccaacttgtaaat

SEQ ID NO: 3273286 - DNA, 13 bp, Homo sapiens
ggacaataaacct

SEQ ID NO: 3273287 - DNA, 18 bp, Homo sapiens
ggacaatcagtcccctcc

SEQ ID NO: 3273288 - DNA, 22 bp, Homo sapiens
ggacaatcagtcccctcccatc

SEQ ID NO: 3273289 - DNA, 21 bp, Homo sapiens
ggacacaaaactccgccccca

SEQ ID NO: 3273290 - DNA, 23 bp, Homo sapiens
ggacacaaaactccgcccccagc

SEQ ID NO: 3273291 - DNA, 22 bp, Homo sapiens
ggacacaaattttcaagtttac

SEQ ID NO: 3273292 - DNA, 23 bp, Homo sapiens
ggacacaataggtctttctctca

SEQ ID NO: 3273293 - DNA, 16 bp, Homo sapiens
ggacacagctcttcat

SEQ ID NO: 3273294 - DNA, 20 bp, Homo sapiens
ggacacagctcttcattcca

SEQ ID NO: 3273295 - DNA, 23 bp, Homo sapiens
ggacacagcttaacaatgcaact

SEQ ID NO: 3273296 - DNA, 21 bp, Homo sapiens
ggacacagttcctgggaacat

SEQ ID NO: 3273297 - DNA, 22 bp, Homo sapiens
ggacacatcccggcctcttcca

SEQ ID NO: 3273298 - DNA, 21 bp, Homo sapiens
ggacaccacacccagcctcag

SEQ ID NO: 3273299 - DNA, 13 bp, Homo sapiens
ggacaccagagct

SEQ ID NO: 3273300 - DNA, 17 bp, Homo sapiens
ggacaccagtgaaagaa

SEQ ID NO: 3273301 - DNA, 13 bp, Homo sapiens
ggacacccctgct

SEQ ID NO: 3273302 - DNA, 14 bp, Homo sapiens
ggacactcagacct

SEQ ID NO: 3273303 - DNA, 16 bp, Homo sapiens
ggacactccagtgcca

SEQ ID NO: 3273304 - DNA, 22 bp, Homo sapiens
ggacagacccaggtcttccaga

SEQ ID NO: 3273305 - DNA, 15 bp, Homo sapiens
ggacagactggccgg

SEQ ID NO: 3273306 - DNA, 22 bp, Homo sapiens
ggacagactggccgggcaggcg

SEQ ID NO: 3273307 - DNA, 20 bp, Homo sapiens
ggacagagactcagatgagg

SEQ ID NO: 3273308 - DNA, 18 bp, Homo sapiens
ggacagagactcagcgct

SEQ ID NO: 3273309 - DNA, 22 bp, Homo sapiens
ggacagagactcagcgctcctc

SEQ ID NO: 3273310 - DNA, 20 bp, Homo sapiens
ggacagaggagcaaggttta

SEQ ID NO: 3273311 - DNA, 11 bp, Homo sapiens
ggaccaaggca

SEQ ID NO: 3273312 - DNA, 22 bp, Homo sapiens
ggaccaaggcaaggcaggtgcc

SEQ ID NO: 3273313 - DNA, 16 bp, Homo sapiens
ggaccaaggtgaagca

SEQ ID NO: 3273314 - DNA, 21 bp, Homo sapiens
ggaccaataaaatttctaaga

SEQ ID NO: 3273315 - DNA, 22 bp, Homo sapiens
ggaccacaaaaatgaaagcatg

SEQ ID NO: 3273316 - DNA, 15 bp, Homo sapiens
ggaccacacagtccc

SEQ ID NO: 3273317 - DNA, 17 bp, Homo sapiens
ggaccacacagtcccca

SEQ ID NO: 3273318 - DNA, 13 bp, Homo sapiens
ggaccacatttta

SEQ ID NO: 3273319 - DNA, 16 bp, Homo sapiens
ggaccactcagcccct

SEQ ID NO: 3273320 - DNA, 16 bp, Homo sapiens
ggaccactcgaggcct

SEQ ID NO: 3273321 - DNA, 17 bp, Homo sapiens
ggaccactcgaggcctg

SEQ ID NO: 3273322 - DNA, 21 bp, Homo sapiens
ggaccactgggtgagagagga

SEQ ID NO: 3273323 - DNA, 17 bp, Homo sapiens
ggaccactttggagact

SEQ ID NO: 3273324 - DNA, 13 bp, Homo sapiens
ggaccagagactt

SEQ ID NO: 3273325 - DNA, 15 bp, Homo sapiens
ggaccagagccagat

SEQ ID NO: 3273326 - DNA, 17 bp, Homo sapiens
ggaccagagccagatgc

SEQ ID NO: 3273327 - DNA, 12 bp, Homo sapiens
ggaccagctggg

SEQ ID NO: 3273328 - DNA, 19 bp, Homo sapiens
ggaccagctggggcgtggg

SEQ ID NO: 3273329 - DNA, 22 bp, Homo sapiens
ggaccagctggggcgtggggag

SEQ ID NO: 3273330 - DNA, 19 bp, Homo sapiens
ggacccaatgtaggagctg

SEQ ID NO: 3273331 - DNA, 12 bp, Homo sapiens
ggacccaccaaa

SEQ ID NO: 3273332 - DNA, 20 bp, Homo sapiens
ggacccaccaaactgcacac

SEQ ID NO: 3273333 - DNA, 23 bp, Homo sapiens
ggacccacccatcttcctgctgc

SEQ ID NO: 3273334 - DNA, 17 bp, Homo sapiens
ggacccagcgggcaggt

SEQ ID NO: 3273335 - DNA, 20 bp, Homo sapiens
ggacccagctactctgtcca

SEQ ID NO: 3273336 - DNA, 21 bp, Homo sapiens
ggacccagctactctgtccag

SEQ ID NO: 3273337 - DNA, 11 bp, Homo sapiens
ggacccaggcc

SEQ ID NO: 3273338 - DNA, 12 bp, Homo sapiens
ggacccaggccc

SEQ ID NO: 3273339 - DNA, 18 bp, Homo sapiens
ggacccaggccctccatg

SEQ ID NO: 3273340 - DNA, 22 bp, Homo sapiens
ggacccaggccctccatgggct

SEQ ID NO: 3273341 - DNA, 12 bp, Homo sapiens
ggacccaggctc

SEQ ID NO: 3273342 - DNA, 21 bp, Homo sapiens
ggaccccagagattcccaagc

SEQ ID NO: 3273343 - DNA, 11 bp, Homo sapiens
ggaccccagct

SEQ ID NO: 3273344 - DNA, 18 bp, Homo sapiens
ggaccccagctgggaggc

SEQ ID NO: 3273345 - DNA, 18 bp, Homo sapiens
ggaccccagctgtgagcc

SEQ ID NO: 3273346 - DNA, 20 bp, Homo sapiens
ggaccccgtttcatttttac

SEQ ID NO: 3273347 - DNA, 17 bp, Homo sapiens
ggaccctgacctccgcc

SEQ ID NO: 3273348 - DNA, 22 bp, Homo sapiens
ggaccctgacctccgcccctgc

SEQ ID NO: 3273349 - DNA, 22 bp, Homo sapiens
ggaccctgtccggcccagtgcc

SEQ ID NO: 3273350 - DNA, 22 bp, Homo sapiens
ggaccctgtgacatggtgcctg

SEQ ID NO: 3273351 - DNA, 23 bp, Homo sapiens
ggaccctgtgacatggtgcctga

SEQ ID NO: 3273352 - DNA, 20 bp, Homo sapiens
ggacccttaggatggggctc

SEQ ID NO: 3273353 - DNA, 21 bp, Homo sapiens
ggaccctttgcctttcttctg

SEQ ID NO: 3273354 - DNA, 15 bp, Homo sapiens
ggaccgggtgggcct

SEQ ID NO: 3273355 - DNA, 16 bp, Homo sapiens
ggaccgggtgggcctg

SEQ ID NO: 3273356 - DNA, 17 bp, Homo sapiens
ggaccgggtgggcctgg

SEQ ID NO: 3273357 - DNA, 21 bp, Homo sapiens
ggaccgggtgggcctggcctg

SEQ ID NO: 3273358 - DNA, 14 bp, Homo sapiens
ggaccggtgctgca

SEQ ID NO: 3273359 - DNA, 14 bp, Homo sapiens
ggaccgtggacagg

SEQ ID NO: 3273360 - DNA, 20 bp, Homo sapiens
ggaccgtggacaggcccagc

SEQ ID NO: 3273361 - DNA, 21 bp, Homo sapiens
ggaccgtttccaagctgcggg

SEQ ID NO: 3273362 - DNA, 21 bp, Homo sapiens
ggacctatgtcctaaggacac

SEQ ID NO: 3273363 - DNA, 16 bp, Homo sapiens
ggacctcctcttcccc

SEQ ID NO: 3273364 - DNA, 11 bp, Homo sapiens
ggacctcctta

SEQ ID NO: 3273365 - DNA, 20 bp, Homo sapiens
ggacctctactttccaggct

SEQ ID NO: 3273366 - DNA, 21 bp, Homo sapiens
ggacctgagcctggtcctggc

SEQ ID NO: 3273367 - DNA, 14 bp, Homo sapiens
ggacctggcatcat

SEQ ID NO: 3273368 - DNA, 17 bp, Homo sapiens
ggacctggcatcatggt

SEQ ID NO: 3273369 - DNA, 18 bp, Homo sapiens
ggaccttaggccttcctc

SEQ ID NO: 3273370 - DNA, 17 bp, Homo sapiens
ggaccttgaactgggta

SEQ ID NO: 3273371 - DNA, 22 bp, Homo sapiens
ggacctttaggtcaaactccct

SEQ ID NO: 3273372 - DNA, 18 bp, Homo sapiens
ggacctttccaccacagc

SEQ ID NO: 3273373 - DNA, 20 bp, Homo sapiens
ggacctttccaccacagcca

SEQ ID NO: 3273374 - DNA, 21 bp, Homo sapiens
ggacgagatgggaaggcacag

SEQ ID NO: 3273375 - DNA, 23 bp, Homo sapiens
ggacgatagcttggagggatgga

SEQ ID NO: 3273376 - DNA, 18 bp, Homo sapiens
ggacgcacgctcgctgcc

SEQ ID NO: 3273377 - DNA, 13 bp, Homo sapiens
ggacgctctctgg

SEQ ID NO: 3273378 - DNA, 19 bp, Homo sapiens
ggacgctctctggccttcg

SEQ ID NO: 3273379 - DNA, 22 bp, Homo sapiens
ggacggcctgatgctccctccc

SEQ ID NO: 3273380 - DNA, 19 bp, Homo sapiens
ggacggtgcccaagccaga

SEQ ID NO: 3273381 - DNA, 22 bp, Homo sapiens
ggacgtcctatctcccccaacc

SEQ ID NO: 3273382 - DNA, 18 bp, Homo sapiens
ggacgtgtgtaaatatgt

SEQ ID NO: 3273383 - DNA, 21 bp, Homo sapiens
ggactaaatgcctagttttta

SEQ ID NO: 3273384 - DNA, 14 bp, Homo sapiens
ggactacaggtgtg

SEQ ID NO: 3273385 - DNA, 23 bp, Homo sapiens
ggactcacaggttggaagagaat

SEQ ID NO: 3273386 - DNA, 16 bp, Homo sapiens
ggactcagcagtgacc

SEQ ID NO: 3273387 - DNA, 11 bp, Homo sapiens
ggactcagccc

SEQ ID NO: 3273388 - DNA, 13 bp, Homo sapiens
ggactcagcccac

SEQ ID NO: 3273389 - DNA, 19 bp, Homo sapiens
ggactcagcccacctgcac

SEQ ID NO: 3273390 - DNA, 15 bp, Homo sapiens
ggactcagccttcag

SEQ ID NO: 3273391 - DNA, 21 bp, Homo sapiens
ggactcagccttcagacagag

SEQ ID NO: 3273392 - DNA, 16 bp, Homo sapiens
ggactccactggacag

SEQ ID NO: 3273393 - DNA, 18 bp, Homo sapiens
ggactccactggacagac

SEQ ID NO: 3273394 - DNA, 19 bp, Homo sapiens
ggactccactggacagacc

SEQ ID NO: 3273395 - DNA, 19 bp, Homo sapiens
ggactcccgggccacgccc

SEQ ID NO: 3273396 - DNA, 20 bp, Homo sapiens
ggactccctcctcacctctg

SEQ ID NO: 3273397 - DNA, 15 bp, Homo sapiens
ggactcctcctttct

SEQ ID NO: 3273398 - DNA, 17 bp, Homo sapiens
ggactcctcctttctcc

SEQ ID NO: 3273399 - DNA, 22 bp, Homo sapiens
ggactcctgccaccagcatcca

SEQ ID NO: 3273400 - DNA, 18 bp, Homo sapiens
ggactcctggtgcccctc

SEQ ID NO: 3273401 - DNA, 14 bp, Homo sapiens
ggactcgcttgtaa

SEQ ID NO: 3273402 - DNA, 21 bp, Homo sapiens
ggactcggagactatggcctc

SEQ ID NO: 3273403 - DNA, 22 bp, Homo sapiens
ggactcggagactatggcctcg

SEQ ID NO: 3273404 - DNA, 15 bp, Homo sapiens
ggactctcagggatt

SEQ ID NO: 3273405 - DNA, 21 bp, Homo sapiens
ggactctgagcgggaggcaga

SEQ ID NO: 3273406 - DNA, 11 bp, Homo sapiens
ggactctgagg

SEQ ID NO: 3273407 - DNA, 13 bp, Homo sapiens
ggactctgaggct

SEQ ID NO: 3273408 - DNA, 23 bp, Homo sapiens
ggactctgcaagtgtctggagcg

SEQ ID NO: 3273409 - DNA, 13 bp, Homo sapiens
ggactctgcccca

SEQ ID NO: 3273410 - DNA, 18 bp, Homo sapiens
ggactctgccccacgctg

SEQ ID NO: 3273411 - DNA, 17 bp, Homo sapiens
ggactctggtgcctcca

SEQ ID NO: 3273412 - DNA, 14 bp, Homo sapiens
ggactcttctcggc

SEQ ID NO: 3273413 - DNA, 16 bp, Homo sapiens
ggactcttgctctttc

SEQ ID NO: 3273414 - DNA, 14 bp, Homo sapiens
ggactgaagcctgc

SEQ ID NO: 3273415 - DNA, 22 bp, Homo sapiens
ggactgactgagacacgatgcc

SEQ ID NO: 3273416 - DNA, 12 bp, Homo sapiens
ggactgagcccc

SEQ ID NO: 3273417 - DNA, 23 bp, Homo sapiens
ggactgagtcccctccaggaaga

SEQ ID NO: 3273418 - DNA, 13 bp, Homo sapiens
ggactgcctctgc

SEQ ID NO: 3273419 - DNA, 24 bp, Homo sapiens
ggactggacagctttgctccgctc

SEQ ID NO: 3273420 - DNA, 21 bp, Homo sapiens
ggactggaggcccctggagcc

SEQ ID NO: 3273421 - DNA, 19 bp, Homo sapiens
ggactggaggtgggcatgc

SEQ ID NO: 3273422 - DNA, 22 bp, Homo sapiens
ggactggcgagtccagagagga

SEQ ID NO: 3273423 - DNA, 21 bp, Homo sapiens
ggactggcgttcacctccctg

SEQ ID NO: 3273424 - DNA, 19 bp, Homo sapiens
ggactgggggactgggagt

SEQ ID NO: 3273425 - DNA, 22 bp, Homo sapiens
ggactgggggactgggagtcag

SEQ ID NO: 3273426 - DNA, 13 bp, Homo sapiens
ggactgggtttgg

SEQ ID NO: 3273427 - DNA, 23 bp, Homo sapiens
ggactgggtttggaccccagctg

SEQ ID NO: 3273428 - DNA, 24 bp, Homo sapiens
ggactgggtttggaccccagctgg

SEQ ID NO: 3273429 - DNA, 15 bp, Homo sapiens
ggactgtcatagaaa

SEQ ID NO: 3273430 - DNA, 20 bp, Homo sapiens
ggactgtctttcagatacat

SEQ ID NO: 3273431 - DNA, 17 bp, Homo sapiens
ggactgttccaaagcca

SEQ ID NO: 3273432 - DNA, 17 bp, Homo sapiens
ggactgttccaggccct

SEQ ID NO: 3273433 - DNA, 18 bp, Homo sapiens
ggactgttccaggccctc

SEQ ID NO: 3273434 - DNA, 17 bp, Homo sapiens
ggacttaacggctccag

SEQ ID NO: 3273435 - DNA, 16 bp, Homo sapiens
ggacttagccgactgc

SEQ ID NO: 3273436 - DNA, 15 bp, Homo sapiens
ggacttcctggggcc

SEQ ID NO: 3273437 - DNA, 23 bp, Homo sapiens
ggacttctacctgccctcaaggg

SEQ ID NO: 3273438 - DNA, 18 bp, Homo sapiens
ggacttctgcagctatgc

SEQ ID NO: 3273439 - DNA, 12 bp, Homo sapiens
ggcagctgcctc

SEQ ID NO: 3273440 - DNA, 14 bp, Homo sapiens
ggcagctgcctctg

SEQ ID NO: 3273441 - DNA, 21 bp, Homo sapiens
ggcagctgcggtccacccagg

SEQ ID NO: 3273442 - DNA, 23 bp, Homo sapiens
ggcagctgcggtccacccaggag

SEQ ID NO: 3273443 - DNA, 11 bp, Homo sapiens
ggcagctgcta

SEQ ID NO: 3273444 - DNA, 22 bp, Homo sapiens
ggcagctgctatttattttcct

SEQ ID NO: 3273445 - DNA, 13 bp, Homo sapiens
ggcagctgctctt

SEQ ID NO: 3273446 - DNA, 11 bp, Homo sapiens
ggcagctgggc

SEQ ID NO: 3273447 - DNA, 21 bp, Homo sapiens
ggcagctgggccccacctact

SEQ ID NO: 3273448 - DNA, 18 bp, Homo sapiens
ggcagcttcaagtgcctt

SEQ ID NO: 3273449 - DNA, 23 bp, Homo sapiens
ggcaggaagcccaattgctggag

SEQ ID NO: 3273450 - DNA, 16 bp, Homo sapiens
ggcaggaaggagagcc

SEQ ID NO: 3273451 - DNA, 15 bp, Homo sapiens
ggcaggaaggagcgg

SEQ ID NO: 3273452 - DNA, 16 bp, Homo sapiens
ggcaggacacatcccg

SEQ ID NO: 3273453 - DNA, 23 bp, Homo sapiens
ggcaggaccttcgggctgtgccc

SEQ ID NO: 3273454 - DNA, 17 bp, Homo sapiens
ggcaggactgagtcccc

SEQ ID NO: 3273455 - DNA, 16 bp, Homo sapiens
ggcaggagaggctggg

SEQ ID NO: 3273456 - DNA, 17 bp, Homo sapiens
ggcaggagaggctgggc

SEQ ID NO: 3273457 - DNA, 16 bp, Homo sapiens
ggcaggcaagcccttc

SEQ ID NO: 3273458 - DNA, 20 bp, Homo sapiens
ggcaggcacacagcagcccc

SEQ ID NO: 3273459 - DNA, 15 bp, Homo sapiens
ggcaggcagcgccaa

SEQ ID NO: 3273460 - DNA, 18 bp, Homo sapiens
ggcaggccagatggcccc

SEQ ID NO: 3273461 - DNA, 17 bp, Homo sapiens
ggcaggccagtgtctgg

SEQ ID NO: 3273462 - DNA, 12 bp, Homo sapiens
ggcaggccctgc

SEQ ID NO: 3273463 - DNA, 16 bp, Homo sapiens
ggcaggccctgcagtg

SEQ ID NO: 3273464 - DNA, 13 bp, Homo sapiens
ggcaggctcactg

SEQ ID NO: 3273465 - DNA, 19 bp, Homo sapiens
ggcaggctcactgccaggc

SEQ ID NO: 3273466 - DNA, 16 bp, Homo sapiens
ggcaggctgacatctg

SEQ ID NO: 3273467 - DNA, 18 bp, Homo sapiens
ggcaggctgacatctgtg

SEQ ID NO: 3273468 - DNA, 17 bp, Homo sapiens
ggcaggctggccagtcc

SEQ ID NO: 3273469 - DNA, 20 bp, Homo sapiens
ggcaggctggccagtccagg

SEQ ID NO: 3273470 - DNA, 13 bp, Homo sapiens
ggcaggctgggcc

SEQ ID NO: 3273471 - DNA, 14 bp, Homo sapiens
ggcaggctgggcca

SEQ ID NO: 3273472 - DNA, 22 bp, Homo sapiens
ggcaggctgggccatgtccaaa

SEQ ID NO: 3273473 - DNA, 22 bp, Homo sapiens
ggcaggctgtctggccaggcct

SEQ ID NO: 3273474 - DNA, 21 bp, Homo sapiens
ggcagggaaggacaggaccct

SEQ ID NO: 3273475 - DNA, 23 bp, Homo sapiens
ggcagggaaggggaggcagccgg

SEQ ID NO: 3273476 - DNA, 13 bp, Homo sapiens
ggcagggagggga

SEQ ID NO: 3273477 - DNA, 15 bp, Homo sapiens
ggcagggaggtcagg

SEQ ID NO: 3273478 - DNA, 19 bp, Homo sapiens
ggcagggaggtcaggccct

SEQ ID NO: 3273479 - DNA, 18 bp, Homo sapiens
ggcagggatgggggtggc

SEQ ID NO: 3273480 - DNA, 22 bp, Homo sapiens
ggcagggatgggggtggctggg

SEQ ID NO: 3273481 - DNA, 23 bp, Homo sapiens
ggcagggcaaatgacatgcactg

SEQ ID NO: 3273482 - DNA, 15 bp, Homo sapiens
ggcagggcagaggga

SEQ ID NO: 3273483 - DNA, 15 bp, Homo sapiens
ggcagggcatctcct

SEQ ID NO: 3273484 - DNA, 23 bp, Homo sapiens
ggcagggccaccccactctacct

SEQ ID NO: 3273485 - DNA, 17 bp, Homo sapiens
ggcagggccaggctggt

SEQ ID NO: 3273486 - DNA, 22 bp, Homo sapiens
ggcagggcccttggggctgggg

SEQ ID NO: 3273487 - DNA, 12 bp, Homo sapiens
ggcagggccttc

SEQ ID NO: 3273488 - DNA, 14 bp, Homo sapiens
ggcagggccttcct

SEQ ID NO: 3273489 - DNA, 22 bp, Homo sapiens
ggcagggcgggcagagggctgg

SEQ ID NO: 3273490 - DNA, 23 bp, Homo sapiens
ggcagggcgggcagagggctgga

SEQ ID NO: 3273491 - DNA, 13 bp, Homo sapiens
ggcagggctcagg

SEQ ID NO: 3273492 - DNA, 15 bp, Homo sapiens
ggcagggctcaggat

SEQ ID NO: 3273493 - DNA, 13 bp, Homo sapiens
ggcagggctctga

SEQ ID NO: 3273494 - DNA, 21 bp, Homo sapiens
ggcagggctggccccagggca

SEQ ID NO: 3273495 - DNA, 16 bp, Homo sapiens
ggcaggggaagccttg

SEQ ID NO: 3273496 - DNA, 18 bp, Homo sapiens
ggcaggggagacaggagc

SEQ ID NO: 3273497 - DNA, 22 bp, Homo sapiens
ggcaggggagacaggagcctag

SEQ ID NO: 3273498 - DNA, 23 bp, Homo sapiens
ggcagggggccccgccagggctg

SEQ ID NO: 3273499 - DNA, 14 bp, Homo sapiens
ggcaggggtggggg

SEQ ID NO: 3273500 - DNA, 18 bp, Homo sapiens
ggcagggtctcactctgt

SEQ ID NO: 3273501 - DNA, 14 bp, Homo sapiens
ggcagggtgaccct

SEQ ID NO: 3273502 - DNA, 20 bp, Homo sapiens
ggcaggtagatcgcttgagc

SEQ ID NO: 3273503 - DNA, 21 bp, Homo sapiens
ggcaggtagatcgcttgagcc

SEQ ID NO: 3273504 - DNA, 14 bp, Homo sapiens
ggcaggtagccagg

SEQ ID NO: 3273505 - DNA, 20 bp, Homo sapiens
ggcaggtagccagggggact

SEQ ID NO: 3273506 - DNA, 15 bp, Homo sapiens
ggcaggtcctgccca

SEQ ID NO: 3273507 - DNA, 19 bp, Homo sapiens
ggcaggtcctgcccatgtg

SEQ ID NO: 3273508 - DNA, 20 bp, Homo sapiens
ggcaggtcttcatatttttg

SEQ ID NO: 3273509 - DNA, 20 bp, Homo sapiens
ggcaggtgcctccaggtgtg

SEQ ID NO: 3273510 - DNA, 14 bp, Homo sapiens
ggcaggtgggcaga

SEQ ID NO: 3273511 - DNA, 17 bp, Homo sapiens
ggcaggtggtggcactg

SEQ ID NO: 3273512 - DNA, 19 bp, Homo sapiens
ggcaggttggatgggagtg

SEQ ID NO: 3273513 - DNA, 14 bp, Homo sapiens
ggcagtcgggggct

SEQ ID NO: 3273514 - DNA, 23 bp, Homo sapiens
ggcagtcgggggctggcctagga

SEQ ID NO: 3273515 - DNA, 19 bp, Homo sapiens
ggcagtctctatattatgt

SEQ ID NO: 3273516 - DNA, 15 bp, Homo sapiens
ggcagtgactggcag

SEQ ID NO: 3273517 - DNA, 19 bp, Homo sapiens
ggcagtgcccatgtgtaca

SEQ ID NO: 3273518 - DNA, 12 bp, Homo sapiens
ggcagtggaggt

SEQ ID NO: 3273519 - DNA, 13 bp, Homo sapiens
ggcagtgggagct

SEQ ID NO: 3273520 - DNA, 23 bp, Homo sapiens
ggcagtgtcccagggccctggat

SEQ ID NO: 3273521 - DNA, 23 bp, Homo sapiens
ggcagttctcactcctaggagag

SEQ ID NO: 3273522 - DNA, 14 bp, Homo sapiens
ggcagttggccaga

SEQ ID NO: 3273523 - DNA, 14 bp, Homo sapiens
ggcatactttctct

SEQ ID NO: 3273524 - DNA, 22 bp, Homo sapiens
ggcatagaggcttctccgccag

SEQ ID NO: 3273525 - DNA, 21 bp, Homo sapiens
ggcatagctccccgcttctgc

SEQ ID NO: 3273526 - DNA, 15 bp, Homo sapiens
ggcatagctctgggg

SEQ ID NO: 3273527 - DNA, 14 bp, Homo sapiens
ggcataggcctggg

SEQ ID NO: 3273528 - DNA, 17 bp, Homo sapiens
ggcataggcctgggtgc

SEQ ID NO: 3273529 - DNA, 23 bp, Homo sapiens
ggcatatcttctatatctgaaga

SEQ ID NO: 3273530 - DNA, 14 bp, Homo sapiens
ggcatcaaccacca

SEQ ID NO: 3273531 - DNA, 21 bp, Homo sapiens
ggcatcaagaggtgggagggc

SEQ ID NO: 3273532 - DNA, 14 bp, Homo sapiens
ggcatcacagggca

SEQ ID NO: 3273533 - DNA, 17 bp, Homo sapiens
ggcatcacagggcagag

SEQ ID NO: 3273534 - DNA, 13 bp, Homo sapiens
ggcatcagcagca

SEQ ID NO: 3273535 - DNA, 16 bp, Homo sapiens
ggcatcagcagcaggg

SEQ ID NO: 3273536 - DNA, 19 bp, Homo sapiens
ggcatcaggcactggtggc

SEQ ID NO: 3273537 - DNA, 16 bp, Homo sapiens
ggcatccacccagtgc

SEQ ID NO: 3273538 - DNA, 22 bp, Homo sapiens
ggcatcgtagaagagatgtggc

SEQ ID NO: 3273539 - DNA, 13 bp, Homo sapiens
ggcatctttgggg

SEQ ID NO: 3273540 - DNA, 14 bp, Homo sapiens
ggcatcttttggag

SEQ ID NO: 3273541 - DNA, 13 bp, Homo sapiens
ggcatgaggaggt

SEQ ID NO: 3273542 - DNA, 19 bp, Homo sapiens
ggcatgagggatcacaggg

SEQ ID NO: 3273543 - DNA, 15 bp, Homo sapiens
ggcatgcacagctgt

SEQ ID NO: 3273544 - DNA, 14 bp, Homo sapiens
ggcatgccaccctc

SEQ ID NO: 3273545 - DNA, 19 bp, Homo sapiens
ggcatgcgcacaaggctga

SEQ ID NO: 3273546 - DNA, 14 bp, Homo sapiens
ggcatgctggggca

SEQ ID NO: 3273547 - DNA, 16 bp, Homo sapiens
ggcatgctggggcaag

SEQ ID NO: 3273548 - DNA, 14 bp, Homo sapiens
ggcatggcaggctg

SEQ ID NO: 3273549 - DNA, 12 bp, Homo sapiens
ggcatggccctg

SEQ ID NO: 3273550 - DNA, 20 bp, Homo sapiens
ggcatggttccttccctggg

SEQ ID NO: 3273551 - DNA, 23 bp, Homo sapiens
ggcatggttccttccctgggaag

SEQ ID NO: 3273552 - DNA, 16 bp, Homo sapiens
ggcatgtcccacccac

SEQ ID NO: 3273553 - DNA, 20 bp, Homo sapiens
ggcatgtcccacccacccgc

SEQ ID NO: 3273554 - DNA, 16 bp, Homo sapiens
ggcatgtggcctgtgg

SEQ ID NO: 3273555 - DNA, 14 bp, Homo sapiens
ggcatgtgtatgtg

SEQ ID NO: 3273556 - DNA, 23 bp, Homo sapiens
ggcatgttctctgaggacactaa

SEQ ID NO: 3273557 - DNA, 16 bp, Homo sapiens
ggcattaatgtttcta

SEQ ID NO: 3273558 - DNA, 17 bp, Homo sapiens
ggcattaatgtttctat

SEQ ID NO: 3273559 - DNA, 13 bp, Homo sapiens
ggcattcctgctt

SEQ ID NO: 3273560 - DNA, 16 bp, Homo sapiens
ggcattcgggccacag

SEQ ID NO: 3273561 - DNA, 16 bp, Homo sapiens
ggcattcggggaagct

SEQ ID NO: 3273562 - DNA, 17 bp, Homo sapiens
ggcattgacaaatctgt

SEQ ID NO: 3273563 - DNA, 20 bp, Homo sapiens
ggcattgacaaatctgtgta

SEQ ID NO: 3273564 - DNA, 19 bp, Homo sapiens
ggcattgaggaagagtctt

SEQ ID NO: 3273565 - DNA, 17 bp, Homo sapiens
ggcattgggctgacacc

SEQ ID NO: 3273566 - DNA, 18 bp, Homo sapiens
ggcattgggctgacacct

SEQ ID NO: 3273567 - DNA, 11 bp, Homo sapiens
ggcatttccta

SEQ ID NO: 3273568 - DNA, 10 bp, Homo sapiens
ggcaccaaag

SEQ ID NO: 3273569 - DNA, 20 bp, Homo sapiens
ggcaccaaagatgcagccgc

SEQ ID NO: 3273570 - DNA, 14 bp, Homo sapiens
ggcaccagaggccg

SEQ ID NO: 3273571 - DNA, 15 bp, Homo sapiens
ggcaccagaggccga

SEQ ID NO: 3273572 - DNA, 13 bp, Homo sapiens
ggcaccagcatcc

SEQ ID NO: 3273573 - DNA, 13 bp, Homo sapiens
ggcaccagccagc

SEQ ID NO: 3273574 - DNA, 14 bp, Homo sapiens
ggcaccagccccct

SEQ ID NO: 3273575 - DNA, 19 bp, Homo sapiens
ggcaccagccccctggatg

SEQ ID NO: 3273576 - DNA, 14 bp, Homo sapiens
ggcaccagctctgt

SEQ ID NO: 3273577 - DNA, 18 bp, Homo sapiens
ggcaccagctctgtggcc

SEQ ID NO: 3273578 - DNA, 22 bp, Homo sapiens
ggcaccagctctgtggcctgtg

SEQ ID NO: 3273579 - DNA, 21 bp, Homo sapiens
ggcaccagggcattcgggcca

SEQ ID NO: 3273580 - DNA, 20 bp, Homo sapiens
ggcacccaccatcatgtctg

SEQ ID NO: 3273581 - DNA, 21 bp, Homo sapiens
ggcacccaccgtggaggagga

SEQ ID NO: 3273582 - DNA, 16 bp, Homo sapiens
ggcacccggcccctgc

SEQ ID NO: 3273583 - DNA, 17 bp, Homo sapiens
ggcacccggcccctgct

SEQ ID NO: 3273584 - DNA, 19 bp, Homo sapiens
ggcacccggcccctgctgg

SEQ ID NO: 3273585 - DNA, 12 bp, Homo sapiens
ggcaccctctgg

SEQ ID NO: 3273586 - DNA, 15 bp, Homo sapiens
ggcaccctctggccg

SEQ ID NO: 3273587 - DNA, 20 bp, Homo sapiens
ggcaccctctggccgcctag

SEQ ID NO: 3273588 - DNA, 17 bp, Homo sapiens
ggcacccttctttcctc

SEQ ID NO: 3273589 - DNA, 15 bp, Homo sapiens
ggcaccgagaatgtt

SEQ ID NO: 3273590 - DNA, 19 bp, Homo sapiens
ggcaccgccacgtcccagc

SEQ ID NO: 3273591 - DNA, 20 bp, Homo sapiens
ggcaccgccacgtcccagca

SEQ ID NO: 3273592 - DNA, 13 bp, Homo sapiens
ggcaccggcgctg

SEQ ID NO: 3273593 - DNA, 16 bp, Homo sapiens
ggcaccggcgctgcag

SEQ ID NO: 3273594 - DNA, 22 bp, Homo sapiens
ggcacctatagtcccagctact

SEQ ID NO: 3273595 - DNA, 16 bp, Homo sapiens
ggcacctcacaggccc

SEQ ID NO: 3273596 - DNA, 18 bp, Homo sapiens
ggcacctcggggacacca

SEQ ID NO: 3273597 - DNA, 12 bp, Homo sapiens
ggcacctcttcc

SEQ ID NO: 3273598 - DNA, 12 bp, Homo sapiens
ggcacctggcct

SEQ ID NO: 3273599 - DNA, 14 bp, Homo sapiens
ggcacctggcctgc

SEQ ID NO: 3273600 - DNA, 15 bp, Homo sapiens
ggcacctggcctgct

SEQ ID NO: 3273601 - DNA, 18 bp, Homo sapiens
ggcacggactgtccacct

SEQ ID NO: 3273602 - DNA, 17 bp, Homo sapiens
ggcacgggtggtccccg

SEQ ID NO: 3273603 - DNA, 21 bp, Homo sapiens
ggcacgtcgcccgctgagctg

SEQ ID NO: 3273604 - DNA, 14 bp, Homo sapiens
ggcactagcctttg

SEQ ID NO: 3273605 - DNA, 15 bp, Homo sapiens
ggcactagcctttgg

SEQ ID NO: 3273606 - DNA, 21 bp, Homo sapiens
ggcactcacagacctggagcc

SEQ ID NO: 3273607 - DNA, 20 bp, Homo sapiens
ggcactcagaagacactgat

SEQ ID NO: 3273608 - DNA, 12 bp, Homo sapiens
ggcactcagcca

SEQ ID NO: 3273609 - DNA, 18 bp, Homo sapiens
ggcactcagccacgacca

SEQ ID NO: 3273610 - DNA, 13 bp, Homo sapiens
ggcactctagatt

SEQ ID NO: 3273611 - DNA, 12 bp, Homo sapiens
ggcactgagccc

SEQ ID NO: 3273612 - DNA, 13 bp, Homo sapiens
ggcactgagcccc

SEQ ID NO: 3273613 - DNA, 19 bp, Homo sapiens
ggcactgagcccccccaac

SEQ ID NO: 3273614 - DNA, 23 bp, Homo sapiens
ggcactgagcccccccaacactg

SEQ ID NO: 3273615 - DNA, 20 bp, Homo sapiens
ggcactgccttctcctctct

SEQ ID NO: 3273616 - DNA, 13 bp, Homo sapiens
ggcactggcccag

SEQ ID NO: 3273617 - DNA, 13 bp, Homo sapiens
ggcactgggctgt

SEQ ID NO: 3273618 - DNA, 13 bp, Homo sapiens
ggcactggtggca

SEQ ID NO: 3273619 - DNA, 15 bp, Homo sapiens
ggcactggtggcccg

SEQ ID NO: 3273620 - DNA, 20 bp, Homo sapiens
ggcacttaagtgcacttttt

SEQ ID NO: 3273621 - DNA, 22 bp, Homo sapiens
ggcacttaatttgtaaacttct

SEQ ID NO: 3273622 - DNA, 17 bp, Homo sapiens
ggcacttagcccaagag

SEQ ID NO: 3273623 - DNA, 16 bp, Homo sapiens
ggcacttgattccttg

SEQ ID NO: 3273624 - DNA, 13 bp, Homo sapiens
ggcacttgtattt

SEQ ID NO: 3273625 - DNA, 23 bp, Homo sapiens
ggcactttgagatgtgttcctcc

SEQ ID NO: 3273626 - DNA, 17 bp, Homo sapiens
ggcagaaaacagagcct

SEQ ID NO: 3273627 - DNA, 19 bp, Homo sapiens
ggcagaaaacagagcctgc

SEQ ID NO: 3273628 - DNA, 22 bp, Homo sapiens
ggcagaaaacagagcctgccta

SEQ ID NO: 3273629 - DNA, 22 bp, Homo sapiens
ggcagaaaagaggagaccctgg

SEQ ID NO: 3273630 - DNA, 23 bp, Homo sapiens
ggcagaaaagaggagaccctgga

SEQ ID NO: 3273631 - DNA, 17 bp, Homo sapiens
ggcagaaacaataaaac

SEQ ID NO: 3273632 - DNA, 22 bp, Homo sapiens
ggcagaaaggaaaacctgaaga

SEQ ID NO: 3273633 - DNA, 16 bp, Homo sapiens
ggcagaaagtggccat

SEQ ID NO: 3273634 - DNA, 15 bp, Homo sapiens
ggcagaagacaccag

SEQ ID NO: 3273635 - DNA, 17 bp, Homo sapiens
ggcagactacacaggat

SEQ ID NO: 3273636 - DNA, 18 bp, Homo sapiens
ggcagactctttaataaa

SEQ ID NO: 3273637 - DNA, 21 bp, Homo sapiens
ggcagactctttaataaattg

SEQ ID NO: 3273638 - DNA, 17 bp, Homo sapiens
ggcagagaaggcctctt

SEQ ID NO: 3273639 - DNA, 15 bp, Homo sapiens
ggcagagaagttctc

SEQ ID NO: 3273640 - DNA, 10 bp, Homo sapiens
ggcagagagc

SEQ ID NO: 3273641 - DNA, 16 bp, Homo sapiens
ggcagagccgggaagc

SEQ ID NO: 3273642 - DNA, 19 bp, Homo sapiens
ggcagagctgacgggaggc

SEQ ID NO: 3273643 - DNA, 24 bp, Homo sapiens
ggcagagctgacgggaggccccag

SEQ ID NO: 3273644 - DNA, 19 bp, Homo sapiens
ggcagagctggctctgagc

SEQ ID NO: 3273645 - DNA, 12 bp, Homo sapiens
ggcagagggctg

SEQ ID NO: 3273646 - DNA, 18 bp, Homo sapiens
ggcagaggggcagccgct

SEQ ID NO: 3273647 - DNA, 18 bp, Homo sapiens
ggcagagtcgttggagac

SEQ ID NO: 3273648 - DNA, 19 bp, Homo sapiens
ggcagagttacagttctgt

SEQ ID NO: 3273649 - DNA, 15 bp, Homo sapiens
ggcagataatcagcc

SEQ ID NO: 3273650 - DNA, 18 bp, Homo sapiens
ggcagataatcagcctct

SEQ ID NO: 3273651 - DNA, 16 bp, Homo sapiens
ggcagatctgtgcccc

SEQ ID NO: 3273652 - DNA, 16 bp, Homo sapiens
ggcagatggagcccat

SEQ ID NO: 3273653 - DNA, 13 bp, Homo sapiens
ggcagattgaaaa

SEQ ID NO: 3273654 - DNA, 14 bp, Homo sapiens
ggcagcacagccca

SEQ ID NO: 3273655 - DNA, 16 bp, Homo sapiens
ggcagcacagcccagg

SEQ ID NO: 3273656 - DNA, 17 bp, Homo sapiens
ggcagcacagcccaggg

SEQ ID NO: 3273657 - DNA, 23 bp, Homo sapiens
ggcagcacagcccagggcctgca

SEQ ID NO: 3273658 - DNA, 12 bp, Homo sapiens
ggcagcaccctc

SEQ ID NO: 3273659 - DNA, 15 bp, Homo sapiens
ggcagcaccctcccc

SEQ ID NO: 3273660 - DNA, 22 bp, Homo sapiens
ggcagcactccccagagctgtg

SEQ ID NO: 3273661 - DNA, 15 bp, Homo sapiens
ggcagcatggagaga

SEQ ID NO: 3273662 - DNA, 17 bp, Homo sapiens
ggcagcatggagagagg

SEQ ID NO: 3273663 - DNA, 18 bp, Homo sapiens
ggcagcatggagagaggc

SEQ ID NO: 3273664 - DNA, 22 bp, Homo sapiens
ggcagccacccaagcctgctgg

SEQ ID NO: 3273665 - DNA, 23 bp, Homo sapiens
ggcagccacttcggccaggtcac

SEQ ID NO: 3273666 - DNA, 15 bp, Homo sapiens
ggcagccagaccagc

SEQ ID NO: 3273667 - DNA, 13 bp, Homo sapiens
ggcagccagcaga

SEQ ID NO: 3273668 - DNA, 12 bp, Homo sapiens
ggcagccaggct

SEQ ID NO: 3273669 - DNA, 13 bp, Homo sapiens
ggcagccaggctg

SEQ ID NO: 3273670 - DNA, 15 bp, Homo sapiens
ggcagccaggctgcc

SEQ ID NO: 3273671 - DNA, 21 bp, Homo sapiens
ggcagccatgcctcatgccac

SEQ ID NO: 3273672 - DNA, 12 bp, Homo sapiens
ggcagccccaga

SEQ ID NO: 3273673 - DNA, 16 bp, Homo sapiens
ggcagccccagagaga

SEQ ID NO: 3273674 - DNA, 23 bp, Homo sapiens
ggcagccccattctgcctgccca

SEQ ID NO: 3273675 - DNA, 11 bp, Homo sapiens
ggcagcccttg

SEQ ID NO: 3273676 - DNA, 17 bp, Homo sapiens
ggcagccgctaggagag

SEQ ID NO: 3273677 - DNA, 23 bp, Homo sapiens
ggcagccgctaggagagactgaa

SEQ ID NO: 3273678 - DNA, 19 bp, Homo sapiens
ggcagccgtgccttcagct

SEQ ID NO: 3273679 - DNA, 16 bp, Homo sapiens
ggcagcctccagagcc

SEQ ID NO: 3273680 - DNA, 17 bp, Homo sapiens
ggcagcctccagagcca

SEQ ID NO: 3273681 - DNA, 20 bp, Homo sapiens
ggcagcctccagagccagcc

SEQ ID NO: 3273682 - DNA, 23 bp, Homo sapiens
ggcagcctccagagccagcctgg

SEQ ID NO: 3273683 - DNA, 15 bp, Homo sapiens
ggcagcgccaagcaa

SEQ ID NO: 3273684 - DNA, 18 bp, Homo sapiens
ggcagcgccaagcaacct

SEQ ID NO: 3273685 - DNA, 20 bp, Homo sapiens
ggcagcgccaagtgcgtgcc

SEQ ID NO: 3273686 - DNA, 13 bp, Homo sapiens
ggcagcgggcgga

SEQ ID NO: 3273687 - DNA, 14 bp, Homo sapiens
ggcagctagactgg

SEQ ID NO: 3273688 - DNA, 15 bp, Homo sapiens
ggcagctagactgga

SEQ ID NO: 3273689 - DNA, 18 bp, Homo sapiens
ggcagctagactggagtg

SEQ ID NO: 3273690 - DNA, 14 bp, Homo sapiens
ggcagctagtgcct

SEQ ID NO: 3273691 - DNA, 15 bp, Homo sapiens
ggcagctagtgcctt

SEQ ID NO: 3273692 - DNA, 17 bp, Homo sapiens
ggcagctagtgccttta

SEQ ID NO: 3273693 - DNA, 16 bp, Homo sapiens
ggcagctcctctcctt

SEQ ID NO: 3273694 - DNA, 13 bp, Homo sapiens
ggcagctctccag

SEQ ID NO: 3273695 - DNA, 21 bp, Homo sapiens
ggcagctctccagtcaggagg

SEQ ID NO: 3273696 - DNA, 18 bp, Homo sapiens
ggcagctgagagccctgc

SEQ ID NO: 3273697 - DNA, 23 bp, Homo sapiens
ggcagctgaggacacaccccaca

SEQ ID NO: 3273698 - DNA, 22 bp, Homo sapiens
ggccatcacaggatgccagccc

SEQ ID NO: 3273699 - DNA, 17 bp, Homo sapiens
ggccatccctgggcccc

SEQ ID NO: 3273700 - DNA, 19 bp, Homo sapiens
ggccatccctgggcccctc

SEQ ID NO: 3273701 - DNA, 15 bp, Homo sapiens
ggccatgagggacag

SEQ ID NO: 3273702 - DNA, 22 bp, Homo sapiens
ggccatgagggacagggtcttt

SEQ ID NO: 3273703 - DNA, 18 bp, Homo sapiens
ggccatgctgaggcctgg

SEQ ID NO: 3273704 - DNA, 22 bp, Homo sapiens
ggccatgggacagggaggacgc

SEQ ID NO: 3273705 - DNA, 16 bp, Homo sapiens
ggccatgtccaaagag

SEQ ID NO: 3273706 - DNA, 14 bp, Homo sapiens
ggccatgtgagcca

SEQ ID NO: 3273707 - DNA, 14 bp, Homo sapiens
ggcccaacattaaa

SEQ ID NO: 3273708 - DNA, 17 bp, Homo sapiens
ggcccaagtcattgttt

SEQ ID NO: 3273709 - DNA, 15 bp, Homo sapiens
ggcccaagtccctgt

SEQ ID NO: 3273710 - DNA, 18 bp, Homo sapiens
ggcccacaggaggcaagc

SEQ ID NO: 3273711 - DNA, 14 bp, Homo sapiens
ggcccaccatcacc

SEQ ID NO: 3273712 - DNA, 17 bp, Homo sapiens
ggcccacctggccacct

SEQ ID NO: 3273713 - DNA, 22 bp, Homo sapiens
ggcccacctggccacctgaggt

SEQ ID NO: 3273714 - DNA, 17 bp, Homo sapiens
ggcccacgtggttgggg

SEQ ID NO: 3273715 - DNA, 22 bp, Homo sapiens
ggcccagaagggtagctgggcg

SEQ ID NO: 3273716 - DNA, 17 bp, Homo sapiens
ggcccagaagtttccct

SEQ ID NO: 3273717 - DNA, 15 bp, Homo sapiens
ggcccagagaagcaa

SEQ ID NO: 3273718 - DNA, 14 bp, Homo sapiens
ggcccagagcagga

SEQ ID NO: 3273719 - DNA, 22 bp, Homo sapiens
ggcccagatctggtcccttgca

SEQ ID NO: 3273720 - DNA, 13 bp, Homo sapiens
ggcccagccagga

SEQ ID NO: 3273721 - DNA, 12 bp, Homo sapiens
ggcccagccagt

SEQ ID NO: 3273722 - DNA, 16 bp, Homo sapiens
ggcccagcccagagcc

SEQ ID NO: 3273723 - DNA, 17 bp, Homo sapiens
ggcccagcccctccacg

SEQ ID NO: 3273724 - DNA, 22 bp, Homo sapiens
ggcccagccggcctctctggcc

SEQ ID NO: 3273725 - DNA, 12 bp, Homo sapiens
ggcccagcgcgg

SEQ ID NO: 3273726 - DNA, 14 bp, Homo sapiens
ggcccagctgtagc

SEQ ID NO: 3273727 - DNA, 19 bp, Homo sapiens
ggcccagctgtagccatgg

SEQ ID NO: 3273728 - DNA, 20 bp, Homo sapiens
ggcccagctgtagccatggc

SEQ ID NO: 3273729 - DNA, 21 bp, Homo sapiens
ggcccagctgtagccatggct

SEQ ID NO: 3273730 - DNA, 14 bp, Homo sapiens
ggcccaggaagccc

SEQ ID NO: 3273731 - DNA, 18 bp, Homo sapiens
ggcccaggaagcccacac

SEQ ID NO: 3273732 - DNA, 17 bp, Homo sapiens
ggcccaggagaccacgg

SEQ ID NO: 3273733 - DNA, 13 bp, Homo sapiens
ggcccaggcctac

SEQ ID NO: 3273734 - DNA, 14 bp, Homo sapiens
ggcccagtgccact

SEQ ID NO: 3273735 - DNA, 13 bp, Homo sapiens
ggcccatctcagc

SEQ ID NO: 3273736 - DNA, 16 bp, Homo sapiens
ggcccatctcagcctc

SEQ ID NO: 3273737 - DNA, 18 bp, Homo sapiens
ggcccatctcagcctcct

SEQ ID NO: 3273738 - DNA, 23 bp, Homo sapiens
ggccccaccctgggccctgggct

SEQ ID NO: 3273739 - DNA, 13 bp, Homo sapiens
ggccccactgatg

SEQ ID NO: 3273740 - DNA, 18 bp, Homo sapiens
ggccccagaccccagggc

SEQ ID NO: 3273741 - DNA, 13 bp, Homo sapiens
ggccccagaggcc

SEQ ID NO: 3273742 - DNA, 19 bp, Homo sapiens
ggccccagatctgcctggg

SEQ ID NO: 3273743 - DNA, 18 bp, Homo sapiens
ggccccagcacagcttga

SEQ ID NO: 3273744 - DNA, 21 bp, Homo sapiens
ggccccagccagagttcctgc

SEQ ID NO: 3273745 - DNA, 14 bp, Homo sapiens
ggccccagccctgc

SEQ ID NO: 3273746 - DNA, 13 bp, Homo sapiens
ggccccagggcac

SEQ ID NO: 3273747 - DNA, 18 bp, Homo sapiens
ggccccagggctaccctc

SEQ ID NO: 3273748 - DNA, 21 bp, Homo sapiens
ggccccatcctcatccctgac

SEQ ID NO: 3273749 - DNA, 14 bp, Homo sapiens
ggccccatgctctg

SEQ ID NO: 3273750 - DNA, 17 bp, Homo sapiens
ggccccatgctctgccc

SEQ ID NO: 3273751 - DNA, 19 bp, Homo sapiens
ggccccatgctctgcccca

SEQ ID NO: 3273752 - DNA, 21 bp, Homo sapiens
ggccccatgctctgccccaag

SEQ ID NO: 3273753 - DNA, 23 bp, Homo sapiens
ggcccccaacctcagggctccca

SEQ ID NO: 3273754 - DNA, 19 bp, Homo sapiens
ggcccccaataaaggcagc

SEQ ID NO: 3273755 - DNA, 21 bp, Homo sapiens
ggcccccaataaaggcagctg

SEQ ID NO: 3273756 - DNA, 17 bp, Homo sapiens
ggcccccagcccagggc

SEQ ID NO: 3273757 - DNA, 20 bp, Homo sapiens
ggcccccaggattcccccag

SEQ ID NO: 3273758 - DNA, 20 bp, Homo sapiens
ggcccccaggggcaggactg

SEQ ID NO: 3273759 - DNA, 15 bp, Homo sapiens
ggccccccagctcag

SEQ ID NO: 3273760 - DNA, 17 bp, Homo sapiens
ggccccccagctcaggg

SEQ ID NO: 3273761 - DNA, 21 bp, Homo sapiens
ggccccccagctcaggggcag

SEQ ID NO: 3273762 - DNA, 23 bp, Homo sapiens
ggccccccagctcaggggcagct

SEQ ID NO: 3273763 - DNA, 21 bp, Homo sapiens
ggccccccgcgctcgcccagc

SEQ ID NO: 3273764 - DNA, 23 bp, Homo sapiens
ggccccccgcgctcgcccagcag

SEQ ID NO: 3273765 - DNA, 16 bp, Homo sapiens
ggcccccgaactgtgc

SEQ ID NO: 3273766 - DNA, 20 bp, Homo sapiens
ggcccccgaactgtgccttc

SEQ ID NO: 3273767 - DNA, 17 bp, Homo sapiens
ggccccctccctggatg

SEQ ID NO: 3273768 - DNA, 20 bp, Homo sapiens
ggccccctctcggccaggca

SEQ ID NO: 3273769 - DNA, 17 bp, Homo sapiens
ggccccgccagggctgg

SEQ ID NO: 3273770 - DNA, 20 bp, Homo sapiens
ggccccgccagggctgggga

SEQ ID NO: 3273771 - DNA, 13 bp, Homo sapiens
ggcccctcaacag

SEQ ID NO: 3273772 - DNA, 19 bp, Homo sapiens
ggcccctcaccctgcctta

SEQ ID NO: 3273773 - DNA, 21 bp, Homo sapiens
ggcccctcagagccctgccct

SEQ ID NO: 3273774 - DNA, 12 bp, Homo sapiens
ggcccctccacg

SEQ ID NO: 3273775 - DNA, 23 bp, Homo sapiens
ggcccctccacgcctcctggcca

SEQ ID NO: 3273776 - DNA, 12 bp, Homo sapiens
ggcccctccact

SEQ ID NO: 3273777 - DNA, 17 bp, Homo sapiens
ggcccctccatccaccc

SEQ ID NO: 3273778 - DNA, 16 bp, Homo sapiens
ggcccctccccctgag

SEQ ID NO: 3273779 - DNA, 17 bp, Homo sapiens
ggcccctccctctgccc

SEQ ID NO: 3273780 - DNA, 21 bp, Homo sapiens
ggcccctccctctgccccaag

SEQ ID NO: 3273781 - DNA, 19 bp, Homo sapiens
ggcccctcctagacccagg

SEQ ID NO: 3273782 - DNA, 19 bp, Homo sapiens
ggcccctgaggactggaga

SEQ ID NO: 3273783 - DNA, 17 bp, Homo sapiens
ggcccctgccaccctgg

SEQ ID NO: 3273784 - DNA, 21 bp, Homo sapiens
ggcccctgcttctccagcctg

SEQ ID NO: 3273785 - DNA, 16 bp, Homo sapiens
ggcccctggcagcaca

SEQ ID NO: 3273786 - DNA, 19 bp, Homo sapiens
ggcccctggcagcacagcc

SEQ ID NO: 3273787 - DNA, 20 bp, Homo sapiens
ggccccttttcactccctcc

SEQ ID NO: 3273788 - DNA, 21 bp, Homo sapiens
ggcccgcagtgctgggaccag

SEQ ID NO: 3273789 - DNA, 23 bp, Homo sapiens
ggcccgcagtgctgggaccagag

SEQ ID NO: 3273790 - DNA, 16 bp, Homo sapiens
ggcccggccagcgggc

SEQ ID NO: 3273791 - DNA, 20 bp, Homo sapiens
ggcccggccagcgggcacag

SEQ ID NO: 3273792 - DNA, 13 bp, Homo sapiens
ggcccggccggcc

SEQ ID NO: 3273793 - DNA, 15 bp, Homo sapiens
ggcccggccggcctg

SEQ ID NO: 3273794 - DNA, 16 bp, Homo sapiens
ggcccggtggcggcag

SEQ ID NO: 3273795 - DNA, 13 bp, Homo sapiens
ggcccgtgcagct

SEQ ID NO: 3273796 - DNA, 21 bp, Homo sapiens
ggccctcatctatgaggaaag

SEQ ID NO: 3273797 - DNA, 23 bp, Homo sapiens
ggccctccctgactccctgtggg

SEQ ID NO: 3273798 - DNA, 14 bp, Homo sapiens
ggccctcctgtgct

SEQ ID NO: 3273799 - DNA, 23 bp, Homo sapiens
ggccctcgacactcaccatgaag

SEQ ID NO: 3273800 - DNA, 14 bp, Homo sapiens
ggccctctctctgg

SEQ ID NO: 3273801 - DNA, 16 bp, Homo sapiens
ggccctctctgcaccg

SEQ ID NO: 3273802 - DNA, 18 bp, Homo sapiens
ggccctctcttctcacct

SEQ ID NO: 3273803 - DNA, 16 bp, Homo sapiens
ggccctgaggtgtggg

SEQ ID NO: 3273804 - DNA, 18 bp, Homo sapiens
ggccctgaggtgtggggg

SEQ ID NO: 3273805 - DNA, 21 bp, Homo sapiens
ggccctgaggtgtgggggctg

SEQ ID NO: 3273806 - DNA, 22 bp, Homo sapiens
ggccctgcaatgtatcccttct

SEQ ID NO: 3273807 - DNA, 18 bp, Homo sapiens
ggccctgcacctgtgcag

SEQ ID NO: 3273808 - DNA, 17 bp, Homo sapiens
ggccctgcagccagctc

SEQ ID NO: 3273809 - DNA, 15 bp, Homo sapiens
ggccctgcagtgttc

SEQ ID NO: 3273810 - DNA, 19 bp, Homo sapiens
ggccctgccccctcccact

SEQ ID NO: 3273811 - DNA, 19 bp, Homo sapiens
ggccctgccctgaggaagg

SEQ ID NO: 3273812 - DNA, 15 bp, Homo sapiens
ggccctgcctcctgg

SEQ ID NO: 3273813 - DNA, 21 bp, Homo sapiens
ggccctgctcctgcagcatgg

SEQ ID NO: 3273814 - DNA, 12 bp, Homo sapiens
ggccctggagga

SEQ ID NO: 3273815 - DNA, 15 bp, Homo sapiens
ggccctggcaccccc

SEQ ID NO: 3273816 - DNA, 22 bp, Homo sapiens
ggccctggcacccccacaagct

SEQ ID NO: 3273817 - DNA, 19 bp, Homo sapiens
ggccctggccctttcccct

SEQ ID NO: 3273818 - DNA, 13 bp, Homo sapiens
ggccctggctccc

SEQ ID NO: 3273819 - DNA, 12 bp, Homo sapiens
ggccctgggctg

SEQ ID NO: 3273820 - DNA, 15 bp, Homo sapiens
ggccctggggtccca

SEQ ID NO: 3273821 - DNA, 15 bp, Homo sapiens
ggccctggtccttcc

SEQ ID NO: 3273822 - DNA, 20 bp, Homo sapiens
ggccctgtccctcccacctc

SEQ ID NO: 3273823 - DNA, 22 bp, Homo sapiens
ggccctgtccctcccacctctg

SEQ ID NO: 3273824 - DNA, 23 bp, Homo sapiens
ggccctgtccctcccacctctgt

SEQ ID NO: 3273825 - DNA, 21 bp, Homo sapiens
ggcccttcaggaactggggct

SEQ ID NO: 3273826 - DNA, 22 bp, Homo sapiens
ggcatttctatactttacagga

SEQ ID NO: 3273827 - DNA, 17 bp, Homo sapiens
ggccaaaagctagacag

SEQ ID NO: 3273828 - DNA, 17 bp, Homo sapiens
ggccaaacatcagacct

SEQ ID NO: 3273829 - DNA, 21 bp, Homo sapiens
ggccaaacccttgctttcctg

SEQ ID NO: 3273830 - DNA, 15 bp, Homo sapiens
ggccaaacctgggac

SEQ ID NO: 3273831 - DNA, 16 bp, Homo sapiens
ggccaaaggctggtgg

SEQ ID NO: 3273832 - DNA, 14 bp, Homo sapiens
ggccaaccagcccg

SEQ ID NO: 3273833 - DNA, 20 bp, Homo sapiens
ggccaaccagcccgacagtg

SEQ ID NO: 3273834 - DNA, 21 bp, Homo sapiens
ggccaactgcaaaaaaagcct

SEQ ID NO: 3273835 - DNA, 23 bp, Homo sapiens
ggccaacttgagggcccagagca

SEQ ID NO: 3273836 - DNA, 23 bp, Homo sapiens
ggccaagacttggcaacagaagc

SEQ ID NO: 3273837 - DNA, 16 bp, Homo sapiens
ggccaagtccgcagaa

SEQ ID NO: 3273838 - DNA, 23 bp, Homo sapiens
ggccaagtccgcagaagccctga

SEQ ID NO: 3273839 - DNA, 14 bp, Homo sapiens
ggccaataaaaagt

SEQ ID NO: 3273840 - DNA, 15 bp, Homo sapiens
ggccaataaaaagtt

SEQ ID NO: 3273841 - DNA, 16 bp, Homo sapiens
ggccaataaaaagttc

SEQ ID NO: 3273842 - DNA, 17 bp, Homo sapiens
ggccaataaaaagttca

SEQ ID NO: 3273843 - DNA, 21 bp, Homo sapiens
ggccaataaaaagttcagagt

SEQ ID NO: 3273844 - DNA, 22 bp, Homo sapiens
ggccaatggaaacctcacgctg

SEQ ID NO: 3273845 - DNA, 21 bp, Homo sapiens
ggccacagcccccttgccctc

SEQ ID NO: 3273846 - DNA, 20 bp, Homo sapiens
ggccacagggcgagactccg

SEQ ID NO: 3273847 - DNA, 13 bp, Homo sapiens
ggccaccaaagct

SEQ ID NO: 3273848 - DNA, 16 bp, Homo sapiens
ggccaccaaagctgcc

SEQ ID NO: 3273849 - DNA, 17 bp, Homo sapiens
ggccaccaaagctgccc

SEQ ID NO: 3273850 - DNA, 15 bp, Homo sapiens
ggccaccaggctggc

SEQ ID NO: 3273851 - DNA, 19 bp, Homo sapiens
ggccaccccctatcctctg

SEQ ID NO: 3273852 - DNA, 16 bp, Homo sapiens
ggccacctccccagca

SEQ ID NO: 3273853 - DNA, 11 bp, Homo sapiens
ggccacctcct

SEQ ID NO: 3273854 - DNA, 17 bp, Homo sapiens
ggccacctcctccccct

SEQ ID NO: 3273855 - DNA, 18 bp, Homo sapiens
ggccacctcctccccctg

SEQ ID NO: 3273856 - DNA, 13 bp, Homo sapiens
ggccacctctcca

SEQ ID NO: 3273857 - DNA, 20 bp, Homo sapiens
ggccacctctccaagggctt

SEQ ID NO: 3273858 - DNA, 22 bp, Homo sapiens
ggccacctgtagccatctgcac

SEQ ID NO: 3273859 - DNA, 23 bp, Homo sapiens
ggccacctgtagccatctgcaca

SEQ ID NO: 3273860 - DNA, 17 bp, Homo sapiens
ggccacgcactgggcca

SEQ ID NO: 3273861 - DNA, 18 bp, Homo sapiens
ggccacgcactgggccac

SEQ ID NO: 3273862 - DNA, 17 bp, Homo sapiens
ggccacgccccagcccg

SEQ ID NO: 3273863 - DNA, 13 bp, Homo sapiens
ggccacggaggag

SEQ ID NO: 3273864 - DNA, 22 bp, Homo sapiens
ggccacggaggagggatgctgc

SEQ ID NO: 3273865 - DNA, 17 bp, Homo sapiens
ggccactccagacccct

SEQ ID NO: 3273866 - DNA, 15 bp, Homo sapiens
ggccactgcacagag

SEQ ID NO: 3273867 - DNA, 18 bp, Homo sapiens
ggccactgcacagagctc

SEQ ID NO: 3273868 - DNA, 13 bp, Homo sapiens
ggccactggggac

SEQ ID NO: 3273869 - DNA, 20 bp, Homo sapiens
ggccactggggactttattt

SEQ ID NO: 3273870 - DNA, 18 bp, Homo sapiens
ggccactgtggccagagc

SEQ ID NO: 3273871 - DNA, 19 bp, Homo sapiens
ggccactgtggccagagct

SEQ ID NO: 3273872 - DNA, 19 bp, Homo sapiens
ggccactttcagagccccc

SEQ ID NO: 3273873 - DNA, 13 bp, Homo sapiens
ggccagaaggagg

SEQ ID NO: 3273874 - DNA, 20 bp, Homo sapiens
ggccagaaggagggcagagc

SEQ ID NO: 3273875 - DNA, 21 bp, Homo sapiens
ggccagaaggagggcagagcc

SEQ ID NO: 3273876 - DNA, 22 bp, Homo sapiens
ggccagaaggagggcagagcca

SEQ ID NO: 3273877 - DNA, 13 bp, Homo sapiens
ggccagactggaa

SEQ ID NO: 3273878 - DNA, 17 bp, Homo sapiens
ggccagactggaagaca

SEQ ID NO: 3273879 - DNA, 22 bp, Homo sapiens
ggccagactggaagacacttca

SEQ ID NO: 3273880 - DNA, 13 bp, Homo sapiens
ggccagagagggc

SEQ ID NO: 3273881 - DNA, 17 bp, Homo sapiens
ggccagagagggcccag

SEQ ID NO: 3273882 - DNA, 15 bp, Homo sapiens
ggccagagctggaag

SEQ ID NO: 3273883 - DNA, 16 bp, Homo sapiens
ggccagagctggaagg

SEQ ID NO: 3273884 - DNA, 19 bp, Homo sapiens
ggccagagctggaaggcag

SEQ ID NO: 3273885 - DNA, 17 bp, Homo sapiens
ggccagagctgggaggc

SEQ ID NO: 3273886 - DNA, 16 bp, Homo sapiens
ggccagaggcccccag

SEQ ID NO: 3273887 - DNA, 14 bp, Homo sapiens
ggccagagggagct

SEQ ID NO: 3273888 - DNA, 14 bp, Homo sapiens
ggccagagtggcct

SEQ ID NO: 3273889 - DNA, 23 bp, Homo sapiens
ggccagatgcacatccctggaag

SEQ ID NO: 3273890 - DNA, 19 bp, Homo sapiens
ggccagatgcaccagccct

SEQ ID NO: 3273891 - DNA, 13 bp, Homo sapiens
ggccagcaccctc

SEQ ID NO: 3273892 - DNA, 12 bp, Homo sapiens
ggccagccaggc

SEQ ID NO: 3273893 - DNA, 14 bp, Homo sapiens
ggccagccaggcgg

SEQ ID NO: 3273894 - DNA, 13 bp, Homo sapiens
ggccagcccagcc

SEQ ID NO: 3273895 - DNA, 15 bp, Homo sapiens
ggccagcccagccag

SEQ ID NO: 3273896 - DNA, 20 bp, Homo sapiens
ggccagccccacccaggagg

SEQ ID NO: 3273897 - DNA, 20 bp, Homo sapiens
ggccagccccacccccagcc

SEQ ID NO: 3273898 - DNA, 22 bp, Homo sapiens
ggccagccccacccccagccag

SEQ ID NO: 3273899 - DNA, 16 bp, Homo sapiens
ggccagcccggctggt

SEQ ID NO: 3273900 - DNA, 18 bp, Homo sapiens
ggccagccctgcagccca

SEQ ID NO: 3273901 - DNA, 17 bp, Homo sapiens
ggccagcccttcctctc

SEQ ID NO: 3273902 - DNA, 24 bp, Homo sapiens
ggccagcccttcctctcactcctg

SEQ ID NO: 3273903 - DNA, 14 bp, Homo sapiens
ggccagcctagccc

SEQ ID NO: 3273904 - DNA, 14 bp, Homo sapiens
ggccagcctcaccc

SEQ ID NO: 3273905 - DNA, 18 bp, Homo sapiens
ggccagcctcacccttgc

SEQ ID NO: 3273906 - DNA, 19 bp, Homo sapiens
ggccagcctccgagaggga

SEQ ID NO: 3273907 - DNA, 20 bp, Homo sapiens
ggccagcctccgagagggag

SEQ ID NO: 3273908 - DNA, 13 bp, Homo sapiens
ggccagcctggat

SEQ ID NO: 3273909 - DNA, 18 bp, Homo sapiens
ggccagcctggggcctgg

SEQ ID NO: 3273910 - DNA, 20 bp, Homo sapiens
ggccagcctggggcctggca

SEQ ID NO: 3273911 - DNA, 16 bp, Homo sapiens
ggccagcgggcacagg

SEQ ID NO: 3273912 - DNA, 17 bp, Homo sapiens
ggccagcgggcacaggg

SEQ ID NO: 3273913 - DNA, 18 bp, Homo sapiens
ggccagcgggcacagggc

SEQ ID NO: 3273914 - DNA, 16 bp, Homo sapiens
ggccagcgtcccaggg

SEQ ID NO: 3273915 - DNA, 19 bp, Homo sapiens
ggccagctgccccagccag

SEQ ID NO: 3273916 - DNA, 21 bp, Homo sapiens
ggccaggaaggacagactggc

SEQ ID NO: 3273917 - DNA, 22 bp, Homo sapiens
ggccaggaccacacagtcccca

SEQ ID NO: 3273918 - DNA, 13 bp, Homo sapiens
ggccaggagcagg

SEQ ID NO: 3273919 - DNA, 13 bp, Homo sapiens
ggccaggagctct

SEQ ID NO: 3273920 - DNA, 17 bp, Homo sapiens
ggccaggaggtagtttc

SEQ ID NO: 3273921 - DNA, 17 bp, Homo sapiens
ggccaggcacagggccc

SEQ ID NO: 3273922 - DNA, 15 bp, Homo sapiens
ggccaggcagatctg

SEQ ID NO: 3273923 - DNA, 11 bp, Homo sapiens
ggccaggcagg

SEQ ID NO: 3273924 - DNA, 14 bp, Homo sapiens
ggccaggccagagg

SEQ ID NO: 3273925 - DNA, 12 bp, Homo sapiens
ggccaggcccag

SEQ ID NO: 3273926 - DNA, 15 bp, Homo sapiens
ggccaggcccaggca

SEQ ID NO: 3273927 - DNA, 16 bp, Homo sapiens
ggccaggcccaggcag

SEQ ID NO: 3273928 - DNA, 13 bp, Homo sapiens
ggccaggctggtc

SEQ ID NO: 3273929 - DNA, 10 bp, Homo sapiens
ggccagggca

SEQ ID NO: 3273930 - DNA, 12 bp, Homo sapiens
ggccagggcagg

SEQ ID NO: 3273931 - DNA, 21 bp, Homo sapiens
ggccagggccacgctccagct

SEQ ID NO: 3273932 - DNA, 13 bp, Homo sapiens
ggccagggccctg

SEQ ID NO: 3273933 - DNA, 16 bp, Homo sapiens
ggccagggccctgcag

SEQ ID NO: 3273934 - DNA, 14 bp, Homo sapiens
ggccagggctgccc

SEQ ID NO: 3273935 - DNA, 23 bp, Homo sapiens
ggccagggtctgtgtgaatgtgg

SEQ ID NO: 3273936 - DNA, 11 bp, Homo sapiens
ggccaggtcac

SEQ ID NO: 3273937 - DNA, 17 bp, Homo sapiens
ggccaggtttctgccca

SEQ ID NO: 3273938 - DNA, 16 bp, Homo sapiens
ggccagtacctttcca

SEQ ID NO: 3273939 - DNA, 23 bp, Homo sapiens
ggccagtccccgaggagctgggc

SEQ ID NO: 3273940 - DNA, 20 bp, Homo sapiens
ggccagtcctgcctggccag

SEQ ID NO: 3273941 - DNA, 21 bp, Homo sapiens
ggccagtcctgcctggccagg

SEQ ID NO: 3273942 - DNA, 13 bp, Homo sapiens
ggccagtctgtgg

SEQ ID NO: 3273943 - DNA, 15 bp, Homo sapiens
ggccagtctgtggat

SEQ ID NO: 3273944 - DNA, 15 bp, Homo sapiens
ggccagtggaagaaa

SEQ ID NO: 3273945 - DNA, 17 bp, Homo sapiens
ggccagtggggcctgtg

SEQ ID NO: 3273946 - DNA, 19 bp, Homo sapiens
ggccagtggggcctgtgga

SEQ ID NO: 3273947 - DNA, 13 bp, Homo sapiens
ggccagtgtctgg

SEQ ID NO: 3273948 - DNA, 14 bp, Homo sapiens
ggccagtgtctggg

SEQ ID NO: 3273949 - DNA, 16 bp, Homo sapiens
ggccagtgtgacaagg

SEQ ID NO: 3273950 - DNA, 16 bp, Homo sapiens
ggccagttgcccagag

SEQ ID NO: 3273951 - DNA, 22 bp, Homo sapiens
ggccagttgcccagagcacttt

SEQ ID NO: 3273952 - DNA, 22 bp, Homo sapiens
ggccataaacggttcctggtga

SEQ ID NO: 3273953 - DNA, 23 bp, Homo sapiens
ggccataaacggttcctggtgac

SEQ ID NO: 3273954 - DNA, 23 bp, Homo sapiens
ggccatatttgtggcccgtgcag

SEQ ID NO: 3273955 - DNA, 18 bp, Homo sapiens
ggcccttcctctccactg

SEQ ID NO: 3273956 - DNA, 22 bp, Homo sapiens
ggcccttcctctccactgcctt

SEQ ID NO: 3273957 - DNA, 18 bp, Homo sapiens
ggcccttgcctttgtggc

SEQ ID NO: 3273958 - DNA, 11 bp, Homo sapiens
ggcccttggaa

SEQ ID NO: 3273959 - DNA, 18 bp, Homo sapiens
ggcccttgggacagccag

SEQ ID NO: 3273960 - DNA, 21 bp, Homo sapiens
ggcccttggggcctggcttgc

SEQ ID NO: 3273961 - DNA, 16 bp, Homo sapiens
ggcccttggggctggg

SEQ ID NO: 3273962 - DNA, 15 bp, Homo sapiens
ggcccttgtcctgcc

SEQ ID NO: 3273963 - DNA, 16 bp, Homo sapiens
ggcccttgtcctgcca

SEQ ID NO: 3273964 - DNA, 18 bp, Homo sapiens
ggcccttgtcctgccagc

SEQ ID NO: 3273965 - DNA, 19 bp, Homo sapiens
ggcccttgtcctgccagct

SEQ ID NO: 3273966 - DNA, 23 bp, Homo sapiens
ggcccttgtcctgccagctgcct

SEQ ID NO: 3273967 - DNA, 14 bp, Homo sapiens
ggccctttcccctt

SEQ ID NO: 3273968 - DNA, 19 bp, Homo sapiens
ggccgaaggtgcctcagac

SEQ ID NO: 3273969 - DNA, 20 bp, Homo sapiens
ggccgagcgttcccagcagg

SEQ ID NO: 3273970 - DNA, 20 bp, Homo sapiens
ggccgcagctcttgcccttc

SEQ ID NO: 3273971 - DNA, 21 bp, Homo sapiens
ggccgcagctcttgcccttcc

SEQ ID NO: 3273972 - DNA, 23 bp, Homo sapiens
ggccgcagctcttgcccttccct

SEQ ID NO: 3273973 - DNA, 17 bp, Homo sapiens
ggccgccacggcctggc

SEQ ID NO: 3273974 - DNA, 12 bp, Homo sapiens
ggccgccccctg

SEQ ID NO: 3273975 - DNA, 18 bp, Homo sapiens
ggccgccccctgcccccc

SEQ ID NO: 3273976 - DNA, 22 bp, Homo sapiens
ggccgccccctgccccccagcc

SEQ ID NO: 3273977 - DNA, 16 bp, Homo sapiens
ggccggaaccacaggg

SEQ ID NO: 3273978 - DNA, 20 bp, Homo sapiens
ggccggaaccacagggccag

SEQ ID NO: 3273979 - DNA, 13 bp, Homo sapiens
ggccgggcaggcg

SEQ ID NO: 3273980 - DNA, 15 bp, Homo sapiens
ggccgggggaggggc

SEQ ID NO: 3273981 - DNA, 20 bp, Homo sapiens
ggccggtctgcaagtcagag

SEQ ID NO: 3273982 - DNA, 23 bp, Homo sapiens
ggccggtctgcaagtcagaggat

SEQ ID NO: 3273983 - DNA, 15 bp, Homo sapiens
ggccggtgtgggctg

SEQ ID NO: 3273984 - DNA, 18 bp, Homo sapiens
ggccgtctcctccctcag

SEQ ID NO: 3273985 - DNA, 15 bp, Homo sapiens
ggccgtgaggacacg

SEQ ID NO: 3273986 - DNA, 13 bp, Homo sapiens
ggccgtgtctctg

SEQ ID NO: 3273987 - DNA, 16 bp, Homo sapiens
ggcctaaaagtaaaca

SEQ ID NO: 3273988 - DNA, 14 bp, Homo sapiens
ggcctaaaatcttg

SEQ ID NO: 3273989 - DNA, 14 bp, Homo sapiens
ggcctaagacatgt

SEQ ID NO: 3273990 - DNA, 20 bp, Homo sapiens
ggcctaccccgcagacacct

SEQ ID NO: 3273991 - DNA, 18 bp, Homo sapiens
ggcctaggtgcagctcct

SEQ ID NO: 3273992 - DNA, 20 bp, Homo sapiens
ggcctataatgaagctttat

SEQ ID NO: 3273993 - DNA, 14 bp, Homo sapiens
ggcctatgtggtct

SEQ ID NO: 3273994 - DNA, 17 bp, Homo sapiens
ggcctcacccacccctg

SEQ ID NO: 3273995 - DNA, 14 bp, Homo sapiens
ggcctcactggctg

SEQ ID NO: 3273996 - DNA, 23 bp, Homo sapiens
ggcctcactggctggggcagagg

SEQ ID NO: 3273997 - DNA, 10 bp, Homo sapiens
ggcctcagaa

SEQ ID NO: 3273998 - DNA, 10 bp, Homo sapiens
ggcctcagcc

SEQ ID NO: 3273999 - DNA, 15 bp, Homo sapiens
ggcctcagccctcag

SEQ ID NO: 3274000 - DNA, 17 bp, Homo sapiens
ggcctcagctgaatgcc

SEQ ID NO: 3274001 - DNA, 13 bp, Homo sapiens
ggcctcagctgcc

SEQ ID NO: 3274002 - DNA, 17 bp, Homo sapiens
ggcctcagctgcctcac

SEQ ID NO: 3274003 - DNA, 14 bp, Homo sapiens
ggcctcaggctctg

SEQ ID NO: 3274004 - DNA, 20 bp, Homo sapiens
ggcctcagggccaggaagga

SEQ ID NO: 3274005 - DNA, 14 bp, Homo sapiens
ggctcagcccgctg

SEQ ID NO: 3274006 - DNA, 20 bp, Homo sapiens
ggctcagcggggacagctcc

SEQ ID NO: 3274007 - DNA, 21 bp, Homo sapiens
ggctcagcggggacagctcct

SEQ ID NO: 3274008 - DNA, 22 bp, Homo sapiens
ggctcaggatttcgtgggtctg

SEQ ID NO: 3274009 - DNA, 14 bp, Homo sapiens
ggctcaggcaagcc

SEQ ID NO: 3274010 - DNA, 14 bp, Homo sapiens
ggctcagggaggga

SEQ ID NO: 3274011 - DNA, 17 bp, Homo sapiens
ggctcagggctggagtg

SEQ ID NO: 3274012 - DNA, 15 bp, Homo sapiens
ggctcagtctcagga

SEQ ID NO: 3274013 - DNA, 22 bp, Homo sapiens
ggctcatggcgtaatgggcctg

SEQ ID NO: 3274014 - DNA, 14 bp, Homo sapiens
ggctccagaaatgt

SEQ ID NO: 3274015 - DNA, 14 bp, Homo sapiens
ggctccagcatcca

SEQ ID NO: 3274016 - DNA, 15 bp, Homo sapiens
ggctccagcatccag

SEQ ID NO: 3274017 - DNA, 18 bp, Homo sapiens
ggctccagcatccagcct

SEQ ID NO: 3274018 - DNA, 12 bp, Homo sapiens
ggctccagctca

SEQ ID NO: 3274019 - DNA, 13 bp, Homo sapiens
ggctccaggactc

SEQ ID NO: 3274020 - DNA, 12 bp, Homo sapiens
ggctccaggctc

SEQ ID NO: 3274021 - DNA, 18 bp, Homo sapiens
ggctccatgattctctga

SEQ ID NO: 3274022 - DNA, 20 bp, Homo sapiens
ggctccatgattctctgagt

SEQ ID NO: 3274023 - DNA, 21 bp, Homo sapiens
ggctcccacaggcccttcctc

SEQ ID NO: 3274024 - DNA, 21 bp, Homo sapiens
ggctcccaggggtctccctgg

SEQ ID NO: 3274025 - DNA, 21 bp, Homo sapiens
ggctcccatgggctgagtggg

SEQ ID NO: 3274026 - DNA, 15 bp, Homo sapiens
ggctccccagggctc

SEQ ID NO: 3274027 - DNA, 22 bp, Homo sapiens
ggctccccatgtgtcctggttc

SEQ ID NO: 3274028 - DNA, 22 bp, Homo sapiens
ggctccctcccgtagtctcctg

SEQ ID NO: 3274029 - DNA, 16 bp, Homo sapiens
ggctccctcctccagg

SEQ ID NO: 3274030 - DNA, 20 bp, Homo sapiens
ggctccctcctccaggcctg

SEQ ID NO: 3274031 - DNA, 15 bp, Homo sapiens
ggctccctctctggt

SEQ ID NO: 3274032 - DNA, 23 bp, Homo sapiens
ggctccctgatgacacccaccct

SEQ ID NO: 3274033 - DNA, 14 bp, Homo sapiens
ggctccctggcagg

SEQ ID NO: 3274034 - DNA, 17 bp, Homo sapiens
ggctccctggcaggatg

SEQ ID NO: 3274035 - DNA, 21 bp, Homo sapiens
ggctccgcccttagtccccca

SEQ ID NO: 3274036 - DNA, 17 bp, Homo sapiens
ggctcctcccggtgccc

SEQ ID NO: 3274037 - DNA, 18 bp, Homo sapiens
ggctcctgccttctgtcc

SEQ ID NO: 3274038 - DNA, 13 bp, Homo sapiens
ggctcctggctgc

SEQ ID NO: 3274039 - DNA, 16 bp, Homo sapiens
ggctcctggctgccag

SEQ ID NO: 3274040 - DNA, 18 bp, Homo sapiens
ggctcctggtggccttct

SEQ ID NO: 3274041 - DNA, 12 bp, Homo sapiens
ggctcctttctc

SEQ ID NO: 3274042 - DNA, 19 bp, Homo sapiens
ggctcctttctccagccag

SEQ ID NO: 3274043 - DNA, 21 bp, Homo sapiens
ggctcctttctccagccagca

SEQ ID NO: 3274044 - DNA, 21 bp, Homo sapiens
ggctcgagcagtcctgcctca

SEQ ID NO: 3274045 - DNA, 19 bp, Homo sapiens
ggctctaattcacagtgct

SEQ ID NO: 3274046 - DNA, 22 bp, Homo sapiens
ggctgggccctctttccctgcg

SEQ ID NO: 3274047 - DNA, 14 bp, Homo sapiens
ggctgggctcacag

SEQ ID NO: 3274048 - DNA, 17 bp, Homo sapiens
ggctgggctcacaggcc

SEQ ID NO: 3274049 - DNA, 22 bp, Homo sapiens
ggctgggctcacaggcctctct

SEQ ID NO: 3274050 - DNA, 13 bp, Homo sapiens
ggctggggcagag

SEQ ID NO: 3274051 - DNA, 15 bp, Homo sapiens
ggctggggcggggcc

SEQ ID NO: 3274052 - DNA, 14 bp, Homo sapiens
ggctggggctgctc

SEQ ID NO: 3274053 - DNA, 14 bp, Homo sapiens
ggctggggtgagag

SEQ ID NO: 3274054 - DNA, 18 bp, Homo sapiens
ggctgggtcagggccaga

SEQ ID NO: 3274055 - DNA, 19 bp, Homo sapiens
ggctggtaacagttcatgt

SEQ ID NO: 3274056 - DNA, 15 bp, Homo sapiens
ggctggtagctcagg

SEQ ID NO: 3274057 - DNA, 16 bp, Homo sapiens
ggctggtagctcaggt

SEQ ID NO: 3274058 - DNA, 13 bp, Homo sapiens
ggctggtccaggg

SEQ ID NO: 3274059 - DNA, 16 bp, Homo sapiens
ggctggtgccccacag

SEQ ID NO: 3274060 - DNA, 17 bp, Homo sapiens
ggctggtgggaggggcg

SEQ ID NO: 3274061 - DNA, 16 bp, Homo sapiens
ggctggtgtcacctga

SEQ ID NO: 3274062 - DNA, 21 bp, Homo sapiens
ggctggttttgtaagatgctg

SEQ ID NO: 3274063 - DNA, 22 bp, Homo sapiens
ggctgtaaatcctagacttgaa

SEQ ID NO: 3274064 - DNA, 14 bp, Homo sapiens
ggctgtaaattgaa

SEQ ID NO: 3274065 - DNA, 19 bp, Homo sapiens
ggctgtatcccatgagcct

SEQ ID NO: 3274066 - DNA, 20 bp, Homo sapiens
ggctgtatcccatgagcctc

SEQ ID NO: 3274067 - DNA, 22 bp, Homo sapiens
ggctgtatcccatgagcctcag

SEQ ID NO: 3274068 - DNA, 13 bp, Homo sapiens
ggctgtctgcctg

SEQ ID NO: 3274069 - DNA, 20 bp, Homo sapiens
ggctgtgaagacccaggaga

SEQ ID NO: 3274070 - DNA, 11 bp, Homo sapiens
ggctgtgccaa

SEQ ID NO: 3274071 - DNA, 16 bp, Homo sapiens
ggctgtgcctctgcct

SEQ ID NO: 3274072 - DNA, 22 bp, Homo sapiens
ggctgtgctgcttttgagcctc

SEQ ID NO: 3274073 - DNA, 12 bp, Homo sapiens
ggctgtggagca

SEQ ID NO: 3274074 - DNA, 22 bp, Homo sapiens
ggctgtggagcaaaaggcagct

SEQ ID NO: 3274075 - DNA, 14 bp, Homo sapiens
ggctgtggaggcct

SEQ ID NO: 3274076 - DNA, 15 bp, Homo sapiens
ggctgtggaggcctg

SEQ ID NO: 3274077 - DNA, 22 bp, Homo sapiens
ggctgtggccgtctcctccctc

SEQ ID NO: 3274078 - DNA, 14 bp, Homo sapiens
ggctgtgggcaagc

SEQ ID NO: 3274079 - DNA, 22 bp, Homo sapiens
ggctgtgggcctcaaggacttg

SEQ ID NO: 3274080 - DNA, 15 bp, Homo sapiens
ggctgtggtcacagc

SEQ ID NO: 3274081 - DNA, 18 bp, Homo sapiens
ggctgtgtgaatttttct

SEQ ID NO: 3274082 - DNA, 21 bp, Homo sapiens
ggctgttctgcactgaaaagg

SEQ ID NO: 3274083 - DNA, 18 bp, Homo sapiens
ggctgttctgtggttcct

SEQ ID NO: 3274084 - DNA, 17 bp, Homo sapiens
ggctgttgaagtcacct

SEQ ID NO: 3274085 - DNA, 17 bp, Homo sapiens
ggctgttggcagtgagt

SEQ ID NO: 3274086 - DNA, 15 bp, Homo sapiens
ggcttaaaacaacac

SEQ ID NO: 3274087 - DNA, 22 bp, Homo sapiens
ggcttaataaaaatgacagact

SEQ ID NO: 3274088 - DNA, 14 bp, Homo sapiens
ggcttaatcatttt

SEQ ID NO: 3274089 - DNA, 22 bp, Homo sapiens
ggcttacctgacctcttgctgt

SEQ ID NO: 3274090 - DNA, 23 bp, Homo sapiens
ggcttacctgacctcttgctgtc

SEQ ID NO: 3274091 - DNA, 21 bp, Homo sapiens
ggcttataaacacattgaatg

SEQ ID NO: 3274092 - DNA, 20 bp, Homo sapiens
ggcttattttaatgtgatga

SEQ ID NO: 3274093 - DNA, 16 bp, Homo sapiens
ggcttcaccagtctgt

SEQ ID NO: 3274094 - DNA, 21 bp, Homo sapiens
ggcttcaccagtctgtctact

SEQ ID NO: 3274095 - DNA, 22 bp, Homo sapiens
ggcttcactgtataaataggag

SEQ ID NO: 3274096 - DNA, 17 bp, Homo sapiens
ggcttcagcatatttat

SEQ ID NO: 3274097 - DNA, 20 bp, Homo sapiens
ggcttcagcatatttatagc

SEQ ID NO: 3274098 - DNA, 18 bp, Homo sapiens
ggcttcaggccgagccag

SEQ ID NO: 3274099 - DNA, 16 bp, Homo sapiens
ggcttcagtggcagct

SEQ ID NO: 3274100 - DNA, 15 bp, Homo sapiens
ggcttccagcttcag

SEQ ID NO: 3274101 - DNA, 14 bp, Homo sapiens
ggcttcccgctcag

SEQ ID NO: 3274102 - DNA, 15 bp, Homo sapiens
ggcttcccgctcagc

SEQ ID NO: 3274103 - DNA, 21 bp, Homo sapiens
ggcttcccgctcagccctccc

SEQ ID NO: 3274104 - DNA, 20 bp, Homo sapiens
ggcttccctgacttgcttta

SEQ ID NO: 3274105 - DNA, 19 bp, Homo sapiens
ggcttcctccgtccaccca

SEQ ID NO: 3274106 - DNA, 21 bp, Homo sapiens
ggcttcctccgtccacccagg

SEQ ID NO: 3274107 - DNA, 19 bp, Homo sapiens
ggcttcgttagaccgctct

SEQ ID NO: 3274108 - DNA, 11 bp, Homo sapiens
ggcttctcctg

SEQ ID NO: 3274109 - DNA, 12 bp, Homo sapiens
ggcttctcctga

SEQ ID NO: 3274110 - DNA, 13 bp, Homo sapiens
ggcttctcctgac

SEQ ID NO: 3274111 - DNA, 12 bp, Homo sapiens
ggcttctcctgt

SEQ ID NO: 3274112 - DNA, 12 bp, Homo sapiens
ggcttctccttc

SEQ ID NO: 3274113 - DNA, 21 bp, Homo sapiens
ggcttctgagtttatattctg

SEQ ID NO: 3274114 - DNA, 16 bp, Homo sapiens
ggcttctggagccctt

SEQ ID NO: 3274115 - DNA, 12 bp, Homo sapiens
ggcttgaagcca

SEQ ID NO: 3274116 - DNA, 13 bp, Homo sapiens
ggcttgaagccaa

SEQ ID NO: 3274117 - DNA, 15 bp, Homo sapiens
ggcttgaagccaaag

SEQ ID NO: 3274118 - DNA, 16 bp, Homo sapiens
ggcttgagctgcagaa

SEQ ID NO: 3274119 - DNA, 19 bp, Homo sapiens
ggcttgcccgcgctctttc

SEQ ID NO: 3274120 - DNA, 14 bp, Homo sapiens
ggcttgctccaggg

SEQ ID NO: 3274121 - DNA, 16 bp, Homo sapiens
ggcttgctccagggtc

SEQ ID NO: 3274122 - DNA, 22 bp, Homo sapiens
ggcttggacttcctggggcccc

SEQ ID NO: 3274123 - DNA, 15 bp, Homo sapiens
ggcttggcctgctgt

SEQ ID NO: 3274124 - DNA, 16 bp, Homo sapiens
ggcttggcctgctgtg

SEQ ID NO: 3274125 - DNA, 15 bp, Homo sapiens
ggcttgggaaaaaaa

SEQ ID NO: 3274126 - DNA, 16 bp, Homo sapiens
ggcttgtagaattgtt

SEQ ID NO: 3274127 - DNA, 14 bp, Homo sapiens
ggcttgtgaactgc

SEQ ID NO: 3274128 - DNA, 14 bp, Homo sapiens
ggcttgtgggctgg

SEQ ID NO: 3274129 - DNA, 15 bp, Homo sapiens
ggcttgtgggctggt

SEQ ID NO: 3274130 - DNA, 22 bp, Homo sapiens
ggctttcattattagtactgct

SEQ ID NO: 3274131 - DNA, 13 bp, Homo sapiens
ggctttccttgtg

SEQ ID NO: 3274132 - DNA, 20 bp, Homo sapiens
ggctttccttgtggcagagg

SEQ ID NO: 3274133 - DNA, 14 bp, Homo sapiens
ggctttctggggcc

SEQ ID NO: 3274134 - DNA, 14 bp, Homo sapiens
ggctttgcaggctc

SEQ ID NO: 3274135 - DNA, 20 bp, Homo sapiens
ggctttgcaggctctgggct

SEQ ID NO: 3274136 - DNA, 18 bp, Homo sapiens
ggctttgccttgcagcca

SEQ ID NO: 3274137 - DNA, 14 bp, Homo sapiens
gggccagaggcagc

SEQ ID NO: 3274138 - DNA, 12 bp, Homo sapiens
gggccagccagg

SEQ ID NO: 3274139 - DNA, 15 bp, Homo sapiens
gggccagccaggcgg

SEQ ID NO: 3274140 - DNA, 16 bp, Homo sapiens
gggccagccaggcggg

SEQ ID NO: 3274141 - DNA, 18 bp, Homo sapiens
gggccagccaggcgggct

SEQ ID NO: 3274142 - DNA, 14 bp, Homo sapiens
gggccagcctagcc

SEQ ID NO: 3274143 - DNA, 15 bp, Homo sapiens
gggccagcctagccc

SEQ ID NO: 3274144 - DNA, 22 bp, Homo sapiens
gggccaggaaggacagactggc

SEQ ID NO: 3274145 - DNA, 14 bp, Homo sapiens
gggccaggactgag

SEQ ID NO: 3274146 - DNA, 17 bp, Homo sapiens
gggccaggactgagccc

SEQ ID NO: 3274147 - DNA, 12 bp, Homo sapiens
gggccaggccag

SEQ ID NO: 3274148 - DNA, 13 bp, Homo sapiens
gggccaggccagg

SEQ ID NO: 3274149 - DNA, 11 bp, Homo sapiens
gggccaggccc

SEQ ID NO: 3274150 - DNA, 14 bp, Homo sapiens
gggccagggccctg

SEQ ID NO: 3274151 - DNA, 20 bp, Homo sapiens
gggccagggctgccctgaga

SEQ ID NO: 3274152 - DNA, 15 bp, Homo sapiens
gggccagtcaggctg

SEQ ID NO: 3274153 - DNA, 15 bp, Homo sapiens
gggccagtcctgcct

SEQ ID NO: 3274154 - DNA, 15 bp, Homo sapiens
gggccagtctgggct

SEQ ID NO: 3274155 - DNA, 17 bp, Homo sapiens
gggccagtggggcctgt

SEQ ID NO: 3274156 - DNA, 21 bp, Homo sapiens
gggccataaacggttcctggt

SEQ ID NO: 3274157 - DNA, 19 bp, Homo sapiens
gggccatcacaggatgcca

SEQ ID NO: 3274158 - DNA, 19 bp, Homo sapiens
gggccatctgactgccaag

SEQ ID NO: 3274159 - DNA, 21 bp, Homo sapiens
gggccatctgactgccaagcc

SEQ ID NO: 3274160 - DNA, 23 bp, Homo sapiens
gggccatctgactgccaagccag

SEQ ID NO: 3274161 - DNA, 21 bp, Homo sapiens
gggccatgctgaggcctgggc

SEQ ID NO: 3274162 - DNA, 14 bp, Homo sapiens
gggccatgtccaaa

SEQ ID NO: 3274163 - DNA, 22 bp, Homo sapiens
gggccatgtccaaagaggctgc

SEQ ID NO: 3274164 - DNA, 18 bp, Homo sapiens
gggcccaagacagatgcc

SEQ ID NO: 3274165 - DNA, 18 bp, Homo sapiens
gggcccaagccccatctc

SEQ ID NO: 3274166 - DNA, 13 bp, Homo sapiens
gggcccacctggc

SEQ ID NO: 3274167 - DNA, 22 bp, Homo sapiens
gggcccacctggccacctgagg

SEQ ID NO: 3274168 - DNA, 23 bp, Homo sapiens
gggcccagaactgcccccactgt

SEQ ID NO: 3274169 - DNA, 17 bp, Homo sapiens
gggcccagagagggtgg

SEQ ID NO: 3274170 - DNA, 12 bp, Homo sapiens
gggcccagagca

SEQ ID NO: 3274171 - DNA, 13 bp, Homo sapiens
gggcccagatctg

SEQ ID NO: 3274172 - DNA, 18 bp, Homo sapiens
gggcccagccaggagcag

SEQ ID NO: 3274173 - DNA, 21 bp, Homo sapiens
gggcccagccaggagcagatg

SEQ ID NO: 3274174 - DNA, 16 bp, Homo sapiens
gggcccagctgtagcc

SEQ ID NO: 3274175 - DNA, 20 bp, Homo sapiens
gggcccagctgtagccatgg

SEQ ID NO: 3274176 - DNA, 16 bp, Homo sapiens
gggcccaggaagccca

SEQ ID NO: 3274177 - DNA, 24 bp, Homo sapiens
gggcccaggaccagctggggcgtg

SEQ ID NO: 3274178 - DNA, 13 bp, Homo sapiens
gggcccaggcagg

SEQ ID NO: 3274179 - DNA, 22 bp, Homo sapiens
gggcccataatagttagccctc

SEQ ID NO: 3274180 - DNA, 22 bp, Homo sapiens
gggccccaaacgggctgccctg

SEQ ID NO: 3274181 - DNA, 22 bp, Homo sapiens
gggccccacctacttgtgactg

SEQ ID NO: 3274182 - DNA, 14 bp, Homo sapiens
gggccccagatctg

SEQ ID NO: 3274183 - DNA, 17 bp, Homo sapiens
gggccccagatctgcct

SEQ ID NO: 3274184 - DNA, 18 bp, Homo sapiens
gggccccagatctgcctg

SEQ ID NO: 3274185 - DNA, 20 bp, Homo sapiens
gggccccagatctgcctggg

SEQ ID NO: 3274186 - DNA, 16 bp, Homo sapiens
gggccccggggctggc

SEQ ID NO: 3274187 - DNA, 17 bp, Homo sapiens
gggccccggggctggca

SEQ ID NO: 3274188 - DNA, 19 bp, Homo sapiens
gggccccggggctggcaag

SEQ ID NO: 3274189 - DNA, 12 bp, Homo sapiens
gggcccctcaac

SEQ ID NO: 3274190 - DNA, 14 bp, Homo sapiens
gggcccctccacgc

SEQ ID NO: 3274191 - DNA, 17 bp, Homo sapiens
gggcccctccacgcctc

SEQ ID NO: 3274192 - DNA, 13 bp, Homo sapiens
gggcccctccctc

SEQ ID NO: 3274193 - DNA, 17 bp, Homo sapiens
gggcccctccctctgcc

SEQ ID NO: 3274194 - DNA, 19 bp, Homo sapiens
gggcccctgcttctccagc

SEQ ID NO: 3274195 - DNA, 21 bp, Homo sapiens
gggcccctgcttctccagcct

SEQ ID NO: 3274196 - DNA, 14 bp, Homo sapiens
gggcccctgggatg

SEQ ID NO: 3274197 - DNA, 14 bp, Homo sapiens
gggcccctgggctt

SEQ ID NO: 3274198 - DNA, 21 bp, Homo sapiens
gggcccgcagtgctgggacca

SEQ ID NO: 3274199 - DNA, 16 bp, Homo sapiens
gggcccggccacaccc

SEQ ID NO: 3274200 - DNA, 18 bp, Homo sapiens
gggcccggtggcggcagg

SEQ ID NO: 3274201 - DNA, 20 bp, Homo sapiens
gggccctcagctcctgggga

SEQ ID NO: 3274202 - DNA, 16 bp, Homo sapiens
gggccctccgacagcc

SEQ ID NO: 3274203 - DNA, 17 bp, Homo sapiens
gggccctctctctgggc

SEQ ID NO: 3274204 - DNA, 22 bp, Homo sapiens
gggccctctctgcaccggacag

SEQ ID NO: 3274205 - DNA, 14 bp, Homo sapiens
gggccctctcttct

SEQ ID NO: 3274206 - DNA, 13 bp, Homo sapiens
gggccctctttcc

SEQ ID NO: 3274207 - DNA, 18 bp, Homo sapiens
gggccctgcacctgtgca

SEQ ID NO: 3274208 - DNA, 14 bp, Homo sapiens
gggccctggccagg

SEQ ID NO: 3274209 - DNA, 13 bp, Homo sapiens
gggccctgggcct

SEQ ID NO: 3274210 - DNA, 19 bp, Homo sapiens
gggcccttgggacagccag

SEQ ID NO: 3274211 - DNA, 20 bp, Homo sapiens
gggcccttggggcctggctt

SEQ ID NO: 3274212 - DNA, 13 bp, Homo sapiens
gggccgaggccca

SEQ ID NO: 3274213 - DNA, 15 bp, Homo sapiens
gggccgaggcccagc

SEQ ID NO: 3274214 - DNA, 16 bp, Homo sapiens
gggccgaggcccagcg

SEQ ID NO: 3274215 - DNA, 19 bp, Homo sapiens
gggccgaggcccagcgggc

SEQ ID NO: 3274216 - DNA, 21 bp, Homo sapiens
gggccgaggcccagcgggcag

SEQ ID NO: 3274217 - DNA, 22 bp, Homo sapiens
gggccgaggcccagcgggcaga

SEQ ID NO: 3274218 - DNA, 17 bp, Homo sapiens
gggccgccacggcctgg

SEQ ID NO: 3274219 - DNA, 18 bp, Homo sapiens
gggccgccacggcctggc

SEQ ID NO: 3274220 - DNA, 21 bp, Homo sapiens
gggccgccacggcctggctgg

SEQ ID NO: 3274221 - DNA, 20 bp, Homo sapiens
gggccgggcgcggtggctca

SEQ ID NO: 3274222 - DNA, 19 bp, Homo sapiens
gggccgggggaggggcgcg

SEQ ID NO: 3274223 - DNA, 18 bp, Homo sapiens
gggccggtagaggctccc

SEQ ID NO: 3274224 - DNA, 14 bp, Homo sapiens
gggcctcaggctct

SEQ ID NO: 3274225 - DNA, 20 bp, Homo sapiens
gggcctcaggctctgcacag

SEQ ID NO: 3274226 - DNA, 14 bp, Homo sapiens
gggcctccctcctt

SEQ ID NO: 3274227 - DNA, 17 bp, Homo sapiens
gggcctcccttgggctg

SEQ ID NO: 3274228 - DNA, 18 bp, Homo sapiens
gggcctccttcccatgcc

SEQ ID NO: 3274229 - DNA, 16 bp, Homo sapiens
gggcctgcagaaggaa

SEQ ID NO: 3274230 - DNA, 11 bp, Homo sapiens
gggcctgcccc

SEQ ID NO: 3274231 - DNA, 14 bp, Homo sapiens
gggcctgcctggcc

SEQ ID NO: 3274232 - DNA, 18 bp, Homo sapiens
gggcctgcttttccagga

SEQ ID NO: 3274233 - DNA, 12 bp, Homo sapiens
gggcctggagat

SEQ ID NO: 3274234 - DNA, 14 bp, Homo sapiens
gggcctggagcccc

SEQ ID NO: 3274235 - DNA, 16 bp, Homo sapiens
gggcctggcaggccag

SEQ ID NO: 3274236 - DNA, 22 bp, Homo sapiens
gggcctggcaggccagtgtctg

SEQ ID NO: 3274237 - DNA, 14 bp, Homo sapiens
ggaggtctccaggg

SEQ ID NO: 3274238 - DNA, 22 bp, Homo sapiens
ggaggtctccaggggcctgcag

SEQ ID NO: 3274239 - DNA, 22 bp, Homo sapiens
ggaggtgcttaagcagaagcat

SEQ ID NO: 3274240 - DNA, 20 bp, Homo sapiens
ggaggtggagattgcagtga

SEQ ID NO: 3274241 - DNA, 12 bp, Homo sapiens
ggaggtgggcat

SEQ ID NO: 3274242 - DNA, 21 bp, Homo sapiens
ggaggtgggcatgccaccctc

SEQ ID NO: 3274243 - DNA, 19 bp, Homo sapiens
ggaggtggggcgaggcagg

SEQ ID NO: 3274244 - DNA, 21 bp, Homo sapiens
ggaggtgggtgtgggtggaag

SEQ ID NO: 3274245 - DNA, 12 bp, Homo sapiens
ggaggtgtgagg

SEQ ID NO: 3274246 - DNA, 13 bp, Homo sapiens
ggaggtgttcact

SEQ ID NO: 3274247 - DNA, 21 bp, Homo sapiens
ggaggtgtttaaagagaggtt

SEQ ID NO: 3274248 - DNA, 15 bp, Homo sapiens
ggaggttctcagagc

SEQ ID NO: 3274249 - DNA, 16 bp, Homo sapiens
ggaggttgaagccaag

SEQ ID NO: 3274250 - DNA, 14 bp, Homo sapiens
ggaggttgcagtga

SEQ ID NO: 3274251 - DNA, 21 bp, Homo sapiens
ggaggtttccttttggaacat

SEQ ID NO: 3274252 - DNA, 22 bp, Homo sapiens
ggagtaacaatacaaatggatt

SEQ ID NO: 3274253 - DNA, 13 bp, Homo sapiens
ggagtacctgctg

SEQ ID NO: 3274254 - DNA, 23 bp, Homo sapiens
ggagtcccaccttggctgcaggg

SEQ ID NO: 3274255 - DNA, 13 bp, Homo sapiens
ggagtcccctcac

SEQ ID NO: 3274256 - DNA, 24 bp, Homo sapiens
ggagtcgtggggtgtgctgggagc

SEQ ID NO: 3274257 - DNA, 13 bp, Homo sapiens
ggagtctctgcca

SEQ ID NO: 3274258 - DNA, 17 bp, Homo sapiens
ggagtctctgccaccca

SEQ ID NO: 3274259 - DNA, 19 bp, Homo sapiens
ggagtctctgccacccact

SEQ ID NO: 3274260 - DNA, 12 bp, Homo sapiens
ggagtctgagtc

SEQ ID NO: 3274261 - DNA, 14 bp, Homo sapiens
ggagtctgagtctg

SEQ ID NO: 3274262 - DNA, 16 bp, Homo sapiens
ggagtctgagtctgag

SEQ ID NO: 3274263 - DNA, 22 bp, Homo sapiens
ggagtctgagtctgagtcctgt

SEQ ID NO: 3274264 - DNA, 18 bp, Homo sapiens
ggagtctgtcctgtgacg

SEQ ID NO: 3274265 - DNA, 21 bp, Homo sapiens
ggagtgaaacctttagggcag

SEQ ID NO: 3274266 - DNA, 16 bp, Homo sapiens
ggagtgaagaggggca

SEQ ID NO: 3274267 - DNA, 17 bp, Homo sapiens
ggagtgaagaggggcag

SEQ ID NO: 3274268 - DNA, 18 bp, Homo sapiens
ggagtgaagaggggcagc

SEQ ID NO: 3274269 - DNA, 20 bp, Homo sapiens
ggagtgaagaggggcagccc

SEQ ID NO: 3274270 - DNA, 23 bp, Homo sapiens
ggagtgaagaggggcagcccttg

SEQ ID NO: 3274271 - DNA, 19 bp, Homo sapiens
ggagtgacagaggcagccc

SEQ ID NO: 3274272 - DNA, 18 bp, Homo sapiens
ggagtgaggcttccaggc

SEQ ID NO: 3274273 - DNA, 20 bp, Homo sapiens
ggagtgaggcttccaggctc

SEQ ID NO: 3274274 - DNA, 22 bp, Homo sapiens
ggagtgaggcttccaggctctt

SEQ ID NO: 3274275 - DNA, 19 bp, Homo sapiens
ggagtgatgatttggggga

SEQ ID NO: 3274276 - DNA, 15 bp, Homo sapiens
ggagtgcagtgagcc

SEQ ID NO: 3274277 - DNA, 12 bp, Homo sapiens
ggagtgcagtgg

SEQ ID NO: 3274278 - DNA, 15 bp, Homo sapiens
ggagtgctggcatta

SEQ ID NO: 3274279 - DNA, 13 bp, Homo sapiens
ggagtgggcacct

SEQ ID NO: 3274280 - DNA, 14 bp, Homo sapiens
ggagtgggcagagc

SEQ ID NO: 3274281 - DNA, 18 bp, Homo sapiens
ggagtggggggacagaga

SEQ ID NO: 3274282 - DNA, 18 bp, Homo sapiens
ggagtggtgatttgaaaa

SEQ ID NO: 3274283 - DNA, 13 bp, Homo sapiens
ggagtggtgcaga

SEQ ID NO: 3274284 - DNA, 16 bp, Homo sapiens
ggagtggtgcagacag

SEQ ID NO: 3274285 - DNA, 15 bp, Homo sapiens
ggagtgtttcatggg

SEQ ID NO: 3274286 - DNA, 12 bp, Homo sapiens
ggagttatctaa

SEQ ID NO: 3274287 - DNA, 14 bp, Homo sapiens
ggagttccacagat

SEQ ID NO: 3274288 - DNA, 18 bp, Homo sapiens
ggagttctagaaccactt

SEQ ID NO: 3274289 - DNA, 23 bp, Homo sapiens
ggagttgaggtgtcagagaaaat

SEQ ID NO: 3274290 - DNA, 13 bp, Homo sapiens
ggagttgagtcac

SEQ ID NO: 3274291 - DNA, 14 bp, Homo sapiens
ggagtttctaaggt

SEQ ID NO: 3274292 - DNA, 14 bp, Homo sapiens
ggagtttctgacga

SEQ ID NO: 3274293 - DNA, 18 bp, Homo sapiens
ggagtttgagacaagccc

SEQ ID NO: 3274294 - DNA, 17 bp, Homo sapiens
ggagttttggcagccag

SEQ ID NO: 3274295 - DNA, 23 bp, Homo sapiens
ggataactgatttctatggcttt

SEQ ID NO: 3274296 - DNA, 20 bp, Homo sapiens
ggataactttacagaaatgg

SEQ ID NO: 3274297 - DNA, 20 bp, Homo sapiens
ggataagccactctgtccct

SEQ ID NO: 3274298 - DNA, 18 bp, Homo sapiens
ggataatatatttgcaga

SEQ ID NO: 3274299 - DNA, 19 bp, Homo sapiens
ggataatggtgaacatttt

SEQ ID NO: 3274300 - DNA, 15 bp, Homo sapiens
ggatactggcacaga

SEQ ID NO: 3274301 - DNA, 23 bp, Homo sapiens
ggatactgtgacctttgtctaga

SEQ ID NO: 3274302 - DNA, 12 bp, Homo sapiens
ggataggagaag

SEQ ID NO: 3274303 - DNA, 18 bp, Homo sapiens
ggatagttgatgcatgtt

SEQ ID NO: 3274304 - DNA, 18 bp, Homo sapiens
ggatatattattgtaagt

SEQ ID NO: 3274305 - DNA, 19 bp, Homo sapiens
ggatatattattgtaagtt

SEQ ID NO: 3274306 - DNA, 22 bp, Homo sapiens
ggatatccttatcagagctaag

SEQ ID NO: 3274307 - DNA, 17 bp, Homo sapiens
ggatatggctgcccagg

SEQ ID NO: 3274308 - DNA, 20 bp, Homo sapiens
ggatatggctgcccaggaga

SEQ ID NO: 3274309 - DNA, 18 bp, Homo sapiens
ggatattgaatgttaaag

SEQ ID NO: 3274310 - DNA, 18 bp, Homo sapiens
ggatatttgatatttggt

SEQ ID NO: 3274311 - DNA, 17 bp, Homo sapiens
ggatatttgcacttatg

SEQ ID NO: 3274312 - DNA, 21 bp, Homo sapiens
ggggaatgagcccagagaaca

SEQ ID NO: 3274313 - DNA, 19 bp, Homo sapiens
ggggacaggcctcacctct

SEQ ID NO: 3274314 - DNA, 13 bp, Homo sapiens
ggggacccaggct

SEQ ID NO: 3274315 - DNA, 21 bp, Homo sapiens
ggggactagcccctgtggaga

SEQ ID NO: 3274316 - DNA, 13 bp, Homo sapiens
ggggactcagccc

SEQ ID NO: 3274317 - DNA, 16 bp, Homo sapiens
ggggactcagccctga

SEQ ID NO: 3274318 - DNA, 14 bp, Homo sapiens
ggggactttattta

SEQ ID NO: 3274319 - DNA, 21 bp, Homo sapiens
ggggagcaaatcatctgcatt

SEQ ID NO: 3274320 - DNA, 14 bp, Homo sapiens
ggggagcagagaca

SEQ ID NO: 3274321 - DNA, 21 bp, Homo sapiens
ggggagcaggaggccaataaa

SEQ ID NO: 3274322 - DNA, 12 bp, Homo sapiens
ggggagcccagt

SEQ ID NO: 3274323 - DNA, 14 bp, Homo sapiens
ggggaggagggggc

SEQ ID NO: 3274324 - DNA, 12 bp, Homo sapiens
ggggaggcaaga

SEQ ID NO: 3274325 - DNA, 17 bp, Homo sapiens
ggggaggcccaaatgat

SEQ ID NO: 3274326 - DNA, 15 bp, Homo sapiens
ggggagtagccaagc

SEQ ID NO: 3274327 - DNA, 11 bp, Homo sapiens
ggggagtgagc

SEQ ID NO: 3274328 - DNA, 13 bp, Homo sapiens
ggggatcacagag

SEQ ID NO: 3274329 - DNA, 21 bp, Homo sapiens
ggggatccagccacttccccc

SEQ ID NO: 3274330 - DNA, 23 bp, Homo sapiens
ggggatccccgcctggccaggag

SEQ ID NO: 3274331 - DNA, 18 bp, Homo sapiens
ggggatgtgggagggagc

SEQ ID NO: 3274332 - DNA, 18 bp, Homo sapiens
ggggcacaccactgccct

SEQ ID NO: 3274333 - DNA, 20 bp, Homo sapiens
ggggcacaccactgccctgc

SEQ ID NO: 3274334 - DNA, 21 bp, Homo sapiens
ggggcacatgctgagtctccc

SEQ ID NO: 3274335 - DNA, 20 bp, Homo sapiens
ggggcaccttccgacatccc

SEQ ID NO: 3274336 - DNA, 23 bp, Homo sapiens
ggggcactcagccacgaccagcc

SEQ ID NO: 3274337 - DNA, 16 bp, Homo sapiens
ggggcagcactcccca

SEQ ID NO: 3274338 - DNA, 16 bp, Homo sapiens
ggggcaggcctgggac

SEQ ID NO: 3274339 - DNA, 12 bp, Homo sapiens
ggggcaggctga

SEQ ID NO: 3274340 - DNA, 16 bp, Homo sapiens
ggggcaggctgggcca

SEQ ID NO: 3274341 - DNA, 21 bp, Homo sapiens
ggggcagggaaggggaggcag

SEQ ID NO: 3274342 - DNA, 22 bp, Homo sapiens
ggggcagtcagatttttaaagt

SEQ ID NO: 3274343 - DNA, 18 bp, Homo sapiens
ggggcagtgactggcagg

SEQ ID NO: 3274344 - DNA, 14 bp, Homo sapiens
ggggcatctgcccc

SEQ ID NO: 3274345 - DNA, 16 bp, Homo sapiens
ggggcatgctggggca

SEQ ID NO: 3274346 - DNA, 19 bp, Homo sapiens
ggggcattgagtattgttt

SEQ ID NO: 3274347 - DNA, 19 bp, Homo sapiens
ggggccacttttgactagg

SEQ ID NO: 3274348 - DNA, 16 bp, Homo sapiens
ggggccaggccaggac

SEQ ID NO: 3274349 - DNA, 12 bp, Homo sapiens
ggggccaggccc

SEQ ID NO: 3274350 - DNA, 13 bp, Homo sapiens
ggggccaggccca

SEQ ID NO: 3274351 - DNA, 14 bp, Homo sapiens
ggggcccaggaagc

SEQ ID NO: 3274352 - DNA, 21 bp, Homo sapiens
ggggcccaggaagcccacact

SEQ ID NO: 3274353 - DNA, 20 bp, Homo sapiens
ggggcccaggagaccacggg

SEQ ID NO: 3274354 - DNA, 23 bp, Homo sapiens
ggggccccagatctgcctgggcc

SEQ ID NO: 3274355 - DNA, 14 bp, Homo sapiens
ggggccccgccagg

SEQ ID NO: 3274356 - DNA, 18 bp, Homo sapiens
ggggccccgccagggctg

SEQ ID NO: 3274357 - DNA, 21 bp, Homo sapiens
ggggccccgccagggctgggg

SEQ ID NO: 3274358 - DNA, 16 bp, Homo sapiens
ggggccccggggctgg

SEQ ID NO: 3274359 - DNA, 12 bp, Homo sapiens
ggggccctgccc

SEQ ID NO: 3274360 - DNA, 19 bp, Homo sapiens
ggggccgccacggcctggc

SEQ ID NO: 3274361 - DNA, 17 bp, Homo sapiens
ggggccgggcaggtcct

SEQ ID NO: 3274362 - DNA, 23 bp, Homo sapiens
ggggccggtagaggctccccagg

SEQ ID NO: 3274363 - DNA, 21 bp, Homo sapiens
ggggcctagcgatctctcctg

SEQ ID NO: 3274364 - DNA, 13 bp, Homo sapiens
ggggcctcagacg

SEQ ID NO: 3274365 - DNA, 12 bp, Homo sapiens
ggggcctccctg

SEQ ID NO: 3274366 - DNA, 15 bp, Homo sapiens
ggggcctgcagaagg

SEQ ID NO: 3274367 - DNA, 19 bp, Homo sapiens
ggggcctggagatcctcct

SEQ ID NO: 3274368 - DNA, 11 bp, Homo sapiens
ggggcctggca

SEQ ID NO: 3274369 - DNA, 22 bp, Homo sapiens
ggggcctggcgggatgggccac

SEQ ID NO: 3274370 - DNA, 13 bp, Homo sapiens
ggggcctggcttg

SEQ ID NO: 3274371 - DNA, 13 bp, Homo sapiens
ggggcgaggcagg

SEQ ID NO: 3274372 - DNA, 14 bp, Homo sapiens
ggggcgaggcaggc

SEQ ID NO: 3274373 - DNA, 14 bp, Homo sapiens
ggggcgatgctccc

SEQ ID NO: 3274374 - DNA, 18 bp, Homo sapiens
ggggcgatgctccctcag

SEQ ID NO: 3274375 - DNA, 14 bp, Homo sapiens
ggggcgcccacctc

SEQ ID NO: 3274376 - DNA, 19 bp, Homo sapiens
ggggcgcccacctccccac

SEQ ID NO: 3274377 - DNA, 14 bp, Homo sapiens
ggggcgcctggaga

SEQ ID NO: 3274378 - DNA, 21 bp, Homo sapiens
ggggcgctcaggacccaggcc

SEQ ID NO: 3274379 - DNA, 22 bp, Homo sapiens
ggggcgctcaggacccaggccc

SEQ ID NO: 3274380 - DNA, 24 bp, Homo sapiens
ggggcgctcaggacccaggccctc

SEQ ID NO: 3274381 - DNA, 14 bp, Homo sapiens
ggggctaatttaac

SEQ ID NO: 3274382 - DNA, 16 bp, Homo sapiens
ggggctccctctctgg

SEQ ID NO: 3274383 - DNA, 12 bp, Homo sapiens
ggggctcctggt

SEQ ID NO: 3274384 - DNA, 22 bp, Homo sapiens
ggggctcctttctccagccagc

SEQ ID NO: 3274385 - DNA, 18 bp, Homo sapiens
ggggctcgaggctggtgc

SEQ ID NO: 3274386 - DNA, 18 bp, Homo sapiens
ggggctcgtggccttccc

SEQ ID NO: 3274387 - DNA, 20 bp, Homo sapiens
ggggctctcagctcagcgcc

SEQ ID NO: 3274388 - DNA, 24 bp, Homo sapiens
ggggctctccaaaggggctgctgg

SEQ ID NO: 3274389 - DNA, 23 bp, Homo sapiens
ggggctctgccctccctccttcc

SEQ ID NO: 3274390 - DNA, 18 bp, Homo sapiens
ggggctctggagagaaac

SEQ ID NO: 3274391 - DNA, 18 bp, Homo sapiens
ggggctggcaagcaggga

SEQ ID NO: 3274392 - DNA, 12 bp, Homo sapiens
ggggctggccta

SEQ ID NO: 3274393 - DNA, 11 bp, Homo sapiens
ggggctgggcc

SEQ ID NO: 3274394 - DNA, 18 bp, Homo sapiens
ggggctggggggcacccc

SEQ ID NO: 3274395 - DNA, 19 bp, Homo sapiens
ggggctggtagctcaggtg

SEQ ID NO: 3274396 - DNA, 22 bp, Homo sapiens
ggggctgtggccgtctcctccc

SEQ ID NO: 3274397 - DNA, 18 bp, Homo sapiens
ggggctgttgaagtcacc

SEQ ID NO: 3274398 - DNA, 24 bp, Homo sapiens
ggggcttcaccagtctgtctactg

SEQ ID NO: 3274399 - DNA, 15 bp, Homo sapiens
ggggctttgccttgc

SEQ ID NO: 3274400 - DNA, 18 bp, Homo sapiens
gggggaacgatgtgtctg

SEQ ID NO: 3274401 - DNA, 21 bp, Homo sapiens
gggggaatgagcccagagaac

SEQ ID NO: 3274402 - DNA, 21 bp, Homo sapiens
gggggactctgagcgggaggc

SEQ ID NO: 3274403 - DNA, 15 bp, Homo sapiens
gggggatgggccagg

SEQ ID NO: 3274404 - DNA, 14 bp, Homo sapiens
gggggcaccgggct

SEQ ID NO: 3274405 - DNA, 20 bp, Homo sapiens
gggggcactcagccacgacc

SEQ ID NO: 3274406 - DNA, 11 bp, Homo sapiens
gggggccctgc

SEQ ID NO: 3274407 - DNA, 12 bp, Homo sapiens
gggggccgggca

SEQ ID NO: 3274408 - DNA, 14 bp, Homo sapiens
gggggccgggcagg

SEQ ID NO: 3274409 - DNA, 18 bp, Homo sapiens
gggggccgggcaggtcct

SEQ ID NO: 3274410 - DNA, 20 bp, Homo sapiens
gggggccgggcaggtcctgc

SEQ ID NO: 3274411 - DNA, 15 bp, Homo sapiens
gggggccgggggagg

SEQ ID NO: 3274412 - DNA, 19 bp, Homo sapiens
gggggccgggggaggggcg

SEQ ID NO: 3274413 - DNA, 15 bp, Homo sapiens
gggggcctcagtgcc

SEQ ID NO: 3274414 - DNA, 17 bp, Homo sapiens
gggggcctcagtgccac

SEQ ID NO: 3274415 - DNA, 10 bp, Homo sapiens
gggggcctgg

SEQ ID NO: 3274416 - DNA, 12 bp, Homo sapiens
gggggcgctcag

SEQ ID NO: 3274417 - DNA, 22 bp, Homo sapiens
gggggctatagctacaggaagc

SEQ ID NO: 3274418 - DNA, 14 bp, Homo sapiens
gggggctgatggct

SEQ ID NO: 3274419 - DNA, 12 bp, Homo sapiens
gggggctggcct

SEQ ID NO: 3274420 - DNA, 20 bp, Homo sapiens
gggggctgggctcacaggcc

SEQ ID NO: 3274421 - DNA, 12 bp, Homo sapiens
gggggctgtgcc

SEQ ID NO: 3274422 - DNA, 16 bp, Homo sapiens
gtccggcccagtgcca

SEQ ID NO: 3274423 - DNA, 19 bp, Homo sapiens
gtccgtgggacggtgccca

SEQ ID NO: 3274424 - DNA, 15 bp, Homo sapiens
gtccgtggtagaggc

SEQ ID NO: 3274425 - DNA, 17 bp, Homo sapiens
gtccgtggtagaggcct

SEQ ID NO: 3274426 - DNA, 21 bp, Homo sapiens
gtccgtggtagaggcctgggg

SEQ ID NO: 3274427 - DNA, 23 bp, Homo sapiens
gtccgtggtagaggcctggggcc

SEQ ID NO: 3274428 - DNA, 16 bp, Homo sapiens
gtcctaactggtatag

SEQ ID NO: 3274429 - DNA, 18 bp, Homo sapiens
gtcctaagagatttatct

SEQ ID NO: 3274430 - DNA, 15 bp, Homo sapiens
gtcctaaggaacctt

SEQ ID NO: 3274431 - DNA, 20 bp, Homo sapiens
gtcctaagtgctaagtgctt

SEQ ID NO: 3274432 - DNA, 13 bp, Homo sapiens
gtcctacccaccc

SEQ ID NO: 3274433 - DNA, 20 bp, Homo sapiens
gtcctactatcactgaacaa

SEQ ID NO: 3274434 - DNA, 23 bp, Homo sapiens
gtcctactctgtgtcaggtgggg

SEQ ID NO: 3274435 - DNA, 18 bp, Homo sapiens
gtcctatctatcttccaa

SEQ ID NO: 3274436 - DNA, 20 bp, Homo sapiens
gtcctatctcccccaaccca

SEQ ID NO: 3274437 - DNA, 15 bp, Homo sapiens
gtcctcacccctgtc

SEQ ID NO: 3274438 - DNA, 17 bp, Homo sapiens
gtcctcacccctgtcct

SEQ ID NO: 3274439 - DNA, 23 bp, Homo sapiens
gtcctcacccctgtcctcactgc

SEQ ID NO: 3274440 - DNA, 16 bp, Homo sapiens
gtcctcactcccagtc

SEQ ID NO: 3274441 - DNA, 20 bp, Homo sapiens
gtcctcagagaatttctacc

SEQ ID NO: 3274442 - DNA, 14 bp, Homo sapiens
gtcctccagaagcc

SEQ ID NO: 3274443 - DNA, 18 bp, Homo sapiens
gtcctccagaagcctctg

SEQ ID NO: 3274444 - DNA, 17 bp, Homo sapiens
gtcctccagaccaccag

SEQ ID NO: 3274445 - DNA, 20 bp, Homo sapiens
gtcctcccatcccctggact

SEQ ID NO: 3274446 - DNA, 12 bp, Homo sapiens
gtcctcccctca

SEQ ID NO: 3274447 - DNA, 18 bp, Homo sapiens
gtcctcccctcacagcct

SEQ ID NO: 3274448 - DNA, 21 bp, Homo sapiens
gtcctcccctcacagcctctg

SEQ ID NO: 3274449 - DNA, 14 bp, Homo sapiens
gtcctcctgggagc

SEQ ID NO: 3274450 - DNA, 15 bp, Homo sapiens
gtcctcctgggagcc

SEQ ID NO: 3274451 - DNA, 17 bp, Homo sapiens
gtcctcgtagccatctc

SEQ ID NO: 3274452 - DNA, 22 bp, Homo sapiens
gtcctcgttcaaaacattccaa

SEQ ID NO: 3274453 - DNA, 20 bp, Homo sapiens
gtcctctcccctccagcctt

SEQ ID NO: 3274454 - DNA, 13 bp, Homo sapiens
gtcctctcgagcc

SEQ ID NO: 3274455 - DNA, 17 bp, Homo sapiens
gtcctctcgagcccaga

SEQ ID NO: 3274456 - DNA, 18 bp, Homo sapiens
gtcctctggagccctaac

SEQ ID NO: 3274457 - DNA, 13 bp, Homo sapiens
gtcctcttctggg

SEQ ID NO: 3274458 - DNA, 14 bp, Homo sapiens
gtcctcttttctga

SEQ ID NO: 3274459 - DNA, 20 bp, Homo sapiens
gtcctgaagaggcgggccag

SEQ ID NO: 3274460 - DNA, 22 bp, Homo sapiens
gtcctgaagaggcgggccagcc

SEQ ID NO: 3274461 - DNA, 16 bp, Homo sapiens
gtcctgaccaccctcc

SEQ ID NO: 3274462 - DNA, 14 bp, Homo sapiens
gtcctgacgccctg

SEQ ID NO: 3274463 - DNA, 16 bp, Homo sapiens
gtcctgaggagaggag

SEQ ID NO: 3274464 - DNA, 15 bp, Homo sapiens
gtcctgatctgtgat

SEQ ID NO: 3274465 - DNA, 15 bp, Homo sapiens
gtcctgatggtcagc

SEQ ID NO: 3274466 - DNA, 18 bp, Homo sapiens
gtcctgatggtcagctcc

SEQ ID NO: 3274467 - DNA, 19 bp, Homo sapiens
gtcctgatggtcagctccc

SEQ ID NO: 3274468 - DNA, 20 bp, Homo sapiens
gtcctgatggtcagctccct

SEQ ID NO: 3274469 - DNA, 16 bp, Homo sapiens
gtcctgcagaagaagc

SEQ ID NO: 3274470 - DNA, 23 bp, Homo sapiens
gtcctgcagcaaacactccaccc

SEQ ID NO: 3274471 - DNA, 18 bp, Homo sapiens
gtcctgcaggagtgctgg

SEQ ID NO: 3274472 - DNA, 13 bp, Homo sapiens
gtcctgcagtcct

SEQ ID NO: 3274473 - DNA, 11 bp, Homo sapiens
gtcctgccagc

SEQ ID NO: 3274474 - DNA, 12 bp, Homo sapiens
gtcctgccagct

SEQ ID NO: 3274475 - DNA, 21 bp, Homo sapiens
gtcctgccagctgccttcctc

SEQ ID NO: 3274476 - DNA, 14 bp, Homo sapiens
gtcctgcccatgcc

SEQ ID NO: 3274477 - DNA, 13 bp, Homo sapiens
gtcctgccggtgg

SEQ ID NO: 3274478 - DNA, 17 bp, Homo sapiens
gtcctgccggtgggacc

SEQ ID NO: 3274479 - DNA, 15 bp, Homo sapiens
gtcctgcctggccag

SEQ ID NO: 3274480 - DNA, 20 bp, Homo sapiens
gtcctggacaccgggccagt

SEQ ID NO: 3274481 - DNA, 14 bp, Homo sapiens
gtcctggaggggct

SEQ ID NO: 3274482 - DNA, 15 bp, Homo sapiens
gtcctggctacatcc

SEQ ID NO: 3274483 - DNA, 19 bp, Homo sapiens
gtcctggctacatcccagc

SEQ ID NO: 3274484 - DNA, 14 bp, Homo sapiens
gtcctggctcctga

SEQ ID NO: 3274485 - DNA, 19 bp, Homo sapiens
gtcctgggagaacctcagg

SEQ ID NO: 3274486 - DNA, 20 bp, Homo sapiens
gtcctgggagaacctcaggc

SEQ ID NO: 3274487 - DNA, 21 bp, Homo sapiens
gtcctgggagaacctcaggct

SEQ ID NO: 3274488 - DNA, 16 bp, Homo sapiens
gtcctgggagtgagct

SEQ ID NO: 3274489 - DNA, 18 bp, Homo sapiens
gtcctgggagtgagctgg

SEQ ID NO: 3274490 - DNA, 15 bp, Homo sapiens
gtcctgggcctgccc

SEQ ID NO: 3274491 - DNA, 18 bp, Homo sapiens
gtcctgtccacacccagc

SEQ ID NO: 3274492 - DNA, 15 bp, Homo sapiens
gtcctgtctctgcct

SEQ ID NO: 3274493 - DNA, 17 bp, Homo sapiens
gtcctgtggcaggcagc

SEQ ID NO: 3274494 - DNA, 15 bp, Homo sapiens
gtcctgttccctacc

SEQ ID NO: 3274495 - DNA, 17 bp, Homo sapiens
gtccttagaacatttta

SEQ ID NO: 3274496 - DNA, 19 bp, Homo sapiens
gtccttaggagacgctgca

SEQ ID NO: 3274497 - DNA, 17 bp, Homo sapiens
gtccttaggcctctgag

SEQ ID NO: 3274498 - DNA, 18 bp, Homo sapiens
gtccttattcttctcata

SEQ ID NO: 3274499 - DNA, 22 bp, Homo sapiens
gtccttcaaaatccttccaaag

SEQ ID NO: 3274500 - DNA, 15 bp, Homo sapiens
gtccttcagatggaa

SEQ ID NO: 3274501 - DNA, 16 bp, Homo sapiens
gtccttccctcaaaga

SEQ ID NO: 3274502 - DNA, 19 bp, Homo sapiens
gtccttccctgttctccct

SEQ ID NO: 3274503 - DNA, 16 bp, Homo sapiens
gtccttgcacccctca

SEQ ID NO: 3274504 - DNA, 13 bp, Homo sapiens
gtcctttatgtgg

SEQ ID NO: 3274505 - DNA, 22 bp, Homo sapiens
gtcctttatgtggaaaacagaa

SEQ ID NO: 3274506 - DNA, 18 bp, Homo sapiens
gtcctttccaaggcttct

SEQ ID NO: 3274507 - DNA, 22 bp, Homo sapiens
gtcctttccaaggcttctccaa

SEQ ID NO: 3274508 - DNA, 20 bp, Homo sapiens
gtcctttcccaccattcctg

SEQ ID NO: 3274509 - DNA, 21 bp, Homo sapiens
gtcctttcccaccattcctgc

SEQ ID NO: 3274510 - DNA, 13 bp, Homo sapiens
gtcctttcccctc

SEQ ID NO: 3274511 - DNA, 18 bp, Homo sapiens
gtcctttcccctctctgc

SEQ ID NO: 3274512 - DNA, 19 bp, Homo sapiens
gtcctttcccctctctgcc

SEQ ID NO: 3274513 - DNA, 19 bp, Homo sapiens
gtcctttctgccttggcct

SEQ ID NO: 3274514 - DNA, 18 bp, Homo sapiens
gtcctttgcgcctgtgac

SEQ ID NO: 3274515 - DNA, 12 bp, Homo sapiens
gtcctttggaca

SEQ ID NO: 3274516 - DNA, 16 bp, Homo sapiens
gtcctttgggtgactc

SEQ ID NO: 3274517 - DNA, 16 bp, Homo sapiens
gtcgaaagctctagaa

SEQ ID NO: 3274518 - DNA, 20 bp, Homo sapiens
gtcgaaggatgctctttccc

SEQ ID NO: 3274519 - DNA, 17 bp, Homo sapiens
gtcgcacccacagcgaa

SEQ ID NO: 3274520 - DNA, 19 bp, Homo sapiens
gtcgcagaccagagctgtc

SEQ ID NO: 3274521 - DNA, 20 bp, Homo sapiens
gtcgcaggatccgctgccac

SEQ ID NO: 3274522 - DNA, 23 bp, Homo sapiens
gtcgcccagtctggaatgcagtg

SEQ ID NO: 3274523 - DNA, 16 bp, Homo sapiens
gtcgccccaggccctc

SEQ ID NO: 3274524 - DNA, 22 bp, Homo sapiens
gtcgccccaggccctccctgac

SEQ ID NO: 3274525 - DNA, 23 bp, Homo sapiens
gtcgccccaggccctccctgact

SEQ ID NO: 3274526 - DNA, 18 bp, Homo sapiens
gtcgccttagcatgtttg

SEQ ID NO: 3274527 - DNA, 23 bp, Homo sapiens
gtcggaaaagcgtctttaagaga

SEQ ID NO: 3274528 - DNA, 14 bp, Homo sapiens
gtcggccccatctc

SEQ ID NO: 3274529 - DNA, 14 bp, Homo sapiens
gtcggctgaccatg

SEQ ID NO: 3274530 - DNA, 15 bp, Homo sapiens
gtcgggggctggcct

SEQ ID NO: 3274531 - DNA, 12 bp, Homo sapiens
gtcgtctgtgaa

SEQ ID NO: 3274532 - DNA, 15 bp, Homo sapiens
gtcgtgcctgtgtcc

SEQ ID NO: 3274533 - DNA, 18 bp, Homo sapiens
gtcgtgcctgtgtccatg

SEQ ID NO: 3274534 - DNA, 14 bp, Homo sapiens
gtcgtggttcttaa

SEQ ID NO: 3274535 - DNA, 16 bp, Homo sapiens
gtcgtggttcttaaat

SEQ ID NO: 3274536 - DNA, 16 bp, Homo sapiens
gtctaaacaatgctga

SEQ ID NO: 3274537 - DNA, 21 bp, Homo sapiens
gtctaaagatggagtttctaa

SEQ ID NO: 3274538 - DNA, 13 bp, Homo sapiens
gtctaaatatttc

SEQ ID NO: 3274539 - DNA, 23 bp, Homo sapiens
gtctaaatatttccttaaactgt

SEQ ID NO: 3274540 - DNA, 23 bp, Homo sapiens
gtctaagactatatatataaatg

SEQ ID NO: 3274541 - DNA, 16 bp, Homo sapiens
gtctaagattctagat

SEQ ID NO: 3274542 - DNA, 14 bp, Homo sapiens
gtctacctgctgga

SEQ ID NO: 3274543 - DNA, 19 bp, Homo sapiens
gtctacctgctggacagcc

SEQ ID NO: 3274544 - DNA, 14 bp, Homo sapiens
gtctactgtggtga

SEQ ID NO: 3274545 - DNA, 22 bp, Homo sapiens
gtctagaaatgcggtctggtct

SEQ ID NO: 3274546 - DNA, 14 bp, Homo sapiens
gtctagaagaacaa

SEQ ID NO: 3274547 - DNA, 22 bp, Homo sapiens
gtctagagtcatgtgagcctcg

SEQ ID NO: 3274548 - DNA, 20 bp, Homo sapiens
gtctagattcaaaggttcta

SEQ ID NO: 3274549 - DNA, 12 bp, Homo sapiens
gtctagattctc

SEQ ID NO: 3274550 - DNA, 23 bp, Homo sapiens
gtctagcttagtttcagagacct

SEQ ID NO: 3274551 - DNA, 13 bp, Homo sapiens
ggtttggaagagt

SEQ ID NO: 3274552 - DNA, 20 bp, Homo sapiens
ggtttggaccccagctggga

SEQ ID NO: 3274553 - DNA, 23 bp, Homo sapiens
ggtttggcaagaacttgtttaca

SEQ ID NO: 3274554 - DNA, 13 bp, Homo sapiens
ggtttgtatgaga

SEQ ID NO: 3274555 - DNA, 14 bp, Homo sapiens
ggtttgtgttcttc

SEQ ID NO: 3274556 - DNA, 16 bp, Homo sapiens
ggttttaaagtgatta

SEQ ID NO: 3274557 - DNA, 21 bp, Homo sapiens
ggttttacttacaaaaatggg

SEQ ID NO: 3274558 - DNA, 13 bp, Homo sapiens
ggttttagcattg

SEQ ID NO: 3274559 - DNA, 22 bp, Homo sapiens
ggttttagcattgtcttgttct

SEQ ID NO: 3274560 - DNA, 18 bp, Homo sapiens
ggttttaggtagaaaaac

SEQ ID NO: 3274561 - DNA, 16 bp, Homo sapiens
ggttttatactgaagg

SEQ ID NO: 3274562 - DNA, 22 bp, Homo sapiens
ggttttattctgacttcctctg

SEQ ID NO: 3274563 - DNA, 19 bp, Homo sapiens
ggttttgtaagatgctggg

SEQ ID NO: 3274564 - DNA, 19 bp, Homo sapiens
ggtttttaaagtaaatctc

SEQ ID NO: 3274565 - DNA, 20 bp, Homo sapiens
ggtttttaaatatatatttt

SEQ ID NO: 3274566 - DNA, 16 bp, Homo sapiens
ggtttttatttctcgg

SEQ ID NO: 3274567 - DNA, 15 bp, Homo sapiens
ggtttttggctcttt

SEQ ID NO: 3274568 - DNA, 20 bp, Homo sapiens
ggtttttggctctttcagag

SEQ ID NO: 3274569 - DNA, 13 bp, Homo sapiens
ggtttttttaagt

SEQ ID NO: 3274570 - DNA, 23 bp, Homo sapiens
ggtttttttttttaaaaaaagaa

SEQ ID NO: 3274571 - DNA, 20 bp, Homo sapiens
gtaaaaaaaaatgcctttga

SEQ ID NO: 3274572 - DNA, 12 bp, Homo sapiens
gtaaaaaaagca

SEQ ID NO: 3274573 - DNA, 15 bp, Homo sapiens
gtaaaaaaagcaaaa

SEQ ID NO: 3274574 - DNA, 14 bp, Homo sapiens
gtaaaaaatggaaa

SEQ ID NO: 3274575 - DNA, 16 bp, Homo sapiens
gtaaaaacagatattg

SEQ ID NO: 3274576 - DNA, 15 bp, Homo sapiens
gtaaaaataaaagca

SEQ ID NO: 3274577 - DNA, 13 bp, Homo sapiens
gtaaaaatgctgc

SEQ ID NO: 3274578 - DNA, 14 bp, Homo sapiens
gtaaaaatgctgct

SEQ ID NO: 3274579 - DNA, 18 bp, Homo sapiens
gtaaaaatgctgctctca

SEQ ID NO: 3274580 - DNA, 21 bp, Homo sapiens
gtaaaaccttgttctattttt

SEQ ID NO: 3274581 - DNA, 18 bp, Homo sapiens
gtaaaagaacagtaaaca

SEQ ID NO: 3274582 - DNA, 17 bp, Homo sapiens
gtaaaagacatttgata

SEQ ID NO: 3274583 - DNA, 19 bp, Homo sapiens
gtaaaatgtgaagtgaatg

SEQ ID NO: 3274584 - DNA, 15 bp, Homo sapiens
gtaaaattataaact

SEQ ID NO: 3274585 - DNA, 16 bp, Homo sapiens
gtaaaattataaactt

SEQ ID NO: 3274586 - DNA, 20 bp, Homo sapiens
gtaaaattataaacttttat

SEQ ID NO: 3274587 - DNA, 19 bp, Homo sapiens
gtaaaattgctgtgcttta

SEQ ID NO: 3274588 - DNA, 14 bp, Homo sapiens
gtaaacagggtacc

SEQ ID NO: 3274589 - DNA, 20 bp, Homo sapiens
gtaaacatgtgttttaattc

SEQ ID NO: 3274590 - DNA, 22 bp, Homo sapiens
gtaaacatgtgttttaattcca

SEQ ID NO: 3274591 - DNA, 18 bp, Homo sapiens
gtaaaccagatctgtctc

SEQ ID NO: 3274592 - DNA, 14 bp, Homo sapiens
gtaaaccattgtaa

SEQ ID NO: 3274593 - DNA, 20 bp, Homo sapiens
gtaaacccattttgaatatt

SEQ ID NO: 3274594 - DNA, 15 bp, Homo sapiens
gtaaactcaaaactt

SEQ ID NO: 3274595 - DNA, 11 bp, Homo sapiens
gtaaactgcca

SEQ ID NO: 3274596 - DNA, 16 bp, Homo sapiens
gtaaacttctgcaaca

SEQ ID NO: 3274597 - DNA, 14 bp, Homo sapiens
gtaaagactggttt

SEQ ID NO: 3274598 - DNA, 19 bp, Homo sapiens
gtaaagactggttttctgc

SEQ ID NO: 3274599 - DNA, 15 bp, Homo sapiens
gtaaagagaaacttt

SEQ ID NO: 3274600 - DNA, 20 bp, Homo sapiens
gtaaagagaaactttgtgct

SEQ ID NO: 3274601 - DNA, 21 bp, Homo sapiens
gtaaagagacctacctcaggt

SEQ ID NO: 3274602 - DNA, 19 bp, Homo sapiens
gtaaagatatttttatctt

SEQ ID NO: 3274603 - DNA, 16 bp, Homo sapiens
gtaaagccaaaaccat

SEQ ID NO: 3274604 - DNA, 20 bp, Homo sapiens
gtaaagctaaaatgatttta

SEQ ID NO: 3274605 - DNA, 15 bp, Homo sapiens
gtaaagctggccctg

SEQ ID NO: 3274606 - DNA, 14 bp, Homo sapiens
gtaaaggagggaga

SEQ ID NO: 3274607 - DNA, 15 bp, Homo sapiens
gtaaaggagggagat

SEQ ID NO: 3274608 - DNA, 18 bp, Homo sapiens
gtaaagggcaaataatga

SEQ ID NO: 3274609 - DNA, 16 bp, Homo sapiens
gtaaataaaatgtgta

SEQ ID NO: 3274610 - DNA, 22 bp, Homo sapiens
gtaaataaaatgtgtacagtga

SEQ ID NO: 3274611 - DNA, 18 bp, Homo sapiens
gtaaataaccacaaggtc

SEQ ID NO: 3274612 - DNA, 19 bp, Homo sapiens
gtaaatacaagactgttgt

SEQ ID NO: 3274613 - DNA, 15 bp, Homo sapiens
gtaaatactgcttga

SEQ ID NO: 3274614 - DNA, 19 bp, Homo sapiens
gtaaatactttgtcctaag

SEQ ID NO: 3274615 - DNA, 21 bp, Homo sapiens
gtaaataggaatcattcagaa

SEQ ID NO: 3274616 - DNA, 16 bp, Homo sapiens
gtaaatagtatttgag

SEQ ID NO: 3274617 - DNA, 17 bp, Homo sapiens
gtaaatatatgtctgat

SEQ ID NO: 3274618 - DNA, 14 bp, Homo sapiens
gtaaatatttactc

SEQ ID NO: 3274619 - DNA, 14 bp, Homo sapiens
gtaaatcagtaaga

SEQ ID NO: 3274620 - DNA, 16 bp, Homo sapiens
gtaaatcctgccattt

SEQ ID NO: 3274621 - DNA, 15 bp, Homo sapiens
gtaaatctgccacaa

SEQ ID NO: 3274622 - DNA, 12 bp, Homo sapiens
gtaaatgatgtg

SEQ ID NO: 3274623 - DNA, 10 bp, Homo sapiens
gtaaatgcct

SEQ ID NO: 3274624 - DNA, 19 bp, Homo sapiens
gtaaatgtttcttttccct

SEQ ID NO: 3274625 - DNA, 22 bp, Homo sapiens
gtaaatgtttcttttcccttaa

SEQ ID NO: 3274626 - DNA, 19 bp, Homo sapiens
gtaaatttagcatatcaat

SEQ ID NO: 3274627 - DNA, 20 bp, Homo sapiens
gtaacaaataaagtgcagtt

SEQ ID NO: 3274628 - DNA, 14 bp, Homo sapiens
gtaacaagaaaaca

SEQ ID NO: 3274629 - DNA, 17 bp, Homo sapiens
gtaacaatacatgagaa

SEQ ID NO: 3274630 - DNA, 17 bp, Homo sapiens
gtaacaatgaagataaa

SEQ ID NO: 3274631 - DNA, 15 bp, Homo sapiens
gtaacagaacagctt

SEQ ID NO: 3274632 - DNA, 20 bp, Homo sapiens
gtaacagatatcagtgtctc

SEQ ID NO: 3274633 - DNA, 14 bp, Homo sapiens
gtaacagatttgct

SEQ ID NO: 3274634 - DNA, 20 bp, Homo sapiens
gtaacaggaaaattttaaaa

SEQ ID NO: 3274635 - DNA, 22 bp, Homo sapiens
gtaacagttcatgtttgcttca

SEQ ID NO: 3274636 - DNA, 20 bp, Homo sapiens
gtaacatcataattacattc

SEQ ID NO: 3274637 - DNA, 23 bp, Homo sapiens
gtaacatcataattacattccta

SEQ ID NO: 3274638 - DNA, 14 bp, Homo sapiens
gtaacattggtgaa

SEQ ID NO: 3274639 - DNA, 13 bp, Homo sapiens
gtaacatttctgt

SEQ ID NO: 3274640 - DNA, 19 bp, Homo sapiens
gtaacatttgctgttttaa

SEQ ID NO: 3274641 - DNA, 20 bp, Homo sapiens
gtaaccaaatattaaagatt

SEQ ID NO: 3274642 - DNA, 20 bp, Homo sapiens
gtaaccaactgaacgacaaa

SEQ ID NO: 3274643 - DNA, 19 bp, Homo sapiens
gtaaccagtgcagaaatga

SEQ ID NO: 3274644 - DNA, 23 bp, Homo sapiens
gtaaccccatactctccttttga

SEQ ID NO: 3274645 - DNA, 12 bp, Homo sapiens
gtaacctcagct

SEQ ID NO: 3274646 - DNA, 15 bp, Homo sapiens
gtaactaattttgtt

SEQ ID NO: 3274647 - DNA, 22 bp, Homo sapiens
gtaactatagactggaaaaaat

SEQ ID NO: 3274648 - DNA, 17 bp, Homo sapiens
gtaactattaacctttt

SEQ ID NO: 3274649 - DNA, 22 bp, Homo sapiens
gtaactattaaccttttttgtc

SEQ ID NO: 3274650 - DNA, 23 bp, Homo sapiens
gtaactattaaccttttttgtct

SEQ ID NO: 3274651 - DNA, 19 bp, Homo sapiens
gtaactccagatagagaaa

SEQ ID NO: 3274652 - DNA, 23 bp, Homo sapiens
gtaactctaattcccattttgca

SEQ ID NO: 3274653 - DNA, 13 bp, Homo sapiens
gtaactgacatga

SEQ ID NO: 3274654 - DNA, 19 bp, Homo sapiens
gtaactgattacctgccaa

SEQ ID NO: 3274655 - DNA, 12 bp, Homo sapiens
gtaactgctgag

SEQ ID NO: 3274656 - DNA, 17 bp, Homo sapiens
gtaactgctgagccact

SEQ ID NO: 3274657 - DNA, 17 bp, Homo sapiens
gtaactgctttctgttc

SEQ ID NO: 3274658 - DNA, 16 bp, Homo sapiens
gtaactgttttttaag

SEQ ID NO: 3274659 - DNA, 15 bp, Homo sapiens
gtaacttatgtagat

SEQ ID NO: 3274660 - DNA, 15 bp, Homo sapiens
gtaacttattagaaa

SEQ ID NO: 3274661 - DNA, 18 bp, Homo sapiens
gtaacttcttatggaatt

SEQ ID NO: 3274662 - DNA, 22 bp, Homo sapiens
gtaactttactctgtgtttaaa

SEQ ID NO: 3274663 - DNA, 15 bp, Homo sapiens
gtaactttatgtgta

SEQ ID NO: 3274664 - DNA, 19 bp, Homo sapiens
gtaacttttttgtgtatgt

SEQ ID NO: 3274665 - DNA, 13 bp, Homo sapiens
gtaagaaaacaaa

SEQ ID NO: 3274666 - DNA, 15 bp, Homo sapiens
gtaagaagaaagcaa

SEQ ID NO: 3274667 - DNA, 16 bp, Homo sapiens
gtaagaagacaaactg

SEQ ID NO: 3274668 - DNA, 15 bp, Homo sapiens
gtaagaagagactgg

SEQ ID NO: 3274669 - DNA, 15 bp, Homo sapiens
gtaagacaaaggttt

SEQ ID NO: 3274670 - DNA, 21 bp, Homo sapiens
gtccctctcggaaggctggct

SEQ ID NO: 3274671 - DNA, 11 bp, Homo sapiens
gtccctctgtg

SEQ ID NO: 3274672 - DNA, 22 bp, Homo sapiens
gtccctctgtgtatttgctttt

SEQ ID NO: 3274673 - DNA, 17 bp, Homo sapiens
gtccctgactctctgtg

SEQ ID NO: 3274674 - DNA, 20 bp, Homo sapiens
gtccctgactctctgtgacc

SEQ ID NO: 3274675 - DNA, 13 bp, Homo sapiens
gtccctgcagggc

SEQ ID NO: 3274676 - DNA, 14 bp, Homo sapiens
gtccctgcagggcc

SEQ ID NO: 3274677 - DNA, 15 bp, Homo sapiens
gtccctggacacagc

SEQ ID NO: 3274678 - DNA, 20 bp, Homo sapiens
gtccctggacacagctcttc

SEQ ID NO: 3274679 - DNA, 23 bp, Homo sapiens
gtccctggacacagctcttcatt

SEQ ID NO: 3274680 - DNA, 17 bp, Homo sapiens
gtccctggcgcaggtgg

SEQ ID NO: 3274681 - DNA, 16 bp, Homo sapiens
gtccctggtccctcgt

SEQ ID NO: 3274682 - DNA, 19 bp, Homo sapiens
gtccctggtccctcgtcca

SEQ ID NO: 3274683 - DNA, 22 bp, Homo sapiens
gtccctggtccctcgtccacag

SEQ ID NO: 3274684 - DNA, 24 bp, Homo sapiens
gtccctggtccctcgtccacaggg

SEQ ID NO: 3274685 - DNA, 20 bp, Homo sapiens
gtccctgtccctctagtgcc

SEQ ID NO: 3274686 - DNA, 15 bp, Homo sapiens
gtccctgtgcctaac

SEQ ID NO: 3274687 - DNA, 21 bp, Homo sapiens
gtccctgtgtgtaggctgggg

SEQ ID NO: 3274688 - DNA, 17 bp, Homo sapiens
gtccctgttttctgagc

SEQ ID NO: 3274689 - DNA, 19 bp, Homo sapiens
gtccctgttttctgagccc

SEQ ID NO: 3274690 - DNA, 13 bp, Homo sapiens
gtcccttcccctc

SEQ ID NO: 3274691 - DNA, 20 bp, Homo sapiens
gtcccttcccctccctggct

SEQ ID NO: 3274692 - DNA, 19 bp, Homo sapiens
gtcccttgaaggaagaggg

SEQ ID NO: 3274693 - DNA, 13 bp, Homo sapiens
gtcccttgcagct

SEQ ID NO: 3274694 - DNA, 19 bp, Homo sapiens
gtcccttgcctcaatgcca

SEQ ID NO: 3274695 - DNA, 11 bp, Homo sapiens
gtcccttgctg

SEQ ID NO: 3274696 - DNA, 16 bp, Homo sapiens
gtcccttgctgtatgc

SEQ ID NO: 3274697 - DNA, 17 bp, Homo sapiens
gtcccttgtttccagct

SEQ ID NO: 3274698 - DNA, 18 bp, Homo sapiens
gtcccttttaatataaaa

SEQ ID NO: 3274699 - DNA, 19 bp, Homo sapiens
gtcccttttaatataaaag

SEQ ID NO: 3274700 - DNA, 19 bp, Homo sapiens
gtccgcaccagctgctctg

SEQ ID NO: 3274701 - DNA, 22 bp, Homo sapiens
gtccgcaccagctgctctgccc

SEQ ID NO: 3274702 - DNA, 20 bp, Homo sapiens
gtccgccctgctcctccctg

SEQ ID NO: 3274703 - DNA, 23 bp, Homo sapiens
gtccgccctgctcctccctggct

SEQ ID NO: 3274704 - DNA, 19 bp, Homo sapiens
gtccgccttaatctggaag

SEQ ID NO: 3274705 - DNA, 19 bp, Homo sapiens
gtccggacccacctcaccc

SEQ ID NO: 3274706 - DNA, 13 bp, Homo sapiens
gtccggcccagtg

SEQ ID NO: 3274707 - DNA, 23 bp, Homo sapiens
gtctgagtcctgtctctgcctgc

SEQ ID NO: 3274708 - DNA, 16 bp, Homo sapiens
gtctgatattaatcaa

SEQ ID NO: 3274709 - DNA, 15 bp, Homo sapiens
gtctgatcgacgtgg

SEQ ID NO: 3274710 - DNA, 18 bp, Homo sapiens
gtctgattggcttgtaga

SEQ ID NO: 3274711 - DNA, 19 bp, Homo sapiens
gtctgattggcttgtagaa

SEQ ID NO: 3274712 - DNA, 22 bp, Homo sapiens
gtctgattggcttgtagaattg

SEQ ID NO: 3274713 - DNA, 21 bp, Homo sapiens
gtctgatttttaaagtacttt

SEQ ID NO: 3274714 - DNA, 22 bp, Homo sapiens
gtctgcaactttaagcagctct

SEQ ID NO: 3274715 - DNA, 14 bp, Homo sapiens
gtctgcaagtcaga

SEQ ID NO: 3274716 - DNA, 21 bp, Homo sapiens
gtctgcaagtcagaggatggc

SEQ ID NO: 3274717 - DNA, 18 bp, Homo sapiens
gtctgcagcccggcgcca

SEQ ID NO: 3274718 - DNA, 11 bp, Homo sapiens
gtctgccaggc

SEQ ID NO: 3274719 - DNA, 12 bp, Homo sapiens
gtctgccaggcc

SEQ ID NO: 3274720 - DNA, 17 bp, Homo sapiens
gtctgccaggcccatct

SEQ ID NO: 3274721 - DNA, 21 bp, Homo sapiens
gtctgccaggcccatctcagg

SEQ ID NO: 3274722 - DNA, 17 bp, Homo sapiens
gtctgcccacgcagagg

SEQ ID NO: 3274723 - DNA, 18 bp, Homo sapiens
gtctgcccacgcagagga

SEQ ID NO: 3274724 - DNA, 13 bp, Homo sapiens
gtctgcctgtatt

SEQ ID NO: 3274725 - DNA, 14 bp, Homo sapiens
gtctgcctgtattt

SEQ ID NO: 3274726 - DNA, 15 bp, Homo sapiens
gtctgcctgtatttt

SEQ ID NO: 3274727 - DNA, 18 bp, Homo sapiens
gtctgctaggcgctgggg

SEQ ID NO: 3274728 - DNA, 15 bp, Homo sapiens
gtctgctctttctct

SEQ ID NO: 3274729 - DNA, 15 bp, Homo sapiens
gtctggaatgcagtg

SEQ ID NO: 3274730 - DNA, 13 bp, Homo sapiens
gtctggaccccgt

SEQ ID NO: 3274731 - DNA, 18 bp, Homo sapiens
gtctggagcggctgctcg

SEQ ID NO: 3274732 - DNA, 18 bp, Homo sapiens
gtctggaggggcccctgc

SEQ ID NO: 3274733 - DNA, 19 bp, Homo sapiens
gtctggagtggtaacagct

SEQ ID NO: 3274734 - DNA, 15 bp, Homo sapiens
gtctggcccaccagg

SEQ ID NO: 3274735 - DNA, 23 bp, Homo sapiens
gtctggctttttcctctgagccc

SEQ ID NO: 3274736 - DNA, 21 bp, Homo sapiens
gtctgggacttccttgctctc

SEQ ID NO: 3274737 - DNA, 18 bp, Homo sapiens
gtctgggatatggctgcc

SEQ ID NO: 3274738 - DNA, 21 bp, Homo sapiens
gtctgggatatggctgcccag

SEQ ID NO: 3274739 - DNA, 22 bp, Homo sapiens
gtctgggatatggctgcccagg

SEQ ID NO: 3274740 - DNA, 16 bp, Homo sapiens
gtctgggatgtagaac

SEQ ID NO: 3274741 - DNA, 17 bp, Homo sapiens
gtctgggatgtagaact

SEQ ID NO: 3274742 - DNA, 14 bp, Homo sapiens
gtctgggcctctga

SEQ ID NO: 3274743 - DNA, 15 bp, Homo sapiens
gtctggggtgtgggg

SEQ ID NO: 3274744 - DNA, 19 bp, Homo sapiens
gtctgggtctaccaggaac

SEQ ID NO: 3274745 - DNA, 18 bp, Homo sapiens
gtctggttttaacaattt

SEQ ID NO: 3274746 - DNA, 21 bp, Homo sapiens
gtctggttttaacaatttcct

SEQ ID NO: 3274747 - DNA, 14 bp, Homo sapiens
gtctgtaatcatgt

SEQ ID NO: 3274748 - DNA, 20 bp, Homo sapiens
gtctgtatcggagacagtga

SEQ ID NO: 3274749 - DNA, 19 bp, Homo sapiens
gtctgtatttatgtgtgag

SEQ ID NO: 3274750 - DNA, 23 bp, Homo sapiens
gtctgtatttatgtgtgaggagc

SEQ ID NO: 3274751 - DNA, 12 bp, Homo sapiens
gtctgtatttca

SEQ ID NO: 3274752 - DNA, 14 bp, Homo sapiens
gtctgtatttcatg

SEQ ID NO: 3274753 - DNA, 20 bp, Homo sapiens
gtctgtatttcatgtggctg

SEQ ID NO: 3274754 - DNA, 19 bp, Homo sapiens
gtctgtcatcctctggaag

SEQ ID NO: 3274755 - DNA, 15 bp, Homo sapiens
gtctgtcccaccagc

SEQ ID NO: 3274756 - DNA, 19 bp, Homo sapiens
gtctgtcccggggtcctgt

SEQ ID NO: 3274757 - DNA, 15 bp, Homo sapiens
gtctgtcttcacagc

SEQ ID NO: 3274758 - DNA, 16 bp, Homo sapiens
gtctgtcttcacagct

SEQ ID NO: 3274759 - DNA, 13 bp, Homo sapiens
gtctgtgaatgct

SEQ ID NO: 3274760 - DNA, 18 bp, Homo sapiens
gtctgtgccctccaaaga

SEQ ID NO: 3274761 - DNA, 12 bp, Homo sapiens
gtctgtgctctt

SEQ ID NO: 3274762 - DNA, 17 bp, Homo sapiens
gtctgtgctgtgcctgc

SEQ ID NO: 3274763 - DNA, 19 bp, Homo sapiens
gtctgtgtggcaaattaaa

SEQ ID NO: 3274764 - DNA, 16 bp, Homo sapiens
gtctgtgtgggactgt

SEQ ID NO: 3274765 - DNA, 20 bp, Homo sapiens
gtctgtgtgggactgtacac

SEQ ID NO: 3274766 - DNA, 14 bp, Homo sapiens
gtctgtgtgtgttc

SEQ ID NO: 3274767 - DNA, 16 bp, Homo sapiens
gtctgtgtgtgttctt

SEQ ID NO: 3274768 - DNA, 14 bp, Homo sapiens
gtctgtgttgctgt

SEQ ID NO: 3274769 - DNA, 16 bp, Homo sapiens
gtctgtgttgctgttt

SEQ ID NO: 3274770 - DNA, 12 bp, Homo sapiens
gtctgtgtttac

SEQ ID NO: 3274771 - DNA, 19 bp, Homo sapiens
gtctgtgtttacagacaga

SEQ ID NO: 3274772 - DNA, 17 bp, Homo sapiens
gtctgtgttttgaaaga

SEQ ID NO: 3274773 - DNA, 16 bp, Homo sapiens
gtctgttatgctgtga

SEQ ID NO: 3274774 - DNA, 17 bp, Homo sapiens
gtctgttcacttttcct

SEQ ID NO: 3274775 - DNA, 21 bp, Homo sapiens
gtctgttccccatggccactt

SEQ ID NO: 3274776 - DNA, 19 bp, Homo sapiens
gtctgttctgcacaataaa

SEQ ID NO: 3274777 - DNA, 14 bp, Homo sapiens
gtctgttggcaggc

SEQ ID NO: 3274778 - DNA, 22 bp, Homo sapiens
gtctgttggcaggctggccagt

SEQ ID NO: 3274779 - DNA, 21 bp, Homo sapiens
gtctgtttggactgcagaagc

SEQ ID NO: 3274780 - DNA, 14 bp, Homo sapiens
gtctgttttccttt

SEQ ID NO: 3274781 - DNA, 16 bp, Homo sapiens
gtctgttttcctttct

SEQ ID NO: 3274782 - DNA, 16 bp, Homo sapiens
gtctgtttttgtatct

SEQ ID NO: 3274783 - DNA, 22 bp, Homo sapiens
gtcttaaactaaatgtgcaata

SEQ ID NO: 3274784 - DNA, 23 bp, Homo sapiens
gtcttaacaaaccaacatctttg

SEQ ID NO: 3274785 - DNA, 13 bp, Homo sapiens
gtcttaattatta

SEQ ID NO: 3274786 - DNA, 21 bp, Homo sapiens
gtcttaattattatttgtgtt

SEQ ID NO: 3274787 - DNA, 19 bp, Homo sapiens
gtcttaatttatttcttaa

SEQ ID NO: 3274788 - DNA, 17 bp, Homo sapiens
gtcttacaatcaaatct

SEQ ID NO: 3274789 - DNA, 17 bp, Homo sapiens
gtcttatatagcagcaa

SEQ ID NO: 3274790 - DNA, 14 bp, Homo sapiens
gtctaggacacagt

SEQ ID NO: 3274791 - DNA, 18 bp, Homo sapiens
gtctaggtctcctcaggg

SEQ ID NO: 3274792 - DNA, 19 bp, Homo sapiens
gtctaggtctcctcagggt

SEQ ID NO: 3274793 - DNA, 20 bp, Homo sapiens
gtctataatcccagcacttt

SEQ ID NO: 3274794 - DNA, 17 bp, Homo sapiens
gtctatatgaaaaacaa

SEQ ID NO: 3274795 - DNA, 12 bp, Homo sapiens
gtctatgaagtt

SEQ ID NO: 3274796 - DNA, 16 bp, Homo sapiens
gtctatgaagttgctg

SEQ ID NO: 3274797 - DNA, 22 bp, Homo sapiens
gtctatgacatgaacaatgtgt

SEQ ID NO: 3274798 - DNA, 14 bp, Homo sapiens
gtctatgggactca

SEQ ID NO: 3274799 - DNA, 15 bp, Homo sapiens
gtctattctgagcct

SEQ ID NO: 3274800 - DNA, 13 bp, Homo sapiens
gtctattttttta

SEQ ID NO: 3274801 - DNA, 19 bp, Homo sapiens
gtctatttttttaactgaa

SEQ ID NO: 3274802 - DNA, 22 bp, Homo sapiens
gtctatttttttaactgaaaat

SEQ ID NO: 3274803 - DNA, 15 bp, Homo sapiens
gtctcacactggcgt

SEQ ID NO: 3274804 - DNA, 19 bp, Homo sapiens
gtctcacctggacttaagc

SEQ ID NO: 3274805 - DNA, 20 bp, Homo sapiens
gtctcactatgttgcccagg

SEQ ID NO: 3274806 - DNA, 21 bp, Homo sapiens
gtctcactatgttgcccaggc

SEQ ID NO: 3274807 - DNA, 23 bp, Homo sapiens
gtctcactatgttgcccaggcag

SEQ ID NO: 3274808 - DNA, 21 bp, Homo sapiens
gtctcactgaaacatttaaat

SEQ ID NO: 3274809 - DNA, 13 bp, Homo sapiens
gtctcactgttgc

SEQ ID NO: 3274810 - DNA, 22 bp, Homo sapiens
gtctcacttgtgcagtgttgac

SEQ ID NO: 3274811 - DNA, 13 bp, Homo sapiens
gtctcacttttca

SEQ ID NO: 3274812 - DNA, 21 bp, Homo sapiens
gtctcactttttacccagaac

SEQ ID NO: 3274813 - DNA, 14 bp, Homo sapiens
gtctcagaagaggt

SEQ ID NO: 3274814 - DNA, 21 bp, Homo sapiens
gtctcagacactaaatgcaga

SEQ ID NO: 3274815 - DNA, 18 bp, Homo sapiens
gtctcagacttttgtaca

SEQ ID NO: 3274816 - DNA, 16 bp, Homo sapiens
gtctcaggagcatggg

SEQ ID NO: 3274817 - DNA, 19 bp, Homo sapiens
gtctcaggcctccagcggc

SEQ ID NO: 3274818 - DNA, 13 bp, Homo sapiens
gtctcaggctggt

SEQ ID NO: 3274819 - DNA, 22 bp, Homo sapiens
gtctcaggctggtgggaggggc

SEQ ID NO: 3274820 - DNA, 16 bp, Homo sapiens
gtctcaggtccctgca

SEQ ID NO: 3274821 - DNA, 14 bp, Homo sapiens
gtctcagtttcttg

SEQ ID NO: 3274822 - DNA, 18 bp, Homo sapiens
gtctcataggttaaaaaa

SEQ ID NO: 3274823 - DNA, 13 bp, Homo sapiens
gtctcatccccag

SEQ ID NO: 3274824 - DNA, 15 bp, Homo sapiens
gtctcatccccaggg

SEQ ID NO: 3274825 - DNA, 19 bp, Homo sapiens
gtctcatctcttcaggttc

SEQ ID NO: 3274826 - DNA, 16 bp, Homo sapiens
gtctcatgctgttgct

SEQ ID NO: 3274827 - DNA, 19 bp, Homo sapiens
gtctcattccgttgtctgt

SEQ ID NO: 3274828 - DNA, 20 bp, Homo sapiens
gtctcattccgttgtctgtg

SEQ ID NO: 3274829 - DNA, 19 bp, Homo sapiens
gtctcattcgcctttgtct

SEQ ID NO: 3274830 - DNA, 20 bp, Homo sapiens
gtctcattcgcctttgtctt

SEQ ID NO: 3274831 - DNA, 23 bp, Homo sapiens
gtctcattcgcctttgtcttgta

SEQ ID NO: 3274832 - DNA, 16 bp, Homo sapiens
gtctcattgcttctga

SEQ ID NO: 3274833 - DNA, 14 bp, Homo sapiens
gtctccaagacctt

SEQ ID NO: 3274834 - DNA, 12 bp, Homo sapiens
gtctccactgtg

SEQ ID NO: 3274835 - DNA, 15 bp, Homo sapiens
gtctccaggccatga

SEQ ID NO: 3274836 - DNA, 22 bp, Homo sapiens
gtctccaggggctgcttcctcc

SEQ ID NO: 3274837 - DNA, 21 bp, Homo sapiens
gtctccagtatccactttgca

SEQ ID NO: 3274838 - DNA, 12 bp, Homo sapiens
gtctcccaaggc

SEQ ID NO: 3274839 - DNA, 19 bp, Homo sapiens
gtctcccatatgcagaaat

SEQ ID NO: 3274840 - DNA, 15 bp, Homo sapiens
gtctccccatcccca

SEQ ID NO: 3274841 - DNA, 18 bp, Homo sapiens
gtctccccatgtgcctgc

SEQ ID NO: 3274842 - DNA, 20 bp, Homo sapiens
gtctcccgattcccaactga

SEQ ID NO: 3274843 - DNA, 14 bp, Homo sapiens
gtctcctactcctg

SEQ ID NO: 3274844 - DNA, 22 bp, Homo sapiens
gtctcctatatatttctattat

SEQ ID NO: 3274845 - DNA, 19 bp, Homo sapiens
gtctcctcactctgtccct

SEQ ID NO: 3274846 - DNA, 13 bp, Homo sapiens
gtctcctcagggt

SEQ ID NO: 3274847 - DNA, 19 bp, Homo sapiens
gtctcctcagggtgggggg

SEQ ID NO: 3274848 - DNA, 19 bp, Homo sapiens
gtctcctccctcagctctc

SEQ ID NO: 3274849 - DNA, 21 bp, Homo sapiens
gtctcctgtgcccacatccca

SEQ ID NO: 3274850 - DNA, 22 bp, Homo sapiens
gtctcctgtgcccacatcccag

SEQ ID NO: 3274851 - DNA, 17 bp, Homo sapiens
gtctccttactctgagc

SEQ ID NO: 3274852 - DNA, 18 bp, Homo sapiens
gtctccttactctgagcc

SEQ ID NO: 3274853 - DNA, 19 bp, Homo sapiens
gtctccttactctgagccc

SEQ ID NO: 3274854 - DNA, 14 bp, Homo sapiens
gtctccttcagcac

SEQ ID NO: 3274855 - DNA, 23 bp, Homo sapiens
gtctcctttgcactgagggccac

SEQ ID NO: 3274856 - DNA, 14 bp, Homo sapiens
gtctcctttgctct

SEQ ID NO: 3274857 - DNA, 16 bp, Homo sapiens
gtctcgaactcctggc

SEQ ID NO: 3274858 - DNA, 17 bp, Homo sapiens
gtctcgaactcctggcc

SEQ ID NO: 3274859 - DNA, 14 bp, Homo sapiens
gtctcgatctcctg

SEQ ID NO: 3274860 - DNA, 15 bp, Homo sapiens
gtctcgatctcctga

SEQ ID NO: 3274861 - DNA, 19 bp, Homo sapiens
gtctcgctttgttgcccag

SEQ ID NO: 3274862 - DNA, 21 bp, Homo sapiens
gtctcggatgacaccctggcc

SEQ ID NO: 3274863 - DNA, 19 bp, Homo sapiens
gtctcgtgtacagctccct

SEQ ID NO: 3274864 - DNA, 22 bp, Homo sapiens
gtctctaagccaactttaattg

SEQ ID NO: 3274865 - DNA, 22 bp, Homo sapiens
gtctctaagtgtaaaagtagta

SEQ ID NO: 3274866 - DNA, 21 bp, Homo sapiens
gtctctacaaaaaataaaata

SEQ ID NO: 3274867 - DNA, 20 bp, Homo sapiens
gtctctatattatgtcttct

SEQ ID NO: 3274868 - DNA, 13 bp, Homo sapiens
gtctctatttaaa

SEQ ID NO: 3274869 - DNA, 22 bp, Homo sapiens
gtctctcccaccccggcctcca

SEQ ID NO: 3274870 - DNA, 12 bp, Homo sapiens
gtctctcctttt

SEQ ID NO: 3274871 - DNA, 15 bp, Homo sapiens
gtctctccttttctt

SEQ ID NO: 3274872 - DNA, 23 bp, Homo sapiens
gtctctccttttcttttgttact

SEQ ID NO: 3274873 - DNA, 22 bp, Homo sapiens
gtctctcgtagtgttaagttat

SEQ ID NO: 3274874 - DNA, 15 bp, Homo sapiens
gtctctctctctcta

SEQ ID NO: 3274875 - DNA, 12 bp, Homo sapiens
gtctctctgtga

SEQ ID NO: 3274876 - DNA, 14 bp, Homo sapiens
gtctctctgtgaat

SEQ ID NO: 3274877 - DNA, 21 bp, Homo sapiens
gtctctcttcagactctcagc

SEQ ID NO: 3274878 - DNA, 22 bp, Homo sapiens
gtctctcttcagactctcagcc

SEQ ID NO: 3274879 - DNA, 15 bp, Homo sapiens
gtctctgagtccttt

SEQ ID NO: 3274880 - DNA, 21 bp, Homo sapiens
gtctctgccacccactcagga

SEQ ID NO: 3274881 - DNA, 22 bp, Homo sapiens
gtctctgctcgccctcctttct

SEQ ID NO: 3274882 - DNA, 23 bp, Homo sapiens
gtctctgctcgccctcctttctg

SEQ ID NO: 3274883 - DNA, 12 bp, Homo sapiens
gtctctgctgaa

SEQ ID NO: 3274884 - DNA, 15 bp, Homo sapiens
gtctctgctggccca

SEQ ID NO: 3274885 - DNA, 20 bp, Homo sapiens
gtctctgttcagatgtgcat

SEQ ID NO: 3274886 - DNA, 17 bp, Homo sapiens
gtctcttaaaaaaataa

SEQ ID NO: 3274887 - DNA, 11 bp, Homo sapiens
gtctcttccac

SEQ ID NO: 3274888 - DNA, 14 bp, Homo sapiens
gtctcttctcccag

SEQ ID NO: 3274889 - DNA, 15 bp, Homo sapiens
gtctcttctcccaga

SEQ ID NO: 3274890 - DNA, 23 bp, Homo sapiens
gtctcttctcccagaatcccagc

SEQ ID NO: 3274891 - DNA, 22 bp, Homo sapiens
gtctcttctttcatctggggat

SEQ ID NO: 3274892 - DNA, 23 bp, Homo sapiens
gtctcttgagggagcttagccaa

SEQ ID NO: 3274893 - DNA, 13 bp, Homo sapiens
gtctctttaagtt

SEQ ID NO: 3274894 - DNA, 18 bp, Homo sapiens
gtctctttaagttttgat

SEQ ID NO: 3274895 - DNA, 18 bp, Homo sapiens
gtctctttaatcttcagt

SEQ ID NO: 3274896 - DNA, 11 bp, Homo sapiens
gtctcttttgt

SEQ ID NO: 3274897 - DNA, 12 bp, Homo sapiens
gtctcttttgta

SEQ ID NO: 3274898 - DNA, 16 bp, Homo sapiens
gtctgaaacatttcat

SEQ ID NO: 3274899 - DNA, 13 bp, Homo sapiens
gtctgaacccttg

SEQ ID NO: 3274900 - DNA, 19 bp, Homo sapiens
gtctgaacccttgtgcttg

SEQ ID NO: 3274901 - DNA, 20 bp, Homo sapiens
gtctgaaggaatagccagag

SEQ ID NO: 3274902 - DNA, 23 bp, Homo sapiens
gtctgaaggaatagccagagagg

SEQ ID NO: 3274903 - DNA, 21 bp, Homo sapiens
gtctgaaggactggattggcc

SEQ ID NO: 3274904 - DNA, 17 bp, Homo sapiens
gtctgaagtcactgcac

SEQ ID NO: 3274905 - DNA, 19 bp, Homo sapiens
gtctgaagtcactgcacag

SEQ ID NO: 3274906 - DNA, 16 bp, Homo sapiens
gtctgaagtggttgtt

SEQ ID NO: 3274907 - DNA, 15 bp, Homo sapiens
gtctgaatgttctga

SEQ ID NO: 3274908 - DNA, 20 bp, Homo sapiens
gtctgaatgttctgacatta

SEQ ID NO: 3274909 - DNA, 14 bp, Homo sapiens
gtctgacaggcaat

SEQ ID NO: 3274910 - DNA, 23 bp, Homo sapiens
gtctgactcaggcgcctggcaca

SEQ ID NO: 3274911 - DNA, 13 bp, Homo sapiens
gtctgactccaga

SEQ ID NO: 3274912 - DNA, 16 bp, Homo sapiens
gtctgactccagagtc

SEQ ID NO: 3274913 - DNA, 17 bp, Homo sapiens
gtctgactctccactcc

SEQ ID NO: 3274914 - DNA, 22 bp, Homo sapiens
gtctgagactcacaggaaggag

SEQ ID NO: 3274915 - DNA, 19 bp, Homo sapiens
gtctgaggaatccagaccc

SEQ ID NO: 3274916 - DNA, 13 bp, Homo sapiens
gtctgaggcctca

SEQ ID NO: 3274917 - DNA, 19 bp, Homo sapiens
gtctgagtcctgtctctgc

SEQ ID NO: 3274918 - DNA, 19 bp, Homo sapiens
gtgccctgccccctggctg

SEQ ID NO: 3274919 - DNA, 20 bp, Homo sapiens
gtgccctgccccctggctga

SEQ ID NO: 3274920 - DNA, 23 bp, Homo sapiens
gtgccctggtggagaaagcactg

SEQ ID NO: 3274921 - DNA, 16 bp, Homo sapiens
gtgccgcctgctcctc

SEQ ID NO: 3274922 - DNA, 17 bp, Homo sapiens
gtgccgcctgctcctca

SEQ ID NO: 3274923 - DNA, 21 bp, Homo sapiens
gtgccgcctgctcctcactgg

SEQ ID NO: 3274924 - DNA, 22 bp, Homo sapiens
gtgccgtagggagtacctgctg

SEQ ID NO: 3274925 - DNA, 15 bp, Homo sapiens
gtgccgtgtgagtgt

SEQ ID NO: 3274926 - DNA, 18 bp, Homo sapiens
gtgcctagactgttactt

SEQ ID NO: 3274927 - DNA, 10 bp, Homo sapiens
gtgcctcaga

SEQ ID NO: 3274928 - DNA, 20 bp, Homo sapiens
gtgcctccaccaccactggc

SEQ ID NO: 3274929 - DNA, 15 bp, Homo sapiens
gtgcctgagaggcag

SEQ ID NO: 3274930 - DNA, 14 bp, Homo sapiens
gtgcctgcaccagg

SEQ ID NO: 3274931 - DNA, 15 bp, Homo sapiens
gtgcctgcaccagga

SEQ ID NO: 3274932 - DNA, 15 bp, Homo sapiens
gtgcctgccatgggc

SEQ ID NO: 3274933 - DNA, 17 bp, Homo sapiens
gtgcctgccatgggcca

SEQ ID NO: 3274934 - DNA, 12 bp, Homo sapiens
gtgcctggaaga

SEQ ID NO: 3274935 - DNA, 18 bp, Homo sapiens
gtgcctggcgcccctgcc

SEQ ID NO: 3274936 - DNA, 17 bp, Homo sapiens
gtgcctgggaatgtatt

SEQ ID NO: 3274937 - DNA, 16 bp, Homo sapiens
gtgcctgtcaggctct

SEQ ID NO: 3274938 - DNA, 12 bp, Homo sapiens
gtgcctgtggca

SEQ ID NO: 3274939 - DNA, 15 bp, Homo sapiens
gtgccttccataatt

SEQ ID NO: 3274940 - DNA, 23 bp, Homo sapiens
gtgccttcctgtttttcacattt

SEQ ID NO: 3274941 - DNA, 23 bp, Homo sapiens
gtgccttcgcttggagacccaca

SEQ ID NO: 3274942 - DNA, 21 bp, Homo sapiens
gtgccttctccttccccagga

SEQ ID NO: 3274943 - DNA, 14 bp, Homo sapiens
gtgccttctgggct

SEQ ID NO: 3274944 - DNA, 15 bp, Homo sapiens
gtgccttctgggctt

SEQ ID NO: 3274945 - DNA, 11 bp, Homo sapiens
gtgcctttcct

SEQ ID NO: 3274946 - DNA, 21 bp, Homo sapiens
gtgcctttcctgttcagcatt

SEQ ID NO: 3274947 - DNA, 22 bp, Homo sapiens
gtgcctttcctgttcagcattc

SEQ ID NO: 3274948 - DNA, 15 bp, Homo sapiens
gtgccttttgcaccc

SEQ ID NO: 3274949 - DNA, 16 bp, Homo sapiens
gtgccttttgcacccc

SEQ ID NO: 3274950 - DNA, 17 bp, Homo sapiens
gtgccttttgcacccct

SEQ ID NO: 3274951 - DNA, 18 bp, Homo sapiens
gtgccttttgcagaagag

SEQ ID NO: 3274952 - DNA, 21 bp, Homo sapiens
gtgccttttgcagaagagggt

SEQ ID NO: 3274953 - DNA, 21 bp, Homo sapiens
gtgcgatctgggttcactgca

SEQ ID NO: 3274954 - DNA, 22 bp, Homo sapiens
gtgcggcgtggagactggcagg

SEQ ID NO: 3274955 - DNA, 23 bp, Homo sapiens
gtgcggcgtggagactggcaggc

SEQ ID NO: 3274956 - DNA, 15 bp, Homo sapiens
gtgcgtgaaacacac

SEQ ID NO: 3274957 - DNA, 21 bp, Homo sapiens
gtgcgtgaaacacaccaggct

SEQ ID NO: 3274958 - DNA, 16 bp, Homo sapiens
gtgcgtgccgtgtgag

SEQ ID NO: 3274959 - DNA, 22 bp, Homo sapiens
gtgcgtgccgtgtgagtgtgac

SEQ ID NO: 3274960 - DNA, 16 bp, Homo sapiens
gtgcgtggctgtggca

SEQ ID NO: 3274961 - DNA, 18 bp, Homo sapiens
gtgctaagtctttcccaa

SEQ ID NO: 3274962 - DNA, 16 bp, Homo sapiens
gtgctacaacatgtga

SEQ ID NO: 3274963 - DNA, 20 bp, Homo sapiens
gtgctactgtctttggaaaa

SEQ ID NO: 3274964 - DNA, 17 bp, Homo sapiens
gtgctacttgcttgaag

SEQ ID NO: 3274965 - DNA, 21 bp, Homo sapiens
gtgctagcttgacacagtcag

SEQ ID NO: 3274966 - DNA, 20 bp, Homo sapiens
gtgctagtggcaagacagtg

SEQ ID NO: 3274967 - DNA, 22 bp, Homo sapiens
gtgctataatctgtttttacgt

SEQ ID NO: 3274968 - DNA, 22 bp, Homo sapiens
gtgctcagaataaggcaggcat

SEQ ID NO: 3274969 - DNA, 20 bp, Homo sapiens
gtgctcagagacctgaagtg

SEQ ID NO: 3274970 - DNA, 13 bp, Homo sapiens
gtgctcatttaag

SEQ ID NO: 3274971 - DNA, 16 bp, Homo sapiens
gtgctctgatcatcca

SEQ ID NO: 3274972 - DNA, 14 bp, Homo sapiens
gtgctctggacagg

SEQ ID NO: 3274973 - DNA, 15 bp, Homo sapiens
gtgctctggacaggc

SEQ ID NO: 3274974 - DNA, 22 bp, Homo sapiens
gtgctctggcggcttcctgtcc

SEQ ID NO: 3274975 - DNA, 23 bp, Homo sapiens
gtgctctggcggcttcctgtcca

SEQ ID NO: 3274976 - DNA, 16 bp, Homo sapiens
gtgctcttttctcctc

SEQ ID NO: 3274977 - DNA, 21 bp, Homo sapiens
gtgctgacatggctctggact

SEQ ID NO: 3274978 - DNA, 11 bp, Homo sapiens
gtgctgatgga

SEQ ID NO: 3274979 - DNA, 22 bp, Homo sapiens
gtgctgcagatttgatatttgc

SEQ ID NO: 3274980 - DNA, 19 bp, Homo sapiens
gtggcagattttacaaaag

SEQ ID NO: 3274981 - DNA, 22 bp, Homo sapiens
gtggcagccatgcctcatgcca

SEQ ID NO: 3274982 - DNA, 13 bp, Homo sapiens
gtggcagccctgt

SEQ ID NO: 3274983 - DNA, 14 bp, Homo sapiens
gtggcagccctgta

SEQ ID NO: 3274984 - DNA, 19 bp, Homo sapiens
gtggcagctgccccagggc

SEQ ID NO: 3274985 - DNA, 19 bp, Homo sapiens
gtggcagctgcggtccacc

SEQ ID NO: 3274986 - DNA, 12 bp, Homo sapiens
gtggcaggcagc

SEQ ID NO: 3274987 - DNA, 19 bp, Homo sapiens
gtggcaggcagcgccaagc

SEQ ID NO: 3274988 - DNA, 18 bp, Homo sapiens
gtggcaggggacaggagt

SEQ ID NO: 3274989 - DNA, 16 bp, Homo sapiens
gtggcaggggagcagg

SEQ ID NO: 3274990 - DNA, 22 bp, Homo sapiens
gtggcatcgtagaagagatgtg

SEQ ID NO: 3274991 - DNA, 20 bp, Homo sapiens
gtggcatctttgccttgggc

SEQ ID NO: 3274992 - DNA, 21 bp, Homo sapiens
gtggcatctttgccttgggct

SEQ ID NO: 3274993 - DNA, 14 bp, Homo sapiens
gtggcatgtggcct

SEQ ID NO: 3274994 - DNA, 19 bp, Homo sapiens
gtggcatgtggcctgtggc

SEQ ID NO: 3274995 - DNA, 14 bp, Homo sapiens
gtggcatgttttga

SEQ ID NO: 3274996 - DNA, 15 bp, Homo sapiens
gtggcattgaaatga

SEQ ID NO: 3274997 - DNA, 20 bp, Homo sapiens
gtggccacaggctagatccc

SEQ ID NO: 3274998 - DNA, 12 bp, Homo sapiens
gtggccagagct

SEQ ID NO: 3274999 - DNA, 15 bp, Homo sapiens
gtggccagagctgga

SEQ ID NO: 3275000 - DNA, 19 bp, Homo sapiens
gtggccagagctggaaggc

SEQ ID NO: 3275001 - DNA, 17 bp, Homo sapiens
gtggccagccagtgcca

SEQ ID NO: 3275002 - DNA, 14 bp, Homo sapiens
gtggccagcccggc

SEQ ID NO: 3275003 - DNA, 15 bp, Homo sapiens
gtggccagcctggat

SEQ ID NO: 3275004 - DNA, 18 bp, Homo sapiens
gtggccatccctgggccc

SEQ ID NO: 3275005 - DNA, 17 bp, Homo sapiens
gtggccatccctgtgag

SEQ ID NO: 3275006 - DNA, 12 bp, Homo sapiens
gtggccccaccc

SEQ ID NO: 3275007 - DNA, 23 bp, Homo sapiens
gtggccccaccctgggccctggg

SEQ ID NO: 3275008 - DNA, 21 bp, Homo sapiens
gtggccctgccctctccttcc

SEQ ID NO: 3275009 - DNA, 23 bp, Homo sapiens
gtggccctgccctctccttcctt

SEQ ID NO: 3275010 - DNA, 21 bp, Homo sapiens
gtggccctgtccctcccacct

SEQ ID NO: 3275011 - DNA, 13 bp, Homo sapiens
gtggccgtctcct

SEQ ID NO: 3275012 - DNA, 20 bp, Homo sapiens
gtggccgtctcctccctcag

SEQ ID NO: 3275013 - DNA, 9 bp, Homo sapiens
gtggcctca

SEQ ID NO: 3275014 - DNA, 15 bp, Homo sapiens
gtggcctcaccctga

SEQ ID NO: 3275015 - DNA, 12 bp, Homo sapiens
gtggcctcagcc

SEQ ID NO: 3275016 - DNA, 15 bp, Homo sapiens
gtggcctcagccctc

SEQ ID NO: 3275017 - DNA, 16 bp, Homo sapiens
gtggcctcagccctca

SEQ ID NO: 3275018 - DNA, 18 bp, Homo sapiens
gtggcctcagccctcaga

SEQ ID NO: 3275019 - DNA, 19 bp, Homo sapiens
gtggcctcagccctcagaa

SEQ ID NO: 3275020 - DNA, 13 bp, Homo sapiens
gtggcctccctgc

SEQ ID NO: 3275021 - DNA, 15 bp, Homo sapiens
gtggcctccctgctg

SEQ ID NO: 3275022 - DNA, 19 bp, Homo sapiens
gtggcctccctgctgtgcc

SEQ ID NO: 3275023 - DNA, 17 bp, Homo sapiens
gtggcctcttgagcagt

SEQ ID NO: 3275024 - DNA, 12 bp, Homo sapiens
gtggcctggcca

SEQ ID NO: 3275025 - DNA, 14 bp, Homo sapiens
gtggcctggtccct

SEQ ID NO: 3275026 - DNA, 15 bp, Homo sapiens
gtggcctgtggcctg

SEQ ID NO: 3275027 - DNA, 16 bp, Homo sapiens
gtggcctgtgtccagc

SEQ ID NO: 3275028 - DNA, 22 bp, Homo sapiens
gtggcctgtgtccagcagctgc

SEQ ID NO: 3275029 - DNA, 17 bp, Homo sapiens
gtggcctgtgtcccatg

SEQ ID NO: 3275030 - DNA, 20 bp, Homo sapiens
gtggcctgtttctgcagccc

SEQ ID NO: 3275031 - DNA, 15 bp, Homo sapiens
gtggccttccccctt

SEQ ID NO: 3275032 - DNA, 21 bp, Homo sapiens
gtggccttccccttttgcctg

SEQ ID NO: 3275033 - DNA, 24 bp, Homo sapiens
gtggccttccccttttgcctggct

SEQ ID NO: 3275034 - DNA, 20 bp, Homo sapiens
gtggccttctgctgcccagg

SEQ ID NO: 3275035 - DNA, 21 bp, Homo sapiens
gtggccttctgctgcccaggc

SEQ ID NO: 3275036 - DNA, 22 bp, Homo sapiens
gtggccttctgctgcccaggcc

SEQ ID NO: 3275037 - DNA, 24 bp, Homo sapiens
gtggcgcaatctcggctcactgca

SEQ ID NO: 3275038 - DNA, 21 bp, Homo sapiens
gtggcggcagggccaggctgg

SEQ ID NO: 3275039 - DNA, 13 bp, Homo sapiens
gtggggcttggcg

SEQ ID NO: 3275040 - DNA, 15 bp, Homo sapiens
gtgggggaaaaataa

SEQ ID NO: 3275041 - DNA, 21 bp, Homo sapiens
gtgggggccaaacctgggacc

SEQ ID NO: 3275042 - DNA, 23 bp, Homo sapiens
gtgggggccaaacctgggacccc

SEQ ID NO: 3275043 - DNA, 12 bp, Homo sapiens
gtggggggtgac

SEQ ID NO: 3275044 - DNA, 17 bp, Homo sapiens
gtggggggtgcaggtgg

SEQ ID NO: 3275045 - DNA, 14 bp, Homo sapiens
gtgggggtggccat

SEQ ID NO: 3275046 - DNA, 18 bp, Homo sapiens
gtgggggttgctgtataa

SEQ ID NO: 3275047 - DNA, 23 bp, Homo sapiens
gtggggtggagtcgcagaccaga

SEQ ID NO: 3275048 - DNA, 10 bp, Homo sapiens
gtggggtggg

SEQ ID NO: 3275049 - DNA, 11 bp, Homo sapiens
gtggggtgggg

SEQ ID NO: 3275050 - DNA, 17 bp, Homo sapiens
gtggggttctgctggga

SEQ ID NO: 3275051 - DNA, 20 bp, Homo sapiens
gtgggtagatcacgagatca

SEQ ID NO: 3275052 - DNA, 12 bp, Homo sapiens
gtgggtccagga

SEQ ID NO: 3275053 - DNA, 16 bp, Homo sapiens
gtgggtccaggaaggc

SEQ ID NO: 3275054 - DNA, 20 bp, Homo sapiens
gtgggtgagatgctggagaa

SEQ ID NO: 3275055 - DNA, 17 bp, Homo sapiens
gtgggtggaagggctgg

SEQ ID NO: 3275056 - DNA, 18 bp, Homo sapiens
gtgggtggaagggctggg

SEQ ID NO: 3275057 - DNA, 17 bp, Homo sapiens
gtgggtggcacctcctg

SEQ ID NO: 3275058 - DNA, 21 bp, Homo sapiens
gtgggttgaatatagcctgcc

SEQ ID NO: 3275059 - DNA, 23 bp, Homo sapiens
gtgggttgaatatagcctgcctc

SEQ ID NO: 3275060 - DNA, 16 bp, Homo sapiens
gtgggtttggttagag

SEQ ID NO: 3275061 - DNA, 21 bp, Homo sapiens
gtggtaagcaacatggctttg

SEQ ID NO: 3275062 - DNA, 12 bp, Homo sapiens
gtggtactctga

SEQ ID NO: 3275063 - DNA, 21 bp, Homo sapiens
gtggtactttattcttgctgg

SEQ ID NO: 3275064 - DNA, 19 bp, Homo sapiens
gtggtaggccttttaacat

SEQ ID NO: 3275065 - DNA, 23 bp, Homo sapiens
gtggtaggccttttaacattttg

SEQ ID NO: 3275066 - DNA, 23 bp, Homo sapiens
gtggtattttattttggcttcat

SEQ ID NO: 3275067 - DNA, 15 bp, Homo sapiens
gtggtcacagcggag

SEQ ID NO: 3275068 - DNA, 16 bp, Homo sapiens
gtggtcacagcggagg

SEQ ID NO: 3275069 - DNA, 13 bp, Homo sapiens
gtggtcaccttcg

SEQ ID NO: 3275070 - DNA, 15 bp, Homo sapiens
gtggtcactgctgtc

SEQ ID NO: 3275071 - DNA, 14 bp, Homo sapiens
gtggtcactgtgca

SEQ ID NO: 3275072 - DNA, 21 bp, Homo sapiens
gtggtcactgtgcactgccct

SEQ ID NO: 3275073 - DNA, 16 bp, Homo sapiens
gtggtcattaagcatt

SEQ ID NO: 3275074 - DNA, 12 bp, Homo sapiens
gtggtcctgact

SEQ ID NO: 3275075 - DNA, 20 bp, Homo sapiens
gtggtctgaatgttctgaca

SEQ ID NO: 3275076 - DNA, 20 bp, Homo sapiens
gtggtctgttggcaggctgg

SEQ ID NO: 3275077 - DNA, 16 bp, Homo sapiens
gtggtctttctggaga

SEQ ID NO: 3275078 - DNA, 17 bp, Homo sapiens
gtggtctttctggagag

SEQ ID NO: 3275079 - DNA, 15 bp, Homo sapiens
gtggtctttgtaaga

SEQ ID NO: 3275080 - DNA, 19 bp, Homo sapiens
gtggtgatcaattaaatgt

SEQ ID NO: 3275081 - DNA, 18 bp, Homo sapiens
gtggtgatttgaaaaata

SEQ ID NO: 3275082 - DNA, 14 bp, Homo sapiens
gtggtggcctcagc

SEQ ID NO: 3275083 - DNA, 18 bp, Homo sapiens
gtggtggctcacacctgc

SEQ ID NO: 3275084 - DNA, 20 bp, Homo sapiens
gtggtgtaaagctggccctg

SEQ ID NO: 3275085 - DNA, 22 bp, Homo sapiens
gtggtgtaaagctggccctgcc

SEQ ID NO: 3275086 - DNA, 16 bp, Homo sapiens
gtggtgtcgtctgtga

SEQ ID NO: 3275087 - DNA, 17 bp, Homo sapiens
gtggtgtcgtctgtgaa

SEQ ID NO: 3275088 - DNA, 21 bp, Homo sapiens
gtggtgtgtccctggacacag

SEQ ID NO: 3275089 - DNA, 18 bp, Homo sapiens
gtggttattagcaaggct

SEQ ID NO: 3275090 - DNA, 14 bp, Homo sapiens
gtggttatttctca

SEQ ID NO: 3275091 - DNA, 20 bp, Homo sapiens
gtggttcagctactttccat

SEQ ID NO: 3275092 - DNA, 16 bp, Homo sapiens
gtgtgggggctgcagc

SEQ ID NO: 3275093 - DNA, 18 bp, Homo sapiens
gtgtggggttctgctggg

SEQ ID NO: 3275094 - DNA, 13 bp, Homo sapiens
gtgtgggtcccgc

SEQ ID NO: 3275095 - DNA, 17 bp, Homo sapiens
gtgtgggtggaagggct

SEQ ID NO: 3275096 - DNA, 21 bp, Homo sapiens
gtgtggtttggtgtgttcccg

SEQ ID NO: 3275097 - DNA, 11 bp, Homo sapiens
gtgtgtaaata

SEQ ID NO: 3275098 - DNA, 15 bp, Homo sapiens
gtgtgtactctgtcc

SEQ ID NO: 3275099 - DNA, 17 bp, Homo sapiens
gtgtgtagagttaagaa

SEQ ID NO: 3275100 - DNA, 14 bp, Homo sapiens
gtgtgtaggctggg

SEQ ID NO: 3275101 - DNA, 19 bp, Homo sapiens
gtgtgtatccgactctaag

SEQ ID NO: 3275102 - DNA, 13 bp, Homo sapiens
gtgtgtccctgga

SEQ ID NO: 3275103 - DNA, 22 bp, Homo sapiens
gtgtgtccctggacacagctct

SEQ ID NO: 3275104 - DNA, 16 bp, Homo sapiens
gtgtgtctgctcagta

SEQ ID NO: 3275105 - DNA, 14 bp, Homo sapiens
gtgtgtcttaatta

SEQ ID NO: 3275106 - DNA, 19 bp, Homo sapiens
gtgtgtgcagagtccattt

SEQ ID NO: 3275107 - DNA, 21 bp, Homo sapiens
gtgtgtgcagagtccatttcc

SEQ ID NO: 3275108 - DNA, 17 bp, Homo sapiens
gtgtgtgcttacagtaa

SEQ ID NO: 3275109 - DNA, 13 bp, Homo sapiens
gtgtgtggcaggg

SEQ ID NO: 3275110 - DNA, 17 bp, Homo sapiens
gtgtgtgtatgtttgca

SEQ ID NO: 3275111 - DNA, 13 bp, Homo sapiens
gtgtgtgtgtgtg

SEQ ID NO: 3275112 - DNA, 14 bp, Homo sapiens
gtgtgtgtgtgtgt

SEQ ID NO: 3275113 - DNA, 16 bp, Homo sapiens
gtgtgttccaagtttc

SEQ ID NO: 3275114 - DNA, 20 bp, Homo sapiens
gtgtgttcttcaagccagct

SEQ ID NO: 3275115 - DNA, 20 bp, Homo sapiens
gtgtgttgtcagcctgtgct

SEQ ID NO: 3275116 - DNA, 20 bp, Homo sapiens
gtgtgtttggcttggccttg

SEQ ID NO: 3275117 - DNA, 17 bp, Homo sapiens
gtgtgttttcataataa

SEQ ID NO: 3275118 - DNA, 21 bp, Homo sapiens
gtgtgtttttgggatgtctta

SEQ ID NO: 3275119 - DNA, 19 bp, Homo sapiens
gtgttaaaggttttctcta

SEQ ID NO: 3275120 - DNA, 19 bp, Homo sapiens
gtgttaaatgaaattgtaa

SEQ ID NO: 3275121 - DNA, 14 bp, Homo sapiens
gtgttaacattcca

SEQ ID NO: 3275122 - DNA, 23 bp, Homo sapiens
gtgttacacagcccaagaggact

SEQ ID NO: 3275123 - DNA, 15 bp, Homo sapiens
gtgttactgtaattc

SEQ ID NO: 3275124 - DNA, 19 bp, Homo sapiens
gtgttactgtaattcctca

SEQ ID NO: 3275125 - DNA, 19 bp, Homo sapiens
gtgttacttcaagtaatac

SEQ ID NO: 3275126 - DNA, 13 bp, Homo sapiens
gtgttagagaaat

SEQ ID NO: 3275127 - DNA, 18 bp, Homo sapiens
gtgttcaaaatactactg

SEQ ID NO: 3275128 - DNA, 15 bp, Homo sapiens
gtgttcaagaaataa

SEQ ID NO: 3275129 - DNA, 14 bp, Homo sapiens
gtgttcattgtttc

SEQ ID NO: 3275130 - DNA, 23 bp, Homo sapiens
gtgttcatttggtgttcctggaa

SEQ ID NO: 3275131 - DNA, 17 bp, Homo sapiens
gtgttccaagtttccaa

SEQ ID NO: 3275132 - DNA, 17 bp, Homo sapiens
gtgttccattgcctctt

SEQ ID NO: 3275133 - DNA, 21 bp, Homo sapiens
gtgttcccatttcagctgatc

SEQ ID NO: 3275134 - DNA, 13 bp, Homo sapiens
gtgttcctcctgc

SEQ ID NO: 3275135 - DNA, 10 bp, Homo sapiens
gtgttcctgg

SEQ ID NO: 3275136 - DNA, 14 bp, Homo sapiens
gtgttcctggaagc

SEQ ID NO: 3275137 - DNA, 15 bp, Homo sapiens
gtgttcctggaagca

SEQ ID NO: 3275138 - DNA, 15 bp, Homo sapiens
gtgttcctggcaata

SEQ ID NO: 3275139 - DNA, 18 bp, Homo sapiens
gtgttcctggcaatagtg

SEQ ID NO: 3275140 - DNA, 21 bp, Homo sapiens
gtgttcctggcccactctgta

SEQ ID NO: 3275141 - DNA, 22 bp, Homo sapiens
gtgttctattgctgagaagcaa

SEQ ID NO: 3275142 - DNA, 16 bp, Homo sapiens
gtgttctgattagaaa

SEQ ID NO: 3275143 - DNA, 14 bp, Homo sapiens
gtgttctgtttgtt

SEQ ID NO: 3275144 - DNA, 18 bp, Homo sapiens
gtgttcttcaagccagct

SEQ ID NO: 3275145 - DNA, 15 bp, Homo sapiens
gtgttcttcttctct

SEQ ID NO: 3275146 - DNA, 20 bp, Homo sapiens
gtgttgagaagaatcaggag

SEQ ID NO: 3275147 - DNA, 21 bp, Homo sapiens
gtgttgagaagaatcaggaga

SEQ ID NO: 3275148 - DNA, 19 bp, Homo sapiens
gtgttgagccttttccctc

SEQ ID NO: 3275149 - DNA, 15 bp, Homo sapiens
gtgttgatcccaaga

SEQ ID NO: 3275150 - DNA, 20 bp, Homo sapiens
gtgttgccaaatatgtcctg

SEQ ID NO: 3275151 - DNA, 20 bp, Homo sapiens
gtgttgctaaaaaaagtgca

SEQ ID NO: 3275152 - DNA, 14 bp, Homo sapiens
gtgttgggatactg

SEQ ID NO: 3275153 - DNA, 23 bp, Homo sapiens
gtgttggggaaaccttcatctga

SEQ ID NO: 3275154 - DNA, 24 bp, Homo sapiens
gtgttggtctttctaatgtagcta

SEQ ID NO: 3275155 - DNA, 19 bp, Homo sapiens
gtgttgtattaacaaaagt

SEQ ID NO: 3275156 - DNA, 19 bp, Homo sapiens
gtgttgtcagcctgtgctg

SEQ ID NO: 3275157 - DNA, 22 bp, Homo sapiens
gtgttgtcagcctgtgctgtgg

SEQ ID NO: 3275158 - DNA, 22 bp, Homo sapiens
gtgtttatggccaatctattct

SEQ ID NO: 3275159 - DNA, 15 bp, Homo sapiens
gtgtttctgttatta

SEQ ID NO: 3275160 - DNA, 18 bp, Homo sapiens
gtgtttgcttaaacaaag

SEQ ID NO: 3275161 - DNA, 16 bp, Homo sapiens
gtgtttgtgagcatgg

SEQ ID NO: 3275162 - DNA, 14 bp, Homo sapiens
gtgttttaattgta

SEQ ID NO: 3275163 - DNA, 19 bp, Homo sapiens
gtgttttcttgtaaatgtt

SEQ ID NO: 3275164 - DNA, 20 bp, Homo sapiens
gtgttttcttgtaaatgttt

SEQ ID NO: 3275165 - DNA, 15 bp, Homo sapiens
gtgttttgaaagaat

SEQ ID NO: 3275166 - DNA, 19 bp, Homo sapiens
gtgtttttctcatatttga

SEQ ID NO: 3275167 - DNA, 13 bp, Homo sapiens
gtgtttttctcca

SEQ ID NO: 3275168 - DNA, 18 bp, Homo sapiens
gtgtttttctccagtgct

SEQ ID NO: 3275169 - DNA, 15 bp, Homo sapiens
gtgtttttgggatgt

SEQ ID NO: 3275170 - DNA, 19 bp, Homo sapiens
gtgtttttgggatgtctta

SEQ ID NO: 3275171 - DNA, 23 bp, Homo sapiens
taactaatttgaatgtggttact

SEQ ID NO: 3275172 - DNA, 20 bp, Homo sapiens
taactaattttgttgaaaat

SEQ ID NO: 3275173 - DNA, 18 bp, Homo sapiens
taactacaaagctttgct

SEQ ID NO: 3275174 - DNA, 21 bp, Homo sapiens
taactacaaagctttgctaca

SEQ ID NO: 3275175 - DNA, 15 bp, Homo sapiens
taactactgtgttcc

SEQ ID NO: 3275176 - DNA, 17 bp, Homo sapiens
taactactgtgttcctg

SEQ ID NO: 3275177 - DNA, 23 bp, Homo sapiens
taactactttataactaacatgt

SEQ ID NO: 3275178 - DNA, 13 bp, Homo sapiens
taactagaattag

SEQ ID NO: 3275179 - DNA, 18 bp, Homo sapiens
taactagaattagtatgt

SEQ ID NO: 3275180 - DNA, 23 bp, Homo sapiens
taactagaattagtatgtctgtt

SEQ ID NO: 3275181 - DNA, 13 bp, Homo sapiens
taactagtggctc

SEQ ID NO: 3275182 - DNA, 17 bp, Homo sapiens
taactatatttgctttt

SEQ ID NO: 3275183 - DNA, 15 bp, Homo sapiens
taactattaaccttt

SEQ ID NO: 3275184 - DNA, 18 bp, Homo sapiens
taactattaacctttttt

SEQ ID NO: 3275185 - DNA, 20 bp, Homo sapiens
taactcaaatacacatttgc

SEQ ID NO: 3275186 - DNA, 19 bp, Homo sapiens
taactcaatcatgaatgaa

SEQ ID NO: 3275187 - DNA, 14 bp, Homo sapiens
taactccactgctt

SEQ ID NO: 3275188 - DNA, 20 bp, Homo sapiens
taactctgcaaaggcctggg

SEQ ID NO: 3275189 - DNA, 17 bp, Homo sapiens
taactctgctgaatgta

SEQ ID NO: 3275190 - DNA, 18 bp, Homo sapiens
taactctgtaaaaacact

SEQ ID NO: 3275191 - DNA, 16 bp, Homo sapiens
taactctgtataatag

SEQ ID NO: 3275192 - DNA, 22 bp, Homo sapiens
taactctgtattacagctttca

SEQ ID NO: 3275193 - DNA, 17 bp, Homo sapiens
taactcttttctatttt

SEQ ID NO: 3275194 - DNA, 15 bp, Homo sapiens
taactgaaaatgtaa

SEQ ID NO: 3275195 - DNA, 13 bp, Homo sapiens
taactgaaccaaa

SEQ ID NO: 3275196 - DNA, 13 bp, Homo sapiens
taactgaatgttt

SEQ ID NO: 3275197 - DNA, 15 bp, Homo sapiens
taactgatttctatg

SEQ ID NO: 3275198 - DNA, 20 bp, Homo sapiens
taactgatttctatggcttt

SEQ ID NO: 3275199 - DNA, 20 bp, Homo sapiens
taactgcaattttaattgat

SEQ ID NO: 3275200 - DNA, 16 bp, Homo sapiens
taactgcagttgactt

SEQ ID NO: 3275201 - DNA, 16 bp, Homo sapiens
taactgctcttgaaca

SEQ ID NO: 3275202 - DNA, 13 bp, Homo sapiens
taactgctgagcc

SEQ ID NO: 3275203 - DNA, 14 bp, Homo sapiens
taactgctgagcca

SEQ ID NO: 3275204 - DNA, 15 bp, Homo sapiens
taactgctgagccac

SEQ ID NO: 3275205 - DNA, 19 bp, Homo sapiens
taactggaacaaattattt

SEQ ID NO: 3275206 - DNA, 22 bp, Homo sapiens
taactggaaggccttccactgt

SEQ ID NO: 3275207 - DNA, 13 bp, Homo sapiens
taactgtaaatca

SEQ ID NO: 3275208 - DNA, 14 bp, Homo sapiens
taactgtaaatcat

SEQ ID NO: 3275209 - DNA, 18 bp, Homo sapiens
taactgtagctcaagttt

SEQ ID NO: 3275210 - DNA, 16 bp, Homo sapiens
taactgtgaaatacca

SEQ ID NO: 3275211 - DNA, 13 bp, Homo sapiens
taactgtgaagtt

SEQ ID NO: 3275212 - DNA, 18 bp, Homo sapiens
taactgtgaagtttacat

SEQ ID NO: 3275213 - DNA, 18 bp, Homo sapiens
taactgtgccagttcttt

SEQ ID NO: 3275214 - DNA, 18 bp, Homo sapiens
taactgtgcgttaaataa

SEQ ID NO: 3275215 - DNA, 21 bp, Homo sapiens
taacttaaaaatgtaaatatt

SEQ ID NO: 3275216 - DNA, 23 bp, Homo sapiens
taacttaaaaatgtaaatattct

SEQ ID NO: 3275217 - DNA, 23 bp, Homo sapiens
taacttaacccagattttattta

SEQ ID NO: 3275218 - DNA, 15 bp, Homo sapiens
taacttaatactcta

SEQ ID NO: 3275219 - DNA, 13 bp, Homo sapiens
taacttactgtat

SEQ ID NO: 3275220 - DNA, 19 bp, Homo sapiens
taacttatgtagatatttg

SEQ ID NO: 3275221 - DNA, 21 bp, Homo sapiens
taacttatgtagatatttggc

SEQ ID NO: 3275222 - DNA, 15 bp, Homo sapiens
taacttattagaaac

SEQ ID NO: 3275223 - DNA, 15 bp, Homo sapiens
taacttatttagaga

SEQ ID NO: 3275224 - DNA, 16 bp, Homo sapiens
taacttccagtggctg

SEQ ID NO: 3275225 - DNA, 18 bp, Homo sapiens
taacttcttaaaagttgt

SEQ ID NO: 3275226 - DNA, 18 bp, Homo sapiens
taacttcttcctgctgga

SEQ ID NO: 3275227 - DNA, 22 bp, Homo sapiens
taacttgagagtagatggtttg

SEQ ID NO: 3275228 - DNA, 15 bp, Homo sapiens
taacttgagttttat

SEQ ID NO: 3275229 - DNA, 12 bp, Homo sapiens
taacttgatgca

SEQ ID NO: 3275230 - DNA, 15 bp, Homo sapiens
taacttggctttcat

SEQ ID NO: 3275231 - DNA, 13 bp, Homo sapiens
taacttggggagg

SEQ ID NO: 3275232 - DNA, 14 bp, Homo sapiens
taacttggggaggc

SEQ ID NO: 3275233 - DNA, 16 bp, Homo sapiens
taactttaagtttcag

SEQ ID NO: 3275234 - DNA, 15 bp, Homo sapiens
taactttatcacatt

SEQ ID NO: 3275235 - DNA, 21 bp, Homo sapiens
taactttattacaatttgtat

SEQ ID NO: 3275236 - DNA, 20 bp, Homo sapiens
taactttattctttgttctt

SEQ ID NO: 3275237 - DNA, 20 bp, Homo sapiens
taacttttgtaaatacacat

SEQ ID NO: 3275238 - DNA, 13 bp, Homo sapiens
taacttttgtaag

SEQ ID NO: 3275239 - DNA, 18 bp, Homo sapiens
taacttttgtaagacaaa

SEQ ID NO: 3275240 - DNA, 17 bp, Homo sapiens
taactttttatttctaa

SEQ ID NO: 3275241 - DNA, 18 bp, Homo sapiens
taacttttttgtgtatgt

SEQ ID NO: 3275242 - DNA, 23 bp, Homo sapiens
taacttttttgtgtatgtactta

SEQ ID NO: 3275243 - DNA, 21 bp, Homo sapiens
taactttttttcttctacttt

SEQ ID NO: 3275244 - DNA, 11 bp, Homo sapiens
taagaaaaaag

SEQ ID NO: 3275245 - DNA, 23 bp, Homo sapiens
taagaaaacaaaatctaaaacaa

SEQ ID NO: 3275246 - DNA, 14 bp, Homo sapiens
taagaaaagatttt

SEQ ID NO: 3275247 - DNA, 12 bp, Homo sapiens
taagaaaagcac

SEQ ID NO: 3275248 - DNA, 18 bp, Homo sapiens
taagaaaagcacttttgt

SEQ ID NO: 3275249 - DNA, 21 bp, Homo sapiens
taagaaaagcacttttgttat

SEQ ID NO: 3275250 - DNA, 17 bp, Homo sapiens
taagaaaatacaataaa

SEQ ID NO: 3275251 - DNA, 14 bp, Homo sapiens
taagaaaatgcttg

SEQ ID NO: 3275252 - DNA, 22 bp, Homo sapiens
taagaaacacagggttttgtat

SEQ ID NO: 3275253 - DNA, 20 bp, Homo sapiens
taagaaactatgaagatctg

SEQ ID NO: 3275254 - DNA, 19 bp, Homo sapiens
taagaaacttttgtaaaga

SEQ ID NO: 3275255 - DNA, 13 bp, Homo sapiens
taagaaatagaat

SEQ ID NO: 3275256 - DNA, 18 bp, Homo sapiens
taagaaccattgatttaa

SEQ ID NO: 3275257 - DNA, 16 bp, Homo sapiens
taagaaccttaatgac

SEQ ID NO: 3275258 - DNA, 18 bp, Homo sapiens
taagaaccttaatgacaa

SEQ ID NO: 3275259 - DNA, 13 bp, Homo sapiens
taagaagaaagca

SEQ ID NO: 3275260 - DNA, 15 bp, Homo sapiens
taagaagacatgaac

SEQ ID NO: 3275261 - DNA, 12 bp, Homo sapiens
taagaagagact

SEQ ID NO: 3275262 - DNA, 19 bp, Homo sapiens
taagaagagactgggaaga

SEQ ID NO: 3275263 - DNA, 22 bp, Homo sapiens
taagaagcctataagaggaatt

SEQ ID NO: 3275264 - DNA, 23 bp, Homo sapiens
taagaagccttaatttgcacagt

SEQ ID NO: 3275265 - DNA, 21 bp, Homo sapiens
taagaagctgttgtacattta

SEQ ID NO: 3275266 - DNA, 14 bp, Homo sapiens
taagaagcttctaa

SEQ ID NO: 3275267 - DNA, 13 bp, Homo sapiens
taagaaggcaaaa

SEQ ID NO: 3275268 - DNA, 15 bp, Homo sapiens
taagaagttgtttga

SEQ ID NO: 3275269 - DNA, 22 bp, Homo sapiens
taagaataccacatcaaataag

SEQ ID NO: 3275270 - DNA, 17 bp, Homo sapiens
taagaatagttctaaaa

SEQ ID NO: 3275271 - DNA, 21 bp, Homo sapiens
taagaatatgtttccttgttt

SEQ ID NO: 3275272 - DNA, 19 bp, Homo sapiens
taagaatcagagtagaaat

SEQ ID NO: 3275273 - DNA, 14 bp, Homo sapiens
taagaatctttaga

SEQ ID NO: 3275274 - DNA, 22 bp, Homo sapiens
taagaatgcagattcctgggcc

SEQ ID NO: 3275275 - DNA, 23 bp, Homo sapiens
taagaatgcagattcctgggcct

SEQ ID NO: 3275276 - DNA, 21 bp, Homo sapiens
taagaatgctggttttcctaa

SEQ ID NO: 3275277 - DNA, 17 bp, Homo sapiens
taagaatggttgcctta

SEQ ID NO: 3275278 - DNA, 14 bp, Homo sapiens
taagaattcaaact

SEQ ID NO: 3275279 - DNA, 22 bp, Homo sapiens
taagaattcaaactggggcctc

SEQ ID NO: 3275280 - DNA, 19 bp, Homo sapiens
taagaattctgattgattt

SEQ ID NO: 3275281 - DNA, 20 bp, Homo sapiens
taagaattctgattgatttg

SEQ ID NO: 3275282 - DNA, 18 bp, Homo sapiens
taagaattgagtaatggt

SEQ ID NO: 3275283 - DNA, 22 bp, Homo sapiens
taagaattgagtaatggtgtag

SEQ ID NO: 3275284 - DNA, 14 bp, Homo sapiens
taagacacaaatgc

SEQ ID NO: 3275285 - DNA, 23 bp, Homo sapiens
taagacactgaaaaatctaagtg

SEQ ID NO: 3275286 - DNA, 18 bp, Homo sapiens
taagacagtgtacaaaac

SEQ ID NO: 3275287 - DNA, 12 bp, Homo sapiens
taagacataacg

SEQ ID NO: 3275288 - DNA, 14 bp, Homo sapiens
taagacatttgtat

SEQ ID NO: 3275289 - DNA, 15 bp, Homo sapiens
taagaccccatctct

SEQ ID NO: 3275290 - DNA, 16 bp, Homo sapiens
taagaccctaattctt

SEQ ID NO: 3275291 - DNA, 21 bp, Homo sapiens
taagaccgtgtcccaaggagc

SEQ ID NO: 3275292 - DNA, 16 bp, Homo sapiens
taagacctactgttct

SEQ ID NO: 3275293 - DNA, 17 bp, Homo sapiens
taagacctactgttcta

SEQ ID NO: 3275294 - DNA, 18 bp, Homo sapiens
taagacctactgttctaa

SEQ ID NO: 3275295 - DNA, 20 bp, Homo sapiens
taagacggttaaatactgtg

SEQ ID NO: 3275296 - DNA, 17 bp, Homo sapiens
taagactaaatctgtaa

SEQ ID NO: 3275297 - DNA, 23 bp, Homo sapiens
taagactaaatctgtaagctctt

SEQ ID NO: 3275298 - DNA, 18 bp, Homo sapiens
taagactcaaatgttcta

SEQ ID NO: 3275299 - DNA, 16 bp, Homo sapiens
taagactctcacactc

SEQ ID NO: 3275300 - DNA, 15 bp, Homo sapiens
taagactgtgtattc

SEQ ID NO: 3275301 - DNA, 17 bp, Homo sapiens
taagacttactctaaga

SEQ ID NO: 3275302 - DNA, 18 bp, Homo sapiens
taagagaaaagagagaaa

SEQ ID NO: 3275303 - DNA, 15 bp, Homo sapiens
taagagaaacaggcc

SEQ ID NO: 3275304 - DNA, 13 bp, Homo sapiens
taagagaaagaaa

SEQ ID NO: 3275305 - DNA, 20 bp, Homo sapiens
taagagacacatacagagtg

SEQ ID NO: 3275306 - DNA, 11 bp, Homo sapiens
taagagattta

SEQ ID NO: 3275307 - DNA, 21 bp, Homo sapiens
taagagatttatctttataca

SEQ ID NO: 3275308 - DNA, 15 bp, Homo sapiens
taagagcaccttcct

SEQ ID NO: 3275309 - DNA, 22 bp, Homo sapiens
taagagccatataagtttgaag

SEQ ID NO: 3275310 - DNA, 22 bp, Homo sapiens
taagagccatttaggggccact

SEQ ID NO: 3275311 - DNA, 17 bp, Homo sapiens
taagagctggtgtctga

SEQ ID NO: 3275312 - DNA, 15 bp, Homo sapiens
taagaggcagggtct

SEQ ID NO: 3275313 - DNA, 12 bp, Homo sapiens
taagagtgtaga

SEQ ID NO: 3275314 - DNA, 16 bp, Homo sapiens
taagagtgtagaagca

SEQ ID NO: 3275315 - DNA, 19 bp, Homo sapiens
taagagtgtagaagcattc

SEQ ID NO: 3275316 - DNA, 16 bp, Homo sapiens
taagataaatgtgctg

SEQ ID NO: 3275317 - DNA, 16 bp, Homo sapiens
taagatatccatcttt

SEQ ID NO: 3275318 - DNA, 20 bp, Homo sapiens
taagatatccatctttttct

SEQ ID NO: 3275319 - DNA, 17 bp, Homo sapiens
taagatcttagattctc

SEQ ID NO: 3275320 - DNA, 15 bp, Homo sapiens
taagatggattctca

SEQ ID NO: 3275321 - DNA, 18 bp, Homo sapiens
taagatgggcagctagtt

SEQ ID NO: 3275322 - DNA, 16 bp, Homo sapiens
taagatggttgaccaa

SEQ ID NO: 3275323 - DNA, 18 bp, Homo sapiens
taagatgtgatattctaa

SEQ ID NO: 3275324 - DNA, 21 bp, Homo sapiens
taagatgtgatattctaagac

SEQ ID NO: 3275325 - DNA, 17 bp, Homo sapiens
taagatgtgttcttatt

SEQ ID NO: 3275326 - DNA, 19 bp, Homo sapiens
taagattacaaatcagaag

SEQ ID NO: 3275327 - DNA, 15 bp, Homo sapiens
taagattagttgaat

SEQ ID NO: 3275328 - DNA, 15 bp, Homo sapiens
taagattatagattc

SEQ ID NO: 3275329 - DNA, 18 bp, Homo sapiens
taagattatagattctaa

SEQ ID NO: 3275330 - DNA, 23 bp, Homo sapiens
taagattatagattctaaagatt

SEQ ID NO: 3275331 - DNA, 16 bp, Homo sapiens
taagattatctgggga

SEQ ID NO: 3275332 - DNA, 14 bp, Homo sapiens
taagattcatattt

SEQ ID NO: 3275333 - DNA, 12 bp, Homo sapiens
taagattctaaa

SEQ ID NO: 3275334 - DNA, 17 bp, Homo sapiens
taagattctaaaggtcc

SEQ ID NO: 3275335 - DNA, 12 bp, Homo sapiens
taagattctaat

SEQ ID NO: 3275336 - DNA, 13 bp, Homo sapiens
taagattctaatg

SEQ ID NO: 3275337 - DNA, 14 bp, Homo sapiens
taagattctaatga

SEQ ID NO: 3275338 - DNA, 11 bp, Homo sapiens
taagattctag

SEQ ID NO: 3275339 - DNA, 12 bp, Homo sapiens
taagattctaga

SEQ ID NO: 3275340 - DNA, 13 bp, Homo sapiens
taagattctagat

SEQ ID NO: 3275341 - DNA, 14 bp, Homo sapiens
taagattctagatc

SEQ ID NO: 3275342 - DNA, 14 bp, Homo sapiens
taagattcttttaa

SEQ ID NO: 3275343 - DNA, 15 bp, Homo sapiens
taagattcttttaaa

SEQ ID NO: 3275344 - DNA, 18 bp, Homo sapiens
taagattgtaaaaataat

SEQ ID NO: 3275345 - DNA, 13 bp, Homo sapiens
taagatttaccca

SEQ ID NO: 3275346 - DNA, 22 bp, Homo sapiens
taagatttacccagaatgtcag

SEQ ID NO: 3275347 - DNA, 19 bp, Homo sapiens
taagatttagagatgaatt

SEQ ID NO: 3275348 - DNA, 14 bp, Homo sapiens
taagattttacaaa

SEQ ID NO: 3275349 - DNA, 20 bp, Homo sapiens
taagatttttctcaaagttt

SEQ ID NO: 3275350 - DNA, 14 bp, Homo sapiens
taagcaaatgttaa

SEQ ID NO: 3275351 - DNA, 18 bp, Homo sapiens
taagcaaatgttaaaagt

SEQ ID NO: 3275352 - DNA, 13 bp, Homo sapiens
taagcaaatttca

SEQ ID NO: 3275353 - DNA, 18 bp, Homo sapiens
taagcaagagagatgttt

SEQ ID NO: 3275354 - DNA, 22 bp, Homo sapiens
taagcactacataaactgactt

SEQ ID NO: 3275355 - DNA, 14 bp, Homo sapiens
taagcactgtgcta

SEQ ID NO: 3275356 - DNA, 16 bp, Homo sapiens
taagcactgtgctaat

SEQ ID NO: 3275357 - DNA, 13 bp, Homo sapiens
taagcagagaagg

SEQ ID NO: 3275358 - DNA, 16 bp, Homo sapiens
taagcagcatggaaaa

SEQ ID NO: 3275359 - DNA, 17 bp, Homo sapiens
taagcagcatggaaaaa

SEQ ID NO: 3275360 - DNA, 19 bp, Homo sapiens
taagcagcatggaaaaatg

SEQ ID NO: 3275361 - DNA, 17 bp, Homo sapiens
taagcagctcttgctaa

SEQ ID NO: 3275362 - DNA, 21 bp, Homo sapiens
taagcaggtggatctatttca

SEQ ID NO: 3275363 - DNA, 12 bp, Homo sapiens
taagcagtatat

SEQ ID NO: 3275364 - DNA, 18 bp, Homo sapiens
taagcagtgtctgtgttt

SEQ ID NO: 3275365 - DNA, 18 bp, Homo sapiens
taagcatactttgtaaat

SEQ ID NO: 3275366 - DNA, 14 bp, Homo sapiens
taagcatctaagtt

SEQ ID NO: 3275367 - DNA, 15 bp, Homo sapiens
taagcattgcctggc

SEQ ID NO: 3275368 - DNA, 10 bp, Homo sapiens
taagcattta

SEQ ID NO: 3275369 - DNA, 12 bp, Homo sapiens
taagcatttatt

SEQ ID NO: 3275370 - DNA, 11 bp, Homo sapiens
taagccaaaga

SEQ ID NO: 3275371 - DNA, 17 bp, Homo sapiens
taagccaaagaaacaag

SEQ ID NO: 3275372 - DNA, 22 bp, Homo sapiens
taagccaaagaaacaagctgtg

SEQ ID NO: 3275373 - DNA, 21 bp, Homo sapiens
taagccaaagaaatgaacatt

SEQ ID NO: 3275374 - DNA, 16 bp, Homo sapiens
taagccagagcctggg

SEQ ID NO: 3275375 - DNA, 19 bp, Homo sapiens
taagccagttttcattttg

SEQ ID NO: 3275376 - DNA, 18 bp, Homo sapiens
taagccctcgaaccaagg

SEQ ID NO: 3275377 - DNA, 21 bp, Homo sapiens
taagccctcgaaccaaggcag

SEQ ID NO: 3275378 - DNA, 22 bp, Homo sapiens
taagccctcgaaccaaggcagc

SEQ ID NO: 3275379 - DNA, 11 bp, Homo sapiens
taagccctgtc

SEQ ID NO: 3275380 - DNA, 18 bp, Homo sapiens
taagccgatggtcactat

SEQ ID NO: 3275381 - DNA, 20 bp, Homo sapiens
taagcctccatttagttctt

SEQ ID NO: 3275382 - DNA, 14 bp, Homo sapiens
taagcctgagcctt

SEQ ID NO: 3275383 - DNA, 20 bp, Homo sapiens
taagccttataaaccaatct

SEQ ID NO: 3275384 - DNA, 22 bp, Homo sapiens
taagcgaagtctttgccttctc

SEQ ID NO: 3275385 - DNA, 23 bp, Homo sapiens
taagcgaagtctttgccttctct

SEQ ID NO: 3275386 - DNA, 17 bp, Homo sapiens
taagcgttaagggcaga

SEQ ID NO: 3275387 - DNA, 15 bp, Homo sapiens
taagctatcagcaat

SEQ ID NO: 3275388 - DNA, 20 bp, Homo sapiens
taagctccttgagtaaaaag

SEQ ID NO: 3275389 - DNA, 21 bp, Homo sapiens
taagctctttgaaacaacttt

SEQ ID NO: 3275390 - DNA, 16 bp, Homo sapiens
taagctgctctattgt

SEQ ID NO: 3275391 - DNA, 15 bp, Homo sapiens
taagctgtgtgcagg

SEQ ID NO: 3275392 - DNA, 13 bp, Homo sapiens
taagctgtttatt

SEQ ID NO: 3275393 - DNA, 21 bp, Homo sapiens
taagctgtttattttatatta

SEQ ID NO: 3275394 - DNA, 16 bp, Homo sapiens
taagctgtttccatag

SEQ ID NO: 3275395 - DNA, 16 bp, Homo sapiens
taagcttatgtcagac

SEQ ID NO: 3275396 - DNA, 23 bp, Homo sapiens
taagcttccattttaattttaaa

SEQ ID NO: 3275397 - DNA, 17 bp, Homo sapiens
taagctttctctcagaa

SEQ ID NO: 3275398 - DNA, 19 bp, Homo sapiens
taagctttctctcagaaat

SEQ ID NO: 3275399 - DNA, 11 bp, Homo sapiens
taaggaaacaa

SEQ ID NO: 3275400 - DNA, 10 bp, Homo sapiens
taaggaaact

SEQ ID NO: 3275401 - DNA, 15 bp, Homo sapiens
taaggaaactcttat

SEQ ID NO: 3275402 - DNA, 20 bp, Homo sapiens
taaggaaactcttatctcag

SEQ ID NO: 3275403 - DNA, 18 bp, Homo sapiens
taaggaaagcaataaatg

SEQ ID NO: 3275404 - DNA, 15 bp, Homo sapiens
taaggaaccttcctt

SEQ ID NO: 3275405 - DNA, 18 bp, Homo sapiens
taaggacatttcccaggg

SEQ ID NO: 3275406 - DNA, 21 bp, Homo sapiens
taaggaccgtggccctgccct

SEQ ID NO: 3275407 - DNA, 23 bp, Homo sapiens
taaggaccgtggccctgccctct

SEQ ID NO: 3275408 - DNA, 18 bp, Homo sapiens
taaggagcatcagccagt

SEQ ID NO: 3275409 - DNA, 19 bp, Homo sapiens
taaggaggaggagggagaa

SEQ ID NO: 3275410 - DNA, 17 bp, Homo sapiens
taaggataatgaaataa

SEQ ID NO: 3275411 - DNA, 17 bp, Homo sapiens
taaggatactttacatg

SEQ ID NO: 3275412 - DNA, 16 bp, Homo sapiens
taaggatctctcagga

SEQ ID NO: 3275413 - DNA, 20 bp, Homo sapiens
taaggatggagccagctctg

SEQ ID NO: 3275414 - DNA, 17 bp, Homo sapiens
taaggatgtcacagggc

SEQ ID NO: 3275415 - DNA, 20 bp, Homo sapiens
taaggatgtcacagggccaa

SEQ ID NO: 3275416 - DNA, 17 bp, Homo sapiens
taaggcacagtgggagc

SEQ ID NO: 3275417 - DNA, 18 bp, Homo sapiens
taaggcctaggattctaa

SEQ ID NO: 3275418 - DNA, 19 bp, Homo sapiens
taagggacttaacttgttt

SEQ ID NO: 3275419 - DNA, 14 bp, Homo sapiens
taagggatttctta

SEQ ID NO: 3275420 - DNA, 17 bp, Homo sapiens
taagggatttcttaggg

SEQ ID NO: 3275421 - DNA, 14 bp, Homo sapiens
taagggcacacaca

SEQ ID NO: 3275422 - DNA, 20 bp, Homo sapiens
taagggcagtgcccatgtgt

SEQ ID NO: 3275423 - DNA, 18 bp, Homo sapiens
taagggggaaaactgttc

SEQ ID NO: 3275424 - DNA, 22 bp, Homo sapiens
taaggggtgggtcagaacatgt

SEQ ID NO: 3275425 - DNA, 23 bp, Homo sapiens
taaggggtttgccatttgatacc

SEQ ID NO: 3275426 - DNA, 17 bp, Homo sapiens
taagggtcgaaagctct

SEQ ID NO: 3275427 - DNA, 13 bp, Homo sapiens
taagggtgggtgc

SEQ ID NO: 3275428 - DNA, 18 bp, Homo sapiens
taagggtgggtgctcaga

SEQ ID NO: 3275429 - DNA, 20 bp, Homo sapiens
taagggtgggtgctcagaat

SEQ ID NO: 3275430 - DNA, 16 bp, Homo sapiens
taagggttgaaggcag

SEQ ID NO: 3275431 - DNA, 18 bp, Homo sapiens
taaggtccggtgttctaa

SEQ ID NO: 3275432 - DNA, 20 bp, Homo sapiens
taaggtccggtgttctaaga

SEQ ID NO: 3275433 - DNA, 21 bp, Homo sapiens
taaggtctttcagtacttttt

SEQ ID NO: 3275434 - DNA, 20 bp, Homo sapiens
taaggtgatatatttaaaaa

SEQ ID NO: 3275435 - DNA, 12 bp, Homo sapiens
taaggtgcagtt

SEQ ID NO: 3275436 - DNA, 20 bp, Homo sapiens
taagtaacttcacattaaaa

SEQ ID NO: 3275437 - DNA, 20 bp, Homo sapiens
taagtaatcaataaagaaaa

SEQ ID NO: 3275438 - DNA, 22 bp, Homo sapiens
taagtaatgtggaagaaaatgg

SEQ ID NO: 3275439 - DNA, 12 bp, Homo sapiens
taagtaattatg

SEQ ID NO: 3275440 - DNA, 16 bp, Homo sapiens
taagtaattcaagaaa

SEQ ID NO: 3275441 - DNA, 18 bp, Homo sapiens
taagtaccactcaggcca

SEQ ID NO: 3275442 - DNA, 19 bp, Homo sapiens
taagtaccctgatgccttt

SEQ ID NO: 3275443 - DNA, 13 bp, Homo sapiens
taagtactatgta

SEQ ID NO: 3275444 - DNA, 17 bp, Homo sapiens
taagtactatgtatcaa

SEQ ID NO: 3275445 - DNA, 19 bp, Homo sapiens
taagtactatgtatcaatg

SEQ ID NO: 3275446 - DNA, 21 bp, Homo sapiens
taagtactgtaataatacctc

SEQ ID NO: 3275447 - DNA, 16 bp, Homo sapiens
taagtagaacaaaaaa

SEQ ID NO: 3275448 - DNA, 19 bp, Homo sapiens
taagtagaacaaaaaaccc

SEQ ID NO: 3275449 - DNA, 18 bp, Homo sapiens
taagtagttggtttgtat

SEQ ID NO: 3275450 - DNA, 21 bp, Homo sapiens
taagtatctgggattattctt

SEQ ID NO: 3275451 - DNA, 20 bp, Homo sapiens
taagtattcttatttaatga

SEQ ID NO: 3275452 - DNA, 10 bp, Homo sapiens
taagtattta

SEQ ID NO: 3275453 - DNA, 18 bp, Homo sapiens
taagtatttaaatgttct

SEQ ID NO: 3275454 - DNA, 14 bp, Homo sapiens
taagtatttataat

SEQ ID NO: 3275455 - DNA, 15 bp, Homo sapiens
taagtatttatatat

SEQ ID NO: 3275456 - DNA, 20 bp, Homo sapiens
taagtcaaaaggaacaaaaa

SEQ ID NO: 3275457 - DNA, 14 bp, Homo sapiens
taagtcaagcacat

SEQ ID NO: 3275458 - DNA, 18 bp, Homo sapiens
taagtcaagcacatgtaa

SEQ ID NO: 3275459 - DNA, 16 bp, Homo sapiens
taagtcattttcatgt

SEQ ID NO: 3275460 - DNA, 20 bp, Homo sapiens
taagtcccagtatacctcat

SEQ ID NO: 3275461 - DNA, 19 bp, Homo sapiens
taagtctgggatgtagaac

SEQ ID NO: 3275462 - DNA, 20 bp, Homo sapiens
taagtcttacataaaccatt

SEQ ID NO: 3275463 - DNA, 14 bp, Homo sapiens
taagtctttactct

SEQ ID NO: 3275464 - DNA, 14 bp, Homo sapiens
taagtctttcatgg

SEQ ID NO: 3275465 - DNA, 12 bp, Homo sapiens
taagtctttccc

SEQ ID NO: 3275466 - DNA, 16 bp, Homo sapiens
taagtgaaaaggtcat

SEQ ID NO: 3275467 - DNA, 13 bp, Homo sapiens
taagtgaatttat

SEQ ID NO: 3275468 - DNA, 16 bp, Homo sapiens
taagtgcactttttta

SEQ ID NO: 3275469 - DNA, 17 bp, Homo sapiens
taagtgcacttttttat

SEQ ID NO: 3275470 - DNA, 12 bp, Homo sapiens
taagtgcccaaa

SEQ ID NO: 3275471 - DNA, 19 bp, Homo sapiens
taagtgcctcacatttttt

SEQ ID NO: 3275472 - DNA, 18 bp, Homo sapiens
taagtgcgtgtgtagagt

SEQ ID NO: 3275473 - DNA, 23 bp, Homo sapiens
taagtgcgtgtgtagagttaaga

SEQ ID NO: 3275474 - DNA, 16 bp, Homo sapiens
taagtggaggcacttt

SEQ ID NO: 3275475 - DNA, 18 bp, Homo sapiens
taagtgtatttttcaata

SEQ ID NO: 3275476 - DNA, 22 bp, Homo sapiens
taagtgtgtcttcctagaattc

SEQ ID NO: 3275477 - DNA, 14 bp, Homo sapiens
taagtgttgtaaat

SEQ ID NO: 3275478 - DNA, 19 bp, Homo sapiens
taagttaataatgtattgt

SEQ ID NO: 3275479 - DNA, 16 bp, Homo sapiens
taagttaatgtatata

SEQ ID NO: 3275480 - DNA, 21 bp, Homo sapiens
taagttaatgtatataaaaat

SEQ ID NO: 3275481 - DNA, 13 bp, Homo sapiens
taagttattttat

SEQ ID NO: 3275482 - DNA, 17 bp, Homo sapiens
taagttgaatggcctgc

SEQ ID NO: 3275483 - DNA, 23 bp, Homo sapiens
taagttgctgtgtgtctgtcctg

SEQ ID NO: 3275484 - DNA, 22 bp, Homo sapiens
taagttggcttctgtttctagt

SEQ ID NO: 3275485 - DNA, 22 bp, Homo sapiens
taagttgtacaaatgtattttg

SEQ ID NO: 3275486 - DNA, 23 bp, Homo sapiens
taagttgtacaaatgtattttga

SEQ ID NO: 3275487 - DNA, 16 bp, Homo sapiens
taagtttacaccttta

SEQ ID NO: 3275488 - DNA, 22 bp, Homo sapiens
taagtttcaggtgacatgtgaa

SEQ ID NO: 3275489 - DNA, 14 bp, Homo sapiens
taagtttctaagat

SEQ ID NO: 3275490 - DNA, 15 bp, Homo sapiens
taagtttctaagatt

SEQ ID NO: 3275491 - DNA, 16 bp, Homo sapiens
taagtttctaagattc

SEQ ID NO: 3275492 - DNA, 19 bp, Homo sapiens
taagtttctaagattctaa

SEQ ID NO: 3275493 - DNA, 20 bp, Homo sapiens
taagtttctaagattctaaa

SEQ ID NO: 3275494 - DNA, 23 bp, Homo sapiens
taagtttctaagattctaaaggt

SEQ ID NO: 3275495 - DNA, 20 bp, Homo sapiens
taagtttggagcactagttt

SEQ ID NO: 3275496 - DNA, 19 bp, Homo sapiens
taataaaaaatggaaagaa

SEQ ID NO: 3275497 - DNA, 14 bp, Homo sapiens
taataaaaatgaca

SEQ ID NO: 3275498 - DNA, 21 bp, Homo sapiens
taataaaaatgacagactgaa

SEQ ID NO: 3275499 - DNA, 18 bp, Homo sapiens
taataaaactgcacagtg

SEQ ID NO: 3275500 - DNA, 22 bp, Homo sapiens
taataaaatgtgttgaaactgc

SEQ ID NO: 3275501 - DNA, 20 bp, Homo sapiens
taataaacactggctctggg

SEQ ID NO: 3275502 - DNA, 22 bp, Homo sapiens
taataaacactggctctgggac

SEQ ID NO: 3275503 - DNA, 12 bp, Homo sapiens
taataaactgta

SEQ ID NO: 3275504 - DNA, 15 bp, Homo sapiens
taataaactgtgttt

SEQ ID NO: 3275505 - DNA, 17 bp, Homo sapiens
taataaactttaatata

SEQ ID NO: 3275506 - DNA, 16 bp, Homo sapiens
taataaagctactgat

SEQ ID NO: 3275507 - DNA, 18 bp, Homo sapiens
taataaagtgttttcaga

SEQ ID NO: 3275508 - DNA, 19 bp, Homo sapiens
taataaagtgttttcagag

SEQ ID NO: 3275509 - DNA, 16 bp, Homo sapiens
taataaatacatacgg

SEQ ID NO: 3275510 - DNA, 19 bp, Homo sapiens
taataaatgacaaatgtat

SEQ ID NO: 3275511 - DNA, 18 bp, Homo sapiens
taataaatgccctcttct

SEQ ID NO: 3275512 - DNA, 15 bp, Homo sapiens
taataaattcaaaac

SEQ ID NO: 3275513 - DNA, 13 bp, Homo sapiens
taataaattcaga

SEQ ID NO: 3275514 - DNA, 15 bp, Homo sapiens
taataaattcagata

SEQ ID NO: 3275515 - DNA, 13 bp, Homo sapiens
taataaattgaaa

SEQ ID NO: 3275516 - DNA, 14 bp, Homo sapiens
taataaatttaagt

SEQ ID NO: 3275517 - DNA, 17 bp, Homo sapiens
taataacaatatataga

SEQ ID NO: 3275518 - DNA, 15 bp, Homo sapiens
taataacattacctt

SEQ ID NO: 3275519 - DNA, 17 bp, Homo sapiens
taataacgtgaaactta

SEQ ID NO: 3275520 - DNA, 20 bp, Homo sapiens
taataactcggattccagcc

SEQ ID NO: 3275521 - DNA, 15 bp, Homo sapiens
taataactgtgaagt

SEQ ID NO: 3275522 - DNA, 16 bp, Homo sapiens
taataagcactgtaaa

SEQ ID NO: 3275523 - DNA, 13 bp, Homo sapiens
taataatacctca

SEQ ID NO: 3275524 - DNA, 20 bp, Homo sapiens
taataatacctcaatgtttg

SEQ ID NO: 3275525 - DNA, 12 bp, Homo sapiens
taataatataat

SEQ ID NO: 3275526 - DNA, 17 bp, Homo sapiens
taataattattattaaa

SEQ ID NO: 3275527 - DNA, 14 bp, Homo sapiens
taataatttctaat

SEQ ID NO: 3275528 - DNA, 13 bp, Homo sapiens
taataatttgcac

SEQ ID NO: 3275529 - DNA, 20 bp, Homo sapiens
taatacactaattcctttct

SEQ ID NO: 3275530 - DNA, 21 bp, Homo sapiens
taatacagcaacaatttatga

SEQ ID NO: 3275531 - DNA, 11 bp, Homo sapiens
taatacctcaa

SEQ ID NO: 3275532 - DNA, 15 bp, Homo sapiens
taatacctctgtgtg

SEQ ID NO: 3275533 - DNA, 18 bp, Homo sapiens
taatacctctgtgtgctc

SEQ ID NO: 3275534 - DNA, 18 bp, Homo sapiens
taatactaaaatatgtct

SEQ ID NO: 3275535 - DNA, 21 bp, Homo sapiens
taatactcaaatgagtaacat

SEQ ID NO: 3275536 - DNA, 21 bp, Homo sapiens
taatactttcggagaaattct

SEQ ID NO: 3275537 - DNA, 14 bp, Homo sapiens
taatagaataaagg

SEQ ID NO: 3275538 - DNA, 19 bp, Homo sapiens
taatagactgagtcagatg

SEQ ID NO: 3275539 - DNA, 22 bp, Homo sapiens
taatagataaaaacctgaactt

SEQ ID NO: 3275540 - DNA, 12 bp, Homo sapiens
taatagattctc

SEQ ID NO: 3275541 - DNA, 15 bp, Homo sapiens
taatagcagcctttc

SEQ ID NO: 3275542 - DNA, 19 bp, Homo sapiens
taatagcgggttactttca

SEQ ID NO: 3275543 - DNA, 18 bp, Homo sapiens
taataggaaaaacggaag

SEQ ID NO: 3275544 - DNA, 16 bp, Homo sapiens
taataggaacaatctt

SEQ ID NO: 3275545 - DNA, 23 bp, Homo sapiens
taataggaacaatctttgctgta

SEQ ID NO: 3275546 - DNA, 16 bp, Homo sapiens
taatagggaatatatc

SEQ ID NO: 3275547 - DNA, 17 bp, Homo sapiens
taataggtagtttggat

SEQ ID NO: 3275548 - DNA, 19 bp, Homo sapiens
taataggtagtttggatat

SEQ ID NO: 3275549 - DNA, 19 bp, Homo sapiens
taatagttagccctcagtc

SEQ ID NO: 3275550 - DNA, 14 bp, Homo sapiens
taatagttcagtag

SEQ ID NO: 3275551 - DNA, 19 bp, Homo sapiens
taatagtttgtctatttta

SEQ ID NO: 3275552 - DNA, 12 bp, Homo sapiens
taatataaaaga

SEQ ID NO: 3275553 - DNA, 19 bp, Homo sapiens
taatataaaagatatatat

SEQ ID NO: 3275554 - DNA, 18 bp, Homo sapiens
taatataatggaagagaa

SEQ ID NO: 3275555 - DNA, 14 bp, Homo sapiens
taatatatatgaat

SEQ ID NO: 3275556 - DNA, 16 bp, Homo sapiens
taatatatatgaataa

SEQ ID NO: 3275557 - DNA, 20 bp, Homo sapiens
taatatatgtattatttata

SEQ ID NO: 3275558 - DNA, 14 bp, Homo sapiens
taatatattgtaca

SEQ ID NO: 3275559 - DNA, 21 bp, Homo sapiens
taaagagcccttgcctcccca

SEQ ID NO: 3275560 - DNA, 23 bp, Homo sapiens
taaagagtctagattcaaaggtt

SEQ ID NO: 3275561 - DNA, 12 bp, Homo sapiens
taaagataatat

SEQ ID NO: 3275562 - DNA, 18 bp, Homo sapiens
taaagatatttttatctt

SEQ ID NO: 3275563 - DNA, 21 bp, Homo sapiens
taaagatgatctactcagaaa

SEQ ID NO: 3275564 - DNA, 19 bp, Homo sapiens
taaagatggagtttctaag

SEQ ID NO: 3275565 - DNA, 19 bp, Homo sapiens
taaagattctatagttcta

SEQ ID NO: 3275566 - DNA, 10 bp, Homo sapiens
taaatattta

SEQ ID NO: 3275567 - DNA, 17 bp, Homo sapiens
taaatatttatttatgt

SEQ ID NO: 3275568 - DNA, 13 bp, Homo sapiens
taaatattttcta

SEQ ID NO: 3275569 - DNA, 13 bp, Homo sapiens
taaatcacacatt

SEQ ID NO: 3275570 - DNA, 16 bp, Homo sapiens
taaatcacacattcag

SEQ ID NO: 3275571 - DNA, 12 bp, Homo sapiens
taaatcagacca

SEQ ID NO: 3275572 - DNA, 18 bp, Homo sapiens
taaatcagtaagaggtgt

SEQ ID NO: 3275573 - DNA, 14 bp, Homo sapiens
taaatcagtatttt

SEQ ID NO: 3275574 - DNA, 15 bp, Homo sapiens
taaatcataaagtca

SEQ ID NO: 3275575 - DNA, 16 bp, Homo sapiens
taaatcataaagtcag

SEQ ID NO: 3275576 - DNA, 14 bp, Homo sapiens
taaatcatattgat

SEQ ID NO: 3275577 - DNA, 14 bp, Homo sapiens
taaatcatgtatgt

SEQ ID NO: 3275578 - DNA, 14 bp, Homo sapiens
taaatccaataaaa

SEQ ID NO: 3275579 - DNA, 22 bp, Homo sapiens
taaatcctagacttgaaagttt

SEQ ID NO: 3275580 - DNA, 17 bp, Homo sapiens
taaatcctgccatttaa

SEQ ID NO: 3275581 - DNA, 16 bp, Homo sapiens
taaatctatttattaa

SEQ ID NO: 3275582 - DNA, 15 bp, Homo sapiens
taaatctctaatatg

SEQ ID NO: 3275583 - DNA, 12 bp, Homo sapiens
taaatctgccac

SEQ ID NO: 3275584 - DNA, 16 bp, Homo sapiens
taaatctgccatttca

SEQ ID NO: 3275585 - DNA, 16 bp, Homo sapiens
taaatctgtaagctct

SEQ ID NO: 3275586 - DNA, 15 bp, Homo sapiens
taaatctgtgatgat

SEQ ID NO: 3275587 - DNA, 21 bp, Homo sapiens
taaatctgttctgggctcttt

SEQ ID NO: 3275588 - DNA, 14 bp, Homo sapiens
taaatcttaaacaa

SEQ ID NO: 3275589 - DNA, 15 bp, Homo sapiens
taaatcttaaacaat

SEQ ID NO: 3275590 - DNA, 14 bp, Homo sapiens
taaatcttttacaa

SEQ ID NO: 3275591 - DNA, 18 bp, Homo sapiens
taaatgaaaatcgtgaca

SEQ ID NO: 3275592 - DNA, 15 bp, Homo sapiens
taaatgaaattgtaa

SEQ ID NO: 3275593 - DNA, 16 bp, Homo sapiens
taaatgaagcagcttt

SEQ ID NO: 3275594 - DNA, 22 bp, Homo sapiens
taaatgagcaaatatcatactg

SEQ ID NO: 3275595 - DNA, 21 bp, Homo sapiens
taaatgatgtggtgcctgagg

SEQ ID NO: 3275596 - DNA, 22 bp, Homo sapiens
taaatgcagacaacaccttcct

SEQ ID NO: 3275597 - DNA, 14 bp, Homo sapiens
taaatgcctagttt

SEQ ID NO: 3275598 - DNA, 17 bp, Homo sapiens
taaatgcctagttttta

SEQ ID NO: 3275599 - DNA, 17 bp, Homo sapiens
taaatgcctcttaaatt

SEQ ID NO: 3275600 - DNA, 18 bp, Homo sapiens
taaatgccttgtataaaa

SEQ ID NO: 3275601 - DNA, 12 bp, Homo sapiens
taaatgccttta

SEQ ID NO: 3275602 - DNA, 22 bp, Homo sapiens
taaatgcttttaaatgctctct

SEQ ID NO: 3275603 - DNA, 16 bp, Homo sapiens
taaatggcctcatgtg

SEQ ID NO: 3275604 - DNA, 15 bp, Homo sapiens
taaatggtgtacata

SEQ ID NO: 3275605 - DNA, 16 bp, Homo sapiens
taaatggtgtacataa

SEQ ID NO: 3275606 - DNA, 17 bp, Homo sapiens
taaatggtttctgaaaa

SEQ ID NO: 3275607 - DNA, 21 bp, Homo sapiens
taaatggtttggtgcttttta

SEQ ID NO: 3275608 - DNA, 22 bp, Homo sapiens
taaatggtttggtgctttttat

SEQ ID NO: 3275609 - DNA, 14 bp, Homo sapiens
taaatgtaacttat

SEQ ID NO: 3275610 - DNA, 14 bp, Homo sapiens
taaatgtagttgtc

SEQ ID NO: 3275611 - DNA, 14 bp, Homo sapiens
taaatgtcttatat

SEQ ID NO: 3275612 - DNA, 13 bp, Homo sapiens
taaatgtgttcct

SEQ ID NO: 3275613 - DNA, 17 bp, Homo sapiens
taaatgttaactacata

SEQ ID NO: 3275614 - DNA, 18 bp, Homo sapiens
taaatgttctaacagatc

SEQ ID NO: 3275615 - DNA, 15 bp, Homo sapiens
taaatgttgaaagat

SEQ ID NO: 3275616 - DNA, 15 bp, Homo sapiens
taaatgtttatactg

SEQ ID NO: 3275617 - DNA, 16 bp, Homo sapiens
taaatgtttatactgt

SEQ ID NO: 3275618 - DNA, 17 bp, Homo sapiens
taaatgttttataagtt

SEQ ID NO: 3275619 - DNA, 22 bp, Homo sapiens
taaatgttttataagttcacaa

SEQ ID NO: 3275620 - DNA, 20 bp, Homo sapiens
taaattaaagcctttagtat

SEQ ID NO: 3275621 - DNA, 19 bp, Homo sapiens
taaattaatacttcatttg

SEQ ID NO: 3275622 - DNA, 11 bp, Homo sapiens
taaattaatat

SEQ ID NO: 3275623 - DNA, 18 bp, Homo sapiens
taaattacagcttttatg

SEQ ID NO: 3275624 - DNA, 20 bp, Homo sapiens
taaattacagcttttatgga

SEQ ID NO: 3275625 - DNA, 16 bp, Homo sapiens
taaattacgtatgcaa

SEQ ID NO: 3275626 - DNA, 12 bp, Homo sapiens
taaattagaaaa

SEQ ID NO: 3275627 - DNA, 13 bp, Homo sapiens
taaattagaaaat

SEQ ID NO: 3275628 - DNA, 16 bp, Homo sapiens
taaattagaaaatatt

SEQ ID NO: 3275629 - DNA, 22 bp, Homo sapiens
taaattaggaggctcaacaata

SEQ ID NO: 3275630 - DNA, 22 bp, Homo sapiens
taaattatacaaattaaaaaga

SEQ ID NO: 3275631 - DNA, 13 bp, Homo sapiens
taaattatatatt

SEQ ID NO: 3275632 - DNA, 21 bp, Homo sapiens
taaattatgtgaccataatgt

SEQ ID NO: 3275633 - DNA, 18 bp, Homo sapiens
taaattatgttttaaaca

SEQ ID NO: 3275634 - DNA, 11 bp, Homo sapiens
taaattatttt

SEQ ID NO: 3275635 - DNA, 20 bp, Homo sapiens
taaattcaaccactgtaaaa

SEQ ID NO: 3275636 - DNA, 18 bp, Homo sapiens
taaattcaactttgtaaa

SEQ ID NO: 3275637 - DNA, 18 bp, Homo sapiens
taaattcacaaactttta

SEQ ID NO: 3275638 - DNA, 16 bp, Homo sapiens
taaattcagatcaaaa

SEQ ID NO: 3275639 - DNA, 21 bp, Homo sapiens
taaattccatatgctccagga

SEQ ID NO: 3275640 - DNA, 19 bp, Homo sapiens
taaattctactaagttatt

SEQ ID NO: 3275641 - DNA, 19 bp, Homo sapiens
taaattctatgttaaatac

SEQ ID NO: 3275642 - DNA, 22 bp, Homo sapiens
taaattctatgttaaatactgt

SEQ ID NO: 3275643 - DNA, 16 bp, Homo sapiens
taaattctcaaagttt

SEQ ID NO: 3275644 - DNA, 19 bp, Homo sapiens
taaattctcaaagttttat

SEQ ID NO: 3275645 - DNA, 13 bp, Homo sapiens
taaattctttatt

SEQ ID NO: 3275646 - DNA, 13 bp, Homo sapiens
taaattgaaattg

SEQ ID NO: 3275647 - DNA, 14 bp, Homo sapiens
taaattgatccttt

SEQ ID NO: 3275648 - DNA, 16 bp, Homo sapiens
taaattgatcctttga

SEQ ID NO: 3275649 - DNA, 16 bp, Homo sapiens
taaattgcataaagca

SEQ ID NO: 3275650 - DNA, 18 bp, Homo sapiens
taaattgcataaagcata

SEQ ID NO: 3275651 - DNA, 12 bp, Homo sapiens
taaattgcatca

SEQ ID NO: 3275652 - DNA, 19 bp, Homo sapiens
taaattgcatcactgtatc

SEQ ID NO: 3275653 - DNA, 15 bp, Homo sapiens
taaattgcctgattt

SEQ ID NO: 3275654 - DNA, 21 bp, Homo sapiens
taaattggtgataagtggaaa

SEQ ID NO: 3275655 - DNA, 19 bp, Homo sapiens
taaattgtatacattttgt

SEQ ID NO: 3275656 - DNA, 23 bp, Homo sapiens
taaattgtctttaaaaactgttt

SEQ ID NO: 3275657 - DNA, 16 bp, Homo sapiens
taaatttaaagatatt

SEQ ID NO: 3275658 - DNA, 21 bp, Homo sapiens
taaatttaaagatattgttca

SEQ ID NO: 3275659 - DNA, 13 bp, Homo sapiens
taaatttaaattt

SEQ ID NO: 3275660 - DNA, 17 bp, Homo sapiens
taaatttaataccagat

SEQ ID NO: 3275661 - DNA, 14 bp, Homo sapiens
taaatttaatgctg

SEQ ID NO: 3275662 - DNA, 15 bp, Homo sapiens
taaatttaatgctgc

SEQ ID NO: 3275663 - DNA, 10 bp, Homo sapiens
taaatttagc

SEQ ID NO: 3275664 - DNA, 19 bp, Homo sapiens
taaatttatatactttttg

SEQ ID NO: 3275665 - DNA, 22 bp, Homo sapiens
taaatttgaatgttaagcagat

SEQ ID NO: 3275666 - DNA, 14 bp, Homo sapiens
taaatttgatactt

SEQ ID NO: 3275667 - DNA, 16 bp, Homo sapiens
taaatttgatacttat

SEQ ID NO: 3275668 - DNA, 21 bp, Homo sapiens
taaatttgatacttatatttt

SEQ ID NO: 3275669 - DNA, 14 bp, Homo sapiens
taaatttgatttcc

SEQ ID NO: 3275670 - DNA, 13 bp, Homo sapiens
taaatttggagat

SEQ ID NO: 3275671 - DNA, 12 bp, Homo sapiens
taaatttgtaag

SEQ ID NO: 3275672 - DNA, 17 bp, Homo sapiens
taaatttgtaagtttca

SEQ ID NO: 3275673 - DNA, 19 bp, Homo sapiens
taaatttgtaagtttcagg

SEQ ID NO: 3275674 - DNA, 20 bp, Homo sapiens
taaatttgtaagtttcaggt

SEQ ID NO: 3275675 - DNA, 18 bp, Homo sapiens
taaattttaccctttaga

SEQ ID NO: 3275676 - DNA, 18 bp, Homo sapiens
taaattttcttcagttgg

SEQ ID NO: 3275677 - DNA, 18 bp, Homo sapiens
taaattttgagttctaca

SEQ ID NO: 3275678 - DNA, 19 bp, Homo sapiens
taaattttgagttctacat

SEQ ID NO: 3275679 - DNA, 23 bp, Homo sapiens
taaattttgtgatgaataaaata

SEQ ID NO: 3275680 - DNA, 16 bp, Homo sapiens
taaattttttgaaaca

SEQ ID NO: 3275681 - DNA, 22 bp, Homo sapiens
taacaaaacactcggcatttca

SEQ ID NO: 3275682 - DNA, 21 bp, Homo sapiens
taacaaacatcactctgctgc

SEQ ID NO: 3275683 - DNA, 18 bp, Homo sapiens
taacaaaccaacatcttt

SEQ ID NO: 3275684 - DNA, 14 bp, Homo sapiens
taacaaactaaaaa

SEQ ID NO: 3275685 - DNA, 20 bp, Homo sapiens
taacaaactacatgtaatcc

SEQ ID NO: 3275686 - DNA, 21 bp, Homo sapiens
taacaaatctaaaaaagcact

SEQ ID NO: 3275687 - DNA, 13 bp, Homo sapiens
taacaacctggcc

SEQ ID NO: 3275688 - DNA, 16 bp, Homo sapiens
taacaactatttttgt

SEQ ID NO: 3275689 - DNA, 21 bp, Homo sapiens
taacaagatttgtaattacag

SEQ ID NO: 3275690 - DNA, 15 bp, Homo sapiens
taacaagatttttaa

SEQ ID NO: 3275691 - DNA, 11 bp, Homo sapiens
taacaaggaat

SEQ ID NO: 3275692 - DNA, 18 bp, Homo sapiens
taacaaggaatgcctgtg

SEQ ID NO: 3275693 - DNA, 20 bp, Homo sapiens
taacaaggaatgcctgtgcc

SEQ ID NO: 3275694 - DNA, 14 bp, Homo sapiens
taacaaggttcttc

SEQ ID NO: 3275695 - DNA, 16 bp, Homo sapiens
taacaataatatttca

SEQ ID NO: 3275696 - DNA, 23 bp, Homo sapiens
taacaataatatttcaagtgcct

SEQ ID NO: 3275697 - DNA, 16 bp, Homo sapiens
taacaatacaaatgga

SEQ ID NO: 3275698 - DNA, 18 bp, Homo sapiens
taacaatacaaatggatt

SEQ ID NO: 3275699 - DNA, 15 bp, Homo sapiens
taacaatatatagaa

SEQ ID NO: 3275700 - DNA, 17 bp, Homo sapiens
taacaatatatagaatt

SEQ ID NO: 3275701 - DNA, 24 bp, Homo sapiens
taacaatggaagatttgcccattt

SEQ ID NO: 3275702 - DNA, 16 bp, Homo sapiens
taacaatgttaaggaa

SEQ ID NO: 3275703 - DNA, 21 bp, Homo sapiens
taacaatgttaaggaaactct

SEQ ID NO: 3275704 - DNA, 20 bp, Homo sapiens
taacaattgtgtagcctttt

SEQ ID NO: 3275705 - DNA, 13 bp, Homo sapiens
taacaatttcctt

SEQ ID NO: 3275706 - DNA, 21 bp, Homo sapiens
taacaatttcctttatattta

SEQ ID NO: 3275707 - DNA, 16 bp, Homo sapiens
taacaatttctgtcct

SEQ ID NO: 3275708 - DNA, 23 bp, Homo sapiens
taacacaagtcctgtgaatttct

SEQ ID NO: 3275709 - DNA, 22 bp, Homo sapiens
taacacattatcgggagcagtg

SEQ ID NO: 3275710 - DNA, 12 bp, Homo sapiens
taacacattttt

SEQ ID NO: 3275711 - DNA, 20 bp, Homo sapiens
taacacatttttttgcatgc

SEQ ID NO: 3275712 - DNA, 15 bp, Homo sapiens
taacaccaaacttca

SEQ ID NO: 3275713 - DNA, 23 bp, Homo sapiens
taacaccaatcccagggctggct

SEQ ID NO: 3275714 - DNA, 16 bp, Homo sapiens
taacactgtgtacacc

SEQ ID NO: 3275715 - DNA, 20 bp, Homo sapiens
taacactgtgtacacctcaa

SEQ ID NO: 3275716 - DNA, 12 bp, Homo sapiens
taacactttgta

SEQ ID NO: 3275717 - DNA, 14 bp, Homo sapiens
taacagaacagctt

SEQ ID NO: 3275718 - DNA, 17 bp, Homo sapiens
taacagaacagcttcag

SEQ ID NO: 3275719 - DNA, 18 bp, Homo sapiens
taacagaacagcttcagg

SEQ ID NO: 3275720 - DNA, 18 bp, Homo sapiens
taacagataagcaagaga

SEQ ID NO: 3275721 - DNA, 17 bp, Homo sapiens
taacagatcctttcaaa

SEQ ID NO: 3275722 - DNA, 18 bp, Homo sapiens
taacagatcctttcaaaa

SEQ ID NO: 3275723 - DNA, 15 bp, Homo sapiens
taacagatgcaatgt

SEQ ID NO: 3275724 - DNA, 21 bp, Homo sapiens
taacagatgcaatgtgctact

SEQ ID NO: 3275725 - DNA, 22 bp, Homo sapiens
taacagatgtgaaaatatactt

SEQ ID NO: 3275726 - DNA, 21 bp, Homo sapiens
taacagcaacagcaagaaata

SEQ ID NO: 3275727 - DNA, 15 bp, Homo sapiens
taacagcatgctgct

SEQ ID NO: 3275728 - DNA, 18 bp, Homo sapiens
taacagcatgctgctttg

SEQ ID NO: 3275729 - DNA, 17 bp, Homo sapiens
taacagccctcctctgc

SEQ ID NO: 3275730 - DNA, 12 bp, Homo sapiens
taacagctcctt

SEQ ID NO: 3275731 - DNA, 13 bp, Homo sapiens
taacagctctctt

SEQ ID NO: 3275732 - DNA, 15 bp, Homo sapiens
taacagctgaggtct

SEQ ID NO: 3275733 - DNA, 15 bp, Homo sapiens
taacaggatgaaagt

SEQ ID NO: 3275734 - DNA, 22 bp, Homo sapiens
taacaggtctagaaaaccagct

SEQ ID NO: 3275735 - DNA, 14 bp, Homo sapiens
taacagtcatttaa

SEQ ID NO: 3275736 - DNA, 23 bp, Homo sapiens
taacagtccccgtggccatccct

SEQ ID NO: 3275737 - DNA, 21 bp, Homo sapiens
taacagtcctaactggtatag

SEQ ID NO: 3275738 - DNA, 21 bp, Homo sapiens
taacagtgcatattcctttct

SEQ ID NO: 3275739 - DNA, 21 bp, Homo sapiens
taacagtgccattgtctttat

SEQ ID NO: 3275740 - DNA, 18 bp, Homo sapiens
taacagtggctgcttctc

SEQ ID NO: 3275741 - DNA, 14 bp, Homo sapiens
taacagtgtttaaa

SEQ ID NO: 3275742 - DNA, 16 bp, Homo sapiens
taacagttatattttt

SEQ ID NO: 3275743 - DNA, 15 bp, Homo sapiens
taacagttttccatg

SEQ ID NO: 3275744 - DNA, 20 bp, Homo sapiens
taacagttttccatgaaaac

SEQ ID NO: 3275745 - DNA, 21 bp, Homo sapiens
taacagttttccatgaaaacg

SEQ ID NO: 3275746 - DNA, 16 bp, Homo sapiens
taacataaaatctgtg

SEQ ID NO: 3275747 - DNA, 16 bp, Homo sapiens
taacataatttttgtt

SEQ ID NO: 3275748 - DNA, 13 bp, Homo sapiens
taacatatttact

SEQ ID NO: 3275749 - DNA, 20 bp, Homo sapiens
taacatcactatccatgcac

SEQ ID NO: 3275750 - DNA, 20 bp, Homo sapiens
taacatcagaactgaaataa

SEQ ID NO: 3275751 - DNA, 18 bp, Homo sapiens
taacatcataattacatt

SEQ ID NO: 3275752 - DNA, 20 bp, Homo sapiens
taacatctaaaaatagactt

SEQ ID NO: 3275753 - DNA, 17 bp, Homo sapiens
taacatctttattgaaa

SEQ ID NO: 3275754 - DNA, 21 bp, Homo sapiens
taacatctttattgaaattct

SEQ ID NO: 3275755 - DNA, 21 bp, Homo sapiens
taacatgaacacccttagaaa

SEQ ID NO: 3275756 - DNA, 23 bp, Homo sapiens
taacatgaggggacattttggtg

SEQ ID NO: 3275757 - DNA, 14 bp, Homo sapiens
taacatgcatactt

SEQ ID NO: 3275758 - DNA, 18 bp, Homo sapiens
taacatggacatgatctt

SEQ ID NO: 3275759 - DNA, 23 bp, Homo sapiens
taacatggacatgatcttcttta

SEQ ID NO: 3275760 - DNA, 18 bp, Homo sapiens
taacatgggctcttcact

SEQ ID NO: 3275761 - DNA, 18 bp, Homo sapiens
taacatggtttaaaagaa

SEQ ID NO: 3275762 - DNA, 19 bp, Homo sapiens
taacatgtaattaagtact

SEQ ID NO: 3275763 - DNA, 17 bp, Homo sapiens
taacattaacatctatt

SEQ ID NO: 3275764 - DNA, 12 bp, Homo sapiens
taacattacctt

SEQ ID NO: 3275765 - DNA, 19 bp, Homo sapiens
taacattaccttactgtgg

SEQ ID NO: 3275766 - DNA, 17 bp, Homo sapiens
taacattatattgcaat

SEQ ID NO: 3275767 - DNA, 12 bp, Homo sapiens
taacattattta

SEQ ID NO: 3275768 - DNA, 16 bp, Homo sapiens
taacattatttatatg

SEQ ID NO: 3275769 - DNA, 21 bp, Homo sapiens
taacattcaggaattcttgga

SEQ ID NO: 3275770 - DNA, 12 bp, Homo sapiens
taacattccaag

SEQ ID NO: 3275771 - DNA, 13 bp, Homo sapiens
taacattccaaga

SEQ ID NO: 3275772 - DNA, 15 bp, Homo sapiens
taacattgaccaaga

SEQ ID NO: 3275773 - DNA, 18 bp, Homo sapiens
taacattgaccaagaact

SEQ ID NO: 3275774 - DNA, 20 bp, Homo sapiens
taacattgaccaagaactgc

SEQ ID NO: 3275775 - DNA, 16 bp, Homo sapiens
taacatttgccttgca

SEQ ID NO: 3275776 - DNA, 23 bp, Homo sapiens
taacatttgccttgcagaactgc

SEQ ID NO: 3275777 - DNA, 13 bp, Homo sapiens
taacatttgctgt

SEQ ID NO: 3275778 - DNA, 16 bp, Homo sapiens
taacatttgctgtttt

SEQ ID NO: 3275779 - DNA, 17 bp, Homo sapiens
taacatttgctgtttta

SEQ ID NO: 3275780 - DNA, 10 bp, Homo sapiens
taacattttg

SEQ ID NO: 3275781 - DNA, 11 bp, Homo sapiens
taacattttgt

SEQ ID NO: 3275782 - DNA, 15 bp, Homo sapiens
taacattttgttctt

SEQ ID NO: 3275783 - DNA, 16 bp, Homo sapiens
taacattttgttctta

SEQ ID NO: 3275784 - DNA, 22 bp, Homo sapiens
taaccaaatattaaagattctc

SEQ ID NO: 3275785 - DNA, 16 bp, Homo sapiens
taaccaactgaacgac

SEQ ID NO: 3275786 - DNA, 18 bp, Homo sapiens
taaccaagtgtgctcttt

SEQ ID NO: 3275787 - DNA, 22 bp, Homo sapiens
taaccacaaggtccactccctg

SEQ ID NO: 3275788 - DNA, 19 bp, Homo sapiens
taaccacttaaaaaatgtc

SEQ ID NO: 3275789 - DNA, 20 bp, Homo sapiens
taaccacttaaaaaatgtcc

SEQ ID NO: 3275790 - DNA, 15 bp, Homo sapiens
taaccagctgtaaca

SEQ ID NO: 3275791 - DNA, 15 bp, Homo sapiens
taaccagtgcagaaa

SEQ ID NO: 3275792 - DNA, 20 bp, Homo sapiens
taaccattgtcttgttctgt

SEQ ID NO: 3275793 - DNA, 16 bp, Homo sapiens
taaccattttaaccta

SEQ ID NO: 3275794 - DNA, 13 bp, Homo sapiens
taacccagatttt

SEQ ID NO: 3275795 - DNA, 14 bp, Homo sapiens
taaccctacaccca

SEQ ID NO: 3275796 - DNA, 17 bp, Homo sapiens
taaccctaggaatttag

SEQ ID NO: 3275797 - DNA, 19 bp, Homo sapiens
taaccgcacatgcacacac

SEQ ID NO: 3275798 - DNA, 18 bp, Homo sapiens
taacctcagagtatcttt

SEQ ID NO: 3275799 - DNA, 13 bp, Homo sapiens
taacctcagctct

SEQ ID NO: 3275800 - DNA, 13 bp, Homo sapiens
taacctctgggga

SEQ ID NO: 3275801 - DNA, 15 bp, Homo sapiens
taacctggtgctgga

SEQ ID NO: 3275802 - DNA, 19 bp, Homo sapiens
taaccttactaattatact

SEQ ID NO: 3275803 - DNA, 14 bp, Homo sapiens
taaccttgaagtga

SEQ ID NO: 3275804 - DNA, 20 bp, Homo sapiens
taaccttttttgtcttattg

SEQ ID NO: 3275805 - DNA, 14 bp, Homo sapiens
taacgacttcaggg

SEQ ID NO: 3275806 - DNA, 18 bp, Homo sapiens
taacggctccaggatttt

SEQ ID NO: 3275807 - DNA, 14 bp, Homo sapiens
taacgggaggctgg

SEQ ID NO: 3275808 - DNA, 18 bp, Homo sapiens
taacgggaggctgggcac

SEQ ID NO: 3275809 - DNA, 22 bp, Homo sapiens
taacggtctgttctgtttcaag

SEQ ID NO: 3275810 - DNA, 17 bp, Homo sapiens
taacggtgcttgtgtca

SEQ ID NO: 3275811 - DNA, 16 bp, Homo sapiens
taacgtgaaacttata

SEQ ID NO: 3275812 - DNA, 16 bp, Homo sapiens
taacgttgagcccctg

SEQ ID NO: 3275813 - DNA, 14 bp, Homo sapiens
taactaaaatgtat

SEQ ID NO: 3275814 - DNA, 16 bp, Homo sapiens
taactaaaatgtatct

SEQ ID NO: 3275815 - DNA, 17 bp, Homo sapiens
taactaaaatgtatcta

SEQ ID NO: 3275816 - DNA, 17 bp, Homo sapiens
taactaaatttgatact

SEQ ID NO: 3275817 - DNA, 20 bp, Homo sapiens
taactaaatttgatacttat

SEQ ID NO: 3275818 - DNA, 19 bp, Homo sapiens
taactaaattttaaagcca

SEQ ID NO: 3275819 - DNA, 16 bp, Homo sapiens
taactaacatgtcctg

SEQ ID NO: 3275820 - DNA, 23 bp, Homo sapiens
taactaatatgggcattgtagtt

SEQ ID NO: 3275821 - DNA, 23 bp, Homo sapiens
taactaatctattgggttcatta

SEQ ID NO: 3275822 - DNA, 20 bp, Homo sapiens
gttcaagctattctcatgcc

SEQ ID NO: 3275823 - DNA, 17 bp, Homo sapiens
gttcaagtgattctctt

SEQ ID NO: 3275824 - DNA, 22 bp, Homo sapiens
gttcaatgcctcacgagatttg

SEQ ID NO: 3275825 - DNA, 17 bp, Homo sapiens
gttcaatggttctgaaa

SEQ ID NO: 3275826 - DNA, 14 bp, Homo sapiens
gttcacagaaaaag

SEQ ID NO: 3275827 - DNA, 12 bp, Homo sapiens
gttcacaggagg

SEQ ID NO: 3275828 - DNA, 15 bp, Homo sapiens
gttcacaggaggcca

SEQ ID NO: 3275829 - DNA, 17 bp, Homo sapiens
gttcacattagaattag

SEQ ID NO: 3275830 - DNA, 14 bp, Homo sapiens
gttcagacacctgt

SEQ ID NO: 3275831 - DNA, 14 bp, Homo sapiens
gttcagatgtgcat

SEQ ID NO: 3275832 - DNA, 22 bp, Homo sapiens
gttcagcattcttagcctgtgg

SEQ ID NO: 3275833 - DNA, 22 bp, Homo sapiens
gttcagctaagctaggaatgaa

SEQ ID NO: 3275834 - DNA, 16 bp, Homo sapiens
gttcagctccagctca

SEQ ID NO: 3275835 - DNA, 15 bp, Homo sapiens
gttcagctgtcctcc

SEQ ID NO: 3275836 - DNA, 19 bp, Homo sapiens
gttcaggcccggcagggcg

SEQ ID NO: 3275837 - DNA, 19 bp, Homo sapiens
gttcaggggactcagccct

SEQ ID NO: 3275838 - DNA, 20 bp, Homo sapiens
gttcaggggactcagccctg

SEQ ID NO: 3275839 - DNA, 19 bp, Homo sapiens
gttcagggttggcccctgc

SEQ ID NO: 3275840 - DNA, 22 bp, Homo sapiens
gttcagggttggcccctgcccg

SEQ ID NO: 3275841 - DNA, 22 bp, Homo sapiens
gttcaggtcccacgtctggcca

SEQ ID NO: 3275842 - DNA, 18 bp, Homo sapiens
gttcagtggcagggctca

SEQ ID NO: 3275843 - DNA, 20 bp, Homo sapiens
gttcataacagtgccattgt

SEQ ID NO: 3275844 - DNA, 16 bp, Homo sapiens
gttcatacctaagtac

SEQ ID NO: 3275845 - DNA, 21 bp, Homo sapiens
gttcatacctaagtactgtaa

SEQ ID NO: 3275846 - DNA, 13 bp, Homo sapiens
gttcatagcccag

SEQ ID NO: 3275847 - DNA, 22 bp, Homo sapiens
gttcatagggtctcttcaggtt

SEQ ID NO: 3275848 - DNA, 19 bp, Homo sapiens
gttcatatgctctgctttt

SEQ ID NO: 3275849 - DNA, 13 bp, Homo sapiens
gttcatcagtgtt

SEQ ID NO: 3275850 - DNA, 17 bp, Homo sapiens
gttcatccaaggctgtt

SEQ ID NO: 3275851 - DNA, 15 bp, Homo sapiens
gttcatccaatcctc

SEQ ID NO: 3275852 - DNA, 16 bp, Homo sapiens
gttcatcccagcccca

SEQ ID NO: 3275853 - DNA, 16 bp, Homo sapiens
gttcatcgattttcta

SEQ ID NO: 3275854 - DNA, 17 bp, Homo sapiens
gttcatcgtataacaca

SEQ ID NO: 3275855 - DNA, 23 bp, Homo sapiens
gttcatctgtccatggcctttct

SEQ ID NO: 3275856 - DNA, 14 bp, Homo sapiens
gttcatgagaatct

SEQ ID NO: 3275857 - DNA, 19 bp, Homo sapiens
gttcatgctgaatccacct

SEQ ID NO: 3275858 - DNA, 23 bp, Homo sapiens
gttcatgtcagcttatatgtgac

SEQ ID NO: 3275859 - DNA, 14 bp, Homo sapiens
gttcatgtgcctct

SEQ ID NO: 3275860 - DNA, 24 bp, Homo sapiens
gttcatgtttgcttcataaatgaa

SEQ ID NO: 3275861 - DNA, 16 bp, Homo sapiens
gttcatgtttggtgca

SEQ ID NO: 3275862 - DNA, 20 bp, Homo sapiens
gttcatgtttggtgcataga

SEQ ID NO: 3275863 - DNA, 18 bp, Homo sapiens
gttcatgtttgtaaatta

SEQ ID NO: 3275864 - DNA, 18 bp, Homo sapiens
gttcattattttgtggtt

SEQ ID NO: 3275865 - DNA, 20 bp, Homo sapiens
gttcattcaagctatttaat

SEQ ID NO: 3275866 - DNA, 16 bp, Homo sapiens
gttcattgcactttga

SEQ ID NO: 3275867 - DNA, 22 bp, Homo sapiens
gttcattgtaatgttactgatc

SEQ ID NO: 3275868 - DNA, 13 bp, Homo sapiens
gttcatttgtgta

SEQ ID NO: 3275869 - DNA, 17 bp, Homo sapiens
gttcattttagtgactg

SEQ ID NO: 3275870 - DNA, 13 bp, Homo sapiens
gttcatttttcaa

SEQ ID NO: 3275871 - DNA, 15 bp, Homo sapiens
gttccaaatgaatgt

SEQ ID NO: 3275872 - DNA, 23 bp, Homo sapiens
gttccaaatgtgtataattttaa

SEQ ID NO: 3275873 - DNA, 15 bp, Homo sapiens
gttccaaattcagtt

SEQ ID NO: 3275874 - DNA, 15 bp, Homo sapiens
gttccaaccaggcag

SEQ ID NO: 3275875 - DNA, 16 bp, Homo sapiens
gttccaagacattgtc

SEQ ID NO: 3275876 - DNA, 19 bp, Homo sapiens
gttccaagacattgtcaat

SEQ ID NO: 3275877 - DNA, 15 bp, Homo sapiens
gttccaatcctggct

SEQ ID NO: 3275878 - DNA, 16 bp, Homo sapiens
gttccaatcctggctc

SEQ ID NO: 3275879 - DNA, 16 bp, Homo sapiens
gttccacagttgccac

SEQ ID NO: 3275880 - DNA, 15 bp, Homo sapiens
gttccaccccaagag

SEQ ID NO: 3275881 - DNA, 20 bp, Homo sapiens
gttccacgtccccctggggc

SEQ ID NO: 3275882 - DNA, 22 bp, Homo sapiens
gttccactgcaaataaagcctt

SEQ ID NO: 3275883 - DNA, 22 bp, Homo sapiens
gttccagattcctatgatggat

SEQ ID NO: 3275884 - DNA, 21 bp, Homo sapiens
gttccagcagatgccacataa

SEQ ID NO: 3275885 - DNA, 17 bp, Homo sapiens
gttccagggtccctctg

SEQ ID NO: 3275886 - DNA, 19 bp, Homo sapiens
gttccagggtccctctgtg

SEQ ID NO: 3275887 - DNA, 19 bp, Homo sapiens
gttccatgcagccttgggg

SEQ ID NO: 3275888 - DNA, 13 bp, Homo sapiens
gttccatgttaaa

SEQ ID NO: 3275889 - DNA, 22 bp, Homo sapiens
gttccattgaagccgactctgg

SEQ ID NO: 3275890 - DNA, 17 bp, Homo sapiens
gttcccactgaggccct

SEQ ID NO: 3275891 - DNA, 23 bp, Homo sapiens
gttcccaggctgcccccaacact

SEQ ID NO: 3275892 - DNA, 22 bp, Homo sapiens
gttcccagtgacacttcagaga

SEQ ID NO: 3275893 - DNA, 17 bp, Homo sapiens
gttcccatgtagccccc

SEQ ID NO: 3275894 - DNA, 16 bp, Homo sapiens
gttcccatttcagctg

SEQ ID NO: 3275895 - DNA, 19 bp, Homo sapiens
gttccccaagggccctggc

SEQ ID NO: 3275896 - DNA, 19 bp, Homo sapiens
gttccccatctgggtcctt

SEQ ID NO: 3275897 - DNA, 23 bp, Homo sapiens
gttccccatctgggtccttgcac

SEQ ID NO: 3275898 - DNA, 22 bp, Homo sapiens
gttcccccaaccatcttcactg

SEQ ID NO: 3275899 - DNA, 12 bp, Homo sapiens
gttcccccagca

SEQ ID NO: 3275900 - DNA, 13 bp, Homo sapiens
gttcccccagcaa

SEQ ID NO: 3275901 - DNA, 21 bp, Homo sapiens
gttcccgattcacgtttttct

SEQ ID NO: 3275902 - DNA, 20 bp, Homo sapiens
gttcccggagcacagccctg

SEQ ID NO: 3275903 - DNA, 21 bp, Homo sapiens
gttcccggagcacagccctgg

SEQ ID NO: 3275904 - DNA, 18 bp, Homo sapiens
gttcccgtttctccacct

SEQ ID NO: 3275905 - DNA, 16 bp, Homo sapiens
gttccctctgctcagc

SEQ ID NO: 3275906 - DNA, 16 bp, Homo sapiens
gttccctctgctcctg

SEQ ID NO: 3275907 - DNA, 16 bp, Homo sapiens
gttccctgattattta

SEQ ID NO: 3275908 - DNA, 11 bp, Homo sapiens
gttccctgcac

SEQ ID NO: 3275909 - DNA, 15 bp, Homo sapiens
gttccctgcaccctg

SEQ ID NO: 3275910 - DNA, 17 bp, Homo sapiens
gttccctgtcagaggct

SEQ ID NO: 3275911 - DNA, 20 bp, Homo sapiens
gttccctgtcagaggctaag

SEQ ID NO: 3275912 - DNA, 22 bp, Homo sapiens
gttcccttgaaactttgggaaa

SEQ ID NO: 3275913 - DNA, 13 bp, Homo sapiens
gttcccttggcct

SEQ ID NO: 3275914 - DNA, 14 bp, Homo sapiens
gttcccttggcctc

SEQ ID NO: 3275915 - DNA, 14 bp, Homo sapiens
gttccgcactttcc

SEQ ID NO: 3275916 - DNA, 11 bp, Homo sapiens
gttcctcctgc

SEQ ID NO: 3275917 - DNA, 13 bp, Homo sapiens
gttcctcctgctg

SEQ ID NO: 3275918 - DNA, 18 bp, Homo sapiens
gttcctcgctctgggatg

SEQ ID NO: 3275919 - DNA, 22 bp, Homo sapiens
gttcctctctggtggctctttg

SEQ ID NO: 3275920 - DNA, 12 bp, Homo sapiens
gttcctctgcct

SEQ ID NO: 3275921 - DNA, 17 bp, Homo sapiens
gttcctgacatcacagc

SEQ ID NO: 3275922 - DNA, 20 bp, Homo sapiens
gttcctgcggagtgaagagg

SEQ ID NO: 3275923 - DNA, 23 bp, Homo sapiens
gttcctgctccatgactggctgt

SEQ ID NO: 3275924 - DNA, 14 bp, Homo sapiens
gttcctggaagcag

SEQ ID NO: 3275925 - DNA, 12 bp, Homo sapiens
gttcctggcaat

SEQ ID NO: 3275926 - DNA, 21 bp, Homo sapiens
gttcctggcaatagtgtgttc

SEQ ID NO: 3275927 - DNA, 14 bp, Homo sapiens
gttcctggcagttt

SEQ ID NO: 3275928 - DNA, 23 bp, Homo sapiens
gttcctggcagtttaaaaaaatt

SEQ ID NO: 3275929 - DNA, 15 bp, Homo sapiens
gttccttccctggga

SEQ ID NO: 3275930 - DNA, 17 bp, Homo sapiens
gttccttccctgggaag

SEQ ID NO: 3275931 - DNA, 21 bp, Homo sapiens
gttccttggtcctagtaagaa

SEQ ID NO: 3275932 - DNA, 14 bp, Homo sapiens
gttcctttttatga

SEQ ID NO: 3275933 - DNA, 17 bp, Homo sapiens
gttcgagaccagcctcg

SEQ ID NO: 3275934 - DNA, 17 bp, Homo sapiens
gttcgagaccagcctgg

SEQ ID NO: 3275935 - DNA, 17 bp, Homo sapiens
gttcgatttctacctca

SEQ ID NO: 3275936 - DNA, 19 bp, Homo sapiens
gttcgcttggctccatgct

SEQ ID NO: 3275937 - DNA, 14 bp, Homo sapiens
gttcggctctgggt

SEQ ID NO: 3275938 - DNA, 13 bp, Homo sapiens
gttcgtagctttc

SEQ ID NO: 3275939 - DNA, 14 bp, Homo sapiens
gttctaaagctctg

SEQ ID NO: 3275940 - DNA, 16 bp, Homo sapiens
gttctaaagttctaag

SEQ ID NO: 3275941 - DNA, 17 bp, Homo sapiens
gttctaaagttctaaga

SEQ ID NO: 3275942 - DNA, 20 bp, Homo sapiens
gttctaacagatcagaacat

SEQ ID NO: 3275943 - DNA, 22 bp, Homo sapiens
gttctaacagtgaagttttact

SEQ ID NO: 3275944 - DNA, 15 bp, Homo sapiens
gttctaagactcaaa

SEQ ID NO: 3275945 - DNA, 20 bp, Homo sapiens
gttctaagactcaaatgttc

SEQ ID NO: 3275946 - DNA, 14 bp, Homo sapiens
gttctaagattcta

SEQ ID NO: 3275947 - DNA, 17 bp, Homo sapiens
gttctaagattctaatg

SEQ ID NO: 3275948 - DNA, 14 bp, Homo sapiens
gttttgcttttgtt

SEQ ID NO: 3275949 - DNA, 10 bp, Homo sapiens
gttttggaca

SEQ ID NO: 3275950 - DNA, 16 bp, Homo sapiens
gttttggactccatct

SEQ ID NO: 3275951 - DNA, 15 bp, Homo sapiens
gttttggagagtttg

SEQ ID NO: 3275952 - DNA, 20 bp, Homo sapiens
gttttggcaaacgctaaaga

SEQ ID NO: 3275953 - DNA, 14 bp, Homo sapiens
gttttggcagccag

SEQ ID NO: 3275954 - DNA, 19 bp, Homo sapiens
gttttgggtgaatcttgag

SEQ ID NO: 3275955 - DNA, 17 bp, Homo sapiens
gttttggtagattaaat

SEQ ID NO: 3275956 - DNA, 14 bp, Homo sapiens
gttttggttaagtt

SEQ ID NO: 3275957 - DNA, 20 bp, Homo sapiens
gttttggttaagttggcttc

SEQ ID NO: 3275958 - DNA, 15 bp, Homo sapiens
gttttggttccacaa

SEQ ID NO: 3275959 - DNA, 22 bp, Homo sapiens
gttttgtacaaagttttccttt

SEQ ID NO: 3275960 - DNA, 14 bp, Homo sapiens
gttttgtacactgc

SEQ ID NO: 3275961 - DNA, 18 bp, Homo sapiens
gttttgtacactgctgta

SEQ ID NO: 3275962 - DNA, 22 bp, Homo sapiens
gttttgtataaataataaagaa

SEQ ID NO: 3275963 - DNA, 21 bp, Homo sapiens
gttttgtatacaaatatattg

SEQ ID NO: 3275964 - DNA, 22 bp, Homo sapiens
gttttgtatacaaatatattgt

SEQ ID NO: 3275965 - DNA, 16 bp, Homo sapiens
gttttgtatatacagt

SEQ ID NO: 3275966 - DNA, 24 bp, Homo sapiens
gttttgtcaaactgtagaaatgat

SEQ ID NO: 3275967 - DNA, 18 bp, Homo sapiens
gttttgtctgtgttgctg

SEQ ID NO: 3275968 - DNA, 12 bp, Homo sapiens
gttttgttcttt

SEQ ID NO: 3275969 - DNA, 15 bp, Homo sapiens
gttttgtttctgaaa

SEQ ID NO: 3275970 - DNA, 11 bp, Homo sapiens
gttttgtttgt

SEQ ID NO: 3275971 - DNA, 16 bp, Homo sapiens
gttttgttttttaagg

SEQ ID NO: 3275972 - DNA, 16 bp, Homo sapiens
gtttttaaaagtttca

SEQ ID NO: 3275973 - DNA, 23 bp, Homo sapiens
gtttttaaatagagtttgctatt

SEQ ID NO: 3275974 - DNA, 13 bp, Homo sapiens
gtttttaagctgt

SEQ ID NO: 3275975 - DNA, 18 bp, Homo sapiens
gtttttaagtaacttaag

SEQ ID NO: 3275976 - DNA, 14 bp, Homo sapiens
gtttttacatactt

SEQ ID NO: 3275977 - DNA, 20 bp, Homo sapiens
gtttttacatacttttgcaa

SEQ ID NO: 3275978 - DNA, 21 bp, Homo sapiens
gtttttacatacttttgcaaa

SEQ ID NO: 3275979 - DNA, 16 bp, Homo sapiens
gtttttactacagttg

SEQ ID NO: 3275980 - DNA, 17 bp, Homo sapiens
gtttttactttctgttg

SEQ ID NO: 3275981 - DNA, 17 bp, Homo sapiens
gtttttagtaatctgta

SEQ ID NO: 3275982 - DNA, 17 bp, Homo sapiens
gtttttatattaatgta

SEQ ID NO: 3275983 - DNA, 20 bp, Homo sapiens
gtttttatgatatccctgat

SEQ ID NO: 3275984 - DNA, 14 bp, Homo sapiens
gtttttattagtac

SEQ ID NO: 3275985 - DNA, 16 bp, Homo sapiens
gtttttcacattttcc

SEQ ID NO: 3275986 - DNA, 20 bp, Homo sapiens
gtttttcaccacttcactga

SEQ ID NO: 3275987 - DNA, 12 bp, Homo sapiens
gtttttcattca

SEQ ID NO: 3275988 - DNA, 20 bp, Homo sapiens
gtttttcctatcatgttaac

SEQ ID NO: 3275989 - DNA, 14 bp, Homo sapiens
gtttttcctttctt

SEQ ID NO: 3275990 - DNA, 14 bp, Homo sapiens
gtttttctgccagg

SEQ ID NO: 3275991 - DNA, 12 bp, Homo sapiens
gtttttcttcaa

SEQ ID NO: 3275992 - DNA, 17 bp, Homo sapiens
gtttttgaaacccacag

SEQ ID NO: 3275993 - DNA, 18 bp, Homo sapiens
gtttttgaaacccacagt

SEQ ID NO: 3275994 - DNA, 19 bp, Homo sapiens
gtttttgaaacccacagtt

SEQ ID NO: 3275995 - DNA, 20 bp, Homo sapiens
gtttttgaaacccacagttt

SEQ ID NO: 3275996 - DNA, 12 bp, Homo sapiens
gtttttgctctc

SEQ ID NO: 3275997 - DNA, 21 bp, Homo sapiens
gtttttggatctggcattgaa

SEQ ID NO: 3275998 - DNA, 13 bp, Homo sapiens
gtttttggctctt

SEQ ID NO: 3275999 - DNA, 11 bp, Homo sapiens
gtttttgtaat

SEQ ID NO: 3276000 - DNA, 14 bp, Homo sapiens
gtttttgtatcttg

SEQ ID NO: 3276001 - DNA, 13 bp, Homo sapiens
gtttttgtattta

SEQ ID NO: 3276002 - DNA, 13 bp, Homo sapiens
gttttttaaagca

SEQ ID NO: 3276003 - DNA, 14 bp, Homo sapiens
gttttttaaagcaa

SEQ ID NO: 3276004 - DNA, 15 bp, Homo sapiens
gttttttaaagcaag

SEQ ID NO: 3276005 - DNA, 22 bp, Homo sapiens
gttttttaagtaagacttttat

SEQ ID NO: 3276006 - DNA, 14 bp, Homo sapiens
gttttttgccacag

SEQ ID NO: 3276007 - DNA, 23 bp, Homo sapiens
gttttttgccacagcttttgcaa

SEQ ID NO: 3276008 - DNA, 14 bp, Homo sapiens
gttttttgtaagat

SEQ ID NO: 3276009 - DNA, 20 bp, Homo sapiens
gttttttttaaataaaagca

SEQ ID NO: 3276010 - DNA, 15 bp, Homo sapiens
gttttttttcagttg

SEQ ID NO: 3276011 - DNA, 14 bp, Homo sapiens
gtttttttttcatt

SEQ ID NO: 3276012 - DNA, 18 bp, Homo sapiens
taaaaaaaaaaggatgaa

SEQ ID NO: 3276013 - DNA, 19 bp, Homo sapiens
taaaaaaaaaaggatgaaa

SEQ ID NO: 3276014 - DNA, 15 bp, Homo sapiens
taaaaaaaaattgta

SEQ ID NO: 3276015 - DNA, 21 bp, Homo sapiens
taaaaaaacaatcatttgctt

SEQ ID NO: 3276016 - DNA, 14 bp, Homo sapiens
taaaaaaagcaaaa

SEQ ID NO: 3276017 - DNA, 11 bp, Homo sapiens
taaaaaaataa

SEQ ID NO: 3276018 - DNA, 22 bp, Homo sapiens
taaaaaaatacagtattctgta

SEQ ID NO: 3276019 - DNA, 13 bp, Homo sapiens
taaaaaaatgaca

SEQ ID NO: 3276020 - DNA, 20 bp, Homo sapiens
taaaaaagactgaacatgtt

SEQ ID NO: 3276021 - DNA, 19 bp, Homo sapiens
taaaaaagtctctatttaa

SEQ ID NO: 3276022 - DNA, 20 bp, Homo sapiens
taaaaaagtctctatttaaa

SEQ ID NO: 3276023 - DNA, 14 bp, Homo sapiens
taaaaaatattttc

SEQ ID NO: 3276024 - DNA, 15 bp, Homo sapiens
taaaaaatgaaaata

SEQ ID NO: 3276025 - DNA, 11 bp, Homo sapiens
taaaaaatgga

SEQ ID NO: 3276026 - DNA, 19 bp, Homo sapiens
taaaaaatggttcagaatt

SEQ ID NO: 3276027 - DNA, 23 bp, Homo sapiens
taaaaaattatggaatatcatct

SEQ ID NO: 3276028 - DNA, 20 bp, Homo sapiens
taaaaacagcattgctttct

SEQ ID NO: 3276029 - DNA, 18 bp, Homo sapiens
taaaaacattttgaagtg

SEQ ID NO: 3276030 - DNA, 13 bp, Homo sapiens
taaaaaccaaatt

SEQ ID NO: 3276031 - DNA, 14 bp, Homo sapiens
taaaaactcttcag

SEQ ID NO: 3276032 - DNA, 13 bp, Homo sapiens
taaaaactttatt

SEQ ID NO: 3276033 - DNA, 12 bp, Homo sapiens
taaaaagaaaaa

SEQ ID NO: 3276034 - DNA, 23 bp, Homo sapiens
taaaaagaaaaaccactcccagt

SEQ ID NO: 3276035 - DNA, 16 bp, Homo sapiens
taaaaagaaatctggt

SEQ ID NO: 3276036 - DNA, 12 bp, Homo sapiens
taaaaagataat

SEQ ID NO: 3276037 - DNA, 23 bp, Homo sapiens
taaaaagataatctcagtgcttt

SEQ ID NO: 3276038 - DNA, 16 bp, Homo sapiens
taaaaagattagcaag

SEQ ID NO: 3276039 - DNA, 18 bp, Homo sapiens
taaaaagattgaagtatt

SEQ ID NO: 3276040 - DNA, 15 bp, Homo sapiens
taaaaagcagaattt

SEQ ID NO: 3276041 - DNA, 23 bp, Homo sapiens
taaaaagcagaattttaatgtga

SEQ ID NO: 3276042 - DNA, 19 bp, Homo sapiens
taaaaagcctgcaatttca

SEQ ID NO: 3276043 - DNA, 18 bp, Homo sapiens
taaaaagctcactgctga

SEQ ID NO: 3276044 - DNA, 15 bp, Homo sapiens
taaaaaggccaaaga

SEQ ID NO: 3276045 - DNA, 19 bp, Homo sapiens
taaaaaggtctgttaatgt

SEQ ID NO: 3276046 - DNA, 21 bp, Homo sapiens
taaaaaggtctgttaatgtca

SEQ ID NO: 3276047 - DNA, 17 bp, Homo sapiens
taaaaagtcttcactct

SEQ ID NO: 3276048 - DNA, 22 bp, Homo sapiens
taaaaagttgaaccattatact

SEQ ID NO: 3276049 - DNA, 17 bp, Homo sapiens
taaaaataaatagaaaa

SEQ ID NO: 3276050 - DNA, 22 bp, Homo sapiens
taaaaatatactgattttgaaa

SEQ ID NO: 3276051 - DNA, 19 bp, Homo sapiens
taaaaatatagcaaatgca

SEQ ID NO: 3276052 - DNA, 19 bp, Homo sapiens
taaaaatatggaacttcta

SEQ ID NO: 3276053 - DNA, 17 bp, Homo sapiens
taaaaatattcctccaa

SEQ ID NO: 3276054 - DNA, 13 bp, Homo sapiens
taaaaatatttca

SEQ ID NO: 3276055 - DNA, 22 bp, Homo sapiens
taaaaatgaaagtgactttaaa

SEQ ID NO: 3276056 - DNA, 15 bp, Homo sapiens
taaaaatgaggtact

SEQ ID NO: 3276057 - DNA, 15 bp, Homo sapiens
taaaaatggacaaaa

SEQ ID NO: 3276058 - DNA, 13 bp, Homo sapiens
taaaaatgtaaat

SEQ ID NO: 3276059 - DNA, 21 bp, Homo sapiens
taaaaatgtagaaattcttca

SEQ ID NO: 3276060 - DNA, 11 bp, Homo sapiens
taaaaatgttc

SEQ ID NO: 3276061 - DNA, 14 bp, Homo sapiens
taaaaattagcatg

SEQ ID NO: 3276062 - DNA, 17 bp, Homo sapiens
taaaaattgtttcttga

SEQ ID NO: 3276063 - DNA, 14 bp, Homo sapiens
taaaaatttttaaa

SEQ ID NO: 3276064 - DNA, 15 bp, Homo sapiens
taaaacaaaatctga

SEQ ID NO: 3276065 - DNA, 23 bp, Homo sapiens
taaaacaaaatctgaactctcaa

SEQ ID NO: 3276066 - DNA, 17 bp, Homo sapiens
taaaacaaaatttgact

SEQ ID NO: 3276067 - DNA, 16 bp, Homo sapiens
taaaacaacagctcga

SEQ ID NO: 3276068 - DNA, 22 bp, Homo sapiens
taaaacaacagctcgatccaaa

SEQ ID NO: 3276069 - DNA, 10 bp, Homo sapiens
taaaacacta

SEQ ID NO: 3276070 - DNA, 13 bp, Homo sapiens
taaaacagacact

SEQ ID NO: 3276071 - DNA, 17 bp, Homo sapiens
taaaacagacactggca

SEQ ID NO: 3276072 - DNA, 18 bp, Homo sapiens
taaaacagacactggcat

SEQ ID NO: 3276073 - DNA, 13 bp, Homo sapiens
taaaacaggaccg

SEQ ID NO: 3276074 - DNA, 14 bp, Homo sapiens
taaaacatatttca

SEQ ID NO: 3276075 - DNA, 19 bp, Homo sapiens
tagtgtattatcactgtct

SEQ ID NO: 3276076 - DNA, 17 bp, Homo sapiens
tagtgtgaaatatatta

SEQ ID NO: 3276077 - DNA, 18 bp, Homo sapiens
tagtgtgtgcttacagta

SEQ ID NO: 3276078 - DNA, 23 bp, Homo sapiens
tagtgtgtgtgcagagtccattt

SEQ ID NO: 3276079 - DNA, 18 bp, Homo sapiens
tagtgttaatgactcttt

SEQ ID NO: 3276080 - DNA, 15 bp, Homo sapiens
tagttaaaatgctga

SEQ ID NO: 3276081 - DNA, 13 bp, Homo sapiens
tagttaaagaaag

SEQ ID NO: 3276082 - DNA, 17 bp, Homo sapiens
tagttaaagaaaggaaa

SEQ ID NO: 3276083 - DNA, 21 bp, Homo sapiens
tagttaaagaaaggaaaagaa

SEQ ID NO: 3276084 - DNA, 14 bp, Homo sapiens
tagttaatattttg

SEQ ID NO: 3276085 - DNA, 18 bp, Homo sapiens
tagttaatttatctaaat

SEQ ID NO: 3276086 - DNA, 13 bp, Homo sapiens
tagttaatttatt

SEQ ID NO: 3276087 - DNA, 14 bp, Homo sapiens
tagttacataatca

SEQ ID NO: 3276088 - DNA, 17 bp, Homo sapiens
tagttacctactgagta

SEQ ID NO: 3276089 - DNA, 18 bp, Homo sapiens
tagttaccttatagttac

SEQ ID NO: 3276090 - DNA, 15 bp, Homo sapiens
tagttaggatagcat

SEQ ID NO: 3276091 - DNA, 16 bp, Homo sapiens
tagttagtagcatgtt

SEQ ID NO: 3276092 - DNA, 19 bp, Homo sapiens
tagttatacttatttgtat

SEQ ID NO: 3276093 - DNA, 14 bp, Homo sapiens
tagttcaaactgca

SEQ ID NO: 3276094 - DNA, 14 bp, Homo sapiens
tagttcaatacagt

SEQ ID NO: 3276095 - DNA, 15 bp, Homo sapiens
tagttcaatacagtg

SEQ ID NO: 3276096 - DNA, 19 bp, Homo sapiens
tagttcagacactttggaa

SEQ ID NO: 3276097 - DNA, 21 bp, Homo sapiens
tagttcagtagaattaccatt

SEQ ID NO: 3276098 - DNA, 16 bp, Homo sapiens
tagttcctaagaagct

SEQ ID NO: 3276099 - DNA, 19 bp, Homo sapiens
tagttcctaagaagcttct

SEQ ID NO: 3276100 - DNA, 21 bp, Homo sapiens
tagttcctaagaagcttctaa

SEQ ID NO: 3276101 - DNA, 11 bp, Homo sapiens
tagttctagac

SEQ ID NO: 3276102 - DNA, 16 bp, Homo sapiens
tagttctaggcactgt

SEQ ID NO: 3276103 - DNA, 18 bp, Homo sapiens
tagttctcttatctttga

SEQ ID NO: 3276104 - DNA, 14 bp, Homo sapiens
tagttctgccaggc

SEQ ID NO: 3276105 - DNA, 18 bp, Homo sapiens
tagttgcagactcagttt

SEQ ID NO: 3276106 - DNA, 22 bp, Homo sapiens
tagttgcgtggactctgcacat

SEQ ID NO: 3276107 - DNA, 19 bp, Homo sapiens
tagttgtattcttctgtat

SEQ ID NO: 3276108 - DNA, 13 bp, Homo sapiens
tagttgtgctttt

SEQ ID NO: 3276109 - DNA, 21 bp, Homo sapiens
tagttgtttctagactataaa

SEQ ID NO: 3276110 - DNA, 20 bp, Homo sapiens
tagtttacagaaaaatcttg

SEQ ID NO: 3276111 - DNA, 15 bp, Homo sapiens
tagtttattggaagt

SEQ ID NO: 3276112 - DNA, 14 bp, Homo sapiens
tagtttattttgtt

SEQ ID NO: 3276113 - DNA, 20 bp, Homo sapiens
tagtttcagagaccttaatt

SEQ ID NO: 3276114 - DNA, 17 bp, Homo sapiens
tagtttcagtaaataat

SEQ ID NO: 3276115 - DNA, 22 bp, Homo sapiens
tagtttctatctctaagctgtt

SEQ ID NO: 3276116 - DNA, 12 bp, Homo sapiens
tagtttcttgtg

SEQ ID NO: 3276117 - DNA, 16 bp, Homo sapiens
tagtttgaattcagta

SEQ ID NO: 3276118 - DNA, 12 bp, Homo sapiens
tagtttgcagtt

SEQ ID NO: 3276119 - DNA, 11 bp, Homo sapiens
tagtttggatt

SEQ ID NO: 3276120 - DNA, 17 bp, Homo sapiens
tagtttgtacatgcatt

SEQ ID NO: 3276121 - DNA, 14 bp, Homo sapiens
tagtttgtataact

SEQ ID NO: 3276122 - DNA, 18 bp, Homo sapiens
tagtttgtctattttaaa

SEQ ID NO: 3276123 - DNA, 21 bp, Homo sapiens
tagtttgtttaatgtgaactt

SEQ ID NO: 3276124 - DNA, 14 bp, Homo sapiens
tagttttagttgca

SEQ ID NO: 3276125 - DNA, 16 bp, Homo sapiens
tagttttagttgcaga

SEQ ID NO: 3276126 - DNA, 13 bp, Homo sapiens
tagttttcaactt

SEQ ID NO: 3276127 - DNA, 22 bp, Homo sapiens
tagtttttaacaatctaacaat

SEQ ID NO: 3276128 - DNA, 20 bp, Homo sapiens
tagtttttacagctgtgtta

SEQ ID NO: 3276129 - DNA, 15 bp, Homo sapiens
tagtttttatatgtt

SEQ ID NO: 3276130 - DNA, 17 bp, Homo sapiens
tagtttttcttcaacat

SEQ ID NO: 3276131 - DNA, 15 bp, Homo sapiens
tagtttttgttctta

SEQ ID NO: 3276132 - DNA, 18 bp, Homo sapiens
tagttttttttgtaaact

SEQ ID NO: 3276133 - DNA, 18 bp, Homo sapiens
tagtttttttttaatcta

SEQ ID NO: 3276134 - DNA, 21 bp, Homo sapiens
tagtttttttttaatctaaat

SEQ ID NO: 3276135 - DNA, 16 bp, Homo sapiens
tataaaaaatggttca

SEQ ID NO: 3276136 - DNA, 21 bp, Homo sapiens
tataaaaacatgagttattca

SEQ ID NO: 3276137 - DNA, 20 bp, Homo sapiens
tataaaaggcaaatgtgtac

SEQ ID NO: 3276138 - DNA, 15 bp, Homo sapiens
tataaaataactaaa

SEQ ID NO: 3276139 - DNA, 12 bp, Homo sapiens
tataaaatagac

SEQ ID NO: 3276140 - DNA, 22 bp, Homo sapiens
tataaaatccaaaatgaatgca

SEQ ID NO: 3276141 - DNA, 20 bp, Homo sapiens
tataaaatgtattcaagcaa

SEQ ID NO: 3276142 - DNA, 15 bp, Homo sapiens
tataaaattaagcaa

SEQ ID NO: 3276143 - DNA, 20 bp, Homo sapiens
tataaaattatgagattggt

SEQ ID NO: 3276144 - DNA, 18 bp, Homo sapiens
tataaacagaaatggaaa

SEQ ID NO: 3276145 - DNA, 18 bp, Homo sapiens
tataaacatcacacacac

SEQ ID NO: 3276146 - DNA, 23 bp, Homo sapiens
tataaacattaaaagaagactgg

SEQ ID NO: 3276147 - DNA, 18 bp, Homo sapiens
tataaaccttcagaagct

SEQ ID NO: 3276148 - DNA, 22 bp, Homo sapiens
tataaactttagagtagcatga

SEQ ID NO: 3276149 - DNA, 15 bp, Homo sapiens
tataaagaatatata

SEQ ID NO: 3276150 - DNA, 18 bp, Homo sapiens
tataaagacaagtatgaa

SEQ ID NO: 3276151 - DNA, 11 bp, Homo sapiens
tataaagatat

SEQ ID NO: 3276152 - DNA, 14 bp, Homo sapiens
tataaagattgtac

SEQ ID NO: 3276153 - DNA, 16 bp, Homo sapiens
tataaagattgtactt

SEQ ID NO: 3276154 - DNA, 17 bp, Homo sapiens
tataaagattgtactta

SEQ ID NO: 3276155 - DNA, 24 bp, Homo sapiens
tataaagattgtacttagccagtt

SEQ ID NO: 3276156 - DNA, 22 bp, Homo sapiens
tataaagcgatatacagatgaa

SEQ ID NO: 3276157 - DNA, 16 bp, Homo sapiens
tataaaggttgacaat

SEQ ID NO: 3276158 - DNA, 15 bp, Homo sapiens
tataaagtaaagcta

SEQ ID NO: 3276159 - DNA, 20 bp, Homo sapiens
tataaagtatagagagaagt

SEQ ID NO: 3276160 - DNA, 15 bp, Homo sapiens
tataaagtattcttt

SEQ ID NO: 3276161 - DNA, 18 bp, Homo sapiens
tataaagtattctttttc

SEQ ID NO: 3276162 - DNA, 23 bp, Homo sapiens
tataaatacgtattacaaacaag

SEQ ID NO: 3276163 - DNA, 13 bp, Homo sapiens
tataaataggaga

SEQ ID NO: 3276164 - DNA, 17 bp, Homo sapiens
tataaataggagaggat

SEQ ID NO: 3276165 - DNA, 20 bp, Homo sapiens
tataaatatatataaagaat

SEQ ID NO: 3276166 - DNA, 15 bp, Homo sapiens
tataaatatatttaa

SEQ ID NO: 3276167 - DNA, 14 bp, Homo sapiens
tataaatcatattg

SEQ ID NO: 3276168 - DNA, 18 bp, Homo sapiens
tataaatcatattgatga

SEQ ID NO: 3276169 - DNA, 21 bp, Homo sapiens
tataaatcatattgatgaaaa

SEQ ID NO: 3276170 - DNA, 22 bp, Homo sapiens
tataaatcatattgatgaaaag

SEQ ID NO: 3276171 - DNA, 12 bp, Homo sapiens
tataaatgagca

SEQ ID NO: 3276172 - DNA, 16 bp, Homo sapiens
tataaatggtgttttt

SEQ ID NO: 3276173 - DNA, 16 bp, Homo sapiens
tataaatgtataaata

SEQ ID NO: 3276174 - DNA, 23 bp, Homo sapiens
tataaatgtatatacacatatac

SEQ ID NO: 3276175 - DNA, 14 bp, Homo sapiens
tataaatgtcctaa

SEQ ID NO: 3276176 - DNA, 11 bp, Homo sapiens
tataaattctg

SEQ ID NO: 3276177 - DNA, 17 bp, Homo sapiens
tataaattctgtgggtc

SEQ ID NO: 3276178 - DNA, 14 bp, Homo sapiens
tataaattgtcttt

SEQ ID NO: 3276179 - DNA, 22 bp, Homo sapiens
tataacaaggttcttctaaaat

SEQ ID NO: 3276180 - DNA, 23 bp, Homo sapiens
tataacacatttttttgcatgca

SEQ ID NO: 3276181 - DNA, 19 bp, Homo sapiens
tataacagaaagtttgtaa

SEQ ID NO: 3276182 - DNA, 16 bp, Homo sapiens
tataacagatacattt

SEQ ID NO: 3276183 - DNA, 14 bp, Homo sapiens
tataacagatcctt

SEQ ID NO: 3276184 - DNA, 16 bp, Homo sapiens
tataacagtgtttaaa

SEQ ID NO: 3276185 - DNA, 13 bp, Homo sapiens
tataacatgtaaa

SEQ ID NO: 3276186 - DNA, 22 bp, Homo sapiens
tataacatgtctttcagcatta

SEQ ID NO: 3276187 - DNA, 17 bp, Homo sapiens
tataacctagttaaaga

SEQ ID NO: 3276188 - DNA, 17 bp, Homo sapiens
tataactcatcataaaa

SEQ ID NO: 3276189 - DNA, 18 bp, Homo sapiens
tataacttaaaaaaatga

SEQ ID NO: 3276190 - DNA, 13 bp, Homo sapiens
tataagaagcctt

SEQ ID NO: 3276191 - DNA, 17 bp, Homo sapiens
tataagaagccttaatt

SEQ ID NO: 3276192 - DNA, 12 bp, Homo sapiens
tataagactctc

SEQ ID NO: 3276193 - DNA, 24 bp, Homo sapiens
tataagagaagtctcattcgcctt

SEQ ID NO: 3276194 - DNA, 18 bp, Homo sapiens
tataagatcctagatcct

SEQ ID NO: 3276195 - DNA, 21 bp, Homo sapiens
tataagatcctagatcctaag

SEQ ID NO: 3276196 - DNA, 19 bp, Homo sapiens
tataagcaaattgcttttt

SEQ ID NO: 3276197 - DNA, 22 bp, Homo sapiens
tataagcaaatttcaaaagaca

SEQ ID NO: 3276198 - DNA, 18 bp, Homo sapiens
tataagcactgaaaaaca

SEQ ID NO: 3276199 - DNA, 19 bp, Homo sapiens
tataagcattgaaattata

SEQ ID NO: 3276200 - DNA, 16 bp, Homo sapiens
tataaggaaagcaata

SEQ ID NO: 3276201 - DNA, 22 bp, Homo sapiens
tataaggaaagcaataaatgaa

SEQ ID NO: 3276202 - DNA, 23 bp, Homo sapiens
tataaggaaagcaataaatgaat

SEQ ID NO: 3276203 - DNA, 20 bp, Homo sapiens
tataagtagttggtttgtat

SEQ ID NO: 3276204 - DNA, 13 bp, Homo sapiens
tataagtcaagca

SEQ ID NO: 3276205 - DNA, 19 bp, Homo sapiens
tataagtcaagcacatgta

SEQ ID NO: 3276206 - DNA, 14 bp, Homo sapiens
tataagtgaagtga

SEQ ID NO: 3276207 - DNA, 21 bp, Homo sapiens
tataagtgcacacagaaatat

SEQ ID NO: 3276208 - DNA, 13 bp, Homo sapiens
tataagtgtacat

SEQ ID NO: 3276209 - DNA, 18 bp, Homo sapiens
tataagtgtacatatgtg

SEQ ID NO: 3276210 - DNA, 19 bp, Homo sapiens
tataagttatttttgtaca

SEQ ID NO: 3276211 - DNA, 21 bp, Homo sapiens
tataagttatttttgtacatg

SEQ ID NO: 3276212 - DNA, 22 bp, Homo sapiens
tataagttatttttgtacatgt

SEQ ID NO: 3276213 - DNA, 20 bp, Homo sapiens
tataataaaatgtgttgaaa

SEQ ID NO: 3276214 - DNA, 23 bp, Homo sapiens
tataataggaacaatctttgctg

SEQ ID NO: 3276215 - DNA, 14 bp, Homo sapiens
tataatatggaacc

SEQ ID NO: 3276216 - DNA, 16 bp, Homo sapiens
tataatcaaatgattt

SEQ ID NO: 3276217 - DNA, 15 bp, Homo sapiens
tataatcattagttt

SEQ ID NO: 3276218 - DNA, 21 bp, Homo sapiens
tataatcattagttttagagg

SEQ ID NO: 3276219 - DNA, 18 bp, Homo sapiens
tataatcccagcactttg

SEQ ID NO: 3276220 - DNA, 13 bp, Homo sapiens
tataatctcaaag

SEQ ID NO: 3276221 - DNA, 14 bp, Homo sapiens
tataatctgtcaaa

SEQ ID NO: 3276222 - DNA, 20 bp, Homo sapiens
tataatctgtcaaaacactg

SEQ ID NO: 3276223 - DNA, 21 bp, Homo sapiens
tataatctgtcaaaacactgt

SEQ ID NO: 3276224 - DNA, 15 bp, Homo sapiens
tataatcttatacaa

SEQ ID NO: 3276225 - DNA, 16 bp, Homo sapiens
tataatcttatacaac

SEQ ID NO: 3276226 - DNA, 16 bp, Homo sapiens
tataatcttgtagaca

SEQ ID NO: 3276227 - DNA, 19 bp, Homo sapiens
tataatcttgtagacactt

SEQ ID NO: 3276228 - DNA, 16 bp, Homo sapiens
tataatgaacaaaatt

SEQ ID NO: 3276229 - DNA, 20 bp, Homo sapiens
tataatgaatgaaacatttt

SEQ ID NO: 3276230 - DNA, 14 bp, Homo sapiens
tataatgtaagctc

SEQ ID NO: 3276231 - DNA, 12 bp, Homo sapiens
tataatgtgtgt

SEQ ID NO: 3276232 - DNA, 14 bp, Homo sapiens
tataatgtgtgtat

SEQ ID NO: 3276233 - DNA, 15 bp, Homo sapiens
tataatgtgtgtatg

SEQ ID NO: 3276234 - DNA, 19 bp, Homo sapiens
tataatgtgtgtatgtgta

SEQ ID NO: 3276235 - DNA, 22 bp, Homo sapiens
tataatgtgtgtatgtgtattt

SEQ ID NO: 3276236 - DNA, 16 bp, Homo sapiens
tataatgttagtagaa

SEQ ID NO: 3276237 - DNA, 17 bp, Homo sapiens
tataatgttgttattta

SEQ ID NO: 3276238 - DNA, 18 bp, Homo sapiens
tataatgttgttatttaa

SEQ ID NO: 3276239 - DNA, 13 bp, Homo sapiens
tataatgtttaaa

SEQ ID NO: 3276240 - DNA, 17 bp, Homo sapiens
tataatgtttaaatcat

SEQ ID NO: 3276241 - DNA, 18 bp, Homo sapiens
tataatgtttattaaatg

SEQ ID NO: 3276242 - DNA, 19 bp, Homo sapiens
tataattatcggaagcagt

SEQ ID NO: 3276243 - DNA, 13 bp, Homo sapiens
tataattccctat

SEQ ID NO: 3276244 - DNA, 13 bp, Homo sapiens
tataattctgtaa

SEQ ID NO: 3276245 - DNA, 13 bp, Homo sapiens
tataattctgtac

SEQ ID NO: 3276246 - DNA, 19 bp, Homo sapiens
tataattctgtacatagcc

SEQ ID NO: 3276247 - DNA, 20 bp, Homo sapiens
tataattctgtacatagcct

SEQ ID NO: 3276248 - DNA, 18 bp, Homo sapiens
tataattggatttcctaa

SEQ ID NO: 3276249 - DNA, 18 bp, Homo sapiens
tataattgtatcagaggc

SEQ ID NO: 3276250 - DNA, 16 bp, Homo sapiens
tataatttcgagattt

SEQ ID NO: 3276251 - DNA, 16 bp, Homo sapiens
tataattttctgaaag

SEQ ID NO: 3276252 - DNA, 19 bp, Homo sapiens
tataattttctgaaagtta

SEQ ID NO: 3276253 - DNA, 13 bp, Homo sapiens
tataattttgcct

SEQ ID NO: 3276254 - DNA, 19 bp, Homo sapiens
tataatttttaaagtatat

SEQ ID NO: 3276255 - DNA, 20 bp, Homo sapiens
tataatttttttattactga

SEQ ID NO: 3276256 - DNA, 21 bp, Homo sapiens
tataatttttttcaatattta

SEQ ID NO: 3276257 - DNA, 14 bp, Homo sapiens
tatacaaaagagca

SEQ ID NO: 3276258 - DNA, 14 bp, Homo sapiens
tatacaaagtgtac

SEQ ID NO: 3276259 - DNA, 16 bp, Homo sapiens
tatacaaatatattgt

SEQ ID NO: 3276260 - DNA, 23 bp, Homo sapiens
tatacaaattaaaaagattcttt

SEQ ID NO: 3276261 - DNA, 14 bp, Homo sapiens
tatacaaattagaa

SEQ ID NO: 3276262 - DNA, 23 bp, Homo sapiens
tatacaaattttcagaaggttat

SEQ ID NO: 3276263 - DNA, 13 bp, Homo sapiens
tatacaaggcaag

SEQ ID NO: 3276264 - DNA, 19 bp, Homo sapiens
tatacaaggcaagcatttt

SEQ ID NO: 3276265 - DNA, 17 bp, Homo sapiens
tatacaataacccagtt

SEQ ID NO: 3276266 - DNA, 18 bp, Homo sapiens
tatacaataacccagtta

SEQ ID NO: 3276267 - DNA, 15 bp, Homo sapiens
tatacaatatataaa

SEQ ID NO: 3276268 - DNA, 13 bp, Homo sapiens
tatacaatgttct

SEQ ID NO: 3276269 - DNA, 13 bp, Homo sapiens
tatacagatgaaa

SEQ ID NO: 3276270 - DNA, 15 bp, Homo sapiens
tatacagatgaaaat

SEQ ID NO: 3276271 - DNA, 19 bp, Homo sapiens
tatacagatgaaaatttga

SEQ ID NO: 3276272 - DNA, 18 bp, Homo sapiens
tatacagtaactttatgt

SEQ ID NO: 3276273 - DNA, 22 bp, Homo sapiens
tatacagtaactttatgtgtaa

SEQ ID NO: 3276274 - DNA, 22 bp, Homo sapiens
tatacagtatagatttttgggt

SEQ ID NO: 3276275 - DNA, 19 bp, Homo sapiens
tatacagttataaaattaa

SEQ ID NO: 3276276 - DNA, 20 bp, Homo sapiens
tatacagttataaaattaaa

SEQ ID NO: 3276277 - DNA, 14 bp, Homo sapiens
tatacagttatttt

SEQ ID NO: 3276278 - DNA, 16 bp, Homo sapiens
tatacagttcaataaa

SEQ ID NO: 3276279 - DNA, 15 bp, Homo sapiens
tatacatacacttgt

SEQ ID NO: 3276280 - DNA, 20 bp, Homo sapiens
tatacatacacttgtataaa

SEQ ID NO: 3276281 - DNA, 15 bp, Homo sapiens
tatacatatctttat

SEQ ID NO: 3276282 - DNA, 19 bp, Homo sapiens
tatacatcaatttaaaaag

SEQ ID NO: 3276283 - DNA, 23 bp, Homo sapiens
tatacatcaatttaaaaagcaaa

SEQ ID NO: 3276284 - DNA, 16 bp, Homo sapiens
tatacatcctgggtaa

SEQ ID NO: 3276285 - DNA, 11 bp, Homo sapiens
tatacatgcca

SEQ ID NO: 3276286 - DNA, 12 bp, Homo sapiens
tatacatgtgtg

SEQ ID NO: 3276287 - DNA, 18 bp, Homo sapiens
tatacatgtgtgtatata

SEQ ID NO: 3276288 - DNA, 16 bp, Homo sapiens
tatacattctttatct

SEQ ID NO: 3276289 - DNA, 14 bp, Homo sapiens
tatacattgtgtga

SEQ ID NO: 3276290 - DNA, 13 bp, Homo sapiens
tatacatttgttg

SEQ ID NO: 3276291 - DNA, 13 bp, Homo sapiens
tatacattttgtt

SEQ ID NO: 3276292 - DNA, 17 bp, Homo sapiens
tataccagcaatatatc

SEQ ID NO: 3276293 - DNA, 19 bp, Homo sapiens
tataccccttacttagcat

SEQ ID NO: 3276294 - DNA, 12 bp, Homo sapiens
tatacctgattt

SEQ ID NO: 3276295 - DNA, 13 bp, Homo sapiens
tatacgtgtagct

SEQ ID NO: 3276296 - DNA, 20 bp, Homo sapiens
tatactaaaccaactctaat

SEQ ID NO: 3276297 - DNA, 22 bp, Homo sapiens
tatactaaaccaactctaatat

SEQ ID NO: 3276298 - DNA, 19 bp, Homo sapiens
tatactaagatgttcactg

SEQ ID NO: 3276299 - DNA, 18 bp, Homo sapiens
tatactctagatgaagtt

SEQ ID NO: 3276300 - DNA, 17 bp, Homo sapiens
tatactctttctgtata

SEQ ID NO: 3276301 - DNA, 20 bp, Homo sapiens
tatactgaaggaaaaacaca

SEQ ID NO: 3276302 - DNA, 16 bp, Homo sapiens
tatactgcatactttt

SEQ ID NO: 3276303 - DNA, 16 bp, Homo sapiens
tatactggaaatgtaa

SEQ ID NO: 3276304 - DNA, 22 bp, Homo sapiens
tatactgtaatttagttattga

SEQ ID NO: 3276305 - DNA, 13 bp, Homo sapiens
tatacttgactct

SEQ ID NO: 3276306 - DNA, 15 bp, Homo sapiens
tatactttacaggaa

SEQ ID NO: 3276307 - DNA, 12 bp, Homo sapiens
tatactttagta

SEQ ID NO: 3276308 - DNA, 19 bp, Homo sapiens
tatactttagtagacattt

SEQ ID NO: 3276309 - DNA, 12 bp, Homo sapiens
tatactttatat

SEQ ID NO: 3276310 - DNA, 18 bp, Homo sapiens
tatactttatatctgtaa

SEQ ID NO: 3276311 - DNA, 19 bp, Homo sapiens
tatacttttcccctgttaa

SEQ ID NO: 3276312 - DNA, 11 bp, Homo sapiens
tatactttttt

SEQ ID NO: 3276313 - DNA, 19 bp, Homo sapiens
tatagaataaaagctataa

SEQ ID NO: 3276314 - DNA, 22 bp, Homo sapiens
tatagaatacttttttctagtt

SEQ ID NO: 3276315 - DNA, 13 bp, Homo sapiens
tatagaattcaga

SEQ ID NO: 3276316 - DNA, 23 bp, Homo sapiens
tatagacagtccttaaaaatcac

SEQ ID NO: 3276317 - DNA, 19 bp, Homo sapiens
tatagactgccgtgcatta

SEQ ID NO: 3276318 - DNA, 15 bp, Homo sapiens
tatagagaaaagtgt

SEQ ID NO: 3276319 - DNA, 18 bp, Homo sapiens
tatagagagggggctctc

SEQ ID NO: 3276320 - DNA, 23 bp, Homo sapiens
tatagagagggggctctccaaag

SEQ ID NO: 3276321 - DNA, 21 bp, Homo sapiens
tatagaggctagcttctgctt

SEQ ID NO: 3276322 - DNA, 16 bp, Homo sapiens
tatagatataactgta

SEQ ID NO: 3276323 - DNA, 16 bp, Homo sapiens
tatagattagaaaaat

SEQ ID NO: 3276324 - DNA, 17 bp, Homo sapiens
tatagattctaaagatt

SEQ ID NO: 3276325 - DNA, 14 bp, Homo sapiens
tatagcaaatgcag

SEQ ID NO: 3276326 - DNA, 17 bp, Homo sapiens
tatagcaaatgcagaac

SEQ ID NO: 3276327 - DNA, 21 bp, Homo sapiens
tatagcaagatattgatcaaa

SEQ ID NO: 3276328 - DNA, 13 bp, Homo sapiens
tatagcaatccat

SEQ ID NO: 3276329 - DNA, 23 bp, Homo sapiens
tatagcaatccatgttagttttt

SEQ ID NO: 3276330 - DNA, 21 bp, Homo sapiens
tatagcactttgaaatacctc

SEQ ID NO: 3276331 - DNA, 20 bp, Homo sapiens
tatagcagagtccttattct

SEQ ID NO: 3276332 - DNA, 21 bp, Homo sapiens
tatagcagcaaaaatataaaa

SEQ ID NO: 3276333 - DNA, 19 bp, Homo sapiens
tatagcattgataatcttc

SEQ ID NO: 3276334 - DNA, 15 bp, Homo sapiens
taatatattgtacaa

SEQ ID NO: 3276335 - DNA, 22 bp, Homo sapiens
taatatatttttatatttagtt

SEQ ID NO: 3276336 - DNA, 22 bp, Homo sapiens
taatatccaacacaactatcaa

SEQ ID NO: 3276337 - DNA, 17 bp, Homo sapiens
taatatccctacatgta

SEQ ID NO: 3276338 - DNA, 18 bp, Homo sapiens
taatatctggcactgtta

SEQ ID NO: 3276339 - DNA, 14 bp, Homo sapiens
taatatctttgtga

SEQ ID NO: 3276340 - DNA, 19 bp, Homo sapiens
taatatctttgtgataatt

SEQ ID NO: 3276341 - DNA, 20 bp, Homo sapiens
taatatctttgtgataattt

SEQ ID NO: 3276342 - DNA, 18 bp, Homo sapiens
taatatgcttaaaataag

SEQ ID NO: 3276343 - DNA, 13 bp, Homo sapiens
taatatggaacct

SEQ ID NO: 3276344 - DNA, 18 bp, Homo sapiens
taatatggaaccttccct

SEQ ID NO: 3276345 - DNA, 19 bp, Homo sapiens
taatattaatttatttaat

SEQ ID NO: 3276346 - DNA, 16 bp, Homo sapiens
taatattagtgattct

SEQ ID NO: 3276347 - DNA, 20 bp, Homo sapiens
taatattcagggtaaatagg

SEQ ID NO: 3276348 - DNA, 16 bp, Homo sapiens
taatattgacttgtat

SEQ ID NO: 3276349 - DNA, 14 bp, Homo sapiens
taatattgagaaag

SEQ ID NO: 3276350 - DNA, 11 bp, Homo sapiens
taatattgctt

SEQ ID NO: 3276351 - DNA, 12 bp, Homo sapiens
taatattgcttc

SEQ ID NO: 3276352 - DNA, 16 bp, Homo sapiens
taatattgcttcttgt

SEQ ID NO: 3276353 - DNA, 20 bp, Homo sapiens
taatattgtttggtaaatgt

SEQ ID NO: 3276354 - DNA, 23 bp, Homo sapiens
taatattgtttttctttctacaa

SEQ ID NO: 3276355 - DNA, 13 bp, Homo sapiens
taatatttaaaca

SEQ ID NO: 3276356 - DNA, 21 bp, Homo sapiens
taatatttaaacagcagtgtt

SEQ ID NO: 3276357 - DNA, 17 bp, Homo sapiens
taatatttaaatattac

SEQ ID NO: 3276358 - DNA, 18 bp, Homo sapiens
taatcaaagccagggtct

SEQ ID NO: 3276359 - DNA, 11 bp, Homo sapiens
taatcaaatga

SEQ ID NO: 3276360 - DNA, 22 bp, Homo sapiens
taatcaactgtaggttatttaa

SEQ ID NO: 3276361 - DNA, 17 bp, Homo sapiens
taatcacagtcatcttt

SEQ ID NO: 3276362 - DNA, 15 bp, Homo sapiens
taatcacgctttcct

SEQ ID NO: 3276363 - DNA, 18 bp, Homo sapiens
taatcacgctttcctgaa

SEQ ID NO: 3276364 - DNA, 13 bp, Homo sapiens
taatcactcccat

SEQ ID NO: 3276365 - DNA, 20 bp, Homo sapiens
taatcactctaattaattgt

SEQ ID NO: 3276366 - DNA, 13 bp, Homo sapiens
taatcacttttca

SEQ ID NO: 3276367 - DNA, 11 bp, Homo sapiens
taatcagcctc

SEQ ID NO: 3276368 - DNA, 13 bp, Homo sapiens
taatcagcctctt

SEQ ID NO: 3276369 - DNA, 16 bp, Homo sapiens
taatcagctctcctgg

SEQ ID NO: 3276370 - DNA, 19 bp, Homo sapiens
taatcagggaggtcatttt

SEQ ID NO: 3276371 - DNA, 11 bp, Homo sapiens
taatcagtgtc

SEQ ID NO: 3276372 - DNA, 18 bp, Homo sapiens
taatcagtgtgtctaaat

SEQ ID NO: 3276373 - DNA, 14 bp, Homo sapiens
taatcatactgtct

SEQ ID NO: 3276374 - DNA, 22 bp, Homo sapiens
taatcatataataaatgtacat

SEQ ID NO: 3276375 - DNA, 13 bp, Homo sapiens
taatcatatgtgt

SEQ ID NO: 3276376 - DNA, 17 bp, Homo sapiens
taatcatctataaagaa

SEQ ID NO: 3276377 - DNA, 20 bp, Homo sapiens
taatcatgtgggtgagccag

SEQ ID NO: 3276378 - DNA, 13 bp, Homo sapiens
taatcatttgttt

SEQ ID NO: 3276379 - DNA, 19 bp, Homo sapiens
taatcatttgtttacattt

SEQ ID NO: 3276380 - DNA, 12 bp, Homo sapiens
taatcattttca

SEQ ID NO: 3276381 - DNA, 13 bp, Homo sapiens
taatccagctgat

SEQ ID NO: 3276382 - DNA, 13 bp, Homo sapiens
taatccattttta

SEQ ID NO: 3276383 - DNA, 16 bp, Homo sapiens
taatcccagcactttg

SEQ ID NO: 3276384 - DNA, 19 bp, Homo sapiens
taatcccctaaaataacag

SEQ ID NO: 3276385 - DNA, 20 bp, Homo sapiens
taatccctgggcattgcttt

SEQ ID NO: 3276386 - DNA, 15 bp, Homo sapiens
taatcctatctgggg

SEQ ID NO: 3276387 - DNA, 19 bp, Homo sapiens
taatcctgtaccaaatctg

SEQ ID NO: 3276388 - DNA, 20 bp, Homo sapiens
taatcctttgttttctgact

SEQ ID NO: 3276389 - DNA, 23 bp, Homo sapiens
taatcctttgttttctgactaat

SEQ ID NO: 3276390 - DNA, 14 bp, Homo sapiens
taatctagacaata

SEQ ID NO: 3276391 - DNA, 20 bp, Homo sapiens
taatctattgggttcattat

SEQ ID NO: 3276392 - DNA, 18 bp, Homo sapiens
taatctcaaaggagaaaa

SEQ ID NO: 3276393 - DNA, 14 bp, Homo sapiens
taatctcatgctgt

SEQ ID NO: 3276394 - DNA, 17 bp, Homo sapiens
taatctctgttatgtac

SEQ ID NO: 3276395 - DNA, 22 bp, Homo sapiens
taatctctgttatgtactgtac

SEQ ID NO: 3276396 - DNA, 24 bp, Homo sapiens
taatctctgttatgtactgtacta

SEQ ID NO: 3276397 - DNA, 14 bp, Homo sapiens
taatctcttattct

SEQ ID NO: 3276398 - DNA, 23 bp, Homo sapiens
taatctgaagatatatttcactt

SEQ ID NO: 3276399 - DNA, 13 bp, Homo sapiens
taatctgaataaa

SEQ ID NO: 3276400 - DNA, 22 bp, Homo sapiens
taatctgaataaagtgtaacaa

SEQ ID NO: 3276401 - DNA, 23 bp, Homo sapiens
taatctgaataaagtgtaacaat

SEQ ID NO: 3276402 - DNA, 15 bp, Homo sapiens
taatctggactcctc

SEQ ID NO: 3276403 - DNA, 19 bp, Homo sapiens
taatctggactcctctgtc

SEQ ID NO: 3276404 - DNA, 20 bp, Homo sapiens
taatctggactcctctgtcc

SEQ ID NO: 3276405 - DNA, 17 bp, Homo sapiens
taatctgggaagggaag

SEQ ID NO: 3276406 - DNA, 17 bp, Homo sapiens
taatctgggcagacatt

SEQ ID NO: 3276407 - DNA, 18 bp, Homo sapiens
taatctgtacattttgtt

SEQ ID NO: 3276408 - DNA, 17 bp, Homo sapiens
taatctgtagggctgga

SEQ ID NO: 3276409 - DNA, 20 bp, Homo sapiens
taatctgtcaaaacactgtg

SEQ ID NO: 3276410 - DNA, 22 bp, Homo sapiens
taatctgtcaaaacactgtgga

SEQ ID NO: 3276411 - DNA, 20 bp, Homo sapiens
taatctgttaggttggggat

SEQ ID NO: 3276412 - DNA, 20 bp, Homo sapiens
taatctgttatgtactagtg

SEQ ID NO: 3276413 - DNA, 19 bp, Homo sapiens
taatcttaggggagagctt

SEQ ID NO: 3276414 - DNA, 15 bp, Homo sapiens
taatcttagtgtatg

SEQ ID NO: 3276415 - DNA, 16 bp, Homo sapiens
taatcttcagttttat

SEQ ID NO: 3276416 - DNA, 15 bp, Homo sapiens
taatcttctgccttc

SEQ ID NO: 3276417 - DNA, 20 bp, Homo sapiens
taatctttctatagccaact

SEQ ID NO: 3276418 - DNA, 21 bp, Homo sapiens
taatgaaaaggaagttaatac

SEQ ID NO: 3276419 - DNA, 19 bp, Homo sapiens
taatgaaagactgtacaaa

SEQ ID NO: 3276420 - DNA, 23 bp, Homo sapiens
taatgaaagactgtacaaagtag

SEQ ID NO: 3276421 - DNA, 19 bp, Homo sapiens
taatgaaagggaaagtcag

SEQ ID NO: 3276422 - DNA, 14 bp, Homo sapiens
taatgaacaaaatt

SEQ ID NO: 3276423 - DNA, 19 bp, Homo sapiens
taatgaactaccatctgat

SEQ ID NO: 3276424 - DNA, 22 bp, Homo sapiens
taatgaagggaaaggatatttt

SEQ ID NO: 3276425 - DNA, 17 bp, Homo sapiens
taatgaataaactgaat

SEQ ID NO: 3276426 - DNA, 16 bp, Homo sapiens
taatgaatactttctt

SEQ ID NO: 3276427 - DNA, 17 bp, Homo sapiens
taatgaatgaaacattt

SEQ ID NO: 3276428 - DNA, 16 bp, Homo sapiens
taatgaattataacag

SEQ ID NO: 3276429 - DNA, 19 bp, Homo sapiens
taatgataagtaaatgcta

SEQ ID NO: 3276430 - DNA, 22 bp, Homo sapiens
taatgataatcccaccaccctt

SEQ ID NO: 3276431 - DNA, 19 bp, Homo sapiens
taatgatactgattatgaa

SEQ ID NO: 3276432 - DNA, 20 bp, Homo sapiens
taatgatactgattatgaaa

SEQ ID NO: 3276433 - DNA, 21 bp, Homo sapiens
taatgatactgattatgaaat

SEQ ID NO: 3276434 - DNA, 22 bp, Homo sapiens
taatgatactgattatgaaatg

SEQ ID NO: 3276435 - DNA, 17 bp, Homo sapiens
taatgatcaaaacatgc

SEQ ID NO: 3276436 - DNA, 11 bp, Homo sapiens
taatgatgttt

SEQ ID NO: 3276437 - DNA, 22 bp, Homo sapiens
taatgcaaattaaaacatattt

SEQ ID NO: 3276438 - DNA, 18 bp, Homo sapiens
taatgcactgtttttaat

SEQ ID NO: 3276439 - DNA, 15 bp, Homo sapiens
taatgcatacagaaa

SEQ ID NO: 3276440 - DNA, 16 bp, Homo sapiens
taatgcattaaacctg

SEQ ID NO: 3276441 - DNA, 19 bp, Homo sapiens
taatgctaatttaaagaga

SEQ ID NO: 3276442 - DNA, 15 bp, Homo sapiens
taatgctacaatttt

SEQ ID NO: 3276443 - DNA, 15 bp, Homo sapiens
taatgctactgtctc

SEQ ID NO: 3276444 - DNA, 23 bp, Homo sapiens
taatgcttcaagtgttgctcttg

SEQ ID NO: 3276445 - DNA, 22 bp, Homo sapiens
gtcttgtacttctgtgttcatt

SEQ ID NO: 3276446 - DNA, 13 bp, Homo sapiens
gtcttgttagaaa

SEQ ID NO: 3276447 - DNA, 15 bp, Homo sapiens
gtctttaaaagagag

SEQ ID NO: 3276448 - DNA, 20 bp, Homo sapiens
gtctttaaaggcccagcccc

SEQ ID NO: 3276449 - DNA, 22 bp, Homo sapiens
gtctttaaaggcccagccccta

SEQ ID NO: 3276450 - DNA, 15 bp, Homo sapiens
gtctttaagagactc

SEQ ID NO: 3276451 - DNA, 16 bp, Homo sapiens
gtctttaagagactca

SEQ ID NO: 3276452 - DNA, 20 bp, Homo sapiens
gtctttactggacctgaaat

SEQ ID NO: 3276453 - DNA, 15 bp, Homo sapiens
gtctttcacagctcc

SEQ ID NO: 3276454 - DNA, 11 bp, Homo sapiens
gtctttcagta

SEQ ID NO: 3276455 - DNA, 21 bp, Homo sapiens
gtctttccaaattatttctta

SEQ ID NO: 3276456 - DNA, 20 bp, Homo sapiens
gtctttctaatgtagctatt

SEQ ID NO: 3276457 - DNA, 15 bp, Homo sapiens
gtctttgatcatcat

SEQ ID NO: 3276458 - DNA, 15 bp, Homo sapiens
gtctttgccttctct

SEQ ID NO: 3276459 - DNA, 18 bp, Homo sapiens
gtctttggaaaaatgttt

SEQ ID NO: 3276460 - DNA, 15 bp, Homo sapiens
gtctttggttcagct

SEQ ID NO: 3276461 - DNA, 15 bp, Homo sapiens
gtctttggttctaag

SEQ ID NO: 3276462 - DNA, 13 bp, Homo sapiens
gtctttgtaagag

SEQ ID NO: 3276463 - DNA, 21 bp, Homo sapiens
gtctttgtaagagtgtagaag

SEQ ID NO: 3276464 - DNA, 13 bp, Homo sapiens
gtcttttaaaatg

SEQ ID NO: 3276465 - DNA, 18 bp, Homo sapiens
gtcttttatatttgtatc

SEQ ID NO: 3276466 - DNA, 12 bp, Homo sapiens
gtcttttctgct

SEQ ID NO: 3276467 - DNA, 16 bp, Homo sapiens
gtctttttctggactg

SEQ ID NO: 3276468 - DNA, 20 bp, Homo sapiens
gtctttttctgttgtaactt

SEQ ID NO: 3276469 - DNA, 16 bp, Homo sapiens
gtcttttttcatttct

SEQ ID NO: 3276470 - DNA, 14 bp, Homo sapiens
gtcttttttttcct

SEQ ID NO: 3276471 - DNA, 20 bp, Homo sapiens
gtgaaaaactgctgtaaaca

SEQ ID NO: 3276472 - DNA, 14 bp, Homo sapiens
gtgaaaataaagca

SEQ ID NO: 3276473 - DNA, 17 bp, Homo sapiens
gtgaaaataaagcagaa

SEQ ID NO: 3276474 - DNA, 17 bp, Homo sapiens
gtgaaaatatacttgac

SEQ ID NO: 3276475 - DNA, 15 bp, Homo sapiens
gtgaaaattctgttg

SEQ ID NO: 3276476 - DNA, 16 bp, Homo sapiens
gtgaaacacaccaggc

SEQ ID NO: 3276477 - DNA, 21 bp, Homo sapiens
gtgaaacacaccaggctgtgg

SEQ ID NO: 3276478 - DNA, 15 bp, Homo sapiens
gtgaaacacagctgt

SEQ ID NO: 3276479 - DNA, 16 bp, Homo sapiens
gtgaaaccctgtctct

SEQ ID NO: 3276480 - DNA, 20 bp, Homo sapiens
gtgaaacctttagggcagct

SEQ ID NO: 3276481 - DNA, 23 bp, Homo sapiens
gtgaaacctttagggcagcttgc

SEQ ID NO: 3276482 - DNA, 19 bp, Homo sapiens
gtgaaactaacagataagc

SEQ ID NO: 3276483 - DNA, 21 bp, Homo sapiens
gtgaaagaaagctgagaagaa

SEQ ID NO: 3276484 - DNA, 20 bp, Homo sapiens
gtgaaagctgagaactcctg

SEQ ID NO: 3276485 - DNA, 17 bp, Homo sapiens
gtgaaagtacatttgga

SEQ ID NO: 3276486 - DNA, 20 bp, Homo sapiens
gtgaaattgcatactttgta

SEQ ID NO: 3276487 - DNA, 21 bp, Homo sapiens
gtgaaatttattagttaatat

SEQ ID NO: 3276488 - DNA, 14 bp, Homo sapiens
gtgaaattttggtg

SEQ ID NO: 3276489 - DNA, 19 bp, Homo sapiens
gtgaacaaatcaaattgct

SEQ ID NO: 3276490 - DNA, 20 bp, Homo sapiens
gtgaacaaatcaaattgctt

SEQ ID NO: 3276491 - DNA, 17 bp, Homo sapiens
gtgaacagagagaccct

SEQ ID NO: 3276492 - DNA, 19 bp, Homo sapiens
gtgaacaggctgggctgct

SEQ ID NO: 3276493 - DNA, 12 bp, Homo sapiens
gtgaacatttta

SEQ ID NO: 3276494 - DNA, 21 bp, Homo sapiens
gtgaaccacaggttttagcat

SEQ ID NO: 3276495 - DNA, 22 bp, Homo sapiens
gtgaaccaccacacccagccca

SEQ ID NO: 3276496 - DNA, 14 bp, Homo sapiens
gtgaacctgtataa

SEQ ID NO: 3276497 - DNA, 23 bp, Homo sapiens
gtgaactcaccctgggagccagt

SEQ ID NO: 3276498 - DNA, 20 bp, Homo sapiens
gtgaacttgtagctgtaaaa

SEQ ID NO: 3276499 - DNA, 21 bp, Homo sapiens
gtgaacttgtagctgtaaaac

SEQ ID NO: 3276500 - DNA, 15 bp, Homo sapiens
gtgaactttattaaa

SEQ ID NO: 3276501 - DNA, 14 bp, Homo sapiens
gtgaactttttgta

SEQ ID NO: 3276502 - DNA, 19 bp, Homo sapiens
gtgaagaatttagatctta

SEQ ID NO: 3276503 - DNA, 13 bp, Homo sapiens
gtgaagaggggca

SEQ ID NO: 3276504 - DNA, 15 bp, Homo sapiens
gtgaagaggggcagc

SEQ ID NO: 3276505 - DNA, 17 bp, Homo sapiens
gtgaagaggggcagccc

SEQ ID NO: 3276506 - DNA, 17 bp, Homo sapiens
gtgaagataatttgcat

SEQ ID NO: 3276507 - DNA, 21 bp, Homo sapiens
gtgaagatgaagaagcctttg

SEQ ID NO: 3276508 - DNA, 13 bp, Homo sapiens
gtgaataaatgtc

SEQ ID NO: 3276509 - DNA, 16 bp, Homo sapiens
gtgaataaatgtcttg

SEQ ID NO: 3276510 - DNA, 15 bp, Homo sapiens
gtgaatacaattaaa

SEQ ID NO: 3276511 - DNA, 15 bp, Homo sapiens
gtgaatacctgctca

SEQ ID NO: 3276512 - DNA, 22 bp, Homo sapiens
gtgaatatttccatatggattt

SEQ ID NO: 3276513 - DNA, 21 bp, Homo sapiens
gtgaatctaaggataatgaaa

SEQ ID NO: 3276514 - DNA, 11 bp, Homo sapiens
gtgaatgaaag

SEQ ID NO: 3276515 - DNA, 18 bp, Homo sapiens
gtgaatgaaagattaaac

SEQ ID NO: 3276516 - DNA, 19 bp, Homo sapiens
gtgaatgaaagattaaaca

SEQ ID NO: 3276517 - DNA, 12 bp, Homo sapiens
gtgaatgctaag

SEQ ID NO: 3276518 - DNA, 14 bp, Homo sapiens
gtgaatgcttctca

SEQ ID NO: 3276519 - DNA, 12 bp, Homo sapiens
gtgaatggaggc

SEQ ID NO: 3276520 - DNA, 19 bp, Homo sapiens
gtgaatggccctagaactg

SEQ ID NO: 3276521 - DNA, 12 bp, Homo sapiens
gtgaattaaaaa

SEQ ID NO: 3276522 - DNA, 20 bp, Homo sapiens
tcaaagttttgaaaagctat

SEQ ID NO: 3276523 - DNA, 23 bp, Homo sapiens
tcaaataaaactagtgacagctt

SEQ ID NO: 3276524 - DNA, 16 bp, Homo sapiens
tcaaataaatttctgg

SEQ ID NO: 3276525 - DNA, 18 bp, Homo sapiens
tcaaataactaaaaggta

SEQ ID NO: 3276526 - DNA, 14 bp, Homo sapiens
tcaaatacaaagta

SEQ ID NO: 3276527 - DNA, 23 bp, Homo sapiens
tcaaataggctattaaaaaagtc

SEQ ID NO: 3276528 - DNA, 22 bp, Homo sapiens
tcaaatatagaaagttgatatt

SEQ ID NO: 3276529 - DNA, 15 bp, Homo sapiens
tcaaatattaccaaa

SEQ ID NO: 3276530 - DNA, 17 bp, Homo sapiens
tcaaatcagtgatctat

SEQ ID NO: 3276531 - DNA, 15 bp, Homo sapiens
tcaaatctaccactg

SEQ ID NO: 3276532 - DNA, 20 bp, Homo sapiens
tcaaatctaccactgtatga

SEQ ID NO: 3276533 - DNA, 19 bp, Homo sapiens
tcaaatctcccacaagtat

SEQ ID NO: 3276534 - DNA, 20 bp, Homo sapiens
tcaaatctcccacaagtata

SEQ ID NO: 3276535 - DNA, 16 bp, Homo sapiens
tcaaatctcctgctga

SEQ ID NO: 3276536 - DNA, 21 bp, Homo sapiens
tcaaatctcctgctgatttca

SEQ ID NO: 3276537 - DNA, 20 bp, Homo sapiens
tcaaatctgtatatgttgta

SEQ ID NO: 3276538 - DNA, 13 bp, Homo sapiens
tcaaatgatttca

SEQ ID NO: 3276539 - DNA, 15 bp, Homo sapiens
tcaaatgatttcata

SEQ ID NO: 3276540 - DNA, 19 bp, Homo sapiens
tcaaatgatttcatattga

SEQ ID NO: 3276541 - DNA, 23 bp, Homo sapiens
tcaaatgcgcgtgtgcacgtgtg

SEQ ID NO: 3276542 - DNA, 15 bp, Homo sapiens
tcaaatgggtgatat

SEQ ID NO: 3276543 - DNA, 20 bp, Homo sapiens
tcaaatggtaggcatttcct

SEQ ID NO: 3276544 - DNA, 19 bp, Homo sapiens
tcaaatgttagatattgct

SEQ ID NO: 3276545 - DNA, 21 bp, Homo sapiens
tatggaaatgcaccctccctc

SEQ ID NO: 3276546 - DNA, 19 bp, Homo sapiens
tatggaagggtttgtggct

SEQ ID NO: 3276547 - DNA, 22 bp, Homo sapiens
tatggaagggtttgtggctggg

SEQ ID NO: 3276548 - DNA, 19 bp, Homo sapiens
tatggaatatcatctgtca

SEQ ID NO: 3276549 - DNA, 18 bp, Homo sapiens
tatggactatctgtctgg

SEQ ID NO: 3276550 - DNA, 12 bp, Homo sapiens
tatggactctgc

SEQ ID NO: 3276551 - DNA, 15 bp, Homo sapiens
tatggactctgcaca

SEQ ID NO: 3276552 - DNA, 16 bp, Homo sapiens
tatggactctgcacat

SEQ ID NO: 3276553 - DNA, 21 bp, Homo sapiens
tatggagcagcctggagaccc

SEQ ID NO: 3276554 - DNA, 19 bp, Homo sapiens
tatggatgattcagaaatt

SEQ ID NO: 3276555 - DNA, 14 bp, Homo sapiens
tatggcaaaaatgg

SEQ ID NO: 3276556 - DNA, 19 bp, Homo sapiens
tatggcaaggaactttccc

SEQ ID NO: 3276557 - DNA, 11 bp, Homo sapiens
tatggcaaggg

SEQ ID NO: 3276558 - DNA, 21 bp, Homo sapiens
tatggccaatctattctcaaa

SEQ ID NO: 3276559 - DNA, 19 bp, Homo sapiens
tatggcctcagctgcctca

SEQ ID NO: 3276560 - DNA, 17 bp, Homo sapiens
tatggcgttttgtctgt

SEQ ID NO: 3276561 - DNA, 18 bp, Homo sapiens
tatggcgttttgtctgtg

SEQ ID NO: 3276562 - DNA, 21 bp, Homo sapiens
tatggcgttttgtctgtgttg

SEQ ID NO: 3276563 - DNA, 22 bp, Homo sapiens
tatggctctgcacccctctgcc

SEQ ID NO: 3276564 - DNA, 18 bp, Homo sapiens
tatggcttgtgaactgct

SEQ ID NO: 3276565 - DNA, 14 bp, Homo sapiens
tatggctttcaaag

SEQ ID NO: 3276566 - DNA, 15 bp, Homo sapiens
tatgggatgtaaaca

SEQ ID NO: 3276567 - DNA, 23 bp, Homo sapiens
tatggggagaggaactccttggc

SEQ ID NO: 3276568 - DNA, 16 bp, Homo sapiens
tatggtatgctggcca

SEQ ID NO: 3276569 - DNA, 18 bp, Homo sapiens
tatggtatgctggccagc

SEQ ID NO: 3276570 - DNA, 22 bp, Homo sapiens
tatggtcaacacttaagggttt

SEQ ID NO: 3276571 - DNA, 22 bp, Homo sapiens
tatggtcttgagccagtaatct

SEQ ID NO: 3276572 - DNA, 19 bp, Homo sapiens
tatggtgcagagaagctgg

SEQ ID NO: 3276573 - DNA, 17 bp, Homo sapiens
tatggtggatccaaact

SEQ ID NO: 3276574 - DNA, 15 bp, Homo sapiens
tatggttgccacccc

SEQ ID NO: 3276575 - DNA, 14 bp, Homo sapiens
tatgtaaagtatgt

SEQ ID NO: 3276576 - DNA, 18 bp, Homo sapiens
tatgtaaagtatgtaaac

SEQ ID NO: 3276577 - DNA, 19 bp, Homo sapiens
tatgtaaagtatgtaaaca

SEQ ID NO: 3276578 - DNA, 16 bp, Homo sapiens
tatgtaagagcacctt

SEQ ID NO: 3276579 - DNA, 17 bp, Homo sapiens
tatgtaatatattgtac

SEQ ID NO: 3276580 - DNA, 24 bp, Homo sapiens
tatgtaatatattgtacaaatgta

SEQ ID NO: 3276581 - DNA, 17 bp, Homo sapiens
tatgtaatttatgcaag

SEQ ID NO: 3276582 - DNA, 18 bp, Homo sapiens
tatgtacgtttgtatgtg

SEQ ID NO: 3276583 - DNA, 21 bp, Homo sapiens
tatgtactcctctttacactg

SEQ ID NO: 3276584 - DNA, 14 bp, Homo sapiens
tatgtactgtacta

SEQ ID NO: 3276585 - DNA, 12 bp, Homo sapiens
tatgtacttgat

SEQ ID NO: 3276586 - DNA, 17 bp, Homo sapiens
tatgtacttgatactga

SEQ ID NO: 3276587 - DNA, 17 bp, Homo sapiens
tatgtagactatataca

SEQ ID NO: 3276588 - DNA, 18 bp, Homo sapiens
tatgtagactatatacat

SEQ ID NO: 3276589 - DNA, 19 bp, Homo sapiens
tatgtagactatatacatg

SEQ ID NO: 3276590 - DNA, 14 bp, Homo sapiens
tatgtagataacaa

SEQ ID NO: 3276591 - DNA, 16 bp, Homo sapiens
tatgtagatatttggc

SEQ ID NO: 3276592 - DNA, 21 bp, Homo sapiens
tatgtaggtaagactgtagat

SEQ ID NO: 3276593 - DNA, 20 bp, Homo sapiens
tatgtagtaattgacatgtg

SEQ ID NO: 3276594 - DNA, 21 bp, Homo sapiens
tatgtatatcattctacagaa

SEQ ID NO: 3276595 - DNA, 16 bp, Homo sapiens
tatgtatcagaagaga

SEQ ID NO: 3276596 - DNA, 13 bp, Homo sapiens
tatgtatgaagga

SEQ ID NO: 3276597 - DNA, 18 bp, Homo sapiens
tatgtattgtaaacatgt

SEQ ID NO: 3276598 - DNA, 16 bp, Homo sapiens
tatgtatttttctatg

SEQ ID NO: 3276599 - DNA, 12 bp, Homo sapiens
tatgtctattta

SEQ ID NO: 3276600 - DNA, 15 bp, Homo sapiens
tatgtctatttaagc

SEQ ID NO: 3276601 - DNA, 19 bp, Homo sapiens
tatgtctcgctagtgatgt

SEQ ID NO: 3276602 - DNA, 15 bp, Homo sapiens
tatgtctgtttttgt

SEQ ID NO: 3276603 - DNA, 19 bp, Homo sapiens
tatgtctgtttttgtatct

SEQ ID NO: 3276604 - DNA, 17 bp, Homo sapiens
tatgtcttcttttgtgg

SEQ ID NO: 3276605 - DNA, 17 bp, Homo sapiens
tatgtcttggacactgt

SEQ ID NO: 3276606 - DNA, 19 bp, Homo sapiens
tatgtcttggacactgtac

SEQ ID NO: 3276607 - DNA, 17 bp, Homo sapiens
tatgtcttttatatttg

SEQ ID NO: 3276608 - DNA, 16 bp, Homo sapiens
tatgtgaaagtgtaaa

SEQ ID NO: 3276609 - DNA, 21 bp, Homo sapiens
tatgtgaaagtgtaaaataga

SEQ ID NO: 3276610 - DNA, 22 bp, Homo sapiens
tatgtgaacaaatcaaattgct

SEQ ID NO: 3276611 - DNA, 12 bp, Homo sapiens
tatgtgaagaat

SEQ ID NO: 3276612 - DNA, 21 bp, Homo sapiens
tatgtgaatcctcttctttat

SEQ ID NO: 3276613 - DNA, 22 bp, Homo sapiens
tatgtgaatgatctctctgaat

SEQ ID NO: 3276614 - DNA, 19 bp, Homo sapiens
tatgtgacaattttgtaca

SEQ ID NO: 3276615 - DNA, 20 bp, Homo sapiens
tatgtgacaccaaagccacc

SEQ ID NO: 3276616 - DNA, 12 bp, Homo sapiens
tatgtgactttt

SEQ ID NO: 3276617 - DNA, 15 bp, Homo sapiens
tatgtgacttttctg

SEQ ID NO: 3276618 - DNA, 16 bp, Homo sapiens
tatgtgagtgcctttt

SEQ ID NO: 3276619 - DNA, 22 bp, Homo sapiens
tatgtgcactgtcactttgctc

SEQ ID NO: 3276620 - DNA, 20 bp, Homo sapiens
tatgtggctgaaaatgcaaa

SEQ ID NO: 3276621 - DNA, 21 bp, Homo sapiens
tatgtgggatattgaatgtta

SEQ ID NO: 3276622 - DNA, 19 bp, Homo sapiens
tatgtggtttccacgatga

SEQ ID NO: 3276623 - DNA, 22 bp, Homo sapiens
tatgtgtatatatacatacact

SEQ ID NO: 3276624 - DNA, 14 bp, Homo sapiens
tatgtgtgaaacaa

SEQ ID NO: 3276625 - DNA, 17 bp, Homo sapiens
tatgtgtgcatgtgtgt

SEQ ID NO: 3276626 - DNA, 19 bp, Homo sapiens
tattaaattctcaaagttt

SEQ ID NO: 3276627 - DNA, 22 bp, Homo sapiens
tattaaattgtgtacactttca

SEQ ID NO: 3276628 - DNA, 16 bp, Homo sapiens
tattaacaaattatgt

SEQ ID NO: 3276629 - DNA, 23 bp, Homo sapiens
tattaacaacaataacactgtct

SEQ ID NO: 3276630 - DNA, 13 bp, Homo sapiens
tattaaccttttt

SEQ ID NO: 3276631 - DNA, 19 bp, Homo sapiens
tattaaccttttttgtctt

SEQ ID NO: 3276632 - DNA, 15 bp, Homo sapiens
tattaacgatgtcca

SEQ ID NO: 3276633 - DNA, 15 bp, Homo sapiens
tattaacgctgagat

SEQ ID NO: 3276634 - DNA, 16 bp, Homo sapiens
tattaactacatttat

SEQ ID NO: 3276635 - DNA, 18 bp, Homo sapiens
tattaagacaatagcact

SEQ ID NO: 3276636 - DNA, 16 bp, Homo sapiens
tattaagacagtgtac

SEQ ID NO: 3276637 - DNA, 21 bp, Homo sapiens
tattaagacagtgtacaaaac

SEQ ID NO: 3276638 - DNA, 13 bp, Homo sapiens
tattaagatggat

SEQ ID NO: 3276639 - DNA, 18 bp, Homo sapiens
tattaagatggattctca

SEQ ID NO: 3276640 - DNA, 20 bp, Homo sapiens
tattaagatggattctcaga

SEQ ID NO: 3276641 - DNA, 17 bp, Homo sapiens
tattaagatttccaagt

SEQ ID NO: 3276642 - DNA, 20 bp, Homo sapiens
tattaagcagtaaaaactgt

SEQ ID NO: 3276643 - DNA, 20 bp, Homo sapiens
tattaagttcgaacatgttt

SEQ ID NO: 3276644 - DNA, 14 bp, Homo sapiens
tattaataaaacaa

SEQ ID NO: 3276645 - DNA, 15 bp, Homo sapiens
tattaataaagcatt

SEQ ID NO: 3276646 - DNA, 13 bp, Homo sapiens
tattaatattatt

SEQ ID NO: 3276647 - DNA, 13 bp, Homo sapiens
tattaatatttaa

SEQ ID NO: 3276648 - DNA, 12 bp, Homo sapiens
tattaatcaaaa

SEQ ID NO: 3276649 - DNA, 21 bp, Homo sapiens
tattaatcaccttctttgtaa

SEQ ID NO: 3276650 - DNA, 17 bp, Homo sapiens
tattaattcttcacctg

SEQ ID NO: 3276651 - DNA, 14 bp, Homo sapiens
tattaatttattta

SEQ ID NO: 3276652 - DNA, 13 bp, Homo sapiens
tattaatttgaaa

SEQ ID NO: 3276653 - DNA, 16 bp, Homo sapiens
tattaatttgaaacca

SEQ ID NO: 3276654 - DNA, 20 bp, Homo sapiens
tattacaataccgttaagat

SEQ ID NO: 3276655 - DNA, 16 bp, Homo sapiens
tattacaatttttaat

SEQ ID NO: 3276656 - DNA, 17 bp, Homo sapiens
tattacatctaatgctt

SEQ ID NO: 3276657 - DNA, 18 bp, Homo sapiens
tattacatgtaatttgat

SEQ ID NO: 3276658 - DNA, 21 bp, Homo sapiens
tattaccaaaaaagtattttt

SEQ ID NO: 3276659 - DNA, 20 bp, Homo sapiens
tattaccagcaagaataaaa

SEQ ID NO: 3276660 - DNA, 21 bp, Homo sapiens
tattaccagcaagaataaaaa

SEQ ID NO: 3276661 - DNA, 14 bp, Homo sapiens
tattacctctgata

SEQ ID NO: 3276662 - DNA, 19 bp, Homo sapiens
tattacctctgatacctca

SEQ ID NO: 3276663 - DNA, 22 bp, Homo sapiens
tattaccttaagatttttcttt

SEQ ID NO: 3276664 - DNA, 22 bp, Homo sapiens
tattactatgactgctccccag

SEQ ID NO: 3276665 - DNA, 16 bp, Homo sapiens
tattactctcaaaatc

SEQ ID NO: 3276666 - DNA, 18 bp, Homo sapiens
tattactgacatttcttc

SEQ ID NO: 3276667 - DNA, 14 bp, Homo sapiens
tattacttgttgca

SEQ ID NO: 3276668 - DNA, 21 bp, Homo sapiens
tattacttgttgcaaaggtct

SEQ ID NO: 3276669 - DNA, 23 bp, Homo sapiens
tattagaaattagaaaaaaatta

SEQ ID NO: 3276670 - DNA, 12 bp, Homo sapiens
tattagaataat

SEQ ID NO: 3276671 - DNA, 23 bp, Homo sapiens
tattagacatcaatcctggtaac

SEQ ID NO: 3276672 - DNA, 20 bp, Homo sapiens
tattagcattctgaaagaag

SEQ ID NO: 3276673 - DNA, 23 bp, Homo sapiens
tattagccaactgtttccctgct

SEQ ID NO: 3276674 - DNA, 21 bp, Homo sapiens
tattagccaggtaatgtgaat

SEQ ID NO: 3276675 - DNA, 22 bp, Homo sapiens
tattaggatctgcaaacaatga

SEQ ID NO: 3276676 - DNA, 21 bp, Homo sapiens
tattaggtgcaatttcaaggt

SEQ ID NO: 3276677 - DNA, 14 bp, Homo sapiens
tattagtgattctg

SEQ ID NO: 3276678 - DNA, 22 bp, Homo sapiens
tattagttccccaaatacaaag

SEQ ID NO: 3276679 - DNA, 13 bp, Homo sapiens
tattataaaaata

SEQ ID NO: 3276680 - DNA, 24 bp, Homo sapiens
tattataaaagggggtccgtggaa

SEQ ID NO: 3276681 - DNA, 22 bp, Homo sapiens
tattataaatatatataaagaa

SEQ ID NO: 3276682 - DNA, 13 bp, Homo sapiens
tattataagcatt

SEQ ID NO: 3276683 - DNA, 17 bp, Homo sapiens
tattataagcattgaaa

SEQ ID NO: 3276684 - DNA, 21 bp, Homo sapiens
tattataagcattgaaattat

SEQ ID NO: 3276685 - DNA, 21 bp, Homo sapiens
tattataagggagagctgagc

SEQ ID NO: 3276686 - DNA, 22 bp, Homo sapiens
tattataagggagagctgagcc

SEQ ID NO: 3276687 - DNA, 19 bp, Homo sapiens
tattataagtcttacataa

SEQ ID NO: 3276688 - DNA, 15 bp, Homo sapiens
tattataatcaaagc

SEQ ID NO: 3276689 - DNA, 21 bp, Homo sapiens
tattatacatgtgatacattt

SEQ ID NO: 3276690 - DNA, 21 bp, Homo sapiens
tattatcctagattatatcaa

SEQ ID NO: 3276691 - DNA, 18 bp, Homo sapiens
tattatgagctacaacaa

SEQ ID NO: 3276692 - DNA, 19 bp, Homo sapiens
tattatgagctttctttgc

SEQ ID NO: 3276693 - DNA, 21 bp, Homo sapiens
tattatggaagattttaaatt

SEQ ID NO: 3276694 - DNA, 15 bp, Homo sapiens
tattatggcttgtga

SEQ ID NO: 3276695 - DNA, 18 bp, Homo sapiens
tattatggcttgtgaact

SEQ ID NO: 3276696 - DNA, 19 bp, Homo sapiens
tattatggcttgtgaactg

SEQ ID NO: 3276697 - DNA, 12 bp, Homo sapiens
tattatgtagct

SEQ ID NO: 3276698 - DNA, 18 bp, Homo sapiens
tattatgtaggtaagact

SEQ ID NO: 3276699 - DNA, 12 bp, Homo sapiens
tattatgtgaag

SEQ ID NO: 3276700 - DNA, 15 bp, Homo sapiens
tattatgtgaagaat

SEQ ID NO: 3276701 - DNA, 13 bp, Homo sapiens
tattatgtttatt

SEQ ID NO: 3276702 - DNA, 17 bp, Homo sapiens
tattatgtttattacaa

SEQ ID NO: 3276703 - DNA, 13 bp, Homo sapiens
tattatgtttcct

SEQ ID NO: 3276704 - DNA, 13 bp, Homo sapiens
tattattagaaat

SEQ ID NO: 3276705 - DNA, 18 bp, Homo sapiens
tattattagaaattagaa

SEQ ID NO: 3276706 - DNA, 19 bp, Homo sapiens
tattattagaaattagaaa

SEQ ID NO: 3276707 - DNA, 14 bp, Homo sapiens
tattattatatata

SEQ ID NO: 3276708 - DNA, 15 bp, Homo sapiens
tattattattttggg

SEQ ID NO: 3276709 - DNA, 22 bp, Homo sapiens
tattattcaaaccaatttcttc

SEQ ID NO: 3276710 - DNA, 23 bp, Homo sapiens
tattattcaaaccaatttcttcc

SEQ ID NO: 3276711 - DNA, 14 bp, Homo sapiens
tattgcttcttgtg

SEQ ID NO: 3276712 - DNA, 18 bp, Homo sapiens
tattggaagtgttcaaga

SEQ ID NO: 3276713 - DNA, 17 bp, Homo sapiens
tattggacctgcccaca

SEQ ID NO: 3276714 - DNA, 20 bp, Homo sapiens
tattgggcacagcctagggt

SEQ ID NO: 3276715 - DNA, 16 bp, Homo sapiens
tattgggccttttgga

SEQ ID NO: 3276716 - DNA, 23 bp, Homo sapiens
tattggggataggagaagaggca

SEQ ID NO: 3276717 - DNA, 17 bp, Homo sapiens
tattggtggctttcctt

SEQ ID NO: 3276718 - DNA, 18 bp, Homo sapiens
tattggtggttctcagca

SEQ ID NO: 3276719 - DNA, 15 bp, Homo sapiens
tattggtttgcacaa

SEQ ID NO: 3276720 - DNA, 17 bp, Homo sapiens
tattgtaaacatgtgtt

SEQ ID NO: 3276721 - DNA, 12 bp, Homo sapiens
tattgtaagttg

SEQ ID NO: 3276722 - DNA, 20 bp, Homo sapiens
tattgtaagttgtacaaatg

SEQ ID NO: 3276723 - DNA, 21 bp, Homo sapiens
tattgtaagttgtacaaatgt

SEQ ID NO: 3276724 - DNA, 21 bp, Homo sapiens
tattgtaatgagtgaattgaa

SEQ ID NO: 3276725 - DNA, 14 bp, Homo sapiens
tattgtacaaatgt

SEQ ID NO: 3276726 - DNA, 15 bp, Homo sapiens
tattgtacaaatgta

SEQ ID NO: 3276727 - DNA, 21 bp, Homo sapiens
tattgtacaaatgtaagcaaa

SEQ ID NO: 3276728 - DNA, 18 bp, Homo sapiens
tattgtacagactgtttt

SEQ ID NO: 3276729 - DNA, 11 bp, Homo sapiens
tattgtacctc

SEQ ID NO: 3276730 - DNA, 14 bp, Homo sapiens
tattgtacctctct

SEQ ID NO: 3276731 - DNA, 17 bp, Homo sapiens
tattgtagcatttcttg

SEQ ID NO: 3276732 - DNA, 14 bp, Homo sapiens
tattgtataaaaag

SEQ ID NO: 3276733 - DNA, 13 bp, Homo sapiens
tattgtattttga

SEQ ID NO: 3276734 - DNA, 17 bp, Homo sapiens
tattgtattttgatgag

SEQ ID NO: 3276735 - DNA, 16 bp, Homo sapiens
tattgtcagatatttt

SEQ ID NO: 3276736 - DNA, 13 bp, Homo sapiens
tattgtcatgttt

SEQ ID NO: 3276737 - DNA, 23 bp, Homo sapiens
tattgtctgaacttgcattgtga

SEQ ID NO: 3276738 - DNA, 19 bp, Homo sapiens
tattgtctgtctacatttc

SEQ ID NO: 3276739 - DNA, 15 bp, Homo sapiens
tattgtgaagtacat

SEQ ID NO: 3276740 - DNA, 19 bp, Homo sapiens
tattgtgaagtacatatta

SEQ ID NO: 3276741 - DNA, 22 bp, Homo sapiens
tattgtgggacttattacaatt

SEQ ID NO: 3276742 - DNA, 15 bp, Homo sapiens
tattgttagaaaatg

SEQ ID NO: 3276743 - DNA, 22 bp, Homo sapiens
tattgttagaaaatgacttatt

SEQ ID NO: 3276744 - DNA, 21 bp, Homo sapiens
tattgttcacacaaagcctgt

SEQ ID NO: 3276745 - DNA, 15 bp, Homo sapiens
tattattctgcagca

SEQ ID NO: 3276746 - DNA, 14 bp, Homo sapiens
tattattgctgaag

SEQ ID NO: 3276747 - DNA, 13 bp, Homo sapiens
tattattgtaagt

SEQ ID NO: 3276748 - DNA, 20 bp, Homo sapiens
tattattgtggtaggccttt

SEQ ID NO: 3276749 - DNA, 13 bp, Homo sapiens
tattatttatata

SEQ ID NO: 3276750 - DNA, 14 bp, Homo sapiens
tattatttctatta

SEQ ID NO: 3276751 - DNA, 22 bp, Homo sapiens
tattatttgggggaactggaca

SEQ ID NO: 3276752 - DNA, 15 bp, Homo sapiens
tattattttcacctg

SEQ ID NO: 3276753 - DNA, 21 bp, Homo sapiens
tattattttggggtctctttt

SEQ ID NO: 3276754 - DNA, 22 bp, Homo sapiens
tattcaaaccaatttcttcctt

SEQ ID NO: 3276755 - DNA, 23 bp, Homo sapiens
tattcaaaccaatttcttccttc

SEQ ID NO: 3276756 - DNA, 14 bp, Homo sapiens
tattcaaactttta

SEQ ID NO: 3276757 - DNA, 18 bp, Homo sapiens
tattcaaagcagcagcca

SEQ ID NO: 3276758 - DNA, 17 bp, Homo sapiens
tattcaaatttgtacag

SEQ ID NO: 3276759 - DNA, 18 bp, Homo sapiens
tattcaacaatttcaata

SEQ ID NO: 3276760 - DNA, 17 bp, Homo sapiens
tattcaagcaaacatca

SEQ ID NO: 3276761 - DNA, 16 bp, Homo sapiens
tattcaattcctctgg

SEQ ID NO: 3276762 - DNA, 20 bp, Homo sapiens
tattcacagttttttaaaaa

SEQ ID NO: 3276763 - DNA, 21 bp, Homo sapiens
tattcacatcgcttctgtgta

SEQ ID NO: 3276764 - DNA, 22 bp, Homo sapiens
tattcacatcgcttctgtgtat

SEQ ID NO: 3276765 - DNA, 16 bp, Homo sapiens
tattcaccctccactt

SEQ ID NO: 3276766 - DNA, 17 bp, Homo sapiens
tattcaccttttcttca

SEQ ID NO: 3276767 - DNA, 20 bp, Homo sapiens
tattcaccttttcttcaaaa

SEQ ID NO: 3276768 - DNA, 14 bp, Homo sapiens
tattcactggcccc

SEQ ID NO: 3276769 - DNA, 14 bp, Homo sapiens
tattcagacaagca

SEQ ID NO: 3276770 - DNA, 23 bp, Homo sapiens
tattcaggaagataaaaatcagt

SEQ ID NO: 3276771 - DNA, 16 bp, Homo sapiens
tattcaggagagtaga

SEQ ID NO: 3276772 - DNA, 14 bp, Homo sapiens
tattcaggagttgg

SEQ ID NO: 3276773 - DNA, 15 bp, Homo sapiens
tattcagtgctgtgg

SEQ ID NO: 3276774 - DNA, 21 bp, Homo sapiens
tattcagtgctgtggcctggg

SEQ ID NO: 3276775 - DNA, 16 bp, Homo sapiens
tattcataatgaatta

SEQ ID NO: 3276776 - DNA, 21 bp, Homo sapiens
tattcataatgaattataaca

SEQ ID NO: 3276777 - DNA, 13 bp, Homo sapiens
tattcatgtaaac

SEQ ID NO: 3276778 - DNA, 12 bp, Homo sapiens
tattcatgtttt

SEQ ID NO: 3276779 - DNA, 21 bp, Homo sapiens
tattccaaaaaggttgctgtt

SEQ ID NO: 3276780 - DNA, 21 bp, Homo sapiens
tattccaaaccaaattttaat

SEQ ID NO: 3276781 - DNA, 14 bp, Homo sapiens
tattccaaatgtct

SEQ ID NO: 3276782 - DNA, 16 bp, Homo sapiens
tcagccttacatttgt

SEQ ID NO: 3276783 - DNA, 19 bp, Homo sapiens
tcagcgactccgttggcca

SEQ ID NO: 3276784 - DNA, 20 bp, Homo sapiens
tcagcgactccgttggccac

SEQ ID NO: 3276785 - DNA, 14 bp, Homo sapiens
tcagcgctcctcct

SEQ ID NO: 3276786 - DNA, 17 bp, Homo sapiens
tcagcgctcctcctgtg

SEQ ID NO: 3276787 - DNA, 18 bp, Homo sapiens
tcagcgctcctcctgtgt

SEQ ID NO: 3276788 - DNA, 20 bp, Homo sapiens
tcagcgctcctcctgtgtga

SEQ ID NO: 3276789 - DNA, 20 bp, Homo sapiens
tcagcggcgcgccctgcaga

SEQ ID NO: 3276790 - DNA, 14 bp, Homo sapiens
tcagcgggcccagg

SEQ ID NO: 3276791 - DNA, 18 bp, Homo sapiens
tcagcgggcccaggccta

SEQ ID NO: 3276792 - DNA, 19 bp, Homo sapiens
tcagcgggcccaggcctac

SEQ ID NO: 3276793 - DNA, 14 bp, Homo sapiens
tcagcggggacagc

SEQ ID NO: 3276794 - DNA, 18 bp, Homo sapiens
tcagcggggacagctcct

SEQ ID NO: 3276795 - DNA, 18 bp, Homo sapiens
tcagcggggcgagctgag

SEQ ID NO: 3276796 - DNA, 13 bp, Homo sapiens
tcagcgttgcatg

SEQ ID NO: 3276797 - DNA, 14 bp, Homo sapiens
tcagctaacaaact

SEQ ID NO: 3276798 - DNA, 15 bp, Homo sapiens
tcagctactgatttt

SEQ ID NO: 3276799 - DNA, 19 bp, Homo sapiens
tcagctacttaagagaaat

SEQ ID NO: 3276800 - DNA, 16 bp, Homo sapiens
tcagctcaatgcagtt

SEQ ID NO: 3276801 - DNA, 23 bp, Homo sapiens
tcagctcaattgttaatgtgatg

SEQ ID NO: 3276802 - DNA, 18 bp, Homo sapiens
tcagctcagcgccagcct

SEQ ID NO: 3276803 - DNA, 17 bp, Homo sapiens
tcagctcaggcagctcg

SEQ ID NO: 3276804 - DNA, 14 bp, Homo sapiens
tcagctccagctca

SEQ ID NO: 3276805 - DNA, 23 bp, Homo sapiens
tcagctccagctcaccagcccca

SEQ ID NO: 3276806 - DNA, 23 bp, Homo sapiens
tcagctccagggaatccaagcct

SEQ ID NO: 3276807 - DNA, 19 bp, Homo sapiens
tcagctctcctggctccct

SEQ ID NO: 3276808 - DNA, 16 bp, Homo sapiens
tcagctctggagaaca

SEQ ID NO: 3276809 - DNA, 11 bp, Homo sapiens
tcagctctggg

SEQ ID NO: 3276810 - DNA, 17 bp, Homo sapiens
tcagctctgggagagga

SEQ ID NO: 3276811 - DNA, 16 bp, Homo sapiens
tcagctcttccatgat

SEQ ID NO: 3276812 - DNA, 22 bp, Homo sapiens
tcagctgaatgcctcctgtggg

SEQ ID NO: 3276813 - DNA, 15 bp, Homo sapiens
tcagctgagccctgg

SEQ ID NO: 3276814 - DNA, 24 bp, Homo sapiens
tcagctgcctcacttcctacaaga

SEQ ID NO: 3276815 - DNA, 16 bp, Homo sapiens
tcagctgcctgaaaca

SEQ ID NO: 3276816 - DNA, 16 bp, Homo sapiens
tcagctgctcagaatt

SEQ ID NO: 3276817 - DNA, 17 bp, Homo sapiens
tcagctgctcagaattc

SEQ ID NO: 3276818 - DNA, 15 bp, Homo sapiens
tcagctgctccctgg

SEQ ID NO: 3276819 - DNA, 19 bp, Homo sapiens
tcagctggaagtctacctg

SEQ ID NO: 3276820 - DNA, 19 bp, Homo sapiens
tcagctggttactcagggt

SEQ ID NO: 3276821 - DNA, 22 bp, Homo sapiens
tcagctggttactcagggttca

SEQ ID NO: 3276822 - DNA, 20 bp, Homo sapiens
tcagctgtaagaagagactg

SEQ ID NO: 3276823 - DNA, 17 bp, Homo sapiens
tcagctgtacttcgtct

SEQ ID NO: 3276824 - DNA, 14 bp, Homo sapiens
tcagctgtcctccc

SEQ ID NO: 3276825 - DNA, 17 bp, Homo sapiens
tcagctgtcctgcagca

SEQ ID NO: 3276826 - DNA, 18 bp, Homo sapiens
tcagctgtcctgcagcaa

SEQ ID NO: 3276827 - DNA, 22 bp, Homo sapiens
tcagcttatgggatccttgtct

SEQ ID NO: 3276828 - DNA, 17 bp, Homo sapiens
tcagcttcagactttta

SEQ ID NO: 3276829 - DNA, 18 bp, Homo sapiens
tcagcttcatttgtgtca

SEQ ID NO: 3276830 - DNA, 21 bp, Homo sapiens
tcagcttcatttgtgtcaatg

SEQ ID NO: 3276831 - DNA, 19 bp, Homo sapiens
tcagcttcccagccatgcc

SEQ ID NO: 3276832 - DNA, 23 bp, Homo sapiens
tcagcttcccagccatgcccagg

SEQ ID NO: 3276833 - DNA, 21 bp, Homo sapiens
tcagcttcttgcactccttcc

SEQ ID NO: 3276834 - DNA, 13 bp, Homo sapiens
tcagcttgctggg

SEQ ID NO: 3276835 - DNA, 14 bp, Homo sapiens
tcagctttcagagc

SEQ ID NO: 3276836 - DNA, 12 bp, Homo sapiens
tcagctttgact

SEQ ID NO: 3276837 - DNA, 22 bp, Homo sapiens
tcagctttgagaagccttcagc

SEQ ID NO: 3276838 - DNA, 18 bp, Homo sapiens
tcagcttttgttgtttat

SEQ ID NO: 3276839 - DNA, 9 bp, Homo sapiens
tcaggaaac

SEQ ID NO: 3276840 - DNA, 14 bp, Homo sapiens
tcaggaaagacgga

SEQ ID NO: 3276841 - DNA, 20 bp, Homo sapiens
tcaggaagaagagatgcact

SEQ ID NO: 3276842 - DNA, 13 bp, Homo sapiens
tcaggaattcagt

SEQ ID NO: 3276843 - DNA, 16 bp, Homo sapiens
tcaggaattcagtgcc

SEQ ID NO: 3276844 - DNA, 14 bp, Homo sapiens
tcaggacccaggcc

SEQ ID NO: 3276845 - DNA, 16 bp, Homo sapiens
tcaggacccaggccct

SEQ ID NO: 3276846 - DNA, 19 bp, Homo sapiens
tcaggacccaggccctcca

SEQ ID NO: 3276847 - DNA, 22 bp, Homo sapiens
tcaggacccaggccctccatgg

SEQ ID NO: 3276848 - DNA, 14 bp, Homo sapiens
tcaggactcctctc

SEQ ID NO: 3276849 - DNA, 17 bp, Homo sapiens
tcaggacttgaaagaaa

SEQ ID NO: 3276850 - DNA, 13 bp, Homo sapiens
tcaggagagcagc

SEQ ID NO: 3276851 - DNA, 22 bp, Homo sapiens
tcaggagagtagaacagataat

SEQ ID NO: 3276852 - DNA, 18 bp, Homo sapiens
tcaggagatggagggctt

SEQ ID NO: 3276853 - DNA, 11 bp, Homo sapiens
tcaggagcaca

SEQ ID NO: 3276854 - DNA, 12 bp, Homo sapiens
tcaggaggcgcc

SEQ ID NO: 3276855 - DNA, 13 bp, Homo sapiens
tcaggaggctgga

SEQ ID NO: 3276856 - DNA, 13 bp, Homo sapiens
tcaggagggattg

SEQ ID NO: 3276857 - DNA, 21 bp, Homo sapiens
tcaggagttcgagaccagcct

SEQ ID NO: 3276858 - DNA, 17 bp, Homo sapiens
tcaggatgaacccagga

SEQ ID NO: 3276859 - DNA, 17 bp, Homo sapiens
tcaggatgcacatttct

SEQ ID NO: 3276860 - DNA, 21 bp, Homo sapiens
tcaggatttcaccagaagtta

SEQ ID NO: 3276861 - DNA, 13 bp, Homo sapiens
tcaggcacacagc

SEQ ID NO: 3276862 - DNA, 14 bp, Homo sapiens
tcaggcacacagct

SEQ ID NO: 3276863 - DNA, 12 bp, Homo sapiens
tcaggcaccagc

SEQ ID NO: 3276864 - DNA, 16 bp, Homo sapiens
tcaggcactagccttt

SEQ ID NO: 3276865 - DNA, 21 bp, Homo sapiens
tcaggcactagcctttggctc

SEQ ID NO: 3276866 - DNA, 22 bp, Homo sapiens
tcaggcactagcctttggctct

SEQ ID NO: 3276867 - DNA, 12 bp, Homo sapiens
tcaggcagctcg

SEQ ID NO: 3276868 - DNA, 15 bp, Homo sapiens
tcaggcataggcctg

SEQ ID NO: 3276869 - DNA, 19 bp, Homo sapiens
tcaggcataggcctgggtg

SEQ ID NO: 3276870 - DNA, 13 bp, Homo sapiens
tcaggccacttga

SEQ ID NO: 3276871 - DNA, 16 bp, Homo sapiens
tcaggccagcccagcc

SEQ ID NO: 3276872 - DNA, 19 bp, Homo sapiens
tcaggccagcccagccagg

SEQ ID NO: 3276873 - DNA, 16 bp, Homo sapiens
tcaggccaggtgcagt

SEQ ID NO: 3276874 - DNA, 15 bp, Homo sapiens
tcaggcctaggaggc

SEQ ID NO: 3276875 - DNA, 17 bp, Homo sapiens
tcaggcctaggaggccc

SEQ ID NO: 3276876 - DNA, 17 bp, Homo sapiens
tcaggcctccctctctc

SEQ ID NO: 3276877 - DNA, 18 bp, Homo sapiens
tcaggcctctgagcccaa

SEQ ID NO: 3276878 - DNA, 21 bp, Homo sapiens
tcaggcctctgagcccaagct

SEQ ID NO: 3276879 - DNA, 16 bp, Homo sapiens
tcaggctctggccctt

SEQ ID NO: 3276880 - DNA, 21 bp, Homo sapiens
tcaggctcttctcctttcaca

SEQ ID NO: 3276881 - DNA, 15 bp, Homo sapiens
tcaggctgggcagcc

SEQ ID NO: 3276882 - DNA, 14 bp, Homo sapiens
tcaggctggtggga

SEQ ID NO: 3276883 - DNA, 17 bp, Homo sapiens
tcaggctggtgggaggg

SEQ ID NO: 3276884 - DNA, 22 bp, Homo sapiens
tcagggaaccgttattataatt

SEQ ID NO: 3276885 - DNA, 15 bp, Homo sapiens
tcagggacagagcca

SEQ ID NO: 3276886 - DNA, 14 bp, Homo sapiens
tcagggaccagctt

SEQ ID NO: 3276887 - DNA, 15 bp, Homo sapiens
tcagggaccagcttt

SEQ ID NO: 3276888 - DNA, 16 bp, Homo sapiens
tcagggaccggtgctg

SEQ ID NO: 3276889 - DNA, 12 bp, Homo sapiens
tcagggacttgg

SEQ ID NO: 3276890 - DNA, 21 bp, Homo sapiens
tcagggagcagggaaggcctg

SEQ ID NO: 3276891 - DNA, 20 bp, Homo sapiens
tcagggagggagggcggtgg

SEQ ID NO: 3276892 - DNA, 15 bp, Homo sapiens
tcagggaggtcattt

SEQ ID NO: 3276893 - DNA, 20 bp, Homo sapiens
tcagggattttttttttaaa

SEQ ID NO: 3276894 - DNA, 16 bp, Homo sapiens
tcagggcagggctctg

SEQ ID NO: 3276895 - DNA, 16 bp, Homo sapiens
tcagggccagaaggag

SEQ ID NO: 3276896 - DNA, 22 bp, Homo sapiens
tcagggccagaaggagggcaga

SEQ ID NO: 3276897 - DNA, 16 bp, Homo sapiens
tcagggccaggaagga

SEQ ID NO: 3276898 - DNA, 13 bp, Homo sapiens
tcagggccagtcc

SEQ ID NO: 3276899 - DNA, 22 bp, Homo sapiens
tcagggccagtcctcctgggag

SEQ ID NO: 3276900 - DNA, 14 bp, Homo sapiens
tcagggccatgctg

SEQ ID NO: 3276901 - DNA, 15 bp, Homo sapiens
tcagggcccaagtcc

SEQ ID NO: 3276902 - DNA, 18 bp, Homo sapiens
tcagggcccaagtccctg

SEQ ID NO: 3276903 - DNA, 17 bp, Homo sapiens
tcagggcctggcaggcc

SEQ ID NO: 3276904 - DNA, 22 bp, Homo sapiens
tcagggcctggggcctgagaga

SEQ ID NO: 3276905 - DNA, 13 bp, Homo sapiens
tcagggctcctgc

SEQ ID NO: 3276906 - DNA, 20 bp, Homo sapiens
tcagggctcctgccttctgt

SEQ ID NO: 3276907 - DNA, 21 bp, Homo sapiens
tcagggctcctgccttctgtc

SEQ ID NO: 3276908 - DNA, 18 bp, Homo sapiens
tcaggggactcagccctg

SEQ ID NO: 3276909 - DNA, 16 bp, Homo sapiens
tcaggggccagaggaa

SEQ ID NO: 3276910 - DNA, 15 bp, Homo sapiens
tcagggttcatctgt

SEQ ID NO: 3276911 - DNA, 16 bp, Homo sapiens
tcaggtacggagaaga

SEQ ID NO: 3276912 - DNA, 12 bp, Homo sapiens
tcagagcctgca

SEQ ID NO: 3276913 - DNA, 13 bp, Homo sapiens
tcagagcctgcag

SEQ ID NO: 3276914 - DNA, 14 bp, Homo sapiens
tcagagcctgcagt

SEQ ID NO: 3276915 - DNA, 18 bp, Homo sapiens
tcagagcctgcagttatt

SEQ ID NO: 3276916 - DNA, 14 bp, Homo sapiens
tcagagcgcacagg

SEQ ID NO: 3276917 - DNA, 14 bp, Homo sapiens
tcagagctcctctg

SEQ ID NO: 3276918 - DNA, 13 bp, Homo sapiens
tcagagctcttaa

SEQ ID NO: 3276919 - DNA, 14 bp, Homo sapiens
tcagagcttgaaga

SEQ ID NO: 3276920 - DNA, 13 bp, Homo sapiens
tcagaggagaaga

SEQ ID NO: 3276921 - DNA, 18 bp, Homo sapiens
tcagaggcacaaaagggt

SEQ ID NO: 3276922 - DNA, 13 bp, Homo sapiens
tcagaggcctgct

SEQ ID NO: 3276923 - DNA, 14 bp, Homo sapiens
tcagaggctgggag

SEQ ID NO: 3276924 - DNA, 20 bp, Homo sapiens
tcagagggcccaaatggcag

SEQ ID NO: 3276925 - DNA, 15 bp, Homo sapiens
tcagaggtgtacact

SEQ ID NO: 3276926 - DNA, 17 bp, Homo sapiens
tcagaggttctttgagg

SEQ ID NO: 3276927 - DNA, 19 bp, Homo sapiens
tcagaggtttgcttcctca

SEQ ID NO: 3276928 - DNA, 16 bp, Homo sapiens
tcagagtccactgtgg

SEQ ID NO: 3276929 - DNA, 20 bp, Homo sapiens
tcagagtgactacacacagt

SEQ ID NO: 3276930 - DNA, 12 bp, Homo sapiens
tcagagtgccac

SEQ ID NO: 3276931 - DNA, 16 bp, Homo sapiens
tcagagtttgtgtgta

SEQ ID NO: 3276932 - DNA, 18 bp, Homo sapiens
tcagagtttgtgtgtatt

SEQ ID NO: 3276933 - DNA, 21 bp, Homo sapiens
tcagagtttgtgtgtatttgt

SEQ ID NO: 3276934 - DNA, 22 bp, Homo sapiens
tcagagtttgtgtgtatttgta

SEQ ID NO: 3276935 - DNA, 23 bp, Homo sapiens
tcagagtttgtgtgtatttgtat

SEQ ID NO: 3276936 - DNA, 14 bp, Homo sapiens
tcagataactgggt

SEQ ID NO: 3276937 - DNA, 23 bp, Homo sapiens
tcagataattagatgattatata

SEQ ID NO: 3276938 - DNA, 15 bp, Homo sapiens
tcagatacatcactg

SEQ ID NO: 3276939 - DNA, 17 bp, Homo sapiens
tcagatacatcactgct

SEQ ID NO: 3276940 - DNA, 23 bp, Homo sapiens
tcagatataagagaagtctcatt

SEQ ID NO: 3276941 - DNA, 16 bp, Homo sapiens
tcagatatatttttca

SEQ ID NO: 3276942 - DNA, 23 bp, Homo sapiens
tcagatatatttttcacagtttt

SEQ ID NO: 3276943 - DNA, 15 bp, Homo sapiens
tcagatatcatactg

SEQ ID NO: 3276944 - DNA, 22 bp, Homo sapiens
tcagatattttttcagaaatat

SEQ ID NO: 3276945 - DNA, 16 bp, Homo sapiens
tcagatcaaaatgcct

SEQ ID NO: 3276946 - DNA, 22 bp, Homo sapiens
tcagatcaaaatgcctttcagg

SEQ ID NO: 3276947 - DNA, 20 bp, Homo sapiens
tcagatctgaacacagttta

SEQ ID NO: 3276948 - DNA, 14 bp, Homo sapiens
tcagatctgaggtt

SEQ ID NO: 3276949 - DNA, 16 bp, Homo sapiens
tcagatgagaacaaag

SEQ ID NO: 3276950 - DNA, 17 bp, Homo sapiens
tcagatgatctctccac

SEQ ID NO: 3276951 - DNA, 14 bp, Homo sapiens
tcagatgcccagag

SEQ ID NO: 3276952 - DNA, 21 bp, Homo sapiens
tcagatgcccagagggcccag

SEQ ID NO: 3276953 - DNA, 22 bp, Homo sapiens
tcagatgcccagagggcccagg

SEQ ID NO: 3276954 - DNA, 16 bp, Homo sapiens
tcagatgcctcagagg

SEQ ID NO: 3276955 - DNA, 20 bp, Homo sapiens
tcagatgcgtgcccagctct

SEQ ID NO: 3276956 - DNA, 13 bp, Homo sapiens
tcagatgcttctg

SEQ ID NO: 3276957 - DNA, 19 bp, Homo sapiens
tcagatggaaaattcattt

SEQ ID NO: 3276958 - DNA, 13 bp, Homo sapiens
tcagatggaggtt

SEQ ID NO: 3276959 - DNA, 15 bp, Homo sapiens
tcagatgggaagaca

SEQ ID NO: 3276960 - DNA, 18 bp, Homo sapiens
tcagatgggaagacatga

SEQ ID NO: 3276961 - DNA, 17 bp, Homo sapiens
tcagatgggtctgatat

SEQ ID NO: 3276962 - DNA, 17 bp, Homo sapiens
tcagatgtcttctgcct

SEQ ID NO: 3276963 - DNA, 21 bp, Homo sapiens
tcagatgtcttctgcctgtta

SEQ ID NO: 3276964 - DNA, 12 bp, Homo sapiens
tcagatgtgcat

SEQ ID NO: 3276965 - DNA, 20 bp, Homo sapiens
tcagatgttaaaataaatgg

SEQ ID NO: 3276966 - DNA, 17 bp, Homo sapiens
tcagattaaattacagc

SEQ ID NO: 3276967 - DNA, 20 bp, Homo sapiens
tcagattaaattacagcttt

SEQ ID NO: 3276968 - DNA, 21 bp, Homo sapiens
tcagattcccagagcaaaata

SEQ ID NO: 3276969 - DNA, 15 bp, Homo sapiens
tcagattcctttccc

SEQ ID NO: 3276970 - DNA, 19 bp, Homo sapiens
tcagattcctttcccttta

SEQ ID NO: 3276971 - DNA, 19 bp, Homo sapiens
tcagattgtcttgcaactt

SEQ ID NO: 3276972 - DNA, 21 bp, Homo sapiens
tcagatttgaactcttcaatc

SEQ ID NO: 3276973 - DNA, 19 bp, Homo sapiens
tcagatttttaaagttttg

SEQ ID NO: 3276974 - DNA, 14 bp, Homo sapiens
tcagattttttcct

SEQ ID NO: 3276975 - DNA, 16 bp, Homo sapiens
tcagcaactcgcttta

SEQ ID NO: 3276976 - DNA, 12 bp, Homo sapiens
tcagcaagagaa

SEQ ID NO: 3276977 - DNA, 23 bp, Homo sapiens
tcagcaccaccctagtcccttcc

SEQ ID NO: 3276978 - DNA, 19 bp, Homo sapiens
tcagcacccccacccacct

SEQ ID NO: 3276979 - DNA, 20 bp, Homo sapiens
tcagcacccccacccacctc

SEQ ID NO: 3276980 - DNA, 12 bp, Homo sapiens
tcagcaccctgg

SEQ ID NO: 3276981 - DNA, 12 bp, Homo sapiens
tcagcactgaaa

SEQ ID NO: 3276982 - DNA, 13 bp, Homo sapiens
tcagcactgtccc

SEQ ID NO: 3276983 - DNA, 21 bp, Homo sapiens
tcagcactgtcccttgcctca

SEQ ID NO: 3276984 - DNA, 20 bp, Homo sapiens
tcagcagcagttggatcttt

SEQ ID NO: 3276985 - DNA, 20 bp, Homo sapiens
tcagcagtacctataaagta

SEQ ID NO: 3276986 - DNA, 14 bp, Homo sapiens
tcagcagttgacat

SEQ ID NO: 3276987 - DNA, 18 bp, Homo sapiens
tcagcatcctggcacccg

SEQ ID NO: 3276988 - DNA, 15 bp, Homo sapiens
tcagcatctgtgatg

SEQ ID NO: 3276989 - DNA, 20 bp, Homo sapiens
tcagcatgcttcccagaggg

SEQ ID NO: 3276990 - DNA, 12 bp, Homo sapiens
tcagcatgtcta

SEQ ID NO: 3276991 - DNA, 19 bp, Homo sapiens
tcagcatgtctattcagct

SEQ ID NO: 3276992 - DNA, 21 bp, Homo sapiens
tcagcatgtctattcagcttc

SEQ ID NO: 3276993 - DNA, 18 bp, Homo sapiens
tcagcattattcctccag

SEQ ID NO: 3276994 - DNA, 23 bp, Homo sapiens
tcagcattctcactcctacctgg

SEQ ID NO: 3276995 - DNA, 20 bp, Homo sapiens
tcagcattcttagcctgtgg

SEQ ID NO: 3276996 - DNA, 19 bp, Homo sapiens
tcagcatttccacaccaag

SEQ ID NO: 3276997 - DNA, 16 bp, Homo sapiens
tcagccaaatgcaggg

SEQ ID NO: 3276998 - DNA, 15 bp, Homo sapiens
tcagccacacccagg

SEQ ID NO: 3276999 - DNA, 18 bp, Homo sapiens
tcagccagccgccctggg

SEQ ID NO: 3277000 - DNA, 23 bp, Homo sapiens
tcagccagccgccctgggctgtc

SEQ ID NO: 3277001 - DNA, 16 bp, Homo sapiens
tcagccaggctgctaa

SEQ ID NO: 3277002 - DNA, 18 bp, Homo sapiens
tcagccagtggggatgag

SEQ ID NO: 3277003 - DNA, 17 bp, Homo sapiens
tcagccatcgtcctggg

SEQ ID NO: 3277004 - DNA, 18 bp, Homo sapiens
tcagccatcgtcctggga

SEQ ID NO: 3277005 - DNA, 17 bp, Homo sapiens
tcagccatttccccctc

SEQ ID NO: 3277006 - DNA, 19 bp, Homo sapiens
tcagccatttccccctcct

SEQ ID NO: 3277007 - DNA, 20 bp, Homo sapiens
tcagccatttccccctcctc

SEQ ID NO: 3277008 - DNA, 13 bp, Homo sapiens
tcagccattttta

SEQ ID NO: 3277009 - DNA, 13 bp, Homo sapiens
tcagcccacctgc

SEQ ID NO: 3277010 - DNA, 15 bp, Homo sapiens
tcagcccacctgcac

SEQ ID NO: 3277011 - DNA, 17 bp, Homo sapiens
tcagcccacctgcaccc

SEQ ID NO: 3277012 - DNA, 24 bp, Homo sapiens
tcagcccagaagaaaattctcctg

SEQ ID NO: 3277013 - DNA, 20 bp, Homo sapiens
tcagcccaggtcagctgtta

SEQ ID NO: 3277014 - DNA, 16 bp, Homo sapiens
tcagcccccagcccct

SEQ ID NO: 3277015 - DNA, 17 bp, Homo sapiens
tcagcccccaggccagg

SEQ ID NO: 3277016 - DNA, 19 bp, Homo sapiens
tcagccccttctcccctcc

SEQ ID NO: 3277017 - DNA, 14 bp, Homo sapiens
tcagccctccctgc

SEQ ID NO: 3277018 - DNA, 15 bp, Homo sapiens
tcagccctccctgcc

SEQ ID NO: 3277019 - DNA, 17 bp, Homo sapiens
tcagccctccctgcccc

SEQ ID NO: 3277020 - DNA, 19 bp, Homo sapiens
tcagccctccctgcccctc

SEQ ID NO: 3277021 - DNA, 13 bp, Homo sapiens
tcagccctgaggt

SEQ ID NO: 3277022 - DNA, 23 bp, Homo sapiens
tcagccctgaggtgaaagggagc

SEQ ID NO: 3277023 - DNA, 21 bp, Homo sapiens
tcagccgagccgggcctgggg

SEQ ID NO: 3277024 - DNA, 13 bp, Homo sapiens
tcagccgcaagga

SEQ ID NO: 3277025 - DNA, 21 bp, Homo sapiens
tcagccggcgtggcaaatata

SEQ ID NO: 3277026 - DNA, 12 bp, Homo sapiens
tcagcctcagag

SEQ ID NO: 3277027 - DNA, 13 bp, Homo sapiens
tcagcctcagagg

SEQ ID NO: 3277028 - DNA, 14 bp, Homo sapiens
tcagcctcccaaag

SEQ ID NO: 3277029 - DNA, 19 bp, Homo sapiens
tcagcctcccaaagtgctg

SEQ ID NO: 3277030 - DNA, 22 bp, Homo sapiens
tcagcctcccaaagtgctggga

SEQ ID NO: 3277031 - DNA, 22 bp, Homo sapiens
tcagcctcccgaatagctggga

SEQ ID NO: 3277032 - DNA, 18 bp, Homo sapiens
tcagcctcccgagtagct

SEQ ID NO: 3277033 - DNA, 21 bp, Homo sapiens
tcagcctcccgagtagctggg

SEQ ID NO: 3277034 - DNA, 22 bp, Homo sapiens
tcagcctcccgagtagctggga

SEQ ID NO: 3277035 - DNA, 18 bp, Homo sapiens
tcagcctcctgagcctgt

SEQ ID NO: 3277036 - DNA, 20 bp, Homo sapiens
tcagcctcctgagcctgtgg

SEQ ID NO: 3277037 - DNA, 22 bp, Homo sapiens
tcagcctcctgagcctgtgggt

SEQ ID NO: 3277038 - DNA, 18 bp, Homo sapiens
tcagcctgaggctgagac

SEQ ID NO: 3277039 - DNA, 11 bp, Homo sapiens
tcagcctgagt

SEQ ID NO: 3277040 - DNA, 16 bp, Homo sapiens
tcagcctgagtctcct

SEQ ID NO: 3277041 - DNA, 12 bp, Homo sapiens
tcatgaaaatac

SEQ ID NO: 3277042 - DNA, 14 bp, Homo sapiens
tcatgaacagctct

SEQ ID NO: 3277043 - DNA, 15 bp, Homo sapiens
tcatgaatgctttta

SEQ ID NO: 3277044 - DNA, 18 bp, Homo sapiens
tcatgaattttaaagtat

SEQ ID NO: 3277045 - DNA, 19 bp, Homo sapiens
tcatgaattttacatggta

SEQ ID NO: 3277046 - DNA, 14 bp, Homo sapiens
tcatgacatgttat

SEQ ID NO: 3277047 - DNA, 21 bp, Homo sapiens
tcatgacatgttatatatttt

SEQ ID NO: 3277048 - DNA, 21 bp, Homo sapiens
tcatgataccacctttactgt

SEQ ID NO: 3277049 - DNA, 15 bp, Homo sapiens
tcatgcaatgacatc

SEQ ID NO: 3277050 - DNA, 16 bp, Homo sapiens
tcatgcaatgacatct

SEQ ID NO: 3277051 - DNA, 12 bp, Homo sapiens
tcatgcagctgt

SEQ ID NO: 3277052 - DNA, 15 bp, Homo sapiens
tcatgcagttcctgg

SEQ ID NO: 3277053 - DNA, 19 bp, Homo sapiens
tcatgcataaatatgcagt

SEQ ID NO: 3277054 - DNA, 20 bp, Homo sapiens
tcatgcataaatatgcagtg

SEQ ID NO: 3277055 - DNA, 19 bp, Homo sapiens
tcatgccaccatggccagc

SEQ ID NO: 3277056 - DNA, 22 bp, Homo sapiens
tcatgccaccatggccagccaa

SEQ ID NO: 3277057 - DNA, 23 bp, Homo sapiens
tcatgccagctacttcctcctcc

SEQ ID NO: 3277058 - DNA, 14 bp, Homo sapiens
tcagtttcataaaa

SEQ ID NO: 3277059 - DNA, 17 bp, Homo sapiens
tcagtttgtgtgtctta

SEQ ID NO: 3277060 - DNA, 14 bp, Homo sapiens
tcagtttgttggaa

SEQ ID NO: 3277061 - DNA, 15 bp, Homo sapiens
tcagtttgttggaaa

SEQ ID NO: 3277062 - DNA, 16 bp, Homo sapiens
tcagtttgttggaaag

SEQ ID NO: 3277063 - DNA, 12 bp, Homo sapiens
tcagttttcatt

SEQ ID NO: 3277064 - DNA, 13 bp, Homo sapiens
tcagttttcattt

SEQ ID NO: 3277065 - DNA, 12 bp, Homo sapiens
tcagttttgtat

SEQ ID NO: 3277066 - DNA, 14 bp, Homo sapiens
tcagtttttgtatc

SEQ ID NO: 3277067 - DNA, 22 bp, Homo sapiens
tcataaaaagcctgcaatttca

SEQ ID NO: 3277068 - DNA, 17 bp, Homo sapiens
tcataaagggttgaaaa

SEQ ID NO: 3277069 - DNA, 16 bp, Homo sapiens
tcataacagtgccatt

SEQ ID NO: 3277070 - DNA, 20 bp, Homo sapiens
tcataaggcttcaaaatgtt

SEQ ID NO: 3277071 - DNA, 16 bp, Homo sapiens
tcataagtaaacctag

SEQ ID NO: 3277072 - DNA, 20 bp, Homo sapiens
tcataagtattatgtctctt

SEQ ID NO: 3277073 - DNA, 20 bp, Homo sapiens
tcatttagataatttgaaaa

SEQ ID NO: 3277074 - DNA, 17 bp, Homo sapiens
tcatttcaatcattgaa

SEQ ID NO: 3277075 - DNA, 20 bp, Homo sapiens
tcatttcaatcattgaagta

SEQ ID NO: 3277076 - DNA, 19 bp, Homo sapiens
tcatttcacattaatggtc

SEQ ID NO: 3277077 - DNA, 14 bp, Homo sapiens
tcatttcattgtat

SEQ ID NO: 3277078 - DNA, 22 bp, Homo sapiens
tcatttccccataactcaatgg

SEQ ID NO: 3277079 - DNA, 23 bp, Homo sapiens
tcatttccgttttgcctgtgact

SEQ ID NO: 3277080 - DNA, 18 bp, Homo sapiens
tcatttcgttccctgatt

SEQ ID NO: 3277081 - DNA, 22 bp, Homo sapiens
tcatttcgttccctgattattt

SEQ ID NO: 3277082 - DNA, 23 bp, Homo sapiens
tcatttctcactgtgtacataat

SEQ ID NO: 3277083 - DNA, 20 bp, Homo sapiens
tcatttctgtctttaagaac

SEQ ID NO: 3277084 - DNA, 22 bp, Homo sapiens
tcatttgactgtctcacttttt

SEQ ID NO: 3277085 - DNA, 21 bp, Homo sapiens
tcatttgcccttaaggacaaa

SEQ ID NO: 3277086 - DNA, 20 bp, Homo sapiens
tcatttggtgttcctggaag

SEQ ID NO: 3277087 - DNA, 18 bp, Homo sapiens
tcatttggttcattaatt

SEQ ID NO: 3277088 - DNA, 12 bp, Homo sapiens
tcatttgtacaa

SEQ ID NO: 3277089 - DNA, 17 bp, Homo sapiens
tcatttgtatgtcaaag

SEQ ID NO: 3277090 - DNA, 14 bp, Homo sapiens
tcatttgtcacaca

SEQ ID NO: 3277091 - DNA, 21 bp, Homo sapiens
tcatttgtggcagtcccttat

SEQ ID NO: 3277092 - DNA, 13 bp, Homo sapiens
tcatttgtgtcaa

SEQ ID NO: 3277093 - DNA, 22 bp, Homo sapiens
tcatttgttaaaattatcaata

SEQ ID NO: 3277094 - DNA, 15 bp, Homo sapiens
tcatttgttttgctt

SEQ ID NO: 3277095 - DNA, 18 bp, Homo sapiens
tcattttaaaaactttat

SEQ ID NO: 3277096 - DNA, 13 bp, Homo sapiens
tcattttaaaaag

SEQ ID NO: 3277097 - DNA, 13 bp, Homo sapiens
tcattttaattat

SEQ ID NO: 3277098 - DNA, 17 bp, Homo sapiens
tcattttagtgactgta

SEQ ID NO: 3277099 - DNA, 15 bp, Homo sapiens
tcattttatatttaa

SEQ ID NO: 3277100 - DNA, 15 bp, Homo sapiens
tcattttccccccac

SEQ ID NO: 3277101 - DNA, 14 bp, Homo sapiens
tcattttctataac

SEQ ID NO: 3277102 - DNA, 20 bp, Homo sapiens
tcattttctataacagatat

SEQ ID NO: 3277103 - DNA, 16 bp, Homo sapiens
tcattttcttttttaa

SEQ ID NO: 3277104 - DNA, 23 bp, Homo sapiens
tcattttgggacaattgttttaa

SEQ ID NO: 3277105 - DNA, 22 bp, Homo sapiens
tcattttggtaaaatacttctt

SEQ ID NO: 3277106 - DNA, 22 bp, Homo sapiens
tcattttggtttatttttgtaa

SEQ ID NO: 3277107 - DNA, 19 bp, Homo sapiens
tcatttttaacagcatgct

SEQ ID NO: 3277108 - DNA, 11 bp, Homo sapiens
tcatttttcaa

SEQ ID NO: 3277109 - DNA, 12 bp, Homo sapiens
tcatttttcaaa

SEQ ID NO: 3277110 - DNA, 13 bp, Homo sapiens
tcatttttcaaaa

SEQ ID NO: 3277111 - DNA, 17 bp, Homo sapiens
tcatttttgccatacat

SEQ ID NO: 3277112 - DNA, 22 bp, Homo sapiens
tcatttttgtacagtttgctgt

SEQ ID NO: 3277113 - DNA, 19 bp, Homo sapiens
tccaaaaaaaaaaaaaata

SEQ ID NO: 3277114 - DNA, 18 bp, Homo sapiens
tccaaaaaaaggaaaaat

SEQ ID NO: 3277115 - DNA, 20 bp, Homo sapiens
tccaaaaagattttcagaaa

SEQ ID NO: 3277116 - DNA, 13 bp, Homo sapiens
tccaaaaattatt

SEQ ID NO: 3277117 - DNA, 14 bp, Homo sapiens
tccaaaaattatta

SEQ ID NO: 3277118 - DNA, 22 bp, Homo sapiens
tccaaaaattattataagcatt

SEQ ID NO: 3277119 - DNA, 13 bp, Homo sapiens
tccaaaactgcct

SEQ ID NO: 3277120 - DNA, 21 bp, Homo sapiens
tccaaaacttagacccatgct

SEQ ID NO: 3277121 - DNA, 13 bp, Homo sapiens
tccaaaagctttt

SEQ ID NO: 3277122 - DNA, 15 bp, Homo sapiens
tccaaaataatttta

SEQ ID NO: 3277123 - DNA, 22 bp, Homo sapiens
tccaaaatgaatgcaaaattgt

SEQ ID NO: 3277124 - DNA, 12 bp, Homo sapiens
tccaaaattctt

SEQ ID NO: 3277125 - DNA, 12 bp, Homo sapiens
tccaaacaccgg

SEQ ID NO: 3277126 - DNA, 19 bp, Homo sapiens
tccaaacaccggcagaaaa

SEQ ID NO: 3277127 - DNA, 12 bp, Homo sapiens
tccaaacctgtc

SEQ ID NO: 3277128 - DNA, 14 bp, Homo sapiens
tccaaacctgtctt

SEQ ID NO: 3277129 - DNA, 16 bp, Homo sapiens
tccaaagactgtactg

SEQ ID NO: 3277130 - DNA, 13 bp, Homo sapiens
tccaaagaggctg

SEQ ID NO: 3277131 - DNA, 19 bp, Homo sapiens
tccaaagaggctgcccctc

SEQ ID NO: 3277132 - DNA, 13 bp, Homo sapiens
tccaaagccagtg

SEQ ID NO: 3277133 - DNA, 23 bp, Homo sapiens
tccaaaggaatctccagttttca

SEQ ID NO: 3277134 - DNA, 15 bp, Homo sapiens
tccaaaggaggctgg

SEQ ID NO: 3277135 - DNA, 17 bp, Homo sapiens
tccaaaggggctgctgg

SEQ ID NO: 3277136 - DNA, 10 bp, Homo sapiens
tccaaataaa

SEQ ID NO: 3277137 - DNA, 13 bp, Homo sapiens
tccaaataaaaac

SEQ ID NO: 3277138 - DNA, 17 bp, Homo sapiens
tccaaataagaaaccta

SEQ ID NO: 3277139 - DNA, 20 bp, Homo sapiens
tccaaatctcttgcttgtca

SEQ ID NO: 3277140 - DNA, 22 bp, Homo sapiens
tccaaatctcttgcttgtcatt

SEQ ID NO: 3277141 - DNA, 20 bp, Homo sapiens
tccaaatcttgaatttctgc

SEQ ID NO: 3277142 - DNA, 17 bp, Homo sapiens
tccaaattatttcttaa

SEQ ID NO: 3277143 - DNA, 12 bp, Homo sapiens
tccaaattcagt

SEQ ID NO: 3277144 - DNA, 18 bp, Homo sapiens
tccaacaccacagacaca

SEQ ID NO: 3277145 - DNA, 21 bp, Homo sapiens
tccaacactttgagcattttt

SEQ ID NO: 3277146 - DNA, 22 bp, Homo sapiens
tccaacactttgagcattttta

SEQ ID NO: 3277147 - DNA, 13 bp, Homo sapiens
tccaacagtgagt

SEQ ID NO: 3277148 - DNA, 21 bp, Homo sapiens
tccaacatttctcactgaaag

SEQ ID NO: 3277149 - DNA, 15 bp, Homo sapiens
tccaaccactgtaca

SEQ ID NO: 3277150 - DNA, 16 bp, Homo sapiens
tccaaccattttcatt

SEQ ID NO: 3277151 - DNA, 19 bp, Homo sapiens
tccaacccggggaccccca

SEQ ID NO: 3277152 - DNA, 22 bp, Homo sapiens
tccaacccgtctggcccaccag

SEQ ID NO: 3277153 - DNA, 23 bp, Homo sapiens
tccaacccgtctggcccaccagg

SEQ ID NO: 3277154 - DNA, 13 bp, Homo sapiens
tccaaccttccca

SEQ ID NO: 3277155 - DNA, 20 bp, Homo sapiens
tccaactactaatagaataa

SEQ ID NO: 3277156 - DNA, 14 bp, Homo sapiens
tccaactcaggtta

SEQ ID NO: 3277157 - DNA, 12 bp, Homo sapiens
tccaactccagc

SEQ ID NO: 3277158 - DNA, 13 bp, Homo sapiens
tccaactccagca

SEQ ID NO: 3277159 - DNA, 18 bp, Homo sapiens
tccaactcgaatctgtgt

SEQ ID NO: 3277160 - DNA, 16 bp, Homo sapiens
tccaactggatgttga

SEQ ID NO: 3277161 - DNA, 19 bp, Homo sapiens
tccaactggcactctgtgg

SEQ ID NO: 3277162 - DNA, 19 bp, Homo sapiens
tccaactgtgttcattaga

SEQ ID NO: 3277163 - DNA, 20 bp, Homo sapiens
tccaactttatcatggaatt

SEQ ID NO: 3277164 - DNA, 17 bp, Homo sapiens
tccaactttcaggggct

SEQ ID NO: 3277165 - DNA, 20 bp, Homo sapiens
tccaagaatccacatttcta

SEQ ID NO: 3277166 - DNA, 22 bp, Homo sapiens
tccaagaatccacatttctaaa

SEQ ID NO: 3277167 - DNA, 20 bp, Homo sapiens
tccaagacatgtctgttcta

SEQ ID NO: 3277168 - DNA, 22 bp, Homo sapiens
tccaagacatgtctgttctaca

SEQ ID NO: 3277169 - DNA, 16 bp, Homo sapiens
tccaagacattgtcaa

SEQ ID NO: 3277170 - DNA, 19 bp, Homo sapiens
tccaagacctgttggttcc

SEQ ID NO: 3277171 - DNA, 13 bp, Homo sapiens
tccaagactctag

SEQ ID NO: 3277172 - DNA, 14 bp, Homo sapiens
tccaagactctaga

SEQ ID NO: 3277173 - DNA, 15 bp, Homo sapiens
tccaagactctagag

SEQ ID NO: 3277174 - DNA, 12 bp, Homo sapiens
tccaagagacat

SEQ ID NO: 3277175 - DNA, 22 bp, Homo sapiens
tccaagagacatggaagagaga

SEQ ID NO: 3277176 - DNA, 15 bp, Homo sapiens
tccaagagtctaaag

SEQ ID NO: 3277177 - DNA, 16 bp, Homo sapiens
tccaagagtctaaaga

SEQ ID NO: 3277178 - DNA, 17 bp, Homo sapiens
tccaagagtctaaagat

SEQ ID NO: 3277179 - DNA, 15 bp, Homo sapiens
tccaagataagcctg

SEQ ID NO: 3277180 - DNA, 18 bp, Homo sapiens
tccaagataagcctgagc

SEQ ID NO: 3277181 - DNA, 22 bp, Homo sapiens
tccaaggtttaaagagtctaga

SEQ ID NO: 3277182 - DNA, 16 bp, Homo sapiens
tccaagtaccaatgct

SEQ ID NO: 3277183 - DNA, 15 bp, Homo sapiens
tccaagtgccaatat

SEQ ID NO: 3277184 - DNA, 16 bp, Homo sapiens
tccaagttcttcacct

SEQ ID NO: 3277185 - DNA, 19 bp, Homo sapiens
tccaagttcttcacctcta

SEQ ID NO: 3277186 - DNA, 20 bp, Homo sapiens
tccaagttcttcacctctat

SEQ ID NO: 3277187 - DNA, 16 bp, Homo sapiens
tccaagttggactggg

SEQ ID NO: 3277188 - DNA, 22 bp, Homo sapiens
tccaataaaaacattttgaagt

SEQ ID NO: 3277189 - DNA, 17 bp, Homo sapiens
tccaataaagcagcctc

SEQ ID NO: 3277190 - DNA, 16 bp, Homo sapiens
tccaataaagtgcctt

SEQ ID NO: 3277191 - DNA, 19 bp, Homo sapiens
tccaataaagtgccttctg

SEQ ID NO: 3277192 - DNA, 23 bp, Homo sapiens
tccaatatttctgctttctttga

SEQ ID NO: 3277193 - DNA, 18 bp, Homo sapiens
tccaatcccaccaaccct

SEQ ID NO: 3277194 - DNA, 14 bp, Homo sapiens
tccaatcctcactg

SEQ ID NO: 3277195 - DNA, 17 bp, Homo sapiens
tccaatcctcactgggt

SEQ ID NO: 3277196 - DNA, 14 bp, Homo sapiens
tccaatgcacagtt

SEQ ID NO: 3277197 - DNA, 21 bp, Homo sapiens
tccaattaaatttattttact

SEQ ID NO: 3277198 - DNA, 20 bp, Homo sapiens
tccaattagtttccttttta

SEQ ID NO: 3277199 - DNA, 19 bp, Homo sapiens
tccaattccttgcacatag

SEQ ID NO: 3277200 - DNA, 14 bp, Homo sapiens
tccaattttctgga

SEQ ID NO: 3277201 - DNA, 17 bp, Homo sapiens
tccacaaggaataaatg

SEQ ID NO: 3277202 - DNA, 19 bp, Homo sapiens
tccacacaaagattttcta

SEQ ID NO: 3277203 - DNA, 19 bp, Homo sapiens
tccacacaagggaaggaca

SEQ ID NO: 3277204 - DNA, 22 bp, Homo sapiens
tccacacaggggtggagtttct

SEQ ID NO: 3277205 - DNA, 20 bp, Homo sapiens
tccacaccactgttgccttt

SEQ ID NO: 3277206 - DNA, 21 bp, Homo sapiens
tccacacccaatgctgctcca

SEQ ID NO: 3277207 - DNA, 15 bp, Homo sapiens
tccacaccttttatt

SEQ ID NO: 3277208 - DNA, 17 bp, Homo sapiens
tccacactgccggcagg

SEQ ID NO: 3277209 - DNA, 21 bp, Homo sapiens
tccacagagagtcccactgcc

SEQ ID NO: 3277210 - DNA, 16 bp, Homo sapiens
tccacagagtgagcca

SEQ ID NO: 3277211 - DNA, 11 bp, Homo sapiens
tccacagattg

SEQ ID NO: 3277212 - DNA, 15 bp, Homo sapiens
tccacagattgtttc

SEQ ID NO: 3277213 - DNA, 16 bp, Homo sapiens
tccacagattgtttct

SEQ ID NO: 3277214 - DNA, 22 bp, Homo sapiens
tccacagattgtttctatacaa

SEQ ID NO: 3277215 - DNA, 16 bp, Homo sapiens
tccacaggggcaggcc

SEQ ID NO: 3277216 - DNA, 13 bp, Homo sapiens
tccacagtgctgc

SEQ ID NO: 3277217 - DNA, 15 bp, Homo sapiens
tccacagttatctta

SEQ ID NO: 3277218 - DNA, 15 bp, Homo sapiens
tccacagttcagtgg

SEQ ID NO: 3277219 - DNA, 20 bp, Homo sapiens
tccacagttgccaccacctc

SEQ ID NO: 3277220 - DNA, 14 bp, Homo sapiens
tccacatcctgtgt

SEQ ID NO: 3277221 - DNA, 15 bp, Homo sapiens
tccacatcctgtgtc

SEQ ID NO: 3277222 - DNA, 15 bp, Homo sapiens
tccacatctgcctta

SEQ ID NO: 3277223 - DNA, 18 bp, Homo sapiens
tccacatctttaagtatt

SEQ ID NO: 3277224 - DNA, 12 bp, Homo sapiens
tccacatgctct

SEQ ID NO: 3277225 - DNA, 13 bp, Homo sapiens
tccacatgctctg

SEQ ID NO: 3277226 - DNA, 14 bp, Homo sapiens
tccacatgtacata

SEQ ID NO: 3277227 - DNA, 19 bp, Homo sapiens
tccacattctctctcactc

SEQ ID NO: 3277228 - DNA, 13 bp, Homo sapiens
tccacatttctaa

SEQ ID NO: 3277229 - DNA, 17 bp, Homo sapiens
tccacatttttgcacag

SEQ ID NO: 3277230 - DNA, 17 bp, Homo sapiens
tccaccaagaaagcagg

SEQ ID NO: 3277231 - DNA, 20 bp, Homo sapiens
tccaccaagtgtctagagtc

SEQ ID NO: 3277232 - DNA, 13 bp, Homo sapiens
tccaccaatctct

SEQ ID NO: 3277233 - DNA, 13 bp, Homo sapiens
tccaccaccactg

SEQ ID NO: 3277234 - DNA, 23 bp, Homo sapiens
tccaccaccactggccaccaggc

SEQ ID NO: 3277235 - DNA, 14 bp, Homo sapiens
tccaccacctccct

SEQ ID NO: 3277236 - DNA, 18 bp, Homo sapiens
tccaccacctccctcacc

SEQ ID NO: 3277237 - DNA, 16 bp, Homo sapiens
tccaccatccccaccc

SEQ ID NO: 3277238 - DNA, 17 bp, Homo sapiens
tccaccatccccacccc

SEQ ID NO: 3277239 - DNA, 19 bp, Homo sapiens
tccaccatccccaccccac

SEQ ID NO: 3277240 - DNA, 13 bp, Homo sapiens
tccacccagcccc

SEQ ID NO: 3277241 - DNA, 12 bp, Homo sapiens
tccacccaggag

SEQ ID NO: 3277242 - DNA, 15 bp, Homo sapiens
tccacccaggagccc

SEQ ID NO: 3277243 - DNA, 13 bp, Homo sapiens
tccacccaggctg

SEQ ID NO: 3277244 - DNA, 14 bp, Homo sapiens
tccacccaggctgc

SEQ ID NO: 3277245 - DNA, 16 bp, Homo sapiens
tccacccaggctgcac

SEQ ID NO: 3277246 - DNA, 20 bp, Homo sapiens
tccacccaggctgcactgca

SEQ ID NO: 3277247 - DNA, 21 bp, Homo sapiens
tccacccaggctgcactgcag

SEQ ID NO: 3277248 - DNA, 24 bp, Homo sapiens
tccacccaggctgcactgcagtga

SEQ ID NO: 3277249 - DNA, 12 bp, Homo sapiens
tccacccagtgc

SEQ ID NO: 3277250 - DNA, 20 bp, Homo sapiens
tccacccagtgctgccatgc

SEQ ID NO: 3277251 - DNA, 22 bp, Homo sapiens
tccacccataatcctttctgcc

SEQ ID NO: 3277252 - DNA, 23 bp, Homo sapiens
tccaccccggcccccgaactgtg

SEQ ID NO: 3277253 - DNA, 12 bp, Homo sapiens
tccaccctgctc

SEQ ID NO: 3277254 - DNA, 12 bp, Homo sapiens
tccaccctggaa

SEQ ID NO: 3277255 - DNA, 20 bp, Homo sapiens
tccaccctgtcccccagctc

SEQ ID NO: 3277256 - DNA, 14 bp, Homo sapiens
tccacccttggcct

SEQ ID NO: 3277257 - DNA, 16 bp, Homo sapiens
tccacccttggcctgt

SEQ ID NO: 3277258 - DNA, 19 bp, Homo sapiens
tccacccttggcctgtctc

SEQ ID NO: 3277259 - DNA, 14 bp, Homo sapiens
tccaccggcccctg

SEQ ID NO: 3277260 - DNA, 20 bp, Homo sapiens
tccaccgttcaagcgccaga

SEQ ID NO: 3277261 - DNA, 13 bp, Homo sapiens
tccacctcggagc

SEQ ID NO: 3277262 - DNA, 20 bp, Homo sapiens
tccacctggtactccctctc

SEQ ID NO: 3277263 - DNA, 17 bp, Homo sapiens
tccacctgtctcagcct

SEQ ID NO: 3277264 - DNA, 11 bp, Homo sapiens
tccacctgtga

SEQ ID NO: 3277265 - DNA, 12 bp, Homo sapiens
tccacctgtgag

SEQ ID NO: 3277266 - DNA, 15 bp, Homo sapiens
tccacctgtgccctc

SEQ ID NO: 3277267 - DNA, 16 bp, Homo sapiens
tccaccttcccatgcc

SEQ ID NO: 3277268 - DNA, 19 bp, Homo sapiens
tccaccttcccatgccctg

SEQ ID NO: 3277269 - DNA, 13 bp, Homo sapiens
tccaccttggctc

SEQ ID NO: 3277270 - DNA, 18 bp, Homo sapiens
tccaccttggctctgcca

SEQ ID NO: 3277271 - DNA, 14 bp, Homo sapiens
tccacctttcccaa

SEQ ID NO: 3277272 - DNA, 14 bp, Homo sapiens
tccacgcctcctgg

SEQ ID NO: 3277273 - DNA, 19 bp, Homo sapiens
tccacgcctcctggccaga

SEQ ID NO: 3277274 - DNA, 17 bp, Homo sapiens
tccacgcgcttcgactt

SEQ ID NO: 3277275 - DNA, 22 bp, Homo sapiens
tccacggtgcgtggctgtggca

SEQ ID NO: 3277276 - DNA, 15 bp, Homo sapiens
tccactacacctggc

SEQ ID NO: 3277277 - DNA, 18 bp, Homo sapiens
tccactacacctggctga

SEQ ID NO: 3277278 - DNA, 23 bp, Homo sapiens
tccactatcccaatcaaagaatt

SEQ ID NO: 3277279 - DNA, 16 bp, Homo sapiens
tccactcccccacctg

SEQ ID NO: 3277280 - DNA, 17 bp, Homo sapiens
tccactcccccacctga

SEQ ID NO: 3277281 - DNA, 18 bp, Homo sapiens
tccactcccccacctgac

SEQ ID NO: 3277282 - DNA, 21 bp, Homo sapiens
tccactcctcctcactaaaaa

SEQ ID NO: 3277283 - DNA, 23 bp, Homo sapiens
tccctgtatgtctacctctgact

SEQ ID NO: 3277284 - DNA, 14 bp, Homo sapiens
tccctgtcagaggc

SEQ ID NO: 3277285 - DNA, 14 bp, Homo sapiens
tccctgtccctcta

SEQ ID NO: 3277286 - DNA, 21 bp, Homo sapiens
tccctgtccctctagtgcctt

SEQ ID NO: 3277287 - DNA, 16 bp, Homo sapiens
tccctgtctctgcatc

SEQ ID NO: 3277288 - DNA, 12 bp, Homo sapiens
tccctgtggggg

SEQ ID NO: 3277289 - DNA, 19 bp, Homo sapiens
tccctgtgggggtggccat

SEQ ID NO: 3277290 - DNA, 20 bp, Homo sapiens
tccctgtgggggtggccatc

SEQ ID NO: 3277291 - DNA, 20 bp, Homo sapiens
tccctgtgtccacctgtggg

SEQ ID NO: 3277292 - DNA, 19 bp, Homo sapiens
tccctgtgtgtaggctggg

SEQ ID NO: 3277293 - DNA, 15 bp, Homo sapiens
tccctgttctccctt

SEQ ID NO: 3277294 - DNA, 19 bp, Homo sapiens
tccctgttctccctttctc

SEQ ID NO: 3277295 - DNA, 23 bp, Homo sapiens
tccctgttctccctttctctctc

SEQ ID NO: 3277296 - DNA, 14 bp, Homo sapiens
tccctgttcttcct

SEQ ID NO: 3277297 - DNA, 21 bp, Homo sapiens
tccctgttgacgaagtctctt

SEQ ID NO: 3277298 - DNA, 18 bp, Homo sapiens
tccctgttggtcggtggg

SEQ ID NO: 3277299 - DNA, 16 bp, Homo sapiens
tccctgtttaatattt

SEQ ID NO: 3277300 - DNA, 19 bp, Homo sapiens
tccctgtttgaagcctgcc

SEQ ID NO: 3277301 - DNA, 15 bp, Homo sapiens
tcccttaacttttcc

SEQ ID NO: 3277302 - DNA, 17 bp, Homo sapiens
tcccttaacttttcctt

SEQ ID NO: 3277303 - DNA, 20 bp, Homo sapiens
tcccttaaggggtatcatgt

SEQ ID NO: 3277304 - DNA, 15 bp, Homo sapiens
tcccttactttgctg

SEQ ID NO: 3277305 - DNA, 15 bp, Homo sapiens
tcccttatgtccacc

SEQ ID NO: 3277306 - DNA, 16 bp, Homo sapiens
tcccttattagttaca

SEQ ID NO: 3277307 - DNA, 22 bp, Homo sapiens
tcccttcaaccattccccatgg

SEQ ID NO: 3277308 - DNA, 20 bp, Homo sapiens
tcccttcaagacgaggggca

SEQ ID NO: 3277309 - DNA, 14 bp, Homo sapiens
tcccttcagccccc

SEQ ID NO: 3277310 - DNA, 19 bp, Homo sapiens
tcccttcagcccccagccc

SEQ ID NO: 3277311 - DNA, 18 bp, Homo sapiens
tcccttcagtaccctctc

SEQ ID NO: 3277312 - DNA, 20 bp, Homo sapiens
tcccttcagtaccctctcag

SEQ ID NO: 3277313 - DNA, 13 bp, Homo sapiens
tcccttccactgc

SEQ ID NO: 3277314 - DNA, 18 bp, Homo sapiens
tcccttccactgcctctg

SEQ ID NO: 3277315 - DNA, 17 bp, Homo sapiens
tcccttcccccataagc

SEQ ID NO: 3277316 - DNA, 20 bp, Homo sapiens
tcccttccctaaagtgatgg

SEQ ID NO: 3277317 - DNA, 20 bp, Homo sapiens
tcccttccgaccctctggga

SEQ ID NO: 3277318 - DNA, 13 bp, Homo sapiens
tcccttcctggcc

SEQ ID NO: 3277319 - DNA, 15 bp, Homo sapiens
tcccttcctggcctc

SEQ ID NO: 3277320 - DNA, 17 bp, Homo sapiens
tcccttccttttccctg

SEQ ID NO: 3277321 - DNA, 18 bp, Homo sapiens
tcccttccttttccctgc

SEQ ID NO: 3277322 - DNA, 15 bp, Homo sapiens
tcccttctcacagca

SEQ ID NO: 3277323 - DNA, 17 bp, Homo sapiens
tcccttctttttcttct

SEQ ID NO: 3277324 - DNA, 20 bp, Homo sapiens
tcccttgcaggggtcccccc

SEQ ID NO: 3277325 - DNA, 17 bp, Homo sapiens
tcccttgctggccccag

SEQ ID NO: 3277326 - DNA, 15 bp, Homo sapiens
tcccttgctttgttt

SEQ ID NO: 3277327 - DNA, 21 bp, Homo sapiens
tcccttgtgtcaagacatttc

SEQ ID NO: 3277328 - DNA, 15 bp, Homo sapiens
tcccttgtgtgtgtg

SEQ ID NO: 3277329 - DNA, 16 bp, Homo sapiens
tccctttacaatgtga

SEQ ID NO: 3277330 - DNA, 13 bp, Homo sapiens
tccctttatgtat

SEQ ID NO: 3277331 - DNA, 17 bp, Homo sapiens
tccctttatttcacata

SEQ ID NO: 3277332 - DNA, 16 bp, Homo sapiens
tccctttccccagcat

SEQ ID NO: 3277333 - DNA, 14 bp, Homo sapiens
tccctttctcccag

SEQ ID NO: 3277334 - DNA, 14 bp, Homo sapiens
tccctttctctctc

SEQ ID NO: 3277335 - DNA, 17 bp, Homo sapiens
tccctttctctctcctc

SEQ ID NO: 3277336 - DNA, 16 bp, Homo sapiens
tccctttgaagataat

SEQ ID NO: 3277337 - DNA, 20 bp, Homo sapiens
tcccttttcaccttttcagg

SEQ ID NO: 3277338 - DNA, 15 bp, Homo sapiens
tcccttttcctgtca

SEQ ID NO: 3277339 - DNA, 21 bp, Homo sapiens
tcccttttctgtttaggaaga

SEQ ID NO: 3277340 - DNA, 12 bp, Homo sapiens
tcccttttgcta

SEQ ID NO: 3277341 - DNA, 19 bp, Homo sapiens
tcctcattgcctcctgttc

SEQ ID NO: 3277342 - DNA, 20 bp, Homo sapiens
tcctcattgcctcctgttct

SEQ ID NO: 3277343 - DNA, 17 bp, Homo sapiens
tcctccaaatctcttgc

SEQ ID NO: 3277344 - DNA, 15 bp, Homo sapiens
tcctccacagtgctg

SEQ ID NO: 3277345 - DNA, 13 bp, Homo sapiens
tcctccacatcct

SEQ ID NO: 3277346 - DNA, 18 bp, Homo sapiens
tcctccacatcctgtgtc

SEQ ID NO: 3277347 - DNA, 16 bp, Homo sapiens
tcctccagaagcctct

SEQ ID NO: 3277348 - DNA, 21 bp, Homo sapiens
tcctccagaagcctctggcta

SEQ ID NO: 3277349 - DNA, 12 bp, Homo sapiens
tcctccagacca

SEQ ID NO: 3277350 - DNA, 13 bp, Homo sapiens
tcctccagcttct

SEQ ID NO: 3277351 - DNA, 22 bp, Homo sapiens
tcctccagggtgattttatgat

SEQ ID NO: 3277352 - DNA, 17 bp, Homo sapiens
tcctccagtaccttgct

SEQ ID NO: 3277353 - DNA, 21 bp, Homo sapiens
tcctcccacctcagcctcccg

SEQ ID NO: 3277354 - DNA, 13 bp, Homo sapiens
tcctcccaggcgc

SEQ ID NO: 3277355 - DNA, 13 bp, Homo sapiens
tcctcccatcccc

SEQ ID NO: 3277356 - DNA, 23 bp, Homo sapiens
tcctcccatcccctggactggga

SEQ ID NO: 3277357 - DNA, 22 bp, Homo sapiens
tcctccccattagagtcagcct

SEQ ID NO: 3277358 - DNA, 14 bp, Homo sapiens
tcctcccccacccc

SEQ ID NO: 3277359 - DNA, 14 bp, Homo sapiens
tcctccccctgcaa

SEQ ID NO: 3277360 - DNA, 15 bp, Homo sapiens
tcctccccctgcaac

SEQ ID NO: 3277361 - DNA, 22 bp, Homo sapiens
tcctccccctgttctgttgggg

SEQ ID NO: 3277362 - DNA, 18 bp, Homo sapiens
tcctcccctcacagcctc

SEQ ID NO: 3277363 - DNA, 23 bp, Homo sapiens
tcctcccctcacagcctctgacc

SEQ ID NO: 3277364 - DNA, 14 bp, Homo sapiens
tcctccctgccccc

SEQ ID NO: 3277365 - DNA, 13 bp, Homo sapiens
tcctccctgtctc

SEQ ID NO: 3277366 - DNA, 18 bp, Homo sapiens
tcctcccttccttttccc

SEQ ID NO: 3277367 - DNA, 21 bp, Homo sapiens
tcctcccttccttttccctgc

SEQ ID NO: 3277368 - DNA, 19 bp, Homo sapiens
tcctccgtccacccaggct

SEQ ID NO: 3277369 - DNA, 21 bp, Homo sapiens
tcctccgtccacccaggctgc

SEQ ID NO: 3277370 - DNA, 14 bp, Homo sapiens
tcctccgtccagcc

SEQ ID NO: 3277371 - DNA, 18 bp, Homo sapiens
tcctccgtccagccgcca

SEQ ID NO: 3277372 - DNA, 15 bp, Homo sapiens
tcctcctccacagtg

SEQ ID NO: 3277373 - DNA, 15 bp, Homo sapiens
tcctcctccagggtg

SEQ ID NO: 3277374 - DNA, 20 bp, Homo sapiens
tcctcctccatctttctaca

SEQ ID NO: 3277375 - DNA, 20 bp, Homo sapiens
tcctcctcccacccggctgc

SEQ ID NO: 3277376 - DNA, 15 bp, Homo sapiens
tcctcctgcagacca

SEQ ID NO: 3277377 - DNA, 11 bp, Homo sapiens
tcctcctgctg

SEQ ID NO: 3277378 - DNA, 13 bp, Homo sapiens
tcctcctgctgta

SEQ ID NO: 3277379 - DNA, 19 bp, Homo sapiens
tcctcctggaaccttgctg

SEQ ID NO: 3277380 - DNA, 15 bp, Homo sapiens
tcctccttcactgtt

SEQ ID NO: 3277381 - DNA, 24 bp, Homo sapiens
tcctccttgcccagactacagggc

SEQ ID NO: 3277382 - DNA, 16 bp, Homo sapiens
tcctcggagagcagca

SEQ ID NO: 3277383 - DNA, 17 bp, Homo sapiens
tcctcggagagcagcag

SEQ ID NO: 3277384 - DNA, 14 bp, Homo sapiens
tcctcggccccctc

SEQ ID NO: 3277385 - DNA, 16 bp, Homo sapiens
tcctcggggctccagg

SEQ ID NO: 3277386 - DNA, 20 bp, Homo sapiens
tcctcgttcaaaacattcca

SEQ ID NO: 3277387 - DNA, 23 bp, Homo sapiens
tcctcgttcaaaacattccaaga

SEQ ID NO: 3277388 - DNA, 15 bp, Homo sapiens
tcctcgttcctttct

SEQ ID NO: 3277389 - DNA, 18 bp, Homo sapiens
tcctctacttaatgagat

SEQ ID NO: 3277390 - DNA, 18 bp, Homo sapiens
tcctctaggcaagcagga

SEQ ID NO: 3277391 - DNA, 21 bp, Homo sapiens
tcctctagtaagatgcactga

SEQ ID NO: 3277392 - DNA, 16 bp, Homo sapiens
tcctctatacatctct

SEQ ID NO: 3277393 - DNA, 20 bp, Homo sapiens
tcctctatacatctctcccc

SEQ ID NO: 3277394 - DNA, 12 bp, Homo sapiens
tcctctattttg

SEQ ID NO: 3277395 - DNA, 22 bp, Homo sapiens
tcctctcaagctagccagaggg

SEQ ID NO: 3277396 - DNA, 18 bp, Homo sapiens
tcctctcactaaacttta

SEQ ID NO: 3277397 - DNA, 18 bp, Homo sapiens
tcctctcactcctgcctc

SEQ ID NO: 3277398 - DNA, 15 bp, Homo sapiens
tcctctccactgcct

SEQ ID NO: 3277399 - DNA, 11 bp, Homo sapiens
tcctctccagg

SEQ ID NO: 3277400 - DNA, 13 bp, Homo sapiens
tcctctcccatcc

SEQ ID NO: 3277401 - DNA, 17 bp, Homo sapiens
tcctctcccatccttga

SEQ ID NO: 3277402 - DNA, 18 bp, Homo sapiens
tcctctcccctccagcct

SEQ ID NO: 3277403 - DNA, 14 bp, Homo sapiens
tcctctccctgcca

SEQ ID NO: 3277404 - DNA, 15 bp, Homo sapiens
tcctctccctgccaa

SEQ ID NO: 3277405 - DNA, 17 bp, Homo sapiens
tcctctccctgccaagt

SEQ ID NO: 3277406 - DNA, 13 bp, Homo sapiens
tcctctcgagccc

SEQ ID NO: 3277407 - DNA, 15 bp, Homo sapiens
tcctctcgagcccag

SEQ ID NO: 3277408 - DNA, 19 bp, Homo sapiens
tcctgagaaaggtgaggag

SEQ ID NO: 3277409 - DNA, 22 bp, Homo sapiens
tcctgagaaaggtgaggagggc

SEQ ID NO: 3277410 - DNA, 16 bp, Homo sapiens
tcctgagaaggcgagg

SEQ ID NO: 3277411 - DNA, 17 bp, Homo sapiens
tcctgagaaggcgagga

SEQ ID NO: 3277412 - DNA, 20 bp, Homo sapiens
tcctgagaaggcgaggagag

SEQ ID NO: 3277413 - DNA, 23 bp, Homo sapiens
tcctgagaataagaaagtttcac

SEQ ID NO: 3277414 - DNA, 22 bp, Homo sapiens
tcctgagccccgccctcttcct

SEQ ID NO: 3277415 - DNA, 23 bp, Homo sapiens
tcctgagccccgccctcttcctg

SEQ ID NO: 3277416 - DNA, 15 bp, Homo sapiens
tcctgagcctgtggg

SEQ ID NO: 3277417 - DNA, 20 bp, Homo sapiens
tcctgaggctccacttggtc

SEQ ID NO: 3277418 - DNA, 21 bp, Homo sapiens
tcctgaggctccacttggtct

SEQ ID NO: 3277419 - DNA, 16 bp, Homo sapiens
tcctgaggctttggat

SEQ ID NO: 3277420 - DNA, 21 bp, Homo sapiens
tcctgaggggcatctgcccct

SEQ ID NO: 3277421 - DNA, 15 bp, Homo sapiens
tcctgagtggtgcca

SEQ ID NO: 3277422 - DNA, 17 bp, Homo sapiens
tcctgagtgtggacttg

SEQ ID NO: 3277423 - DNA, 17 bp, Homo sapiens
tcctgataataattgat

SEQ ID NO: 3277424 - DNA, 19 bp, Homo sapiens
tcctgataataattgatca

SEQ ID NO: 3277425 - DNA, 16 bp, Homo sapiens
tcctgatggccaagag

SEQ ID NO: 3277426 - DNA, 17 bp, Homo sapiens
tcctgatggtcagctcc

SEQ ID NO: 3277427 - DNA, 18 bp, Homo sapiens
tcctgcaactcaaggact

SEQ ID NO: 3277428 - DNA, 16 bp, Homo sapiens
tcctgcagaagaagct

SEQ ID NO: 3277429 - DNA, 20 bp, Homo sapiens
tcctgcagaggaccacagtg

SEQ ID NO: 3277430 - DNA, 13 bp, Homo sapiens
tcctgcagcaaac

SEQ ID NO: 3277431 - DNA, 20 bp, Homo sapiens
tcctgcagcaaacactccac

SEQ ID NO: 3277432 - DNA, 17 bp, Homo sapiens
tcctgcagcatggtccc

SEQ ID NO: 3277433 - DNA, 18 bp, Homo sapiens
tcctgcagccccagaaga

SEQ ID NO: 3277434 - DNA, 14 bp, Homo sapiens
tcctgcaggagtgc

SEQ ID NO: 3277435 - DNA, 17 bp, Homo sapiens
tcctgcaggagtgctgg

SEQ ID NO: 3277436 - DNA, 14 bp, Homo sapiens
tcctgcatttctct

SEQ ID NO: 3277437 - DNA, 15 bp, Homo sapiens
tcctgcatttctctt

SEQ ID NO: 3277438 - DNA, 16 bp, Homo sapiens
tcctgcatttgtgaaa

SEQ ID NO: 3277439 - DNA, 18 bp, Homo sapiens
tcctgccacatggagccc

SEQ ID NO: 3277440 - DNA, 11 bp, Homo sapiens
tcctgccagct

SEQ ID NO: 3277441 - DNA, 13 bp, Homo sapiens
tcctgccagctgc

SEQ ID NO: 3277442 - DNA, 18 bp, Homo sapiens
tcctgccagctgccttcc

SEQ ID NO: 3277443 - DNA, 17 bp, Homo sapiens
tcctgccattcttctgg

SEQ ID NO: 3277444 - DNA, 23 bp, Homo sapiens
tcctgcccaagcacttcacagct

SEQ ID NO: 3277445 - DNA, 17 bp, Homo sapiens
tcctgcccagtccccca

SEQ ID NO: 3277446 - DNA, 13 bp, Homo sapiens
tcctgcccagtgt

SEQ ID NO: 3277447 - DNA, 14 bp, Homo sapiens
tcctgcccagtgtt

SEQ ID NO: 3277448 - DNA, 22 bp, Homo sapiens
tcctgcccagtgttgtttgtaa

SEQ ID NO: 3277449 - DNA, 16 bp, Homo sapiens
tcctgcccatgtgtcc

SEQ ID NO: 3277450 - DNA, 17 bp, Homo sapiens
tcctgcccatgtgtccc

SEQ ID NO: 3277451 - DNA, 18 bp, Homo sapiens
tcctgcccatgtgtcccc

SEQ ID NO: 3277452 - DNA, 20 bp, Homo sapiens
tcctgcccatgtgtcccctc

SEQ ID NO: 3277453 - DNA, 22 bp, Homo sapiens
tcctgcccgccacacagaccac

SEQ ID NO: 3277454 - DNA, 12 bp, Homo sapiens
tcctgccctccc

SEQ ID NO: 3277455 - DNA, 21 bp, Homo sapiens
tcctgccctgtccctgtcccc

SEQ ID NO: 3277456 - DNA, 12 bp, Homo sapiens
tcctgccctgtt

SEQ ID NO: 3277457 - DNA, 19 bp, Homo sapiens
tcctgccgcagacgggcac

SEQ ID NO: 3277458 - DNA, 23 bp, Homo sapiens
tcctgccggtgggaccctgtccg

SEQ ID NO: 3277459 - DNA, 17 bp, Homo sapiens
tcctgcctcagcctccc

SEQ ID NO: 3277460 - DNA, 19 bp, Homo sapiens
tcctgcctccgctggcttt

SEQ ID NO: 3277461 - DNA, 12 bp, Homo sapiens
tcctgcctggcc

SEQ ID NO: 3277462 - DNA, 15 bp, Homo sapiens
tcctgcctgggtggg

SEQ ID NO: 3277463 - DNA, 21 bp, Homo sapiens
tcctgcctgggtgggacagcc

SEQ ID NO: 3277464 - DNA, 23 bp, Homo sapiens
tcctgcctgggtgggacagcctc

SEQ ID NO: 3277465 - DNA, 14 bp, Homo sapiens
tcctgcctgtggcg

SEQ ID NO: 3277466 - DNA, 13 bp, Homo sapiens
tcctgccttctgt

SEQ ID NO: 3277467 - DNA, 20 bp, Homo sapiens
tcctgcctttaagccaaaga

SEQ ID NO: 3277468 - DNA, 23 bp, Homo sapiens
tcctgcctttaagccaaagaaac

SEQ ID NO: 3277469 - DNA, 19 bp, Homo sapiens
tcctgcgccccgcccacac

SEQ ID NO: 3277470 - DNA, 19 bp, Homo sapiens
tcctgcggagtgaagaggg

SEQ ID NO: 3277471 - DNA, 13 bp, Homo sapiens
tcctgcgtcctcc

SEQ ID NO: 3277472 - DNA, 14 bp, Homo sapiens
tcctgcgtcctcct

SEQ ID NO: 3277473 - DNA, 18 bp, Homo sapiens
tcctgctaagttaatgtt

SEQ ID NO: 3277474 - DNA, 21 bp, Homo sapiens
tcctgctacaacttcagcagt

SEQ ID NO: 3277475 - DNA, 14 bp, Homo sapiens
tcctgctacaggag

SEQ ID NO: 3277476 - DNA, 23 bp, Homo sapiens
tcctgctcaactctacccctgct

SEQ ID NO: 3277477 - DNA, 15 bp, Homo sapiens
tcctgctcatattgt

SEQ ID NO: 3277478 - DNA, 12 bp, Homo sapiens
tcctgctccaga

SEQ ID NO: 3277479 - DNA, 20 bp, Homo sapiens
tcctgctccatgactggctg

SEQ ID NO: 3277480 - DNA, 10 bp, Homo sapiens
tcctgctcct

SEQ ID NO: 3277481 - DNA, 22 bp, Homo sapiens
tctccataaagcacattttaag

SEQ ID NO: 3277482 - DNA, 24 bp, Homo sapiens
tctccataggagggaaggagcagt

SEQ ID NO: 3277483 - DNA, 16 bp, Homo sapiens
tctccatatctccttc

SEQ ID NO: 3277484 - DNA, 15 bp, Homo sapiens
tctccatatgttaca

SEQ ID NO: 3277485 - DNA, 14 bp, Homo sapiens
tctccatcatatgc

SEQ ID NO: 3277486 - DNA, 18 bp, Homo sapiens
tctccatcatatgcctga

SEQ ID NO: 3277487 - DNA, 13 bp, Homo sapiens
tctccatctgtca

SEQ ID NO: 3277488 - DNA, 22 bp, Homo sapiens
tctcccaagctatctaaagttt

SEQ ID NO: 3277489 - DNA, 19 bp, Homo sapiens
tctcccacagagtgctgga

SEQ ID NO: 3277490 - DNA, 22 bp, Homo sapiens
tctcccacagagtgctggactg

SEQ ID NO: 3277491 - DNA, 12 bp, Homo sapiens
tctcccaccctg

SEQ ID NO: 3277492 - DNA, 14 bp, Homo sapiens
tctcccacgtggga

SEQ ID NO: 3277493 - DNA, 15 bp, Homo sapiens
tctcccacgtgggag

SEQ ID NO: 3277494 - DNA, 17 bp, Homo sapiens
tctcccagaatcccagc

SEQ ID NO: 3277495 - DNA, 15 bp, Homo sapiens
tctcccaggccccct

SEQ ID NO: 3277496 - DNA, 12 bp, Homo sapiens
tctcccatcccc

SEQ ID NO: 3277497 - DNA, 14 bp, Homo sapiens
tctcccatccccct

SEQ ID NO: 3277498 - DNA, 24 bp, Homo sapiens
tctcccatcctggggcagcactcc

SEQ ID NO: 3277499 - DNA, 22 bp, Homo sapiens
tctccccaaccctaggttccct

SEQ ID NO: 3277500 - DNA, 12 bp, Homo sapiens
tctccccacagc

SEQ ID NO: 3277501 - DNA, 14 bp, Homo sapiens
tctccccacagcct

SEQ ID NO: 3277502 - DNA, 13 bp, Homo sapiens
tctccccacccac

SEQ ID NO: 3277503 - DNA, 19 bp, Homo sapiens
tctccccacgagggctggc

SEQ ID NO: 3277504 - DNA, 20 bp, Homo sapiens
tctccccacgagggctggct

SEQ ID NO: 3277505 - DNA, 12 bp, Homo sapiens
tctccccagaat

SEQ ID NO: 3277506 - DNA, 18 bp, Homo sapiens
tctccccaggcctccagc

SEQ ID NO: 3277507 - DNA, 16 bp, Homo sapiens
tctccccatccccatt

SEQ ID NO: 3277508 - DNA, 21 bp, Homo sapiens
tctccccatccccttcctaaa

SEQ ID NO: 3277509 - DNA, 21 bp, Homo sapiens
tctcccccgacactgctgcac

SEQ ID NO: 3277510 - DNA, 16 bp, Homo sapiens
tctcccctcaaagtct

SEQ ID NO: 3277511 - DNA, 23 bp, Homo sapiens
tctcccctcaaagtctgcaactt

SEQ ID NO: 3277512 - DNA, 12 bp, Homo sapiens
tctcccctccag

SEQ ID NO: 3277513 - DNA, 15 bp, Homo sapiens
tctcccctccagcct

SEQ ID NO: 3277514 - DNA, 13 bp, Homo sapiens
tctcccctcccag

SEQ ID NO: 3277515 - DNA, 23 bp, Homo sapiens
tctcccctccccgcctggccagg

SEQ ID NO: 3277516 - DNA, 14 bp, Homo sapiens
tctcccctgccctg

SEQ ID NO: 3277517 - DNA, 14 bp, Homo sapiens
tctcccggctgcct

SEQ ID NO: 3277518 - DNA, 16 bp, Homo sapiens
tctcccggctgcctgc

SEQ ID NO: 3277519 - DNA, 17 bp, Homo sapiens
tctcccggctgcctgcc

SEQ ID NO: 3277520 - DNA, 22 bp, Homo sapiens
tctcccgtcagggcccaagtcc

SEQ ID NO: 3277521 - DNA, 22 bp, Homo sapiens
tctccctcacaagcgctcccag

SEQ ID NO: 3277522 - DNA, 12 bp, Homo sapiens
tctccctctctc

SEQ ID NO: 3277523 - DNA, 23 bp, Homo sapiens
tctccctgccaagtctcagaaga

SEQ ID NO: 3277524 - DNA, 15 bp, Homo sapiens
tctccctgccagagg

SEQ ID NO: 3277525 - DNA, 12 bp, Homo sapiens
tctccctgcctg

SEQ ID NO: 3277526 - DNA, 14 bp, Homo sapiens
tctccctgcctggc

SEQ ID NO: 3277527 - DNA, 15 bp, Homo sapiens
tctccctgcctggcc

SEQ ID NO: 3277528 - DNA, 23 bp, Homo sapiens
tctccctggctccctcctccagg

SEQ ID NO: 3277529 - DNA, 14 bp, Homo sapiens
tctccctttctctc

SEQ ID NO: 3277530 - DNA, 19 bp, Homo sapiens
tctccctttctctctcctc

SEQ ID NO: 3277531 - DNA, 22 bp, Homo sapiens
tctccctttctctctcctctct

SEQ ID NO: 3277532 - DNA, 13 bp, Homo sapiens
tctccgccagcct

SEQ ID NO: 3277533 - DNA, 14 bp, Homo sapiens
tctccgccagcctc

SEQ ID NO: 3277534 - DNA, 20 bp, Homo sapiens
tctccgccagcctcctctgg

SEQ ID NO: 3277535 - DNA, 13 bp, Homo sapiens
tctccggggtctg

SEQ ID NO: 3277536 - DNA, 20 bp, Homo sapiens
tctccggggtctgtgctgtg

SEQ ID NO: 3277537 - DNA, 21 bp, Homo sapiens
tctccggggtctgtgctgtgc

SEQ ID NO: 3277538 - DNA, 22 bp, Homo sapiens
tctccggggtctgtgctgtgcc

SEQ ID NO: 3277539 - DNA, 16 bp, Homo sapiens
tctccgggtgtggcct

SEQ ID NO: 3277540 - DNA, 17 bp, Homo sapiens
tctccgggtgtggcctc

SEQ ID NO: 3277541 - DNA, 19 bp, Homo sapiens
tctccgggtgtggcctcag

SEQ ID NO: 3277542 - DNA, 16 bp, Homo sapiens
tctccgttagctcctg

SEQ ID NO: 3277543 - DNA, 17 bp, Homo sapiens
tctccgttagctcctgt

SEQ ID NO: 3277544 - DNA, 23 bp, Homo sapiens
tctccgttagctcctgtggcccc

SEQ ID NO: 3277545 - DNA, 21 bp, Homo sapiens
tctcctaatttgtttcttctg

SEQ ID NO: 3277546 - DNA, 14 bp, Homo sapiens
tctcctactcctga

SEQ ID NO: 3277547 - DNA, 17 bp, Homo sapiens
tctcctataatctgtca

SEQ ID NO: 3277548 - DNA, 18 bp, Homo sapiens
tctcctatatatttctat

SEQ ID NO: 3277549 - DNA, 12 bp, Homo sapiens
tctcctattttt

SEQ ID NO: 3277550 - DNA, 20 bp, Homo sapiens
tctcctcaagtccccaagat

SEQ ID NO: 3277551 - DNA, 21 bp, Homo sapiens
tctcctcagacagtaaccatg

SEQ ID NO: 3277552 - DNA, 13 bp, Homo sapiens
tctcctcccagcg

SEQ ID NO: 3277553 - DNA, 21 bp, Homo sapiens
tctcctcccagcgtgtgtatc

SEQ ID NO: 3277554 - DNA, 14 bp, Homo sapiens
tctcctcggccccc

SEQ ID NO: 3277555 - DNA, 13 bp, Homo sapiens
tctcctctctggg

SEQ ID NO: 3277556 - DNA, 14 bp, Homo sapiens
tctcctctctgggc

SEQ ID NO: 3277557 - DNA, 16 bp, Homo sapiens
tctcctctctgggcct

SEQ ID NO: 3277558 - DNA, 20 bp, Homo sapiens
tctcctctctgggcctttgt

SEQ ID NO: 3277559 - DNA, 17 bp, Homo sapiens
tctcctcttgccactgc

SEQ ID NO: 3277560 - DNA, 23 bp, Homo sapiens
tctcctgaaacccaaagccctgg

SEQ ID NO: 3277561 - DNA, 15 bp, Homo sapiens
tctcctgacagaagg

SEQ ID NO: 3277562 - DNA, 17 bp, Homo sapiens
tctcctgacccagtccc

SEQ ID NO: 3277563 - DNA, 15 bp, Homo sapiens
tctcctgcctcagcc

SEQ ID NO: 3277564 - DNA, 13 bp, Homo sapiens
tctcctgcctgta

SEQ ID NO: 3277565 - DNA, 17 bp, Homo sapiens
tctcctgcgccccgccc

SEQ ID NO: 3277566 - DNA, 18 bp, Homo sapiens
tctcctgctctttctaca

SEQ ID NO: 3277567 - DNA, 16 bp, Homo sapiens
tctcctgctgatttca

SEQ ID NO: 3277568 - DNA, 22 bp, Homo sapiens
tctcctgctgatttcactttgg

SEQ ID NO: 3277569 - DNA, 21 bp, Homo sapiens
tctcctggaaatattaagaaa

SEQ ID NO: 3277570 - DNA, 20 bp, Homo sapiens
tctcctggcctggccatctc

SEQ ID NO: 3277571 - DNA, 21 bp, Homo sapiens
tctcctggcctggccatctcc

SEQ ID NO: 3277572 - DNA, 21 bp, Homo sapiens
tctcctggctaagcctctgct

SEQ ID NO: 3277573 - DNA, 12 bp, Homo sapiens
tctcctgtctgc

SEQ ID NO: 3277574 - DNA, 16 bp, Homo sapiens
tctcctgtctgccctc

SEQ ID NO: 3277575 - DNA, 20 bp, Homo sapiens
tctcctgtctgccctctggg

SEQ ID NO: 3277576 - DNA, 18 bp, Homo sapiens
tctcctgtgcccacatcc

SEQ ID NO: 3277577 - DNA, 18 bp, Homo sapiens
tctcctgttttatatatt

SEQ ID NO: 3277578 - DNA, 17 bp, Homo sapiens
tctccttactctgagcc

SEQ ID NO: 3277579 - DNA, 18 bp, Homo sapiens
tctccttactctgagccc

SEQ ID NO: 3277580 - DNA, 20 bp, Homo sapiens
tctccttatagacacttgct

SEQ ID NO: 3277581 - DNA, 18 bp, Homo sapiens
tctccttcccctacacct

SEQ ID NO: 3277582 - DNA, 19 bp, Homo sapiens
tctccttcccctttcccca

SEQ ID NO: 3277583 - DNA, 13 bp, Homo sapiens
tctccttcctgtg

SEQ ID NO: 3277584 - DNA, 18 bp, Homo sapiens
tctccttccttacccaaa

SEQ ID NO: 3277585 - DNA, 18 bp, Homo sapiens
tctccttcgtatcccgag

SEQ ID NO: 3277586 - DNA, 17 bp, Homo sapiens
tctccttctccttccca

SEQ ID NO: 3277587 - DNA, 13 bp, Homo sapiens
tctccttcttagc

SEQ ID NO: 3277588 - DNA, 14 bp, Homo sapiens
tctgccccagctct

SEQ ID NO: 3277589 - DNA, 14 bp, Homo sapiens
tctgcccccagccc

SEQ ID NO: 3277590 - DNA, 16 bp, Homo sapiens
tctgcccccagcccaa

SEQ ID NO: 3277591 - DNA, 18 bp, Homo sapiens
tctgcccccagcccaaag

SEQ ID NO: 3277592 - DNA, 14 bp, Homo sapiens
tctgcccctccccc

SEQ ID NO: 3277593 - DNA, 18 bp, Homo sapiens
tctgcccctcccccaacc

SEQ ID NO: 3277594 - DNA, 22 bp, Homo sapiens
tctgcccctcccccaaccccca

SEQ ID NO: 3277595 - DNA, 15 bp, Homo sapiens
tctgccccttgggca

SEQ ID NO: 3277596 - DNA, 18 bp, Homo sapiens
tctgccctccctccttcc

SEQ ID NO: 3277597 - DNA, 13 bp, Homo sapiens
tctgccctctggg

SEQ ID NO: 3277598 - DNA, 15 bp, Homo sapiens
tctgccctggctgct

SEQ ID NO: 3277599 - DNA, 18 bp, Homo sapiens
tctgccctttcctaggcc

SEQ ID NO: 3277600 - DNA, 15 bp, Homo sapiens
tctgccgcctcagct

SEQ ID NO: 3277601 - DNA, 20 bp, Homo sapiens
tctgccgctacctccctccc

SEQ ID NO: 3277602 - DNA, 23 bp, Homo sapiens
tctgccggctctttccttgctca

SEQ ID NO: 3277603 - DNA, 19 bp, Homo sapiens
tctgccggtcgggcagcca

SEQ ID NO: 3277604 - DNA, 22 bp, Homo sapiens
tctgccggtcgggcagccagca

SEQ ID NO: 3277605 - DNA, 21 bp, Homo sapiens
tctgcctagagtgtagcctaa

SEQ ID NO: 3277606 - DNA, 13 bp, Homo sapiens
tctgcctccctct

SEQ ID NO: 3277607 - DNA, 15 bp, Homo sapiens
tctgcctcctcttca

SEQ ID NO: 3277608 - DNA, 15 bp, Homo sapiens
tctgcctctctagga

SEQ ID NO: 3277609 - DNA, 13 bp, Homo sapiens
tctgcctgcccag

SEQ ID NO: 3277610 - DNA, 17 bp, Homo sapiens
tctgcctgcccaggccc

SEQ ID NO: 3277611 - DNA, 21 bp, Homo sapiens
tctgcctgcccaggcccctgc

SEQ ID NO: 3277612 - DNA, 23 bp, Homo sapiens
tctgcctggagacttagggcacc

SEQ ID NO: 3277613 - DNA, 12 bp, Homo sapiens
tctgcctggcct

SEQ ID NO: 3277614 - DNA, 13 bp, Homo sapiens
tctgcctggcctg

SEQ ID NO: 3277615 - DNA, 20 bp, Homo sapiens
tctgcctggcctggctcccc

SEQ ID NO: 3277616 - DNA, 10 bp, Homo sapiens
tctgcctggg

SEQ ID NO: 3277617 - DNA, 18 bp, Homo sapiens
tctgcctgggcctgtgca

SEQ ID NO: 3277618 - DNA, 21 bp, Homo sapiens
tctgcctgggcctgtgcagca

SEQ ID NO: 3277619 - DNA, 22 bp, Homo sapiens
tctgcctgggcctgtgcagcag

SEQ ID NO: 3277620 - DNA, 20 bp, Homo sapiens
tctgcctggtggtcagatgc

SEQ ID NO: 3277621 - DNA, 22 bp, Homo sapiens
tctgcctgttataactctgcac

SEQ ID NO: 3277622 - DNA, 23 bp, Homo sapiens
tctgccttactggtttccccagg

SEQ ID NO: 3277623 - DNA, 19 bp, Homo sapiens
tctgccttagtctcagttt

SEQ ID NO: 3277624 - DNA, 13 bp, Homo sapiens
tctgccttcccaa

SEQ ID NO: 3277625 - DNA, 14 bp, Homo sapiens
tctgccttggcctc

SEQ ID NO: 3277626 - DNA, 20 bp, Homo sapiens
tctgccttggcttggacaaa

SEQ ID NO: 3277627 - DNA, 16 bp, Homo sapiens
tctgcctttgacattt

SEQ ID NO: 3277628 - DNA, 13 bp, Homo sapiens
tctgcgcctcagg

SEQ ID NO: 3277629 - DNA, 22 bp, Homo sapiens
tctgcggaccccagctgtgagc

SEQ ID NO: 3277630 - DNA, 15 bp, Homo sapiens
tctgcgtctgtgttg

SEQ ID NO: 3277631 - DNA, 20 bp, Homo sapiens
tctgctaggcgctggggaga

SEQ ID NO: 3277632 - DNA, 13 bp, Homo sapiens
tctgctcagccaa

SEQ ID NO: 3277633 - DNA, 15 bp, Homo sapiens
tctgctcagccaagc

SEQ ID NO: 3277634 - DNA, 17 bp, Homo sapiens
tctgctcagccaagctt

SEQ ID NO: 3277635 - DNA, 10 bp, Homo sapiens
tctgctccac

SEQ ID NO: 3277636 - DNA, 12 bp, Homo sapiens
tctgctccacca

SEQ ID NO: 3277637 - DNA, 14 bp, Homo sapiens
tctgctccaccctt

SEQ ID NO: 3277638 - DNA, 16 bp, Homo sapiens
tctgctccacccttgg

SEQ ID NO: 3277639 - DNA, 13 bp, Homo sapiens
tctgctccctctg

SEQ ID NO: 3277640 - DNA, 12 bp, Homo sapiens
tctgctcctctc

SEQ ID NO: 3277641 - DNA, 18 bp, Homo sapiens
tctgctcctctccccagc

SEQ ID NO: 3277642 - DNA, 22 bp, Homo sapiens
tctgctcctggagcctttgaat

SEQ ID NO: 3277643 - DNA, 19 bp, Homo sapiens
tctgctcgccctcctttct

SEQ ID NO: 3277644 - DNA, 18 bp, Homo sapiens
tctgctctagccaggagt

SEQ ID NO: 3277645 - DNA, 18 bp, Homo sapiens
tctgctctagggaatctg

SEQ ID NO: 3277646 - DNA, 20 bp, Homo sapiens
tctgctctcatccattcctc

SEQ ID NO: 3277647 - DNA, 18 bp, Homo sapiens
tctgctctttctctgcca

SEQ ID NO: 3277648 - DNA, 13 bp, Homo sapiens
tctgctgaaggaa

SEQ ID NO: 3277649 - DNA, 16 bp, Homo sapiens
tctgctgaatgtaaaa

SEQ ID NO: 3277650 - DNA, 20 bp, Homo sapiens
tctgctgaatgtaaaagaaa

SEQ ID NO: 3277651 - DNA, 17 bp, Homo sapiens
tctgctgacagacacag

SEQ ID NO: 3277652 - DNA, 18 bp, Homo sapiens
tctgctgacagacacagg

SEQ ID NO: 3277653 - DNA, 19 bp, Homo sapiens
tctgctgacagacacaggc

SEQ ID NO: 3277654 - DNA, 17 bp, Homo sapiens
tctgctgagctgggccc

SEQ ID NO: 3277655 - DNA, 13 bp, Homo sapiens
tctgctgatataa

SEQ ID NO: 3277656 - DNA, 18 bp, Homo sapiens
tctgctgatataatatca

SEQ ID NO: 3277657 - DNA, 13 bp, Homo sapiens
tctgctgcccagg

SEQ ID NO: 3277658 - DNA, 15 bp, Homo sapiens
tctgctgcccaggcc

SEQ ID NO: 3277659 - DNA, 16 bp, Homo sapiens
tctgctgcccaggcca

SEQ ID NO: 3277660 - DNA, 23 bp, Homo sapiens
tctgctgcctgcccgcacagcag

SEQ ID NO: 3277661 - DNA, 20 bp, Homo sapiens
tctgctggcccagccaaacc

SEQ ID NO: 3277662 - DNA, 18 bp, Homo sapiens
tctgctgggagttctaga

SEQ ID NO: 3277663 - DNA, 18 bp, Homo sapiens
tctgctggttcctgactg

SEQ ID NO: 3277664 - DNA, 19 bp, Homo sapiens
tctgctgttgccatagccc

SEQ ID NO: 3277665 - DNA, 21 bp, Homo sapiens
tctgctgttgccatagcccca

SEQ ID NO: 3277666 - DNA, 13 bp, Homo sapiens
tctgcttcagcct

SEQ ID NO: 3277667 - DNA, 13 bp, Homo sapiens
tctgcttcagtgg

SEQ ID NO: 3277668 - DNA, 14 bp, Homo sapiens
tctgcttcagtgga

SEQ ID NO: 3277669 - DNA, 13 bp, Homo sapiens
tctgcttctctca

SEQ ID NO: 3277670 - DNA, 14 bp, Homo sapiens
tctgcttctctgac

SEQ ID NO: 3277671 - DNA, 22 bp, Homo sapiens
tctgcttctctgacttctgcct

SEQ ID NO: 3277672 - DNA, 22 bp, Homo sapiens
tctgctttaaagggcctgcctg

SEQ ID NO: 3277673 - DNA, 15 bp, Homo sapiens
tctgctttatctttt

SEQ ID NO: 3277674 - DNA, 19 bp, Homo sapiens
tctgctttctttgattctc

SEQ ID NO: 3277675 - DNA, 18 bp, Homo sapiens
tctgcttttctgccctgg

SEQ ID NO: 3277676 - DNA, 20 bp, Homo sapiens
tctgcttttctgccctggct

SEQ ID NO: 3277677 - DNA, 13 bp, Homo sapiens
tctggaagaaaaa

SEQ ID NO: 3277678 - DNA, 17 bp, Homo sapiens
tctggaagcccctgggc

SEQ ID NO: 3277679 - DNA, 18 bp, Homo sapiens
tctggaagccctggagac

SEQ ID NO: 3277680 - DNA, 15 bp, Homo sapiens
tctggaaggctggct

SEQ ID NO: 3277681 - DNA, 16 bp, Homo sapiens
tctggaaggctggctg

SEQ ID NO: 3277682 - DNA, 19 bp, Homo sapiens
tctggaagggcagcatata

SEQ ID NO: 3277683 - DNA, 13 bp, Homo sapiens
tctggaagtccaa

SEQ ID NO: 3277684 - DNA, 16 bp, Homo sapiens
tctggaatgtaatcaa

SEQ ID NO: 3277685 - DNA, 22 bp, Homo sapiens
tctggaatgtaatcaatgtttc

SEQ ID NO: 3277686 - DNA, 12 bp, Homo sapiens
tctggacaagcc

SEQ ID NO: 3277687 - DNA, 14 bp, Homo sapiens
tctggacaggcatg

SEQ ID NO: 3277688 - DNA, 21 bp, Homo sapiens
tctggacaggcatgttctctg

SEQ ID NO: 3277689 - DNA, 19 bp, Homo sapiens
tctggacggcaggctcact

SEQ ID NO: 3277690 - DNA, 15 bp, Homo sapiens
tctggactcctctgt

SEQ ID NO: 3277691 - DNA, 18 bp, Homo sapiens
tctggactcctctgtcca

SEQ ID NO: 3277692 - DNA, 14 bp, Homo sapiens
tctggactctaaag

SEQ ID NO: 3277693 - DNA, 15 bp, Homo sapiens
tctggactctaaaga

SEQ ID NO: 3277694 - DNA, 22 bp, Homo sapiens
tctggactggcgttcacctccc

SEQ ID NO: 3277695 - DNA, 17 bp, Homo sapiens
tctggagacagccccag

SEQ ID NO: 3277696 - DNA, 21 bp, Homo sapiens
tctggagaccagggagccttt

SEQ ID NO: 3277697 - DNA, 13 bp, Homo sapiens
tctggagcccttg

SEQ ID NO: 3277698 - DNA, 15 bp, Homo sapiens
tctggagcggctgct

SEQ ID NO: 3277699 - DNA, 17 bp, Homo sapiens
tctggagcggctgctcg

SEQ ID NO: 3277700 - DNA, 18 bp, Homo sapiens
tctggaggaaagggagga

SEQ ID NO: 3277701 - DNA, 24 bp, Homo sapiens
tctggaggctgcagagctgaccca

SEQ ID NO: 3277702 - DNA, 16 bp, Homo sapiens
tctggagggaaacacc

SEQ ID NO: 3277703 - DNA, 14 bp, Homo sapiens
tctggagtgggcag

SEQ ID NO: 3277704 - DNA, 15 bp, Homo sapiens
tctggatatttgcac

SEQ ID NO: 3277705 - DNA, 18 bp, Homo sapiens
tctggatatttgcactta

SEQ ID NO: 3277706 - DNA, 20 bp, Homo sapiens
tctggatatttgcacttatg

SEQ ID NO: 3277707 - DNA, 23 bp, Homo sapiens
tctggattatgttatacaaggca

SEQ ID NO: 3277708 - DNA, 15 bp, Homo sapiens
tctggattctgggag

SEQ ID NO: 3277709 - DNA, 23 bp, Homo sapiens
tctggattgtggttccatgcagc

SEQ ID NO: 3277710 - DNA, 18 bp, Homo sapiens
tctggcattagaattatt

SEQ ID NO: 3277711 - DNA, 18 bp, Homo sapiens
tctggccaggcactgcct

SEQ ID NO: 3277712 - DNA, 14 bp, Homo sapiens
tctggccaggcatg

SEQ ID NO: 3277713 - DNA, 9 bp, Homo sapiens
tctggccct

SEQ ID NO: 3277714 - DNA, 22 bp, Homo sapiens
tctggccctcggtggctgcaca

SEQ ID NO: 3277715 - DNA, 10 bp, Homo sapiens
tctggccctg

SEQ ID NO: 3277716 - DNA, 23 bp, Homo sapiens
tctggccctgtgtaggggcaggg

SEQ ID NO: 3277717 - DNA, 19 bp, Homo sapiens
tctggcccttgcctttgtg

SEQ ID NO: 3277718 - DNA, 17 bp, Homo sapiens
tctgagccagattacag

SEQ ID NO: 3277719 - DNA, 20 bp, Homo sapiens
tctgagccagtgctttaatg

SEQ ID NO: 3277720 - DNA, 13 bp, Homo sapiens
tctgagcccaagc

SEQ ID NO: 3277721 - DNA, 17 bp, Homo sapiens
tctgagcccagctgcct

SEQ ID NO: 3277722 - DNA, 12 bp, Homo sapiens
tctgagcccagg

SEQ ID NO: 3277723 - DNA, 13 bp, Homo sapiens
tctgagcccaggc

SEQ ID NO: 3277724 - DNA, 18 bp, Homo sapiens
tctgagcccccggctagt

SEQ ID NO: 3277725 - DNA, 16 bp, Homo sapiens
tctgagcccgggctgc

SEQ ID NO: 3277726 - DNA, 18 bp, Homo sapiens
tctgagcccgggctgcct

SEQ ID NO: 3277727 - DNA, 20 bp, Homo sapiens
tctgagcccgggctgcctgg

SEQ ID NO: 3277728 - DNA, 21 bp, Homo sapiens
tctgagcccgggctgcctggg

SEQ ID NO: 3277729 - DNA, 20 bp, Homo sapiens
tctgagccctggtgtgtttc

SEQ ID NO: 3277730 - DNA, 21 bp, Homo sapiens
tctgagcgcctccatccaagg

SEQ ID NO: 3277731 - DNA, 22 bp, Homo sapiens
tctgagctatttcatctatttt

SEQ ID NO: 3277732 - DNA, 14 bp, Homo sapiens
tctgagctgctcac

SEQ ID NO: 3277733 - DNA, 16 bp, Homo sapiens
tctgaggaatccagac

SEQ ID NO: 3277734 - DNA, 13 bp, Homo sapiens
tctgagggaggag

SEQ ID NO: 3277735 - DNA, 18 bp, Homo sapiens
tctgagggaggaggccac

SEQ ID NO: 3277736 - DNA, 20 bp, Homo sapiens
tctgagggaggaggccacct

SEQ ID NO: 3277737 - DNA, 16 bp, Homo sapiens
tctgaggggagggggt

SEQ ID NO: 3277738 - DNA, 22 bp, Homo sapiens
tctgaggggagggggtccgtgg

SEQ ID NO: 3277739 - DNA, 16 bp, Homo sapiens
tctgaggtccctgtgt

SEQ ID NO: 3277740 - DNA, 21 bp, Homo sapiens
tctgaggttggatttgctcat

SEQ ID NO: 3277741 - DNA, 23 bp, Homo sapiens
tctgagtagagcttgtaataaat

SEQ ID NO: 3277742 - DNA, 16 bp, Homo sapiens
tctgagtattctcata

SEQ ID NO: 3277743 - DNA, 18 bp, Homo sapiens
tctgagtccactgctcca

SEQ ID NO: 3277744 - DNA, 16 bp, Homo sapiens
tctgagtcctgtctct

SEQ ID NO: 3277745 - DNA, 13 bp, Homo sapiens
tctgagtctgagt

SEQ ID NO: 3277746 - DNA, 19 bp, Homo sapiens
tctgagtggtggttccttt

SEQ ID NO: 3277747 - DNA, 24 bp, Homo sapiens
tctgagtgtttttactacagttgt

SEQ ID NO: 3277748 - DNA, 12 bp, Homo sapiens
tctgagttatgt

SEQ ID NO: 3277749 - DNA, 19 bp, Homo sapiens
tctgagttgccaagacaaa

SEQ ID NO: 3277750 - DNA, 21 bp, Homo sapiens
tctgagttgccaagacaaatc

SEQ ID NO: 3277751 - DNA, 15 bp, Homo sapiens
tctgagtttcattct

SEQ ID NO: 3277752 - DNA, 22 bp, Homo sapiens
tctgagtttcattctcctgcct

SEQ ID NO: 3277753 - DNA, 12 bp, Homo sapiens
tctgatattaat

SEQ ID NO: 3277754 - DNA, 15 bp, Homo sapiens
tctgatattaatcaa

SEQ ID NO: 3277755 - DNA, 12 bp, Homo sapiens
tctgatcaaaat

SEQ ID NO: 3277756 - DNA, 16 bp, Homo sapiens
tctgatcacttcatgt

SEQ ID NO: 3277757 - DNA, 19 bp, Homo sapiens
tctgatcttgtgctcagca

SEQ ID NO: 3277758 - DNA, 16 bp, Homo sapiens
tctgatggtgagctgg

SEQ ID NO: 3277759 - DNA, 17 bp, Homo sapiens
tctgatggtgagctggg

SEQ ID NO: 3277760 - DNA, 18 bp, Homo sapiens
tctgatggtgagctggga

SEQ ID NO: 3277761 - DNA, 20 bp, Homo sapiens
tctgatgtgtgttgtcagcc

SEQ ID NO: 3277762 - DNA, 19 bp, Homo sapiens
tctgattaaaatgcttcct

SEQ ID NO: 3277763 - DNA, 15 bp, Homo sapiens
tctgattaatatatt

SEQ ID NO: 3277764 - DNA, 14 bp, Homo sapiens
tctgattactgtcc

SEQ ID NO: 3277765 - DNA, 13 bp, Homo sapiens
tctgattccatat

SEQ ID NO: 3277766 - DNA, 20 bp, Homo sapiens
tctgattcccaagctctgct

SEQ ID NO: 3277767 - DNA, 16 bp, Homo sapiens
tctgattggacatttt

SEQ ID NO: 3277768 - DNA, 17 bp, Homo sapiens
tctgattggcttgtaga

SEQ ID NO: 3277769 - DNA, 23 bp, Homo sapiens
tctgatttatggtttttttaagt

SEQ ID NO: 3277770 - DNA, 13 bp, Homo sapiens
tctgatttcagga

SEQ ID NO: 3277771 - DNA, 20 bp, Homo sapiens
tctgatttgtattaaaattg

SEQ ID NO: 3277772 - DNA, 20 bp, Homo sapiens
tctgatttgtccctatgcat

SEQ ID NO: 3277773 - DNA, 14 bp, Homo sapiens
tctgattttggcat

SEQ ID NO: 3277774 - DNA, 21 bp, Homo sapiens
tctgattttgtgcaaaagctt

SEQ ID NO: 3277775 - DNA, 19 bp, Homo sapiens
tctgcaaaaatatttataa

SEQ ID NO: 3277776 - DNA, 20 bp, Homo sapiens
tctgcaaaaatatttataaa

SEQ ID NO: 3277777 - DNA, 14 bp, Homo sapiens
tctgcaaaggcctg

SEQ ID NO: 3277778 - DNA, 17 bp, Homo sapiens
tctgcaaaggcctgggc

SEQ ID NO: 3277779 - DNA, 14 bp, Homo sapiens
tctgcaacaagcat

SEQ ID NO: 3277780 - DNA, 17 bp, Homo sapiens
tctgcaactagccaagg

SEQ ID NO: 3277781 - DNA, 18 bp, Homo sapiens
tctgcaactagccaaggc

SEQ ID NO: 3277782 - DNA, 19 bp, Homo sapiens
tctgcaactagccaaggct

SEQ ID NO: 3277783 - DNA, 14 bp, Homo sapiens
tctgcaactttaag

SEQ ID NO: 3277784 - DNA, 21 bp, Homo sapiens
tctgcaactttaagcagctct

SEQ ID NO: 3277785 - DNA, 22 bp, Homo sapiens
tctgcaactttaagcagctctt

SEQ ID NO: 3277786 - DNA, 14 bp, Homo sapiens
tctgcaagtcagag

SEQ ID NO: 3277787 - DNA, 17 bp, Homo sapiens
tctgcaagtgtctggag

SEQ ID NO: 3277788 - DNA, 19 bp, Homo sapiens
tctgcaatgggcactggga

SEQ ID NO: 3277789 - DNA, 16 bp, Homo sapiens
tctgcaattcaaaagt

SEQ ID NO: 3277790 - DNA, 19 bp, Homo sapiens
tctgcacagacaagcagcc

SEQ ID NO: 3277791 - DNA, 22 bp, Homo sapiens
tctgcacagacaagcagccctt

SEQ ID NO: 3277792 - DNA, 12 bp, Homo sapiens
tctgcacatgaa

SEQ ID NO: 3277793 - DNA, 15 bp, Homo sapiens
tctgcacatgtcttg

SEQ ID NO: 3277794 - DNA, 16 bp, Homo sapiens
tctgcacatgtcttgt

SEQ ID NO: 3277795 - DNA, 21 bp, Homo sapiens
tctgcacatgtcttgtacatg

SEQ ID NO: 3277796 - DNA, 13 bp, Homo sapiens
tctgcacccctct

SEQ ID NO: 3277797 - DNA, 14 bp, Homo sapiens
tctgcaccctccac

SEQ ID NO: 3277798 - DNA, 18 bp, Homo sapiens
tctgcaccctccaccctg

SEQ ID NO: 3277799 - DNA, 19 bp, Homo sapiens
tctgcactactcctctgca

SEQ ID NO: 3277800 - DNA, 20 bp, Homo sapiens
tctgcactactgacatgtgg

SEQ ID NO: 3277801 - DNA, 16 bp, Homo sapiens
tctgcagaacagtgaa

SEQ ID NO: 3277802 - DNA, 23 bp, Homo sapiens
tctgcagacacgccttcccctca

SEQ ID NO: 3277803 - DNA, 22 bp, Homo sapiens
tctgcagctatgcgcaatgtgg

SEQ ID NO: 3277804 - DNA, 22 bp, Homo sapiens
tctgcaggcctaggtgcagctc

SEQ ID NO: 3277805 - DNA, 23 bp, Homo sapiens
tctgcagtaaaacacatttggga

SEQ ID NO: 3277806 - DNA, 17 bp, Homo sapiens
tctgcagttctttttgt

SEQ ID NO: 3277807 - DNA, 16 bp, Homo sapiens
tctgcatcatctgtag

SEQ ID NO: 3277808 - DNA, 18 bp, Homo sapiens
tctgcatcatctgtagat

SEQ ID NO: 3277809 - DNA, 19 bp, Homo sapiens
tctgcatcccagcacctgc

SEQ ID NO: 3277810 - DNA, 24 bp, Homo sapiens
tctgcatcccagcacctgcctcct

SEQ ID NO: 3277811 - DNA, 17 bp, Homo sapiens
tctgcatctcctgtctt

SEQ ID NO: 3277812 - DNA, 22 bp, Homo sapiens
tctgcattcctgtaacttttaa

SEQ ID NO: 3277813 - DNA, 20 bp, Homo sapiens
tctgcattgttattgtggaa

SEQ ID NO: 3277814 - DNA, 14 bp, Homo sapiens
tctgcatttagcac

SEQ ID NO: 3277815 - DNA, 19 bp, Homo sapiens
tctgccaaaggatgtgata

SEQ ID NO: 3277816 - DNA, 20 bp, Homo sapiens
tctgccacaggccatatttg

SEQ ID NO: 3277817 - DNA, 12 bp, Homo sapiens
tctgccagacct

SEQ ID NO: 3277818 - DNA, 13 bp, Homo sapiens
tctgccaggccca

SEQ ID NO: 3277819 - DNA, 14 bp, Homo sapiens
tctgccagggagct

SEQ ID NO: 3277820 - DNA, 13 bp, Homo sapiens
tctgccagtgaca

SEQ ID NO: 3277821 - DNA, 21 bp, Homo sapiens
tctgccagtgacagacaggct

SEQ ID NO: 3277822 - DNA, 23 bp, Homo sapiens
tctgccagtgacagacaggctct

SEQ ID NO: 3277823 - DNA, 15 bp, Homo sapiens
tctgccagtggatcc

SEQ ID NO: 3277824 - DNA, 18 bp, Homo sapiens
tctgccatattctgttgg

SEQ ID NO: 3277825 - DNA, 16 bp, Homo sapiens
tctgccatgtccatag

SEQ ID NO: 3277826 - DNA, 15 bp, Homo sapiens
tctgccattgggacc

SEQ ID NO: 3277827 - DNA, 19 bp, Homo sapiens
tctgcccaaaaatatggtt

SEQ ID NO: 3277828 - DNA, 22 bp, Homo sapiens
tctgcccacctcagcctcccaa

SEQ ID NO: 3277829 - DNA, 19 bp, Homo sapiens
tctgcccacgatcccctcc

SEQ ID NO: 3277830 - DNA, 23 bp, Homo sapiens
tctgcccacgatcccctccccca

SEQ ID NO: 3277831 - DNA, 17 bp, Homo sapiens
tctgcccacgcagagga

SEQ ID NO: 3277832 - DNA, 20 bp, Homo sapiens
tctgcccacgcagaggacgc

SEQ ID NO: 3277833 - DNA, 19 bp, Homo sapiens
tctgcccacttccccttcc

SEQ ID NO: 3277834 - DNA, 23 bp, Homo sapiens
tctgcccaggggtgccccctcct

SEQ ID NO: 3277835 - DNA, 18 bp, Homo sapiens
tctgccccaagcagccag

SEQ ID NO: 3277836 - DNA, 14 bp, Homo sapiens
tctgccccaagccc

SEQ ID NO: 3277837 - DNA, 22 bp, Homo sapiens
tctgccccaagcccccaacccc

SEQ ID NO: 3277838 - DNA, 13 bp, Homo sapiens
tctcgagcccaga

SEQ ID NO: 3277839 - DNA, 22 bp, Homo sapiens
tctcggatgacaccctggcctg

SEQ ID NO: 3277840 - DNA, 23 bp, Homo sapiens
tctcggatgaccaaaccagcctt

SEQ ID NO: 3277841 - DNA, 13 bp, Homo sapiens
tctcggccaggca

SEQ ID NO: 3277842 - DNA, 15 bp, Homo sapiens
tctcggctcactgca

SEQ ID NO: 3277843 - DNA, 13 bp, Homo sapiens
tctcggctcaggc

SEQ ID NO: 3277844 - DNA, 19 bp, Homo sapiens
tctcggctcaggctctgct

SEQ ID NO: 3277845 - DNA, 21 bp, Homo sapiens
tctcggctcaggctctgctgg

SEQ ID NO: 3277846 - DNA, 23 bp, Homo sapiens
tctctaaagcactaccgattctt

SEQ ID NO: 3277847 - DNA, 22 bp, Homo sapiens
tctctaacttcaaggcccatat

SEQ ID NO: 3277848 - DNA, 15 bp, Homo sapiens
tctctaatcgaaaga

SEQ ID NO: 3277849 - DNA, 15 bp, Homo sapiens
tctctaattttggat

SEQ ID NO: 3277850 - DNA, 16 bp, Homo sapiens
tctctaattttggata

SEQ ID NO: 3277851 - DNA, 12 bp, Homo sapiens
tctctactgctt

SEQ ID NO: 3277852 - DNA, 16 bp, Homo sapiens
tctctaggctgttttc

SEQ ID NO: 3277853 - DNA, 22 bp, Homo sapiens
tctctaggtgtgtccacagagt

SEQ ID NO: 3277854 - DNA, 15 bp, Homo sapiens
tctctatgtatgtag

SEQ ID NO: 3277855 - DNA, 21 bp, Homo sapiens
tctctattggaggtgagatca

SEQ ID NO: 3277856 - DNA, 15 bp, Homo sapiens
tctctatttaaattc

SEQ ID NO: 3277857 - DNA, 16 bp, Homo sapiens
tctctatttaaattct

SEQ ID NO: 3277858 - DNA, 14 bp, Homo sapiens
tctctcagagcatc

SEQ ID NO: 3277859 - DNA, 16 bp, Homo sapiens
tctctcagagccctca

SEQ ID NO: 3277860 - DNA, 14 bp, Homo sapiens
tctctcaggagcac

SEQ ID NO: 3277861 - DNA, 15 bp, Homo sapiens
tctctcaggagcaca

SEQ ID NO: 3277862 - DNA, 18 bp, Homo sapiens
tctctcaggagcacaggc

SEQ ID NO: 3277863 - DNA, 13 bp, Homo sapiens
tctctccagatgt

SEQ ID NO: 3277864 - DNA, 13 bp, Homo sapiens
tctctccaggatc

SEQ ID NO: 3277865 - DNA, 21 bp, Homo sapiens
tctctcccaccccggcctcca

SEQ ID NO: 3277866 - DNA, 17 bp, Homo sapiens
tctctcccatcctgggg

SEQ ID NO: 3277867 - DNA, 19 bp, Homo sapiens
tctctcccatcctggggca

SEQ ID NO: 3277868 - DNA, 22 bp, Homo sapiens
tctctcccctcaaagtctgcaa

SEQ ID NO: 3277869 - DNA, 21 bp, Homo sapiens
tctctccctcccctgccattt

SEQ ID NO: 3277870 - DNA, 17 bp, Homo sapiens
tctctccgccattgaga

SEQ ID NO: 3277871 - DNA, 12 bp, Homo sapiens
tctctcctctct

SEQ ID NO: 3277872 - DNA, 13 bp, Homo sapiens
tctctcctggcct

SEQ ID NO: 3277873 - DNA, 20 bp, Homo sapiens
tctctcctgtaagccaaaga

SEQ ID NO: 3277874 - DNA, 14 bp, Homo sapiens
tctctcctttcttt

SEQ ID NO: 3277875 - DNA, 22 bp, Homo sapiens
tctctcctttctttttcttctt

SEQ ID NO: 3277876 - DNA, 11 bp, Homo sapiens
tctctcctttt

SEQ ID NO: 3277877 - DNA, 13 bp, Homo sapiens
tctctccttttct

SEQ ID NO: 3277878 - DNA, 15 bp, Homo sapiens
tctctcggctcccca

SEQ ID NO: 3277879 - DNA, 15 bp, Homo sapiens
tctctcggttccacg

SEQ ID NO: 3277880 - DNA, 22 bp, Homo sapiens
tctctctaggagggagccttgt

SEQ ID NO: 3277881 - DNA, 23 bp, Homo sapiens
tctctctcactcacattttctca

SEQ ID NO: 3277882 - DNA, 13 bp, Homo sapiens
tctctctcctctc

SEQ ID NO: 3277883 - DNA, 14 bp, Homo sapiens
tctctctctaaggt

SEQ ID NO: 3277884 - DNA, 14 bp, Homo sapiens
tctctctctacaaa

SEQ ID NO: 3277885 - DNA, 14 bp, Homo sapiens
tctctctctctccc

SEQ ID NO: 3277886 - DNA, 19 bp, Homo sapiens
tctctctgctgagctgggc

SEQ ID NO: 3277887 - DNA, 18 bp, Homo sapiens
tctctctggggccctggg

SEQ ID NO: 3277888 - DNA, 19 bp, Homo sapiens
tctctctggggccctgggc

SEQ ID NO: 3277889 - DNA, 21 bp, Homo sapiens
tctctctggggccctgggcct

SEQ ID NO: 3277890 - DNA, 12 bp, Homo sapiens
tctctctgtgaa

SEQ ID NO: 3277891 - DNA, 14 bp, Homo sapiens
tctctctgtgaata

SEQ ID NO: 3277892 - DNA, 20 bp, Homo sapiens
tctctctgtgaatacaatta

SEQ ID NO: 3277893 - DNA, 19 bp, Homo sapiens
tctctctgtgtctttctct

SEQ ID NO: 3277894 - DNA, 14 bp, Homo sapiens
tctctcttctgctc

SEQ ID NO: 3277895 - DNA, 16 bp, Homo sapiens
tctctcttctgctcca

SEQ ID NO: 3277896 - DNA, 17 bp, Homo sapiens
tctctctttatacagct

SEQ ID NO: 3277897 - DNA, 15 bp, Homo sapiens
tctctgaacacaggc

SEQ ID NO: 3277898 - DNA, 16 bp, Homo sapiens
tctctgaacacaggca

SEQ ID NO: 3277899 - DNA, 19 bp, Homo sapiens
tctctgaacacaggcagct

SEQ ID NO: 3277900 - DNA, 20 bp, Homo sapiens
tctctgaacacaggcagctt

SEQ ID NO: 3277901 - DNA, 14 bp, Homo sapiens
tctctgaagcatgt

SEQ ID NO: 3277902 - DNA, 16 bp, Homo sapiens
tctctgaagcatgttt

SEQ ID NO: 3277903 - DNA, 19 bp, Homo sapiens
tctctgaagcatgtttcat

SEQ ID NO: 3277904 - DNA, 22 bp, Homo sapiens
tctctgaagcatgtttcatgtt

SEQ ID NO: 3277905 - DNA, 15 bp, Homo sapiens
tctctgaatgcccca

SEQ ID NO: 3277906 - DNA, 22 bp, Homo sapiens
tctctgaattcctgtcttccaa

SEQ ID NO: 3277907 - DNA, 16 bp, Homo sapiens
tctctgactaaaaata

SEQ ID NO: 3277908 - DNA, 16 bp, Homo sapiens
tctctgacttctgcct

SEQ ID NO: 3277909 - DNA, 13 bp, Homo sapiens
tctctgaggacac

SEQ ID NO: 3277910 - DNA, 18 bp, Homo sapiens
tctctgagtggtggttcc

SEQ ID NO: 3277911 - DNA, 22 bp, Homo sapiens
tctctgagttctgtgtattttc

SEQ ID NO: 3277912 - DNA, 22 bp, Homo sapiens
tctctgatcttgtgctcagcat

SEQ ID NO: 3277913 - DNA, 19 bp, Homo sapiens
tctctgattttcaaagctt

SEQ ID NO: 3277914 - DNA, 12 bp, Homo sapiens
tctctgcaatgc

SEQ ID NO: 3277915 - DNA, 20 bp, Homo sapiens
tctctgcagtaaaacacatt

SEQ ID NO: 3277916 - DNA, 17 bp, Homo sapiens
tctctgcccctgatcac

SEQ ID NO: 3277917 - DNA, 22 bp, Homo sapiens
tctctgccgctacctccctccc

SEQ ID NO: 3277918 - DNA, 21 bp, Homo sapiens
tctctgcctagaatctttatt

SEQ ID NO: 3277919 - DNA, 19 bp, Homo sapiens
tctctgcctttgacattta

SEQ ID NO: 3277920 - DNA, 21 bp, Homo sapiens
tctctgcctttgacatttaat

SEQ ID NO: 3277921 - DNA, 16 bp, Homo sapiens
tctctgctagatttct

SEQ ID NO: 3277922 - DNA, 18 bp, Homo sapiens
tctctgctagatttctac

SEQ ID NO: 3277923 - DNA, 12 bp, Homo sapiens
tctctgctccac

SEQ ID NO: 3277924 - DNA, 13 bp, Homo sapiens
tctctgctccacc

SEQ ID NO: 3277925 - DNA, 15 bp, Homo sapiens
tctctgctccaccac

SEQ ID NO: 3277926 - DNA, 14 bp, Homo sapiens
tctctgctccttca

SEQ ID NO: 3277927 - DNA, 15 bp, Homo sapiens
tctctgctctagcca

SEQ ID NO: 3277928 - DNA, 16 bp, Homo sapiens
tctctgctctagccag

SEQ ID NO: 3277929 - DNA, 18 bp, Homo sapiens
tctctgctctagccagga

SEQ ID NO: 3277930 - DNA, 15 bp, Homo sapiens
tctctgctgagctgg

SEQ ID NO: 3277931 - DNA, 16 bp, Homo sapiens
tctctgctgagctggg

SEQ ID NO: 3277932 - DNA, 15 bp, Homo sapiens
tctctgctggcccag

SEQ ID NO: 3277933 - DNA, 16 bp, Homo sapiens
tctctgctggcccagc

SEQ ID NO: 3277934 - DNA, 14 bp, Homo sapiens
tctctggcatttgt

SEQ ID NO: 3277935 - DNA, 19 bp, Homo sapiens
tctctggcccttcttgcct

SEQ ID NO: 3277936 - DNA, 11 bp, Homo sapiens
tctctggcctc

SEQ ID NO: 3277937 - DNA, 17 bp, Homo sapiens
tctctggcctcccaccc

SEQ ID NO: 3277938 - DNA, 21 bp, Homo sapiens
tctctggccttcggcctccat

SEQ ID NO: 3277939 - DNA, 22 bp, Homo sapiens
tctctggctgtaaggctctaga

SEQ ID NO: 3277940 - DNA, 23 bp, Homo sapiens
tctctggctgtaaggctctagat

SEQ ID NO: 3277941 - DNA, 17 bp, Homo sapiens
tctctgggacctcctta

SEQ ID NO: 3277942 - DNA, 16 bp, Homo sapiens
tctctggggcagatcc

SEQ ID NO: 3277943 - DNA, 17 bp, Homo sapiens
tctctggggcagatccc

SEQ ID NO: 3277944 - DNA, 22 bp, Homo sapiens
tctctggggcagatccccactg

SEQ ID NO: 3277945 - DNA, 17 bp, Homo sapiens
tctctggtaatattgac

SEQ ID NO: 3277946 - DNA, 21 bp, Homo sapiens
tctctgtacttttcattctct

SEQ ID NO: 3277947 - DNA, 15 bp, Homo sapiens
tctctgtagttccta

SEQ ID NO: 3277948 - DNA, 16 bp, Homo sapiens
tctctgtataaacatt

SEQ ID NO: 3277949 - DNA, 15 bp, Homo sapiens
tctctgtcctacttc

SEQ ID NO: 3277950 - DNA, 16 bp, Homo sapiens
tcttaacttcttgctt

SEQ ID NO: 3277951 - DNA, 15 bp, Homo sapiens
tcttaagacttttgg

SEQ ID NO: 3277952 - DNA, 23 bp, Homo sapiens
tcttaagtcccagtatacctcat

SEQ ID NO: 3277953 - DNA, 12 bp, Homo sapiens
tcttaatctgtg

SEQ ID NO: 3277954 - DNA, 15 bp, Homo sapiens
tcttaatctgtgtgt

SEQ ID NO: 3277955 - DNA, 15 bp, Homo sapiens
tcttaattaatttga

SEQ ID NO: 3277956 - DNA, 14 bp, Homo sapiens
tcttaattctttgt

SEQ ID NO: 3277957 - DNA, 19 bp, Homo sapiens
tcttaattctttgttctgt

SEQ ID NO: 3277958 - DNA, 16 bp, Homo sapiens
tcttacaattgcactg

SEQ ID NO: 3277959 - DNA, 16 bp, Homo sapiens
tcttacacatacagtt

SEQ ID NO: 3277960 - DNA, 13 bp, Homo sapiens
tcttacacttctt

SEQ ID NO: 3277961 - DNA, 19 bp, Homo sapiens
tcttacataaaccattttt

SEQ ID NO: 3277962 - DNA, 16 bp, Homo sapiens
tcttaccacagtgttt

SEQ ID NO: 3277963 - DNA, 18 bp, Homo sapiens
tcttaccacagtgtttta

SEQ ID NO: 3277964 - DNA, 13 bp, Homo sapiens
tcttaccagatgc

SEQ ID NO: 3277965 - DNA, 13 bp, Homo sapiens
tcttacccaaagc

SEQ ID NO: 3277966 - DNA, 16 bp, Homo sapiens
tcttacccaatttccc

SEQ ID NO: 3277967 - DNA, 17 bp, Homo sapiens
tcttacccatatatctt

SEQ ID NO: 3277968 - DNA, 20 bp, Homo sapiens
tcttaccctagttctcttat

SEQ ID NO: 3277969 - DNA, 23 bp, Homo sapiens
tcttaccctagttctcttatctt

SEQ ID NO: 3277970 - DNA, 21 bp, Homo sapiens
tcttacctgtatgtctccagt

SEQ ID NO: 3277971 - DNA, 14 bp, Homo sapiens
tcttactaaacatt

SEQ ID NO: 3277972 - DNA, 17 bp, Homo sapiens
tcttactattaagcagt

SEQ ID NO: 3277973 - DNA, 18 bp, Homo sapiens
tcttactcattactgcaa

SEQ ID NO: 3277974 - DNA, 17 bp, Homo sapiens
tcttacttttaaatgca

SEQ ID NO: 3277975 - DNA, 13 bp, Homo sapiens
tcttagaaatgaa

SEQ ID NO: 3277976 - DNA, 14 bp, Homo sapiens
tcttagaaatgaag

SEQ ID NO: 3277977 - DNA, 24 bp, Homo sapiens
tcttagagattaaaccaattataa

SEQ ID NO: 3277978 - DNA, 21 bp, Homo sapiens
tcttagagccttttatctgca

SEQ ID NO: 3277979 - DNA, 14 bp, Homo sapiens
tcttagatgtatat

SEQ ID NO: 3277980 - DNA, 17 bp, Homo sapiens
tcttagcctgtggcagt

SEQ ID NO: 3277981 - DNA, 15 bp, Homo sapiens
tcttagctactgtat

SEQ ID NO: 3277982 - DNA, 13 bp, Homo sapiens
tcttagctggata

SEQ ID NO: 3277983 - DNA, 20 bp, Homo sapiens
tcttagctggatataatgta

SEQ ID NO: 3277984 - DNA, 14 bp, Homo sapiens
tcttagctttttaa

SEQ ID NO: 3277985 - DNA, 16 bp, Homo sapiens
tcttagctttttaatt

SEQ ID NO: 3277986 - DNA, 14 bp, Homo sapiens
tcttaggcactttg

SEQ ID NO: 3277987 - DNA, 21 bp, Homo sapiens
tcttagtaccagagctagttt

SEQ ID NO: 3277988 - DNA, 18 bp, Homo sapiens
tcttagtgcctgagagta

SEQ ID NO: 3277989 - DNA, 21 bp, Homo sapiens
tcttagtgcttcagagtttgt

SEQ ID NO: 3277990 - DNA, 19 bp, Homo sapiens
tcttagtgtggtatttgct

SEQ ID NO: 3277991 - DNA, 15 bp, Homo sapiens
tcttagttctcactg

SEQ ID NO: 3277992 - DNA, 17 bp, Homo sapiens
tcttataatactctgtt

SEQ ID NO: 3277993 - DNA, 19 bp, Homo sapiens
tcttatacgcttttctttg

SEQ ID NO: 3277994 - DNA, 19 bp, Homo sapiens
tcttatagaatatttatta

SEQ ID NO: 3277995 - DNA, 16 bp, Homo sapiens
tcttatagcactttga

SEQ ID NO: 3277996 - DNA, 17 bp, Homo sapiens
tcttatagcactttgaa

SEQ ID NO: 3277997 - DNA, 19 bp, Homo sapiens
tcttatagcactttgaaat

SEQ ID NO: 3277998 - DNA, 23 bp, Homo sapiens
tcttatagcactttgaaatacct

SEQ ID NO: 3277999 - DNA, 17 bp, Homo sapiens
tcttatagggtaaaaaa

SEQ ID NO: 3278000 - DNA, 12 bp, Homo sapiens
tcttatatagca

SEQ ID NO: 3278001 - DNA, 20 bp, Homo sapiens
tcttatctcagtcatgcata

SEQ ID NO: 3278002 - DNA, 20 bp, Homo sapiens
tcttatgccatttgtttatt

SEQ ID NO: 3278003 - DNA, 21 bp, Homo sapiens
tcttatgctctcactgtttgt

SEQ ID NO: 3278004 - DNA, 18 bp, Homo sapiens
tcttatggaattgatttg

SEQ ID NO: 3278005 - DNA, 21 bp, Homo sapiens
tcttatggaattgatttgcat

SEQ ID NO: 3278006 - DNA, 19 bp, Homo sapiens
tcttattaattcttcacct

SEQ ID NO: 3278007 - DNA, 21 bp, Homo sapiens
tcttattataaaatggacaca

SEQ ID NO: 3278008 - DNA, 16 bp, Homo sapiens
tcttattcccaaacta

SEQ ID NO: 3278009 - DNA, 12 bp, Homo sapiens
tcttattccgag

SEQ ID NO: 3278010 - DNA, 18 bp, Homo sapiens
tcttattccgagcattcc

SEQ ID NO: 3278011 - DNA, 21 bp, Homo sapiens
tcttattgcaaggcagtctct

SEQ ID NO: 3278012 - DNA, 22 bp, Homo sapiens
tcttattgcccacgctggagtg

SEQ ID NO: 3278013 - DNA, 17 bp, Homo sapiens
tcttattgcgctgctac

SEQ ID NO: 3278014 - DNA, 15 bp, Homo sapiens
tcttatttctgaatt

SEQ ID NO: 3278015 - DNA, 13 bp, Homo sapiens
tcttattttagaa

SEQ ID NO: 3278016 - DNA, 16 bp, Homo sapiens
tcttcaaaaagcagag

SEQ ID NO: 3278017 - DNA, 14 bp, Homo sapiens
tcttcaaaatgtat

SEQ ID NO: 3278018 - DNA, 17 bp, Homo sapiens
tcttcaaaatgtatata

SEQ ID NO: 3278019 - DNA, 15 bp, Homo sapiens
tcttcaaactttcac

SEQ ID NO: 3278020 - DNA, 14 bp, Homo sapiens
tcttcaaagccttc

SEQ ID NO: 3278021 - DNA, 17 bp, Homo sapiens
tcttcaaagccttctcc

SEQ ID NO: 3278022 - DNA, 22 bp, Homo sapiens
tcttcaacataacccacttgtc

SEQ ID NO: 3278023 - DNA, 18 bp, Homo sapiens
tcttcaacatcctgccag

SEQ ID NO: 3278024 - DNA, 16 bp, Homo sapiens
tcttcaactgaccagc

SEQ ID NO: 3278025 - DNA, 20 bp, Homo sapiens
tcttcaccccggcaggccct

SEQ ID NO: 3278026 - DNA, 18 bp, Homo sapiens
tcttcacctcctgccagc

SEQ ID NO: 3278027 - DNA, 13 bp, Homo sapiens
tcttcacctgcca

SEQ ID NO: 3278028 - DNA, 16 bp, Homo sapiens
tcttcacctgccacca

SEQ ID NO: 3278029 - DNA, 20 bp, Homo sapiens
tcttcacctgccaccacaca

SEQ ID NO: 3278030 - DNA, 12 bp, Homo sapiens
tcttcacctgtt

SEQ ID NO: 3278031 - DNA, 21 bp, Homo sapiens
tcttcacctttgtaagacatt

SEQ ID NO: 3278032 - DNA, 15 bp, Homo sapiens
tcttcactcttaggc

SEQ ID NO: 3278033 - DNA, 21 bp, Homo sapiens
tcttcactcttaggcactttg

SEQ ID NO: 3278034 - DNA, 16 bp, Homo sapiens
tcttcactgtggccac

SEQ ID NO: 3278035 - DNA, 21 bp, Homo sapiens
tcttcagaacacacagacttt

SEQ ID NO: 3278036 - DNA, 22 bp, Homo sapiens
tcttcagaacacacagactttc

SEQ ID NO: 3278037 - DNA, 23 bp, Homo sapiens
tcttcagaactgcccttgctgcc

SEQ ID NO: 3278038 - DNA, 12 bp, Homo sapiens
tcttcagaactt

SEQ ID NO: 3278039 - DNA, 18 bp, Homo sapiens
tcttcagactctcagccc

SEQ ID NO: 3278040 - DNA, 22 bp, Homo sapiens
tcttcagactctcagcccagaa

SEQ ID NO: 3278041 - DNA, 19 bp, Homo sapiens
tcttcagatacaaactgca

SEQ ID NO: 3278042 - DNA, 19 bp, Homo sapiens
tcttcagcattccctccca

SEQ ID NO: 3278043 - DNA, 14 bp, Homo sapiens
tcttcagggtctaa

SEQ ID NO: 3278044 - DNA, 22 bp, Homo sapiens
tcttcagtcagaaaactttaaa

SEQ ID NO: 3278045 - DNA, 17 bp, Homo sapiens
tcttcagtgactcctgc

SEQ ID NO: 3278046 - DNA, 21 bp, Homo sapiens
tcttcagtgcaaattgtatct

SEQ ID NO: 3278047 - DNA, 20 bp, Homo sapiens
tcttcagttggtgtgttttt

SEQ ID NO: 3278048 - DNA, 20 bp, Homo sapiens
tcttcataaagtacttgagt

SEQ ID NO: 3278049 - DNA, 22 bp, Homo sapiens
tcttcatactttttttcacagt

SEQ ID NO: 3278050 - DNA, 18 bp, Homo sapiens
tcttcatccaacttccaa

SEQ ID NO: 3278051 - DNA, 17 bp, Homo sapiens
tcttcattccattgact

SEQ ID NO: 3278052 - DNA, 14 bp, Homo sapiens
tcttcatttcattg

SEQ ID NO: 3278053 - DNA, 22 bp, Homo sapiens
tcttcattttggtttatttttg

SEQ ID NO: 3278054 - DNA, 22 bp, Homo sapiens
tcttccaaggtagctctaagtt

SEQ ID NO: 3278055 - DNA, 13 bp, Homo sapiens
tcttccactttgc

SEQ ID NO: 3278056 - DNA, 19 bp, Homo sapiens
tcttccatgtatcttttga

SEQ ID NO: 3278057 - DNA, 14 bp, Homo sapiens
tcttccatgtgaac

SEQ ID NO: 3278058 - DNA, 17 bp, Homo sapiens
tcttcccatgcattctg

SEQ ID NO: 3278059 - DNA, 20 bp, Homo sapiens
tcttccccagaaaggagact

SEQ ID NO: 3278060 - DNA, 15 bp, Homo sapiens
tcttccccttgccct

SEQ ID NO: 3278061 - DNA, 22 bp, Homo sapiens
tcttccccttgcccttgccctg

SEQ ID NO: 3278062 - DNA, 23 bp, Homo sapiens
tcttccccttgcccttgccctga

SEQ ID NO: 3278063 - DNA, 13 bp, Homo sapiens
tcttccctacctc

SEQ ID NO: 3278064 - DNA, 17 bp, Homo sapiens
tcttccctttccccagc

SEQ ID NO: 3278065 - DNA, 19 bp, Homo sapiens
tcttccctttccccagcat

SEQ ID NO: 3278066 - DNA, 15 bp, Homo sapiens
tcttccggagatgta

SEQ ID NO: 3278067 - DNA, 19 bp, Homo sapiens
tcttccggagatgtagcaa

SEQ ID NO: 3278068 - DNA, 21 bp, Homo sapiens
tcttcctaccaagtcaaactt

SEQ ID NO: 3278069 - DNA, 13 bp, Homo sapiens
tcttcctagaatt

SEQ ID NO: 3278070 - DNA, 23 bp, Homo sapiens
tcttcctagttttctcctcccag

SEQ ID NO: 3278071 - DNA, 17 bp, Homo sapiens
tcttcctatccctctcc

SEQ ID NO: 3278072 - DNA, 21 bp, Homo sapiens
tcttcctatttgccatgggct

SEQ ID NO: 3278073 - DNA, 13 bp, Homo sapiens
tcttcctcagctg

SEQ ID NO: 3278074 - DNA, 15 bp, Homo sapiens
tcttcctcagctggt

SEQ ID NO: 3278075 - DNA, 14 bp, Homo sapiens
tcttcctccagctg

SEQ ID NO: 3278076 - DNA, 17 bp, Homo sapiens
tcttcctccagctgcac

SEQ ID NO: 3278077 - DNA, 19 bp, Homo sapiens
tcttcctccagctgcacca

SEQ ID NO: 3278078 - DNA, 12 bp, Homo sapiens
tcttcctctgct

SEQ ID NO: 3278079 - DNA, 12 bp, Homo sapiens
tctggcccttgg

SEQ ID NO: 3278080 - DNA, 13 bp, Homo sapiens
tctggcccttgga

SEQ ID NO: 3278081 - DNA, 14 bp, Homo sapiens
tctggcccttggaa

SEQ ID NO: 3278082 - DNA, 15 bp, Homo sapiens
tctggcccttggaat

SEQ ID NO: 3278083 - DNA, 16 bp, Homo sapiens
tctggcccttggaata

SEQ ID NO: 3278084 - DNA, 15 bp, Homo sapiens
tctggcctcccaccc

SEQ ID NO: 3278085 - DNA, 21 bp, Homo sapiens
tctggcctggcctggccctgc

SEQ ID NO: 3278086 - DNA, 23 bp, Homo sapiens
tctggcctggcctggccctgccc

SEQ ID NO: 3278087 - DNA, 16 bp, Homo sapiens
tctggctagaggccag

SEQ ID NO: 3278088 - DNA, 22 bp, Homo sapiens
tctggctagaggccagccccac

SEQ ID NO: 3278089 - DNA, 16 bp, Homo sapiens
tctggctctaattcac

SEQ ID NO: 3278090 - DNA, 20 bp, Homo sapiens
tctggctctaattcacagtg

SEQ ID NO: 3278091 - DNA, 13 bp, Homo sapiens
tctggctctgtct

SEQ ID NO: 3278092 - DNA, 18 bp, Homo sapiens
tctggctgaacactggca

SEQ ID NO: 3278093 - DNA, 16 bp, Homo sapiens
tctggctgaaccctgt

SEQ ID NO: 3278094 - DNA, 18 bp, Homo sapiens
tctggctgaaccctgtgc

SEQ ID NO: 3278095 - DNA, 20 bp, Homo sapiens
tctggctgaaccctgtgctg

SEQ ID NO: 3278096 - DNA, 20 bp, Homo sapiens
tctggctgtttagcagaact

SEQ ID NO: 3278097 - DNA, 22 bp, Homo sapiens
tctggctgtttagcagaactca

SEQ ID NO: 3278098 - DNA, 15 bp, Homo sapiens
tctggcttagtgcca

SEQ ID NO: 3278099 - DNA, 17 bp, Homo sapiens
tctggcttagtgccacc

SEQ ID NO: 3278100 - DNA, 16 bp, Homo sapiens
tctggcttattttaat

SEQ ID NO: 3278101 - DNA, 17 bp, Homo sapiens
tctggcttattttaatg

SEQ ID NO: 3278102 - DNA, 18 bp, Homo sapiens
tctggcttattttaatgt

SEQ ID NO: 3278103 - DNA, 14 bp, Homo sapiens
tctggcttgactgg

SEQ ID NO: 3278104 - DNA, 20 bp, Homo sapiens
tctggctttttcctctgagc

SEQ ID NO: 3278105 - DNA, 15 bp, Homo sapiens
tctgggaacctccca

SEQ ID NO: 3278106 - DNA, 18 bp, Homo sapiens
tctgggaatgggagaggg

SEQ ID NO: 3278107 - DNA, 12 bp, Homo sapiens
tctgggacacag

SEQ ID NO: 3278108 - DNA, 13 bp, Homo sapiens
tctgggacacagt

SEQ ID NO: 3278109 - DNA, 14 bp, Homo sapiens
tctgggacacagtt

SEQ ID NO: 3278110 - DNA, 16 bp, Homo sapiens
tctgggacctcagttt

SEQ ID NO: 3278111 - DNA, 13 bp, Homo sapiens
tctgggacttcct

SEQ ID NO: 3278112 - DNA, 17 bp, Homo sapiens
tctgggacttccttgct

SEQ ID NO: 3278113 - DNA, 16 bp, Homo sapiens
tctgggagaggatttt

SEQ ID NO: 3278114 - DNA, 17 bp, Homo sapiens
tctgggaggcaagaaaa

SEQ ID NO: 3278115 - DNA, 20 bp, Homo sapiens
tctgggaggcaagaaaagga

SEQ ID NO: 3278116 - DNA, 15 bp, Homo sapiens
tctgggatatttaac

SEQ ID NO: 3278117 - DNA, 15 bp, Homo sapiens
tctgggattattctt

SEQ ID NO: 3278118 - DNA, 18 bp, Homo sapiens
tctgggcacactctgcca

SEQ ID NO: 3278119 - DNA, 18 bp, Homo sapiens
tctgggcaccacaaaata

SEQ ID NO: 3278120 - DNA, 12 bp, Homo sapiens
tctgggcctgac

SEQ ID NO: 3278121 - DNA, 12 bp, Homo sapiens
tctgggcctggg

SEQ ID NO: 3278122 - DNA, 18 bp, Homo sapiens
tctgggctcagggctgga

SEQ ID NO: 3278123 - DNA, 14 bp, Homo sapiens
tctgggctctttcc

SEQ ID NO: 3278124 - DNA, 21 bp, Homo sapiens
tctgggctgcgggaggccctg

SEQ ID NO: 3278125 - DNA, 22 bp, Homo sapiens
tctgggctgcgggaggccctgg

SEQ ID NO: 3278126 - DNA, 14 bp, Homo sapiens
tctggggaccccaa

SEQ ID NO: 3278127 - DNA, 17 bp, Homo sapiens
tctggggcaggctgggc

SEQ ID NO: 3278128 - DNA, 21 bp, Homo sapiens
tctggggcaggctgggccatg

SEQ ID NO: 3278129 - DNA, 16 bp, Homo sapiens
tctggggccctgggcc

SEQ ID NO: 3278130 - DNA, 18 bp, Homo sapiens
tctggggccctgggcctc

SEQ ID NO: 3278131 - DNA, 17 bp, Homo sapiens
tctggggtgggcagttt

SEQ ID NO: 3278132 - DNA, 20 bp, Homo sapiens
tctggggttggcaacaggac

SEQ ID NO: 3278133 - DNA, 17 bp, Homo sapiens
tctggtaaagttacact

SEQ ID NO: 3278134 - DNA, 21 bp, Homo sapiens
tctggtaatattgacttgtat

SEQ ID NO: 3278135 - DNA, 15 bp, Homo sapiens
tctggtactttctgt

SEQ ID NO: 3278136 - DNA, 17 bp, Homo sapiens
tctggtccacactagaa

SEQ ID NO: 3278137 - DNA, 13 bp, Homo sapiens
tctggtcccttgc

SEQ ID NO: 3278138 - DNA, 17 bp, Homo sapiens
tctggtcgctcctgccc

SEQ ID NO: 3278139 - DNA, 21 bp, Homo sapiens
tctggtctaatttattaatct

SEQ ID NO: 3278140 - DNA, 17 bp, Homo sapiens
tctggtgccatttctga

SEQ ID NO: 3278141 - DNA, 15 bp, Homo sapiens
tctggtgcctccaga

SEQ ID NO: 3278142 - DNA, 14 bp, Homo sapiens
tctggttccagggt

SEQ ID NO: 3278143 - DNA, 23 bp, Homo sapiens
tctggttccagggtccctctgtg

SEQ ID NO: 3278144 - DNA, 13 bp, Homo sapiens
tctggttctaaca

SEQ ID NO: 3278145 - DNA, 14 bp, Homo sapiens
tctggttctgatgc

SEQ ID NO: 3278146 - DNA, 17 bp, Homo sapiens
tctggttgtatttctat

SEQ ID NO: 3278147 - DNA, 20 bp, Homo sapiens
tctggttgtatttctatatt

SEQ ID NO: 3278148 - DNA, 16 bp, Homo sapiens
tctggttgtctagtca

SEQ ID NO: 3278149 - DNA, 16 bp, Homo sapiens
tctggttgtttctgtt

SEQ ID NO: 3278150 - DNA, 16 bp, Homo sapiens
tctggtttctcattct

SEQ ID NO: 3278151 - DNA, 14 bp, Homo sapiens
tctgtaaactgtgt

SEQ ID NO: 3278152 - DNA, 15 bp, Homo sapiens
tctgtaaactgtgta

SEQ ID NO: 3278153 - DNA, 21 bp, Homo sapiens
tctgtaaataccattgacaca

SEQ ID NO: 3278154 - DNA, 16 bp, Homo sapiens
tctgtaatagttcagt

SEQ ID NO: 3278155 - DNA, 20 bp, Homo sapiens
tctgtaatggaactgacccc

SEQ ID NO: 3278156 - DNA, 15 bp, Homo sapiens
tctgtaatttttcag

SEQ ID NO: 3278157 - DNA, 13 bp, Homo sapiens
tctgtacacgtgt

SEQ ID NO: 3278158 - DNA, 17 bp, Homo sapiens
tctgtacacgtgtcctg

SEQ ID NO: 3278159 - DNA, 13 bp, Homo sapiens
tctgtacattttg

SEQ ID NO: 3278160 - DNA, 21 bp, Homo sapiens
tctgtacattttgttgtaaaa

SEQ ID NO: 3278161 - DNA, 13 bp, Homo sapiens
tctgtaccagtta

SEQ ID NO: 3278162 - DNA, 22 bp, Homo sapiens
tctgtaccagttaatttttcca

SEQ ID NO: 3278163 - DNA, 13 bp, Homo sapiens
tctgtacctcaaa

SEQ ID NO: 3278164 - DNA, 16 bp, Homo sapiens
tctgtacctcaaatga

SEQ ID NO: 3278165 - DNA, 22 bp, Homo sapiens
tctgtactaaacagtaagatat

SEQ ID NO: 3278166 - DNA, 20 bp, Homo sapiens
tctgtacttttcattctctt

SEQ ID NO: 3278167 - DNA, 21 bp, Homo sapiens
tctgtagatgttgtcttggct

SEQ ID NO: 3278168 - DNA, 14 bp, Homo sapiens
tctgtagctcctca

SEQ ID NO: 3278169 - DNA, 23 bp, Homo sapiens
tctgtagctcctcaactcaccta

SEQ ID NO: 3278170 - DNA, 19 bp, Homo sapiens
tctgtagggaactctgggg

SEQ ID NO: 3278171 - DNA, 15 bp, Homo sapiens
tctgtagtaatttat

SEQ ID NO: 3278172 - DNA, 24 bp, Homo sapiens
tctgtagtaatttattgtctgtct

SEQ ID NO: 3278173 - DNA, 19 bp, Homo sapiens
tctgtagtactccttaaga

SEQ ID NO: 3278174 - DNA, 15 bp, Homo sapiens
tctgtagtcatttac

SEQ ID NO: 3278175 - DNA, 19 bp, Homo sapiens
tctgtagtcatttactaaa

SEQ ID NO: 3278176 - DNA, 22 bp, Homo sapiens
tctgtataaacattaaatgtct

SEQ ID NO: 3278177 - DNA, 16 bp, Homo sapiens
tctgtatagaaatcta

SEQ ID NO: 3278178 - DNA, 15 bp, Homo sapiens
tctgtatatactttt

SEQ ID NO: 3278179 - DNA, 20 bp, Homo sapiens
tctgtatatgttgtaataaa

SEQ ID NO: 3278180 - DNA, 19 bp, Homo sapiens
tctgtatcggagacagtga

SEQ ID NO: 3278181 - DNA, 12 bp, Homo sapiens
tctgtatctctc

SEQ ID NO: 3278182 - DNA, 13 bp, Homo sapiens
tctgtatctctct

SEQ ID NO: 3278183 - DNA, 17 bp, Homo sapiens
tctgtattgtgctgatt

SEQ ID NO: 3278184 - DNA, 20 bp, Homo sapiens
tctgtatttaatggttttta

SEQ ID NO: 3278185 - DNA, 23 bp, Homo sapiens
tctgtatttatgtgtgaggagct

SEQ ID NO: 3278186 - DNA, 17 bp, Homo sapiens
tctgtatttattatttg

SEQ ID NO: 3278187 - DNA, 20 bp, Homo sapiens
tctgtatttattatttgaag

SEQ ID NO: 3278188 - DNA, 15 bp, Homo sapiens
tctgtatttcatgtg

SEQ ID NO: 3278189 - DNA, 14 bp, Homo sapiens
tctgtcaatgaaaa

SEQ ID NO: 3278190 - DNA, 13 bp, Homo sapiens
tctgtcaattttt

SEQ ID NO: 3278191 - DNA, 19 bp, Homo sapiens
tctgtcaccagctatctgt

SEQ ID NO: 3278192 - DNA, 22 bp, Homo sapiens
tctgtcagatgagaacaaagct

SEQ ID NO: 3278193 - DNA, 24 bp, Homo sapiens
tctgtcagatgagaacaaagctgt

SEQ ID NO: 3278194 - DNA, 18 bp, Homo sapiens
tctgtcagatgggaagac

SEQ ID NO: 3278195 - DNA, 19 bp, Homo sapiens
tctgtcagatgggaagaca

SEQ ID NO: 3278196 - DNA, 17 bp, Homo sapiens
tctgtcagccagccgcc

SEQ ID NO: 3278197 - DNA, 20 bp, Homo sapiens
tctgtcagccagccgccctg

SEQ ID NO: 3278198 - DNA, 17 bp, Homo sapiens
tctgtcaggagagcagc

SEQ ID NO: 3278199 - DNA, 13 bp, Homo sapiens
tctgtcatctctc

SEQ ID NO: 3278200 - DNA, 21 bp, Homo sapiens
tctgtcatctctctggggccc

SEQ ID NO: 3278201 - DNA, 22 bp, Homo sapiens
tctgtcatctctctggggccct

SEQ ID NO: 3278202 - DNA, 23 bp, Homo sapiens
tctgtcatttgagcagggctcag

SEQ ID NO: 3278203 - DNA, 15 bp, Homo sapiens
tctgtccaaaggagg

SEQ ID NO: 3278204 - DNA, 19 bp, Homo sapiens
ctggcaggggagacaggag

SEQ ID NO: 3278205 - DNA, 20 bp, Homo sapiens
ctggcaggggagacaggagc

SEQ ID NO: 3278206 - DNA, 21 bp, Homo sapiens
ctggcagtaacctagtgaatt

SEQ ID NO: 3278207 - DNA, 22 bp, Homo sapiens
ctggcagtcctggaagccagct

SEQ ID NO: 3278208 - DNA, 13 bp, Homo sapiens
ctggcatcatggt

SEQ ID NO: 3278209 - DNA, 18 bp, Homo sapiens
ctggcatcgcaccattct

SEQ ID NO: 3278210 - DNA, 23 bp, Homo sapiens
ctggcatcgcaccattctgactc

SEQ ID NO: 3278211 - DNA, 21 bp, Homo sapiens
ctggcatctaattctgattct

SEQ ID NO: 3278212 - DNA, 18 bp, Homo sapiens
ctggcatctgacacaaaa

SEQ ID NO: 3278213 - DNA, 20 bp, Homo sapiens
ctggcatgttcaaagccaca

SEQ ID NO: 3278214 - DNA, 21 bp, Homo sapiens
ctggcattaccctctgcagaa

SEQ ID NO: 3278215 - DNA, 19 bp, Homo sapiens
ctggcattatgtccactgt

SEQ ID NO: 3278216 - DNA, 16 bp, Homo sapiens
ctggccaccaggctgg

SEQ ID NO: 3278217 - DNA, 17 bp, Homo sapiens
ctggccaccaggctggc

SEQ ID NO: 3278218 - DNA, 18 bp, Homo sapiens
ctggccaccaggctggcg

SEQ ID NO: 3278219 - DNA, 23 bp, Homo sapiens
ctggccaccaggctggcgcagcc

SEQ ID NO: 3278220 - DNA, 15 bp, Homo sapiens
ctggccacctgaggt

SEQ ID NO: 3278221 - DNA, 16 bp, Homo sapiens
ctggccacctgaggtg

SEQ ID NO: 3278222 - DNA, 20 bp, Homo sapiens
ctggccacctgaggtgggcc

SEQ ID NO: 3278223 - DNA, 21 bp, Homo sapiens
ctggccacctgaggtgggccc

SEQ ID NO: 3278224 - DNA, 22 bp, Homo sapiens
ctggccacctgaggtgggccca

SEQ ID NO: 3278225 - DNA, 18 bp, Homo sapiens
ctggccactgcacagagc

SEQ ID NO: 3278226 - DNA, 20 bp, Homo sapiens
ctggccactgcacagagctc

SEQ ID NO: 3278227 - DNA, 21 bp, Homo sapiens
ctggccactgcacagagctct

SEQ ID NO: 3278228 - DNA, 22 bp, Homo sapiens
ctggccactgcacagagctctc

SEQ ID NO: 3278229 - DNA, 16 bp, Homo sapiens
ctggccagacgctgcc

SEQ ID NO: 3278230 - DNA, 11 bp, Homo sapiens
ctggccagaga

SEQ ID NO: 3278231 - DNA, 17 bp, Homo sapiens
ctggccagagagggccc

SEQ ID NO: 3278232 - DNA, 20 bp, Homo sapiens
ctggccagagagggcccagc

SEQ ID NO: 3278233 - DNA, 23 bp, Homo sapiens
ctggccagagagggcccagctgt

SEQ ID NO: 3278234 - DNA, 19 bp, Homo sapiens
ctggccagatgcaccagcc

SEQ ID NO: 3278235 - DNA, 21 bp, Homo sapiens
ctggccagatgcaccagccct

SEQ ID NO: 3278236 - DNA, 22 bp, Homo sapiens
ctggccagatgcaccagccctt

SEQ ID NO: 3278237 - DNA, 17 bp, Homo sapiens
ctggccagcaaggcagg

SEQ ID NO: 3278238 - DNA, 12 bp, Homo sapiens
ctggccagcacc

SEQ ID NO: 3278239 - DNA, 13 bp, Homo sapiens
ctggccagcaccc

SEQ ID NO: 3278240 - DNA, 15 bp, Homo sapiens
ctggccagcaccctc

SEQ ID NO: 3278241 - DNA, 22 bp, Homo sapiens
ctggccagcaccctctcctggg

SEQ ID NO: 3278242 - DNA, 23 bp, Homo sapiens
ctggccagcaccctctcctgggg

SEQ ID NO: 3278243 - DNA, 12 bp, Homo sapiens
ctggccagcctg

SEQ ID NO: 3278244 - DNA, 15 bp, Homo sapiens
ctggccagcctgggg

SEQ ID NO: 3278245 - DNA, 24 bp, Homo sapiens
ctggccagcctggggcctggcagg

SEQ ID NO: 3278246 - DNA, 14 bp, Homo sapiens
ctggccaggagcag

SEQ ID NO: 3278247 - DNA, 15 bp, Homo sapiens
ctggccaggagcagg

SEQ ID NO: 3278248 - DNA, 13 bp, Homo sapiens
ctggccaggagct

SEQ ID NO: 3278249 - DNA, 15 bp, Homo sapiens
ctggccaggagctct

SEQ ID NO: 3278250 - DNA, 23 bp, Homo sapiens
ctggccaggataatatatttgca

SEQ ID NO: 3278251 - DNA, 23 bp, Homo sapiens
ctggccaggatggaggggtggtc

SEQ ID NO: 3278252 - DNA, 14 bp, Homo sapiens
ctggccaggcagat

SEQ ID NO: 3278253 - DNA, 21 bp, Homo sapiens
ctggccaggcagatctgtgcc

SEQ ID NO: 3278254 - DNA, 12 bp, Homo sapiens
ctggccagggca

SEQ ID NO: 3278255 - DNA, 18 bp, Homo sapiens
ctggccagggcagggcca

SEQ ID NO: 3278256 - DNA, 19 bp, Homo sapiens
ctggccagggcagggccac

SEQ ID NO: 3278257 - DNA, 18 bp, Homo sapiens
ctggccagtccaggctgc

SEQ ID NO: 3278258 - DNA, 15 bp, Homo sapiens
ctggccagtgtcatt

SEQ ID NO: 3278259 - DNA, 17 bp, Homo sapiens
ctggccagttggaacca

SEQ ID NO: 3278260 - DNA, 19 bp, Homo sapiens
ctggccatctccctcccca

SEQ ID NO: 3278261 - DNA, 16 bp, Homo sapiens
ctggcccacgccctcc

SEQ ID NO: 3278262 - DNA, 13 bp, Homo sapiens
ctggcccagccaa

SEQ ID NO: 3278263 - DNA, 17 bp, Homo sapiens
ctggcccagccaaaccc

SEQ ID NO: 3278264 - DNA, 20 bp, Homo sapiens
ctggcccagccaaaccctgt

SEQ ID NO: 3278265 - DNA, 21 bp, Homo sapiens
ctggcccagccggcctctctg

SEQ ID NO: 3278266 - DNA, 21 bp, Homo sapiens
ctggcccatagaaacatgaca

SEQ ID NO: 3278267 - DNA, 16 bp, Homo sapiens
ctggcccatctcagcc

SEQ ID NO: 3278268 - DNA, 20 bp, Homo sapiens
ctggcccatctcagcctcct

SEQ ID NO: 3278269 - DNA, 14 bp, Homo sapiens
ctggccccagccct

SEQ ID NO: 3278270 - DNA, 15 bp, Homo sapiens
ctggccccagccctg

SEQ ID NO: 3278271 - DNA, 16 bp, Homo sapiens
ctggccccagccctgc

SEQ ID NO: 3278272 - DNA, 22 bp, Homo sapiens
ctggcccccaacctcagggctc

SEQ ID NO: 3278273 - DNA, 22 bp, Homo sapiens
ctggcccccaggattcccccag

SEQ ID NO: 3278274 - DNA, 15 bp, Homo sapiens
ctggccccctccctg

SEQ ID NO: 3278275 - DNA, 16 bp, Homo sapiens
ctggccccctccctgg

SEQ ID NO: 3278276 - DNA, 17 bp, Homo sapiens
ctggccccctccctgga

SEQ ID NO: 3278277 - DNA, 18 bp, Homo sapiens
ctggccccggatcagagc

SEQ ID NO: 3278278 - DNA, 22 bp, Homo sapiens
ctggcccctaggctgctgctgt

SEQ ID NO: 3278279 - DNA, 24 bp, Homo sapiens
ctggcccctcgcctgtggagctca

SEQ ID NO: 3278280 - DNA, 12 bp, Homo sapiens
ctggccctccac

SEQ ID NO: 3278281 - DNA, 16 bp, Homo sapiens
ctggccctccactcct

SEQ ID NO: 3278282 - DNA, 14 bp, Homo sapiens
ctggccctgaggtg

SEQ ID NO: 3278283 - DNA, 19 bp, Homo sapiens
ctggccctgaggtgtgggg

SEQ ID NO: 3278284 - DNA, 11 bp, Homo sapiens
ctggccctgcc

SEQ ID NO: 3278285 - DNA, 12 bp, Homo sapiens
ctggccctgcct

SEQ ID NO: 3278286 - DNA, 17 bp, Homo sapiens
ctggccctgcctcctgg

SEQ ID NO: 3278287 - DNA, 18 bp, Homo sapiens
ctggccctgcctcctggg

SEQ ID NO: 3278288 - DNA, 19 bp, Homo sapiens
ctggccctgcctcctggga

SEQ ID NO: 3278289 - DNA, 12 bp, Homo sapiens
ctggccctgtgt

SEQ ID NO: 3278290 - DNA, 14 bp, Homo sapiens
ctggccctttcccc

SEQ ID NO: 3278291 - DNA, 16 bp, Homo sapiens
ctggccctttcccctt

SEQ ID NO: 3278292 - DNA, 17 bp, Homo sapiens
ctggccgagggtcctgg

SEQ ID NO: 3278293 - DNA, 19 bp, Homo sapiens
ctggccgagggtcctggct

SEQ ID NO: 3278294 - DNA, 16 bp, Homo sapiens
ctggccgccaccccca

SEQ ID NO: 3278295 - DNA, 19 bp, Homo sapiens
ctggccgccacccccatct

SEQ ID NO: 3278296 - DNA, 22 bp, Homo sapiens
ctggccgcgtttagaccaagga

SEQ ID NO: 3278297 - DNA, 18 bp, Homo sapiens
ctggccggcaaccccagt

SEQ ID NO: 3278298 - DNA, 12 bp, Homo sapiens
ctggccgggcag

SEQ ID NO: 3278299 - DNA, 13 bp, Homo sapiens
ctggccgggcagg

SEQ ID NO: 3278300 - DNA, 14 bp, Homo sapiens
ctggccgggcaggc

SEQ ID NO: 3278301 - DNA, 16 bp, Homo sapiens
ctggccggtctgcaag

SEQ ID NO: 3278302 - DNA, 23 bp, Homo sapiens
ctggcctcaagtgattctcctgc

SEQ ID NO: 3278303 - DNA, 14 bp, Homo sapiens
ctggcctcactggc

SEQ ID NO: 3278304 - DNA, 17 bp, Homo sapiens
ctggcctcactggctgg

SEQ ID NO: 3278305 - DNA, 21 bp, Homo sapiens
ctggcctcactggctggggca

SEQ ID NO: 3278306 - DNA, 17 bp, Homo sapiens
ctggcctcagttcccag

SEQ ID NO: 3278307 - DNA, 12 bp, Homo sapiens
ctggcctcccac

SEQ ID NO: 3278308 - DNA, 17 bp, Homo sapiens
ctggcctcccacccgat

SEQ ID NO: 3278309 - DNA, 22 bp, Homo sapiens
ctggcctcccacccgatgctgc

SEQ ID NO: 3278310 - DNA, 20 bp, Homo sapiens
ctggcctctaccacaagggc

SEQ ID NO: 3278311 - DNA, 11 bp, Homo sapiens
ctggcctctgt

SEQ ID NO: 3278312 - DNA, 14 bp, Homo sapiens
ctggcctctgtgcc

SEQ ID NO: 3278313 - DNA, 17 bp, Homo sapiens
ctggcctgaactgagga

SEQ ID NO: 3278314 - DNA, 21 bp, Homo sapiens
ctggcctgaactgaggagatg

SEQ ID NO: 3278315 - DNA, 15 bp, Homo sapiens
ctggcctgagctggg

SEQ ID NO: 3278316 - DNA, 15 bp, Homo sapiens
ctggcctgctgggaa

SEQ ID NO: 3278317 - DNA, 17 bp, Homo sapiens
ctggcctgctgggaacc

SEQ ID NO: 3278318 - DNA, 23 bp, Homo sapiens
ctggcctgctgggaaccccgcag

SEQ ID NO: 3278319 - DNA, 12 bp, Homo sapiens
ctggcctggatc

SEQ ID NO: 3278320 - DNA, 13 bp, Homo sapiens
ctggcctggcaca

SEQ ID NO: 3278321 - DNA, 17 bp, Homo sapiens
ctggcctggcacacatc

SEQ ID NO: 3278322 - DNA, 18 bp, Homo sapiens
ctggcctggcacacatca

SEQ ID NO: 3278323 - DNA, 13 bp, Homo sapiens
ctggcctggccct

SEQ ID NO: 3278324 - DNA, 15 bp, Homo sapiens
ctggcctggccctgc

SEQ ID NO: 3278325 - DNA, 19 bp, Homo sapiens
ctggcctggccctgccctg

SEQ ID NO: 3278326 - DNA, 17 bp, Homo sapiens
ctggccttaaaaggggc

SEQ ID NO: 3278327 - DNA, 16 bp, Homo sapiens
ctggccttcggcctcc

SEQ ID NO: 3278328 - DNA, 22 bp, Homo sapiens
ctggccttcggcctccatcctg

SEQ ID NO: 3278329 - DNA, 17 bp, Homo sapiens
ctggcctttttcattta

SEQ ID NO: 3278330 - DNA, 14 bp, Homo sapiens
ctggcgacacactc

SEQ ID NO: 3278331 - DNA, 12 bp, Homo sapiens
ctggcgcagcca

SEQ ID NO: 3278332 - DNA, 15 bp, Homo sapiens
ctggcgcagccaagg

SEQ ID NO: 3278333 - DNA, 13 bp, Homo sapiens
ctggcgcaggtgg

SEQ ID NO: 3278334 - DNA, 17 bp, Homo sapiens
ctggcggcttcctgtcc

SEQ ID NO: 3278335 - DNA, 19 bp, Homo sapiens
ctggcggcttcctgtccac

SEQ ID NO: 3278336 - DNA, 20 bp, Homo sapiens
ctggcggcttcctgtccact

SEQ ID NO: 3278337 - DNA, 16 bp, Homo sapiens
ctggcgggatgggcca

SEQ ID NO: 3278338 - DNA, 22 bp, Homo sapiens
ctggcgttcacctccctgctca

SEQ ID NO: 3278339 - DNA, 19 bp, Homo sapiens
ctggctacatcccagcctg

SEQ ID NO: 3278340 - DNA, 22 bp, Homo sapiens
ctggctagaggccagccccacc

SEQ ID NO: 3278341 - DNA, 18 bp, Homo sapiens
ctggctagagtcctcact

SEQ ID NO: 3278342 - DNA, 23 bp, Homo sapiens
ctggctccatgattctctgagtg

SEQ ID NO: 3278343 - DNA, 18 bp, Homo sapiens
ctggctcccacaggccct

SEQ ID NO: 3278344 - DNA, 21 bp, Homo sapiens
ctggctccccacgagtcacct

SEQ ID NO: 3278345 - DNA, 12 bp, Homo sapiens
ctggctcctcaa

SEQ ID NO: 3278346 - DNA, 15 bp, Homo sapiens
ctggctcctgagggg

SEQ ID NO: 3278347 - DNA, 17 bp, Homo sapiens
ctggctcctgaggggca

SEQ ID NO: 3278348 - DNA, 15 bp, Homo sapiens
ctggctctaattcac

SEQ ID NO: 3278349 - DNA, 19 bp, Homo sapiens
ctggctctaattcacagtg

SEQ ID NO: 3278350 - DNA, 17 bp, Homo sapiens
ctggctctcatggggtc

SEQ ID NO: 3278351 - DNA, 13 bp, Homo sapiens
ctggctctccaag

SEQ ID NO: 3278352 - DNA, 22 bp, Homo sapiens
ctggctctccaagtgccagagg

SEQ ID NO: 3278353 - DNA, 13 bp, Homo sapiens
ctggctctctcca

SEQ ID NO: 3278354 - DNA, 15 bp, Homo sapiens
ctggctctctccagg

SEQ ID NO: 3278355 - DNA, 15 bp, Homo sapiens
ctggctctgcactaa

SEQ ID NO: 3278356 - DNA, 14 bp, Homo sapiens
ctggctctgggact

SEQ ID NO: 3278357 - DNA, 18 bp, Homo sapiens
ctggctctgtggcttgct

SEQ ID NO: 3278358 - DNA, 16 bp, Homo sapiens
ctggctctgtttgatg

SEQ ID NO: 3278359 - DNA, 20 bp, Homo sapiens
ctggctcttgatacccccct

SEQ ID NO: 3278360 - DNA, 22 bp, Homo sapiens
ctggctcttgatacccccctct

SEQ ID NO: 3278361 - DNA, 17 bp, Homo sapiens
ctggctcttgtgctgga

SEQ ID NO: 3278362 - DNA, 23 bp, Homo sapiens
ctggctctttcgtcacccttgga

SEQ ID NO: 3278363 - DNA, 13 bp, Homo sapiens
ctggctgaaccct

SEQ ID NO: 3278364 - DNA, 18 bp, Homo sapiens
ctggctgaaccctgtgct

SEQ ID NO: 3278365 - DNA, 20 bp, Homo sapiens
ctggctgaaccctgtgctgg

SEQ ID NO: 3278366 - DNA, 21 bp, Homo sapiens
ctggctgaaccctgtgctggt

SEQ ID NO: 3278367 - DNA, 13 bp, Homo sapiens
ctggctgactggc

SEQ ID NO: 3278368 - DNA, 21 bp, Homo sapiens
ctggctgaggatttcaagcct

SEQ ID NO: 3278369 - DNA, 13 bp, Homo sapiens
ctggctgcagtga

SEQ ID NO: 3278370 - DNA, 12 bp, Homo sapiens
ctggctgccagg

SEQ ID NO: 3278371 - DNA, 16 bp, Homo sapiens
ctggctgccaggcgtt

SEQ ID NO: 3278372 - DNA, 17 bp, Homo sapiens
ctggctgccaggcgttg

SEQ ID NO: 3278373 - DNA, 18 bp, Homo sapiens
ctggctgccaggcgttgg

SEQ ID NO: 3278374 - DNA, 12 bp, Homo sapiens
ctggctgcccag

SEQ ID NO: 3278375 - DNA, 13 bp, Homo sapiens
ctggctgccctgg

SEQ ID NO: 3278376 - DNA, 16 bp, Homo sapiens
ctggctgccctggccc

SEQ ID NO: 3278377 - DNA, 23 bp, Homo sapiens
ctggctgccctggccctgaggtg

SEQ ID NO: 3278378 - DNA, 14 bp, Homo sapiens
ctggctgccttaga

SEQ ID NO: 3278379 - DNA, 13 bp, Homo sapiens
ctggctgctgccc

SEQ ID NO: 3278380 - DNA, 14 bp, Homo sapiens
ctggctgctgcccc

SEQ ID NO: 3278381 - DNA, 17 bp, Homo sapiens
ctggctgctgcccccac

SEQ ID NO: 3278382 - DNA, 16 bp, Homo sapiens
ctggctggcctgagca

SEQ ID NO: 3278383 - DNA, 17 bp, Homo sapiens
ctggctggcctgagcaa

SEQ ID NO: 3278384 - DNA, 17 bp, Homo sapiens
ctggctggctgcagtga

SEQ ID NO: 3278385 - DNA, 13 bp, Homo sapiens
ctggctggggcag

SEQ ID NO: 3278386 - DNA, 15 bp, Homo sapiens
ctggctggggcagag

SEQ ID NO: 3278387 - DNA, 19 bp, Homo sapiens
ctggctgggttcaggtccc

SEQ ID NO: 3278388 - DNA, 23 bp, Homo sapiens
ctggctggtgggaaggccggcag

SEQ ID NO: 3278389 - DNA, 20 bp, Homo sapiens
ctggctgtaaggctctagat

SEQ ID NO: 3278390 - DNA, 16 bp, Homo sapiens
ctggctgtggaggcct

SEQ ID NO: 3278391 - DNA, 18 bp, Homo sapiens
ctggctgtggaggcctga

SEQ ID NO: 3278392 - DNA, 20 bp, Homo sapiens
ctggctgtggaggcctgatg

SEQ ID NO: 3278393 - DNA, 21 bp, Homo sapiens
ctggctgtggaggcctgatgc

SEQ ID NO: 3278394 - DNA, 22 bp, Homo sapiens
ctggctgtggaggcctgatgct

SEQ ID NO: 3278395 - DNA, 23 bp, Homo sapiens
ctggctgtggaggcctgatgctg

SEQ ID NO: 3278396 - DNA, 23 bp, Homo sapiens
ctggctgttctgtggttcctctg

SEQ ID NO: 3278397 - DNA, 19 bp, Homo sapiens
ctggctgttggctgggggc

SEQ ID NO: 3278398 - DNA, 15 bp, Homo sapiens
ctggcttattttaat

SEQ ID NO: 3278399 - DNA, 19 bp, Homo sapiens
ctggcttccagcttcaggc

SEQ ID NO: 3278400 - DNA, 22 bp, Homo sapiens
ctggcttccagcttcaggcacc

SEQ ID NO: 3278401 - DNA, 17 bp, Homo sapiens
ctggcttccatcagtgg

SEQ ID NO: 3278402 - DNA, 15 bp, Homo sapiens
ctggcttcccatagt

SEQ ID NO: 3278403 - DNA, 15 bp, Homo sapiens
ctggcttctggagcc

SEQ ID NO: 3278404 - DNA, 20 bp, Homo sapiens
ctggcttctggagcccttgg

SEQ ID NO: 3278405 - DNA, 13 bp, Homo sapiens
ctggcttgctcca

SEQ ID NO: 3278406 - DNA, 15 bp, Homo sapiens
ctggcttgctccagg

SEQ ID NO: 3278407 - DNA, 16 bp, Homo sapiens
ctggcttgctccaggg

SEQ ID NO: 3278408 - DNA, 18 bp, Homo sapiens
ctggcttgctccagggtc

SEQ ID NO: 3278409 - DNA, 22 bp, Homo sapiens
ctggcttgctccagggtcttgg

SEQ ID NO: 3278410 - DNA, 16 bp, Homo sapiens
ctggcttgtttgattt

SEQ ID NO: 3278411 - DNA, 16 bp, Homo sapiens
ctggctttaagccttc

SEQ ID NO: 3278412 - DNA, 19 bp, Homo sapiens
ctggctttgggaaagccca

SEQ ID NO: 3278413 - DNA, 20 bp, Homo sapiens
ctggctttgggaaagcccag

SEQ ID NO: 3278414 - DNA, 21 bp, Homo sapiens
ctggctttgggaaagcccaga

SEQ ID NO: 3278415 - DNA, 22 bp, Homo sapiens
ctggctttgggaaagcccagac

SEQ ID NO: 3278416 - DNA, 19 bp, Homo sapiens
ctggcttttcactgctggc

SEQ ID NO: 3278417 - DNA, 22 bp, Homo sapiens
ctggcttttcactgctggctgc

SEQ ID NO: 3278418 - DNA, 23 bp, Homo sapiens
ctggcttttcactgctggctgcc

SEQ ID NO: 3278419 - DNA, 15 bp, Homo sapiens
ctggctttttaactc

SEQ ID NO: 3278420 - DNA, 18 bp, Homo sapiens
ctggctttttcctctgag

SEQ ID NO: 3278421 - DNA, 21 bp, Homo sapiens
ctggctttttcctctgagccc

SEQ ID NO: 3278422 - DNA, 23 bp, Homo sapiens
ctgggaaaaaagttttgatgaaa

SEQ ID NO: 3278423 - DNA, 16 bp, Homo sapiens
ctgggaaaggacccac

SEQ ID NO: 3278424 - DNA, 16 bp, Homo sapiens
ctgggaaataagagag

SEQ ID NO: 3278425 - DNA, 20 bp, Homo sapiens
ctgggaaccactcccaccac

SEQ ID NO: 3278426 - DNA, 16 bp, Homo sapiens
ctgggaacctcccaga

SEQ ID NO: 3278427 - DNA, 17 bp, Homo sapiens
ctgggaacctcccagag

SEQ ID NO: 3278428 - DNA, 19 bp, Homo sapiens
ctgggaagacgcctgagct

SEQ ID NO: 3278429 - DNA, 18 bp, Homo sapiens
ctgggaagataggctctg

SEQ ID NO: 3278430 - DNA, 20 bp, Homo sapiens
ctgggaagctgagggcaaat

SEQ ID NO: 3278431 - DNA, 23 bp, Homo sapiens
ctgggaagctgtactcagagcag

SEQ ID NO: 3278432 - DNA, 22 bp, Homo sapiens
ctgggaagcttgagcctccccc

SEQ ID NO: 3278433 - DNA, 14 bp, Homo sapiens
ctgggaaggctaag

SEQ ID NO: 3278434 - DNA, 20 bp, Homo sapiens
ctgggaatcatgtccatccc

SEQ ID NO: 3278435 - DNA, 15 bp, Homo sapiens
ctgggaatgggagag

SEQ ID NO: 3278436 - DNA, 13 bp, Homo sapiens
ctgggaatgtatt

SEQ ID NO: 3278437 - DNA, 23 bp, Homo sapiens
ctgggaatgtattattctgcagc

SEQ ID NO: 3278438 - DNA, 11 bp, Homo sapiens
ctgggacacag

SEQ ID NO: 3278439 - DNA, 12 bp, Homo sapiens
ctgggacacagt

SEQ ID NO: 3278440 - DNA, 13 bp, Homo sapiens
ctgggacacagtt

SEQ ID NO: 3278441 - DNA, 22 bp, Homo sapiens
ctgggacaccattaccaaaata

SEQ ID NO: 3278442 - DNA, 22 bp, Homo sapiens
ctgggaccacaggttcatgcca

SEQ ID NO: 3278443 - DNA, 14 bp, Homo sapiens
ctgggaccagagcc

SEQ ID NO: 3278444 - DNA, 18 bp, Homo sapiens
ctgggaccagagccagat

SEQ ID NO: 3278445 - DNA, 19 bp, Homo sapiens
ctgggaccagagccagatg

SEQ ID NO: 3278446 - DNA, 23 bp, Homo sapiens
ctgggacccagctactctgtcca

SEQ ID NO: 3278447 - DNA, 19 bp, Homo sapiens
ctgggacccttaggatggg

SEQ ID NO: 3278448 - DNA, 17 bp, Homo sapiens
ctgggacctgccaggca

SEQ ID NO: 3278449 - DNA, 20 bp, Homo sapiens
ctgggacctgccaggcaggg

SEQ ID NO: 3278450 - DNA, 13 bp, Homo sapiens
ctgggactacagg

SEQ ID NO: 3278451 - DNA, 16 bp, Homo sapiens
ctgggactcagccttc

SEQ ID NO: 3278452 - DNA, 17 bp, Homo sapiens
ctgggactcagccttca

SEQ ID NO: 3278453 - DNA, 18 bp, Homo sapiens
ctgggactcagccttcag

SEQ ID NO: 3278454 - DNA, 21 bp, Homo sapiens
ctgggactcagccttcagaca

SEQ ID NO: 3278455 - DNA, 15 bp, Homo sapiens
ctgggactcctggtg

SEQ ID NO: 3278456 - DNA, 17 bp, Homo sapiens
ctgggactcctggtgcc

SEQ ID NO: 3278457 - DNA, 20 bp, Homo sapiens
ctgggacttccttgctctcc

SEQ ID NO: 3278458 - DNA, 16 bp, Homo sapiens
ctgggagaacctcagg

SEQ ID NO: 3278459 - DNA, 14 bp, Homo sapiens
ctgggagacagacc

SEQ ID NO: 3278460 - DNA, 13 bp, Homo sapiens
ctgggagagaagt

SEQ ID NO: 3278461 - DNA, 17 bp, Homo sapiens
ctgggctctgccccagc

SEQ ID NO: 3278462 - DNA, 18 bp, Homo sapiens
ctgggctctgccccagct

SEQ ID NO: 3278463 - DNA, 23 bp, Homo sapiens
ctgggctctgccccagctctggc

SEQ ID NO: 3278464 - DNA, 15 bp, Homo sapiens
ctgggctgcgggagg

SEQ ID NO: 3278465 - DNA, 18 bp, Homo sapiens
ctgggctgcgggaggccc

SEQ ID NO: 3278466 - DNA, 19 bp, Homo sapiens
ctgggctgcgggaggccct

SEQ ID NO: 3278467 - DNA, 21 bp, Homo sapiens
ctgggctgcgggaggccctgg

SEQ ID NO: 3278468 - DNA, 15 bp, Homo sapiens
ctgggctgctggagg

SEQ ID NO: 3278469 - DNA, 15 bp, Homo sapiens
ctgggctggactgga

SEQ ID NO: 3278470 - DNA, 21 bp, Homo sapiens
ctgggctggactggaggtggg

SEQ ID NO: 3278471 - DNA, 15 bp, Homo sapiens
ctgggctggccagtt

SEQ ID NO: 3278472 - DNA, 14 bp, Homo sapiens
ctgggctgggccct

SEQ ID NO: 3278473 - DNA, 23 bp, Homo sapiens
ctgggctgtaacgtggcactggt

SEQ ID NO: 3278474 - DNA, 17 bp, Homo sapiens
ctgggctgtctgtcacc

SEQ ID NO: 3278475 - DNA, 21 bp, Homo sapiens
ctgggctgtctgtcaccagct

SEQ ID NO: 3278476 - DNA, 12 bp, Homo sapiens
ctgggctgtgct

SEQ ID NO: 3278477 - DNA, 14 bp, Homo sapiens
ctgggctgttggca

SEQ ID NO: 3278478 - DNA, 15 bp, Homo sapiens
ctgggcttcagtggc

SEQ ID NO: 3278479 - DNA, 21 bp, Homo sapiens
ctgggcttcagtggcagctgc

SEQ ID NO: 3278480 - DNA, 23 bp, Homo sapiens
ctgggcttcagtggcagctgctt

SEQ ID NO: 3278481 - DNA, 15 bp, Homo sapiens
ctgggcttcatctgg

SEQ ID NO: 3278482 - DNA, 13 bp, Homo sapiens
ctgggcttggcct

SEQ ID NO: 3278483 - DNA, 19 bp, Homo sapiens
ctgggcttggggcttccta

SEQ ID NO: 3278484 - DNA, 20 bp, Homo sapiens
ctgggcttggggcttcctaa

SEQ ID NO: 3278485 - DNA, 17 bp, Homo sapiens
ctgggcttggggtgtgg

SEQ ID NO: 3278486 - DNA, 22 bp, Homo sapiens
ctgggcttttggtttgggggcg

SEQ ID NO: 3278487 - DNA, 20 bp, Homo sapiens
ctggggaaacaacatttata

SEQ ID NO: 3278488 - DNA, 15 bp, Homo sapiens
ctggggaaggagcca

SEQ ID NO: 3278489 - DNA, 16 bp, Homo sapiens
ctggggaaggagccag

SEQ ID NO: 3278490 - DNA, 13 bp, Homo sapiens
ctggggacagagg

SEQ ID NO: 3278491 - DNA, 13 bp, Homo sapiens
ctggggactcagg

SEQ ID NO: 3278492 - DNA, 15 bp, Homo sapiens
ctggggactcaggga

SEQ ID NO: 3278493 - DNA, 20 bp, Homo sapiens
ctggggactgctacctctga

SEQ ID NO: 3278494 - DNA, 12 bp, Homo sapiens
ctcccccgccac

SEQ ID NO: 3278495 - DNA, 19 bp, Homo sapiens
ctccccctcaacctcacca

SEQ ID NO: 3278496 - DNA, 14 bp, Homo sapiens
ctccccctcagatg

SEQ ID NO: 3278497 - DNA, 23 bp, Homo sapiens
ctccccctgcaacttccgctgag

SEQ ID NO: 3278498 - DNA, 11 bp, Homo sapiens
ctccccctggg

SEQ ID NO: 3278499 - DNA, 13 bp, Homo sapiens
ctccccctgggct

SEQ ID NO: 3278500 - DNA, 12 bp, Homo sapiens
ctccccctgttc

SEQ ID NO: 3278501 - DNA, 20 bp, Homo sapiens
ctccccgcctggccagggca

SEQ ID NO: 3278502 - DNA, 21 bp, Homo sapiens
ctccccgcctggccagggcag

SEQ ID NO: 3278503 - DNA, 15 bp, Homo sapiens
ctccccgcctgttcc

SEQ ID NO: 3278504 - DNA, 22 bp, Homo sapiens
ctccccgccttccgccccttcc

SEQ ID NO: 3278505 - DNA, 20 bp, Homo sapiens
ctccccggacatactctctg

SEQ ID NO: 3278506 - DNA, 19 bp, Homo sapiens
ctccccggcaccctctggc

SEQ ID NO: 3278507 - DNA, 10 bp, Homo sapiens
ctcccctcaa

SEQ ID NO: 3278508 - DNA, 20 bp, Homo sapiens
ctcccctcaaagtctgcaac

SEQ ID NO: 3278509 - DNA, 12 bp, Homo sapiens
ctcccctccagc

SEQ ID NO: 3278510 - DNA, 14 bp, Homo sapiens
ctcccctccatccc

SEQ ID NO: 3278511 - DNA, 19 bp, Homo sapiens
ctcccctccatccctggcc

SEQ ID NO: 3278512 - DNA, 12 bp, Homo sapiens
ctcccctcccag

SEQ ID NO: 3278513 - DNA, 13 bp, Homo sapiens
ctcccctcccagt

SEQ ID NO: 3278514 - DNA, 16 bp, Homo sapiens
ctcccctcccagtcct

SEQ ID NO: 3278515 - DNA, 18 bp, Homo sapiens
ctcccctccccgcctggc

SEQ ID NO: 3278516 - DNA, 21 bp, Homo sapiens
ctcccctccccgcctggccag

SEQ ID NO: 3278517 - DNA, 13 bp, Homo sapiens
ctcccctcccttg

SEQ ID NO: 3278518 - DNA, 13 bp, Homo sapiens
ctcccctccttgt

SEQ ID NO: 3278519 - DNA, 17 bp, Homo sapiens
ctcccctcgtgtcagct

SEQ ID NO: 3278520 - DNA, 12 bp, Homo sapiens
ctcccctctctt

SEQ ID NO: 3278521 - DNA, 17 bp, Homo sapiens
ctcccctctcttgcacc

SEQ ID NO: 3278522 - DNA, 13 bp, Homo sapiens
ctcccctcttgag

SEQ ID NO: 3278523 - DNA, 23 bp, Homo sapiens
ctcccctgccaccaggccacctc

SEQ ID NO: 3278524 - DNA, 13 bp, Homo sapiens
ctcccctgccctg

SEQ ID NO: 3278525 - DNA, 15 bp, Homo sapiens
ctcccctgccctgct

SEQ ID NO: 3278526 - DNA, 23 bp, Homo sapiens
ctcccctgggcatcttctggctt

SEQ ID NO: 3278527 - DNA, 12 bp, Homo sapiens
ctccccttctct

SEQ ID NO: 3278528 - DNA, 14 bp, Homo sapiens
ctccccttgccttc

SEQ ID NO: 3278529 - DNA, 17 bp, Homo sapiens
ctccccttgccttcccc

SEQ ID NO: 3278530 - DNA, 21 bp, Homo sapiens
ctccccttgccttcccctgtc

SEQ ID NO: 3278531 - DNA, 14 bp, Homo sapiens
ctcccgaagccacc

SEQ ID NO: 3278532 - DNA, 19 bp, Homo sapiens
ctcccgaatagctgggact

SEQ ID NO: 3278533 - DNA, 15 bp, Homo sapiens
ctcccgagtagctgg

SEQ ID NO: 3278534 - DNA, 16 bp, Homo sapiens
ctcccgagtagctggg

SEQ ID NO: 3278535 - DNA, 11 bp, Homo sapiens
ctcccgcggtg

SEQ ID NO: 3278536 - DNA, 23 bp, Homo sapiens
ctcccgctgcaagtcagattgct

SEQ ID NO: 3278537 - DNA, 19 bp, Homo sapiens
ctcccggaggttgggtggg

SEQ ID NO: 3278538 - DNA, 14 bp, Homo sapiens
ctcccggctgcctg

SEQ ID NO: 3278539 - DNA, 21 bp, Homo sapiens
ctcccgggccacgccccagcc

SEQ ID NO: 3278540 - DNA, 14 bp, Homo sapiens
ctcccgtcagggcc

SEQ ID NO: 3278541 - DNA, 21 bp, Homo sapiens
ctcccgtcagggcccaagtcc

SEQ ID NO: 3278542 - DNA, 14 bp, Homo sapiens
ctccctaaactgta

SEQ ID NO: 3278543 - DNA, 13 bp, Homo sapiens
ctccctacactga

SEQ ID NO: 3278544 - DNA, 14 bp, Homo sapiens
ctccctactcccct

SEQ ID NO: 3278545 - DNA, 17 bp, Homo sapiens
ctccctagactgcatcc

SEQ ID NO: 3278546 - DNA, 14 bp, Homo sapiens
ctccctagtctcca

SEQ ID NO: 3278547 - DNA, 22 bp, Homo sapiens
ctccctcacaagcgctcccagc

SEQ ID NO: 3278548 - DNA, 17 bp, Homo sapiens
ctccctcagctctctgg

SEQ ID NO: 3278549 - DNA, 18 bp, Homo sapiens
ctccctcagctctctggg

SEQ ID NO: 3278550 - DNA, 14 bp, Homo sapiens
ctccctcatggctc

SEQ ID NO: 3278551 - DNA, 19 bp, Homo sapiens
ctccctcatggctctggca

SEQ ID NO: 3278552 - DNA, 14 bp, Homo sapiens
ctccctccacctac

SEQ ID NO: 3278553 - DNA, 16 bp, Homo sapiens
ctccctccagtaccat

SEQ ID NO: 3278554 - DNA, 22 bp, Homo sapiens
ctgtaaaaacactgaaaaatta

SEQ ID NO: 3278555 - DNA, 22 bp, Homo sapiens
ctgtaaaatgcatgattttgta

SEQ ID NO: 3278556 - DNA, 19 bp, Homo sapiens
ctgtaaaattataaacttt

SEQ ID NO: 3278557 - DNA, 19 bp, Homo sapiens
ctgtaaactcaaaacttaa

SEQ ID NO: 3278558 - DNA, 22 bp, Homo sapiens
ctgtaaactcaaaacttaacat

SEQ ID NO: 3278559 - DNA, 13 bp, Homo sapiens
ctgtaaactgtgt

SEQ ID NO: 3278560 - DNA, 22 bp, Homo sapiens
ctgtaaagagacctacctcagg

SEQ ID NO: 3278561 - DNA, 20 bp, Homo sapiens
ctgtaaatcctagacttgaa

SEQ ID NO: 3278562 - DNA, 17 bp, Homo sapiens
ctgtaaatggtgtacat

SEQ ID NO: 3278563 - DNA, 23 bp, Homo sapiens
ctgtaaatggtgtacataatgta

SEQ ID NO: 3278564 - DNA, 16 bp, Homo sapiens
ctgtaaattgaacttc

SEQ ID NO: 3278565 - DNA, 17 bp, Homo sapiens
ctgtaaattgaacttcc

SEQ ID NO: 3278566 - DNA, 19 bp, Homo sapiens
ctgtaacatactggcctgg

SEQ ID NO: 3278567 - DNA, 22 bp, Homo sapiens
ctgtaacatcactatccatgca

SEQ ID NO: 3278568 - DNA, 20 bp, Homo sapiens
ctgtaactgctgagccactc

SEQ ID NO: 3278569 - DNA, 16 bp, Homo sapiens
ctgtaacttttaatcc

SEQ ID NO: 3278570 - DNA, 17 bp, Homo sapiens
ctgtaagaagagactgg

SEQ ID NO: 3278571 - DNA, 22 bp, Homo sapiens
ctgtaagaagagactgggaaga

SEQ ID NO: 3278572 - DNA, 15 bp, Homo sapiens
ctgtaagccaaagaa

SEQ ID NO: 3278573 - DNA, 21 bp, Homo sapiens
ctgtaagccaaagaaatgaac

SEQ ID NO: 3278574 - DNA, 22 bp, Homo sapiens
ctgtaagccaaagaaatgaaca

SEQ ID NO: 3278575 - DNA, 13 bp, Homo sapiens
ctgtaagcctgca

SEQ ID NO: 3278576 - DNA, 17 bp, Homo sapiens
ctgtaagctctttgaaa

SEQ ID NO: 3278577 - DNA, 21 bp, Homo sapiens
ctgtaaggatccggaaagaag

SEQ ID NO: 3278578 - DNA, 14 bp, Homo sapiens
ctgtaaggctctag

SEQ ID NO: 3278579 - DNA, 20 bp, Homo sapiens
ctgtaaggctctagatcata

SEQ ID NO: 3278580 - DNA, 22 bp, Homo sapiens
ctgtaaggctctagatcataag

SEQ ID NO: 3278581 - DNA, 12 bp, Homo sapiens
ctgtaagggcag

SEQ ID NO: 3278582 - DNA, 13 bp, Homo sapiens
ctgtaagggcagt

SEQ ID NO: 3278583 - DNA, 17 bp, Homo sapiens
ctgtaagggcagtgccc

SEQ ID NO: 3278584 - DNA, 23 bp, Homo sapiens
ctgtaataaataaatatactcaa

SEQ ID NO: 3278585 - DNA, 16 bp, Homo sapiens
ctgtaataatacctca

SEQ ID NO: 3278586 - DNA, 23 bp, Homo sapiens
ctgtaatagttcagtagaattac

SEQ ID NO: 3278587 - DNA, 19 bp, Homo sapiens
ctgtaatcatataataaat

SEQ ID NO: 3278588 - DNA, 13 bp, Homo sapiens
ctgtaatcccagc

SEQ ID NO: 3278589 - DNA, 20 bp, Homo sapiens
ctgtaatcccagcactttgg

SEQ ID NO: 3278590 - DNA, 18 bp, Homo sapiens
ctgtaatcccagctactt

SEQ ID NO: 3278591 - DNA, 20 bp, Homo sapiens
ctgtaatcgccctactattc

SEQ ID NO: 3278592 - DNA, 22 bp, Homo sapiens
ctgtaatgatactgattatgaa

SEQ ID NO: 3278593 - DNA, 21 bp, Homo sapiens
ctgtaattaagtaaaccaaaa

SEQ ID NO: 3278594 - DNA, 13 bp, Homo sapiens
ctgtacaaagtag

SEQ ID NO: 3278595 - DNA, 15 bp, Homo sapiens
ctgtacaaagtagaa

SEQ ID NO: 3278596 - DNA, 22 bp, Homo sapiens
ctgtacaatcatgaacagctct

SEQ ID NO: 3278597 - DNA, 21 bp, Homo sapiens
ctgtacacattcctgcattca

SEQ ID NO: 3278598 - DNA, 17 bp, Homo sapiens
ctgtacataaacaatga

SEQ ID NO: 3278599 - DNA, 15 bp, Homo sapiens
ctgtacatagcctat

SEQ ID NO: 3278600 - DNA, 20 bp, Homo sapiens
ctgtacatatttgagactag

SEQ ID NO: 3278601 - DNA, 14 bp, Homo sapiens
ctgtacatctattt

SEQ ID NO: 3278602 - DNA, 13 bp, Homo sapiens
ctgtacatttaaa

SEQ ID NO: 3278603 - DNA, 14 bp, Homo sapiens
ctgtacatttaaaa

SEQ ID NO: 3278604 - DNA, 19 bp, Homo sapiens
ctgtacatttaaaattgct

SEQ ID NO: 3278605 - DNA, 16 bp, Homo sapiens
ctgtacattttgttgt

SEQ ID NO: 3278606 - DNA, 13 bp, Homo sapiens
ctgtaccacatct

SEQ ID NO: 3278607 - DNA, 18 bp, Homo sapiens
ctgtaccagttaattttt

SEQ ID NO: 3278608 - DNA, 15 bp, Homo sapiens
ctgtaccctttaaga

SEQ ID NO: 3278609 - DNA, 16 bp, Homo sapiens
ctgtacctcaaatgaa

SEQ ID NO: 3278610 - DNA, 15 bp, Homo sapiens
ctgtacctcagtgga

SEQ ID NO: 3278611 - DNA, 20 bp, Homo sapiens
ctgtaccttttgaggagccc

SEQ ID NO: 3278612 - DNA, 22 bp, Homo sapiens
ctgtactaaagtaacgcaataa

SEQ ID NO: 3278613 - DNA, 13 bp, Homo sapiens
ctgtactagagat

SEQ ID NO: 3278614 - DNA, 15 bp, Homo sapiens
ctgtactataagtag

SEQ ID NO: 3278615 - DNA, 14 bp, Homo sapiens
ctgtactcagagca

SEQ ID NO: 3278616 - DNA, 13 bp, Homo sapiens
ctgtactcaggag

SEQ ID NO: 3278617 - DNA, 20 bp, Homo sapiens
ctgtactcaggaggctgagg

SEQ ID NO: 3278618 - DNA, 21 bp, Homo sapiens
ctgtactcctcccaggcgccc

SEQ ID NO: 3278619 - DNA, 16 bp, Homo sapiens
ctgtactcttgctgat

SEQ ID NO: 3278620 - DNA, 16 bp, Homo sapiens
ctgtactgacttgagg

SEQ ID NO: 3278621 - DNA, 15 bp, Homo sapiens
ctgtactggccagtg

SEQ ID NO: 3278622 - DNA, 17 bp, Homo sapiens
ctgtactgtgtctcatg

SEQ ID NO: 3278623 - DNA, 20 bp, Homo sapiens
ctgtactgttctgtgtcttt

SEQ ID NO: 3278624 - DNA, 13 bp, Homo sapiens
ctgtacttaataa

SEQ ID NO: 3278625 - DNA, 20 bp, Homo sapiens
ctgtacttcaagttaaagtg

SEQ ID NO: 3278626 - DNA, 21 bp, Homo sapiens
ctgtacttccaatttataatg

SEQ ID NO: 3278627 - DNA, 18 bp, Homo sapiens
ctgtacttttcattctct

SEQ ID NO: 3278628 - DNA, 22 bp, Homo sapiens
ctgtagacctagggaggacctt

SEQ ID NO: 3278629 - DNA, 15 bp, Homo sapiens
ctgtagactagtgcc

SEQ ID NO: 3278630 - DNA, 13 bp, Homo sapiens
ctgtagagttgct

SEQ ID NO: 3278631 - DNA, 16 bp, Homo sapiens
ctgtagagttgctgag

SEQ ID NO: 3278632 - DNA, 14 bp, Homo sapiens
ctgtagatatgtat

SEQ ID NO: 3278633 - DNA, 19 bp, Homo sapiens
ctgtagattgcttctgtag

SEQ ID NO: 3278634 - DNA, 16 bp, Homo sapiens
ctgtagcacttactgg

SEQ ID NO: 3278635 - DNA, 12 bp, Homo sapiens
ctgtagccatgg

SEQ ID NO: 3278636 - DNA, 15 bp, Homo sapiens
ctgtagccatggctc

SEQ ID NO: 3278637 - DNA, 20 bp, Homo sapiens
ctgtagccatggctcaggca

SEQ ID NO: 3278638 - DNA, 21 bp, Homo sapiens
ctgtagccatggctcaggcaa

SEQ ID NO: 3278639 - DNA, 21 bp, Homo sapiens
ctgtagcctatttttttagat

SEQ ID NO: 3278640 - DNA, 20 bp, Homo sapiens
ctgtagctctgcctccctct

SEQ ID NO: 3278641 - DNA, 22 bp, Homo sapiens
ctgtagctgatgaaactcctga

SEQ ID NO: 3278642 - DNA, 16 bp, Homo sapiens
ctgtagcttctaatgt

SEQ ID NO: 3278643 - DNA, 18 bp, Homo sapiens
ctgtagcttgttccctgt

SEQ ID NO: 3278644 - DNA, 14 bp, Homo sapiens
ctgtaggaaaccca

SEQ ID NO: 3278645 - DNA, 21 bp, Homo sapiens
ctgtaggaaggttaatgttca

SEQ ID NO: 3278646 - DNA, 20 bp, Homo sapiens
ctgtagggagggcggcaggg

SEQ ID NO: 3278647 - DNA, 21 bp, Homo sapiens
ctgtagggagggcggcagggg

SEQ ID NO: 3278648 - DNA, 13 bp, Homo sapiens
ctgtagggccagg

SEQ ID NO: 3278649 - DNA, 14 bp, Homo sapiens
ctgtagggctggac

SEQ ID NO: 3278650 - DNA, 15 bp, Homo sapiens
ctgtaggtggtatgt

SEQ ID NO: 3278651 - DNA, 20 bp, Homo sapiens
ctgtagtaaactatttatct

SEQ ID NO: 3278652 - DNA, 19 bp, Homo sapiens
ctgtagtaatttattgtct

SEQ ID NO: 3278653 - DNA, 21 bp, Homo sapiens
ctgtagtagccctttctgtgt

SEQ ID NO: 3278654 - DNA, 22 bp, Homo sapiens
ctgtagtcatttactaaacata

SEQ ID NO: 3278655 - DNA, 14 bp, Homo sapiens
ctgtagtcctttct

SEQ ID NO: 3278656 - DNA, 19 bp, Homo sapiens
ctgtagtcctttctgcctt

SEQ ID NO: 3278657 - DNA, 21 bp, Homo sapiens
ctgtagtcctttctgccttgg

SEQ ID NO: 3278658 - DNA, 13 bp, Homo sapiens
ctgtagtctctga

SEQ ID NO: 3278659 - DNA, 18 bp, Homo sapiens
ctgtagttaggaaataaa

SEQ ID NO: 3278660 - DNA, 20 bp, Homo sapiens
ctgtagttcctaatggattc

SEQ ID NO: 3278661 - DNA, 20 bp, Homo sapiens
ctgtagttgcgtggactctg

SEQ ID NO: 3278662 - DNA, 23 bp, Homo sapiens
ctgtagtttatggcagaagggaa

SEQ ID NO: 3278663 - DNA, 21 bp, Homo sapiens
ctgtataaacattaaatgtct

SEQ ID NO: 3278664 - DNA, 14 bp, Homo sapiens
ctgtataaatagga

SEQ ID NO: 3278665 - DNA, 16 bp, Homo sapiens
ctgtataaataggaga

SEQ ID NO: 3278666 - DNA, 19 bp, Homo sapiens
ctgtataaataggagagga

SEQ ID NO: 3278667 - DNA, 15 bp, Homo sapiens
ctgtataagcactga

SEQ ID NO: 3278668 - DNA, 21 bp, Homo sapiens
ctgtataagtggaggcacttt

SEQ ID NO: 3278669 - DNA, 22 bp, Homo sapiens
ctgtataagtggaggcacttta

SEQ ID NO: 3278670 - DNA, 22 bp, Homo sapiens
ctgtataagttatttttgtaca

SEQ ID NO: 3278671 - DNA, 18 bp, Homo sapiens
ctgtataatagagataag

SEQ ID NO: 3278672 - DNA, 13 bp, Homo sapiens
ctgtatatacttt

SEQ ID NO: 3278673 - DNA, 15 bp, Homo sapiens
ctgtatatacttttt

SEQ ID NO: 3278674 - DNA, 15 bp, Homo sapiens
ctgtatatgtattcc

SEQ ID NO: 3278675 - DNA, 14 bp, Homo sapiens
ctgtatattcagga

SEQ ID NO: 3278676 - DNA, 22 bp, Homo sapiens
ctgtatatttgtgatagcactt

SEQ ID NO: 3278677 - DNA, 16 bp, Homo sapiens
ctgtatcattttcttt

SEQ ID NO: 3278678 - DNA, 23 bp, Homo sapiens
ctgtatccaggttccctcccaga

SEQ ID NO: 3278679 - DNA, 20 bp, Homo sapiens
ctgtatcccatgagcctcag

SEQ ID NO: 3278680 - DNA, 18 bp, Homo sapiens
ctgtatgatttgttttga

SEQ ID NO: 3278681 - DNA, 23 bp, Homo sapiens
ctgtatgatttgttttgaatttt

SEQ ID NO: 3278682 - DNA, 15 bp, Homo sapiens
ctgtatgccttctgt

SEQ ID NO: 3278683 - DNA, 16 bp, Homo sapiens
ctgtatgccttctgta

SEQ ID NO: 3278684 - DNA, 16 bp, Homo sapiens
ctgtatgctgatcatc

SEQ ID NO: 3278685 - DNA, 15 bp, Homo sapiens
ctgtatggaaacact

SEQ ID NO: 3278686 - DNA, 21 bp, Homo sapiens
ctgtatggaaacactgatttt

SEQ ID NO: 3278687 - DNA, 12 bp, Homo sapiens
ctgtatgtcaga

SEQ ID NO: 3278688 - DNA, 13 bp, Homo sapiens
ctgtatgttgtac

SEQ ID NO: 3278689 - DNA, 14 bp, Homo sapiens
ctgtatgttgtaca

SEQ ID NO: 3278690 - DNA, 18 bp, Homo sapiens
ctgtatgttgtacaatca

SEQ ID NO: 3278691 - DNA, 15 bp, Homo sapiens
ctgtatgttgtccaa

SEQ ID NO: 3278692 - DNA, 23 bp, Homo sapiens
ctgtattaaatcttaaacaatgt

SEQ ID NO: 3278693 - DNA, 14 bp, Homo sapiens
ctgtattacagctt

SEQ ID NO: 3278694 - DNA, 20 bp, Homo sapiens
ctgtattccgatacaaagtg

SEQ ID NO: 3278695 - DNA, 16 bp, Homo sapiens
ctgtattcgtgcattt

SEQ ID NO: 3278696 - DNA, 18 bp, Homo sapiens
ctgtattcttgttttaca

SEQ ID NO: 3278697 - DNA, 22 bp, Homo sapiens
ctgtattcttgttttacatttg

SEQ ID NO: 3278698 - DNA, 14 bp, Homo sapiens
ctgtattgtctgaa

SEQ ID NO: 3278699 - DNA, 17 bp, Homo sapiens
ctgtattgtctgaactt

SEQ ID NO: 3278700 - DNA, 21 bp, Homo sapiens
ctgtattgtgctgattgtgga

SEQ ID NO: 3278701 - DNA, 23 bp, Homo sapiens
ctgtattttatttagacaagaga

SEQ ID NO: 3278702 - DNA, 14 bp, Homo sapiens
ctgtcaaaacactg

SEQ ID NO: 3278703 - DNA, 16 bp, Homo sapiens
ctgtcaaaacactgtg

SEQ ID NO: 3278704 - DNA, 19 bp, Homo sapiens
ctgtcaaaacactgtggaa

SEQ ID NO: 3278705 - DNA, 20 bp, Homo sapiens
ctgtcaaaacactgtggaac

SEQ ID NO: 3278706 - DNA, 17 bp, Homo sapiens
ctgtcaaattttcaaat

SEQ ID NO: 3278707 - DNA, 17 bp, Homo sapiens
ctgtcaaggctgcttag

SEQ ID NO: 3278708 - DNA, 20 bp, Homo sapiens
ctgtcaagttaacaaggaat

SEQ ID NO: 3278709 - DNA, 21 bp, Homo sapiens
ctgtcaagttaacaaggaatg

SEQ ID NO: 3278710 - DNA, 12 bp, Homo sapiens
ctgtcaataaac

SEQ ID NO: 3278711 - DNA, 20 bp, Homo sapiens
ctgtcaatgattattttcat

SEQ ID NO: 3278712 - DNA, 19 bp, Homo sapiens
ctgtcacagtaaaaataaa

SEQ ID NO: 3278713 - DNA, 22 bp, Homo sapiens
ctgtcacagtaaaaataaaata

SEQ ID NO: 3278714 - DNA, 22 bp, Homo sapiens
ctgtcacatagtttttcctggg

SEQ ID NO: 3278715 - DNA, 14 bp, Homo sapiens
ctgtcactggctgg

SEQ ID NO: 3278716 - DNA, 16 bp, Homo sapiens
ctgtcactggctggct

SEQ ID NO: 3278717 - DNA, 18 bp, Homo sapiens
ctgtcactggctggctcc

SEQ ID NO: 3278718 - DNA, 21 bp, Homo sapiens
ctgtcactggctggctcctag

SEQ ID NO: 3278719 - DNA, 11 bp, Homo sapiens
ctgtcactgtt

SEQ ID NO: 3278720 - DNA, 12 bp, Homo sapiens
ctgtcactttgc

SEQ ID NO: 3278721 - DNA, 17 bp, Homo sapiens
ctgtcactttgctctgg

SEQ ID NO: 3278722 - DNA, 12 bp, Homo sapiens
ctgtcagaatgc

SEQ ID NO: 3278723 - DNA, 17 bp, Homo sapiens
ctgtcagatgagaacaa

SEQ ID NO: 3278724 - DNA, 20 bp, Homo sapiens
ctgtcagatgagaacaaagc

SEQ ID NO: 3278725 - DNA, 21 bp, Homo sapiens
ctgtcagatgagaacaaagct

SEQ ID NO: 3278726 - DNA, 21 bp, Homo sapiens
ctgtcagattaaattacagct

SEQ ID NO: 3278727 - DNA, 19 bp, Homo sapiens
cttatttatgttaaaagat

SEQ ID NO: 3278728 - DNA, 22 bp, Homo sapiens
cttatttcactatcttcttcaa

SEQ ID NO: 3278729 - DNA, 23 bp, Homo sapiens
cttatttcactatcttcttcaaa

SEQ ID NO: 3278730 - DNA, 12 bp, Homo sapiens
cttatttccaag

SEQ ID NO: 3278731 - DNA, 16 bp, Homo sapiens
cttatttctgaattca

SEQ ID NO: 3278732 - DNA, 17 bp, Homo sapiens
cttatttctgctctgga

SEQ ID NO: 3278733 - DNA, 16 bp, Homo sapiens
cttattttaatgtgat

SEQ ID NO: 3278734 - DNA, 17 bp, Homo sapiens
cttattttaatgtgatg

SEQ ID NO: 3278735 - DNA, 21 bp, Homo sapiens
cttattttagaaattataatt

SEQ ID NO: 3278736 - DNA, 12 bp, Homo sapiens
cttattttcaag

SEQ ID NO: 3278737 - DNA, 18 bp, Homo sapiens
cttattttcaagaaactg

SEQ ID NO: 3278738 - DNA, 15 bp, Homo sapiens
cttattttctctgtg

SEQ ID NO: 3278739 - DNA, 20 bp, Homo sapiens
cttattttgtcttattctta

SEQ ID NO: 3278740 - DNA, 13 bp, Homo sapiens
cttatttttccta

SEQ ID NO: 3278741 - DNA, 15 bp, Homo sapiens
cttcaaaatgtatat

SEQ ID NO: 3278742 - DNA, 20 bp, Homo sapiens
cttcaaaatgtatatattta

SEQ ID NO: 3278743 - DNA, 17 bp, Homo sapiens
cttcaaactttcacttt

SEQ ID NO: 3278744 - DNA, 13 bp, Homo sapiens
cttcaaagaaact

SEQ ID NO: 3278745 - DNA, 16 bp, Homo sapiens
cttcaaagaaacttga

SEQ ID NO: 3278746 - DNA, 13 bp, Homo sapiens
cttcaaagccttc

SEQ ID NO: 3278747 - DNA, 18 bp, Homo sapiens
cttcaaatccttccaaaa

SEQ ID NO: 3278748 - DNA, 16 bp, Homo sapiens
cttcaaattcaaggcc

SEQ ID NO: 3278749 - DNA, 18 bp, Homo sapiens
cttcaaattcaaggcctt

SEQ ID NO: 3278750 - DNA, 23 bp, Homo sapiens
cttcaacagaccccctctagaaa

SEQ ID NO: 3278751 - DNA, 19 bp, Homo sapiens
cttcaacatcaatgttcat

SEQ ID NO: 3278752 - DNA, 22 bp, Homo sapiens
cttcaacatcaatgttcattgt

SEQ ID NO: 3278753 - DNA, 13 bp, Homo sapiens
cttcaacatcctg

SEQ ID NO: 3278754 - DNA, 18 bp, Homo sapiens
cttcaacatcctgccagc

SEQ ID NO: 3278755 - DNA, 22 bp, Homo sapiens
cttcaacattaaggcagtatga

SEQ ID NO: 3278756 - DNA, 14 bp, Homo sapiens
cttcaacccagtgg

SEQ ID NO: 3278757 - DNA, 15 bp, Homo sapiens
cttcaacccagtggg

SEQ ID NO: 3278758 - DNA, 17 bp, Homo sapiens
cttcaactgaccagcct

SEQ ID NO: 3278759 - DNA, 17 bp, Homo sapiens
cttcaagccagctctag

SEQ ID NO: 3278760 - DNA, 20 bp, Homo sapiens
cttcaaggatatactgcagc

SEQ ID NO: 3278761 - DNA, 13 bp, Homo sapiens
cttcaagtgccaa

SEQ ID NO: 3278762 - DNA, 13 bp, Homo sapiens
cttcaagtgcctt

SEQ ID NO: 3278763 - DNA, 23 bp, Homo sapiens
cttcaagtgccttttgctgcgca

SEQ ID NO: 3278764 - DNA, 19 bp, Homo sapiens
cttcaagttagctcaggag

SEQ ID NO: 3278765 - DNA, 14 bp, Homo sapiens
cttcaatagaactg

SEQ ID NO: 3278766 - DNA, 14 bp, Homo sapiens
cttcaatcccagcc

SEQ ID NO: 3278767 - DNA, 16 bp, Homo sapiens
cttcaattcctgggcc

SEQ ID NO: 3278768 - DNA, 20 bp, Homo sapiens
cttcaatttattactgaaaa

SEQ ID NO: 3278769 - DNA, 17 bp, Homo sapiens
cttcacaccccaggccc

SEQ ID NO: 3278770 - DNA, 19 bp, Homo sapiens
cttcacaccccaggccctt

SEQ ID NO: 3278771 - DNA, 14 bp, Homo sapiens
cttcacaggcactc

SEQ ID NO: 3278772 - DNA, 18 bp, Homo sapiens
cttcacaggcagtgcatg

SEQ ID NO: 3278773 - DNA, 19 bp, Homo sapiens
cttcacaggcagtgcatgt

SEQ ID NO: 3278774 - DNA, 17 bp, Homo sapiens
cttcacagtagagccag

SEQ ID NO: 3278775 - DNA, 18 bp, Homo sapiens
cttcacagtagagccagc

SEQ ID NO: 3278776 - DNA, 19 bp, Homo sapiens
cttcacagtagagccagct

SEQ ID NO: 3278777 - DNA, 22 bp, Homo sapiens
cttcacagtagagccagcttgg

SEQ ID NO: 3278778 - DNA, 12 bp, Homo sapiens
cttcacagtgtt

SEQ ID NO: 3278779 - DNA, 17 bp, Homo sapiens
cttcacataccctcccc

SEQ ID NO: 3278780 - DNA, 17 bp, Homo sapiens
cttcacattaaaaaatg

SEQ ID NO: 3278781 - DNA, 18 bp, Homo sapiens
cttcaccccggcaggccc

SEQ ID NO: 3278782 - DNA, 20 bp, Homo sapiens
cttcaccccggcaggccctg

SEQ ID NO: 3278783 - DNA, 22 bp, Homo sapiens
cttcaccccggcaggccctgca

SEQ ID NO: 3278784 - DNA, 14 bp, Homo sapiens
cttcacccctgcac

SEQ ID NO: 3278785 - DNA, 16 bp, Homo sapiens
cttcacccctgcactt

SEQ ID NO: 3278786 - DNA, 24 bp, Homo sapiens
cttcaccctcaccccctcctggca

SEQ ID NO: 3278787 - DNA, 21 bp, Homo sapiens
cttcaccctgaatggttccat

SEQ ID NO: 3278788 - DNA, 15 bp, Homo sapiens
cttcaccctgagttt

SEQ ID NO: 3278789 - DNA, 14 bp, Homo sapiens
cttcaccctgtcaa

SEQ ID NO: 3278790 - DNA, 21 bp, Homo sapiens
cttcaccctgtcaagttaaca

SEQ ID NO: 3278791 - DNA, 17 bp, Homo sapiens
cttcactcaaattttgg

SEQ ID NO: 3278792 - DNA, 23 bp, Homo sapiens
cttcactccggtgtgcctgcagc

SEQ ID NO: 3278793 - DNA, 24 bp, Homo sapiens
cttcactccggtgtgcctgcagcc

SEQ ID NO: 3278794 - DNA, 14 bp, Homo sapiens
cttcactctccagg

SEQ ID NO: 3278795 - DNA, 16 bp, Homo sapiens
cttcactgtataaata

SEQ ID NO: 3278796 - DNA, 23 bp, Homo sapiens
cttcactgtataaataggagagg

SEQ ID NO: 3278797 - DNA, 17 bp, Homo sapiens
cttcactgtcatcttca

SEQ ID NO: 3278798 - DNA, 18 bp, Homo sapiens
cttcactgtggccacagc

SEQ ID NO: 3278799 - DNA, 20 bp, Homo sapiens
cttcactgttccctctggct

SEQ ID NO: 3278800 - DNA, 19 bp, Homo sapiens
cttcactgttgaaaattat

SEQ ID NO: 3278801 - DNA, 22 bp, Homo sapiens
cttcagaaacccggcttcctgt

SEQ ID NO: 3278802 - DNA, 23 bp, Homo sapiens
cttcagaaacccggcttcctgtg

SEQ ID NO: 3278803 - DNA, 16 bp, Homo sapiens
cttcagaacacacaga

SEQ ID NO: 3278804 - DNA, 18 bp, Homo sapiens
cttcagaacacacagact

SEQ ID NO: 3278805 - DNA, 23 bp, Homo sapiens
cttcagaacacacagactttctg

SEQ ID NO: 3278806 - DNA, 15 bp, Homo sapiens
cttcagaactgccct

SEQ ID NO: 3278807 - DNA, 16 bp, Homo sapiens
cttcagaactgccctt

SEQ ID NO: 3278808 - DNA, 15 bp, Homo sapiens
cttcagaacttgtca

SEQ ID NO: 3278809 - DNA, 14 bp, Homo sapiens
cttcagactctcag

SEQ ID NO: 3278810 - DNA, 14 bp, Homo sapiens
cttcagactttgct

SEQ ID NO: 3278811 - DNA, 18 bp, Homo sapiens
cttcagactttgcttccc

SEQ ID NO: 3278812 - DNA, 16 bp, Homo sapiens
cttcagagagctggta

SEQ ID NO: 3278813 - DNA, 22 bp, Homo sapiens
cttcagagagctggtagttagt

SEQ ID NO: 3278814 - DNA, 16 bp, Homo sapiens
cttcagagtttgtgtg

SEQ ID NO: 3278815 - DNA, 18 bp, Homo sapiens
cttcagatttgtgttata

SEQ ID NO: 3278816 - DNA, 13 bp, Homo sapiens
cttcagcattccc

SEQ ID NO: 3278817 - DNA, 17 bp, Homo sapiens
cttcagcattccctccc

SEQ ID NO: 3278818 - DNA, 16 bp, Homo sapiens
cttcagcccccagccc

SEQ ID NO: 3278819 - DNA, 17 bp, Homo sapiens
cttcagcccccagcccc

SEQ ID NO: 3278820 - DNA, 20 bp, Homo sapiens
cttcagcccccagcccctcc

SEQ ID NO: 3278821 - DNA, 13 bp, Homo sapiens
cttcagccccttc

SEQ ID NO: 3278822 - DNA, 22 bp, Homo sapiens
cttcagccccttctcccctccc

SEQ ID NO: 3278823 - DNA, 13 bp, Homo sapiens
cttcagcctctcc

SEQ ID NO: 3278824 - DNA, 16 bp, Homo sapiens
cttcagcctgaggctg

SEQ ID NO: 3278825 - DNA, 20 bp, Homo sapiens
cttcagcctgaggctgagac

SEQ ID NO: 3278826 - DNA, 20 bp, Homo sapiens
cttcagctagcttttaggaa

SEQ ID NO: 3278827 - DNA, 15 bp, Homo sapiens
cttcagctccaggga

SEQ ID NO: 3278828 - DNA, 18 bp, Homo sapiens
cttcagctgcctgaaaca

SEQ ID NO: 3278829 - DNA, 15 bp, Homo sapiens
cttcaggcaccagca

SEQ ID NO: 3278830 - DNA, 21 bp, Homo sapiens
cttcaggcatggggggtgggg

SEQ ID NO: 3278831 - DNA, 14 bp, Homo sapiens
cttcaggctcttct

SEQ ID NO: 3278832 - DNA, 16 bp, Homo sapiens
cttcaggctcttctcc

SEQ ID NO: 3278833 - DNA, 18 bp, Homo sapiens
cttcaggctcttctcctt

SEQ ID NO: 3278834 - DNA, 16 bp, Homo sapiens
cttcagggcagggctc

SEQ ID NO: 3278835 - DNA, 20 bp, Homo sapiens
cttcagggcagggctctgat

SEQ ID NO: 3278836 - DNA, 23 bp, Homo sapiens
cttcagggccagaaggagggcag

SEQ ID NO: 3278837 - DNA, 15 bp, Homo sapiens
cttcaggggatgggt

SEQ ID NO: 3278838 - DNA, 23 bp, Homo sapiens
cttcaggtaaagggcaaataatg

SEQ ID NO: 3278839 - DNA, 15 bp, Homo sapiens
cttcaggtgaacact

SEQ ID NO: 3278840 - DNA, 20 bp, Homo sapiens
cttcaggttatcgaaataac

SEQ ID NO: 3278841 - DNA, 16 bp, Homo sapiens
cttcagtcagaaaact

SEQ ID NO: 3278842 - DNA, 19 bp, Homo sapiens
cttcagtcctgctccagaa

SEQ ID NO: 3278843 - DNA, 23 bp, Homo sapiens
cttcagtcctgctccagaatttg

SEQ ID NO: 3278844 - DNA, 14 bp, Homo sapiens
cttcagtgactcct

SEQ ID NO: 3278845 - DNA, 23 bp, Homo sapiens
cttcagtgactcctgctggtacc

SEQ ID NO: 3278846 - DNA, 14 bp, Homo sapiens
cttcagttgcttgt

SEQ ID NO: 3278847 - DNA, 19 bp, Homo sapiens
cttcagttggtgtgttttt

SEQ ID NO: 3278848 - DNA, 19 bp, Homo sapiens
cttcagtttaatgtctcct

SEQ ID NO: 3278849 - DNA, 19 bp, Homo sapiens
cttcataacaattttagga

SEQ ID NO: 3278850 - DNA, 16 bp, Homo sapiens
cttcatactggcagga

SEQ ID NO: 3278851 - DNA, 15 bp, Homo sapiens
cttcatccctttcca

SEQ ID NO: 3278852 - DNA, 11 bp, Homo sapiens
cttcatcctct

SEQ ID NO: 3278853 - DNA, 14 bp, Homo sapiens
cttcatctggcaac

SEQ ID NO: 3278854 - DNA, 13 bp, Homo sapiens
cttcatctgggac

SEQ ID NO: 3278855 - DNA, 16 bp, Homo sapiens
cttcatgaaactgtcc

SEQ ID NO: 3278856 - DNA, 14 bp, Homo sapiens
cttcatgccagcta

SEQ ID NO: 3278857 - DNA, 15 bp, Homo sapiens
cttcatgccagctac

SEQ ID NO: 3278858 - DNA, 18 bp, Homo sapiens
cttcatgcccttctgatt

SEQ ID NO: 3278859 - DNA, 14 bp, Homo sapiens
cttcatgcctttgt

SEQ ID NO: 3278860 - DNA, 15 bp, Homo sapiens
cttcatgcctttgta

SEQ ID NO: 3278861 - DNA, 21 bp, Homo sapiens
cttcattccattgacttagag

SEQ ID NO: 3278862 - DNA, 13 bp, Homo sapiens
cttcattctcctt

SEQ ID NO: 3278863 - DNA, 21 bp, Homo sapiens
cttcattgagagttttgtctt

SEQ ID NO: 3278864 - DNA, 13 bp, Homo sapiens
cttcatttaaaaa

SEQ ID NO: 3278865 - DNA, 19 bp, Homo sapiens
cttcatttaaaaaaatcac

SEQ ID NO: 3278866 - DNA, 14 bp, Homo sapiens
cttcatttcaatca

SEQ ID NO: 3278867 - DNA, 15 bp, Homo sapiens
cttcatttcattgta

SEQ ID NO: 3278868 - DNA, 17 bp, Homo sapiens
cttcatttcattgtatg

SEQ ID NO: 3278869 - DNA, 11 bp, Homo sapiens
cttcatttgta

SEQ ID NO: 3278870 - DNA, 14 bp, Homo sapiens
cttcattttatatt

SEQ ID NO: 3278871 - DNA, 16 bp, Homo sapiens
cttcattttatattta

SEQ ID NO: 3278872 - DNA, 16 bp, Homo sapiens
cttccaaaaattatta

SEQ ID NO: 3278873 - DNA, 15 bp, Homo sapiens
cttccaaacaaaagc

SEQ ID NO: 3278874 - DNA, 21 bp, Homo sapiens
cttccaaagtaaaattgctgt

SEQ ID NO: 3278875 - DNA, 17 bp, Homo sapiens
cttccaaatttggctca

SEQ ID NO: 3278876 - DNA, 16 bp, Homo sapiens
cttccaagcatgacaa

SEQ ID NO: 3278877 - DNA, 18 bp, Homo sapiens
cttccaaggagaccaagt

SEQ ID NO: 3278878 - DNA, 20 bp, Homo sapiens
cttccaaggagaccaagtcc

SEQ ID NO: 3278879 - DNA, 18 bp, Homo sapiens
cttccaaggccctgcttt

SEQ ID NO: 3278880 - DNA, 19 bp, Homo sapiens
cttccaataaagcagcctc

SEQ ID NO: 3278881 - DNA, 19 bp, Homo sapiens
cttccaatttataatgaat

SEQ ID NO: 3278882 - DNA, 22 bp, Homo sapiens
cttccacacaattatttatttc

SEQ ID NO: 3278883 - DNA, 14 bp, Homo sapiens
cttccacatgtaca

SEQ ID NO: 3278884 - DNA, 15 bp, Homo sapiens
cttccacatgtacat

SEQ ID NO: 3278885 - DNA, 16 bp, Homo sapiens
cttccacatgttactg

SEQ ID NO: 3278886 - DNA, 14 bp, Homo sapiens
cttccacccattcc

SEQ ID NO: 3278887 - DNA, 18 bp, Homo sapiens
cttccacccgtctctctg

SEQ ID NO: 3278888 - DNA, 22 bp, Homo sapiens
cttccacctcctagaggtgggc

SEQ ID NO: 3278889 - DNA, 17 bp, Homo sapiens
cttccacctgtgccctc

SEQ ID NO: 3278890 - DNA, 14 bp, Homo sapiens
cttccactgcctct

SEQ ID NO: 3278891 - DNA, 19 bp, Homo sapiens
cttccactgcctctgcctt

SEQ ID NO: 3278892 - DNA, 15 bp, Homo sapiens
cttccacttctaact

SEQ ID NO: 3278893 - DNA, 13 bp, Homo sapiens
cttccagacctgc

SEQ ID NO: 3278894 - DNA, 17 bp, Homo sapiens
cttccagatcactgcca

SEQ ID NO: 3278895 - DNA, 18 bp, Homo sapiens
cttccagatcactgccac

SEQ ID NO: 3278896 - DNA, 13 bp, Homo sapiens
cttccagctcctg

SEQ ID NO: 3278897 - DNA, 14 bp, Homo sapiens
cttccagctcctgt

SEQ ID NO: 3278898 - DNA, 18 bp, Homo sapiens
cttccagcttcaggcacc

SEQ ID NO: 3278899 - DNA, 22 bp, Homo sapiens
cttccagcttcaggcaccagca

SEQ ID NO: 3278900 - DNA, 22 bp, Homo sapiens
cttccaggaaactccacatctg

SEQ ID NO: 3278901 - DNA, 16 bp, Homo sapiens
cttccaggcccccacc

SEQ ID NO: 3278902 - DNA, 13 bp, Homo sapiens
cttccaggctctt

SEQ ID NO: 3278903 - DNA, 17 bp, Homo sapiens
cttccaggctcttcctg

SEQ ID NO: 3278904 - DNA, 15 bp, Homo sapiens
cttccaggggaacct

SEQ ID NO: 3278905 - DNA, 16 bp, Homo sapiens
cttccaggggaacctg

SEQ ID NO: 3278906 - DNA, 19 bp, Homo sapiens
cttccaggggaacctgcca

SEQ ID NO: 3278907 - DNA, 14 bp, Homo sapiens
cttccaggtcagga

SEQ ID NO: 3278908 - DNA, 23 bp, Homo sapiens
cttccaggtcaggatgcacattt

SEQ ID NO: 3278909 - DNA, 20 bp, Homo sapiens
cttccaggtgttactgtaat

SEQ ID NO: 3278910 - DNA, 22 bp, Homo sapiens
cttccagtcttcctgacacttt

SEQ ID NO: 3278911 - DNA, 18 bp, Homo sapiens
cttccagtgtccttagaa

SEQ ID NO: 3278912 - DNA, 19 bp, Homo sapiens
cttccagtgtccttagaac

SEQ ID NO: 3278913 - DNA, 11 bp, Homo sapiens
cttccataatg

SEQ ID NO: 3278914 - DNA, 18 bp, Homo sapiens
cttccataatgctactgt

SEQ ID NO: 3278915 - DNA, 14 bp, Homo sapiens
cttccatagcctaa

SEQ ID NO: 3278916 - DNA, 19 bp, Homo sapiens
cttccatcccaaccagtgc

SEQ ID NO: 3278917 - DNA, 22 bp, Homo sapiens
cttccatcccaggacaccacac

SEQ ID NO: 3278918 - DNA, 16 bp, Homo sapiens
cttccatccctacccc

SEQ ID NO: 3278919 - DNA, 16 bp, Homo sapiens
cttccatctctgactt

SEQ ID NO: 3278920 - DNA, 21 bp, Homo sapiens
cttccatgagaacagcagggt

SEQ ID NO: 3278921 - DNA, 14 bp, Homo sapiens
cttccatgatttta

SEQ ID NO: 3278922 - DNA, 14 bp, Homo sapiens
cttccatgtggaga

SEQ ID NO: 3278923 - DNA, 18 bp, Homo sapiens
cttccattaacaaatgct

SEQ ID NO: 3278924 - DNA, 22 bp, Homo sapiens
cttccattttcccccactactg

SEQ ID NO: 3278925 - DNA, 16 bp, Homo sapiens
cttcccaacagcctta

SEQ ID NO: 3278926 - DNA, 18 bp, Homo sapiens
cttcccaacagccttagc

SEQ ID NO: 3278927 - DNA, 20 bp, Homo sapiens
cttcccaatcagcactgaaa

SEQ ID NO: 3278928 - DNA, 22 bp, Homo sapiens
cttcccaatcagcactgaaaat

SEQ ID NO: 3278929 - DNA, 16 bp, Homo sapiens
cttcccacctccctgc

SEQ ID NO: 3278930 - DNA, 16 bp, Homo sapiens
cttcccagagggagca

SEQ ID NO: 3278931 - DNA, 17 bp, Homo sapiens
cttcccagagggagcag

SEQ ID NO: 3278932 - DNA, 17 bp, Homo sapiens
cttcccagcagcagaat

SEQ ID NO: 3278933 - DNA, 19 bp, Homo sapiens
cttcccagccatgcccagg

SEQ ID NO: 3278934 - DNA, 20 bp, Homo sapiens
cttcccagccatgcccagga

SEQ ID NO: 3278935 - DNA, 13 bp, Homo sapiens
cttcccagctctg

SEQ ID NO: 3278936 - DNA, 16 bp, Homo sapiens
cttcccatcctaccct

SEQ ID NO: 3278937 - DNA, 19 bp, Homo sapiens
cttcccatcctaccctcgg

SEQ ID NO: 3278938 - DNA, 17 bp, Homo sapiens
cttcccatgactgcacc

SEQ ID NO: 3278939 - DNA, 21 bp, Homo sapiens
cttcccatgactgcacccagc

SEQ ID NO: 3278940 - DNA, 23 bp, Homo sapiens
cttcccatgactgcacccagctc

SEQ ID NO: 3278941 - DNA, 18 bp, Homo sapiens
cttccccaacttccctag

SEQ ID NO: 3278942 - DNA, 21 bp, Homo sapiens
cttccccaccgcagtcaccac

SEQ ID NO: 3278943 - DNA, 13 bp, Homo sapiens
cttccccaggccc

SEQ ID NO: 3278944 - DNA, 17 bp, Homo sapiens
cttccccaggcccacca

SEQ ID NO: 3278945 - DNA, 18 bp, Homo sapiens
cttccccatcttctaaac

SEQ ID NO: 3278946 - DNA, 18 bp, Homo sapiens
cttcccctacacctccct

SEQ ID NO: 3278947 - DNA, 18 bp, Homo sapiens
cttcccctccctggctcc

SEQ ID NO: 3278948 - DNA, 12 bp, Homo sapiens
cttcccctgtct

SEQ ID NO: 3278949 - DNA, 15 bp, Homo sapiens
cttccccttcctaag

SEQ ID NO: 3278950 - DNA, 12 bp, Homo sapiens
cttccccttgcc

SEQ ID NO: 3278951 - DNA, 14 bp, Homo sapiens
cttccccttgccct

SEQ ID NO: 3278952 - DNA, 23 bp, Homo sapiens
cttccccttgcccttgccctgac

SEQ ID NO: 3278953 - DNA, 16 bp, Homo sapiens
cttccccttttgcctg

SEQ ID NO: 3278954 - DNA, 17 bp, Homo sapiens
cttccccttttgcctgg

SEQ ID NO: 3278955 - DNA, 18 bp, Homo sapiens
cttccccttttgcctggc

SEQ ID NO: 3278956 - DNA, 15 bp, Homo sapiens
cttcccgccagaggg

SEQ ID NO: 3278957 - DNA, 15 bp, Homo sapiens
cttcccgtctcagaa

SEQ ID NO: 3278958 - DNA, 23 bp, Homo sapiens
cttccctagagggttcctgtaga

SEQ ID NO: 3278959 - DNA, 22 bp, Homo sapiens
cttccctagctttagaccctgg

SEQ ID NO: 3278960 - DNA, 13 bp, Homo sapiens
cttccctatttat

SEQ ID NO: 3278961 - DNA, 20 bp, Homo sapiens
cttccctcgtgacagtggtg

SEQ ID NO: 3278962 - DNA, 21 bp, Homo sapiens
cttccctgattgacctgctcc

SEQ ID NO: 3278963 - DNA, 18 bp, Homo sapiens
cttccctgcgcctgtgat

SEQ ID NO: 3278964 - DNA, 19 bp, Homo sapiens
cttccctgggaaggctaag

SEQ ID NO: 3278965 - DNA, 22 bp, Homo sapiens
cttccctgtatgattccttgat

SEQ ID NO: 3278966 - DNA, 14 bp, Homo sapiens
cttccctgtccctc

SEQ ID NO: 3278967 - DNA, 19 bp, Homo sapiens
cttccctgttctccctttc

SEQ ID NO: 3278968 - DNA, 14 bp, Homo sapiens
cttcccttttctgt

SEQ ID NO: 3278969 - DNA, 22 bp, Homo sapiens
cttccgaccctctgggaacctc

SEQ ID NO: 3278970 - DNA, 12 bp, Homo sapiens
cttccgccactc

SEQ ID NO: 3278971 - DNA, 18 bp, Homo sapiens
cttccgccccttcccttc

SEQ ID NO: 3278972 - DNA, 14 bp, Homo sapiens
cttccgctgagggg

SEQ ID NO: 3278973 - DNA, 17 bp, Homo sapiens
cttccgctttgaaagaa

SEQ ID NO: 3278974 - DNA, 20 bp, Homo sapiens
cttccgctttgaaagaagca

SEQ ID NO: 3278975 - DNA, 21 bp, Homo sapiens
cttccgctttgaaagaagcaa

SEQ ID NO: 3278976 - DNA, 20 bp, Homo sapiens
cttccggtagggaggcagcc

SEQ ID NO: 3278977 - DNA, 22 bp, Homo sapiens
cttccggtagggaggcagcctc

SEQ ID NO: 3278978 - DNA, 17 bp, Homo sapiens
cttcctaaatatccaaa

SEQ ID NO: 3278979 - DNA, 23 bp, Homo sapiens
cttcctaatttcccttcttgcat

SEQ ID NO: 3278980 - DNA, 18 bp, Homo sapiens
cttcctacaagagcagcc

SEQ ID NO: 3278981 - DNA, 24 bp, Homo sapiens
cttcctacaagagcagcctgtggc

SEQ ID NO: 3278982 - DNA, 17 bp, Homo sapiens
cttcctaccaagtcaaa

SEQ ID NO: 3278983 - DNA, 21 bp, Homo sapiens
cttcctataacttcttcctgc

SEQ ID NO: 3278984 - DNA, 22 bp, Homo sapiens
cttcctataacttcttcctgct

SEQ ID NO: 3278985 - DNA, 24 bp, Homo sapiens
cttcctataacttcttcctgctgg

SEQ ID NO: 3278986 - DNA, 17 bp, Homo sapiens
cttcctataacttgatg

SEQ ID NO: 3278987 - DNA, 13 bp, Homo sapiens
cttcctcactgcc

SEQ ID NO: 3278988 - DNA, 14 bp, Homo sapiens
cttcctcacttcca

SEQ ID NO: 3278989 - DNA, 10 bp, Homo sapiens
cttcctcagc

SEQ ID NO: 3278990 - DNA, 12 bp, Homo sapiens
cttcctcagctg

SEQ ID NO: 3278991 - DNA, 21 bp, Homo sapiens
cttcctcagtaacatttctgt

SEQ ID NO: 3278992 - DNA, 23 bp, Homo sapiens
cttcctcagtaacatttctgttc

SEQ ID NO: 3278993 - DNA, 18 bp, Homo sapiens
cttcctcatccaccccat

SEQ ID NO: 3278994 - DNA, 22 bp, Homo sapiens
cttcctcatccaccccatccct

SEQ ID NO: 3278995 - DNA, 23 bp, Homo sapiens
cttcctcatccaccccatccctc

SEQ ID NO: 3278996 - DNA, 14 bp, Homo sapiens
cttcctcatcccct

SEQ ID NO: 3278997 - DNA, 13 bp, Homo sapiens
cttcctccctgtc

SEQ ID NO: 3278998 - DNA, 18 bp, Homo sapiens
cttcctccctgtctctgc

SEQ ID NO: 3278999 - DNA, 16 bp, Homo sapiens
cttcctccgtccaccc

SEQ ID NO: 3279000 - DNA, 19 bp, Homo sapiens
cttcctccgtccacccagg

SEQ ID NO: 3279001 - DNA, 11 bp, Homo sapiens
cttcctcctga

SEQ ID NO: 3279002 - DNA, 15 bp, Homo sapiens
cttcctcctgcagac

SEQ ID NO: 3279003 - DNA, 14 bp, Homo sapiens
cttcctcctggaaa

SEQ ID NO: 3279004 - DNA, 18 bp, Homo sapiens
cttcctctagaagccaag

SEQ ID NO: 3279005 - DNA, 19 bp, Homo sapiens
cttcctctagaagccaagg

SEQ ID NO: 3279006 - DNA, 17 bp, Homo sapiens
cttcctctcactcctgc

SEQ ID NO: 3279007 - DNA, 13 bp, Homo sapiens
cttcctctcaggc

SEQ ID NO: 3279008 - DNA, 19 bp, Homo sapiens
cttcctctccactgccttc

SEQ ID NO: 3279009 - DNA, 21 bp, Homo sapiens
cttcctctccactgccttcga

SEQ ID NO: 3279010 - DNA, 15 bp, Homo sapiens
cttcctctctcctta

SEQ ID NO: 3279011 - DNA, 12 bp, Homo sapiens
cttcctctgctg

SEQ ID NO: 3279012 - DNA, 14 bp, Homo sapiens
cttcctcttgtctg

SEQ ID NO: 3279013 - DNA, 16 bp, Homo sapiens
cttcctcttgtctgat

SEQ ID NO: 3279014 - DNA, 18 bp, Homo sapiens
cttcctcttgtctgattt

SEQ ID NO: 3279015 - DNA, 16 bp, Homo sapiens
cttcctgaaataaaca

SEQ ID NO: 3279016 - DNA, 18 bp, Homo sapiens
cttcctgaaataaacact

SEQ ID NO: 3279017 - DNA, 16 bp, Homo sapiens
cttcctgacactttaa

SEQ ID NO: 3279018 - DNA, 18 bp, Homo sapiens
cttcctgacactttaatt

SEQ ID NO: 3279019 - DNA, 18 bp, Homo sapiens
cttcctgacgaaactggc

SEQ ID NO: 3279020 - DNA, 15 bp, Homo sapiens
cttcctgcaattttc

SEQ ID NO: 3279021 - DNA, 21 bp, Homo sapiens
cttcctgcaggcaggaacaaa

SEQ ID NO: 3279022 - DNA, 12 bp, Homo sapiens
cttcctgccagc

SEQ ID NO: 3279023 - DNA, 17 bp, Homo sapiens
cttcctgccctacagag

SEQ ID NO: 3279024 - DNA, 15 bp, Homo sapiens
cttcctgcgtcctcc

SEQ ID NO: 3279025 - DNA, 17 bp, Homo sapiens
cttcctgctacaggagg

SEQ ID NO: 3279026 - DNA, 15 bp, Homo sapiens
cttcctgctcctttt

SEQ ID NO: 3279027 - DNA, 12 bp, Homo sapiens
cttcctgctgct

SEQ ID NO: 3279028 - DNA, 14 bp, Homo sapiens
cttcctgctgctgt

SEQ ID NO: 3279029 - DNA, 18 bp, Homo sapiens
cttcctggaaacagcatg

SEQ ID NO: 3279030 - DNA, 16 bp, Homo sapiens
cttcctggacctgagt

SEQ ID NO: 3279031 - DNA, 17 bp, Homo sapiens
cttcctggacctgagtc

SEQ ID NO: 3279032 - DNA, 20 bp, Homo sapiens
cttcctgggcagcctttcca

SEQ ID NO: 3279033 - DNA, 23 bp, Homo sapiens
cttcctggggcatctggcgaatc

SEQ ID NO: 3279034 - DNA, 21 bp, Homo sapiens
cttcctgggtcctgttcccta

SEQ ID NO: 3279035 - DNA, 23 bp, Homo sapiens
cttcctgggtcctgttccctacc

SEQ ID NO: 3279036 - DNA, 24 bp, Homo sapiens
cttcctggttttgtacactgctgt

SEQ ID NO: 3279037 - DNA, 23 bp, Homo sapiens
cttcctgtccactctcggggccc

SEQ ID NO: 3279038 - DNA, 16 bp, Homo sapiens
cttcctgtctagtctc

SEQ ID NO: 3279039 - DNA, 23 bp, Homo sapiens
cttcctgtctagtctctcctgta

SEQ ID NO: 3279040 - DNA, 16 bp, Homo sapiens
cttcctgtgacttcag

SEQ ID NO: 3279041 - DNA, 18 bp, Homo sapiens
cttcctgtgatccaccca

SEQ ID NO: 3279042 - DNA, 15 bp, Homo sapiens
cttcctgtgctaagt

SEQ ID NO: 3279043 - DNA, 21 bp, Homo sapiens
cttcctgtgctaagtctttcc

SEQ ID NO: 3279044 - DNA, 16 bp, Homo sapiens
cttcctgtgggagcag

SEQ ID NO: 3279045 - DNA, 15 bp, Homo sapiens
cttcctgtgtgtcca

SEQ ID NO: 3279046 - DNA, 23 bp, Homo sapiens
cttcctgtttttcacattttcct

SEQ ID NO: 3279047 - DNA, 18 bp, Homo sapiens
cttccttcagggtttaat

SEQ ID NO: 3279048 - DNA, 23 bp, Homo sapiens
cttccttcagggtttaatagact

SEQ ID NO: 3279049 - DNA, 14 bp, Homo sapiens
cttccttcctgctt

SEQ ID NO: 3279050 - DNA, 14 bp, Homo sapiens
cttccttctgggac

SEQ ID NO: 3279051 - DNA, 18 bp, Homo sapiens
cttccttgagacacggag

SEQ ID NO: 3279052 - DNA, 20 bp, Homo sapiens
cttccttgagacacggagcc

SEQ ID NO: 3279053 - DNA, 18 bp, Homo sapiens
cttcctttaggtctggtt

SEQ ID NO: 3279054 - DNA, 19 bp, Homo sapiens
cttcctttaggtctggttg

SEQ ID NO: 3279055 - DNA, 17 bp, Homo sapiens
cttcctttcttgtcttt

SEQ ID NO: 3279056 - DNA, 23 bp, Homo sapiens
cttcctttcttgtctttcctcct

SEQ ID NO: 3279057 - DNA, 21 bp, Homo sapiens
cttcctttgaccactgtcttt

SEQ ID NO: 3279058 - DNA, 15 bp, Homo sapiens
cttcctttggtgcct

SEQ ID NO: 3279059 - DNA, 19 bp, Homo sapiens
cttcctttggtgcctcact

SEQ ID NO: 3279060 - DNA, 14 bp, Homo sapiens
cttccttttccctg

SEQ ID NO: 3279061 - DNA, 14 bp, Homo sapiens
cttcgactcaggat

SEQ ID NO: 3279062 - DNA, 15 bp, Homo sapiens
cttcgactcaggatc

SEQ ID NO: 3279063 - DNA, 16 bp, Homo sapiens
cttcgactcaggatcc

SEQ ID NO: 3279064 - DNA, 18 bp, Homo sapiens
cttcgactcaggatccag

SEQ ID NO: 3279065 - DNA, 17 bp, Homo sapiens
cttcgacttttcttaac

SEQ ID NO: 3279066 - DNA, 17 bp, Homo sapiens
cttcgagcactgtccag

SEQ ID NO: 3279067 - DNA, 16 bp, Homo sapiens
cttcgctcctgtgtct

SEQ ID NO: 3279068 - DNA, 17 bp, Homo sapiens
cttcgctcctgtgtctt

SEQ ID NO: 3279069 - DNA, 19 bp, Homo sapiens
cttcgctgctctagctggc

SEQ ID NO: 3279070 - DNA, 20 bp, Homo sapiens
cttcgctgctctagctggca

SEQ ID NO: 3279071 - DNA, 21 bp, Homo sapiens
cttcgctgctctagctggcag

SEQ ID NO: 3279072 - DNA, 16 bp, Homo sapiens
cttcgcttcttgcctc

SEQ ID NO: 3279073 - DNA, 14 bp, Homo sapiens
cttcggacaaaata

SEQ ID NO: 3279074 - DNA, 14 bp, Homo sapiens
cttcggaccgcttg

SEQ ID NO: 3279075 - DNA, 18 bp, Homo sapiens
cttcggagggcccctgcg

SEQ ID NO: 3279076 - DNA, 16 bp, Homo sapiens
cttcggccaggtcaca

SEQ ID NO: 3279077 - DNA, 21 bp, Homo sapiens
cttcggggcgatgctccctca

SEQ ID NO: 3279078 - DNA, 19 bp, Homo sapiens
cttcgtatcccgagtctgg

SEQ ID NO: 3279079 - DNA, 21 bp, Homo sapiens
cttcgtatcccgagtctggga

SEQ ID NO: 3279080 - DNA, 23 bp, Homo sapiens
cttcgtatcccgagtctgggaca

SEQ ID NO: 3279081 - DNA, 21 bp, Homo sapiens
cttcgtctttcccatggggag

SEQ ID NO: 3279082 - DNA, 16 bp, Homo sapiens
cttcgtgtctctccca

SEQ ID NO: 3279083 - DNA, 17 bp, Homo sapiens
cttcgtgtctctcccac

SEQ ID NO: 3279084 - DNA, 17 bp, Homo sapiens
cttcgttaactgtgtat

SEQ ID NO: 3279085 - DNA, 14 bp, Homo sapiens
cttcgttttctaaa

SEQ ID NO: 3279086 - DNA, 18 bp, Homo sapiens
cttctaaacttccccatc

SEQ ID NO: 3279087 - DNA, 15 bp, Homo sapiens
cttctaaatgcatat

SEQ ID NO: 3279088 - DNA, 23 bp, Homo sapiens
cttctaaatggcaaaggaaggtg

SEQ ID NO: 3279089 - DNA, 14 bp, Homo sapiens
cttctaactccact

SEQ ID NO: 3279090 - DNA, 13 bp, Homo sapiens
cttctaataaatt

SEQ ID NO: 3279091 - DNA, 15 bp, Homo sapiens
cttctaatatatttt

SEQ ID NO: 3279092 - DNA, 18 bp, Homo sapiens
cttctacatttgagggcc

SEQ ID NO: 3279093 - DNA, 17 bp, Homo sapiens
cttctaccatgaacaga

SEQ ID NO: 3279094 - DNA, 12 bp, Homo sapiens
cttctacctgcc

SEQ ID NO: 3279095 - DNA, 15 bp, Homo sapiens
cttctacctgccctc

SEQ ID NO: 3279096 - DNA, 16 bp, Homo sapiens
cttctacctgccctca

SEQ ID NO: 3279097 - DNA, 13 bp, Homo sapiens
cttctacttttaa

SEQ ID NO: 3279098 - DNA, 15 bp, Homo sapiens
cttctagaacctggg

SEQ ID NO: 3279099 - DNA, 16 bp, Homo sapiens
cttctagaacctgggc

SEQ ID NO: 3279100 - DNA, 19 bp, Homo sapiens
cttctagaacctgggctgt

SEQ ID NO: 3279101 - DNA, 20 bp, Homo sapiens
cttctagaacctgggctgtg

SEQ ID NO: 3279102 - DNA, 20 bp, Homo sapiens
cttctagaagataacatttt

SEQ ID NO: 3279103 - DNA, 21 bp, Homo sapiens
cttctagaagataacattttc

SEQ ID NO: 3279104 - DNA, 9 bp, Homo sapiens
cttctagag

SEQ ID NO: 3279105 - DNA, 13 bp, Homo sapiens
cttctagagttca

SEQ ID NO: 3279106 - DNA, 18 bp, Homo sapiens
cttctagtgatgatggtt

SEQ ID NO: 3279107 - DNA, 13 bp, Homo sapiens
cttctatatttta

SEQ ID NO: 3279108 - DNA, 16 bp, Homo sapiens
cttctcaagtgcctta

SEQ ID NO: 3279109 - DNA, 21 bp, Homo sapiens
cttctcaagttctaagattct

SEQ ID NO: 3279110 - DNA, 18 bp, Homo sapiens
cttctcacagcacatgct

SEQ ID NO: 3279111 - DNA, 19 bp, Homo sapiens
cttctcacagcacatgctg

SEQ ID NO: 3279112 - DNA, 18 bp, Homo sapiens
cttctcagctcttccatg

SEQ ID NO: 3279113 - DNA, 13 bp, Homo sapiens
cttctcatagcat

SEQ ID NO: 3279114 - DNA, 22 bp, Homo sapiens
cttctcatagcattaactaatc

SEQ ID NO: 3279115 - DNA, 21 bp, Homo sapiens
ctgttcccctgtcctgtgaat

SEQ ID NO: 3279116 - DNA, 13 bp, Homo sapiens
ctgttccctctgg

SEQ ID NO: 3279117 - DNA, 16 bp, Homo sapiens
ctgttccctctggctt

SEQ ID NO: 3279118 - DNA, 16 bp, Homo sapiens
ctgttccttagacctt

SEQ ID NO: 3279119 - DNA, 14 bp, Homo sapiens
ctgttccttttata

SEQ ID NO: 3279120 - DNA, 22 bp, Homo sapiens
ctgttctaagggggaggggaag

SEQ ID NO: 3279121 - DNA, 14 bp, Homo sapiens
ctgttctagttttt

SEQ ID NO: 3279122 - DNA, 20 bp, Homo sapiens
ctgttctatgcctttagtca

SEQ ID NO: 3279123 - DNA, 15 bp, Homo sapiens
ctgttctcttgggaa

SEQ ID NO: 3279124 - DNA, 14 bp, Homo sapiens
ctgttctgcagaca

SEQ ID NO: 3279125 - DNA, 13 bp, Homo sapiens
ctgttctgctggg

SEQ ID NO: 3279126 - DNA, 14 bp, Homo sapiens
ctgttctgctggga

SEQ ID NO: 3279127 - DNA, 22 bp, Homo sapiens
ctgttctgctgggagttctaga

SEQ ID NO: 3279128 - DNA, 14 bp, Homo sapiens
ctgttctggaggaa

SEQ ID NO: 3279129 - DNA, 23 bp, Homo sapiens
ctgttctggaggaaagggaggag

SEQ ID NO: 3279130 - DNA, 19 bp, Homo sapiens
ctgttctgtggttcctctg

SEQ ID NO: 3279131 - DNA, 20 bp, Homo sapiens
ctgttctgtggttcctctgc

SEQ ID NO: 3279132 - DNA, 21 bp, Homo sapiens
ctgttctgtttcaaggcactc

SEQ ID NO: 3279133 - DNA, 17 bp, Homo sapiens
ctgttctgtttggcact

SEQ ID NO: 3279134 - DNA, 22 bp, Homo sapiens
ctgttctgtttggcacttgtat

SEQ ID NO: 3279135 - DNA, 21 bp, Homo sapiens
ctgttcttagagtgtagctgt

SEQ ID NO: 3279136 - DNA, 15 bp, Homo sapiens
ctgttcttcatctgc

SEQ ID NO: 3279137 - DNA, 13 bp, Homo sapiens
ctgttcttcctcc

SEQ ID NO: 3279138 - DNA, 15 bp, Homo sapiens
ctgttcttcctccag

SEQ ID NO: 3279139 - DNA, 22 bp, Homo sapiens
ctgttcttcctccagctgcacc

SEQ ID NO: 3279140 - DNA, 17 bp, Homo sapiens
ctgttcttgctgctaga

SEQ ID NO: 3279141 - DNA, 21 bp, Homo sapiens
ctgttcttgctgctagaactt

SEQ ID NO: 3279142 - DNA, 13 bp, Homo sapiens
ctgttcttggtaa

SEQ ID NO: 3279143 - DNA, 14 bp, Homo sapiens
ctgttgaaaattat

SEQ ID NO: 3279144 - DNA, 18 bp, Homo sapiens
ctgttgaagtcaccttgt

SEQ ID NO: 3279145 - DNA, 17 bp, Homo sapiens
ctgttgaatttcccaca

SEQ ID NO: 3279146 - DNA, 17 bp, Homo sapiens
ctgttgacgaagtctct

SEQ ID NO: 3279147 - DNA, 20 bp, Homo sapiens
ctgttgatgaagtatacttt

SEQ ID NO: 3279148 - DNA, 14 bp, Homo sapiens
ctgttgatgtatct

SEQ ID NO: 3279149 - DNA, 16 bp, Homo sapiens
ctgttgatgtatctga

SEQ ID NO: 3279150 - DNA, 21 bp, Homo sapiens
ctgttgcaattaggattttga

SEQ ID NO: 3279151 - DNA, 22 bp, Homo sapiens
ctgttgcaattaggattttgat

SEQ ID NO: 3279152 - DNA, 15 bp, Homo sapiens
ctgttgcatttactt

SEQ ID NO: 3279153 - DNA, 16 bp, Homo sapiens
ctgttgcccaggctgg

SEQ ID NO: 3279154 - DNA, 20 bp, Homo sapiens
ctgttgccctttctgtacca

SEQ ID NO: 3279155 - DNA, 15 bp, Homo sapiens
ctgttgccttttaaa

SEQ ID NO: 3279156 - DNA, 11 bp, Homo sapiens
ctgttgctcaa

SEQ ID NO: 3279157 - DNA, 23 bp, Homo sapiens
ctgttggaatggatttttcttta

SEQ ID NO: 3279158 - DNA, 14 bp, Homo sapiens
ctgttggagcaaac

SEQ ID NO: 3279159 - DNA, 17 bp, Homo sapiens
ctgttggagcaaaccat

SEQ ID NO: 3279160 - DNA, 14 bp, Homo sapiens
ctgttggaggcaca

SEQ ID NO: 3279161 - DNA, 21 bp, Homo sapiens
ctgttggcactcacagacctg

SEQ ID NO: 3279162 - DNA, 13 bp, Homo sapiens
ctgttggcagctc

SEQ ID NO: 3279163 - DNA, 14 bp, Homo sapiens
ctgttggcagctct

SEQ ID NO: 3279164 - DNA, 16 bp, Homo sapiens
ctgttggcagctctag

SEQ ID NO: 3279165 - DNA, 18 bp, Homo sapiens
ctgttggcaggctggcca

SEQ ID NO: 3279166 - DNA, 18 bp, Homo sapiens
ctgttggttctgattagg

SEQ ID NO: 3279167 - DNA, 13 bp, Homo sapiens
ctgttgtacattt

SEQ ID NO: 3279168 - DNA, 14 bp, Homo sapiens
ctgttgtacattta

SEQ ID NO: 3279169 - DNA, 18 bp, Homo sapiens
ctgttgtgatcttgcatt

SEQ ID NO: 3279170 - DNA, 14 bp, Homo sapiens
ctgttgtgggcgct

SEQ ID NO: 3279171 - DNA, 20 bp, Homo sapiens
ctgttgtgggcgctgcttcc

SEQ ID NO: 3279172 - DNA, 21 bp, Homo sapiens
ctgttgtgtatagatgcaaga

SEQ ID NO: 3279173 - DNA, 12 bp, Homo sapiens
ctgttgttccat

SEQ ID NO: 3279174 - DNA, 18 bp, Homo sapiens
ctgtttaatatttaaaca

SEQ ID NO: 3279175 - DNA, 20 bp, Homo sapiens
ctgtttaatatttaaacagc

SEQ ID NO: 3279176 - DNA, 9 bp, Homo sapiens
ctgtttaga

SEQ ID NO: 3279177 - DNA, 14 bp, Homo sapiens
ctgtttagcagaac

SEQ ID NO: 3279178 - DNA, 17 bp, Homo sapiens
ctgtttagcagcagcct

SEQ ID NO: 3279179 - DNA, 13 bp, Homo sapiens
ctgtttaggaaga

SEQ ID NO: 3279180 - DNA, 23 bp, Homo sapiens
ctgtttaggaagaagtggtacta

SEQ ID NO: 3279181 - DNA, 19 bp, Homo sapiens
ctgtttataatctgaagat

SEQ ID NO: 3279182 - DNA, 10 bp, Homo sapiens
ctgtttatat

SEQ ID NO: 3279183 - DNA, 12 bp, Homo sapiens
ctgtttatataa

SEQ ID NO: 3279184 - DNA, 20 bp, Homo sapiens
ctgtttatgatctatttgta

SEQ ID NO: 3279185 - DNA, 13 bp, Homo sapiens
ctgtttatggcct

SEQ ID NO: 3279186 - DNA, 16 bp, Homo sapiens
ctgtttattaatctta

SEQ ID NO: 3279187 - DNA, 21 bp, Homo sapiens
ctgtttcaaggcactctagat

SEQ ID NO: 3279188 - DNA, 15 bp, Homo sapiens
ctgtttcaatcactg

SEQ ID NO: 3279189 - DNA, 17 bp, Homo sapiens
ctgtttcaatcactgtc

SEQ ID NO: 3279190 - DNA, 11 bp, Homo sapiens
ctgtttcacaa

SEQ ID NO: 3279191 - DNA, 20 bp, Homo sapiens
ctgtttccctgctgaatgcc

SEQ ID NO: 3279192 - DNA, 19 bp, Homo sapiens
ctgtttcccttcccttcca

SEQ ID NO: 3279193 - DNA, 21 bp, Homo sapiens
ctgtttcccttcccttccact

SEQ ID NO: 3279194 - DNA, 17 bp, Homo sapiens
ctgtttcctagctgtgt

SEQ ID NO: 3279195 - DNA, 19 bp, Homo sapiens
ctgtttcctgacattgtct

SEQ ID NO: 3279196 - DNA, 22 bp, Homo sapiens
ctgtttcgtgtagtggaagagc

SEQ ID NO: 3279197 - DNA, 11 bp, Homo sapiens
ctgtttctcat

SEQ ID NO: 3279198 - DNA, 14 bp, Homo sapiens
ctgtttctctgctg

SEQ ID NO: 3279199 - DNA, 16 bp, Homo sapiens
ctgtttctcttgagct

SEQ ID NO: 3279200 - DNA, 20 bp, Homo sapiens
ctgtttctcttgagctggcc

SEQ ID NO: 3279201 - DNA, 22 bp, Homo sapiens
ctgtttctcttgagctggcctc

SEQ ID NO: 3279202 - DNA, 17 bp, Homo sapiens
ctgtttctgcagccctt

SEQ ID NO: 3279203 - DNA, 23 bp, Homo sapiens
ctgtttgatataccaaattaaaa

SEQ ID NO: 3279204 - DNA, 10 bp, Homo sapiens
ctgtttgatg

SEQ ID NO: 3279205 - DNA, 23 bp, Homo sapiens
ctgtttgatgctatttatgcaag

SEQ ID NO: 3279206 - DNA, 12 bp, Homo sapiens
ctgtttgatgta

SEQ ID NO: 3279207 - DNA, 19 bp, Homo sapiens
ctgtttgatgtatgtgtga

SEQ ID NO: 3279208 - DNA, 22 bp, Homo sapiens
ctgtttgggagactgtgctctc

SEQ ID NO: 3279209 - DNA, 14 bp, Homo sapiens
ctgtttgttaaaac

SEQ ID NO: 3279210 - DNA, 14 bp, Homo sapiens
ctgtttgtttcata

SEQ ID NO: 3279211 - DNA, 12 bp, Homo sapiens
ctgttttaaatt

SEQ ID NO: 3279212 - DNA, 14 bp, Homo sapiens
ctgttttcctttct

SEQ ID NO: 3279213 - DNA, 18 bp, Homo sapiens
ctgttttcctttctcacc

SEQ ID NO: 3279214 - DNA, 23 bp, Homo sapiens
ctgttttcctttctcaccgcagt

SEQ ID NO: 3279215 - DNA, 21 bp, Homo sapiens
ctgttttctctcggctcccca

SEQ ID NO: 3279216 - DNA, 17 bp, Homo sapiens
ctgttttctgagcccgg

SEQ ID NO: 3279217 - DNA, 19 bp, Homo sapiens
ctgttttctgagcccgggc

SEQ ID NO: 3279218 - DNA, 12 bp, Homo sapiens
ctgttttcttct

SEQ ID NO: 3279219 - DNA, 16 bp, Homo sapiens
ctgttttcttttttct

SEQ ID NO: 3279220 - DNA, 16 bp, Homo sapiens
ctgttttgcacagtta

SEQ ID NO: 3279221 - DNA, 18 bp, Homo sapiens
ctgttttgtggtttggaa

SEQ ID NO: 3279222 - DNA, 19 bp, Homo sapiens
ctgttttgtggtttggaat

SEQ ID NO: 3279223 - DNA, 20 bp, Homo sapiens
ctgttttgtggtttggaata

SEQ ID NO: 3279224 - DNA, 15 bp, Homo sapiens
ctgtttttaagctgt

SEQ ID NO: 3279225 - DNA, 16 bp, Homo sapiens
ctgtttttaagctgtt

SEQ ID NO: 3279226 - DNA, 17 bp, Homo sapiens
ctgtttttaagctgttt

SEQ ID NO: 3279227 - DNA, 18 bp, Homo sapiens
ctgtttttaagctgtttc

SEQ ID NO: 3279228 - DNA, 15 bp, Homo sapiens
ctgtttttagacacc

SEQ ID NO: 3279229 - DNA, 18 bp, Homo sapiens
ctgtttttagacaccttc

SEQ ID NO: 3279230 - DNA, 21 bp, Homo sapiens
ctgtttttctctaatgcttga

SEQ ID NO: 3279231 - DNA, 15 bp, Homo sapiens
ctgtttttctgggtg

SEQ ID NO: 3279232 - DNA, 21 bp, Homo sapiens
ctgtttttctgggtggcctcg

SEQ ID NO: 3279233 - DNA, 22 bp, Homo sapiens
ctgtttttgtatctttatgctg

SEQ ID NO: 3279234 - DNA, 14 bp, Homo sapiens
ctgtttttgttgtg

SEQ ID NO: 3279235 - DNA, 14 bp, Homo sapiens
cttaaaaaaataaa

SEQ ID NO: 3279236 - DNA, 17 bp, Homo sapiens
cttaaaaaaatgacaga

SEQ ID NO: 3279237 - DNA, 13 bp, Homo sapiens
cttaaaaaatgtc

SEQ ID NO: 3279238 - DNA, 12 bp, Homo sapiens
cttaaaaaggaa

SEQ ID NO: 3279239 - DNA, 13 bp, Homo sapiens
cttaaaaatcaca

SEQ ID NO: 3279240 - DNA, 21 bp, Homo sapiens
cttaaaaccaaagagggcttc

SEQ ID NO: 3279241 - DNA, 18 bp, Homo sapiens
cttaaaaggggcccaagc

SEQ ID NO: 3279242 - DNA, 22 bp, Homo sapiens
cttaaaagtactttaaaaagga

SEQ ID NO: 3279243 - DNA, 15 bp, Homo sapiens
cttaaaagtattcat

SEQ ID NO: 3279244 - DNA, 17 bp, Homo sapiens
cttaaaataaacagttg

SEQ ID NO: 3279245 - DNA, 20 bp, Homo sapiens
cttaaaataaacagttgtga

SEQ ID NO: 3279246 - DNA, 12 bp, Homo sapiens
cttaaaataagc

SEQ ID NO: 3279247 - DNA, 13 bp, Homo sapiens
cttaaaataatta

SEQ ID NO: 3279248 - DNA, 17 bp, Homo sapiens
cttaaaataattaaata

SEQ ID NO: 3279249 - DNA, 20 bp, Homo sapiens
cttaaaataattaaataaat

SEQ ID NO: 3279250 - DNA, 21 bp, Homo sapiens
cttaaaataattaaataaatg

SEQ ID NO: 3279251 - DNA, 13 bp, Homo sapiens
cttaaaatagaaa

SEQ ID NO: 3279252 - DNA, 18 bp, Homo sapiens
cttaaaatagaaataagt

SEQ ID NO: 3279253 - DNA, 16 bp, Homo sapiens
cttaaacaatgtataa

SEQ ID NO: 3279254 - DNA, 23 bp, Homo sapiens
cttaaaccttcagttatgatttt

SEQ ID NO: 3279255 - DNA, 14 bp, Homo sapiens
cttaaactaaatgt

SEQ ID NO: 3279256 - DNA, 14 bp, Homo sapiens
cttaaactgtgtgg

SEQ ID NO: 3279257 - DNA, 15 bp, Homo sapiens
cttaaactgtgtgga

SEQ ID NO: 3279258 - DNA, 15 bp, Homo sapiens
cttaaagagggacag

SEQ ID NO: 3279259 - DNA, 15 bp, Homo sapiens
cttaaaggcctggaa

SEQ ID NO: 3279260 - DNA, 16 bp, Homo sapiens
cttaaaggcctggaac

SEQ ID NO: 3279261 - DNA, 23 bp, Homo sapiens
cttaaaggctgtggtagtactcc

SEQ ID NO: 3279262 - DNA, 21 bp, Homo sapiens
cttaaataataaacagtggaa

SEQ ID NO: 3279263 - DNA, 16 bp, Homo sapiens
cttaaatacagataat

SEQ ID NO: 3279264 - DNA, 15 bp, Homo sapiens
cttaaatatagttcc

SEQ ID NO: 3279265 - DNA, 19 bp, Homo sapiens
cttaaatggaattattttg

SEQ ID NO: 3279266 - DNA, 21 bp, Homo sapiens
cttaaatgtagcaatggcact

SEQ ID NO: 3279267 - DNA, 18 bp, Homo sapiens
cttaaattcctactccct

SEQ ID NO: 3279268 - DNA, 16 bp, Homo sapiens
cttaaatttaatacca

SEQ ID NO: 3279269 - DNA, 13 bp, Homo sapiens
cttaaatttggtt

SEQ ID NO: 3279270 - DNA, 21 bp, Homo sapiens
cttaaatttggtttgttaatt

SEQ ID NO: 3279271 - DNA, 15 bp, Homo sapiens
cttaaatttgtttaa

SEQ ID NO: 3279272 - DNA, 13 bp, Homo sapiens
cttaaattttaac

SEQ ID NO: 3279273 - DNA, 12 bp, Homo sapiens
cttaacaatgca

SEQ ID NO: 3279274 - DNA, 17 bp, Homo sapiens
cttaacaatgcaacttt

SEQ ID NO: 3279275 - DNA, 13 bp, Homo sapiens
cttaacatattta

SEQ ID NO: 3279276 - DNA, 15 bp, Homo sapiens
cttaacatatttact

SEQ ID NO: 3279277 - DNA, 18 bp, Homo sapiens
cttaacatccctcctgct

SEQ ID NO: 3279278 - DNA, 21 bp, Homo sapiens
cttaaccccgggatgcaaggt

SEQ ID NO: 3279279 - DNA, 13 bp, Homo sapiens
cttaacctttgct

SEQ ID NO: 3279280 - DNA, 13 bp, Homo sapiens
cttaactaatttg

SEQ ID NO: 3279281 - DNA, 12 bp, Homo sapiens
cttaactatgag

SEQ ID NO: 3279282 - DNA, 11 bp, Homo sapiens
cttaactattc

SEQ ID NO: 3279283 - DNA, 17 bp, Homo sapiens
cttaactccttccagtg

SEQ ID NO: 3279284 - DNA, 22 bp, Homo sapiens
cttaactgatgacattccacca

SEQ ID NO: 3279285 - DNA, 18 bp, Homo sapiens
cttaactggcctaaattt

SEQ ID NO: 3279286 - DNA, 13 bp, Homo sapiens
cttaacttttcct

SEQ ID NO: 3279287 - DNA, 11 bp, Homo sapiens
cttaagaacac

SEQ ID NO: 3279288 - DNA, 20 bp, Homo sapiens
cttaagaactgcttcatgtg

SEQ ID NO: 3279289 - DNA, 20 bp, Homo sapiens
cttaagacctactgttctaa

SEQ ID NO: 3279290 - DNA, 20 bp, Homo sapiens
cttaagcagcatggaaaaat

SEQ ID NO: 3279291 - DNA, 22 bp, Homo sapiens
cttaagcagcatggaaaaatgg

SEQ ID NO: 3279292 - DNA, 20 bp, Homo sapiens
cttaaggaagtttgattttt

SEQ ID NO: 3279293 - DNA, 20 bp, Homo sapiens
cttaaggattgtgatatttt

SEQ ID NO: 3279294 - DNA, 20 bp, Homo sapiens
cttaaggggggcagggagtg

SEQ ID NO: 3279295 - DNA, 18 bp, Homo sapiens
cttaagggttgaaggcag

SEQ ID NO: 3279296 - DNA, 21 bp, Homo sapiens
cttaagggttgaaggcagtct

SEQ ID NO: 3279297 - DNA, 21 bp, Homo sapiens
cttaagtcccagtatacctca

SEQ ID NO: 3279298 - DNA, 16 bp, Homo sapiens
cttaagtgcacttttt

SEQ ID NO: 3279299 - DNA, 16 bp, Homo sapiens
cttaataaaaatgaca

SEQ ID NO: 3279300 - DNA, 12 bp, Homo sapiens
cttaataaattc

SEQ ID NO: 3279301 - DNA, 17 bp, Homo sapiens
cttaataaattcagata

SEQ ID NO: 3279302 - DNA, 18 bp, Homo sapiens
cttaataaattcagatat

SEQ ID NO: 3279303 - DNA, 22 bp, Homo sapiens
cttaatactcaaatgagtaaca

SEQ ID NO: 3279304 - DNA, 12 bp, Homo sapiens
cttaatagcaac

SEQ ID NO: 3279305 - DNA, 15 bp, Homo sapiens
cttaatagccctccc

SEQ ID NO: 3279306 - DNA, 22 bp, Homo sapiens
cttaatcaggtcctcagagaat

SEQ ID NO: 3279307 - DNA, 18 bp, Homo sapiens
cttaatccagctgatgag

SEQ ID NO: 3279308 - DNA, 20 bp, Homo sapiens
cttaatctgtgtgtatattg

SEQ ID NO: 3279309 - DNA, 16 bp, Homo sapiens
cttaatgacaacactt

SEQ ID NO: 3279310 - DNA, 12 bp, Homo sapiens
cttaatgagata

SEQ ID NO: 3279311 - DNA, 21 bp, Homo sapiens
cttaatgtatggctcatttgc

SEQ ID NO: 3279312 - DNA, 14 bp, Homo sapiens
cttaatgtatgtta

SEQ ID NO: 3279313 - DNA, 22 bp, Homo sapiens
cttaatgttctgaataatttct

SEQ ID NO: 3279314 - DNA, 18 bp, Homo sapiens
cttaattaatttgattaa

SEQ ID NO: 3279315 - DNA, 13 bp, Homo sapiens
cttaattacagtt

SEQ ID NO: 3279316 - DNA, 22 bp, Homo sapiens
cttaattacagttaaagaagca

SEQ ID NO: 3279317 - DNA, 23 bp, Homo sapiens
cttaattacagttaaagaagcaa

SEQ ID NO: 3279318 - DNA, 14 bp, Homo sapiens
cttaattattataa

SEQ ID NO: 3279319 - DNA, 17 bp, Homo sapiens
cttaattcctttctcat

SEQ ID NO: 3279320 - DNA, 15 bp, Homo sapiens
cttaattctttgttc

SEQ ID NO: 3279321 - DNA, 18 bp, Homo sapiens
cttaatttgtaaacttct

SEQ ID NO: 3279322 - DNA, 19 bp, Homo sapiens
cttaatttttttttcatag

SEQ ID NO: 3279323 - DNA, 20 bp, Homo sapiens
cttaatttttttttcataga

SEQ ID NO: 3279324 - DNA, 17 bp, Homo sapiens
cttacaatcaaatctcc

SEQ ID NO: 3279325 - DNA, 14 bp, Homo sapiens
cttacaatctttat

SEQ ID NO: 3279326 - DNA, 19 bp, Homo sapiens
cttacactgcctgtatact

SEQ ID NO: 3279327 - DNA, 17 bp, Homo sapiens
cttacacttggagcccg

SEQ ID NO: 3279328 - DNA, 15 bp, Homo sapiens
cttacagtgaagatg

SEQ ID NO: 3279329 - DNA, 22 bp, Homo sapiens
cttacatagttttaaactcatt

SEQ ID NO: 3279330 - DNA, 21 bp, Homo sapiens
cttacatcttctgtgaaatat

SEQ ID NO: 3279331 - DNA, 20 bp, Homo sapiens
cttacattagcagtttgctt

SEQ ID NO: 3279332 - DNA, 20 bp, Homo sapiens
cttacatttgtgagattcct

SEQ ID NO: 3279333 - DNA, 14 bp, Homo sapiens
cttaccagatgcta

SEQ ID NO: 3279334 - DNA, 12 bp, Homo sapiens
cttacccaaagc

SEQ ID NO: 3279335 - DNA, 20 bp, Homo sapiens
cttaccccttagcctccctg

SEQ ID NO: 3279336 - DNA, 22 bp, Homo sapiens
cttaccctttcctcctttatca

SEQ ID NO: 3279337 - DNA, 15 bp, Homo sapiens
cttaccgtagcctcc

SEQ ID NO: 3279338 - DNA, 21 bp, Homo sapiens
cttacctaaacagatataaat

SEQ ID NO: 3279339 - DNA, 15 bp, Homo sapiens
cttacctaacatctg

SEQ ID NO: 3279340 - DNA, 19 bp, Homo sapiens
cttacctaagtgacatttg

SEQ ID NO: 3279341 - DNA, 15 bp, Homo sapiens
cttacctcttccgga

SEQ ID NO: 3279342 - DNA, 11 bp, Homo sapiens
cttacctgaca

SEQ ID NO: 3279343 - DNA, 19 bp, Homo sapiens
cttacctgacacaagagga

SEQ ID NO: 3279344 - DNA, 18 bp, Homo sapiens
cttacctgacctcttgct

SEQ ID NO: 3279345 - DNA, 20 bp, Homo sapiens
cttacctgacctcttgctgt

SEQ ID NO: 3279346 - DNA, 19 bp, Homo sapiens
cttacctttttatttgcat

SEQ ID NO: 3279347 - DNA, 19 bp, Homo sapiens
cttactattaagcagtaaa

SEQ ID NO: 3279348 - DNA, 14 bp, Homo sapiens
cttactctgagccc

SEQ ID NO: 3279349 - DNA, 17 bp, Homo sapiens
cttactctgagcccagg

SEQ ID NO: 3279350 - DNA, 18 bp, Homo sapiens
cttactctgagcccaggc

SEQ ID NO: 3279351 - DNA, 16 bp, Homo sapiens
cttactctgtccattt

SEQ ID NO: 3279352 - DNA, 15 bp, Homo sapiens
cttactcttcttgaa

SEQ ID NO: 3279353 - DNA, 12 bp, Homo sapiens
cttactgatata

SEQ ID NO: 3279354 - DNA, 17 bp, Homo sapiens
cttactgattattttct

SEQ ID NO: 3279355 - DNA, 20 bp, Homo sapiens
cttactgggtaggtgattct

SEQ ID NO: 3279356 - DNA, 23 bp, Homo sapiens
cttactggtttccccagggaagg

SEQ ID NO: 3279357 - DNA, 14 bp, Homo sapiens
cttactgtttctgt

SEQ ID NO: 3279358 - DNA, 20 bp, Homo sapiens
cttactttcctttccccagc

SEQ ID NO: 3279359 - DNA, 22 bp, Homo sapiens
cttactttcctttccccagccc

SEQ ID NO: 3279360 - DNA, 14 bp, Homo sapiens
cttagaaagggaag

SEQ ID NO: 3279361 - DNA, 15 bp, Homo sapiens
cttagaaagggaagg

SEQ ID NO: 3279362 - DNA, 19 bp, Homo sapiens
cttagaaatcattgtagaa

SEQ ID NO: 3279363 - DNA, 18 bp, Homo sapiens
cttagaaatgtaaactgc

SEQ ID NO: 3279364 - DNA, 22 bp, Homo sapiens
cttagaaatgtaaactgccata

SEQ ID NO: 3279365 - DNA, 17 bp, Homo sapiens
cttagaaattgcatttc

SEQ ID NO: 3279366 - DNA, 16 bp, Homo sapiens
cttagaacattttaat

SEQ ID NO: 3279367 - DNA, 19 bp, Homo sapiens
cttagaacattttaattca

SEQ ID NO: 3279368 - DNA, 15 bp, Homo sapiens
cttagaacctttctt

SEQ ID NO: 3279369 - DNA, 17 bp, Homo sapiens
cttagaagtcacacagt

SEQ ID NO: 3279370 - DNA, 16 bp, Homo sapiens
cttagacataacaaaa

SEQ ID NO: 3279371 - DNA, 19 bp, Homo sapiens
cttagacttcgactcagga

SEQ ID NO: 3279372 - DNA, 22 bp, Homo sapiens
cttagagacaaaccttaaaaca

SEQ ID NO: 3279373 - DNA, 15 bp, Homo sapiens
cttagaggaaaaggg

SEQ ID NO: 3279374 - DNA, 18 bp, Homo sapiens
cttagagtgtagctgtaa

SEQ ID NO: 3279375 - DNA, 19 bp, Homo sapiens
cttagagtgtagctgtaag

SEQ ID NO: 3279376 - DNA, 15 bp, Homo sapiens
cttagatccaaggca

SEQ ID NO: 3279377 - DNA, 22 bp, Homo sapiens
cttagatggagaagttgtgaaa

SEQ ID NO: 3279378 - DNA, 13 bp, Homo sapiens
cttagatgtatat

SEQ ID NO: 3279379 - DNA, 11 bp, Homo sapiens
cttagattctc

SEQ ID NO: 3279380 - DNA, 22 bp, Homo sapiens
cttagattctctgtgtctaaga

SEQ ID NO: 3279381 - DNA, 24 bp, Homo sapiens
cttagattctctgtgtctaagatt

SEQ ID NO: 3279382 - DNA, 13 bp, Homo sapiens
cttagatttcata

SEQ ID NO: 3279383 - DNA, 16 bp, Homo sapiens
cttagcagcttccaga

SEQ ID NO: 3279384 - DNA, 21 bp, Homo sapiens
cttagcagggaaacagctaat

SEQ ID NO: 3279385 - DNA, 19 bp, Homo sapiens
cttagcatagcttattatt

SEQ ID NO: 3279386 - DNA, 21 bp, Homo sapiens
cttagcatcagaggtttgctt

SEQ ID NO: 3279387 - DNA, 14 bp, Homo sapiens
cttagcatgcacaa

SEQ ID NO: 3279388 - DNA, 18 bp, Homo sapiens
cttagcatgtttgctgaa

SEQ ID NO: 3279389 - DNA, 12 bp, Homo sapiens
cttagcccaaga

SEQ ID NO: 3279390 - DNA, 22 bp, Homo sapiens
cttagcccaagaggtctgagcc

SEQ ID NO: 3279391 - DNA, 23 bp, Homo sapiens
cttagcccaagaggtctgagccc

SEQ ID NO: 3279392 - DNA, 18 bp, Homo sapiens
cttagccgactgcgctgc

SEQ ID NO: 3279393 - DNA, 20 bp, Homo sapiens
cttagccgcaccctgcacct

SEQ ID NO: 3279394 - DNA, 22 bp, Homo sapiens
cttagccgcaccctgcacctgc

SEQ ID NO: 3279395 - DNA, 14 bp, Homo sapiens
cttagcctggagca

SEQ ID NO: 3279396 - DNA, 22 bp, Homo sapiens
cttagcctggagcacctttcct

SEQ ID NO: 3279397 - DNA, 14 bp, Homo sapiens
cttagccttgtgcc

SEQ ID NO: 3279398 - DNA, 12 bp, Homo sapiens
cttagcgggaca

SEQ ID NO: 3279399 - DNA, 22 bp, Homo sapiens
cttagctactgtatgcaaagtc

SEQ ID NO: 3279400 - DNA, 14 bp, Homo sapiens
cttagctatcagaa

SEQ ID NO: 3279401 - DNA, 21 bp, Homo sapiens
cttagctccctcccgcacccc

SEQ ID NO: 3279402 - DNA, 16 bp, Homo sapiens
cttagctgccagtgct

SEQ ID NO: 3279403 - DNA, 14 bp, Homo sapiens
cttagctgccttga

SEQ ID NO: 3279404 - DNA, 18 bp, Homo sapiens
cttagctgtactataagt

SEQ ID NO: 3279405 - DNA, 17 bp, Homo sapiens
cttagctgtctgctcag

SEQ ID NO: 3279406 - DNA, 17 bp, Homo sapiens
cttagcttatctttctt

SEQ ID NO: 3279407 - DNA, 21 bp, Homo sapiens
cttagcttatctttctttcca

SEQ ID NO: 3279408 - DNA, 17 bp, Homo sapiens
cttagctttccctgtgc

SEQ ID NO: 3279409 - DNA, 16 bp, Homo sapiens
cttagctttttaattg

SEQ ID NO: 3279410 - DNA, 15 bp, Homo sapiens
cttaggaaaggagat

SEQ ID NO: 3279411 - DNA, 14 bp, Homo sapiens
cttaggatgtgtgc

SEQ ID NO: 3279412 - DNA, 16 bp, Homo sapiens
cttaggatgtgtgcat

SEQ ID NO: 3279413 - DNA, 22 bp, Homo sapiens
cttaggatgtgtgcatgtgtgt

SEQ ID NO: 3279414 - DNA, 22 bp, Homo sapiens
cttaggcatgtaggaccctgca

SEQ ID NO: 3279415 - DNA, 12 bp, Homo sapiens
cttaggccttcc

SEQ ID NO: 3279416 - DNA, 15 bp, Homo sapiens
cttaggccttcctct

SEQ ID NO: 3279417 - DNA, 15 bp, Homo sapiens
cttagggcaccaggg

SEQ ID NO: 3279418 - DNA, 17 bp, Homo sapiens
cttagggcactgggctg

SEQ ID NO: 3279419 - DNA, 18 bp, Homo sapiens
cttagggcactgggctgt

SEQ ID NO: 3279420 - DNA, 22 bp, Homo sapiens
cttagggtgaaccacttcattc

SEQ ID NO: 3279421 - DNA, 18 bp, Homo sapiens
cttagggtggctttaatt

SEQ ID NO: 3279422 - DNA, 20 bp, Homo sapiens
cttagggtggctttaattgt

SEQ ID NO: 3279423 - DNA, 15 bp, Homo sapiens
cttaggtcagatgga

SEQ ID NO: 3279424 - DNA, 21 bp, Homo sapiens
cttaggtggcaagctgtgact

SEQ ID NO: 3279425 - DNA, 18 bp, Homo sapiens
cttaggttattttgcttt

SEQ ID NO: 3279426 - DNA, 22 bp, Homo sapiens
cttaggttattttgctttggtt

SEQ ID NO: 3279427 - DNA, 14 bp, Homo sapiens
cttagtattttacc

SEQ ID NO: 3279428 - DNA, 12 bp, Homo sapiens
cttagtccccca

SEQ ID NO: 3279429 - DNA, 20 bp, Homo sapiens
cttagtctcagtttgtgtgt

SEQ ID NO: 3279430 - DNA, 15 bp, Homo sapiens
cttagtcttctcata

SEQ ID NO: 3279431 - DNA, 19 bp, Homo sapiens
cttagtgatcatttaaaaa

SEQ ID NO: 3279432 - DNA, 18 bp, Homo sapiens
cttagtgccacccacctt

SEQ ID NO: 3279433 - DNA, 20 bp, Homo sapiens
cttagtgcttcagagtttgt

SEQ ID NO: 3279434 - DNA, 22 bp, Homo sapiens
cttagtgcttcagagtttgtgt

SEQ ID NO: 3279435 - DNA, 13 bp, Homo sapiens
cttagtgggccag

SEQ ID NO: 3279436 - DNA, 18 bp, Homo sapiens
cttagtgggccagggctg

SEQ ID NO: 3279437 - DNA, 17 bp, Homo sapiens
cttagtggtatgtctct

SEQ ID NO: 3279438 - DNA, 18 bp, Homo sapiens
cttagtggtatgtctctt

SEQ ID NO: 3279439 - DNA, 20 bp, Homo sapiens
cttagtggtatgtctcttta

SEQ ID NO: 3279440 - DNA, 17 bp, Homo sapiens
cttataaaccaatctta

SEQ ID NO: 3279441 - DNA, 18 bp, Homo sapiens
cttataaaccaatcttaa

SEQ ID NO: 3279442 - DNA, 19 bp, Homo sapiens
cttataaaccaatcttaaa

SEQ ID NO: 3279443 - DNA, 22 bp, Homo sapiens
cttataaatcatattgatgaaa

SEQ ID NO: 3279444 - DNA, 22 bp, Homo sapiens
cttataacctagttaaagaaag

SEQ ID NO: 3279445 - DNA, 19 bp, Homo sapiens
cttataagtgaagtgatac

SEQ ID NO: 3279446 - DNA, 13 bp, Homo sapiens
cttataatactct

SEQ ID NO: 3279447 - DNA, 22 bp, Homo sapiens
cttatacaacagcaaaccctga

SEQ ID NO: 3279448 - DNA, 23 bp, Homo sapiens
cttatacccccattaaattcact

SEQ ID NO: 3279449 - DNA, 17 bp, Homo sapiens
cttatagaataaaagct

SEQ ID NO: 3279450 - DNA, 14 bp, Homo sapiens
cttatagttaatat

SEQ ID NO: 3279451 - DNA, 15 bp, Homo sapiens
cttatagttactgtg

SEQ ID NO: 3279452 - DNA, 16 bp, Homo sapiens
cttatagttactgtgt

SEQ ID NO: 3279453 - DNA, 21 bp, Homo sapiens
cttatagttactgtgtaatta

SEQ ID NO: 3279454 - DNA, 14 bp, Homo sapiens
cttatagttctagg

SEQ ID NO: 3279455 - DNA, 14 bp, Homo sapiens
cttatattggtttg

SEQ ID NO: 3279456 - DNA, 18 bp, Homo sapiens
cttatattggtttgcaca

SEQ ID NO: 3279457 - DNA, 20 bp, Homo sapiens
cttatattggtttgcacaag

SEQ ID NO: 3279458 - DNA, 23 bp, Homo sapiens
cttatatttccctaaaatacatt

SEQ ID NO: 3279459 - DNA, 21 bp, Homo sapiens
cttatattttcgtatgaaaat

SEQ ID NO: 3279460 - DNA, 17 bp, Homo sapiens
cttatcaagtgtcttcc

SEQ ID NO: 3279461 - DNA, 23 bp, Homo sapiens
cttatcagctacttaagagaaat

SEQ ID NO: 3279462 - DNA, 19 bp, Homo sapiens
cttatctgtgcgtgaaaca

SEQ ID NO: 3279463 - DNA, 21 bp, Homo sapiens
cttatctgtgcgtgaaacaca

SEQ ID NO: 3279464 - DNA, 16 bp, Homo sapiens
cttatctttctttcca

SEQ ID NO: 3279465 - DNA, 23 bp, Homo sapiens
cttatgacgcggctcaaaaggaa

SEQ ID NO: 3279466 - DNA, 18 bp, Homo sapiens
cttatgatgttttccctt

SEQ ID NO: 3279467 - DNA, 22 bp, Homo sapiens
cttatgatgttttcccttaact

SEQ ID NO: 3279468 - DNA, 21 bp, Homo sapiens
cttatgattaaacttccttct

SEQ ID NO: 3279469 - DNA, 14 bp, Homo sapiens
cttatgccacggga

SEQ ID NO: 3279470 - DNA, 15 bp, Homo sapiens
cttatgctaaattaa

SEQ ID NO: 3279471 - DNA, 21 bp, Homo sapiens
cttatgctagtttattggaag

SEQ ID NO: 3279472 - DNA, 15 bp, Homo sapiens
cttatgctgatttat

SEQ ID NO: 3279473 - DNA, 17 bp, Homo sapiens
cttatggaattgatttg

SEQ ID NO: 3279474 - DNA, 20 bp, Homo sapiens
cttatggaattgatttgcat

SEQ ID NO: 3279475 - DNA, 21 bp, Homo sapiens
cttatggaattgatttgcatt

SEQ ID NO: 3279476 - DNA, 18 bp, Homo sapiens
cttatgggatccttgtct

SEQ ID NO: 3279477 - DNA, 14 bp, Homo sapiens
cttatgtacttgat

SEQ ID NO: 3279478 - DNA, 15 bp, Homo sapiens
cttatgtacttgata

SEQ ID NO: 3279479 - DNA, 14 bp, Homo sapiens
cttatgtagagttt

SEQ ID NO: 3279480 - DNA, 19 bp, Homo sapiens
cttatgtagcaggaaataa

SEQ ID NO: 3279481 - DNA, 18 bp, Homo sapiens
cttatgttgaaaaaattt

SEQ ID NO: 3279482 - DNA, 22 bp, Homo sapiens
cttattaagttcgaacatgttt

SEQ ID NO: 3279483 - DNA, 14 bp, Homo sapiens
cttattacatttaa

SEQ ID NO: 3279484 - DNA, 16 bp, Homo sapiens
cttattacattttatt

SEQ ID NO: 3279485 - DNA, 24 bp, Homo sapiens
cttattataaaatggacacaaatt

SEQ ID NO: 3279486 - DNA, 20 bp, Homo sapiens
cttattcccaaactacagaa

SEQ ID NO: 3279487 - DNA, 17 bp, Homo sapiens
cttattccgagcattcc

SEQ ID NO: 3279488 - DNA, 18 bp, Homo sapiens
cttattccgagcattcca

SEQ ID NO: 3279489 - DNA, 15 bp, Homo sapiens
cttattcctctaggc

SEQ ID NO: 3279490 - DNA, 12 bp, Homo sapiens
cttattcttaag

SEQ ID NO: 3279491 - DNA, 17 bp, Homo sapiens
cttattcttttataata

SEQ ID NO: 3279492 - DNA, 23 bp, Homo sapiens
cttattgaaaaaaaaaatgttga

SEQ ID NO: 3279493 - DNA, 14 bp, Homo sapiens
cttattgcgctgct

SEQ ID NO: 3279494 - DNA, 14 bp, Homo sapiens
cttattgcttagta

SEQ ID NO: 3279495 - DNA, 21 bp, Homo sapiens
cttattggaaatgtacttttg

SEQ ID NO: 3279496 - DNA, 16 bp, Homo sapiens
cttattggatatttga

SEQ ID NO: 3279497 - DNA, 21 bp, Homo sapiens
cttattggatatttgatattt

SEQ ID NO: 3279498 - DNA, 18 bp, Homo sapiens
cttattgtacctctctta

SEQ ID NO: 3279499 - DNA, 14 bp, Homo sapiens
cttattgttccaag

SEQ ID NO: 3279500 - DNA, 21 bp, Homo sapiens
cttattgttccaagacattgt

SEQ ID NO: 3279501 - DNA, 22 bp, Homo sapiens
cttatttaatcttttcttattt

SEQ ID NO: 3279502 - DNA, 13 bp, Homo sapiens
gacacagttcctg

SEQ ID NO: 3279503 - DNA, 14 bp, Homo sapiens
gacacagttcctgg

SEQ ID NO: 3279504 - DNA, 15 bp, Homo sapiens
gacacagttcctggg

SEQ ID NO: 3279505 - DNA, 15 bp, Homo sapiens
gacacatacagagtg

SEQ ID NO: 3279506 - DNA, 19 bp, Homo sapiens
gacacatacagagtgggcc

SEQ ID NO: 3279507 - DNA, 13 bp, Homo sapiens
gacacatcccggc

SEQ ID NO: 3279508 - DNA, 21 bp, Homo sapiens
gacacatcccggcctcttcca

SEQ ID NO: 3279509 - DNA, 14 bp, Homo sapiens
gacaccaaagttct

SEQ ID NO: 3279510 - DNA, 15 bp, Homo sapiens
gacaccaaagttcta

SEQ ID NO: 3279511 - DNA, 16 bp, Homo sapiens
gacaccaaccagacag

SEQ ID NO: 3279512 - DNA, 14 bp, Homo sapiens
gacaccacacccag

SEQ ID NO: 3279513 - DNA, 18 bp, Homo sapiens
gacaccacacccagcctc

SEQ ID NO: 3279514 - DNA, 15 bp, Homo sapiens
gacaccagagcagat

SEQ ID NO: 3279515 - DNA, 18 bp, Homo sapiens
gacaccagagcagatgca

SEQ ID NO: 3279516 - DNA, 13 bp, Homo sapiens
gacaccagagctg

SEQ ID NO: 3279517 - DNA, 17 bp, Homo sapiens
gacaccattctcctgcc

SEQ ID NO: 3279518 - DNA, 13 bp, Homo sapiens
gacacccctgctc

SEQ ID NO: 3279519 - DNA, 22 bp, Homo sapiens
gacaccctacacaaaatacagc

SEQ ID NO: 3279520 - DNA, 12 bp, Homo sapiens
gacaccctggcc

SEQ ID NO: 3279521 - DNA, 20 bp, Homo sapiens
gacaccggggtggtgggaac

SEQ ID NO: 3279522 - DNA, 13 bp, Homo sapiens
gacacctaccatg

SEQ ID NO: 3279523 - DNA, 17 bp, Homo sapiens
gacacctactgagtggc

SEQ ID NO: 3279524 - DNA, 17 bp, Homo sapiens
gacacctgaaccctcca

SEQ ID NO: 3279525 - DNA, 14 bp, Homo sapiens
gacacctgccctgc

SEQ ID NO: 3279526 - DNA, 15 bp, Homo sapiens
gacacctgccctgcc

SEQ ID NO: 3279527 - DNA, 18 bp, Homo sapiens
gacaccttgacagggcac

SEQ ID NO: 3279528 - DNA, 17 bp, Homo sapiens
gacacgcgctctccacc

SEQ ID NO: 3279529 - DNA, 20 bp, Homo sapiens
gacactaaccacgctggacc

SEQ ID NO: 3279530 - DNA, 14 bp, Homo sapiens
gacactagaaaact

SEQ ID NO: 3279531 - DNA, 16 bp, Homo sapiens
gacactagaagatttt

SEQ ID NO: 3279532 - DNA, 21 bp, Homo sapiens
gacactccccgaagtcttttg

SEQ ID NO: 3279533 - DNA, 19 bp, Homo sapiens
gacactcctataaggagag

SEQ ID NO: 3279534 - DNA, 16 bp, Homo sapiens
gacactgagccccacc

SEQ ID NO: 3279535 - DNA, 20 bp, Homo sapiens
gacactgccgacatcagcat

SEQ ID NO: 3279536 - DNA, 14 bp, Homo sapiens
gacactgctgcacc

SEQ ID NO: 3279537 - DNA, 13 bp, Homo sapiens
gacactgtacaag

SEQ ID NO: 3279538 - DNA, 15 bp, Homo sapiens
gacacttcagagagc

SEQ ID NO: 3279539 - DNA, 17 bp, Homo sapiens
gacacttcagagagctg

SEQ ID NO: 3279540 - DNA, 12 bp, Homo sapiens
gacacttcagat

SEQ ID NO: 3279541 - DNA, 14 bp, Homo sapiens
gacagaaactggat

SEQ ID NO: 3279542 - DNA, 21 bp, Homo sapiens
gacagaaaggagagtggccat

SEQ ID NO: 3279543 - DNA, 21 bp, Homo sapiens
gacagaagagaaggaagccat

SEQ ID NO: 3279544 - DNA, 16 bp, Homo sapiens
gacagaagcaggctgg

SEQ ID NO: 3279545 - DNA, 23 bp, Homo sapiens
gacagaagcctggactctgcccc

SEQ ID NO: 3279546 - DNA, 14 bp, Homo sapiens
gacagaaggtgcca

SEQ ID NO: 3279547 - DNA, 23 bp, Homo sapiens
gacagaaggtgccactttaccca

SEQ ID NO: 3279548 - DNA, 20 bp, Homo sapiens
gacagaatggctatcaaaag

SEQ ID NO: 3279549 - DNA, 15 bp, Homo sapiens
gacagacacacacac

SEQ ID NO: 3279550 - DNA, 15 bp, Homo sapiens
gacagacaggctctt

SEQ ID NO: 3279551 - DNA, 21 bp, Homo sapiens
gacagacaggctcttagcagc

SEQ ID NO: 3279552 - DNA, 18 bp, Homo sapiens
gacagaccacatctttat

SEQ ID NO: 3279553 - DNA, 15 bp, Homo sapiens
gacagaccacttgcc

SEQ ID NO: 3279554 - DNA, 15 bp, Homo sapiens
gacagacccaggtct

SEQ ID NO: 3279555 - DNA, 17 bp, Homo sapiens
gacagacccaggtcttc

SEQ ID NO: 3279556 - DNA, 21 bp, Homo sapiens
gacagacccaggtcttccaga

SEQ ID NO: 3279557 - DNA, 19 bp, Homo sapiens
gacagagactcagatgagg

SEQ ID NO: 3279558 - DNA, 15 bp, Homo sapiens
gacagagaggactgt

SEQ ID NO: 3279559 - DNA, 16 bp, Homo sapiens
gacagagaggactgta

SEQ ID NO: 3279560 - DNA, 19 bp, Homo sapiens
gacagagaggactgtaggg

SEQ ID NO: 3279561 - DNA, 13 bp, Homo sapiens
gacagagccatgc

SEQ ID NO: 3279562 - DNA, 19 bp, Homo sapiens
gacagagccatgctgggaa

SEQ ID NO: 3279563 - DNA, 12 bp, Homo sapiens
gacagaggcagc

SEQ ID NO: 3279564 - DNA, 14 bp, Homo sapiens
gacagaggcagccc

SEQ ID NO: 3279565 - DNA, 16 bp, Homo sapiens
gacagagtatgaacac

SEQ ID NO: 3279566 - DNA, 14 bp, Homo sapiens
gacagagttcacag

SEQ ID NO: 3279567 - DNA, 17 bp, Homo sapiens
gacagagttcacaggag

SEQ ID NO: 3279568 - DNA, 21 bp, Homo sapiens
gacagagttcacaggaggcca

SEQ ID NO: 3279569 - DNA, 22 bp, Homo sapiens
gacagagttcacaggaggccag

SEQ ID NO: 3279570 - DNA, 23 bp, Homo sapiens
gacagatacgtagttgtgctttt

SEQ ID NO: 3279571 - DNA, 23 bp, Homo sapiens
gacagatccccgttcctgacatc

SEQ ID NO: 3279572 - DNA, 19 bp, Homo sapiens
gacagatgccccagagctg

SEQ ID NO: 3279573 - DNA, 17 bp, Homo sapiens
gacagatgtcagccgag

SEQ ID NO: 3279574 - DNA, 18 bp, Homo sapiens
gacagatgtcagccgagc

SEQ ID NO: 3279575 - DNA, 19 bp, Homo sapiens
gacagatgtcagcttccca

SEQ ID NO: 3279576 - DNA, 23 bp, Homo sapiens
gacagatgtcagcttcccagcca

SEQ ID NO: 3279577 - DNA, 16 bp, Homo sapiens
gacagcacagggcagg

SEQ ID NO: 3279578 - DNA, 13 bp, Homo sapiens
gacagcatgcccc

SEQ ID NO: 3279579 - DNA, 22 bp, Homo sapiens
gacagcatgccccttggctgga

SEQ ID NO: 3279580 - DNA, 13 bp, Homo sapiens
gacagcatttaaa

SEQ ID NO: 3279581 - DNA, 18 bp, Homo sapiens
gacagccaagcacctcca

SEQ ID NO: 3279582 - DNA, 18 bp, Homo sapiens
gacccacggagccctccc

SEQ ID NO: 3279583 - DNA, 16 bp, Homo sapiens
gacccactgatctcta

SEQ ID NO: 3279584 - DNA, 17 bp, Homo sapiens
gacccagaatggagcct

SEQ ID NO: 3279585 - DNA, 17 bp, Homo sapiens
gacccagcatctcccag

SEQ ID NO: 3279586 - DNA, 19 bp, Homo sapiens
gacccagctactctgtcca

SEQ ID NO: 3279587 - DNA, 23 bp, Homo sapiens
gacccagctactctgtccaggcc

SEQ ID NO: 3279588 - DNA, 11 bp, Homo sapiens
gacccaggccc

SEQ ID NO: 3279589 - DNA, 12 bp, Homo sapiens
gacccaggccct

SEQ ID NO: 3279590 - DNA, 18 bp, Homo sapiens
gacccaggccctccatgg

SEQ ID NO: 3279591 - DNA, 13 bp, Homo sapiens
gacccaggccgca

SEQ ID NO: 3279592 - DNA, 17 bp, Homo sapiens
gacccaggccgcagctc

SEQ ID NO: 3279593 - DNA, 18 bp, Homo sapiens
gacccaggctccgccctt

SEQ ID NO: 3279594 - DNA, 15 bp, Homo sapiens
gacccaggtcttcca

SEQ ID NO: 3279595 - DNA, 17 bp, Homo sapiens
gacccaggtcttccaga

SEQ ID NO: 3279596 - DNA, 20 bp, Homo sapiens
gacccaggtcttccagacct

SEQ ID NO: 3279597 - DNA, 23 bp, Homo sapiens
gacccaggtggagggcacagccc

SEQ ID NO: 3279598 - DNA, 11 bp, Homo sapiens
gacccatctgt

SEQ ID NO: 3279599 - DNA, 13 bp, Homo sapiens
gaccccactgcca

SEQ ID NO: 3279600 - DNA, 20 bp, Homo sapiens
gaccccactgccaagtgggg

SEQ ID NO: 3279601 - DNA, 14 bp, Homo sapiens
gaccccagctggga

SEQ ID NO: 3279602 - DNA, 16 bp, Homo sapiens
gaccccagctgggagg

SEQ ID NO: 3279603 - DNA, 12 bp, Homo sapiens
gaccccagggca

SEQ ID NO: 3279604 - DNA, 13 bp, Homo sapiens
gaccccagtttct

SEQ ID NO: 3279605 - DNA, 12 bp, Homo sapiens
gacccccaacca

SEQ ID NO: 3279606 - DNA, 15 bp, Homo sapiens
gacccccacacctca

SEQ ID NO: 3279607 - DNA, 18 bp, Homo sapiens
gacccccacgattggcca

SEQ ID NO: 3279608 - DNA, 24 bp, Homo sapiens
gacccccaggcctgtccaccctgc

SEQ ID NO: 3279609 - DNA, 15 bp, Homo sapiens
gaccccgcacccggc

SEQ ID NO: 3279610 - DNA, 18 bp, Homo sapiens
gacccctccatgtgggct

SEQ ID NO: 3279611 - DNA, 21 bp, Homo sapiens
gacccctccatgtgggctagt

SEQ ID NO: 3279612 - DNA, 17 bp, Homo sapiens
gacccctcccctcgtgt

SEQ ID NO: 3279613 - DNA, 12 bp, Homo sapiens
gacccctcctca

SEQ ID NO: 3279614 - DNA, 13 bp, Homo sapiens
gacccctcctcac

SEQ ID NO: 3279615 - DNA, 15 bp, Homo sapiens
gacccctcctcactg

SEQ ID NO: 3279616 - DNA, 21 bp, Homo sapiens
gacccctgctcccagcctgct

SEQ ID NO: 3279617 - DNA, 11 bp, Homo sapiens
gaccccttgct

SEQ ID NO: 3279618 - DNA, 15 bp, Homo sapiens
gacccgcaacaagta

SEQ ID NO: 3279619 - DNA, 13 bp, Homo sapiens
gacccggctgcgt

SEQ ID NO: 3279620 - DNA, 22 bp, Homo sapiens
gaccctcaggaattcagtgcct

SEQ ID NO: 3279621 - DNA, 18 bp, Homo sapiens
gaccctcatggcccccag

SEQ ID NO: 3279622 - DNA, 19 bp, Homo sapiens
gaccctcctcctcccccag

SEQ ID NO: 3279623 - DNA, 15 bp, Homo sapiens
gaccctctgccacca

SEQ ID NO: 3279624 - DNA, 20 bp, Homo sapiens
gaccctctgccaccagagac

SEQ ID NO: 3279625 - DNA, 14 bp, Homo sapiens
gaccctctgggaac

SEQ ID NO: 3279626 - DNA, 20 bp, Homo sapiens
gaccctctgggaacctccca

SEQ ID NO: 3279627 - DNA, 21 bp, Homo sapiens
gaccctctgggaacctcccag

SEQ ID NO: 3279628 - DNA, 22 bp, Homo sapiens
gaccctcttgcccatcctgact

SEQ ID NO: 3279629 - DNA, 16 bp, Homo sapiens
gaccctgacctccgcc

SEQ ID NO: 3279630 - DNA, 11 bp, Homo sapiens
gaccctgagac

SEQ ID NO: 3279631 - DNA, 17 bp, Homo sapiens
gaccctgagactccaga

SEQ ID NO: 3279632 - DNA, 19 bp, Homo sapiens
gaccctgcaaacagaacag

SEQ ID NO: 3279633 - DNA, 20 bp, Homo sapiens
gaccctgcgaaggggccctg

SEQ ID NO: 3279634 - DNA, 21 bp, Homo sapiens
gaccctgcgaaggggccctgg

SEQ ID NO: 3279635 - DNA, 22 bp, Homo sapiens
gaccctgcgaaggggccctggt

SEQ ID NO: 3279636 - DNA, 19 bp, Homo sapiens
gaccctggaattcagcacc

SEQ ID NO: 3279637 - DNA, 22 bp, Homo sapiens
gaccctggaattcagcaccctg

SEQ ID NO: 3279638 - DNA, 18 bp, Homo sapiens
gaccctgggtgggctctg

SEQ ID NO: 3279639 - DNA, 19 bp, Homo sapiens
gaccctgggtgggctctgt

SEQ ID NO: 3279640 - DNA, 12 bp, Homo sapiens
gaccctgtctct

SEQ ID NO: 3279641 - DNA, 13 bp, Homo sapiens
gaaaataggcttt

SEQ ID NO: 3279642 - DNA, 12 bp, Homo sapiens
gaaaatatactt

SEQ ID NO: 3279643 - DNA, 16 bp, Homo sapiens
gaaaatatatgatggc

SEQ ID NO: 3279644 - DNA, 21 bp, Homo sapiens
gaaaatattatgtgtttccat

SEQ ID NO: 3279645 - DNA, 19 bp, Homo sapiens
gaaaatattctctatttga

SEQ ID NO: 3279646 - DNA, 14 bp, Homo sapiens
gaaaatctaatatt

SEQ ID NO: 3279647 - DNA, 20 bp, Homo sapiens
gaaaatctaatattaaaaat

SEQ ID NO: 3279648 - DNA, 13 bp, Homo sapiens
gaaaatgaaagct

SEQ ID NO: 3279649 - DNA, 16 bp, Homo sapiens
gaaaatgaactgccca

SEQ ID NO: 3279650 - DNA, 12 bp, Homo sapiens
gaaaatgactta

SEQ ID NO: 3279651 - DNA, 15 bp, Homo sapiens
gaaaatgacttattt

SEQ ID NO: 3279652 - DNA, 20 bp, Homo sapiens
gaaaatgatacgcaacataa

SEQ ID NO: 3279653 - DNA, 20 bp, Homo sapiens
gaaaatggctaataaactgt

SEQ ID NO: 3279654 - DNA, 23 bp, Homo sapiens
gaaaatggtttattttgtattgt

SEQ ID NO: 3279655 - DNA, 13 bp, Homo sapiens
gaaaatgtaaatt

SEQ ID NO: 3279656 - DNA, 17 bp, Homo sapiens
gaaaatgtaagctgttt

SEQ ID NO: 3279657 - DNA, 15 bp, Homo sapiens
gaaaatgtatgtgta

SEQ ID NO: 3279658 - DNA, 23 bp, Homo sapiens
gaaaatgtcagaaaccagttatg

SEQ ID NO: 3279659 - DNA, 19 bp, Homo sapiens
gaaaatgtgtttgctgcct

SEQ ID NO: 3279660 - DNA, 15 bp, Homo sapiens
gaaaatgttatttaa

SEQ ID NO: 3279661 - DNA, 15 bp, Homo sapiens
gaaaatgttctgttt

SEQ ID NO: 3279662 - DNA, 21 bp, Homo sapiens
gaaaatgttctgtttgctgtg

SEQ ID NO: 3279663 - DNA, 15 bp, Homo sapiens
gaaaatgttgagaat

SEQ ID NO: 3279664 - DNA, 20 bp, Homo sapiens
gaaaattcaaaaagtgttta

SEQ ID NO: 3279665 - DNA, 14 bp, Homo sapiens
gaaaattcattttt

SEQ ID NO: 3279666 - DNA, 18 bp, Homo sapiens
gaaaattccagaaaggat

SEQ ID NO: 3279667 - DNA, 13 bp, Homo sapiens
gaaaattctgtgc

SEQ ID NO: 3279668 - DNA, 21 bp, Homo sapiens
gaaaattggcagtggcagaga

SEQ ID NO: 3279669 - DNA, 12 bp, Homo sapiens
gaaaattgtatt

SEQ ID NO: 3279670 - DNA, 19 bp, Homo sapiens
gaaaattttaaaaatacat

SEQ ID NO: 3279671 - DNA, 20 bp, Homo sapiens
gaaaattttaaaaatacata

SEQ ID NO: 3279672 - DNA, 11 bp, Homo sapiens
gaaaatttttt

SEQ ID NO: 3279673 - DNA, 18 bp, Homo sapiens
gaaacaaaaagagctttc

SEQ ID NO: 3279674 - DNA, 19 bp, Homo sapiens
gaaacaaaaattgtcttta

SEQ ID NO: 3279675 - DNA, 23 bp, Homo sapiens
gaaacaaaaattgtctttatgag

SEQ ID NO: 3279676 - DNA, 12 bp, Homo sapiens
gaaacaaagatg

SEQ ID NO: 3279677 - DNA, 18 bp, Homo sapiens
gaaacaacatttatatgt

SEQ ID NO: 3279678 - DNA, 13 bp, Homo sapiens
gaaacaagctgtg

SEQ ID NO: 3279679 - DNA, 10 bp, Homo sapiens
gaaacaatgt

SEQ ID NO: 3279680 - DNA, 15 bp, Homo sapiens
gaaacacaataccta

SEQ ID NO: 3279681 - DNA, 14 bp, Homo sapiens
gaaacacacaagca

SEQ ID NO: 3279682 - DNA, 14 bp, Homo sapiens
gaaacacagaaacc

SEQ ID NO: 3279683 - DNA, 12 bp, Homo sapiens
gaaacacagctg

SEQ ID NO: 3279684 - DNA, 13 bp, Homo sapiens
gaaacacagctgt

SEQ ID NO: 3279685 - DNA, 14 bp, Homo sapiens
gaaacacagggttt

SEQ ID NO: 3279686 - DNA, 15 bp, Homo sapiens
gaaacacataaatta

SEQ ID NO: 3279687 - DNA, 19 bp, Homo sapiens
gaaacacatcaaataaact

SEQ ID NO: 3279688 - DNA, 16 bp, Homo sapiens
gaaacacgaaacttgt

SEQ ID NO: 3279689 - DNA, 18 bp, Homo sapiens
gaaacacgaaacttgtta

SEQ ID NO: 3279690 - DNA, 13 bp, Homo sapiens
gaaacacttgctt

SEQ ID NO: 3279691 - DNA, 17 bp, Homo sapiens
gaaacagaaaaataagt

SEQ ID NO: 3279692 - DNA, 14 bp, Homo sapiens
gaaacagaaacaaa

SEQ ID NO: 3279693 - DNA, 14 bp, Homo sapiens
gaaacagagacagg

SEQ ID NO: 3279694 - DNA, 16 bp, Homo sapiens
gaaacagagacaggcc

SEQ ID NO: 3279695 - DNA, 17 bp, Homo sapiens
gaaacagagacaggccc

SEQ ID NO: 3279696 - DNA, 19 bp, Homo sapiens
gaaacagagtccaatttaa

SEQ ID NO: 3279697 - DNA, 19 bp, Homo sapiens
gaaacagattcaggccagc

SEQ ID NO: 3279698 - DNA, 11 bp, Homo sapiens
gaaacagcatg

SEQ ID NO: 3279699 - DNA, 17 bp, Homo sapiens
gaaacagcatgaataaa

SEQ ID NO: 3279700 - DNA, 20 bp, Homo sapiens
gaaacagcatgaataaaaca

SEQ ID NO: 3279701 - DNA, 19 bp, Homo sapiens
gaaacagccatgtccaagt

SEQ ID NO: 3279702 - DNA, 18 bp, Homo sapiens
gaaacagctaatgggaca

SEQ ID NO: 3279703 - DNA, 12 bp, Homo sapiens
gaaacagctcag

SEQ ID NO: 3279704 - DNA, 15 bp, Homo sapiens
gaaacagctcagcca

SEQ ID NO: 3279705 - DNA, 20 bp, Homo sapiens
gaaacagctttcaagtgcct

SEQ ID NO: 3279706 - DNA, 21 bp, Homo sapiens
gaaacagctttcaagtgcctt

SEQ ID NO: 3279707 - DNA, 18 bp, Homo sapiens
gaaacagttggtaacttt

SEQ ID NO: 3279708 - DNA, 19 bp, Homo sapiens
gaaacagttggtaactttt

SEQ ID NO: 3279709 - DNA, 13 bp, Homo sapiens
gaaacatgacact

SEQ ID NO: 3279710 - DNA, 17 bp, Homo sapiens
gaaacatgacactgacc

SEQ ID NO: 3279711 - DNA, 20 bp, Homo sapiens
gaaacatgactcgtatatgt

SEQ ID NO: 3279712 - DNA, 16 bp, Homo sapiens
gaaacattacagttca

SEQ ID NO: 3279713 - DNA, 22 bp, Homo sapiens
gaaacattcacacagggctctt

SEQ ID NO: 3279714 - DNA, 13 bp, Homo sapiens
gaaaccaaaacat

SEQ ID NO: 3279715 - DNA, 19 bp, Homo sapiens
gaaaccaattaagcagctt

SEQ ID NO: 3279716 - DNA, 16 bp, Homo sapiens
gaaaccagaaaagcaa

SEQ ID NO: 3279717 - DNA, 20 bp, Homo sapiens
gaaaccattttcccatcatc

SEQ ID NO: 3279718 - DNA, 23 bp, Homo sapiens
gaaacccacagatgtctctgggg

SEQ ID NO: 3279719 - DNA, 14 bp, Homo sapiens
gaaaccctctgtca

SEQ ID NO: 3279720 - DNA, 14 bp, Homo sapiens
gaaaccctggtctc

SEQ ID NO: 3279721 - DNA, 15 bp, Homo sapiens
gaaaccctggtctcc

SEQ ID NO: 3279722 - DNA, 16 bp, Homo sapiens
gaaaccctggtctccg

SEQ ID NO: 3279723 - DNA, 19 bp, Homo sapiens
gaaacccttcacaccccag

SEQ ID NO: 3279724 - DNA, 16 bp, Homo sapiens
gaaacccttgctgctt

SEQ ID NO: 3279725 - DNA, 18 bp, Homo sapiens
gaaacccttgctgcttta

SEQ ID NO: 3279726 - DNA, 13 bp, Homo sapiens
gaaaccgggagaa

SEQ ID NO: 3279727 - DNA, 21 bp, Homo sapiens
gaaacctacacactgtcatgc

SEQ ID NO: 3279728 - DNA, 18 bp, Homo sapiens
gaaacctagtactgcccc

SEQ ID NO: 3279729 - DNA, 17 bp, Homo sapiens
gaaacctcattggccag

SEQ ID NO: 3279730 - DNA, 18 bp, Homo sapiens
gaaacctggggtgaatac

SEQ ID NO: 3279731 - DNA, 13 bp, Homo sapiens
gaaaccttaatat

SEQ ID NO: 3279732 - DNA, 20 bp, Homo sapiens
gaaacctttagggcagcttg

SEQ ID NO: 3279733 - DNA, 21 bp, Homo sapiens
gaaacctttagggcagcttgc

SEQ ID NO: 3279734 - DNA, 17 bp, Homo sapiens
gaaaccttttttaagat

SEQ ID NO: 3279735 - DNA, 22 bp, Homo sapiens
gaaaccttttttaagatttttc

SEQ ID NO: 3279736 - DNA, 20 bp, Homo sapiens
gaaacgccccgggcaaaggg

SEQ ID NO: 3279737 - DNA, 23 bp, Homo sapiens
gaaacgccccgggcaaagggtct

SEQ ID NO: 3279738 - DNA, 23 bp, Homo sapiens
gaaacgctacctctctgtccctt

SEQ ID NO: 3279739 - DNA, 13 bp, Homo sapiens
gaaacgtgttaaa

SEQ ID NO: 3279740 - DNA, 15 bp, Homo sapiens
gaaactaacagataa

SEQ ID NO: 3279741 - DNA, 14 bp, Homo sapiens
gaaactagaaatgt

SEQ ID NO: 3279742 - DNA, 13 bp, Homo sapiens
gaaactatgtgtt

SEQ ID NO: 3279743 - DNA, 18 bp, Homo sapiens
gaaactatgtgtttttct

SEQ ID NO: 3279744 - DNA, 17 bp, Homo sapiens
gaaactcaccatgtaaa

SEQ ID NO: 3279745 - DNA, 15 bp, Homo sapiens
gaaactccaaagtcc

SEQ ID NO: 3279746 - DNA, 17 bp, Homo sapiens
gaaactccacatctgcc

SEQ ID NO: 3279747 - DNA, 18 bp, Homo sapiens
gaaactccacatctgcct

SEQ ID NO: 3279748 - DNA, 20 bp, Homo sapiens
gaaactccacatctgcctta

SEQ ID NO: 3279749 - DNA, 18 bp, Homo sapiens
gaaactcccatgtatgga

SEQ ID NO: 3279750 - DNA, 17 bp, Homo sapiens
gaaactcccctgggggt

SEQ ID NO: 3279751 - DNA, 15 bp, Homo sapiens
gaaactccgaagaaa

SEQ ID NO: 3279752 - DNA, 20 bp, Homo sapiens
gaaactcttatctcagtcat

SEQ ID NO: 3279753 - DNA, 21 bp, Homo sapiens
gaaactcttatctcagtcatg

SEQ ID NO: 3279754 - DNA, 15 bp, Homo sapiens
gaaactgaaagtgtt

SEQ ID NO: 3279755 - DNA, 22 bp, Homo sapiens
gaaactgatgccaaggggctga

SEQ ID NO: 3279756 - DNA, 19 bp, Homo sapiens
gaatatttccatatggatt

SEQ ID NO: 3279757 - DNA, 20 bp, Homo sapiens
gaatattttttatttctaag

SEQ ID NO: 3279758 - DNA, 13 bp, Homo sapiens
gaatcaaaactct

SEQ ID NO: 3279759 - DNA, 22 bp, Homo sapiens
gaatcacggtggtaaagaaagt

SEQ ID NO: 3279760 - DNA, 20 bp, Homo sapiens
gaatcactaggtaacttatt

SEQ ID NO: 3279761 - DNA, 15 bp, Homo sapiens
gaatcactgcagccc

SEQ ID NO: 3279762 - DNA, 18 bp, Homo sapiens
gaatcactgcagcccagg

SEQ ID NO: 3279763 - DNA, 11 bp, Homo sapiens
gaatcactgtt

SEQ ID NO: 3279764 - DNA, 14 bp, Homo sapiens
gaatcactgttttt

SEQ ID NO: 3279765 - DNA, 16 bp, Homo sapiens
gaatcactgtttttag

SEQ ID NO: 3279766 - DNA, 17 bp, Homo sapiens
gaatcactgtttttaga

SEQ ID NO: 3279767 - DNA, 23 bp, Homo sapiens
gaatcactgtttttagacacctt

SEQ ID NO: 3279768 - DNA, 21 bp, Homo sapiens
gaatcagtataaacaaagtta

SEQ ID NO: 3279769 - DNA, 20 bp, Homo sapiens
gaatcatgtcaggcctgtgt

SEQ ID NO: 3279770 - DNA, 17 bp, Homo sapiens
gaatcatgtccatccct

SEQ ID NO: 3279771 - DNA, 21 bp, Homo sapiens
gaatcatgtccatcccttttc

SEQ ID NO: 3279772 - DNA, 21 bp, Homo sapiens
gaatcattccagtgctagaaa

SEQ ID NO: 3279773 - DNA, 13 bp, Homo sapiens
gaatcatttagca

SEQ ID NO: 3279774 - DNA, 12 bp, Homo sapiens
gaatccaaactt

SEQ ID NO: 3279775 - DNA, 12 bp, Homo sapiens
gaatccaagatt

SEQ ID NO: 3279776 - DNA, 17 bp, Homo sapiens
gaatccacatttctaaa

SEQ ID NO: 3279777 - DNA, 18 bp, Homo sapiens
gaatccacatttctaaaa

SEQ ID NO: 3279778 - DNA, 12 bp, Homo sapiens
gaatccacctcg

SEQ ID NO: 3279779 - DNA, 22 bp, Homo sapiens
gaatccacctcggagcatggtg

SEQ ID NO: 3279780 - DNA, 18 bp, Homo sapiens
gaatccagctccctagac

SEQ ID NO: 3279781 - DNA, 18 bp, Homo sapiens
gaatcccacccacatgtg

SEQ ID NO: 3279782 - DNA, 17 bp, Homo sapiens
gaatcccactgtatgat

SEQ ID NO: 3279783 - DNA, 13 bp, Homo sapiens
gaatcccagccgg

SEQ ID NO: 3279784 - DNA, 13 bp, Homo sapiens
gaatcccccaggg

SEQ ID NO: 3279785 - DNA, 16 bp, Homo sapiens
gaatccccgaaggtgc

SEQ ID NO: 3279786 - DNA, 15 bp, Homo sapiens
gaatcccttaaaatt

SEQ ID NO: 3279787 - DNA, 16 bp, Homo sapiens
gaatcccttaaaatta

SEQ ID NO: 3279788 - DNA, 19 bp, Homo sapiens
gaatcctatggaagagaat

SEQ ID NO: 3279789 - DNA, 19 bp, Homo sapiens
gaatcctcagttggaatca

SEQ ID NO: 3279790 - DNA, 10 bp, Homo sapiens
gaatcctcct

SEQ ID NO: 3279791 - DNA, 21 bp, Homo sapiens
gaatctaaacgtggtcacctt

SEQ ID NO: 3279792 - DNA, 22 bp, Homo sapiens
gaatctaaacgtggtcaccttc

SEQ ID NO: 3279793 - DNA, 18 bp, Homo sapiens
gaatctaaggataatgaa

SEQ ID NO: 3279794 - DNA, 18 bp, Homo sapiens
gaatctacccccagatcc

SEQ ID NO: 3279795 - DNA, 17 bp, Homo sapiens
gacgtctggggtgtggg

SEQ ID NO: 3279796 - DNA, 19 bp, Homo sapiens
gacgtctggggtgtgggga

SEQ ID NO: 3279797 - DNA, 22 bp, Homo sapiens
gacgtgaccggacttttctgca

SEQ ID NO: 3279798 - DNA, 20 bp, Homo sapiens
gacgtggagcggggtatgaa

SEQ ID NO: 3279799 - DNA, 21 bp, Homo sapiens
gacgttcggggcatgctgggg

SEQ ID NO: 3279800 - DNA, 22 bp, Homo sapiens
gacgttggcctcagggccagga

SEQ ID NO: 3279801 - DNA, 23 bp, Homo sapiens
gacgttggcctcagggccaggaa

SEQ ID NO: 3279802 - DNA, 12 bp, Homo sapiens
gacgtttctcat

SEQ ID NO: 3279803 - DNA, 23 bp, Homo sapiens
gacgtttctcatttgtttttctc

SEQ ID NO: 3279804 - DNA, 20 bp, Homo sapiens
gactaaactttttttctgta

SEQ ID NO: 3279805 - DNA, 22 bp, Homo sapiens
gactaaactttttttctgtacc

SEQ ID NO: 3279806 - DNA, 13 bp, Homo sapiens
gactaaagagaga

SEQ ID NO: 3279807 - DNA, 20 bp, Homo sapiens
gactaacataaaatctgtga

SEQ ID NO: 3279808 - DNA, 21 bp, Homo sapiens
gactaacataaaatctgtgaa

SEQ ID NO: 3279809 - DNA, 19 bp, Homo sapiens
gactaaccccaacgcacag

SEQ ID NO: 3279810 - DNA, 22 bp, Homo sapiens
gactaaccccaacgcacaggaa

SEQ ID NO: 3279811 - DNA, 16 bp, Homo sapiens
gactaactcaaataca

SEQ ID NO: 3279812 - DNA, 15 bp, Homo sapiens
gactacaaaatacaa

SEQ ID NO: 3279813 - DNA, 18 bp, Homo sapiens
gactacaggtgtgagtca

SEQ ID NO: 3279814 - DNA, 14 bp, Homo sapiens
gactacatttagag

SEQ ID NO: 3279815 - DNA, 19 bp, Homo sapiens
gactacttggaactaggct

SEQ ID NO: 3279816 - DNA, 21 bp, Homo sapiens
gactagatactactttctctt

SEQ ID NO: 3279817 - DNA, 16 bp, Homo sapiens
gactagatgatggatg

SEQ ID NO: 3279818 - DNA, 16 bp, Homo sapiens
gactagcaggctactg

SEQ ID NO: 3279819 - DNA, 19 bp, Homo sapiens
gactagcaggctactggga

SEQ ID NO: 3279820 - DNA, 23 bp, Homo sapiens
gactagcccctgtggagactggg

SEQ ID NO: 3279821 - DNA, 17 bp, Homo sapiens
gactagggattcaggct

SEQ ID NO: 3279822 - DNA, 21 bp, Homo sapiens
gactagggattcaggctgctt

SEQ ID NO: 3279823 - DNA, 13 bp, Homo sapiens
gactagtcacctg

SEQ ID NO: 3279824 - DNA, 14 bp, Homo sapiens
gactagtcacctgg

SEQ ID NO: 3279825 - DNA, 15 bp, Homo sapiens
gactataaacattaa

SEQ ID NO: 3279826 - DNA, 16 bp, Homo sapiens
gactataaacattaaa

SEQ ID NO: 3279827 - DNA, 13 bp, Homo sapiens
gactatatacatg

SEQ ID NO: 3279828 - DNA, 22 bp, Homo sapiens
gactatctaaatgttgaaagat

SEQ ID NO: 3279829 - DNA, 18 bp, Homo sapiens
gactatctgtctggtggc

SEQ ID NO: 3279830 - DNA, 21 bp, Homo sapiens
gactatttaaacttataaatc

SEQ ID NO: 3279831 - DNA, 13 bp, Homo sapiens
gactatttatgaa

SEQ ID NO: 3279832 - DNA, 14 bp, Homo sapiens
gactcaaaaataag

SEQ ID NO: 3279833 - DNA, 16 bp, Homo sapiens
gactcaaatgttctaa

SEQ ID NO: 3279834 - DNA, 19 bp, Homo sapiens
gactcaagaagtgaagaat

SEQ ID NO: 3279835 - DNA, 20 bp, Homo sapiens
gactcaagaagtgaagaatg

SEQ ID NO: 3279836 - DNA, 17 bp, Homo sapiens
gactcacacttgtaatc

SEQ ID NO: 3279837 - DNA, 14 bp, Homo sapiens
gactcacaggaagg

SEQ ID NO: 3279838 - DNA, 19 bp, Homo sapiens
gactcacaggccctggaga

SEQ ID NO: 3279839 - DNA, 19 bp, Homo sapiens
gactcacttcaatgtgtca

SEQ ID NO: 3279840 - DNA, 20 bp, Homo sapiens
gactcacttcaatgtgtcat

SEQ ID NO: 3279841 - DNA, 13 bp, Homo sapiens
gactcagcagcct

SEQ ID NO: 3279842 - DNA, 11 bp, Homo sapiens
gactcagccct

SEQ ID NO: 3279843 - DNA, 14 bp, Homo sapiens
gactcagccttcag

SEQ ID NO: 3279844 - DNA, 19 bp, Homo sapiens
gactcagccttcagacaga

SEQ ID NO: 3279845 - DNA, 19 bp, Homo sapiens
gactcagcgctcctcctgt

SEQ ID NO: 3279846 - DNA, 20 bp, Homo sapiens
gactcagcgctcctcctgtg

SEQ ID NO: 3279847 - DNA, 22 bp, Homo sapiens
gactcagcgctcctcctgtgtg

SEQ ID NO: 3279848 - DNA, 23 bp, Homo sapiens
gactcagcgctcctcctgtgtga

SEQ ID NO: 3279849 - DNA, 16 bp, Homo sapiens
gactcagctggaagtc

SEQ ID NO: 3279850 - DNA, 17 bp, Homo sapiens
gactcaggcgcctggca

SEQ ID NO: 3279851 - DNA, 19 bp, Homo sapiens
gactcaggcgcctggcaca

SEQ ID NO: 3279852 - DNA, 16 bp, Homo sapiens
gactcaggtgggccct

SEQ ID NO: 3279853 - DNA, 20 bp, Homo sapiens
gactcaggtgggccctctga

SEQ ID NO: 3279854 - DNA, 22 bp, Homo sapiens
gactcatcaatcaaataagtat

SEQ ID NO: 3279855 - DNA, 14 bp, Homo sapiens
gactccactggaca

SEQ ID NO: 3279856 - DNA, 19 bp, Homo sapiens
gactccagaatctgctgtt

SEQ ID NO: 3279857 - DNA, 15 bp, Homo sapiens
gactttgcttcccat

SEQ ID NO: 3279858 - DNA, 14 bp, Homo sapiens
gactttgcttgctt

SEQ ID NO: 3279859 - DNA, 22 bp, Homo sapiens
gactttgtaccccccaacccct

SEQ ID NO: 3279860 - DNA, 17 bp, Homo sapiens
gacttttcgttaacatt

SEQ ID NO: 3279861 - DNA, 13 bp, Homo sapiens
gacttttctgcaa

SEQ ID NO: 3279862 - DNA, 14 bp, Homo sapiens
gacttttctgcaaa

SEQ ID NO: 3279863 - DNA, 21 bp, Homo sapiens
gacttttctttgtggcttcct

SEQ ID NO: 3279864 - DNA, 15 bp, Homo sapiens
gacttttgtacatct

SEQ ID NO: 3279865 - DNA, 16 bp, Homo sapiens
gactttttgcatttaa

SEQ ID NO: 3279866 - DNA, 19 bp, Homo sapiens
gagaaaaaaaaccttgtaa

SEQ ID NO: 3279867 - DNA, 19 bp, Homo sapiens
gagaaaaaaattgctctgt

SEQ ID NO: 3279868 - DNA, 14 bp, Homo sapiens
gagaaaaaccaatg

SEQ ID NO: 3279869 - DNA, 17 bp, Homo sapiens
gagaaaaaccaatgatt

SEQ ID NO: 3279870 - DNA, 17 bp, Homo sapiens
gagaaaaactttcattt

SEQ ID NO: 3279871 - DNA, 23 bp, Homo sapiens
gagaaaagcaggcctttgcagat

SEQ ID NO: 3279872 - DNA, 18 bp, Homo sapiens
gagaaaaggctggagaga

SEQ ID NO: 3279873 - DNA, 18 bp, Homo sapiens
gagaaaataaatttaact

SEQ ID NO: 3279874 - DNA, 23 bp, Homo sapiens
gagaaaatgcctcaattcacata

SEQ ID NO: 3279875 - DNA, 17 bp, Homo sapiens
gagaaacaataaagaga

SEQ ID NO: 3279876 - DNA, 14 bp, Homo sapiens
gagaaacagctcag

SEQ ID NO: 3279877 - DNA, 16 bp, Homo sapiens
gagaaacagctcagcc

SEQ ID NO: 3279878 - DNA, 19 bp, Homo sapiens
gagaaacagttggtaactt

SEQ ID NO: 3279879 - DNA, 22 bp, Homo sapiens
gagaaaccgtcctctttttcca

SEQ ID NO: 3279880 - DNA, 14 bp, Homo sapiens
gagaaactccaaag

SEQ ID NO: 3279881 - DNA, 12 bp, Homo sapiens
gagaaagagaac

SEQ ID NO: 3279882 - DNA, 15 bp, Homo sapiens
gagaaagagagaagc

SEQ ID NO: 3279883 - DNA, 14 bp, Homo sapiens
gagaaagagctgcc

SEQ ID NO: 3279884 - DNA, 12 bp, Homo sapiens
gagaaaggtgag

SEQ ID NO: 3279885 - DNA, 21 bp, Homo sapiens
gagaaaggtgaggagggcagt

SEQ ID NO: 3279886 - DNA, 22 bp, Homo sapiens
gagaaagtacttctccaccctg

SEQ ID NO: 3279887 - DNA, 18 bp, Homo sapiens
gagaaagtgtgagcaaac

SEQ ID NO: 3279888 - DNA, 23 bp, Homo sapiens
gagaaataaagtttgcttagaaa

SEQ ID NO: 3279889 - DNA, 18 bp, Homo sapiens
gagaaatgaggaaaagaa

SEQ ID NO: 3279890 - DNA, 20 bp, Homo sapiens
gagaaatgaggaaaagaaaa

SEQ ID NO: 3279891 - DNA, 11 bp, Homo sapiens
gagaaattatt

SEQ ID NO: 3279892 - DNA, 19 bp, Homo sapiens
gagaaattcgtgtgttttt

SEQ ID NO: 3279893 - DNA, 12 bp, Homo sapiens
gagaaattctgt

SEQ ID NO: 3279894 - DNA, 20 bp, Homo sapiens
gagaaattctgttaaaatct

SEQ ID NO: 3279895 - DNA, 17 bp, Homo sapiens
gagaacaagtcacagct

SEQ ID NO: 3279896 - DNA, 20 bp, Homo sapiens
gagaacaagtcacagctgca

SEQ ID NO: 3279897 - DNA, 22 bp, Homo sapiens
gagaacaagtcacagctgcagc

SEQ ID NO: 3279898 - DNA, 20 bp, Homo sapiens
gagaacagtggttgcctggg

SEQ ID NO: 3279899 - DNA, 23 bp, Homo sapiens
gagaacagtggttgcctgggggc

SEQ ID NO: 3279900 - DNA, 16 bp, Homo sapiens
gagaaccaccactgcc

SEQ ID NO: 3279901 - DNA, 21 bp, Homo sapiens
gagaaccagtctcctcactct

SEQ ID NO: 3279902 - DNA, 16 bp, Homo sapiens
gagaacgccagtctcc

SEQ ID NO: 3279903 - DNA, 22 bp, Homo sapiens
gagaacgccagtctcccaggcc

SEQ ID NO: 3279904 - DNA, 22 bp, Homo sapiens
gagaactcgcgctcagtaaacg

SEQ ID NO: 3279905 - DNA, 15 bp, Homo sapiens
gagaactgtggccgt

SEQ ID NO: 3279906 - DNA, 20 bp, Homo sapiens
gagaacttatggccacagcc

SEQ ID NO: 3279907 - DNA, 20 bp, Homo sapiens
gagaagaaaggtgagtttga

SEQ ID NO: 3279908 - DNA, 22 bp, Homo sapiens
gagaagaatgaaaatgcagtcc

SEQ ID NO: 3279909 - DNA, 19 bp, Homo sapiens
gagaagagggcccagccca

SEQ ID NO: 3279910 - DNA, 20 bp, Homo sapiens
gagagaccccgcacccggct

SEQ ID NO: 3279911 - DNA, 17 bp, Homo sapiens
gagagacctcatcagga

SEQ ID NO: 3279912 - DNA, 17 bp, Homo sapiens
gagagactgaaagcagc

SEQ ID NO: 3279913 - DNA, 18 bp, Homo sapiens
gagagactgaaagcagca

SEQ ID NO: 3279914 - DNA, 17 bp, Homo sapiens
gagagactgagcagccg

SEQ ID NO: 3279915 - DNA, 11 bp, Homo sapiens
gagagagaaaa

SEQ ID NO: 3279916 - DNA, 11 bp, Homo sapiens
gagagagaaat

SEQ ID NO: 3279917 - DNA, 10 bp, Homo sapiens
gagagagaga

SEQ ID NO: 3279918 - DNA, 14 bp, Homo sapiens
gagagagagaaatt

SEQ ID NO: 3279919 - DNA, 13 bp, Homo sapiens
gagagagagagaa

SEQ ID NO: 3279920 - DNA, 15 bp, Homo sapiens
gagagagagagagaa

SEQ ID NO: 3279921 - DNA, 14 bp, Homo sapiens
gagagagagagagg

SEQ ID NO: 3279922 - DNA, 13 bp, Homo sapiens
gagagaggacagc

SEQ ID NO: 3279923 - DNA, 16 bp, Homo sapiens
gagagaggcagagagc

SEQ ID NO: 3279924 - DNA, 20 bp, Homo sapiens
gagagcaactctgagatcta

SEQ ID NO: 3279925 - DNA, 16 bp, Homo sapiens
gagagcagaggtctcc

SEQ ID NO: 3279926 - DNA, 13 bp, Homo sapiens
gagagcagcagca

SEQ ID NO: 3279927 - DNA, 17 bp, Homo sapiens
gagagcagcagcaccaa

SEQ ID NO: 3279928 - DNA, 21 bp, Homo sapiens
gagagcagctttaaactcagg

SEQ ID NO: 3279929 - DNA, 18 bp, Homo sapiens
gagagccaacctcggctt

SEQ ID NO: 3279930 - DNA, 21 bp, Homo sapiens
gagagccaacctcggcttgtg

SEQ ID NO: 3279931 - DNA, 15 bp, Homo sapiens
gagagccatgaagca

SEQ ID NO: 3279932 - DNA, 17 bp, Homo sapiens
gagagccattttgtgaa

SEQ ID NO: 3279933 - DNA, 13 bp, Homo sapiens
gagagcccagcca

SEQ ID NO: 3279934 - DNA, 15 bp, Homo sapiens
gagagcccctggggc

SEQ ID NO: 3279935 - DNA, 20 bp, Homo sapiens
gagagcccctggggcctaga

SEQ ID NO: 3279936 - DNA, 14 bp, Homo sapiens
gagagcctcttagt

SEQ ID NO: 3279937 - DNA, 13 bp, Homo sapiens
gagagcctgctgc

SEQ ID NO: 3279938 - DNA, 14 bp, Homo sapiens
gagagcctgctgca

SEQ ID NO: 3279939 - DNA, 14 bp, Homo sapiens
gagagcggtctcag

SEQ ID NO: 3279940 - DNA, 13 bp, Homo sapiens
gagagctggtgcc

SEQ ID NO: 3279941 - DNA, 14 bp, Homo sapiens
gagagctggtgccc

SEQ ID NO: 3279942 - DNA, 17 bp, Homo sapiens
gagagctggtgcccgga

SEQ ID NO: 3279943 - DNA, 18 bp, Homo sapiens
gagagcttagcctggagc

SEQ ID NO: 3279944 - DNA, 22 bp, Homo sapiens
gagaggaactccttggcctagc

SEQ ID NO: 3279945 - DNA, 14 bp, Homo sapiens
gagaggaaggagat

SEQ ID NO: 3279946 - DNA, 18 bp, Homo sapiens
gagaggaaggagattcca

SEQ ID NO: 3279947 - DNA, 19 bp, Homo sapiens
gagaggaatgcctgtgtga

SEQ ID NO: 3279948 - DNA, 20 bp, Homo sapiens
gagaggactgtagggagggc

SEQ ID NO: 3279949 - DNA, 12 bp, Homo sapiens
gagaggagagag

SEQ ID NO: 3279950 - DNA, 19 bp, Homo sapiens
gagaggagagaggcagaga

SEQ ID NO: 3279951 - DNA, 18 bp, Homo sapiens
gagaggagaggagagagg

SEQ ID NO: 3279952 - DNA, 19 bp, Homo sapiens
gagaggagcacctgaaccc

SEQ ID NO: 3279953 - DNA, 17 bp, Homo sapiens
gagaggaggcagccccc

SEQ ID NO: 3279954 - DNA, 13 bp, Homo sapiens
gagaggagggttc

SEQ ID NO: 3279955 - DNA, 15 bp, Homo sapiens
gagaggcaatggcca

SEQ ID NO: 3279956 - DNA, 12 bp, Homo sapiens
gagaggcagaga

SEQ ID NO: 3279957 - DNA, 13 bp, Homo sapiens
gagaggcagagag

SEQ ID NO: 3279958 - DNA, 16 bp, Homo sapiens
gagaggcagagagcgg

SEQ ID NO: 3279959 - DNA, 15 bp, Homo sapiens
gagaggcaggcatag

SEQ ID NO: 3279960 - DNA, 18 bp, Homo sapiens
gagaggccaaaggctggt

SEQ ID NO: 3279961 - DNA, 16 bp, Homo sapiens
gagaggcccgcccgcc

SEQ ID NO: 3279962 - DNA, 14 bp, Homo sapiens
gagaggcctggagc

SEQ ID NO: 3279963 - DNA, 15 bp, Homo sapiens
gagaggccttttgga

SEQ ID NO: 3279964 - DNA, 12 bp, Homo sapiens
gagaggcggcct

SEQ ID NO: 3279965 - DNA, 10 bp, Homo sapiens
gagagggaga

SEQ ID NO: 3279966 - DNA, 14 bp, Homo sapiens
gagagggagagaga

SEQ ID NO: 3279967 - DNA, 23 bp, Homo sapiens
gagagggaggtcactggaaaggg

SEQ ID NO: 3279968 - DNA, 21 bp, Homo sapiens
gagagggcaatctttgccttt

SEQ ID NO: 3279969 - DNA, 21 bp, Homo sapiens
gagagggcccagctgtagcca

SEQ ID NO: 3279970 - DNA, 20 bp, Homo sapiens
gagagggctcgaggggtggg

SEQ ID NO: 3279971 - DNA, 14 bp, Homo sapiens
gagaggggtttggg

SEQ ID NO: 3279972 - DNA, 16 bp, Homo sapiens
gagagggtgaaggagg

SEQ ID NO: 3279973 - DNA, 19 bp, Homo sapiens
gagaggttataggtcactc

SEQ ID NO: 3279974 - DNA, 22 bp, Homo sapiens
gagagtatttttatacaaacct

SEQ ID NO: 3279975 - DNA, 14 bp, Homo sapiens
gagagtcaaagctg

SEQ ID NO: 3279976 - DNA, 22 bp, Homo sapiens
gagagtcccactgcctcaggtt

SEQ ID NO: 3279977 - DNA, 23 bp, Homo sapiens
gagagtctagcactcattttcta

SEQ ID NO: 3279978 - DNA, 22 bp, Homo sapiens
gagagtggaaattacccactgt

SEQ ID NO: 3279979 - DNA, 19 bp, Homo sapiens
gagataaaccaataaatcc

SEQ ID NO: 3279980 - DNA, 14 bp, Homo sapiens
gagataaattttat

SEQ ID NO: 3279981 - DNA, 21 bp, Homo sapiens
gagatagcaccattgcactcc

SEQ ID NO: 3279982 - DNA, 22 bp, Homo sapiens
gagatatctgagggaggaggcc

SEQ ID NO: 3279983 - DNA, 19 bp, Homo sapiens
gagatcacagcctccaggg

SEQ ID NO: 3279984 - DNA, 21 bp, Homo sapiens
gagatcacagcctccagggcc

SEQ ID NO: 3279985 - DNA, 19 bp, Homo sapiens
gagatcacgccactgcact

SEQ ID NO: 3279986 - DNA, 20 bp, Homo sapiens
gagatcacgccactgcactc

SEQ ID NO: 3279987 - DNA, 17 bp, Homo sapiens
gagatcccgcctcttct

SEQ ID NO: 3279988 - DNA, 12 bp, Homo sapiens
gagatcctcctg

SEQ ID NO: 3279989 - DNA, 13 bp, Homo sapiens
gagatcctcctgc

SEQ ID NO: 3279990 - DNA, 17 bp, Homo sapiens
gagatcctcctgcagac

SEQ ID NO: 3279991 - DNA, 17 bp, Homo sapiens
gagatccttcacaggca

SEQ ID NO: 3279992 - DNA, 22 bp, Homo sapiens
gagatccttcacaggcagtgca

SEQ ID NO: 3279993 - DNA, 21 bp, Homo sapiens
gagatcgtgctactgcactcc

SEQ ID NO: 3279994 - DNA, 19 bp, Homo sapiens
gagatctaagcctttccat

SEQ ID NO: 3279995 - DNA, 23 bp, Homo sapiens
gagatctaaggatgtcacagggc

SEQ ID NO: 3279996 - DNA, 16 bp, Homo sapiens
gagatgaccagggatg

SEQ ID NO: 3279997 - DNA, 18 bp, Homo sapiens
gagatgaccagggatgct

SEQ ID NO: 3279998 - DNA, 21 bp, Homo sapiens
gagatgaccagggatgctggg

SEQ ID NO: 3279999 - DNA, 22 bp, Homo sapiens
gagatgaccagggatgctgggc

SEQ ID NO: 3280000 - DNA, 14 bp, Homo sapiens
gagatgagaaatga

SEQ ID NO: 3280001 - DNA, 16 bp, Homo sapiens
gagatgagttttagga

SEQ ID NO: 3280002 - DNA, 16 bp, Homo sapiens
gagatgctagaactcc

SEQ ID NO: 3280003 - DNA, 19 bp, Homo sapiens
gagatgctggagaagagag

SEQ ID NO: 3280004 - DNA, 20 bp, Homo sapiens
gagatgctggagaagagagg

SEQ ID NO: 3280005 - DNA, 21 bp, Homo sapiens
gagatgctggagaagagagga

SEQ ID NO: 3280006 - DNA, 22 bp, Homo sapiens
gagatggacagttcacaccctg

SEQ ID NO: 3280007 - DNA, 20 bp, Homo sapiens
gagatgggaatgaggtggga

SEQ ID NO: 3280008 - DNA, 18 bp, Homo sapiens
gagatgggcttgttttct

SEQ ID NO: 3280009 - DNA, 15 bp, Homo sapiens
gagatggtaacagat

SEQ ID NO: 3280010 - DNA, 16 bp, Homo sapiens
gagatggttaaaaagg

SEQ ID NO: 3280011 - DNA, 16 bp, Homo sapiens
gagatgtaattgtttt

SEQ ID NO: 3280012 - DNA, 15 bp, Homo sapiens
gagatgtcttggaac

SEQ ID NO: 3280013 - DNA, 19 bp, Homo sapiens
gagatgtgttcctcctgct

SEQ ID NO: 3280014 - DNA, 14 bp, Homo sapiens
gagatgtttttaaa

SEQ ID NO: 3280015 - DNA, 17 bp, Homo sapiens
gagatgtttttaaaagt

SEQ ID NO: 3280016 - DNA, 17 bp, Homo sapiens
gagattagaacatttaa

SEQ ID NO: 3280017 - DNA, 14 bp, Homo sapiens
gagattcccaagcc

SEQ ID NO: 3280018 - DNA, 16 bp, Homo sapiens
gagattgaactccaag

SEQ ID NO: 3280019 - DNA, 22 bp, Homo sapiens
gagattgaatttcactgtcttt

SEQ ID NO: 3280020 - DNA, 20 bp, Homo sapiens
gagattgagaaggagagaaa

SEQ ID NO: 3280021 - DNA, 17 bp, Homo sapiens
gagattgggagaaatca

SEQ ID NO: 3280022 - DNA, 18 bp, Homo sapiens
gagatttgccagcacagg

SEQ ID NO: 3280023 - DNA, 22 bp, Homo sapiens
gagatttgccagcacaggggcc

SEQ ID NO: 3280024 - DNA, 16 bp, Homo sapiens
gagatttgggagctga

SEQ ID NO: 3280025 - DNA, 16 bp, Homo sapiens
gagcaaaaggcagctc

SEQ ID NO: 3280026 - DNA, 22 bp, Homo sapiens
gagcaaaaggcagctcacccct

SEQ ID NO: 3280027 - DNA, 19 bp, Homo sapiens
gagcaaaataaggaagagg

SEQ ID NO: 3280028 - DNA, 12 bp, Homo sapiens
gagcaaaataat

SEQ ID NO: 3280029 - DNA, 20 bp, Homo sapiens
gagcaacagagtgagaccct

SEQ ID NO: 3280030 - DNA, 14 bp, Homo sapiens
gagcaacccctgta

SEQ ID NO: 3280031 - DNA, 18 bp, Homo sapiens
gagcaacccctgtaccca

SEQ ID NO: 3280032 - DNA, 21 bp, Homo sapiens
gagcaacccctgtacccagct

SEQ ID NO: 3280033 - DNA, 19 bp, Homo sapiens
gagcaacctctcactcccc

SEQ ID NO: 3280034 - DNA, 20 bp, Homo sapiens
gagcaacgaccagggccgag

SEQ ID NO: 3280035 - DNA, 18 bp, Homo sapiens
gagcaagaccctgtctct

SEQ ID NO: 3280036 - DNA, 15 bp, Homo sapiens
gatatctgagggagg

SEQ ID NO: 3280037 - DNA, 21 bp, Homo sapiens
gatatctgagggaggaggcca

SEQ ID NO: 3280038 - DNA, 23 bp, Homo sapiens
gatatctgagggaggaggccacc

SEQ ID NO: 3280039 - DNA, 15 bp, Homo sapiens
gatatgaaagctgat

SEQ ID NO: 3280040 - DNA, 15 bp, Homo sapiens
gatatggcagaagac

SEQ ID NO: 3280041 - DNA, 22 bp, Homo sapiens
gatatggcattgcactgcttat

SEQ ID NO: 3280042 - DNA, 17 bp, Homo sapiens
gatatgtatgggtaggg

SEQ ID NO: 3280043 - DNA, 20 bp, Homo sapiens
gatatgtattcttttctcag

SEQ ID NO: 3280044 - DNA, 19 bp, Homo sapiens
gatatgtggtgtatatcct

SEQ ID NO: 3280045 - DNA, 12 bp, Homo sapiens
gatattaaattc

SEQ ID NO: 3280046 - DNA, 15 bp, Homo sapiens
gatattactttatca

SEQ ID NO: 3280047 - DNA, 22 bp, Homo sapiens
gatattactttatcactttttg

SEQ ID NO: 3280048 - DNA, 21 bp, Homo sapiens
gatattccatgaatgtatcag

SEQ ID NO: 3280049 - DNA, 12 bp, Homo sapiens
gatattctaaga

SEQ ID NO: 3280050 - DNA, 13 bp, Homo sapiens
gatattctaagac

SEQ ID NO: 3280051 - DNA, 20 bp, Homo sapiens
gatattcttctcttgcttta

SEQ ID NO: 3280052 - DNA, 15 bp, Homo sapiens
gatattgaaggaatt

SEQ ID NO: 3280053 - DNA, 13 bp, Homo sapiens
gatattgaatgtt

SEQ ID NO: 3280054 - DNA, 14 bp, Homo sapiens
gatattgatattga

SEQ ID NO: 3280055 - DNA, 16 bp, Homo sapiens
gatattgtttaaaatt

SEQ ID NO: 3280056 - DNA, 18 bp, Homo sapiens
gatattgtttaaaattca

SEQ ID NO: 3280057 - DNA, 20 bp, Homo sapiens
gatatttaagaaaatacaat

SEQ ID NO: 3280058 - DNA, 17 bp, Homo sapiens
gatatttgatatttggt

SEQ ID NO: 3280059 - DNA, 21 bp, Homo sapiens
gatatttgcacttatgtactt

SEQ ID NO: 3280060 - DNA, 19 bp, Homo sapiens
gatatttggcttaaatata

SEQ ID NO: 3280061 - DNA, 21 bp, Homo sapiens
gatattttacctcttattgca

SEQ ID NO: 3280062 - DNA, 19 bp, Homo sapiens
gatattttcaaattgtatc

SEQ ID NO: 3280063 - DNA, 20 bp, Homo sapiens
gatattttcaaattgtatct

SEQ ID NO: 3280064 - DNA, 23 bp, Homo sapiens
gatattttcaacgcagccctgct

SEQ ID NO: 3280065 - DNA, 21 bp, Homo sapiens
gatattttctgtgcctgaata

SEQ ID NO: 3280066 - DNA, 20 bp, Homo sapiens
gatattttcttccaagcaaa

SEQ ID NO: 3280067 - DNA, 13 bp, Homo sapiens
gatatttttaaaa

SEQ ID NO: 3280068 - DNA, 13 bp, Homo sapiens
gatatttttccat

SEQ ID NO: 3280069 - DNA, 17 bp, Homo sapiens
gatatttttgtacttga

SEQ ID NO: 3280070 - DNA, 21 bp, Homo sapiens
gatattttttcagaaatatgt

SEQ ID NO: 3280071 - DNA, 22 bp, Homo sapiens
gatcaaaacctgtgccaggctg

SEQ ID NO: 3280072 - DNA, 23 bp, Homo sapiens
gatcaaaaggttaataaagtaat

SEQ ID NO: 3280073 - DNA, 17 bp, Homo sapiens
gatcaaaataaaaagtg

SEQ ID NO: 3280074 - DNA, 22 bp, Homo sapiens
gatcaaaccccgaccacctgcc

SEQ ID NO: 3280075 - DNA, 15 bp, Homo sapiens
gatcaaatatagaaa

SEQ ID NO: 3280076 - DNA, 18 bp, Homo sapiens
gatcaaccagctaagaaa

SEQ ID NO: 3280077 - DNA, 21 bp, Homo sapiens
gatcaaccccttcgctcctgt

SEQ ID NO: 3280078 - DNA, 18 bp, Homo sapiens
gatcaacgcctcactgaa

SEQ ID NO: 3280079 - DNA, 14 bp, Homo sapiens
gatcaataaaatgt

SEQ ID NO: 3280080 - DNA, 15 bp, Homo sapiens
gatcaattaaatgta

SEQ ID NO: 3280081 - DNA, 12 bp, Homo sapiens
gatcacaagatg

SEQ ID NO: 3280082 - DNA, 13 bp, Homo sapiens
gatcacaagatgg

SEQ ID NO: 3280083 - DNA, 14 bp, Homo sapiens
gatcacaagatgga

SEQ ID NO: 3280084 - DNA, 17 bp, Homo sapiens
gatcacagagacattcc

SEQ ID NO: 3280085 - DNA, 15 bp, Homo sapiens
gatcaccagcccggc

SEQ ID NO: 3280086 - DNA, 15 bp, Homo sapiens
gatcaccattatatt

SEQ ID NO: 3280087 - DNA, 17 bp, Homo sapiens
gatcacgacgctgcaga

SEQ ID NO: 3280088 - DNA, 15 bp, Homo sapiens
gatcacgccactgca

SEQ ID NO: 3280089 - DNA, 15 bp, Homo sapiens
gatcacgcctggcta

SEQ ID NO: 3280090 - DNA, 22 bp, Homo sapiens
gatcacgctccccgcctgttcc

SEQ ID NO: 3280091 - DNA, 23 bp, Homo sapiens
gatcacggctcactgcagcctca

SEQ ID NO: 3280092 - DNA, 14 bp, Homo sapiens
gatcactcccagca

SEQ ID NO: 3280093 - DNA, 16 bp, Homo sapiens
gatcactcccagcact

SEQ ID NO: 3280094 - DNA, 13 bp, Homo sapiens
gatcactgccaca

SEQ ID NO: 3280095 - DNA, 17 bp, Homo sapiens
gatcactggagcccagg

SEQ ID NO: 3280096 - DNA, 19 bp, Homo sapiens
gatcactggctggcctgag

SEQ ID NO: 3280097 - DNA, 22 bp, Homo sapiens
gatcactttctcagttttcata

SEQ ID NO: 3280098 - DNA, 14 bp, Homo sapiens
gatcagaacatgaa

SEQ ID NO: 3280099 - DNA, 16 bp, Homo sapiens
gatcagaacattcagc

SEQ ID NO: 3280100 - DNA, 23 bp, Homo sapiens
gatcagaacattcagctctggag

SEQ ID NO: 3280101 - DNA, 23 bp, Homo sapiens
gatcagagcaggacctcccttcc

SEQ ID NO: 3280102 - DNA, 15 bp, Homo sapiens
gatcagagcaggagc

SEQ ID NO: 3280103 - DNA, 15 bp, Homo sapiens
gatcagaggtgtaca

SEQ ID NO: 3280104 - DNA, 16 bp, Homo sapiens
gatcagaggtgtacac

SEQ ID NO: 3280105 - DNA, 17 bp, Homo sapiens
gatcagatgctccaaga

SEQ ID NO: 3280106 - DNA, 14 bp, Homo sapiens
gatcagcatctgtg

SEQ ID NO: 3280107 - DNA, 21 bp, Homo sapiens
gatcaggcacccggggccaga

SEQ ID NO: 3280108 - DNA, 22 bp, Homo sapiens
gatcaggcacccggggccagag

SEQ ID NO: 3280109 - DNA, 17 bp, Homo sapiens
gatcagggaatccagct

SEQ ID NO: 3280110 - DNA, 19 bp, Homo sapiens
gatcaggtaccaaggaaat

SEQ ID NO: 3280111 - DNA, 22 bp, Homo sapiens
gatcagtctgattcccaagctc

SEQ ID NO: 3280112 - DNA, 18 bp, Homo sapiens
gatcagttataagtagca

SEQ ID NO: 3280113 - DNA, 17 bp, Homo sapiens
gatcataaggcttcaaa

SEQ ID NO: 3280114 - DNA, 18 bp, Homo sapiens
gatcataggtatttcaaa

SEQ ID NO: 3280115 - DNA, 21 bp, Homo sapiens
gatcatcaacaagatttcctt

SEQ ID NO: 3280116 - DNA, 13 bp, Homo sapiens
gatcatccactgt

SEQ ID NO: 3280117 - DNA, 17 bp, Homo sapiens
gatcatccactgtgcca

SEQ ID NO: 3280118 - DNA, 21 bp, Homo sapiens
gatcatcgccagaggtgcttc

SEQ ID NO: 3280119 - DNA, 23 bp, Homo sapiens
gatcatcgccagaggtgcttcac

SEQ ID NO: 3280120 - DNA, 12 bp, Homo sapiens
gatcatgcattg

SEQ ID NO: 3280121 - DNA, 21 bp, Homo sapiens
gatcatggtgtaataagacat

SEQ ID NO: 3280122 - DNA, 19 bp, Homo sapiens
gatcatgtactttttagta

SEQ ID NO: 3280123 - DNA, 15 bp, Homo sapiens
gatcatgtgtggaag

SEQ ID NO: 3280124 - DNA, 21 bp, Homo sapiens
gatcatgtgtggaagttatta

SEQ ID NO: 3280125 - DNA, 21 bp, Homo sapiens
gatcatgttgttaaaattatg

SEQ ID NO: 3280126 - DNA, 14 bp, Homo sapiens
gatcattcttttat

SEQ ID NO: 3280127 - DNA, 15 bp, Homo sapiens
gatcatttaaaaagc

SEQ ID NO: 3280128 - DNA, 23 bp, Homo sapiens
gatcattttccccccactctccc

SEQ ID NO: 3280129 - DNA, 12 bp, Homo sapiens
gatccaagctgg

SEQ ID NO: 3280130 - DNA, 16 bp, Homo sapiens
gatccaagctggtccc

SEQ ID NO: 3280131 - DNA, 17 bp, Homo sapiens
gatccaagctggtccca

SEQ ID NO: 3280132 - DNA, 22 bp, Homo sapiens
gatccaaggcagggaaaggaaa

SEQ ID NO: 3280133 - DNA, 14 bp, Homo sapiens
gatccacacacaga

SEQ ID NO: 3280134 - DNA, 16 bp, Homo sapiens
gatccacacacagagg

SEQ ID NO: 3280135 - DNA, 17 bp, Homo sapiens
gatccacacacagagga

SEQ ID NO: 3280136 - DNA, 18 bp, Homo sapiens
gatccacacacagaggaa

SEQ ID NO: 3280137 - DNA, 19 bp, Homo sapiens
gatccacacacagaggaag

SEQ ID NO: 3280138 - DNA, 16 bp, Homo sapiens
gatccacccaacccta

SEQ ID NO: 3280139 - DNA, 12 bp, Homo sapiens
gatccaccccct

SEQ ID NO: 3280140 - DNA, 17 bp, Homo sapiens
gatccaccccctgccca

SEQ ID NO: 3280141 - DNA, 16 bp, Homo sapiens
gaatgtatctgtgaag

SEQ ID NO: 3280142 - DNA, 14 bp, Homo sapiens
gaatgtatgtaatg

SEQ ID NO: 3280143 - DNA, 12 bp, Homo sapiens
gaatgtatttat

SEQ ID NO: 3280144 - DNA, 13 bp, Homo sapiens
gaatgtatttatt

SEQ ID NO: 3280145 - DNA, 23 bp, Homo sapiens
gaatgtatttatttgggagaccg

SEQ ID NO: 3280146 - DNA, 15 bp, Homo sapiens
gaatgtcacaaattg

SEQ ID NO: 3280147 - DNA, 16 bp, Homo sapiens
gaatgtcacaaattga

SEQ ID NO: 3280148 - DNA, 14 bp, Homo sapiens
gaatgtcagattcc

SEQ ID NO: 3280149 - DNA, 15 bp, Homo sapiens
gaatgtcagattcct

SEQ ID NO: 3280150 - DNA, 16 bp, Homo sapiens
gaatgtcttttgaata

SEQ ID NO: 3280151 - DNA, 16 bp, Homo sapiens
gaatgtgcccctggcc

SEQ ID NO: 3280152 - DNA, 18 bp, Homo sapiens
gaatgtgcccctggccca

SEQ ID NO: 3280153 - DNA, 19 bp, Homo sapiens
gaatgtgcccctggcccat

SEQ ID NO: 3280154 - DNA, 20 bp, Homo sapiens
gaatgtggccacttatttca

SEQ ID NO: 3280155 - DNA, 13 bp, Homo sapiens
gaatgtggtctca

SEQ ID NO: 3280156 - DNA, 22 bp, Homo sapiens
gaatgtggttacttcctactgt

SEQ ID NO: 3280157 - DNA, 18 bp, Homo sapiens
gaatgtgtacaaagtgta

SEQ ID NO: 3280158 - DNA, 23 bp, Homo sapiens
gaatgtgtgtgtgtggcaggggg

SEQ ID NO: 3280159 - DNA, 15 bp, Homo sapiens
gaatgttaagcagat

SEQ ID NO: 3280160 - DNA, 17 bp, Homo sapiens
gaatgttacattgtttg

SEQ ID NO: 3280161 - DNA, 20 bp, Homo sapiens
gaatgttacattgtttgtct

SEQ ID NO: 3280162 - DNA, 16 bp, Homo sapiens
gaatgttactttggaa

SEQ ID NO: 3280163 - DNA, 22 bp, Homo sapiens
gaatgttatgggatgtaaacaa

SEQ ID NO: 3280164 - DNA, 15 bp, Homo sapiens
gaatgttccctgcac

SEQ ID NO: 3280165 - DNA, 16 bp, Homo sapiens
gaatgttccctgcacc

SEQ ID NO: 3280166 - DNA, 17 bp, Homo sapiens
gaatgttccctgcaccc

SEQ ID NO: 3280167 - DNA, 15 bp, Homo sapiens
gaatgttctgacatt

SEQ ID NO: 3280168 - DNA, 16 bp, Homo sapiens
gaatgttctgacatta

SEQ ID NO: 3280169 - DNA, 20 bp, Homo sapiens
gaatgttctgacattaacag

SEQ ID NO: 3280170 - DNA, 20 bp, Homo sapiens
gaatgttgcaatgtgaaaaa

SEQ ID NO: 3280171 - DNA, 18 bp, Homo sapiens
gaatgttggtttactttc

SEQ ID NO: 3280172 - DNA, 15 bp, Homo sapiens
gaatgtttgcctctg

SEQ ID NO: 3280173 - DNA, 18 bp, Homo sapiens
gaatgtttgcctctgcct

SEQ ID NO: 3280174 - DNA, 19 bp, Homo sapiens
gaattaaaaggatagtatt

SEQ ID NO: 3280175 - DNA, 20 bp, Homo sapiens
gaattaaattaggaataaat

SEQ ID NO: 3280176 - DNA, 20 bp, Homo sapiens
gaattaagttatctttaaaa

SEQ ID NO: 3280177 - DNA, 21 bp, Homo sapiens
gaattaatatccctacatgta

SEQ ID NO: 3280178 - DNA, 13 bp, Homo sapiens
gaattacagtgaa

SEQ ID NO: 3280179 - DNA, 21 bp, Homo sapiens
gaattacatgtaaaacattat

SEQ ID NO: 3280180 - DNA, 18 bp, Homo sapiens
gaattactgtatataaac

SEQ ID NO: 3280181 - DNA, 18 bp, Homo sapiens
gaattaggctgtaactac

SEQ ID NO: 3280182 - DNA, 15 bp, Homo sapiens
gaattataacagtta

SEQ ID NO: 3280183 - DNA, 20 bp, Homo sapiens
gaattataacagttatattt

SEQ ID NO: 3280184 - DNA, 19 bp, Homo sapiens
gagccactgcaccgggcca

SEQ ID NO: 3280185 - DNA, 15 bp, Homo sapiens
gagccacttctcccc

SEQ ID NO: 3280186 - DNA, 18 bp, Homo sapiens
gagccagatgcaggacag

SEQ ID NO: 3280187 - DNA, 23 bp, Homo sapiens
gagccagatgcaggacaggaggc

SEQ ID NO: 3280188 - DNA, 13 bp, Homo sapiens
gagccagcctggg

SEQ ID NO: 3280189 - DNA, 11 bp, Homo sapiens
gagccagctgc

SEQ ID NO: 3280190 - DNA, 17 bp, Homo sapiens
gagccaggatgcccaga

SEQ ID NO: 3280191 - DNA, 22 bp, Homo sapiens
gagccaggcctgggtctgtgtc

SEQ ID NO: 3280192 - DNA, 14 bp, Homo sapiens
gagccagggtctca

SEQ ID NO: 3280193 - DNA, 23 bp, Homo sapiens
gagccagtcctccactcgaccca

SEQ ID NO: 3280194 - DNA, 19 bp, Homo sapiens
gagccatataagtttgaag

SEQ ID NO: 3280195 - DNA, 22 bp, Homo sapiens
gagccatcactagaagaaaagc

SEQ ID NO: 3280196 - DNA, 17 bp, Homo sapiens
gagccatgcgccccctc

SEQ ID NO: 3280197 - DNA, 14 bp, Homo sapiens
gagccatgctggga

SEQ ID NO: 3280198 - DNA, 15 bp, Homo sapiens
gagccatgggcctgg

SEQ ID NO: 3280199 - DNA, 19 bp, Homo sapiens
gagccatgggcctgggcct

SEQ ID NO: 3280200 - DNA, 22 bp, Homo sapiens
gagccatgggcctgggcctgct

SEQ ID NO: 3280201 - DNA, 17 bp, Homo sapiens
gagcccaagctaagcca

SEQ ID NO: 3280202 - DNA, 21 bp, Homo sapiens
gagcccaatgcatagagccct

SEQ ID NO: 3280203 - DNA, 22 bp, Homo sapiens
gagcccaatgcatagagccctg

SEQ ID NO: 3280204 - DNA, 15 bp, Homo sapiens
gagcccaccttggct

SEQ ID NO: 3280205 - DNA, 17 bp, Homo sapiens
gagcccaccttggctca

SEQ ID NO: 3280206 - DNA, 19 bp, Homo sapiens
gagcccagagggtggcaag

SEQ ID NO: 3280207 - DNA, 21 bp, Homo sapiens
gagcccagaggtaacagaaca

SEQ ID NO: 3280208 - DNA, 22 bp, Homo sapiens
gagcccagaggtaacagaacag

SEQ ID NO: 3280209 - DNA, 22 bp, Homo sapiens
gagcccagccattaccatggag

SEQ ID NO: 3280210 - DNA, 13 bp, Homo sapiens
gagcccagcctgg

SEQ ID NO: 3280211 - DNA, 17 bp, Homo sapiens
gagcccagcctgggagc

SEQ ID NO: 3280212 - DNA, 21 bp, Homo sapiens
gagcccagcctgggagcccag

SEQ ID NO: 3280213 - DNA, 23 bp, Homo sapiens
gagcccagcctgggagcccagag

SEQ ID NO: 3280214 - DNA, 16 bp, Homo sapiens
gagcccagctgcctgg

SEQ ID NO: 3280215 - DNA, 21 bp, Homo sapiens
gagcccagctgcctggagagg

SEQ ID NO: 3280216 - DNA, 22 bp, Homo sapiens
gagcccagctgcctggagaggg

SEQ ID NO: 3280217 - DNA, 12 bp, Homo sapiens
gagcccaggagt

SEQ ID NO: 3280218 - DNA, 21 bp, Homo sapiens
gagcccaggagtttgaatcca

SEQ ID NO: 3280219 - DNA, 13 bp, Homo sapiens
gagcccaggcggg

SEQ ID NO: 3280220 - DNA, 15 bp, Homo sapiens
gagcccaggcgggag

SEQ ID NO: 3280221 - DNA, 17 bp, Homo sapiens
gagcccagtgaagcctc

SEQ ID NO: 3280222 - DNA, 19 bp, Homo sapiens
gagcccatactcagcctgc

SEQ ID NO: 3280223 - DNA, 20 bp, Homo sapiens
gagcccatgttctgccccca

SEQ ID NO: 3280224 - DNA, 12 bp, Homo sapiens
gagtatatgcac

SEQ ID NO: 3280225 - DNA, 16 bp, Homo sapiens
gagtatccttccttca

SEQ ID NO: 3280226 - DNA, 22 bp, Homo sapiens
gagtattctcataggagactgc

SEQ ID NO: 3280227 - DNA, 14 bp, Homo sapiens
gagtcaaagctgac

SEQ ID NO: 3280228 - DNA, 21 bp, Homo sapiens
gagtcacctgcaagccccagg

SEQ ID NO: 3280229 - DNA, 23 bp, Homo sapiens
gagtcaccttccaggacccctgg

SEQ ID NO: 3280230 - DNA, 20 bp, Homo sapiens
gagtcacgctggggctctct

SEQ ID NO: 3280231 - DNA, 22 bp, Homo sapiens
gagtcagacattttaagatggt

SEQ ID NO: 3280232 - DNA, 17 bp, Homo sapiens
gagtcagagccctggct

SEQ ID NO: 3280233 - DNA, 13 bp, Homo sapiens
gagtcagaggaga

SEQ ID NO: 3280234 - DNA, 16 bp, Homo sapiens
gagtcagaggagaaga

SEQ ID NO: 3280235 - DNA, 16 bp, Homo sapiens
gagtcagccaggagct

SEQ ID NO: 3280236 - DNA, 11 bp, Homo sapiens
gagtcagcctt

SEQ ID NO: 3280237 - DNA, 15 bp, Homo sapiens
gagtcagggcccaga

SEQ ID NO: 3280238 - DNA, 17 bp, Homo sapiens
gagtcagggcccagagg

SEQ ID NO: 3280239 - DNA, 17 bp, Homo sapiens
gagtcagtgtctggctt

SEQ ID NO: 3280240 - DNA, 15 bp, Homo sapiens
gagtccaagaatcca

SEQ ID NO: 3280241 - DNA, 19 bp, Homo sapiens
gagtccaaggtttaaagag

SEQ ID NO: 3280242 - DNA, 18 bp, Homo sapiens
gagtccaggagctcagga

SEQ ID NO: 3280243 - DNA, 16 bp, Homo sapiens
gagtccattctcccag

SEQ ID NO: 3280244 - DNA, 12 bp, Homo sapiens
gagtcccacctt

SEQ ID NO: 3280245 - DNA, 16 bp, Homo sapiens
gagtcccaccttggct

SEQ ID NO: 3280246 - DNA, 20 bp, Homo sapiens
gagtcccaccttggctgcag

SEQ ID NO: 3280247 - DNA, 13 bp, Homo sapiens
gagtcccactgcc

SEQ ID NO: 3280248 - DNA, 19 bp, Homo sapiens
gagtcccactgcctcaggt

SEQ ID NO: 3280249 - DNA, 20 bp, Homo sapiens
gagtcccactgcctcaggtt

SEQ ID NO: 3280250 - DNA, 20 bp, Homo sapiens
gagtccccgggcatctttgg

SEQ ID NO: 3280251 - DNA, 11 bp, Homo sapiens
gagtcccctca

SEQ ID NO: 3280252 - DNA, 16 bp, Homo sapiens
gagtcccctcacctcc

SEQ ID NO: 3280253 - DNA, 14 bp, Homo sapiens
gagtccttaaaatg

SEQ ID NO: 3280254 - DNA, 18 bp, Homo sapiens
gagtcggccccacatggg

SEQ ID NO: 3280255 - DNA, 17 bp, Homo sapiens
gagtcgtacagaaagct

SEQ ID NO: 3280256 - DNA, 20 bp, Homo sapiens
gagtcgtcactctctattgt

SEQ ID NO: 3280257 - DNA, 19 bp, Homo sapiens
gagtcgtcatcacttttca

SEQ ID NO: 3280258 - DNA, 20 bp, Homo sapiens
gagtcgtggggtgtgctggg

SEQ ID NO: 3280259 - DNA, 21 bp, Homo sapiens
gagtcgtggggtgtgctggga

SEQ ID NO: 3280260 - DNA, 22 bp, Homo sapiens
gagtcgtggggtgtgctgggag

SEQ ID NO: 3280261 - DNA, 20 bp, Homo sapiens
gagtcgttggagactgaaga

SEQ ID NO: 3280262 - DNA, 12 bp, Homo sapiens
gagtctaaagat

SEQ ID NO: 3280263 - DNA, 19 bp, Homo sapiens
gagtctaatagtctttgcc

SEQ ID NO: 3280264 - DNA, 11 bp, Homo sapiens
gagtctagatg

SEQ ID NO: 3280265 - DNA, 19 bp, Homo sapiens
gagtctcactgttgcccag

SEQ ID NO: 3280266 - DNA, 16 bp, Homo sapiens
gagtctctgccaccca

SEQ ID NO: 3280267 - DNA, 18 bp, Homo sapiens
gagtctctgccacccact

SEQ ID NO: 3280268 - DNA, 13 bp, Homo sapiens
gagtctgagcccc

SEQ ID NO: 3280269 - DNA, 14 bp, Homo sapiens
gagtctggagtggg

SEQ ID NO: 3280270 - DNA, 14 bp, Homo sapiens
gagtctgtgctctt

SEQ ID NO: 3280271 - DNA, 20 bp, Homo sapiens
gagtcttggcggcagcagcc

SEQ ID NO: 3280272 - DNA, 14 bp, Homo sapiens
gagtcttgggcctg

SEQ ID NO: 3280273 - DNA, 18 bp, Homo sapiens
gagtctttggttctaagg

SEQ ID NO: 3280274 - DNA, 14 bp, Homo sapiens
gagtgaagaggggc

SEQ ID NO: 3280275 - DNA, 19 bp, Homo sapiens
gagtgaagaggggcagccc

SEQ ID NO: 3280276 - DNA, 21 bp, Homo sapiens
gagtgaagaggggcagccctt

SEQ ID NO: 3280277 - DNA, 17 bp, Homo sapiens
gagtgacagaggcagcc

SEQ ID NO: 3280278 - DNA, 18 bp, Homo sapiens
gagtgagactctgtctca

SEQ ID NO: 3280279 - DNA, 13 bp, Homo sapiens
gagtgagactgac

SEQ ID NO: 3280280 - DNA, 24 bp, Homo sapiens
gagtgagcactaaggtgtgctctg

SEQ ID NO: 3280281 - DNA, 21 bp, Homo sapiens
gagtgagcggccgctgccgcc

SEQ ID NO: 3280282 - DNA, 15 bp, Homo sapiens
gagtgagctacagag

SEQ ID NO: 3280283 - DNA, 12 bp, Homo sapiens
gagtgagctggt

SEQ ID NO: 3280284 - DNA, 19 bp, Homo sapiens
gagtgaggcttccaggctc

SEQ ID NO: 3280285 - DNA, 18 bp, Homo sapiens
gagtgagttcaactacat

SEQ ID NO: 3280286 - DNA, 18 bp, Homo sapiens
gagtgatttccatctctg

SEQ ID NO: 3280287 - DNA, 18 bp, Homo sapiens
gagtgcagtgagccgaga

SEQ ID NO: 3280288 - DNA, 18 bp, Homo sapiens
gagtgccttttgcagaag

SEQ ID NO: 3280289 - DNA, 21 bp, Homo sapiens
gagtgcgctcttggtccctgg

SEQ ID NO: 3280290 - DNA, 17 bp, Homo sapiens
gagtgcggcgtggagac

SEQ ID NO: 3280291 - DNA, 23 bp, Homo sapiens
gagtgcggcgtggagactggcag

SEQ ID NO: 3280292 - DNA, 19 bp, Homo sapiens
gagtgcgtctgaggggaca

SEQ ID NO: 3280293 - DNA, 14 bp, Homo sapiens
gagtgctaaatttt

SEQ ID NO: 3280294 - DNA, 13 bp, Homo sapiens
gagtgctggactg

SEQ ID NO: 3280295 - DNA, 18 bp, Homo sapiens
gagtgcttgttagagaga

SEQ ID NO: 3280296 - DNA, 19 bp, Homo sapiens
gagtggaaattacccactg

SEQ ID NO: 3280297 - DNA, 13 bp, Homo sapiens
gagtggaatgcag

SEQ ID NO: 3280298 - DNA, 14 bp, Homo sapiens
gagtggaatgcagg

SEQ ID NO: 3280299 - DNA, 12 bp, Homo sapiens
gagtggcagcca

SEQ ID NO: 3280300 - DNA, 16 bp, Homo sapiens
gagtggcaggggacag

SEQ ID NO: 3280301 - DNA, 17 bp, Homo sapiens
gagtggccagccagtgc

SEQ ID NO: 3280302 - DNA, 19 bp, Homo sapiens
gagtggccagccagtgcca

SEQ ID NO: 3280303 - DNA, 20 bp, Homo sapiens
gagtggccagccagtgccat

SEQ ID NO: 3280304 - DNA, 16 bp, Homo sapiens
gagtggcctccctgct

SEQ ID NO: 3280305 - DNA, 17 bp, Homo sapiens
gagtggcctccctgctg

SEQ ID NO: 3280306 - DNA, 10 bp, Homo sapiens
gagtggcctg

SEQ ID NO: 3280307 - DNA, 15 bp, Homo sapiens
gagtggcctggccag

SEQ ID NO: 3280308 - DNA, 16 bp, Homo sapiens
gagtgggccccgggct

SEQ ID NO: 3280309 - DNA, 20 bp, Homo sapiens
gagtgggccccgggctggag

SEQ ID NO: 3280310 - DNA, 22 bp, Homo sapiens
gagtgggccccgggctggagaa

SEQ ID NO: 3280311 - DNA, 22 bp, Homo sapiens
gagtgggggagagcaggctggc

SEQ ID NO: 3280312 - DNA, 16 bp, Homo sapiens
gagtggggggacagag

SEQ ID NO: 3280313 - DNA, 15 bp, Homo sapiens
gagtgggtgacaaga

SEQ ID NO: 3280314 - DNA, 16 bp, Homo sapiens
gagtggtaacagctct

SEQ ID NO: 3280315 - DNA, 17 bp, Homo sapiens
gagtggtggttcctttg

SEQ ID NO: 3280316 - DNA, 15 bp, Homo sapiens
gagtgtaaataattt

SEQ ID NO: 3280317 - DNA, 17 bp, Homo sapiens
gagtgtaagtgtgagta

SEQ ID NO: 3280318 - DNA, 20 bp, Homo sapiens
gagtgtaagtgtgagtaaga

SEQ ID NO: 3280319 - DNA, 16 bp, Homo sapiens
gagtgtagaagcattc

SEQ ID NO: 3280320 - DNA, 22 bp, Homo sapiens
gagtgtattttttaaaattgat

SEQ ID NO: 3280321 - DNA, 19 bp, Homo sapiens
gagtgtccttagtgtataa

SEQ ID NO: 3280322 - DNA, 11 bp, Homo sapiens
gagtgtgacag

SEQ ID NO: 3280323 - DNA, 17 bp, Homo sapiens
gagtgtgacagggccag

SEQ ID NO: 3280324 - DNA, 18 bp, Homo sapiens
gagtgtgagccacctaag

SEQ ID NO: 3280325 - DNA, 16 bp, Homo sapiens
gattctaaagattcta

SEQ ID NO: 3280326 - DNA, 15 bp, Homo sapiens
gattctaaaggtcca

SEQ ID NO: 3280327 - DNA, 23 bp, Homo sapiens
gattctactttaagcactacata

SEQ ID NO: 3280328 - DNA, 19 bp, Homo sapiens
gattctagatcagatgctc

SEQ ID NO: 3280329 - DNA, 21 bp, Homo sapiens
gattctagatcagatgctcca

SEQ ID NO: 3280330 - DNA, 15 bp, Homo sapiens
gattctatagttcta

SEQ ID NO: 3280331 - DNA, 17 bp, Homo sapiens
gattctatagttctaga

SEQ ID NO: 3280332 - DNA, 18 bp, Homo sapiens
gattctatagttctagac

SEQ ID NO: 3280333 - DNA, 17 bp, Homo sapiens
gattttaatcaagttga

SEQ ID NO: 3280334 - DNA, 18 bp, Homo sapiens
gattttaatcaagttgaa

SEQ ID NO: 3280335 - DNA, 15 bp, Homo sapiens
gattttaattgtcat

SEQ ID NO: 3280336 - DNA, 16 bp, Homo sapiens
gattttacaaaagatg

SEQ ID NO: 3280337 - DNA, 17 bp, Homo sapiens
gattttacaaaagatgt

SEQ ID NO: 3280338 - DNA, 12 bp, Homo sapiens
gattttaccaaa

SEQ ID NO: 3280339 - DNA, 19 bp, Homo sapiens
gattttatgatcagtgttg

SEQ ID NO: 3280340 - DNA, 15 bp, Homo sapiens
gattttattttacta

SEQ ID NO: 3280341 - DNA, 18 bp, Homo sapiens
gattttcaaagctttttc

SEQ ID NO: 3280342 - DNA, 12 bp, Homo sapiens
gattttcagtta

SEQ ID NO: 3280343 - DNA, 13 bp, Homo sapiens
gattttccaaatg

SEQ ID NO: 3280344 - DNA, 17 bp, Homo sapiens
gattttctactgtaaga

SEQ ID NO: 3280345 - DNA, 16 bp, Homo sapiens
gattttctccagctca

SEQ ID NO: 3280346 - DNA, 17 bp, Homo sapiens
gattttggataataaac

SEQ ID NO: 3280347 - DNA, 21 bp, Homo sapiens
gattttggggttgtgttgtca

SEQ ID NO: 3280348 - DNA, 13 bp, Homo sapiens
gattttgtaaccc

SEQ ID NO: 3280349 - DNA, 16 bp, Homo sapiens
gatttttacaagatcc

SEQ ID NO: 3280350 - DNA, 17 bp, Homo sapiens
gatttttacaagatcca

SEQ ID NO: 3280351 - DNA, 18 bp, Homo sapiens
gatttttctcaaagtttt

SEQ ID NO: 3280352 - DNA, 13 bp, Homo sapiens
gatttttgcctct

SEQ ID NO: 3280353 - DNA, 14 bp, Homo sapiens
gatttttgttaatt

SEQ ID NO: 3280354 - DNA, 17 bp, Homo sapiens
gattttttaaaagaaat

SEQ ID NO: 3280355 - DNA, 20 bp, Homo sapiens
gattttttacagctgcctgc

SEQ ID NO: 3280356 - DNA, 13 bp, Homo sapiens
gattttttccaaa

SEQ ID NO: 3280357 - DNA, 19 bp, Homo sapiens
gatttttttaatagtgctt

SEQ ID NO: 3280358 - DNA, 20 bp, Homo sapiens
gatttttttgtgtatgtttt

SEQ ID NO: 3280359 - DNA, 18 bp, Homo sapiens
gcaaaaaaaaaaaaaagc

SEQ ID NO: 3280360 - DNA, 17 bp, Homo sapiens
gcaaaaaaagcctccaa

SEQ ID NO: 3280361 - DNA, 18 bp, Homo sapiens
gcaaaaagcaagggagaa

SEQ ID NO: 3280362 - DNA, 11 bp, Homo sapiens
gcaaaaatata

SEQ ID NO: 3280363 - DNA, 13 bp, Homo sapiens
gcaaaaatataaa

SEQ ID NO: 3280364 - DNA, 18 bp, Homo sapiens
gcaaaaatccgaggtgct

SEQ ID NO: 3280365 - DNA, 20 bp, Homo sapiens
gcaaaaatgacaacagaaaa

SEQ ID NO: 3280366 - DNA, 21 bp, Homo sapiens
gcaaaaatgacaacagaaaaa

SEQ ID NO: 3280367 - DNA, 16 bp, Homo sapiens
gcaaaacccacagaag

SEQ ID NO: 3280368 - DNA, 15 bp, Homo sapiens
gcaaaaggcagctca

SEQ ID NO: 3280369 - DNA, 16 bp, Homo sapiens
gcaaaaggcagctcac

SEQ ID NO: 3280370 - DNA, 23 bp, Homo sapiens
gcaaaaggcagctcacccctggg

SEQ ID NO: 3280371 - DNA, 17 bp, Homo sapiens
gcaaaaggcctcttgta

SEQ ID NO: 3280372 - DNA, 23 bp, Homo sapiens
gcaaaaggcctcttgtaaagact

SEQ ID NO: 3280373 - DNA, 20 bp, Homo sapiens
gcaaaaggttcactaaagca

SEQ ID NO: 3280374 - DNA, 21 bp, Homo sapiens
gcaaaaggttcactaaagcag

SEQ ID NO: 3280375 - DNA, 13 bp, Homo sapiens
gcaaaataatttt

SEQ ID NO: 3280376 - DNA, 10 bp, Homo sapiens
gcaaaatatg

SEQ ID NO: 3280377 - DNA, 18 bp, Homo sapiens
gcaaaatatgccccttct

SEQ ID NO: 3280378 - DNA, 16 bp, Homo sapiens
gcaaaatgttgaagaa

SEQ ID NO: 3280379 - DNA, 17 bp, Homo sapiens
gcaaaattgcaaatctt

SEQ ID NO: 3280380 - DNA, 13 bp, Homo sapiens
gcaaaattgtttt

SEQ ID NO: 3280381 - DNA, 22 bp, Homo sapiens
gcaaaattgttttcacttgtat

SEQ ID NO: 3280382 - DNA, 15 bp, Homo sapiens
gcaaaatttgatgcc

SEQ ID NO: 3280383 - DNA, 20 bp, Homo sapiens
gcaaaatttgatgccaggac

SEQ ID NO: 3280384 - DNA, 22 bp, Homo sapiens
gcaaaatttgatgccaggacac

SEQ ID NO: 3280385 - DNA, 14 bp, Homo sapiens
gcaaacaagaaacg

SEQ ID NO: 3280386 - DNA, 15 bp, Homo sapiens
gcaaacagaacaggg

SEQ ID NO: 3280387 - DNA, 12 bp, Homo sapiens
gcaaacatcaaa

SEQ ID NO: 3280388 - DNA, 21 bp, Homo sapiens
gcaaaccaatggtgatcctct

SEQ ID NO: 3280389 - DNA, 16 bp, Homo sapiens
gcaaaccatttttaaa

SEQ ID NO: 3280390 - DNA, 22 bp, Homo sapiens
gcaaaccccctttgtgctgtgg

SEQ ID NO: 3280391 - DNA, 23 bp, Homo sapiens
gcaaaccctggtggtattttatt

SEQ ID NO: 3280392 - DNA, 21 bp, Homo sapiens
gcaaaccttcctgggaggaca

SEQ ID NO: 3280393 - DNA, 17 bp, Homo sapiens
gcaaactcactgctcaa

SEQ ID NO: 3280394 - DNA, 14 bp, Homo sapiens
gcaaactctctaaa

SEQ ID NO: 3280395 - DNA, 23 bp, Homo sapiens
gcaaacttggaatttgtaacctc

SEQ ID NO: 3280396 - DNA, 18 bp, Homo sapiens
gcaaagacagtatttatt

SEQ ID NO: 3280397 - DNA, 20 bp, Homo sapiens
gcaaagaggactcgcttgta

SEQ ID NO: 3280398 - DNA, 23 bp, Homo sapiens
gcaaagaggactcgcttgtaaat

SEQ ID NO: 3280399 - DNA, 16 bp, Homo sapiens
gcaaagatcaaaataa

SEQ ID NO: 3280400 - DNA, 21 bp, Homo sapiens
gcaaagcaaaaggctgagaag

SEQ ID NO: 3280401 - DNA, 23 bp, Homo sapiens
gcaaagccacaaggctggccagc

SEQ ID NO: 3280402 - DNA, 14 bp, Homo sapiens
gcaaagctggttgt

SEQ ID NO: 3280403 - DNA, 11 bp, Homo sapiens
gcaaagcttgt

SEQ ID NO: 3280404 - DNA, 15 bp, Homo sapiens
gcaaaggaaggtgga

SEQ ID NO: 3280405 - DNA, 20 bp, Homo sapiens
gcaaaggaaggtggatggcc

SEQ ID NO: 3280406 - DNA, 21 bp, Homo sapiens
gcaaaggttccaactgtatat

SEQ ID NO: 3280407 - DNA, 23 bp, Homo sapiens
gcaaagtgttttctcagaacagc

SEQ ID NO: 3280408 - DNA, 14 bp, Homo sapiens
gcaaataaagcctt

SEQ ID NO: 3280409 - DNA, 16 bp, Homo sapiens
gcaaataaagcctttt

SEQ ID NO: 3280410 - DNA, 20 bp, Homo sapiens
gcaaataatgatcgaaaaaa

SEQ ID NO: 3280411 - DNA, 16 bp, Homo sapiens
gcaaatataaacatct

SEQ ID NO: 3280412 - DNA, 17 bp, Homo sapiens
gcaaatataagctggga

SEQ ID NO: 3280413 - DNA, 20 bp, Homo sapiens
gcaaatatcatactgttcaa

SEQ ID NO: 3280414 - DNA, 20 bp, Homo sapiens
gcaaatcagaaacttgtgaa

SEQ ID NO: 3280415 - DNA, 22 bp, Homo sapiens
gcaaatcatctgcattcctgat

SEQ ID NO: 3280416 - DNA, 12 bp, Homo sapiens
gcaaatctaaag

SEQ ID NO: 3280417 - DNA, 15 bp, Homo sapiens
gcaaatctacagatc

SEQ ID NO: 3280418 - DNA, 15 bp, Homo sapiens
gcaaatggctgagat

SEQ ID NO: 3280419 - DNA, 12 bp, Homo sapiens
gcaaatgtgtac

SEQ ID NO: 3280420 - DNA, 20 bp, Homo sapiens
gcaaatttcaaaagacatgt

SEQ ID NO: 3280421 - DNA, 22 bp, Homo sapiens
gcaaatttcaaaagacatgttg

SEQ ID NO: 3280422 - DNA, 23 bp, Homo sapiens
gcaaatttcaaaagacatgttgt

SEQ ID NO: 3280423 - DNA, 16 bp, Homo sapiens
gcaacaaacctcactg

SEQ ID NO: 3280424 - DNA, 19 bp, Homo sapiens
gcaacaaacctcactgaga

SEQ ID NO: 3280425 - DNA, 17 bp, Homo sapiens
gcaacaaagattgagaa

SEQ ID NO: 3280426 - DNA, 22 bp, Homo sapiens
gcaacaacaattggtaaaactc

SEQ ID NO: 3280427 - DNA, 21 bp, Homo sapiens
gcaacaagcccgttagcccca

SEQ ID NO: 3280428 - DNA, 16 bp, Homo sapiens
gcaacacgcatggtca

SEQ ID NO: 3280429 - DNA, 17 bp, Homo sapiens
gcaacagagagaaaaag

SEQ ID NO: 3280430 - DNA, 13 bp, Homo sapiens
gcaacagagcact

SEQ ID NO: 3280431 - DNA, 14 bp, Homo sapiens
gcaacagcaagaaa

SEQ ID NO: 3280432 - DNA, 13 bp, Homo sapiens
gcaacagcactgg

SEQ ID NO: 3280433 - DNA, 12 bp, Homo sapiens
gcaacaggacag

SEQ ID NO: 3280434 - DNA, 23 bp, Homo sapiens
gcaacaggacagagttcacagga

SEQ ID NO: 3280435 - DNA, 14 bp, Homo sapiens
gcaacaggctgggc

SEQ ID NO: 3280436 - DNA, 15 bp, Homo sapiens
gcaacaggctgggct

SEQ ID NO: 3280437 - DNA, 20 bp, Homo sapiens
gcaacaggggaggaaaaaag

SEQ ID NO: 3280438 - DNA, 21 bp, Homo sapiens
gcaacaggggaggaaaaaaga

SEQ ID NO: 3280439 - DNA, 22 bp, Homo sapiens
gcaacatgaagaatgcattcaa

SEQ ID NO: 3280440 - DNA, 20 bp, Homo sapiens
gcaaccccagttctgctcct

SEQ ID NO: 3280441 - DNA, 21 bp, Homo sapiens
gcaaccccagttctgctcctc

SEQ ID NO: 3280442 - DNA, 16 bp, Homo sapiens
gcaacccccagcctgc

SEQ ID NO: 3280443 - DNA, 18 bp, Homo sapiens
gcaacccccagcctgcta

SEQ ID NO: 3280444 - DNA, 14 bp, Homo sapiens
gcaacccctgtacc

SEQ ID NO: 3280445 - DNA, 21 bp, Homo sapiens
gcaacccctgtacccagctcc

SEQ ID NO: 3280446 - DNA, 23 bp, Homo sapiens
gcaaccgtctgttatgctgtgac

SEQ ID NO: 3280447 - DNA, 14 bp, Homo sapiens
gcaacctacccagc

SEQ ID NO: 3280448 - DNA, 15 bp, Homo sapiens
gcaacctcactatgg

SEQ ID NO: 3280449 - DNA, 13 bp, Homo sapiens
gcaacctctgcct

SEQ ID NO: 3280450 - DNA, 17 bp, Homo sapiens
gcaacctgattgtaaac

SEQ ID NO: 3280451 - DNA, 14 bp, Homo sapiens
gcaacctgggtcca

SEQ ID NO: 3280452 - DNA, 22 bp, Homo sapiens
gcaacctttcacctttgtgtat

SEQ ID NO: 3280453 - DNA, 23 bp, Homo sapiens
gcaacgaagaaaaaaaataacac

SEQ ID NO: 3280454 - DNA, 20 bp, Homo sapiens
gcaacgaccagggccgagga

SEQ ID NO: 3280455 - DNA, 22 bp, Homo sapiens
gcaacgaccagggccgaggagg

SEQ ID NO: 3280456 - DNA, 19 bp, Homo sapiens
gcaactacagaagtggaag

SEQ ID NO: 3280457 - DNA, 14 bp, Homo sapiens
gcaactagccaagg

SEQ ID NO: 3280458 - DNA, 15 bp, Homo sapiens
gcaactgaagatcca

SEQ ID NO: 3280459 - DNA, 18 bp, Homo sapiens
gcacacaccagagcccac

SEQ ID NO: 3280460 - DNA, 16 bp, Homo sapiens
gcacacacctccgaga

SEQ ID NO: 3280461 - DNA, 17 bp, Homo sapiens
gcacacagaaatatata

SEQ ID NO: 3280462 - DNA, 14 bp, Homo sapiens
gcacacagcagccc

SEQ ID NO: 3280463 - DNA, 15 bp, Homo sapiens
gcacacagcagcccc

SEQ ID NO: 3280464 - DNA, 13 bp, Homo sapiens
gatgtaaacaatg

SEQ ID NO: 3280465 - DNA, 19 bp, Homo sapiens
gatgtaattagctctgggg

SEQ ID NO: 3280466 - DNA, 22 bp, Homo sapiens
gatgtaattagctctggggggc

SEQ ID NO: 3280467 - DNA, 16 bp, Homo sapiens
gatgtacaattaaaaa

SEQ ID NO: 3280468 - DNA, 16 bp, Homo sapiens
gatgtacagtctgtca

SEQ ID NO: 3280469 - DNA, 13 bp, Homo sapiens
gatgtatctgagt

SEQ ID NO: 3280470 - DNA, 20 bp, Homo sapiens
gatgtatgtgtgaaacaatg

SEQ ID NO: 3280471 - DNA, 20 bp, Homo sapiens
gatgtcagcttcccagccat

SEQ ID NO: 3280472 - DNA, 22 bp, Homo sapiens
gatgtcagcttcccagccatgc

SEQ ID NO: 3280473 - DNA, 12 bp, Homo sapiens
gatgtccagaag

SEQ ID NO: 3280474 - DNA, 19 bp, Homo sapiens
gatgtccctgggccagggt

SEQ ID NO: 3280475 - DNA, 20 bp, Homo sapiens
gatgtccctgggccagggtc

SEQ ID NO: 3280476 - DNA, 15 bp, Homo sapiens
gatgtcgacatgttt

SEQ ID NO: 3280477 - DNA, 16 bp, Homo sapiens
gatgtctctaaagcac

SEQ ID NO: 3280478 - DNA, 15 bp, Homo sapiens
gatgtctctggggca

SEQ ID NO: 3280479 - DNA, 16 bp, Homo sapiens
gatgtctcttgtagaa

SEQ ID NO: 3280480 - DNA, 17 bp, Homo sapiens
gatgtctcttgtagaag

SEQ ID NO: 3280481 - DNA, 16 bp, Homo sapiens
gatgtcttatttttag

SEQ ID NO: 3280482 - DNA, 18 bp, Homo sapiens
gatgtcttatttttagat

SEQ ID NO: 3280483 - DNA, 14 bp, Homo sapiens
gatgtcttttcttg

SEQ ID NO: 3280484 - DNA, 15 bp, Homo sapiens
gatgtgaagataatt

SEQ ID NO: 3280485 - DNA, 20 bp, Homo sapiens
gatgtgacccaccagtgcct

SEQ ID NO: 3280486 - DNA, 12 bp, Homo sapiens
gatgtgactttt

SEQ ID NO: 3280487 - DNA, 13 bp, Homo sapiens
gatgtgacttttt

SEQ ID NO: 3280488 - DNA, 23 bp, Homo sapiens
gatgtgagccccaggggggcctc

SEQ ID NO: 3280489 - DNA, 12 bp, Homo sapiens
gatgtgcaagcg

SEQ ID NO: 3280490 - DNA, 19 bp, Homo sapiens
gatgtgcaagcgacgacag

SEQ ID NO: 3280491 - DNA, 14 bp, Homo sapiens
gatgtggaaagcac

SEQ ID NO: 3280492 - DNA, 20 bp, Homo sapiens
gatgtggtgcctgaggtctg

SEQ ID NO: 3280493 - DNA, 13 bp, Homo sapiens
gatgtgtctgtat

SEQ ID NO: 3280494 - DNA, 13 bp, Homo sapiens
gatgtgtgcatgt

SEQ ID NO: 3280495 - DNA, 14 bp, Homo sapiens
gatgtgtgctttcc

SEQ ID NO: 3280496 - DNA, 16 bp, Homo sapiens
gatgtgtggggcatgg

SEQ ID NO: 3280497 - DNA, 18 bp, Homo sapiens
gatgtgtgttgtcagcct

SEQ ID NO: 3280498 - DNA, 19 bp, Homo sapiens
gatgtgtgttgtcagcctg

SEQ ID NO: 3280499 - DNA, 23 bp, Homo sapiens
gatgtgttcattcaagctattta

SEQ ID NO: 3280500 - DNA, 17 bp, Homo sapiens
gatgttaaaataaatgg

SEQ ID NO: 3280501 - DNA, 17 bp, Homo sapiens
gatgttcagcactgtcc

SEQ ID NO: 3280502 - DNA, 19 bp, Homo sapiens
gatgttcagcactgtccct

SEQ ID NO: 3280503 - DNA, 12 bp, Homo sapiens
gatgttcctttt

SEQ ID NO: 3280504 - DNA, 12 bp, Homo sapiens
gatgttctaagg

SEQ ID NO: 3280505 - DNA, 13 bp, Homo sapiens
gatgttctaaggc

SEQ ID NO: 3280506 - DNA, 19 bp, Homo sapiens
gatgttctaaggctctgag

SEQ ID NO: 3280507 - DNA, 22 bp, Homo sapiens
gatgttctattttttgttttgt

SEQ ID NO: 3280508 - DNA, 16 bp, Homo sapiens
gatgttctgggacaca

SEQ ID NO: 3280509 - DNA, 13 bp, Homo sapiens
gatgttgaactgg

SEQ ID NO: 3280510 - DNA, 20 bp, Homo sapiens
gatgttgaagaatacagtta

SEQ ID NO: 3280511 - DNA, 19 bp, Homo sapiens
gatgtttattcttctagag

SEQ ID NO: 3280512 - DNA, 19 bp, Homo sapiens
gatgtttccagacttcctt

SEQ ID NO: 3280513 - DNA, 13 bp, Homo sapiens
gatgtttgtggcc

SEQ ID NO: 3280514 - DNA, 18 bp, Homo sapiens
gatgtttgtggcctcaga

SEQ ID NO: 3280515 - DNA, 22 bp, Homo sapiens
gatgttttggtagattaaatat

SEQ ID NO: 3280516 - DNA, 20 bp, Homo sapiens
gatgtttttaaaagtttcaa

SEQ ID NO: 3280517 - DNA, 12 bp, Homo sapiens
gattaaaggaag

SEQ ID NO: 3280518 - DNA, 23 bp, Homo sapiens
gattaaatatagattagaaaaat

SEQ ID NO: 3280519 - DNA, 13 bp, Homo sapiens
gattaaattacag

SEQ ID NO: 3280520 - DNA, 17 bp, Homo sapiens
gattaaattacagcttt

SEQ ID NO: 3280521 - DNA, 10 bp, Homo sapiens
gattaaattt

SEQ ID NO: 3280522 - DNA, 14 bp, Homo sapiens
gattaacctctgca

SEQ ID NO: 3280523 - DNA, 13 bp, Homo sapiens
gattaagagccat

SEQ ID NO: 3280524 - DNA, 18 bp, Homo sapiens
gattaagattttacaaaa

SEQ ID NO: 3280525 - DNA, 12 bp, Homo sapiens
gattaagggcaa

SEQ ID NO: 3280526 - DNA, 14 bp, Homo sapiens
gattaatatattta

SEQ ID NO: 3280527 - DNA, 18 bp, Homo sapiens
gattaatatgaaaactta

SEQ ID NO: 3280528 - DNA, 20 bp, Homo sapiens
gattaatcaaaggcatatct

SEQ ID NO: 3280529 - DNA, 14 bp, Homo sapiens
gattaatgttttca

SEQ ID NO: 3280530 - DNA, 19 bp, Homo sapiens
gattaatgttttgtacaat

SEQ ID NO: 3280531 - DNA, 13 bp, Homo sapiens
gattacaagcgtg

SEQ ID NO: 3280532 - DNA, 22 bp, Homo sapiens
gattacaagcgtgagccactgc

SEQ ID NO: 3280533 - DNA, 18 bp, Homo sapiens
gattacaggaatgaagaa

SEQ ID NO: 3280534 - DNA, 20 bp, Homo sapiens
gattacaggaatgaagaact

SEQ ID NO: 3280535 - DNA, 22 bp, Homo sapiens
gattacaggaatgaagaactgt

SEQ ID NO: 3280536 - DNA, 22 bp, Homo sapiens
gattactggcctttttcattta

SEQ ID NO: 3280537 - DNA, 17 bp, Homo sapiens
gattactgtcaataaac

SEQ ID NO: 3280538 - DNA, 15 bp, Homo sapiens
gattagaaatttaac

SEQ ID NO: 3280539 - DNA, 13 bp, Homo sapiens
gattagctttatt

SEQ ID NO: 3280540 - DNA, 14 bp, Homo sapiens
gattagctttatta

SEQ ID NO: 3280541 - DNA, 20 bp, Homo sapiens
gattagctttattatggctt

SEQ ID NO: 3280542 - DNA, 22 bp, Homo sapiens
gattataaaaaatgtaacatca

SEQ ID NO: 3280543 - DNA, 18 bp, Homo sapiens
gattatatcaaagtattt

SEQ ID NO: 3280544 - DNA, 17 bp, Homo sapiens
gattatggcctttttaa

SEQ ID NO: 3280545 - DNA, 15 bp, Homo sapiens
gattatggttttgtg

SEQ ID NO: 3280546 - DNA, 21 bp, Homo sapiens
gattatgttatacaaggcaag

SEQ ID NO: 3280547 - DNA, 21 bp, Homo sapiens
gattattcatttaaaatgatt

SEQ ID NO: 3280548 - DNA, 17 bp, Homo sapiens
gattattctgattccac

SEQ ID NO: 3280549 - DNA, 12 bp, Homo sapiens
gattattggaaa

SEQ ID NO: 3280550 - DNA, 17 bp, Homo sapiens
gattattgtatttattc

SEQ ID NO: 3280551 - DNA, 17 bp, Homo sapiens
gattatttaataacatt

SEQ ID NO: 3280552 - DNA, 18 bp, Homo sapiens
gattatttaataacatta

SEQ ID NO: 3280553 - DNA, 21 bp, Homo sapiens
gattatttaataacattacct

SEQ ID NO: 3280554 - DNA, 23 bp, Homo sapiens
gattatttcactttagatgctga

SEQ ID NO: 3280555 - DNA, 18 bp, Homo sapiens
gattatttgtatttacag

SEQ ID NO: 3280556 - DNA, 15 bp, Homo sapiens
gattcaaaggttcta

SEQ ID NO: 3280557 - DNA, 13 bp, Homo sapiens
gattcaaattgct

SEQ ID NO: 3280558 - DNA, 17 bp, Homo sapiens
gattcaaattgctgctt

SEQ ID NO: 3280559 - DNA, 16 bp, Homo sapiens
gattcaatctgtaaac

SEQ ID NO: 3280560 - DNA, 22 bp, Homo sapiens
gattcaattacggactctggat

SEQ ID NO: 3280561 - DNA, 21 bp, Homo sapiens
gattcacgtttttctggacca

SEQ ID NO: 3280562 - DNA, 14 bp, Homo sapiens
gattcactgtgctt

SEQ ID NO: 3280563 - DNA, 21 bp, Homo sapiens
gattcagaaaatgttctgttt

SEQ ID NO: 3280564 - DNA, 18 bp, Homo sapiens
gattcagattgttatcta

SEQ ID NO: 3280565 - DNA, 22 bp, Homo sapiens
gattcaggccagcccagccagg

SEQ ID NO: 3280566 - DNA, 15 bp, Homo sapiens
gattcataacaatgt

SEQ ID NO: 3280567 - DNA, 18 bp, Homo sapiens
gattcatgttatatttaa

SEQ ID NO: 3280568 - DNA, 22 bp, Homo sapiens
gattccagagagtggctcctcc

SEQ ID NO: 3280569 - DNA, 17 bp, Homo sapiens
gattcccaagctctgct

SEQ ID NO: 3280570 - DNA, 13 bp, Homo sapiens
gattcccagagca

SEQ ID NO: 3280571 - DNA, 13 bp, Homo sapiens
gattcccccagcc

SEQ ID NO: 3280572 - DNA, 21 bp, Homo sapiens
gattcccctaacctcattccc

SEQ ID NO: 3280573 - DNA, 22 bp, Homo sapiens
gattccggatcctaagcatcta

SEQ ID NO: 3280574 - DNA, 23 bp, Homo sapiens
gattcctatgatggatggcagac

SEQ ID NO: 3280575 - DNA, 20 bp, Homo sapiens
gattcctcttgcctctctca

SEQ ID NO: 3280576 - DNA, 13 bp, Homo sapiens
gattcctgaccca

SEQ ID NO: 3280577 - DNA, 19 bp, Homo sapiens
gattcctgacccaggccgc

SEQ ID NO: 3280578 - DNA, 13 bp, Homo sapiens
gattcctgggcct

SEQ ID NO: 3280579 - DNA, 18 bp, Homo sapiens
gattccttagactctttt

SEQ ID NO: 3280580 - DNA, 13 bp, Homo sapiens
gattccttctctg

SEQ ID NO: 3280581 - DNA, 17 bp, Homo sapiens
gattcggtatcccccca

SEQ ID NO: 3280582 - DNA, 12 bp, Homo sapiens
gattctaaaatg

SEQ ID NO: 3280583 - DNA, 12 bp, Homo sapiens
gattctaaagat

SEQ ID NO: 3280584 - DNA, 18 bp, Homo sapiens
cttgcctcaatgccagta

SEQ ID NO: 3280585 - DNA, 13 bp, Homo sapiens
cttgcctctctca

SEQ ID NO: 3280586 - DNA, 24 bp, Homo sapiens
cttgcctctgcacaccctccagag

SEQ ID NO: 3280587 - DNA, 13 bp, Homo sapiens
cttgcctctgtgc

SEQ ID NO: 3280588 - DNA, 20 bp, Homo sapiens
cttgcctctgtgctgtgtgt

SEQ ID NO: 3280589 - DNA, 13 bp, Homo sapiens
cttgcctcttcct

SEQ ID NO: 3280590 - DNA, 17 bp, Homo sapiens
cttgcctggggtctgag

SEQ ID NO: 3280591 - DNA, 23 bp, Homo sapiens
cttgccttaaacactcaccttct

SEQ ID NO: 3280592 - DNA, 22 bp, Homo sapiens
cttgccttagaaacacataaat

SEQ ID NO: 3280593 - DNA, 12 bp, Homo sapiens
cttgccttcccc

SEQ ID NO: 3280594 - DNA, 12 bp, Homo sapiens
cttgcctttgtg

SEQ ID NO: 3280595 - DNA, 13 bp, Homo sapiens
cttgcctttgtgg

SEQ ID NO: 3280596 - DNA, 23 bp, Homo sapiens
cttgcgaactagagatgtgcaat

SEQ ID NO: 3280597 - DNA, 19 bp, Homo sapiens
cttgcgaatccaagctccc

SEQ ID NO: 3280598 - DNA, 20 bp, Homo sapiens
cttgcggaatcactctgtcc

SEQ ID NO: 3280599 - DNA, 15 bp, Homo sapiens
cttgcgtcctgcaga

SEQ ID NO: 3280600 - DNA, 18 bp, Homo sapiens
cttgcgtcctgcagagga

SEQ ID NO: 3280601 - DNA, 22 bp, Homo sapiens
cttgcgtgtcaatttccctcag

SEQ ID NO: 3280602 - DNA, 23 bp, Homo sapiens
cttgctaaagcactttgcactta

SEQ ID NO: 3280603 - DNA, 19 bp, Homo sapiens
cttgctagtattcgctgtg

SEQ ID NO: 3280604 - DNA, 12 bp, Homo sapiens
ctttatgtgtaa

SEQ ID NO: 3280605 - DNA, 14 bp, Homo sapiens
ctttatgtgtaaat

SEQ ID NO: 3280606 - DNA, 18 bp, Homo sapiens
ctttattacaatttgtat

SEQ ID NO: 3280607 - DNA, 22 bp, Homo sapiens
ctttattacaatttgtattact

SEQ ID NO: 3280608 - DNA, 22 bp, Homo sapiens
ctttattaccccctccttcaga

SEQ ID NO: 3280609 - DNA, 13 bp, Homo sapiens
ctttctgccttgg

SEQ ID NO: 3280610 - DNA, 16 bp, Homo sapiens
ctttctgccttggcct

SEQ ID NO: 3280611 - DNA, 13 bp, Homo sapiens
ctttctggactgg

SEQ ID NO: 3280612 - DNA, 17 bp, Homo sapiens
ctttctggcctgccttc

SEQ ID NO: 3280613 - DNA, 15 bp, Homo sapiens
ctttctgggagcaga

SEQ ID NO: 3280614 - DNA, 17 bp, Homo sapiens
ctttctgtaccatttat

SEQ ID NO: 3280615 - DNA, 22 bp, Homo sapiens
ctttctgtgccctactcattgg

SEQ ID NO: 3280616 - DNA, 15 bp, Homo sapiens
ctttctgtgtgcacc

SEQ ID NO: 3280617 - DNA, 21 bp, Homo sapiens
ctttctgtgtgcaccttacca

SEQ ID NO: 3280618 - DNA, 23 bp, Homo sapiens
ctttctgttccaaattcagtttc

SEQ ID NO: 3280619 - DNA, 16 bp, Homo sapiens
ctttctgttgagagaa

SEQ ID NO: 3280620 - DNA, 12 bp, Homo sapiens
ctttcttcctct

SEQ ID NO: 3280621 - DNA, 13 bp, Homo sapiens
ctttcttcctctg

SEQ ID NO: 3280622 - DNA, 16 bp, Homo sapiens
ctttcttcctctgctg

SEQ ID NO: 3280623 - DNA, 11 bp, Homo sapiens
ctttcttcctt

SEQ ID NO: 3280624 - DNA, 16 bp, Homo sapiens
ctttcttgctggctct

SEQ ID NO: 3280625 - DNA, 19 bp, Homo sapiens
ctttcttgctggctctgag

SEQ ID NO: 3280626 - DNA, 20 bp, Homo sapiens
ctttcttgtctttcctccta

SEQ ID NO: 3280627 - DNA, 15 bp, Homo sapiens
ctttctttaaatgtt

SEQ ID NO: 3280628 - DNA, 15 bp, Homo sapiens
ctttctttcagatgt

SEQ ID NO: 3280629 - DNA, 12 bp, Homo sapiens
ctttctttgatt

SEQ ID NO: 3280630 - DNA, 21 bp, Homo sapiens
ctttctttgcaccaaagacat

SEQ ID NO: 3280631 - DNA, 20 bp, Homo sapiens
ctttctttggtgcctttcct

SEQ ID NO: 3280632 - DNA, 11 bp, Homo sapiens
ctttcttttct

SEQ ID NO: 3280633 - DNA, 18 bp, Homo sapiens
ctttcttttgattcttcc

SEQ ID NO: 3280634 - DNA, 19 bp, Homo sapiens
ctttgaaacctgctctgta

SEQ ID NO: 3280635 - DNA, 20 bp, Homo sapiens
ctttgaaacctgctctgtag

SEQ ID NO: 3280636 - DNA, 12 bp, Homo sapiens
ctttgaaagaag

SEQ ID NO: 3280637 - DNA, 15 bp, Homo sapiens
ctttgaaagaagcaa

SEQ ID NO: 3280638 - DNA, 17 bp, Homo sapiens
ctttgaaagaagcaaga

SEQ ID NO: 3280639 - DNA, 13 bp, Homo sapiens
ctttgaaatacct

SEQ ID NO: 3280640 - DNA, 14 bp, Homo sapiens
ctttgaaatacctc

SEQ ID NO: 3280641 - DNA, 19 bp, Homo sapiens
ctttgaaatacctcatgtt

SEQ ID NO: 3280642 - DNA, 19 bp, Homo sapiens
ctttgaaatagtctgtgtg

SEQ ID NO: 3280643 - DNA, 15 bp, Homo sapiens
ctttgaaattgttta

SEQ ID NO: 3280644 - DNA, 18 bp, Homo sapiens
ctttgaacctgtgcaata

SEQ ID NO: 3280645 - DNA, 16 bp, Homo sapiens
ctttgaagcctcagct

SEQ ID NO: 3280646 - DNA, 23 bp, Homo sapiens
ctttgaagctgaaaatataaaac

SEQ ID NO: 3280647 - DNA, 16 bp, Homo sapiens
ctttgaaggggcctca

SEQ ID NO: 3280648 - DNA, 17 bp, Homo sapiens
ctttgaagtagctcttt

SEQ ID NO: 3280649 - DNA, 23 bp, Homo sapiens
ctttgaatgctaagaatgcatta

SEQ ID NO: 3280650 - DNA, 23 bp, Homo sapiens
ctttgaatgctttttgaatgtta

SEQ ID NO: 3280651 - DNA, 18 bp, Homo sapiens
ctttgacaattgggagct

SEQ ID NO: 3280652 - DNA, 18 bp, Homo sapiens
ctttgacatttaatttag

SEQ ID NO: 3280653 - DNA, 23 bp, Homo sapiens
ctttgacatttccttctttgtct

SEQ ID NO: 3280654 - DNA, 15 bp, Homo sapiens
ctttgacttcagctg

SEQ ID NO: 3280655 - DNA, 21 bp, Homo sapiens
ctttgactttatctcctgctc

SEQ ID NO: 3280656 - DNA, 15 bp, Homo sapiens
ctttgactttttgca

SEQ ID NO: 3280657 - DNA, 17 bp, Homo sapiens
ctttgactttttgcatt

SEQ ID NO: 3280658 - DNA, 22 bp, Homo sapiens
ctttgagaagccttcagctcca

SEQ ID NO: 3280659 - DNA, 17 bp, Homo sapiens
ctttgagacagtttctt

SEQ ID NO: 3280660 - DNA, 18 bp, Homo sapiens
ctttgagacagtttctta

SEQ ID NO: 3280661 - DNA, 17 bp, Homo sapiens
ctttgagactgggtctc

SEQ ID NO: 3280662 - DNA, 20 bp, Homo sapiens
ctttgagatgcttctggctc

SEQ ID NO: 3280663 - DNA, 24 bp, Homo sapiens
ctttgagatgtgttcctcctgctg

SEQ ID NO: 3280664 - DNA, 19 bp, Homo sapiens
ctttgagggactgcctctg

SEQ ID NO: 3280665 - DNA, 21 bp, Homo sapiens
ctttgagggactgcctctgcc

SEQ ID NO: 3280666 - DNA, 22 bp, Homo sapiens
ctttgagggactgcctctgcca

SEQ ID NO: 3280667 - DNA, 19 bp, Homo sapiens
ctttgagtcccccagagat

SEQ ID NO: 3280668 - DNA, 13 bp, Homo sapiens
ctttgagtgatcc

SEQ ID NO: 3280669 - DNA, 22 bp, Homo sapiens
ctttgagtgtcttctaacttta

SEQ ID NO: 3280670 - DNA, 23 bp, Homo sapiens
ctttgatcgtatatttctcataa

SEQ ID NO: 3280671 - DNA, 16 bp, Homo sapiens
ctttgatctggacaga

SEQ ID NO: 3280672 - DNA, 22 bp, Homo sapiens
ctttgatctggacagaacattt

SEQ ID NO: 3280673 - DNA, 21 bp, Homo sapiens
ctttgatgattaattcacctt

SEQ ID NO: 3280674 - DNA, 16 bp, Homo sapiens
ctttgattatgcagac

SEQ ID NO: 3280675 - DNA, 22 bp, Homo sapiens
ctttgattctccttttatgtgt

SEQ ID NO: 3280676 - DNA, 17 bp, Homo sapiens
ctttgcaagatgcttgg

SEQ ID NO: 3280677 - DNA, 14 bp, Homo sapiens
ctttgcaatagcag

SEQ ID NO: 3280678 - DNA, 22 bp, Homo sapiens
ctttgcaatagcagttataaca

SEQ ID NO: 3280679 - DNA, 15 bp, Homo sapiens
ctttgcaatccaaat

SEQ ID NO: 3280680 - DNA, 16 bp, Homo sapiens
ctttgcacaggatgct

SEQ ID NO: 3280681 - DNA, 20 bp, Homo sapiens
ctttgcacaggatgctggcc

SEQ ID NO: 3280682 - DNA, 13 bp, Homo sapiens
ctttgcaccaaag

SEQ ID NO: 3280683 - DNA, 17 bp, Homo sapiens
ctttgcaccaaagacat

SEQ ID NO: 3280684 - DNA, 22 bp, Homo sapiens
ctttgcaccctgtagatgttct

SEQ ID NO: 3280685 - DNA, 13 bp, Homo sapiens
ctttgcactgagg

SEQ ID NO: 3280686 - DNA, 23 bp, Homo sapiens
ctttgcactgagggccacactat

SEQ ID NO: 3280687 - DNA, 20 bp, Homo sapiens
ctttgcagacaggcaagcac

SEQ ID NO: 3280688 - DNA, 13 bp, Homo sapiens
ctttgcaggctct

SEQ ID NO: 3280689 - DNA, 15 bp, Homo sapiens
ctttgcaggctctgg

SEQ ID NO: 3280690 - DNA, 14 bp, Homo sapiens
ctttgcagggcagc

SEQ ID NO: 3280691 - DNA, 17 bp, Homo sapiens
ctttgcagggcagcccc

SEQ ID NO: 3280692 - DNA, 22 bp, Homo sapiens
ctttgcagggctaaggccccca

SEQ ID NO: 3280693 - DNA, 20 bp, Homo sapiens
ctttgcagttggactctcag

SEQ ID NO: 3280694 - DNA, 23 bp, Homo sapiens
ctttgcagttggactctcaggga

SEQ ID NO: 3280695 - DNA, 19 bp, Homo sapiens
ctttgcatagctctccttc

SEQ ID NO: 3280696 - DNA, 21 bp, Homo sapiens
ctttgcatagctctccttccc

SEQ ID NO: 3280697 - DNA, 23 bp, Homo sapiens
ctttgccaagttgctgtcactgt

SEQ ID NO: 3280698 - DNA, 20 bp, Homo sapiens
ctttgccatttttctataaa

SEQ ID NO: 3280699 - DNA, 16 bp, Homo sapiens
ctttgcccaacaccag

SEQ ID NO: 3280700 - DNA, 18 bp, Homo sapiens
ctttgcccaacaccagcc

SEQ ID NO: 3280701 - DNA, 19 bp, Homo sapiens
ctttgcccaacaccagccc

SEQ ID NO: 3280702 - DNA, 22 bp, Homo sapiens
ctttgcctcctgtgtactgtgt

SEQ ID NO: 3280703 - DNA, 13 bp, Homo sapiens
ctttgccttctct

SEQ ID NO: 3280704 - DNA, 11 bp, Homo sapiens
ctttgccttgc

SEQ ID NO: 3280705 - DNA, 17 bp, Homo sapiens
ctttgccttgcagccac

SEQ ID NO: 3280706 - DNA, 22 bp, Homo sapiens
ctttgccttgcagccacatggc

SEQ ID NO: 3280707 - DNA, 13 bp, Homo sapiens
ctttgccttgggc

SEQ ID NO: 3280708 - DNA, 18 bp, Homo sapiens
ctttgccttgggctgctc

SEQ ID NO: 3280709 - DNA, 22 bp, Homo sapiens
ctttgccttgggctgctcctca

SEQ ID NO: 3280710 - DNA, 23 bp, Homo sapiens
ctttgccttgggctgctcctcat

SEQ ID NO: 3280711 - DNA, 14 bp, Homo sapiens
ctttgctacaaatt

SEQ ID NO: 3280712 - DNA, 16 bp, Homo sapiens
ctttgctatgtaaggg

SEQ ID NO: 3280713 - DNA, 16 bp, Homo sapiens
ctttgctccgctccca

SEQ ID NO: 3280714 - DNA, 18 bp, Homo sapiens
ctttgctccgctcccacc

SEQ ID NO: 3280715 - DNA, 19 bp, Homo sapiens
ctttgctccgctcccaccg

SEQ ID NO: 3280716 - DNA, 12 bp, Homo sapiens
ctttgctcttgc

SEQ ID NO: 3280717 - DNA, 14 bp, Homo sapiens
ctttgctgagagct

SEQ ID NO: 3280718 - DNA, 11 bp, Homo sapiens
ctttgctgcca

SEQ ID NO: 3280719 - DNA, 21 bp, Homo sapiens
ctttgctgctaccgccctggg

SEQ ID NO: 3280720 - DNA, 22 bp, Homo sapiens
ctttgctgctatgaaaatgagc

SEQ ID NO: 3280721 - DNA, 17 bp, Homo sapiens
ctttgctgtactcttgc

SEQ ID NO: 3280722 - DNA, 21 bp, Homo sapiens
ctttgctgtactcttgctgat

SEQ ID NO: 3280723 - DNA, 22 bp, Homo sapiens
ctttgctgtactcttgctgatg

SEQ ID NO: 3280724 - DNA, 21 bp, Homo sapiens
ctttgctgtgaggctgtcctg

SEQ ID NO: 3280725 - DNA, 22 bp, Homo sapiens
ctttgctgtgaggctgtcctgt

SEQ ID NO: 3280726 - DNA, 20 bp, Homo sapiens
ctttgcttatgaatatttat

SEQ ID NO: 3280727 - DNA, 23 bp, Homo sapiens
ctttgcttcaaattcaaggcctt

SEQ ID NO: 3280728 - DNA, 19 bp, Homo sapiens
ctttgcttgaacacagtat

SEQ ID NO: 3280729 - DNA, 21 bp, Homo sapiens
ctttgcttgaacacagtattt

SEQ ID NO: 3280730 - DNA, 18 bp, Homo sapiens
ctttgcttgctttgaagt

SEQ ID NO: 3280731 - DNA, 20 bp, Homo sapiens
ctttgctttttaattgagga

SEQ ID NO: 3280732 - DNA, 12 bp, Homo sapiens
ctttggaaaaat

SEQ ID NO: 3280733 - DNA, 17 bp, Homo sapiens
ctttggaaacaggacca

SEQ ID NO: 3280734 - DNA, 15 bp, Homo sapiens
ctttttctgttgtaa

SEQ ID NO: 3280735 - DNA, 16 bp, Homo sapiens
ctttttctgttgtaac

SEQ ID NO: 3280736 - DNA, 13 bp, Homo sapiens
ctttttcttcctc

SEQ ID NO: 3280737 - DNA, 23 bp, Homo sapiens
ctttttcttgtcattaacacatt

SEQ ID NO: 3280738 - DNA, 16 bp, Homo sapiens
ctttttctttataaac

SEQ ID NO: 3280739 - DNA, 15 bp, Homo sapiens
ctttttgaaatgaaa

SEQ ID NO: 3280740 - DNA, 12 bp, Homo sapiens
cttgggctcctg

SEQ ID NO: 3280741 - DNA, 13 bp, Homo sapiens
cttgggctcctgg

SEQ ID NO: 3280742 - DNA, 14 bp, Homo sapiens
cttgggctcctggc

SEQ ID NO: 3280743 - DNA, 19 bp, Homo sapiens
cttgggctcctggctgcca

SEQ ID NO: 3280744 - DNA, 20 bp, Homo sapiens
cttgggctcctggctgccag

SEQ ID NO: 3280745 - DNA, 21 bp, Homo sapiens
cttgggctcctggctgccagg

SEQ ID NO: 3280746 - DNA, 23 bp, Homo sapiens
cttgggctcctggctgccaggcg

SEQ ID NO: 3280747 - DNA, 17 bp, Homo sapiens
cttgggctgacccagca

SEQ ID NO: 3280748 - DNA, 16 bp, Homo sapiens
cttggggaatttcctc

SEQ ID NO: 3280749 - DNA, 13 bp, Homo sapiens
cttggggaggcaa

SEQ ID NO: 3280750 - DNA, 19 bp, Homo sapiens
cttggggccaccaaagctg

SEQ ID NO: 3280751 - DNA, 21 bp, Homo sapiens
cttggggccaccaaagctgcc

SEQ ID NO: 3280752 - DNA, 22 bp, Homo sapiens
cttggggccactttcagagccc

SEQ ID NO: 3280753 - DNA, 17 bp, Homo sapiens
cttggggcctggcttgc

SEQ ID NO: 3280754 - DNA, 17 bp, Homo sapiens
cttctctgacttctgcc

SEQ ID NO: 3280755 - DNA, 13 bp, Homo sapiens
cttctctgcaatg

SEQ ID NO: 3280756 - DNA, 19 bp, Homo sapiens
cttctctgcaatgcttctg

SEQ ID NO: 3280757 - DNA, 21 bp, Homo sapiens
cttctctgcaatgcttctgta

SEQ ID NO: 3280758 - DNA, 22 bp, Homo sapiens
cttctctgcaatgcttctgtag

SEQ ID NO: 3280759 - DNA, 12 bp, Homo sapiens
cttctctgcagt

SEQ ID NO: 3280760 - DNA, 15 bp, Homo sapiens
cttctctgcagtaaa

SEQ ID NO: 3280761 - DNA, 14 bp, Homo sapiens
cttctctgctccac

SEQ ID NO: 3280762 - DNA, 22 bp, Homo sapiens
cttctctgctccaccacatcct

SEQ ID NO: 3280763 - DNA, 21 bp, Homo sapiens
cttctctgtgaacgatttaga

SEQ ID NO: 3280764 - DNA, 14 bp, Homo sapiens
cttctcttctctgc

SEQ ID NO: 3280765 - DNA, 18 bp, Homo sapiens
cttctcttctctgcaatg

SEQ ID NO: 3280766 - DNA, 17 bp, Homo sapiens
cttctgaactcaaactg

SEQ ID NO: 3280767 - DNA, 15 bp, Homo sapiens
cttctgaatgctgct

SEQ ID NO: 3280768 - DNA, 19 bp, Homo sapiens
cttctgaatgctgctactt

SEQ ID NO: 3280769 - DNA, 21 bp, Homo sapiens
cttctgaatgtgctgatcatt

SEQ ID NO: 3280770 - DNA, 20 bp, Homo sapiens
cttctgacgtgccttttgca

SEQ ID NO: 3280771 - DNA, 14 bp, Homo sapiens
cttctgactttact

SEQ ID NO: 3280772 - DNA, 16 bp, Homo sapiens
cttctgagctatttca

SEQ ID NO: 3280773 - DNA, 14 bp, Homo sapiens
cttctgagtattct

SEQ ID NO: 3280774 - DNA, 15 bp, Homo sapiens
cttctgattcccctc

SEQ ID NO: 3280775 - DNA, 18 bp, Homo sapiens
cttctgcaacaagcatgc

SEQ ID NO: 3280776 - DNA, 13 bp, Homo sapiens
cttctgcaccctc

SEQ ID NO: 3280777 - DNA, 16 bp, Homo sapiens
cttctgcaccctccac

SEQ ID NO: 3280778 - DNA, 21 bp, Homo sapiens
cttctgcaccctccaccctgt

SEQ ID NO: 3280779 - DNA, 21 bp, Homo sapiens
cttctgccatattctgttggc

SEQ ID NO: 3280780 - DNA, 19 bp, Homo sapiens
cttctgccctttcctaggc

SEQ ID NO: 3280781 - DNA, 22 bp, Homo sapiens
cttctgccctttcctaggccca

SEQ ID NO: 3280782 - DNA, 14 bp, Homo sapiens
cttctgcctggaga

SEQ ID NO: 3280783 - DNA, 18 bp, Homo sapiens
cttctgccttagtctcag

SEQ ID NO: 3280784 - DNA, 14 bp, Homo sapiens
cttctgccttctca

SEQ ID NO: 3280785 - DNA, 15 bp, Homo sapiens
cttctgcgcctcagg

SEQ ID NO: 3280786 - DNA, 13 bp, Homo sapiens
cttctgctccacc

SEQ ID NO: 3280787 - DNA, 19 bp, Homo sapiens
cttctgctccacccttggc

SEQ ID NO: 3280788 - DNA, 23 bp, Homo sapiens
cttctgctccacccttggcctgt

SEQ ID NO: 3280789 - DNA, 13 bp, Homo sapiens
cttctgctgccca

SEQ ID NO: 3280790 - DNA, 19 bp, Homo sapiens
cttctgctggataaaatga

SEQ ID NO: 3280791 - DNA, 18 bp, Homo sapiens
cttctgcttaggagagac

SEQ ID NO: 3280792 - DNA, 22 bp, Homo sapiens
cttctgcttttctgccctggct

SEQ ID NO: 3280793 - DNA, 19 bp, Homo sapiens
cttctggaaggctggctga

SEQ ID NO: 3280794 - DNA, 14 bp, Homo sapiens
cttctggaatattg

SEQ ID NO: 3280795 - DNA, 15 bp, Homo sapiens
cttctggaatattgt

SEQ ID NO: 3280796 - DNA, 18 bp, Homo sapiens
cttctggaatttgttcaa

SEQ ID NO: 3280797 - DNA, 17 bp, Homo sapiens
cttctggcacttggaga

SEQ ID NO: 3280798 - DNA, 11 bp, Homo sapiens
cttctggcctt

SEQ ID NO: 3280799 - DNA, 22 bp, Homo sapiens
cttctggcctttcctctctcct

SEQ ID NO: 3280800 - DNA, 19 bp, Homo sapiens
cttctgggactggacagct

SEQ ID NO: 3280801 - DNA, 19 bp, Homo sapiens
cttctgggcatctgttctg

SEQ ID NO: 3280802 - DNA, 16 bp, Homo sapiens
cttctgggcctgacca

SEQ ID NO: 3280803 - DNA, 21 bp, Homo sapiens
cttctgggcttcatctggcaa

SEQ ID NO: 3280804 - DNA, 14 bp, Homo sapiens
cttctggtctgtgt

SEQ ID NO: 3280805 - DNA, 15 bp, Homo sapiens
cttctgtaattgtgt

SEQ ID NO: 3280806 - DNA, 20 bp, Homo sapiens
cttctgtaattgtgtggatt

SEQ ID NO: 3280807 - DNA, 14 bp, Homo sapiens
cttctgtacgtctg

SEQ ID NO: 3280808 - DNA, 21 bp, Homo sapiens
cttctgtacgtctgacaggca

SEQ ID NO: 3280809 - DNA, 14 bp, Homo sapiens
cttctgtagcttct

SEQ ID NO: 3280810 - DNA, 20 bp, Homo sapiens
cttctgtagcttctaatgtt

SEQ ID NO: 3280811 - DNA, 15 bp, Homo sapiens
cttctgtagtactcc

SEQ ID NO: 3280812 - DNA, 18 bp, Homo sapiens
cttctgtagtactcctta

SEQ ID NO: 3280813 - DNA, 21 bp, Homo sapiens
cttctgtatttctaggcacaa

SEQ ID NO: 3280814 - DNA, 22 bp, Homo sapiens
cttctgtccccagccctgtcct

SEQ ID NO: 3280815 - DNA, 11 bp, Homo sapiens
cttctgtgggc

SEQ ID NO: 3280816 - DNA, 20 bp, Homo sapiens
cttctgtgggcccctcaaca

SEQ ID NO: 3280817 - DNA, 17 bp, Homo sapiens
cttctgtggtccctctg

SEQ ID NO: 3280818 - DNA, 22 bp, Homo sapiens
cttctgtgtatctctttcacat

SEQ ID NO: 3280819 - DNA, 14 bp, Homo sapiens
cttctgttctgcag

SEQ ID NO: 3280820 - DNA, 16 bp, Homo sapiens
cttcttaaaggcctgg

SEQ ID NO: 3280821 - DNA, 17 bp, Homo sapiens
cttcttaattaatttga

SEQ ID NO: 3280822 - DNA, 22 bp, Homo sapiens
cttcttacacttcttaccccag

SEQ ID NO: 3280823 - DNA, 13 bp, Homo sapiens
cttcttacatgca

SEQ ID NO: 3280824 - DNA, 15 bp, Homo sapiens
cttcttacatgcatt

SEQ ID NO: 3280825 - DNA, 15 bp, Homo sapiens
cttcttacccaaagc

SEQ ID NO: 3280826 - DNA, 20 bp, Homo sapiens
cttcttactcattactgcaa

SEQ ID NO: 3280827 - DNA, 13 bp, Homo sapiens
cttcttatacatt

SEQ ID NO: 3280828 - DNA, 16 bp, Homo sapiens
cttcttatacatttga

SEQ ID NO: 3280829 - DNA, 19 bp, Homo sapiens
cttcttatggaattgattt

SEQ ID NO: 3280830 - DNA, 18 bp, Homo sapiens
cttcttcaaatacaaagt

SEQ ID NO: 3280831 - DNA, 14 bp, Homo sapiens
cttcttcacccagc

SEQ ID NO: 3280832 - DNA, 15 bp, Homo sapiens
cttcttcacccagct

SEQ ID NO: 3280833 - DNA, 18 bp, Homo sapiens
cttcttcacccagctaat

SEQ ID NO: 3280834 - DNA, 16 bp, Homo sapiens
cttcttcatattctaa

SEQ ID NO: 3280835 - DNA, 16 bp, Homo sapiens
cttcttcattctatca

SEQ ID NO: 3280836 - DNA, 17 bp, Homo sapiens
cttcttcctaggtccaa

SEQ ID NO: 3280837 - DNA, 14 bp, Homo sapiens
cttcttcctgctgg

SEQ ID NO: 3280838 - DNA, 20 bp, Homo sapiens
cttcttcgcaaactgatgga

SEQ ID NO: 3280839 - DNA, 13 bp, Homo sapiens
cttcttcttcaga

SEQ ID NO: 3280840 - DNA, 12 bp, Homo sapiens
cttcttctttcc

SEQ ID NO: 3280841 - DNA, 16 bp, Homo sapiens
cttcttgaatataaaa

SEQ ID NO: 3280842 - DNA, 20 bp, Homo sapiens
cttcttgcatccttcctata

SEQ ID NO: 3280843 - DNA, 22 bp, Homo sapiens
cttcttgcatccttcctataac

SEQ ID NO: 3280844 - DNA, 15 bp, Homo sapiens
cttcttgcctctgtg

SEQ ID NO: 3280845 - DNA, 17 bp, Homo sapiens
cttcttgcctctgtgct

SEQ ID NO: 3280846 - DNA, 15 bp, Homo sapiens
cttcttggcgctgga

SEQ ID NO: 3280847 - DNA, 23 bp, Homo sapiens
cttcttggcgctggagagtcaaa

SEQ ID NO: 3280848 - DNA, 20 bp, Homo sapiens
cttcttgtcagacataaagc

SEQ ID NO: 3280849 - DNA, 22 bp, Homo sapiens
cttcttgtgattgctgccataa

SEQ ID NO: 3280850 - DNA, 15 bp, Homo sapiens
cttctttcctcttcc

SEQ ID NO: 3280851 - DNA, 14 bp, Homo sapiens
cttctttccttcca

SEQ ID NO: 3280852 - DNA, 23 bp, Homo sapiens
cttctttctctcagccttacatt

SEQ ID NO: 3280853 - DNA, 12 bp, Homo sapiens
ctgtgtggtttg

SEQ ID NO: 3280854 - DNA, 17 bp, Homo sapiens
ctgtgtgtaggctgggg

SEQ ID NO: 3280855 - DNA, 14 bp, Homo sapiens
ctgtgtgtatattg

SEQ ID NO: 3280856 - DNA, 19 bp, Homo sapiens
ctgtgtgtatattgagaat

SEQ ID NO: 3280857 - DNA, 20 bp, Homo sapiens
ctgtgtgtgcgcctacagga

SEQ ID NO: 3280858 - DNA, 12 bp, Homo sapiens
ctgtgtgtgtga

SEQ ID NO: 3280859 - DNA, 18 bp, Homo sapiens
ctgtgtgtgtgaatgaac

SEQ ID NO: 3280860 - DNA, 21 bp, Homo sapiens
ctgtgtgtgtgaatgaacact

SEQ ID NO: 3280861 - DNA, 23 bp, Homo sapiens
ctgtgtgtgtgaatgaacactct

SEQ ID NO: 3280862 - DNA, 23 bp, Homo sapiens
ctgtgttactaaaaaaaagatga

SEQ ID NO: 3280863 - DNA, 13 bp, Homo sapiens
ctgtgttcatttt

SEQ ID NO: 3280864 - DNA, 13 bp, Homo sapiens
ctgtgttcccaga

SEQ ID NO: 3280865 - DNA, 13 bp, Homo sapiens
ctgtgttgaaaca

SEQ ID NO: 3280866 - DNA, 17 bp, Homo sapiens
ctgtgttgaaacagaaa

SEQ ID NO: 3280867 - DNA, 17 bp, Homo sapiens
ctgtgttgccaagctcc

SEQ ID NO: 3280868 - DNA, 18 bp, Homo sapiens
ctgtgttgcgtgtcgtgg

SEQ ID NO: 3280869 - DNA, 14 bp, Homo sapiens
ctgtgttgctgttt

SEQ ID NO: 3280870 - DNA, 21 bp, Homo sapiens
ctgtgttgtattaacaaaagt

SEQ ID NO: 3280871 - DNA, 19 bp, Homo sapiens
ctgtgtttaaaaagtaagt

SEQ ID NO: 3280872 - DNA, 14 bp, Homo sapiens
ctgtgtttaatttg

SEQ ID NO: 3280873 - DNA, 16 bp, Homo sapiens
ctgtgtttacagacag

SEQ ID NO: 3280874 - DNA, 23 bp, Homo sapiens
ctgtgtttccatctcaaagaagg

SEQ ID NO: 3280875 - DNA, 14 bp, Homo sapiens
ctgtgtttgttcct

SEQ ID NO: 3280876 - DNA, 17 bp, Homo sapiens
ctgtgttttgaaagaat

SEQ ID NO: 3280877 - DNA, 11 bp, Homo sapiens
ctgttaaactg

SEQ ID NO: 3280878 - DNA, 15 bp, Homo sapiens
ctgttaaactgttag

SEQ ID NO: 3280879 - DNA, 19 bp, Homo sapiens
ctgttaaactgttagcact

SEQ ID NO: 3280880 - DNA, 19 bp, Homo sapiens
ctgttaaggtggaaaatgg

SEQ ID NO: 3280881 - DNA, 21 bp, Homo sapiens
ctgttaaggtggaaaatggac

SEQ ID NO: 3280882 - DNA, 14 bp, Homo sapiens
ctgttaatgtattt

SEQ ID NO: 3280883 - DNA, 15 bp, Homo sapiens
ctgttaccatgtcac

SEQ ID NO: 3280884 - DNA, 20 bp, Homo sapiens
ctgttaccatgtcactgtgg

SEQ ID NO: 3280885 - DNA, 19 bp, Homo sapiens
ctgttacttacctaaacag

SEQ ID NO: 3280886 - DNA, 15 bp, Homo sapiens
ctgttagaacactat

SEQ ID NO: 3280887 - DNA, 18 bp, Homo sapiens
ctgttagaacactatttt

SEQ ID NO: 3280888 - DNA, 19 bp, Homo sapiens
ctgttagaacactattttc

SEQ ID NO: 3280889 - DNA, 13 bp, Homo sapiens
ctgttagcactgt

SEQ ID NO: 3280890 - DNA, 15 bp, Homo sapiens
ctgttagcactgttg

SEQ ID NO: 3280891 - DNA, 20 bp, Homo sapiens
ctgttagcactgttgatgta

SEQ ID NO: 3280892 - DNA, 13 bp, Homo sapiens
ctgttagtcattt

SEQ ID NO: 3280893 - DNA, 18 bp, Homo sapiens
ctgttagtcatttgctga

SEQ ID NO: 3280894 - DNA, 18 bp, Homo sapiens
ctgttatatcccctgcta

SEQ ID NO: 3280895 - DNA, 14 bp, Homo sapiens
ctgttatgctgtga

SEQ ID NO: 3280896 - DNA, 15 bp, Homo sapiens
ctgttatgtactgta

SEQ ID NO: 3280897 - DNA, 21 bp, Homo sapiens
ctgttatgtactgtactaatt

SEQ ID NO: 3280898 - DNA, 16 bp, Homo sapiens
ctgttatttagactca

SEQ ID NO: 3280899 - DNA, 12 bp, Homo sapiens
ctgttcaatact

SEQ ID NO: 3280900 - DNA, 22 bp, Homo sapiens
ctgttcacaaactacctctgga

SEQ ID NO: 3280901 - DNA, 14 bp, Homo sapiens
ctgttcagatgtgc

SEQ ID NO: 3280902 - DNA, 18 bp, Homo sapiens
ctgttcagatgtgcattt

SEQ ID NO: 3280903 - DNA, 14 bp, Homo sapiens
ctgttcagctccag

SEQ ID NO: 3280904 - DNA, 18 bp, Homo sapiens
ctgttcagctccagctca

SEQ ID NO: 3280905 - DNA, 16 bp, Homo sapiens
ctgttcatgtgcctct

SEQ ID NO: 3280906 - DNA, 18 bp, Homo sapiens
ctgttccaaagccagtga

SEQ ID NO: 3280907 - DNA, 19 bp, Homo sapiens
ctgttccaaagccagtgaa

SEQ ID NO: 3280908 - DNA, 17 bp, Homo sapiens
ctgttccaaattcagtt

SEQ ID NO: 3280909 - DNA, 20 bp, Homo sapiens
ctgttccaaattcagtttca

SEQ ID NO: 3280910 - DNA, 22 bp, Homo sapiens
ctgttccacacccaatgctgct

SEQ ID NO: 3280911 - DNA, 23 bp, Homo sapiens
ctgttccacacccaatgctgctc

SEQ ID NO: 3280912 - DNA, 14 bp, Homo sapiens
ctgttccaggccct

SEQ ID NO: 3280913 - DNA, 16 bp, Homo sapiens
ctgttccaggccctcc

SEQ ID NO: 3280914 - DNA, 14 bp, Homo sapiens
ctgttcccccaccc

SEQ ID NO: 3280915 - DNA, 15 bp, Homo sapiens
ctgttcccccaccct

SEQ ID NO: 3280916 - DNA, 17 bp, Homo sapiens
ctgttcccctcactgga

SEQ ID NO: 3280917 - DNA, 23 bp, Homo sapiens
cgctgagtggggggtcgtgggcc

SEQ ID NO: 3280918 - DNA, 18 bp, Homo sapiens
cgctgatacataactaaa

SEQ ID NO: 3280919 - DNA, 17 bp, Homo sapiens
cgctgccagcacagagc

SEQ ID NO: 3280920 - DNA, 18 bp, Homo sapiens
cgctgccatcaccgctgg

SEQ ID NO: 3280921 - DNA, 15 bp, Homo sapiens
cgctgccgctgccgc

SEQ ID NO: 3280922 - DNA, 19 bp, Homo sapiens
cgctgctccacgcgcttcg

SEQ ID NO: 3280923 - DNA, 12 bp, Homo sapiens
cgctgctccttg

SEQ ID NO: 3280924 - DNA, 18 bp, Homo sapiens
cgtatttatatttggaaa

SEQ ID NO: 3280925 - DNA, 19 bp, Homo sapiens
cgtatttatatttggaaag

SEQ ID NO: 3280926 - DNA, 12 bp, Homo sapiens
cgtattttaaaa

SEQ ID NO: 3280927 - DNA, 22 bp, Homo sapiens
cgtattttaaaagccacataga

SEQ ID NO: 3280928 - DNA, 17 bp, Homo sapiens
cgtcagaagcacccagg

SEQ ID NO: 3280929 - DNA, 20 bp, Homo sapiens
cgtcagggcccaagtccctg

SEQ ID NO: 3280930 - DNA, 16 bp, Homo sapiens
cgtcagggttggtgtg

SEQ ID NO: 3280931 - DNA, 18 bp, Homo sapiens
cgtcagggttggtgtgct

SEQ ID NO: 3280932 - DNA, 19 bp, Homo sapiens
cgtcagggttggtgtgctg

SEQ ID NO: 3280933 - DNA, 17 bp, Homo sapiens
cgtcagtctttttctgt

SEQ ID NO: 3280934 - DNA, 21 bp, Homo sapiens
cgtcattgctgctgctaccag

SEQ ID NO: 3280935 - DNA, 22 bp, Homo sapiens
cgtccacaggggcaggcctggg

SEQ ID NO: 3280936 - DNA, 17 bp, Homo sapiens
cgtccacccaggctgca

SEQ ID NO: 3280937 - DNA, 19 bp, Homo sapiens
cgtccatagctcctctccc

SEQ ID NO: 3280938 - DNA, 23 bp, Homo sapiens
cgtccatcacgttagctgtccca

SEQ ID NO: 3280939 - DNA, 16 bp, Homo sapiens
cgtccatggcaccagc

SEQ ID NO: 3280940 - DNA, 18 bp, Homo sapiens
cgtcccagcatccctgga

SEQ ID NO: 3280941 - DNA, 16 bp, Homo sapiens
cgtccctagcagtgaa

SEQ ID NO: 3280942 - DNA, 14 bp, Homo sapiens
cgtccctgcccaga

SEQ ID NO: 3280943 - DNA, 15 bp, Homo sapiens
cgtccgccctgctcc

SEQ ID NO: 3280944 - DNA, 16 bp, Homo sapiens
cgtcctatctccccca

SEQ ID NO: 3280945 - DNA, 21 bp, Homo sapiens
cgtcctcctcacctcatgccc

SEQ ID NO: 3280946 - DNA, 17 bp, Homo sapiens
cgtcctgacgccctgcg

SEQ ID NO: 3280947 - DNA, 20 bp, Homo sapiens
cgtcctgacgccctgcgttg

SEQ ID NO: 3280948 - DNA, 14 bp, Homo sapiens
cgtcctgcctgtgg

SEQ ID NO: 3280949 - DNA, 15 bp, Homo sapiens
cgtcctgcctgtggc

SEQ ID NO: 3280950 - DNA, 16 bp, Homo sapiens
cgtcctgcctgtggcg

SEQ ID NO: 3280951 - DNA, 23 bp, Homo sapiens
cgtcctgtccacacccagctcag

SEQ ID NO: 3280952 - DNA, 21 bp, Homo sapiens
cgtcggggaggctcctgcctg

SEQ ID NO: 3280953 - DNA, 19 bp, Homo sapiens
cgtcgggggctgaggggca

SEQ ID NO: 3280954 - DNA, 15 bp, Homo sapiens
cgtctagcttagttt

SEQ ID NO: 3280955 - DNA, 23 bp, Homo sapiens
cgtctcaaaaaaaaaaaaatgca

SEQ ID NO: 3280956 - DNA, 18 bp, Homo sapiens
cgtctccctcgacagcgc

SEQ ID NO: 3280957 - DNA, 15 bp, Homo sapiens
cgtctgaagcttgac

SEQ ID NO: 3280958 - DNA, 21 bp, Homo sapiens
cgtctgaagcttgactcccaa

SEQ ID NO: 3280959 - DNA, 13 bp, Homo sapiens
cgtctgacaggca

SEQ ID NO: 3280960 - DNA, 20 bp, Homo sapiens
cgtctgacaggcaatgctgg

SEQ ID NO: 3280961 - DNA, 21 bp, Homo sapiens
cgtctgacaggcaatgctggc

SEQ ID NO: 3280962 - DNA, 22 bp, Homo sapiens
cgtctgacaggcaatgctggct

SEQ ID NO: 3280963 - DNA, 14 bp, Homo sapiens
cgtctgactccaga

SEQ ID NO: 3280964 - DNA, 16 bp, Homo sapiens
cgtctgactccagagt

SEQ ID NO: 3280965 - DNA, 18 bp, Homo sapiens
cgtctgactccagagtct

SEQ ID NO: 3280966 - DNA, 14 bp, Homo sapiens
cgtctgccaggccc

SEQ ID NO: 3280967 - DNA, 18 bp, Homo sapiens
cgtctggaggggcccctg

SEQ ID NO: 3280968 - DNA, 14 bp, Homo sapiens
cgtctggggtgtgg

SEQ ID NO: 3280969 - DNA, 18 bp, Homo sapiens
cgtctgtcttcacagctc

SEQ ID NO: 3280970 - DNA, 13 bp, Homo sapiens
cgtctgtgaatgc

SEQ ID NO: 3280971 - DNA, 14 bp, Homo sapiens
cgtctgtgaatgct

SEQ ID NO: 3280972 - DNA, 17 bp, Homo sapiens
cgtctgtgaatgctaag

SEQ ID NO: 3280973 - DNA, 21 bp, Homo sapiens
cgtctgtgaatgctaagtcca

SEQ ID NO: 3280974 - DNA, 11 bp, Homo sapiens
cgtcttccttc

SEQ ID NO: 3280975 - DNA, 23 bp, Homo sapiens
cgtcttggtgccttttgtgtgat

SEQ ID NO: 3280976 - DNA, 18 bp, Homo sapiens
cgtcttttcctgtttcct

SEQ ID NO: 3280977 - DNA, 16 bp, Homo sapiens
cgtgaaaacggagctg

SEQ ID NO: 3280978 - DNA, 17 bp, Homo sapiens
cgtgaaaacggagctga

SEQ ID NO: 3280979 - DNA, 20 bp, Homo sapiens
cgtgaagcagtgcctcgagg

SEQ ID NO: 3280980 - DNA, 15 bp, Homo sapiens
cgtgacaacacttgt

SEQ ID NO: 3280981 - DNA, 16 bp, Homo sapiens
cgtgacagtgcctggg

SEQ ID NO: 3280982 - DNA, 18 bp, Homo sapiens
cgtgacccttcagggcca

SEQ ID NO: 3280983 - DNA, 20 bp, Homo sapiens
cgtgaccggacttttctgca

SEQ ID NO: 3280984 - DNA, 21 bp, Homo sapiens
cgtgagacgccaccattcctg

SEQ ID NO: 3280985 - DNA, 23 bp, Homo sapiens
cgtgagacgccaccattcctgga

SEQ ID NO: 3280986 - DNA, 14 bp, Homo sapiens
cgtgagagaaagag

SEQ ID NO: 3280987 - DNA, 18 bp, Homo sapiens
cgtgagagaaagagagaa

SEQ ID NO: 3280988 - DNA, 23 bp, Homo sapiens
cgtgagagaaagagagaagccag

SEQ ID NO: 3280989 - DNA, 20 bp, Homo sapiens
cgtgagcaggaaggcctggg

SEQ ID NO: 3280990 - DNA, 20 bp, Homo sapiens
cgtgagccactgcaccgggc

SEQ ID NO: 3280991 - DNA, 21 bp, Homo sapiens
cgtgagcgcctgtgcacacac

SEQ ID NO: 3280992 - DNA, 19 bp, Homo sapiens
cgtgaggggcaagctaggc

SEQ ID NO: 3280993 - DNA, 15 bp, Homo sapiens
cgtgaggtcccagga

SEQ ID NO: 3280994 - DNA, 14 bp, Homo sapiens
cgtgagttctcagg

SEQ ID NO: 3280995 - DNA, 18 bp, Homo sapiens
cgtgagttctcagggctc

SEQ ID NO: 3280996 - DNA, 20 bp, Homo sapiens
cgtgagttctcagggctcct

SEQ ID NO: 3280997 - DNA, 21 bp, Homo sapiens
cgtgagttctcagggctcctg

SEQ ID NO: 3280998 - DNA, 15 bp, Homo sapiens
cgtgatagaaaaaaa

SEQ ID NO: 3280999 - DNA, 18 bp, Homo sapiens
cgtgatccgcctgcctct

SEQ ID NO: 3281000 - DNA, 20 bp, Homo sapiens
cgtgatggagaggacagagc

SEQ ID NO: 3281001 - DNA, 14 bp, Homo sapiens
cgtgcacacaccag

SEQ ID NO: 3281002 - DNA, 18 bp, Homo sapiens
cgtgcacacaccagagcc

SEQ ID NO: 3281003 - DNA, 12 bp, Homo sapiens
cgtgcacagggt

SEQ ID NO: 3281004 - DNA, 17 bp, Homo sapiens
cgtgcacgtggagagct

SEQ ID NO: 3281005 - DNA, 21 bp, Homo sapiens
cgtgcacgtggagagctggtg

SEQ ID NO: 3281006 - DNA, 22 bp, Homo sapiens
cgtgcattagcacagattttaa

SEQ ID NO: 3281007 - DNA, 20 bp, Homo sapiens
cgtgccaaagtctcccttct

SEQ ID NO: 3281008 - DNA, 17 bp, Homo sapiens
cgtgccagctctagttt

SEQ ID NO: 3281009 - DNA, 21 bp, Homo sapiens
cgtgccagtcaagaagaaaaa

SEQ ID NO: 3281010 - DNA, 20 bp, Homo sapiens
cgtgcccccgcctgccaccg

SEQ ID NO: 3281011 - DNA, 16 bp, Homo sapiens
cgtgccgcctgctcct

SEQ ID NO: 3281012 - DNA, 22 bp, Homo sapiens
cgtgccgcctgctcctcactgg

SEQ ID NO: 3281013 - DNA, 14 bp, Homo sapiens
cgtgcctccaccac

SEQ ID NO: 3281014 - DNA, 17 bp, Homo sapiens
cgtgcctccaccaccac

SEQ ID NO: 3281015 - DNA, 12 bp, Homo sapiens
cgtgcctgtgtc

SEQ ID NO: 3281016 - DNA, 15 bp, Homo sapiens
cgtgccttcagctct

SEQ ID NO: 3281017 - DNA, 20 bp, Homo sapiens
cgtgccttttgcacccctcc

SEQ ID NO: 3281018 - DNA, 21 bp, Homo sapiens
cgtgcgcccgtggggtctgcg

SEQ ID NO: 3281019 - DNA, 14 bp, Homo sapiens
cgtgctaaattttc

SEQ ID NO: 3281020 - DNA, 22 bp, Homo sapiens
cgtgctgtcttctggtctgtgt

SEQ ID NO: 3281021 - DNA, 16 bp, Homo sapiens
cgtggaacctctgtct

SEQ ID NO: 3281022 - DNA, 15 bp, Homo sapiens
cgtggacaggcccag

SEQ ID NO: 3281023 - DNA, 16 bp, Homo sapiens
cgtggactctgcacat

SEQ ID NO: 3281024 - DNA, 15 bp, Homo sapiens
cgtggagactggcag

SEQ ID NO: 3281025 - DNA, 16 bp, Homo sapiens
cgtggagactggcagg

SEQ ID NO: 3281026 - DNA, 21 bp, Homo sapiens
cgtggagcggggtatgaagag

SEQ ID NO: 3281027 - DNA, 17 bp, Homo sapiens
cgtggattgcacgtggc

SEQ ID NO: 3281028 - DNA, 14 bp, Homo sapiens
cgtggcaaatataa

SEQ ID NO: 3281029 - DNA, 17 bp, Homo sapiens
cgtggcaaatataaaac

SEQ ID NO: 3281030 - DNA, 22 bp, Homo sapiens
cgtggcagataatcagcctctt

SEQ ID NO: 3281031 - DNA, 11 bp, Homo sapiens
cgtggccagcc

SEQ ID NO: 3281032 - DNA, 13 bp, Homo sapiens
cgtggccagcccg

SEQ ID NO: 3281033 - DNA, 19 bp, Homo sapiens
cgtggccatccctgtgagg

SEQ ID NO: 3281034 - DNA, 18 bp, Homo sapiens
cgtggccccgccctcagg

SEQ ID NO: 3281035 - DNA, 19 bp, Homo sapiens
cgtggccccgccctcaggc

SEQ ID NO: 3281036 - DNA, 15 bp, Homo sapiens
cgtggccctgccctc

SEQ ID NO: 3281037 - DNA, 19 bp, Homo sapiens
cgtggcctcgtgaggggca

SEQ ID NO: 3281038 - DNA, 23 bp, Homo sapiens
cgtggcctcgtgaggggcaagct

SEQ ID NO: 3281039 - DNA, 13 bp, Homo sapiens
cgtggcctgcacc

SEQ ID NO: 3281040 - DNA, 21 bp, Homo sapiens
cgtggccttccccttttgcct

SEQ ID NO: 3281041 - DNA, 23 bp, Homo sapiens
cgtggctgtgctctcaccagctg

SEQ ID NO: 3281042 - DNA, 18 bp, Homo sapiens
cgtggcttcccgctcagc

SEQ ID NO: 3281043 - DNA, 17 bp, Homo sapiens
cgtgggaatttcaatgc

SEQ ID NO: 3281044 - DNA, 19 bp, Homo sapiens
cgtgggacggtgcccaagc

SEQ ID NO: 3281045 - DNA, 20 bp, Homo sapiens
cgtgggacggtgcccaagcc

SEQ ID NO: 3281046 - DNA, 17 bp, Homo sapiens
cgtgggcagtgccaccc

SEQ ID NO: 3281047 - DNA, 18 bp, Homo sapiens
cgtgggccagtccccgag

SEQ ID NO: 3281048 - DNA, 15 bp, Homo sapiens
cgtggggtgtgctgg

SEQ ID NO: 3281049 - DNA, 18 bp, Homo sapiens
ctaaaggggagaaactga

SEQ ID NO: 3281050 - DNA, 19 bp, Homo sapiens
ctaaaggtccacaggtcta

SEQ ID NO: 3281051 - DNA, 20 bp, Homo sapiens
ctaaaggtccacaggtctag

SEQ ID NO: 3281052 - DNA, 19 bp, Homo sapiens
ctaaagtatttttataaat

SEQ ID NO: 3281053 - DNA, 10 bp, Homo sapiens
ctaaagtgtt

SEQ ID NO: 3281054 - DNA, 20 bp, Homo sapiens
ctaaagtgttggtctttcta

SEQ ID NO: 3281055 - DNA, 13 bp, Homo sapiens
ctaaagttctaag

SEQ ID NO: 3281056 - DNA, 18 bp, Homo sapiens
ctaaagttctaagattct

SEQ ID NO: 3281057 - DNA, 16 bp, Homo sapiens
ctaaataatgaataaa

SEQ ID NO: 3281058 - DNA, 23 bp, Homo sapiens
ctaaatactttaaaatttgtcct

SEQ ID NO: 3281059 - DNA, 22 bp, Homo sapiens
ctagaggtgggcagctgggccc

SEQ ID NO: 3281060 - DNA, 20 bp, Homo sapiens
ctagagtccaaggtttaaag

SEQ ID NO: 3281061 - DNA, 19 bp, Homo sapiens
ctagagtcctcactcccag

SEQ ID NO: 3281062 - DNA, 14 bp, Homo sapiens
ctagagtctcagaa

SEQ ID NO: 3281063 - DNA, 20 bp, Homo sapiens
ctagagtctgaacagctgta

SEQ ID NO: 3281064 - DNA, 16 bp, Homo sapiens
ctagataaaaagatgg

SEQ ID NO: 3281065 - DNA, 16 bp, Homo sapiens
ctagatactactttct

SEQ ID NO: 3281066 - DNA, 22 bp, Homo sapiens
ctagatactactttctcttttt

SEQ ID NO: 3281067 - DNA, 14 bp, Homo sapiens
ctagatatcgactt

SEQ ID NO: 3281068 - DNA, 17 bp, Homo sapiens
ctagatcataaggcttc

SEQ ID NO: 3281069 - DNA, 18 bp, Homo sapiens
ctagatcataaggcttca

SEQ ID NO: 3281070 - DNA, 22 bp, Homo sapiens
ctagatcataaggcttcaaaat

SEQ ID NO: 3281071 - DNA, 18 bp, Homo sapiens
ctagatgcatcactgggt

SEQ ID NO: 3281072 - DNA, 22 bp, Homo sapiens
ctagatgtagtattttttgtat

SEQ ID NO: 3281073 - DNA, 16 bp, Homo sapiens
ctagatgtttaacaaa

SEQ ID NO: 3281074 - DNA, 20 bp, Homo sapiens
ctagatgtttaacaaatcta

SEQ ID NO: 3281075 - DNA, 22 bp, Homo sapiens
ctagatgtttattcttctagag

SEQ ID NO: 3281076 - DNA, 23 bp, Homo sapiens
ctagatgtttattcttctagagt

SEQ ID NO: 3281077 - DNA, 16 bp, Homo sapiens
ctagattatatcaaag

SEQ ID NO: 3281078 - DNA, 17 bp, Homo sapiens
ctagattatatcaaagt

SEQ ID NO: 3281079 - DNA, 12 bp, Homo sapiens
ctagattcaaag

SEQ ID NO: 3281080 - DNA, 15 bp, Homo sapiens
ctagattcaaaggtt

SEQ ID NO: 3281081 - DNA, 17 bp, Homo sapiens
ctagattcaaaggttct

SEQ ID NO: 3281082 - DNA, 18 bp, Homo sapiens
ctagattcaaaggttcta

SEQ ID NO: 3281083 - DNA, 20 bp, Homo sapiens
ctagattcaaaggttctagg

SEQ ID NO: 3281084 - DNA, 21 bp, Homo sapiens
ctagattcaaaggttctaggt

SEQ ID NO: 3281085 - DNA, 21 bp, Homo sapiens
ctagattgctaaggagctgat

SEQ ID NO: 3281086 - DNA, 14 bp, Homo sapiens
ctagatttgtcctt

SEQ ID NO: 3281087 - DNA, 13 bp, Homo sapiens
ctaagtctttccc

SEQ ID NO: 3281088 - DNA, 16 bp, Homo sapiens
ctaagtgacatttgta

SEQ ID NO: 3281089 - DNA, 13 bp, Homo sapiens
ctaagtgatataa

SEQ ID NO: 3281090 - DNA, 20 bp, Homo sapiens
ctaagtgatcctcccacctc

SEQ ID NO: 3281091 - DNA, 22 bp, Homo sapiens
ctaagtgatcctcccacctcag

SEQ ID NO: 3281092 - DNA, 23 bp, Homo sapiens
ctaagtgatcctcccacctcagc

SEQ ID NO: 3281093 - DNA, 11 bp, Homo sapiens
ctaagtgccca

SEQ ID NO: 3281094 - DNA, 13 bp, Homo sapiens
ctaagtgcccaaa

SEQ ID NO: 3281095 - DNA, 17 bp, Homo sapiens
ctaagtgcccaaagtgg

SEQ ID NO: 3281096 - DNA, 22 bp, Homo sapiens
ctaagtgcccaaagtggggagg

SEQ ID NO: 3281097 - DNA, 17 bp, Homo sapiens
ctaagtgctaagtgctt

SEQ ID NO: 3281098 - DNA, 21 bp, Homo sapiens
ctaagtgcttattacatttta

SEQ ID NO: 3281099 - DNA, 21 bp, Homo sapiens
ctaagtggattggctttgtgc

SEQ ID NO: 3281100 - DNA, 12 bp, Homo sapiens
ctaagtgggaga

SEQ ID NO: 3281101 - DNA, 23 bp, Homo sapiens
ctaagtgtaaaagtagtaaattt

SEQ ID NO: 3281102 - DNA, 17 bp, Homo sapiens
ctaagttattttatgac

SEQ ID NO: 3281103 - DNA, 18 bp, Homo sapiens
ctaagttcacattagaat

SEQ ID NO: 3281104 - DNA, 17 bp, Homo sapiens
ctaagttctaagttcat

SEQ ID NO: 3281105 - DNA, 21 bp, Homo sapiens
ctaagtttctaagattctaaa

SEQ ID NO: 3281106 - DNA, 10 bp, Homo sapiens
ctaataaaac

SEQ ID NO: 3281107 - DNA, 21 bp, Homo sapiens
ctaataaacactggctctggg

SEQ ID NO: 3281108 - DNA, 15 bp, Homo sapiens
ctaataaactgtatt

SEQ ID NO: 3281109 - DNA, 16 bp, Homo sapiens
ctaataaactgtatta

SEQ ID NO: 3281110 - DNA, 18 bp, Homo sapiens
ctaataaactgtattaaa

SEQ ID NO: 3281111 - DNA, 13 bp, Homo sapiens
ctaataaatacat

SEQ ID NO: 3281112 - DNA, 15 bp, Homo sapiens
ctaataaatacatac

SEQ ID NO: 3281113 - DNA, 21 bp, Homo sapiens
ctaataaatatactatgaaat

SEQ ID NO: 3281114 - DNA, 14 bp, Homo sapiens
ctaataatttctaa

SEQ ID NO: 3281115 - DNA, 17 bp, Homo sapiens
ctaataatttctaatgt

SEQ ID NO: 3281116 - DNA, 18 bp, Homo sapiens
ctaataatttctaatgtt

SEQ ID NO: 3281117 - DNA, 19 bp, Homo sapiens
ctaatacagcaacaattta

SEQ ID NO: 3281118 - DNA, 23 bp, Homo sapiens
ctaatacagcaacaatttatgaa

SEQ ID NO: 3281119 - DNA, 15 bp, Homo sapiens
ctaatacctctgtgt

SEQ ID NO: 3281120 - DNA, 17 bp, Homo sapiens
ctaatactttgtttatt

SEQ ID NO: 3281121 - DNA, 21 bp, Homo sapiens
ctaatagaataaaggcagttt

SEQ ID NO: 3281122 - DNA, 23 bp, Homo sapiens
ctaatagaataaaggcagttttc

SEQ ID NO: 3281123 - DNA, 15 bp, Homo sapiens
ctaatagtttgttga

SEQ ID NO: 3281124 - DNA, 13 bp, Homo sapiens
ctaatatatatga

SEQ ID NO: 3281125 - DNA, 17 bp, Homo sapiens
ctaatatccccaaatta

SEQ ID NO: 3281126 - DNA, 22 bp, Homo sapiens
ctaatatcttaattctttgttc

SEQ ID NO: 3281127 - DNA, 18 bp, Homo sapiens
ctaatattaaaaatatgg

SEQ ID NO: 3281128 - DNA, 16 bp, Homo sapiens
ctaatcaaagccaggg

SEQ ID NO: 3281129 - DNA, 17 bp, Homo sapiens
ctaatcagaaattttta

SEQ ID NO: 3281130 - DNA, 17 bp, Homo sapiens
ctaatcagcattctcac

SEQ ID NO: 3281131 - DNA, 17 bp, Homo sapiens
ctaatcagtgtctcaca

SEQ ID NO: 3281132 - DNA, 21 bp, Homo sapiens
ctaatcagtgtctcacactgg

SEQ ID NO: 3281133 - DNA, 21 bp, Homo sapiens
ctaatcatgtgggtgagccag

SEQ ID NO: 3281134 - DNA, 20 bp, Homo sapiens
ctaatccctgggcattgctt

SEQ ID NO: 3281135 - DNA, 21 bp, Homo sapiens
ctaatccctgggcattgcttt

SEQ ID NO: 3281136 - DNA, 23 bp, Homo sapiens
ctaatccctgggcattgctttcc

SEQ ID NO: 3281137 - DNA, 15 bp, Homo sapiens
ctaatcgaactatga

SEQ ID NO: 3281138 - DNA, 18 bp, Homo sapiens
ctaatctaacaatggaag

SEQ ID NO: 3281139 - DNA, 19 bp, Homo sapiens
ctaatctagatatcgactt

SEQ ID NO: 3281140 - DNA, 14 bp, Homo sapiens
ctaatctattgggt

SEQ ID NO: 3281141 - DNA, 17 bp, Homo sapiens
ctaatctattgggttca

SEQ ID NO: 3281142 - DNA, 18 bp, Homo sapiens
ctaatctattgggttcat

SEQ ID NO: 3281143 - DNA, 18 bp, Homo sapiens
ctaatctcatacctctga

SEQ ID NO: 3281144 - DNA, 16 bp, Homo sapiens
ctaatctcttattcta

SEQ ID NO: 3281145 - DNA, 13 bp, Homo sapiens
ctaatctgtaggg

SEQ ID NO: 3281146 - DNA, 21 bp, Homo sapiens
ctaatctgtagggctggacct

SEQ ID NO: 3281147 - DNA, 19 bp, Homo sapiens
ctaatctttcacttgaaag

SEQ ID NO: 3281148 - DNA, 22 bp, Homo sapiens
ctaatctttcacttgaaagatt

SEQ ID NO: 3281149 - DNA, 17 bp, Homo sapiens
ctaatgagggtgtgaga

SEQ ID NO: 3281150 - DNA, 17 bp, Homo sapiens
ctaatgagtatttggta

SEQ ID NO: 3281151 - DNA, 13 bp, Homo sapiens
ctaatgatgtttt

SEQ ID NO: 3281152 - DNA, 15 bp, Homo sapiens
ctaatgcttgattta

SEQ ID NO: 3281153 - DNA, 19 bp, Homo sapiens
ctaatgtaataactgtgaa

SEQ ID NO: 3281154 - DNA, 18 bp, Homo sapiens
ctaatgtagctatttttc

SEQ ID NO: 3281155 - DNA, 21 bp, Homo sapiens
ctaatgtctcactgttctgca

SEQ ID NO: 3281156 - DNA, 13 bp, Homo sapiens
ctaatgtcttcat

SEQ ID NO: 3281157 - DNA, 15 bp, Homo sapiens
ctaatgtcttcataa

SEQ ID NO: 3281158 - DNA, 17 bp, Homo sapiens
ctaatgtcttcataaag

SEQ ID NO: 3281159 - DNA, 19 bp, Homo sapiens
ctaatgtcttcatttcatt

SEQ ID NO: 3281160 - DNA, 15 bp, Homo sapiens
ctaattaatatatta

SEQ ID NO: 3281161 - DNA, 20 bp, Homo sapiens
ctaattagggtacatttata

SEQ ID NO: 3281162 - DNA, 16 bp, Homo sapiens
ctaattatactacttt

SEQ ID NO: 3281163 - DNA, 21 bp, Homo sapiens
ctaattatactactttgttag

SEQ ID NO: 3281164 - DNA, 15 bp, Homo sapiens
ctaattcacagtgct

SEQ ID NO: 3281165 - DNA, 17 bp, Homo sapiens
ctaattccacacctttt

SEQ ID NO: 3281166 - DNA, 17 bp, Homo sapiens
ctaattcccattttgca

SEQ ID NO: 3281167 - DNA, 20 bp, Homo sapiens
ctaattcccattttgcaaaa

SEQ ID NO: 3281168 - DNA, 21 bp, Homo sapiens
ctaattgacttgcaaagacct

SEQ ID NO: 3281169 - DNA, 15 bp, Homo sapiens
ctaattggaaagtgc

SEQ ID NO: 3281170 - DNA, 16 bp, Homo sapiens
ctaattggaaagtgcc

SEQ ID NO: 3281171 - DNA, 22 bp, Homo sapiens
ctaattggaaagtgccagcatt

SEQ ID NO: 3281172 - DNA, 12 bp, Homo sapiens
ctaatttaaaaa

SEQ ID NO: 3281173 - DNA, 14 bp, Homo sapiens
ctaatttaaagaga

SEQ ID NO: 3281174 - DNA, 11 bp, Homo sapiens
ctaatttaaca

SEQ ID NO: 3281175 - DNA, 17 bp, Homo sapiens
ctaatttataaaaaggt

SEQ ID NO: 3281176 - DNA, 22 bp, Homo sapiens
ctaatttatagcaagatattga

SEQ ID NO: 3281177 - DNA, 15 bp, Homo sapiens
ctaatttatgtgcta

SEQ ID NO: 3281178 - DNA, 17 bp, Homo sapiens
ctaatttcaaaatgctt

SEQ ID NO: 3281179 - DNA, 11 bp, Homo sapiens
ctaatttcata

SEQ ID NO: 3281180 - DNA, 13 bp, Homo sapiens
ctaatttgcatta

SEQ ID NO: 3281181 - DNA, 14 bp, Homo sapiens
ctaatttgcattaa

SEQ ID NO: 3281182 - DNA, 19 bp, Homo sapiens
ctaatttgcattaaattca

SEQ ID NO: 3281183 - DNA, 22 bp, Homo sapiens
ctaatttgtaggaaaaagcaag

SEQ ID NO: 3281184 - DNA, 17 bp, Homo sapiens
ctaatttttaagcaaaa

SEQ ID NO: 3281185 - DNA, 14 bp, Homo sapiens
ctaatttttgtaat

SEQ ID NO: 3281186 - DNA, 19 bp, Homo sapiens
ctaatttttgtattatttt

SEQ ID NO: 3281187 - DNA, 17 bp, Homo sapiens
ctacaaaaaggtataaa

SEQ ID NO: 3281188 - DNA, 20 bp, Homo sapiens
ctacaaaacctgatgttaaa

SEQ ID NO: 3281189 - DNA, 18 bp, Homo sapiens
ctacaaaatttgaaattt

SEQ ID NO: 3281190 - DNA, 20 bp, Homo sapiens
ctacaaagcactagagaatg

SEQ ID NO: 3281191 - DNA, 17 bp, Homo sapiens
ctacaaagctttgctac

SEQ ID NO: 3281192 - DNA, 10 bp, Homo sapiens
ctacaaatca

SEQ ID NO: 3281193 - DNA, 18 bp, Homo sapiens
ctacaaatttatgcattt

SEQ ID NO: 3281194 - DNA, 16 bp, Homo sapiens
ctacaacaagagttta

SEQ ID NO: 3281195 - DNA, 16 bp, Homo sapiens
ctacaacttaatggaa

SEQ ID NO: 3281196 - DNA, 14 bp, Homo sapiens
ctacaacttcagca

SEQ ID NO: 3281197 - DNA, 16 bp, Homo sapiens
ctacaacttcagcagt

SEQ ID NO: 3281198 - DNA, 19 bp, Homo sapiens
ctacctgctggacagcctc

SEQ ID NO: 3281199 - DNA, 12 bp, Homo sapiens
ctacctgtgcct

SEQ ID NO: 3281200 - DNA, 13 bp, Homo sapiens
ctacctgtgcctg

SEQ ID NO: 3281201 - DNA, 18 bp, Homo sapiens
ctacctgtgtggtactct

SEQ ID NO: 3281202 - DNA, 14 bp, Homo sapiens
ctaccttgaaaata

SEQ ID NO: 3281203 - DNA, 23 bp, Homo sapiens
ctacctttatatttggggtcctt

SEQ ID NO: 3281204 - DNA, 19 bp, Homo sapiens
ctacgcgatagtctctgtt

SEQ ID NO: 3281205 - DNA, 16 bp, Homo sapiens
ctacgctgtccagaaa

SEQ ID NO: 3281206 - DNA, 14 bp, Homo sapiens
ctactaaaaatgca

SEQ ID NO: 3281207 - DNA, 17 bp, Homo sapiens
ctactaatagaataaag

SEQ ID NO: 3281208 - DNA, 14 bp, Homo sapiens
ctactaatagtttg

SEQ ID NO: 3281209 - DNA, 15 bp, Homo sapiens
ctactaatagtttgt

SEQ ID NO: 3281210 - DNA, 13 bp, Homo sapiens
ctactaatgatgt

SEQ ID NO: 3281211 - DNA, 12 bp, Homo sapiens
ctactaattcca

SEQ ID NO: 3281212 - DNA, 17 bp, Homo sapiens
ctactaccacaaggaaa

SEQ ID NO: 3281213 - DNA, 11 bp, Homo sapiens
ctactacctct

SEQ ID NO: 3281214 - DNA, 18 bp, Homo sapiens
ctactaggagaggggggc

SEQ ID NO: 3281215 - DNA, 15 bp, Homo sapiens
ctactataaagagaa

SEQ ID NO: 3281216 - DNA, 12 bp, Homo sapiens
ctactataatca

SEQ ID NO: 3281217 - DNA, 16 bp, Homo sapiens
ctactataatcaaatg

SEQ ID NO: 3281218 - DNA, 19 bp, Homo sapiens
ctactatatacatatatat

SEQ ID NO: 3281219 - DNA, 20 bp, Homo sapiens
ctactatgtgctgggtgcct

SEQ ID NO: 3281220 - DNA, 17 bp, Homo sapiens
ctactcacagtctcttt

SEQ ID NO: 3281221 - DNA, 20 bp, Homo sapiens
ctactcaggaggctgaggca

SEQ ID NO: 3281222 - DNA, 14 bp, Homo sapiens
ctactcagttatta

SEQ ID NO: 3281223 - DNA, 13 bp, Homo sapiens
ctactccactgcc

SEQ ID NO: 3281224 - DNA, 22 bp, Homo sapiens
ctagtgagcaaaatatgcccct

SEQ ID NO: 3281225 - DNA, 14 bp, Homo sapiens
ctagtgagctgggc

SEQ ID NO: 3281226 - DNA, 23 bp, Homo sapiens
ctagtgagtgtgctgacttttta

SEQ ID NO: 3281227 - DNA, 13 bp, Homo sapiens
ctagtgcagctga

SEQ ID NO: 3281228 - DNA, 15 bp, Homo sapiens
ctagtgcagctgatt

SEQ ID NO: 3281229 - DNA, 13 bp, Homo sapiens
ctagtgcatttca

SEQ ID NO: 3281230 - DNA, 15 bp, Homo sapiens
ctagtggatgactgt

SEQ ID NO: 3281231 - DNA, 22 bp, Homo sapiens
ctagtggcaataagttccatgt

SEQ ID NO: 3281232 - DNA, 13 bp, Homo sapiens
ctagtgggacagc

SEQ ID NO: 3281233 - DNA, 22 bp, Homo sapiens
ctagtgggacagcccagagcct

SEQ ID NO: 3281234 - DNA, 20 bp, Homo sapiens
ctagtgggccctctctctgg

SEQ ID NO: 3281235 - DNA, 18 bp, Homo sapiens
ctagtgtgagtggcagcc

SEQ ID NO: 3281236 - DNA, 20 bp, Homo sapiens
ctagtgtgagtggcagccat

SEQ ID NO: 3281237 - DNA, 21 bp, Homo sapiens
ctagtgtgagtggcagccatg

SEQ ID NO: 3281238 - DNA, 22 bp, Homo sapiens
ctagtgtgagtggcagccatgc

SEQ ID NO: 3281239 - DNA, 23 bp, Homo sapiens
ctagtgtgagtggcagccatgcc

SEQ ID NO: 3281240 - DNA, 14 bp, Homo sapiens
ctagtgtggtgtgt

SEQ ID NO: 3281241 - DNA, 16 bp, Homo sapiens
ctagtgtggtgtgttt

SEQ ID NO: 3281242 - DNA, 13 bp, Homo sapiens
ctagtgttctgtc

SEQ ID NO: 3281243 - DNA, 15 bp, Homo sapiens
ctagtgttctgtcta

SEQ ID NO: 3281244 - DNA, 23 bp, Homo sapiens
ctagttatacttatttgtatatg

SEQ ID NO: 3281245 - DNA, 19 bp, Homo sapiens
ctagttcatccaatcctca

SEQ ID NO: 3281246 - DNA, 20 bp, Homo sapiens
ctagttcatccaatcctcac

SEQ ID NO: 3281247 - DNA, 22 bp, Homo sapiens
ctagttcatccaatcctcactg

SEQ ID NO: 3281248 - DNA, 18 bp, Homo sapiens
ctagttccctctgctcag

SEQ ID NO: 3281249 - DNA, 20 bp, Homo sapiens
ctagttccctctgctcagcc

SEQ ID NO: 3281250 - DNA, 22 bp, Homo sapiens
ctagttccctctgctcagccaa

SEQ ID NO: 3281251 - DNA, 16 bp, Homo sapiens
ctagttctaacagtga

SEQ ID NO: 3281252 - DNA, 16 bp, Homo sapiens
ctagttctcttatctt

SEQ ID NO: 3281253 - DNA, 15 bp, Homo sapiens
ctagttctttcctcc

SEQ ID NO: 3281254 - DNA, 16 bp, Homo sapiens
ctagttctttcctccc

SEQ ID NO: 3281255 - DNA, 22 bp, Homo sapiens
ctagttctttcctccccctgca

SEQ ID NO: 3281256 - DNA, 22 bp, Homo sapiens
ctagttctttgttcatagccca

SEQ ID NO: 3281257 - DNA, 14 bp, Homo sapiens
ctagtttattttgt

SEQ ID NO: 3281258 - DNA, 16 bp, Homo sapiens
ctagtttcagtaaata

SEQ ID NO: 3281259 - DNA, 17 bp, Homo sapiens
ctagtttgattattatg

SEQ ID NO: 3281260 - DNA, 21 bp, Homo sapiens
ctagttttacagattgcctcc

SEQ ID NO: 3281261 - DNA, 20 bp, Homo sapiens
ctagttttagttttctctta

SEQ ID NO: 3281262 - DNA, 14 bp, Homo sapiens
ctagtttttagtaa

SEQ ID NO: 3281263 - DNA, 17 bp, Homo sapiens
ctagttttttttctagt

SEQ ID NO: 3281264 - DNA, 18 bp, Homo sapiens
ctagttttttttgtaaac

SEQ ID NO: 3281265 - DNA, 12 bp, Homo sapiens
ctataaacatta

SEQ ID NO: 3281266 - DNA, 13 bp, Homo sapiens
ctataaagagaag

SEQ ID NO: 3281267 - DNA, 17 bp, Homo sapiens
ctataaagtaaagctaa

SEQ ID NO: 3281268 - DNA, 17 bp, Homo sapiens
ctataaatcagtatttt

SEQ ID NO: 3281269 - DNA, 23 bp, Homo sapiens
ctataaatggtgtttttttaata

SEQ ID NO: 3281270 - DNA, 14 bp, Homo sapiens
ctataaatgttgct

SEQ ID NO: 3281271 - DNA, 19 bp, Homo sapiens
ctataaattttttgaaaca

SEQ ID NO: 3281272 - DNA, 19 bp, Homo sapiens
ctataacttcttcctgctg

SEQ ID NO: 3281273 - DNA, 20 bp, Homo sapiens
ctataacttcttcctgctgg

SEQ ID NO: 3281274 - DNA, 17 bp, Homo sapiens
ctataacttgatgcatg

SEQ ID NO: 3281275 - DNA, 22 bp, Homo sapiens
ctataacttgatgcatgtggtt

SEQ ID NO: 3281276 - DNA, 21 bp, Homo sapiens
ctataagaggaatttcttttc

SEQ ID NO: 3281277 - DNA, 19 bp, Homo sapiens
ctataagcttaaataggaa

SEQ ID NO: 3281278 - DNA, 22 bp, Homo sapiens
ctataagtagttggtttgtatg

SEQ ID NO: 3281279 - DNA, 13 bp, Homo sapiens
ctataatcaaatg

SEQ ID NO: 3281280 - DNA, 15 bp, Homo sapiens
ctataatcaaatgat

SEQ ID NO: 3281281 - DNA, 18 bp, Homo sapiens
ctataatcaaatgatttc

SEQ ID NO: 3281282 - DNA, 21 bp, Homo sapiens
ctataatcaaatgatttcata

SEQ ID NO: 3281283 - DNA, 21 bp, Homo sapiens
ctataatcattagttttagag

SEQ ID NO: 3281284 - DNA, 21 bp, Homo sapiens
ctataatctgtcaaaacactg

SEQ ID NO: 3281285 - DNA, 15 bp, Homo sapiens
ctataatcttataca

SEQ ID NO: 3281286 - DNA, 19 bp, Homo sapiens
ctataatgaagctttatac

SEQ ID NO: 3281287 - DNA, 15 bp, Homo sapiens
ctataattttgcctt

SEQ ID NO: 3281288 - DNA, 21 bp, Homo sapiens
ctatacaaattttcagaaggt

SEQ ID NO: 3281289 - DNA, 15 bp, Homo sapiens
ctatacacaagcaat

SEQ ID NO: 3281290 - DNA, 15 bp, Homo sapiens
ctatacacacacaca

SEQ ID NO: 3281291 - DNA, 16 bp, Homo sapiens
ctatacacaccctgcc

SEQ ID NO: 3281292 - DNA, 17 bp, Homo sapiens
ctatacacaccctgccc

SEQ ID NO: 3281293 - DNA, 13 bp, Homo sapiens
ctatactggaaat

SEQ ID NO: 3281294 - DNA, 12 bp, Homo sapiens
ctatagagaaaa

SEQ ID NO: 3281295 - DNA, 14 bp, Homo sapiens
ctatagagaggggg

SEQ ID NO: 3281296 - DNA, 13 bp, Homo sapiens
ctatagttctaga

SEQ ID NO: 3281297 - DNA, 19 bp, Homo sapiens
ctatagtttaaaacacatt

SEQ ID NO: 3281298 - DNA, 15 bp, Homo sapiens
ctatataaaatgtat

SEQ ID NO: 3281299 - DNA, 17 bp, Homo sapiens
ctatataaaatgtattc

SEQ ID NO: 3281300 - DNA, 14 bp, Homo sapiens
ctatataatttatt

SEQ ID NO: 3281301 - DNA, 11 bp, Homo sapiens
ctatatacatg

SEQ ID NO: 3281302 - DNA, 13 bp, Homo sapiens
ctatatataattc

SEQ ID NO: 3281303 - DNA, 19 bp, Homo sapiens
ctatatataattctgtaca

SEQ ID NO: 3281304 - DNA, 15 bp, Homo sapiens
ctatatatataaata

SEQ ID NO: 3281305 - DNA, 18 bp, Homo sapiens
ctatatatataaatgtat

SEQ ID NO: 3281306 - DNA, 14 bp, Homo sapiens
ctatatccatgtac

SEQ ID NO: 3281307 - DNA, 15 bp, Homo sapiens
ctatatccatgtact

SEQ ID NO: 3281308 - DNA, 19 bp, Homo sapiens
ctatatccatgtactgtag

SEQ ID NO: 3281309 - DNA, 15 bp, Homo sapiens
ctatatcctgtgact

SEQ ID NO: 3281310 - DNA, 20 bp, Homo sapiens
ctatatgaatttaaatataa

SEQ ID NO: 3281311 - DNA, 18 bp, Homo sapiens
ctatatgatttatagttt

SEQ ID NO: 3281312 - DNA, 19 bp, Homo sapiens
ctatatgatttatagtttg

SEQ ID NO: 3281313 - DNA, 18 bp, Homo sapiens
ctatatgtgaatcctctt

SEQ ID NO: 3281314 - DNA, 12 bp, Homo sapiens
ctatattatgtc

SEQ ID NO: 3281315 - DNA, 15 bp, Homo sapiens
ctatatttacagtga

SEQ ID NO: 3281316 - DNA, 16 bp, Homo sapiens
ctcactttaaacctgt

SEQ ID NO: 3281317 - DNA, 21 bp, Homo sapiens
ctcacttttcatccttcccca

SEQ ID NO: 3281318 - DNA, 21 bp, Homo sapiens
ctcactttttacccagaacag

SEQ ID NO: 3281319 - DNA, 22 bp, Homo sapiens
ctcagaaaagaaaaccatttta

SEQ ID NO: 3281320 - DNA, 19 bp, Homo sapiens
ctcagaaactcccctgggg

SEQ ID NO: 3281321 - DNA, 10 bp, Homo sapiens
ctcagaaagt

SEQ ID NO: 3281322 - DNA, 17 bp, Homo sapiens
ctcagaaagtcaccagg

SEQ ID NO: 3281323 - DNA, 17 bp, Homo sapiens
ctcagaaatttttattt

SEQ ID NO: 3281324 - DNA, 14 bp, Homo sapiens
ctcagaacccaggg

SEQ ID NO: 3281325 - DNA, 17 bp, Homo sapiens
ctcagaacccagggctc

SEQ ID NO: 3281326 - DNA, 13 bp, Homo sapiens
ctcagaagacact

SEQ ID NO: 3281327 - DNA, 13 bp, Homo sapiens
ctcagaagcctga

SEQ ID NO: 3281328 - DNA, 14 bp, Homo sapiens
ctcagaagcctgag

SEQ ID NO: 3281329 - DNA, 18 bp, Homo sapiens
ctcagaagcctgaggctg

SEQ ID NO: 3281330 - DNA, 14 bp, Homo sapiens
ctcagaaggccgag

SEQ ID NO: 3281331 - DNA, 22 bp, Homo sapiens
ctcagaagtgaaaatcttggag

SEQ ID NO: 3281332 - DNA, 23 bp, Homo sapiens
ctcagaatttatctcccttagaa

SEQ ID NO: 3281333 - DNA, 14 bp, Homo sapiens
ctcagaccccaggt

SEQ ID NO: 3281334 - DNA, 18 bp, Homo sapiens
ctcagaccccaggtcagc

SEQ ID NO: 3281335 - DNA, 18 bp, Homo sapiens
ctcagacggcggccaggc

SEQ ID NO: 3281336 - DNA, 19 bp, Homo sapiens
ctcagacggcggccaggca

SEQ ID NO: 3281337 - DNA, 20 bp, Homo sapiens
ctcagacggcggccaggcac

SEQ ID NO: 3281338 - DNA, 16 bp, Homo sapiens
ctcagacttaccagga

SEQ ID NO: 3281339 - DNA, 13 bp, Homo sapiens
ctcagagcatctg

SEQ ID NO: 3281340 - DNA, 14 bp, Homo sapiens
ctcagagcatctgg

SEQ ID NO: 3281341 - DNA, 16 bp, Homo sapiens
ctcagagcatctggct

SEQ ID NO: 3281342 - DNA, 18 bp, Homo sapiens
ctcagagcatctggctgt

SEQ ID NO: 3281343 - DNA, 11 bp, Homo sapiens
ctcagagccaa

SEQ ID NO: 3281344 - DNA, 13 bp, Homo sapiens
ctcagagccctca

SEQ ID NO: 3281345 - DNA, 22 bp, Homo sapiens
ctcagagccctcaactattctg

SEQ ID NO: 3281346 - DNA, 23 bp, Homo sapiens
ctcagagccctcaactattctgt

SEQ ID NO: 3281347 - DNA, 18 bp, Homo sapiens
ctcagagccctgccctgc

SEQ ID NO: 3281348 - DNA, 17 bp, Homo sapiens
ctcagagcttgaagatt

SEQ ID NO: 3281349 - DNA, 19 bp, Homo sapiens
ctcagaggagctctaccct

SEQ ID NO: 3281350 - DNA, 13 bp, Homo sapiens
ctcagaggcctgc

SEQ ID NO: 3281351 - DNA, 22 bp, Homo sapiens
ctcagaggcctgctgccagtgc

SEQ ID NO: 3281352 - DNA, 21 bp, Homo sapiens
ctcagagggtagccttgattt

SEQ ID NO: 3281353 - DNA, 22 bp, Homo sapiens
ctcagatataagagaagtctca

SEQ ID NO: 3281354 - DNA, 21 bp, Homo sapiens
ctcagatatcatactgatttt

SEQ ID NO: 3281355 - DNA, 14 bp, Homo sapiens
ctcagatatttata

SEQ ID NO: 3281356 - DNA, 17 bp, Homo sapiens
ctcagatgatctctcca

SEQ ID NO: 3281357 - DNA, 13 bp, Homo sapiens
ctcagatggggca

SEQ ID NO: 3281358 - DNA, 16 bp, Homo sapiens
ctcagatggggcacca

SEQ ID NO: 3281359 - DNA, 14 bp, Homo sapiens
ctcagatgttaaaa

SEQ ID NO: 3281360 - DNA, 19 bp, Homo sapiens
ctcagatgttaaaataaat

SEQ ID NO: 3281361 - DNA, 15 bp, Homo sapiens
ctcagattatttaaa

SEQ ID NO: 3281362 - DNA, 17 bp, Homo sapiens
ctcagcacagagatggg

SEQ ID NO: 3281363 - DNA, 13 bp, Homo sapiens
ctcagcacccctt

SEQ ID NO: 3281364 - DNA, 15 bp, Homo sapiens
ctcagcaccccttcc

SEQ ID NO: 3281365 - DNA, 18 bp, Homo sapiens
ctcagcagttgacatcca

SEQ ID NO: 3281366 - DNA, 22 bp, Homo sapiens
ctccaataaagtgccttctggg

SEQ ID NO: 3281367 - DNA, 22 bp, Homo sapiens
ctccaatcccaccaaccctcag

SEQ ID NO: 3281368 - DNA, 13 bp, Homo sapiens
ctccaatctggta

SEQ ID NO: 3281369 - DNA, 20 bp, Homo sapiens
ctccaatgtctgctgaggag

SEQ ID NO: 3281370 - DNA, 14 bp, Homo sapiens
ctccacacctccac

SEQ ID NO: 3281371 - DNA, 18 bp, Homo sapiens
ctccacagataccagacc

SEQ ID NO: 3281372 - DNA, 13 bp, Homo sapiens
ctccacagcgagg

SEQ ID NO: 3281373 - DNA, 20 bp, Homo sapiens
ctccacagcgagggcagctg

SEQ ID NO: 3281374 - DNA, 22 bp, Homo sapiens
ctccacagcgagggcagctgct

SEQ ID NO: 3281375 - DNA, 12 bp, Homo sapiens
ctccacagtgct

SEQ ID NO: 3281376 - DNA, 14 bp, Homo sapiens
ctccacagtgctgc

SEQ ID NO: 3281377 - DNA, 16 bp, Homo sapiens
ctccacagtgctgctt

SEQ ID NO: 3281378 - DNA, 15 bp, Homo sapiens
ctccacagttcagtg

SEQ ID NO: 3281379 - DNA, 17 bp, Homo sapiens
ctccacagttcagtggc

SEQ ID NO: 3281380 - DNA, 13 bp, Homo sapiens
ctccacatctgcc

SEQ ID NO: 3281381 - DNA, 18 bp, Homo sapiens
ctccaccacatctgccag

SEQ ID NO: 3281382 - DNA, 12 bp, Homo sapiens
ctccaccaccac

SEQ ID NO: 3281383 - DNA, 17 bp, Homo sapiens
ctccaccaccactggcc

SEQ ID NO: 3281384 - DNA, 11 bp, Homo sapiens
ctccacccagc

SEQ ID NO: 3281385 - DNA, 12 bp, Homo sapiens
ctccacccagcc

SEQ ID NO: 3281386 - DNA, 17 bp, Homo sapiens
ctccacccagcccctgg

SEQ ID NO: 3281387 - DNA, 22 bp, Homo sapiens
ctccacccgttcccactgccct

SEQ ID NO: 3281388 - DNA, 14 bp, Homo sapiens
ctccaccctccacc

SEQ ID NO: 3281389 - DNA, 16 bp, Homo sapiens
ctccaccctcccccag

SEQ ID NO: 3281390 - DNA, 14 bp, Homo sapiens
ctccaccctgtccc

SEQ ID NO: 3281391 - DNA, 15 bp, Homo sapiens
ctccaccctgtcccc

SEQ ID NO: 3281392 - DNA, 17 bp, Homo sapiens
ctccaccctgtccccca

SEQ ID NO: 3281393 - DNA, 23 bp, Homo sapiens
ctccaccctgtcccccagctctg

SEQ ID NO: 3281394 - DNA, 19 bp, Homo sapiens
ctccaccgttcaagcgcca

SEQ ID NO: 3281395 - DNA, 20 bp, Homo sapiens
ctccaccgttcaagcgccag

SEQ ID NO: 3281396 - DNA, 12 bp, Homo sapiens
ctccaccttcca

SEQ ID NO: 3281397 - DNA, 14 bp, Homo sapiens
ctccaccttcccac

SEQ ID NO: 3281398 - DNA, 20 bp, Homo sapiens
ctccacgatcctgccaccct

SEQ ID NO: 3281399 - DNA, 15 bp, Homo sapiens
ctccacgcctcctgg

SEQ ID NO: 3281400 - DNA, 18 bp, Homo sapiens
ctccacgcctcctggcca

SEQ ID NO: 3281401 - DNA, 13 bp, Homo sapiens
ctccacggagagc

SEQ ID NO: 3281402 - DNA, 17 bp, Homo sapiens
ctccacggtgcgtggct

SEQ ID NO: 3281403 - DNA, 19 bp, Homo sapiens
ctccacggtgcgtggctgt

SEQ ID NO: 3281404 - DNA, 22 bp, Homo sapiens
ctccacggtgcgtggctgtggc

SEQ ID NO: 3281405 - DNA, 21 bp, Homo sapiens
ctccacgtgatttccagtgag

SEQ ID NO: 3281406 - DNA, 14 bp, Homo sapiens
ctccactcagctgt

SEQ ID NO: 3281407 - DNA, 13 bp, Homo sapiens
ctccactccccca

SEQ ID NO: 3281408 - DNA, 20 bp, Homo sapiens
ctccactctccttcgtgtct

SEQ ID NO: 3281409 - DNA, 21 bp, Homo sapiens
ctccactctccttcgtgtctc

SEQ ID NO: 3281410 - DNA, 12 bp, Homo sapiens
ctccactctgct

SEQ ID NO: 3281411 - DNA, 13 bp, Homo sapiens
ctccactctgctt

SEQ ID NO: 3281412 - DNA, 11 bp, Homo sapiens
ctccactgcct

SEQ ID NO: 3281413 - DNA, 15 bp, Homo sapiens
ctccactggacagac

SEQ ID NO: 3281414 - DNA, 16 bp, Homo sapiens
ctccactggacagacc

SEQ ID NO: 3281415 - DNA, 18 bp, Homo sapiens
ctccactggacagaccca

SEQ ID NO: 3281416 - DNA, 21 bp, Homo sapiens
ctccactggacagacccaggt

SEQ ID NO: 3281417 - DNA, 14 bp, Homo sapiens
ctccactggatgga

SEQ ID NO: 3281418 - DNA, 17 bp, Homo sapiens
ctccactggggaatgct

SEQ ID NO: 3281419 - DNA, 24 bp, Homo sapiens
ctccactggggaatgctcccagct

SEQ ID NO: 3281420 - DNA, 9 bp, Homo sapiens
ctccactgt

SEQ ID NO: 3281421 - DNA, 22 bp, Homo sapiens
ctccactgtgcctttgcaaatc

SEQ ID NO: 3281422 - DNA, 23 bp, Homo sapiens
ctccactgtgcctttgcaaatca

SEQ ID NO: 3281423 - DNA, 17 bp, Homo sapiens
ctccacttggtctgtga

SEQ ID NO: 3281424 - DNA, 21 bp, Homo sapiens
ctccacttggtctgtgagatg

SEQ ID NO: 3281425 - DNA, 22 bp, Homo sapiens
ctccacttggtctgtgagatgc

SEQ ID NO: 3281426 - DNA, 14 bp, Homo sapiens
ctccagaagcctct

SEQ ID NO: 3281427 - DNA, 19 bp, Homo sapiens
ctccagaagcctctggcta

SEQ ID NO: 3281428 - DNA, 15 bp, Homo sapiens
ctccagaatctgctg

SEQ ID NO: 3281429 - DNA, 17 bp, Homo sapiens
ctccagaatctgctgtt

SEQ ID NO: 3281430 - DNA, 20 bp, Homo sapiens
ctccagaatctgctgttgcc

SEQ ID NO: 3281431 - DNA, 14 bp, Homo sapiens
ctcaggcctccagc

SEQ ID NO: 3281432 - DNA, 17 bp, Homo sapiens
ctcaggcgcctggcaca

SEQ ID NO: 3281433 - DNA, 22 bp, Homo sapiens
ctcaggcgcctggcacatttca

SEQ ID NO: 3281434 - DNA, 11 bp, Homo sapiens
ctcaggctctg

SEQ ID NO: 3281435 - DNA, 13 bp, Homo sapiens
ctcaggctctgct

SEQ ID NO: 3281436 - DNA, 17 bp, Homo sapiens
ctcaggcttccttggca

SEQ ID NO: 3281437 - DNA, 15 bp, Homo sapiens
ctcagggacagagcc

SEQ ID NO: 3281438 - DNA, 18 bp, Homo sapiens
ctcagggacagagccatg

SEQ ID NO: 3281439 - DNA, 19 bp, Homo sapiens
ctcagggacagagccatgc

SEQ ID NO: 3281440 - DNA, 20 bp, Homo sapiens
ctcagggaccggtgctgcag

SEQ ID NO: 3281441 - DNA, 22 bp, Homo sapiens
ctcagggaccggtgctgcagga

SEQ ID NO: 3281442 - DNA, 14 bp, Homo sapiens
ctcagggcacgcag

SEQ ID NO: 3281443 - DNA, 14 bp, Homo sapiens
ctcagggccaggaa

SEQ ID NO: 3281444 - DNA, 15 bp, Homo sapiens
ctcagggccaggaag

SEQ ID NO: 3281445 - DNA, 17 bp, Homo sapiens
ctcagggcctggcaggc

SEQ ID NO: 3281446 - DNA, 23 bp, Homo sapiens
ctcagggcctggcaggccagtgt

SEQ ID NO: 3281447 - DNA, 14 bp, Homo sapiens
ctcagggcgctcag

SEQ ID NO: 3281448 - DNA, 16 bp, Homo sapiens
ctcagggctcccaggg

SEQ ID NO: 3281449 - DNA, 19 bp, Homo sapiens
ctcagggctcctcccagct

SEQ ID NO: 3281450 - DNA, 14 bp, Homo sapiens
ctcagggctcctgc

SEQ ID NO: 3281451 - DNA, 15 bp, Homo sapiens
ctcagggctcctgcc

SEQ ID NO: 3281452 - DNA, 22 bp, Homo sapiens
ctcagggctcctgccttctgtc

SEQ ID NO: 3281453 - DNA, 12 bp, Homo sapiens
ctcagggctgga

SEQ ID NO: 3281454 - DNA, 18 bp, Homo sapiens
ctcaggggccagaggaac

SEQ ID NO: 3281455 - DNA, 16 bp, Homo sapiens
ctcaggggctgtttga

SEQ ID NO: 3281456 - DNA, 13 bp, Homo sapiens
ctcagggtggggg

SEQ ID NO: 3281457 - DNA, 18 bp, Homo sapiens
ctcagggtggggggtgac

SEQ ID NO: 3281458 - DNA, 18 bp, Homo sapiens
ctcagggttcatctgtcc

SEQ ID NO: 3281459 - DNA, 17 bp, Homo sapiens
ctcaggtagaaggttga

SEQ ID NO: 3281460 - DNA, 23 bp, Homo sapiens
ctcaggtagaaggttgacacagt

SEQ ID NO: 3281461 - DNA, 17 bp, Homo sapiens
ctcaggtccctgcaggg

SEQ ID NO: 3281462 - DNA, 13 bp, Homo sapiens
ctcaggtgccact

SEQ ID NO: 3281463 - DNA, 14 bp, Homo sapiens
ctcaggtgccactc

SEQ ID NO: 3281464 - DNA, 17 bp, Homo sapiens
ctcaggtgccactccct

SEQ ID NO: 3281465 - DNA, 19 bp, Homo sapiens
ctcaggtgccactccctga

SEQ ID NO: 3281466 - DNA, 22 bp, Homo sapiens
ctcaggtgccactccctgagct

SEQ ID NO: 3281467 - DNA, 22 bp, Homo sapiens
ctcaggtggccagcctggatct

SEQ ID NO: 3281468 - DNA, 14 bp, Homo sapiens
ctcaggtgggccct

SEQ ID NO: 3281469 - DNA, 13 bp, Homo sapiens
ctcaggtgggcgt

SEQ ID NO: 3281470 - DNA, 20 bp, Homo sapiens
ctcaggttcctatggctggc

SEQ ID NO: 3281471 - DNA, 20 bp, Homo sapiens
ctcaggttctattttcttaa

SEQ ID NO: 3281472 - DNA, 18 bp, Homo sapiens
ctcaggttcttcagggcc

SEQ ID NO: 3281473 - DNA, 23 bp, Homo sapiens
ctcaggttgctggttgctgtgtg

SEQ ID NO: 3281474 - DNA, 22 bp, Homo sapiens
ctcaggttgtctgaagtcactg

SEQ ID NO: 3281475 - DNA, 16 bp, Homo sapiens
ctcagtaaagcacttg

SEQ ID NO: 3281476 - DNA, 20 bp, Homo sapiens
ctcagtaaatgtacaactgc

SEQ ID NO: 3281477 - DNA, 20 bp, Homo sapiens
ctcagtaacatttctgttct

SEQ ID NO: 3281478 - DNA, 13 bp, Homo sapiens
ctcagtaccccat

SEQ ID NO: 3281479 - DNA, 15 bp, Homo sapiens
ctcagtatatttaaa

SEQ ID NO: 3281480 - DNA, 22 bp, Homo sapiens
ctcagtcatgcataaatatgca

SEQ ID NO: 3281481 - DNA, 14 bp, Homo sapiens
ctcagtcctcccct

SEQ ID NO: 3281482 - DNA, 16 bp, Homo sapiens
ctcagtcctcccctca

SEQ ID NO: 3281483 - DNA, 15 bp, Homo sapiens
ctcagtctcaggagc

SEQ ID NO: 3281484 - DNA, 13 bp, Homo sapiens
ctcagtctccctt

SEQ ID NO: 3281485 - DNA, 19 bp, Homo sapiens
ctcagtctctcttctctcc

SEQ ID NO: 3281486 - DNA, 22 bp, Homo sapiens
ctcagtgacatcaaagcctggc

SEQ ID NO: 3281487 - DNA, 14 bp, Homo sapiens
ctcagtgcagcaat

SEQ ID NO: 3281488 - DNA, 14 bp, Homo sapiens
cgccccgcccacac

SEQ ID NO: 3281489 - DNA, 15 bp, Homo sapiens
cgccccgcccacacc

SEQ ID NO: 3281490 - DNA, 16 bp, Homo sapiens
cgccccgcccacaccc

SEQ ID NO: 3281491 - DNA, 18 bp, Homo sapiens
cgccccgggcaaagggtc

SEQ ID NO: 3281492 - DNA, 12 bp, Homo sapiens
cgcccctctgca

SEQ ID NO: 3281493 - DNA, 12 bp, Homo sapiens
cgcccctgcagc

SEQ ID NO: 3281494 - DNA, 12 bp, Homo sapiens
cgcccctgtggc

SEQ ID NO: 3281495 - DNA, 13 bp, Homo sapiens
cgcccctgtggcc

SEQ ID NO: 3281496 - DNA, 20 bp, Homo sapiens
cgcccctgtggccaactgca

SEQ ID NO: 3281497 - DNA, 13 bp, Homo sapiens
cgccccttccccc

SEQ ID NO: 3281498 - DNA, 15 bp, Homo sapiens
cgcccgagctgttta

SEQ ID NO: 3281499 - DNA, 14 bp, Homo sapiens
cgcccgcacccccg

SEQ ID NO: 3281500 - DNA, 14 bp, Homo sapiens
cgcccgcccctgca

SEQ ID NO: 3281501 - DNA, 16 bp, Homo sapiens
cgcccgcccctgcagc

SEQ ID NO: 3281502 - DNA, 18 bp, Homo sapiens
cgcccgcccctgcagcac

SEQ ID NO: 3281503 - DNA, 17 bp, Homo sapiens
cgcccgctcctgccgca

SEQ ID NO: 3281504 - DNA, 18 bp, Homo sapiens
cgcccgctgagctgagtg

SEQ ID NO: 3281505 - DNA, 15 bp, Homo sapiens
cgccctactccactg

SEQ ID NO: 3281506 - DNA, 22 bp, Homo sapiens
cgccctcccctcccctgctgca

SEQ ID NO: 3281507 - DNA, 21 bp, Homo sapiens
cgccctcctcgggccgaggcc

SEQ ID NO: 3281508 - DNA, 12 bp, Homo sapiens
cgccctctctgc

SEQ ID NO: 3281509 - DNA, 16 bp, Homo sapiens
cgccctctctgctcct

SEQ ID NO: 3281510 - DNA, 14 bp, Homo sapiens
cgccctcttcctga

SEQ ID NO: 3281511 - DNA, 11 bp, Homo sapiens
cgccctgccac

SEQ ID NO: 3281512 - DNA, 18 bp, Homo sapiens
cgccctgctcctccctgg

SEQ ID NO: 3281513 - DNA, 21 bp, Homo sapiens
cgccctgctcctccctggctg

SEQ ID NO: 3281514 - DNA, 13 bp, Homo sapiens
cgccctgggctgg

SEQ ID NO: 3281515 - DNA, 19 bp, Homo sapiens
cgccctgggctgtctgtca

SEQ ID NO: 3281516 - DNA, 22 bp, Homo sapiens
cgccctgggctgtctgtcacca

SEQ ID NO: 3281517 - DNA, 11 bp, Homo sapiens
cgcccttggct

SEQ ID NO: 3281518 - DNA, 17 bp, Homo sapiens
cgcccttggcttctgtg

SEQ ID NO: 3281519 - DNA, 16 bp, Homo sapiens
cgccctttcctcctca

SEQ ID NO: 3281520 - DNA, 17 bp, Homo sapiens
cgccctttcctcctcag

SEQ ID NO: 3281521 - DNA, 18 bp, Homo sapiens
cgccgcctcccacggcac

SEQ ID NO: 3281522 - DNA, 21 bp, Homo sapiens
cgccgcctgctccctgcaccc

SEQ ID NO: 3281523 - DNA, 19 bp, Homo sapiens
cgccggaagtggctccgtg

SEQ ID NO: 3281524 - DNA, 16 bp, Homo sapiens
cgccgtctccatggca

SEQ ID NO: 3281525 - DNA, 16 bp, Homo sapiens
cgccgtgctgtaaata

SEQ ID NO: 3281526 - DNA, 14 bp, Homo sapiens
cgcctacaggagtg

SEQ ID NO: 3281527 - DNA, 21 bp, Homo sapiens
cgcctagagcgcggctggctc

SEQ ID NO: 3281528 - DNA, 18 bp, Homo sapiens
cgcctccatccaaggcca

SEQ ID NO: 3281529 - DNA, 11 bp, Homo sapiens
cgcctcccagc

SEQ ID NO: 3281530 - DNA, 10 bp, Homo sapiens
cgcctccccg

SEQ ID NO: 3281531 - DNA, 22 bp, Homo sapiens
cgcctccccgaaacaggctact

SEQ ID NO: 3281532 - DNA, 22 bp, Homo sapiens
cgcctccctctcagaggcctgc

SEQ ID NO: 3281533 - DNA, 22 bp, Homo sapiens
cgcctcctcggggctccaggct

SEQ ID NO: 3281534 - DNA, 13 bp, Homo sapiens
cgcctctgcattc

SEQ ID NO: 3281535 - DNA, 16 bp, Homo sapiens
cgcctctggccgccac

SEQ ID NO: 3281536 - DNA, 20 bp, Homo sapiens
cgcctgacaccgtgggtcat

SEQ ID NO: 3281537 - DNA, 21 bp, Homo sapiens
cgcctgagcccaggaggtgga

SEQ ID NO: 3281538 - DNA, 15 bp, Homo sapiens
cgcctgagctcctgc

SEQ ID NO: 3281539 - DNA, 12 bp, Homo sapiens
cgcctgccaccg

SEQ ID NO: 3281540 - DNA, 17 bp, Homo sapiens
cgcctgccctccccaga

SEQ ID NO: 3281541 - DNA, 20 bp, Homo sapiens
cgcctgccctccccagagca

SEQ ID NO: 3281542 - DNA, 16 bp, Homo sapiens
cgcctgcctctgcctc

SEQ ID NO: 3281543 - DNA, 13 bp, Homo sapiens
cgcctgctcctca

SEQ ID NO: 3281544 - DNA, 12 bp, Homo sapiens
cgcctggagagc

SEQ ID NO: 3281545 - DNA, 18 bp, Homo sapiens
cgcctggagagcgaggag

SEQ ID NO: 3281546 - DNA, 15 bp, Homo sapiens
cgcctggatttctgg

SEQ ID NO: 3281547 - DNA, 16 bp, Homo sapiens
cgcctggatttctggt

SEQ ID NO: 3281548 - DNA, 15 bp, Homo sapiens
cgcctggcacatttc

SEQ ID NO: 3281549 - DNA, 18 bp, Homo sapiens
cgcctggccaggagcagg

SEQ ID NO: 3281550 - DNA, 14 bp, Homo sapiens
cgcctggccagggc

SEQ ID NO: 3281551 - DNA, 19 bp, Homo sapiens
cgcctggccagggcagggc

SEQ ID NO: 3281552 - DNA, 22 bp, Homo sapiens
cgcctggccagggcagggccac

SEQ ID NO: 3281553 - DNA, 18 bp, Homo sapiens
cgcctgtaatcccagcac

SEQ ID NO: 3281554 - DNA, 17 bp, Homo sapiens
cgcctgtaatcccagct

SEQ ID NO: 3281555 - DNA, 17 bp, Homo sapiens
cgcctgtcctcctggaa

SEQ ID NO: 3281556 - DNA, 16 bp, Homo sapiens
cgcctgtgcacacaca

SEQ ID NO: 3281557 - DNA, 21 bp, Homo sapiens
cgccttagcatgtttgctgaa

SEQ ID NO: 3281558 - DNA, 18 bp, Homo sapiens
cgccttcatctgggacaa

SEQ ID NO: 3281559 - DNA, 17 bp, Homo sapiens
cgccttcctcctccaca

SEQ ID NO: 3281560 - DNA, 22 bp, Homo sapiens
cgccttcctcctccacagtgct

SEQ ID NO: 3281561 - DNA, 17 bp, Homo sapiens
cgcctttgtcttgtact

SEQ ID NO: 3281562 - DNA, 17 bp, Homo sapiens
cgcgagcacatgttcat

SEQ ID NO: 3281563 - DNA, 16 bp, Homo sapiens
cgcgatcccacacagg

SEQ ID NO: 3281564 - DNA, 20 bp, Homo sapiens
cgcgccactcgcttccccca

SEQ ID NO: 3281565 - DNA, 18 bp, Homo sapiens
cgcgccccccgcgcccct

SEQ ID NO: 3281566 - DNA, 17 bp, Homo sapiens
cgcgcccgcccctgcag

SEQ ID NO: 3281567 - DNA, 23 bp, Homo sapiens
cgcggaggaggagggaggccagg

SEQ ID NO: 3281568 - DNA, 13 bp, Homo sapiens
cgcggctggagcg

SEQ ID NO: 3281569 - DNA, 15 bp, Homo sapiens
cgcggctggctctgt

SEQ ID NO: 3281570 - DNA, 16 bp, Homo sapiens
cgcgggaggcaccagc

SEQ ID NO: 3281571 - DNA, 15 bp, Homo sapiens
cgcgggcagccaccc

SEQ ID NO: 3281572 - DNA, 17 bp, Homo sapiens
cgcgggcagccacccaa

SEQ ID NO: 3281573 - DNA, 18 bp, Homo sapiens
cgcgggcagcgggccagg

SEQ ID NO: 3281574 - DNA, 15 bp, Homo sapiens
cgcggtgctctggcg

SEQ ID NO: 3281575 - DNA, 13 bp, Homo sapiens
cgcgtctcctgtt

SEQ ID NO: 3281576 - DNA, 14 bp, Homo sapiens
cgcgtcttcctgag

SEQ ID NO: 3281577 - DNA, 15 bp, Homo sapiens
cgcgtttagaccaag

SEQ ID NO: 3281578 - DNA, 19 bp, Homo sapiens
cgctaaagagcccttgcct

SEQ ID NO: 3281579 - DNA, 23 bp, Homo sapiens
cgctaattcaaggaatttcttaa

SEQ ID NO: 3281580 - DNA, 13 bp, Homo sapiens
cgctacctccctc

SEQ ID NO: 3281581 - DNA, 17 bp, Homo sapiens
cgctacctctctgtccc

SEQ ID NO: 3281582 - DNA, 20 bp, Homo sapiens
cgctaggagagactgaaagc

SEQ ID NO: 3281583 - DNA, 17 bp, Homo sapiens
cgctcagacggcggcca

SEQ ID NO: 3281584 - DNA, 19 bp, Homo sapiens
cgctcagacggcggccagg

SEQ ID NO: 3281585 - DNA, 23 bp, Homo sapiens
cgctcagacggcggccaggcaca

SEQ ID NO: 3281586 - DNA, 18 bp, Homo sapiens
cgctcaggacccaggccc

SEQ ID NO: 3281587 - DNA, 20 bp, Homo sapiens
cgctcagggccatgctgagg

SEQ ID NO: 3281588 - DNA, 18 bp, Homo sapiens
cgctccagctgccccggc

SEQ ID NO: 3281589 - DNA, 18 bp, Homo sapiens
cgctcccaccgcccccac

SEQ ID NO: 3281590 - DNA, 17 bp, Homo sapiens
cgctccccgcctgttcc

SEQ ID NO: 3281591 - DNA, 15 bp, Homo sapiens
cgctcccgctcccag

SEQ ID NO: 3281592 - DNA, 15 bp, Homo sapiens
cgctcctcctgtgtg

SEQ ID NO: 3281593 - DNA, 13 bp, Homo sapiens
cgctcctgtgtct

SEQ ID NO: 3281594 - DNA, 14 bp, Homo sapiens
cgctcgcccagcag

SEQ ID NO: 3281595 - DNA, 16 bp, Homo sapiens
cgctcgcccagcagga

SEQ ID NO: 3281596 - DNA, 12 bp, Homo sapiens
cgctcggaggcc

SEQ ID NO: 3281597 - DNA, 20 bp, Homo sapiens
cgctcggaggccccaaagga

SEQ ID NO: 3281598 - DNA, 14 bp, Homo sapiens
cgctcggcaggaag

SEQ ID NO: 3281599 - DNA, 12 bp, Homo sapiens
cgctctccacca

SEQ ID NO: 3281600 - DNA, 14 bp, Homo sapiens
cgctctccaccacc

SEQ ID NO: 3281601 - DNA, 14 bp, Homo sapiens
cgctctctggcctt

SEQ ID NO: 3281602 - DNA, 15 bp, Homo sapiens
cgctctctggccttc

SEQ ID NO: 3281603 - DNA, 15 bp, Homo sapiens
cgctctgctggcctg

SEQ ID NO: 3281604 - DNA, 12 bp, Homo sapiens
cgctctgggatg

SEQ ID NO: 3281605 - DNA, 21 bp, Homo sapiens
cgctctgggatgcaggcatgc

SEQ ID NO: 3281606 - DNA, 21 bp, Homo sapiens
cgctcttggcaggtactcagc

SEQ ID NO: 3281607 - DNA, 15 bp, Homo sapiens
cgctgagctgagtgg

SEQ ID NO: 3281608 - DNA, 16 bp, Homo sapiens
cgagttggcaaaatgg

SEQ ID NO: 3281609 - DNA, 18 bp, Homo sapiens
cgagtttgcaatgtcaca

SEQ ID NO: 3281610 - DNA, 18 bp, Homo sapiens
cgatacaccgggcctgga

SEQ ID NO: 3281611 - DNA, 23 bp, Homo sapiens
cgatacccaggaccaagccacag

SEQ ID NO: 3281612 - DNA, 19 bp, Homo sapiens
cgatactgcgactttctgc

SEQ ID NO: 3281613 - DNA, 20 bp, Homo sapiens
cgatactgcgactttctgcc

SEQ ID NO: 3281614 - DNA, 12 bp, Homo sapiens
cgatagagtctc

SEQ ID NO: 3281615 - DNA, 13 bp, Homo sapiens
cgatatacagatg

SEQ ID NO: 3281616 - DNA, 15 bp, Homo sapiens
cgatccacctgtctc

SEQ ID NO: 3281617 - DNA, 17 bp, Homo sapiens
cgatcctgccaccctgt

SEQ ID NO: 3281618 - DNA, 21 bp, Homo sapiens
cgatcctggattcactcactc

SEQ ID NO: 3281619 - DNA, 14 bp, Homo sapiens
cgatctcccacctt

SEQ ID NO: 3281620 - DNA, 16 bp, Homo sapiens
cgatctcctgacctcg

SEQ ID NO: 3281621 - DNA, 16 bp, Homo sapiens
cgatctctcctggcct

SEQ ID NO: 3281622 - DNA, 19 bp, Homo sapiens
cgatctgggttcactgcaa

SEQ ID NO: 3281623 - DNA, 21 bp, Homo sapiens
cgatgatgcttgtaacaagaa

SEQ ID NO: 3281624 - DNA, 11 bp, Homo sapiens
cgatgcacagt

SEQ ID NO: 3281625 - DNA, 16 bp, Homo sapiens
cgatgcatttaataaa

SEQ ID NO: 3281626 - DNA, 17 bp, Homo sapiens
cgatgcatttaataaag

SEQ ID NO: 3281627 - DNA, 19 bp, Homo sapiens
cgatgcatttaataaagat

SEQ ID NO: 3281628 - DNA, 24 bp, Homo sapiens
cgatgcatttaataaagatgagtt

SEQ ID NO: 3281629 - DNA, 11 bp, Homo sapiens
cgatgctccct

SEQ ID NO: 3281630 - DNA, 12 bp, Homo sapiens
cgatgctccctc

SEQ ID NO: 3281631 - DNA, 22 bp, Homo sapiens
cgatgctgctttcccctgtggg

SEQ ID NO: 3281632 - DNA, 16 bp, Homo sapiens
cgatggagcccccaga

SEQ ID NO: 3281633 - DNA, 13 bp, Homo sapiens
cgatgtcccctgc

SEQ ID NO: 3281634 - DNA, 12 bp, Homo sapiens
cgattccttctc

SEQ ID NO: 3281635 - DNA, 13 bp, Homo sapiens
cgattccttctct

SEQ ID NO: 3281636 - DNA, 13 bp, Homo sapiens
cgattggctttaa

SEQ ID NO: 3281637 - DNA, 12 bp, Homo sapiens
cgatttttgtat

SEQ ID NO: 3281638 - DNA, 12 bp, Homo sapiens
cgcaactctcca

SEQ ID NO: 3281639 - DNA, 15 bp, Homo sapiens
cgcaactctccagcc

SEQ ID NO: 3281640 - DNA, 20 bp, Homo sapiens
cgcaagatagatttggaata

SEQ ID NO: 3281641 - DNA, 15 bp, Homo sapiens
cgcaaggatccttcc

SEQ ID NO: 3281642 - DNA, 16 bp, Homo sapiens
cgcaagggcatcaggc

SEQ ID NO: 3281643 - DNA, 19 bp, Homo sapiens
cgcaagggcatcaggcact

SEQ ID NO: 3281644 - DNA, 20 bp, Homo sapiens
cgcaagggcatcaggcactg

SEQ ID NO: 3281645 - DNA, 20 bp, Homo sapiens
cgcaatctcggctcactgca

SEQ ID NO: 3281646 - DNA, 22 bp, Homo sapiens
cgcaatgaaaagtcgttttcca

SEQ ID NO: 3281647 - DNA, 22 bp, Homo sapiens
cgcaattgtgggatgtcctctt

SEQ ID NO: 3281648 - DNA, 14 bp, Homo sapiens
cgcacacacacaca

SEQ ID NO: 3281649 - DNA, 22 bp, Homo sapiens
cgcacacacacacacacacatc

SEQ ID NO: 3281650 - DNA, 13 bp, Homo sapiens
cgcacagcagttc

SEQ ID NO: 3281651 - DNA, 17 bp, Homo sapiens
cgcacagccacccgtgg

SEQ ID NO: 3281652 - DNA, 15 bp, Homo sapiens
cgcacagtctctctc

SEQ ID NO: 3281653 - DNA, 16 bp, Homo sapiens
cgcaccagctgctctg

SEQ ID NO: 3281654 - DNA, 17 bp, Homo sapiens
cgcaccagctgctctgc

SEQ ID NO: 3281655 - DNA, 19 bp, Homo sapiens
cgcaccagctgctctgccc

SEQ ID NO: 3281656 - DNA, 16 bp, Homo sapiens
cgcaccattctcctgc

SEQ ID NO: 3281657 - DNA, 14 bp, Homo sapiens
cgcacccccctgtt

SEQ ID NO: 3281658 - DNA, 21 bp, Homo sapiens
cgcacccccctgttctaaggg

SEQ ID NO: 3281659 - DNA, 22 bp, Homo sapiens
cgcaccccgatgtggacctcta

SEQ ID NO: 3281660 - DNA, 20 bp, Homo sapiens
cgcaccccggcctcagggcg

SEQ ID NO: 3281661 - DNA, 19 bp, Homo sapiens
cgcaccgccgccaccagcc

SEQ ID NO: 3281662 - DNA, 16 bp, Homo sapiens
cgcacgcacacacaca

SEQ ID NO: 3281663 - DNA, 13 bp, Homo sapiens
cgcacggcttcct

SEQ ID NO: 3281664 - DNA, 14 bp, Homo sapiens
cgcacggcttccta

SEQ ID NO: 3281665 - DNA, 18 bp, Homo sapiens
cgcactgggccacggagg

SEQ ID NO: 3281666 - DNA, 16 bp, Homo sapiens
cgcacttatggtaatc

SEQ ID NO: 3281667 - DNA, 20 bp, Homo sapiens
cgcactttccacttcttcct

SEQ ID NO: 3281668 - DNA, 16 bp, Homo sapiens
cgcagacgggcacaga

SEQ ID NO: 3281669 - DNA, 17 bp, Homo sapiens
cgcagacgggcacagac

SEQ ID NO: 3281670 - DNA, 24 bp, Homo sapiens
cgcagactggcggagaaggagagg

SEQ ID NO: 3281671 - DNA, 11 bp, Homo sapiens
cgcagagactg

SEQ ID NO: 3281672 - DNA, 23 bp, Homo sapiens
cgcagaggacgcacgctcgctgc

SEQ ID NO: 3281673 - DNA, 14 bp, Homo sapiens
cgcagatgatccat

SEQ ID NO: 3281674 - DNA, 12 bp, Homo sapiens
cgcagccaaggc

SEQ ID NO: 3281675 - DNA, 13 bp, Homo sapiens
cgcagccaaggcc

SEQ ID NO: 3281676 - DNA, 21 bp, Homo sapiens
cgcagccagccggtgcctggc

SEQ ID NO: 3281677 - DNA, 17 bp, Homo sapiens
cgcagcccgtgaagcag

SEQ ID NO: 3281678 - DNA, 13 bp, Homo sapiens
cgcagccctgctt

SEQ ID NO: 3281679 - DNA, 15 bp, Homo sapiens
cgcagccctgctttg

SEQ ID NO: 3281680 - DNA, 24 bp, Homo sapiens
cgcagccctgctttgggctgccct

SEQ ID NO: 3281681 - DNA, 14 bp, Homo sapiens
cgcagcggggtagg

SEQ ID NO: 3281682 - DNA, 18 bp, Homo sapiens
cgcagctcttgcccttcc

SEQ ID NO: 3281683 - DNA, 20 bp, Homo sapiens
cgcagctcttgcccttccct

SEQ ID NO: 3281684 - DNA, 18 bp, Homo sapiens
cgcaggtgggctggactt

SEQ ID NO: 3281685 - DNA, 16 bp, Homo sapiens
cgcaggtgggtgctgc

SEQ ID NO: 3281686 - DNA, 23 bp, Homo sapiens
cgcaggtgggtgctgccctgtgt

SEQ ID NO: 3281687 - DNA, 15 bp, Homo sapiens
cgcagtccccagccc

SEQ ID NO: 3281688 - DNA, 16 bp, Homo sapiens
cgcagtcgcaggatcc

SEQ ID NO: 3281689 - DNA, 19 bp, Homo sapiens
cgcagtcgtcgcacagtct

SEQ ID NO: 3281690 - DNA, 22 bp, Homo sapiens
cgcagtcgtcgcacagtctctc

SEQ ID NO: 3281691 - DNA, 22 bp, Homo sapiens
cgcagtctggcctgggcgacag

SEQ ID NO: 3281692 - DNA, 22 bp, Homo sapiens
cgcagtgctgggaccagagcca

SEQ ID NO: 3281693 - DNA, 19 bp, Homo sapiens
cgcagtgcttctctacaga

SEQ ID NO: 3281694 - DNA, 21 bp, Homo sapiens
cgcatacacacatgccctcct

SEQ ID NO: 3281695 - DNA, 18 bp, Homo sapiens
cgcatattaagcacttta

SEQ ID NO: 3281696 - DNA, 18 bp, Homo sapiens
cgcatggagtgtgtattg

SEQ ID NO: 3281697 - DNA, 17 bp, Homo sapiens
cgccaaggactgactga

SEQ ID NO: 3281698 - DNA, 20 bp, Homo sapiens
cgccaaggactgactgagac

SEQ ID NO: 3281699 - DNA, 16 bp, Homo sapiens
cgccaagtgcgtgccg

SEQ ID NO: 3281700 - DNA, 21 bp, Homo sapiens
cgccaccagcccgcaactctc

SEQ ID NO: 3281701 - DNA, 15 bp, Homo sapiens
cgccaccattcctgg

SEQ ID NO: 3281702 - DNA, 13 bp, Homo sapiens
cgccacccccatc

SEQ ID NO: 3281703 - DNA, 23 bp, Homo sapiens
cgccacccccatcttccacctgt

SEQ ID NO: 3281704 - DNA, 18 bp, Homo sapiens
cgccaccgccacccgcag

SEQ ID NO: 3281705 - DNA, 18 bp, Homo sapiens
cgccacctttcaccctca

SEQ ID NO: 3281706 - DNA, 19 bp, Homo sapiens
cgccacggcctggctggtg

SEQ ID NO: 3281707 - DNA, 13 bp, Homo sapiens
cgccactcagcca

SEQ ID NO: 3281708 - DNA, 23 bp, Homo sapiens
cgccactcgcttcccccatagcc

SEQ ID NO: 3281709 - DNA, 23 bp, Homo sapiens
cgccactgcactccagcctgggc

SEQ ID NO: 3281710 - DNA, 15 bp, Homo sapiens
cgccacttcctttgt

SEQ ID NO: 3281711 - DNA, 17 bp, Homo sapiens
cgccacttcctttgtgt

SEQ ID NO: 3281712 - DNA, 14 bp, Homo sapiens
cgccagcctcctct

SEQ ID NO: 3281713 - DNA, 21 bp, Homo sapiens
cgccagcctcctctggacggc

SEQ ID NO: 3281714 - DNA, 23 bp, Homo sapiens
cgccagcctcctctggacggcag

SEQ ID NO: 3281715 - DNA, 19 bp, Homo sapiens
cgccagctgggagcactgg

SEQ ID NO: 3281716 - DNA, 18 bp, Homo sapiens
cgccagcttctcctgcgc

SEQ ID NO: 3281717 - DNA, 11 bp, Homo sapiens
cgccagggctg

SEQ ID NO: 3281718 - DNA, 14 bp, Homo sapiens
cgccagggctgggg

SEQ ID NO: 3281719 - DNA, 16 bp, Homo sapiens
cgccagggctggggac

SEQ ID NO: 3281720 - DNA, 21 bp, Homo sapiens
cgccagtgtaatcccccagga

SEQ ID NO: 3281721 - DNA, 16 bp, Homo sapiens
cgccatgggatgtcaa

SEQ ID NO: 3281722 - DNA, 14 bp, Homo sapiens
cgccattgccacca

SEQ ID NO: 3281723 - DNA, 18 bp, Homo sapiens
cgccattgccaccaggag

SEQ ID NO: 3281724 - DNA, 20 bp, Homo sapiens
cgcccaccaccccctcaagc

SEQ ID NO: 3281725 - DNA, 18 bp, Homo sapiens
ccttttttgtcattttat

SEQ ID NO: 3281726 - DNA, 13 bp, Homo sapiens
ccttttttgtcta

SEQ ID NO: 3281727 - DNA, 21 bp, Homo sapiens
ccttttttgtcttattgaaaa

SEQ ID NO: 3281728 - DNA, 16 bp, Homo sapiens
ccttttttttttcttg

SEQ ID NO: 3281729 - DNA, 15 bp, Homo sapiens
cgaaaagagtcttcc

SEQ ID NO: 3281730 - DNA, 18 bp, Homo sapiens
cgaaaccttgcctttctc

SEQ ID NO: 3281731 - DNA, 14 bp, Homo sapiens
cgaaagctctagaa

SEQ ID NO: 3281732 - DNA, 14 bp, Homo sapiens
cgaaaggcgagtcc

SEQ ID NO: 3281733 - DNA, 17 bp, Homo sapiens
cgaaataacaatgttaa

SEQ ID NO: 3281734 - DNA, 19 bp, Homo sapiens
cgaaatgccacgtggtcac

SEQ ID NO: 3281735 - DNA, 13 bp, Homo sapiens
cgaaatgttattt

SEQ ID NO: 3281736 - DNA, 14 bp, Homo sapiens
cgaaatgttatttt

SEQ ID NO: 3281737 - DNA, 16 bp, Homo sapiens
cgaaccaaggcagcct

SEQ ID NO: 3281738 - DNA, 22 bp, Homo sapiens
cgaaccaaggcagcctccagag

SEQ ID NO: 3281739 - DNA, 16 bp, Homo sapiens
cgaactcctggcctca

SEQ ID NO: 3281740 - DNA, 17 bp, Homo sapiens
cgaagaatggagaggaa

SEQ ID NO: 3281741 - DNA, 23 bp, Homo sapiens
cgaagaccctcttgcccatcctg

SEQ ID NO: 3281742 - DNA, 15 bp, Homo sapiens
cgaagagttcccttg

SEQ ID NO: 3281743 - DNA, 14 bp, Homo sapiens
cgaagcccaggccc

SEQ ID NO: 3281744 - DNA, 19 bp, Homo sapiens
cgaagccttctgcagcagg

SEQ ID NO: 3281745 - DNA, 11 bp, Homo sapiens
cgaagcgcgcc

SEQ ID NO: 3281746 - DNA, 23 bp, Homo sapiens
cgaagcgcgccactcgcttcccc

SEQ ID NO: 3281747 - DNA, 14 bp, Homo sapiens
cgaagctctggctg

SEQ ID NO: 3281748 - DNA, 15 bp, Homo sapiens
cgaagctctggctga

SEQ ID NO: 3281749 - DNA, 20 bp, Homo sapiens
cgaagctctggctgaaccct

SEQ ID NO: 3281750 - DNA, 18 bp, Homo sapiens
cgaaggatgctctttccc

SEQ ID NO: 3281751 - DNA, 21 bp, Homo sapiens
cgaaggatgctctttcccttt

SEQ ID NO: 3281752 - DNA, 19 bp, Homo sapiens
cgaaggggccccggggctg

SEQ ID NO: 3281753 - DNA, 13 bp, Homo sapiens
cgaaggtgctgga

SEQ ID NO: 3281754 - DNA, 21 bp, Homo sapiens
cgaagtagcttgctccctgtg

SEQ ID NO: 3281755 - DNA, 17 bp, Homo sapiens
cgaagtctttgccttct

SEQ ID NO: 3281756 - DNA, 19 bp, Homo sapiens
cgaagtctttgccttctct

SEQ ID NO: 3281757 - DNA, 14 bp, Homo sapiens
cgaatagctgggac

SEQ ID NO: 3281758 - DNA, 18 bp, Homo sapiens
cgaatccaagctccctgc

SEQ ID NO: 3281759 - DNA, 15 bp, Homo sapiens
cgaatcccccaggga

SEQ ID NO: 3281760 - DNA, 16 bp, Homo sapiens
cgaatctctgtgcctt

SEQ ID NO: 3281761 - DNA, 14 bp, Homo sapiens
cgaatgggttttct

SEQ ID NO: 3281762 - DNA, 13 bp, Homo sapiens
cgaatgtgcaggt

SEQ ID NO: 3281763 - DNA, 21 bp, Homo sapiens
cgaatgtgcaggtttgttaca

SEQ ID NO: 3281764 - DNA, 12 bp, Homo sapiens
cgacaagtgctg

SEQ ID NO: 3281765 - DNA, 12 bp, Homo sapiens
cgacagcctggc

SEQ ID NO: 3281766 - DNA, 13 bp, Homo sapiens
cgacagcctggca

SEQ ID NO: 3281767 - DNA, 14 bp, Homo sapiens
cgacagcctggcac

SEQ ID NO: 3281768 - DNA, 17 bp, Homo sapiens
cgacagcgcccctgctg

SEQ ID NO: 3281769 - DNA, 18 bp, Homo sapiens
cgacagcgcccctgctgt

SEQ ID NO: 3281770 - DNA, 22 bp, Homo sapiens
cgacaggaatagatgtggtcct

SEQ ID NO: 3281771 - DNA, 16 bp, Homo sapiens
cgacaggagtattttt

SEQ ID NO: 3281772 - DNA, 19 bp, Homo sapiens
cgacagggcctggagcccc

SEQ ID NO: 3281773 - DNA, 15 bp, Homo sapiens
cgacagttctgaact

SEQ ID NO: 3281774 - DNA, 18 bp, Homo sapiens
cgacatacatgctacttt

SEQ ID NO: 3281775 - DNA, 15 bp, Homo sapiens
cgaccagagccccac

SEQ ID NO: 3281776 - DNA, 17 bp, Homo sapiens
cgaccctctgggaacct

SEQ ID NO: 3281777 - DNA, 21 bp, Homo sapiens
cgaccctctgggaacctccca

SEQ ID NO: 3281778 - DNA, 18 bp, Homo sapiens
cgaccgcacttatggtaa

SEQ ID NO: 3281779 - DNA, 22 bp, Homo sapiens
cgaccgggcctcccctccatgg

SEQ ID NO: 3281780 - DNA, 18 bp, Homo sapiens
cgacctggtttttaaata

SEQ ID NO: 3281781 - DNA, 17 bp, Homo sapiens
cgaccttctggtatctt

SEQ ID NO: 3281782 - DNA, 13 bp, Homo sapiens
cgacgctgcagag

SEQ ID NO: 3281783 - DNA, 13 bp, Homo sapiens
cgactagccagga

SEQ ID NO: 3281784 - DNA, 15 bp, Homo sapiens
cgactctaagctgtg

SEQ ID NO: 3281785 - DNA, 16 bp, Homo sapiens
cgactctaagctgtgt

SEQ ID NO: 3281786 - DNA, 18 bp, Homo sapiens
cgactctaagctgtgtgc

SEQ ID NO: 3281787 - DNA, 18 bp, Homo sapiens
cgactctatagactctag

SEQ ID NO: 3281788 - DNA, 20 bp, Homo sapiens
cgactggccagggccacgct

SEQ ID NO: 3281789 - DNA, 16 bp, Homo sapiens
cgactggtccagctct

SEQ ID NO: 3281790 - DNA, 19 bp, Homo sapiens
cgactggtccagctctgac

SEQ ID NO: 3281791 - DNA, 19 bp, Homo sapiens
cgacttgtttttgcacatg

SEQ ID NO: 3281792 - DNA, 16 bp, Homo sapiens
cgactttctgcctgga

SEQ ID NO: 3281793 - DNA, 17 bp, Homo sapiens
cgactttgtacccccca

SEQ ID NO: 3281794 - DNA, 20 bp, Homo sapiens
cgagaaataaagtttgctta

SEQ ID NO: 3281795 - DNA, 21 bp, Homo sapiens
cgagaaattcgtgtgtttttt

SEQ ID NO: 3281796 - DNA, 14 bp, Homo sapiens
cgagacacttgcct

SEQ ID NO: 3281797 - DNA, 17 bp, Homo sapiens
cgagacccaagggcaga

SEQ ID NO: 3281798 - DNA, 12 bp, Homo sapiens
cgagactggtct

SEQ ID NO: 3281799 - DNA, 15 bp, Homo sapiens
cgagagaggagccag

SEQ ID NO: 3281800 - DNA, 21 bp, Homo sapiens
cgagagaggagccagacagac

SEQ ID NO: 3281801 - DNA, 16 bp, Homo sapiens
cgagagatcaaagatg

SEQ ID NO: 3281802 - DNA, 22 bp, Homo sapiens
cgagaggtgagctactttgtga

SEQ ID NO: 3281803 - DNA, 14 bp, Homo sapiens
cgagaggtgggcca

SEQ ID NO: 3281804 - DNA, 16 bp, Homo sapiens
cgagatcacgccactg

SEQ ID NO: 3281805 - DNA, 16 bp, Homo sapiens
cgagatcggggtagaa

SEQ ID NO: 3281806 - DNA, 23 bp, Homo sapiens
cgagatgtgacccaccagtgcct

SEQ ID NO: 3281807 - DNA, 15 bp, Homo sapiens
cgagcaaagatcaaa

SEQ ID NO: 3281808 - DNA, 23 bp, Homo sapiens
cgagcaaagatcaaaataaaaag

SEQ ID NO: 3281809 - DNA, 18 bp, Homo sapiens
cgagcattccagtaactt

SEQ ID NO: 3281810 - DNA, 21 bp, Homo sapiens
cgagcattccagtaacttttt

SEQ ID NO: 3281811 - DNA, 21 bp, Homo sapiens
cgagccaactctaacaggcac

SEQ ID NO: 3281812 - DNA, 20 bp, Homo sapiens
cgagccaggttcacactcag

SEQ ID NO: 3281813 - DNA, 12 bp, Homo sapiens
cgagcccagatg

SEQ ID NO: 3281814 - DNA, 15 bp, Homo sapiens
cgagccctggtggca

SEQ ID NO: 3281815 - DNA, 19 bp, Homo sapiens
cgagccctggtggcagtgg

SEQ ID NO: 3281816 - DNA, 15 bp, Homo sapiens
cgagccgggcctggg

SEQ ID NO: 3281817 - DNA, 22 bp, Homo sapiens
cgagccggggagtttctttcct

SEQ ID NO: 3281818 - DNA, 14 bp, Homo sapiens
cgagcctaatgaaa

SEQ ID NO: 3281819 - DNA, 18 bp, Homo sapiens
cgagcgttcccagcaggg

SEQ ID NO: 3281820 - DNA, 21 bp, Homo sapiens
cgagctggtgcattacagaga

SEQ ID NO: 3281821 - DNA, 23 bp, Homo sapiens
cgagctggtgcattacagagagg

SEQ ID NO: 3281822 - DNA, 22 bp, Homo sapiens
cgaggaatctgtgggtctggga

SEQ ID NO: 3281823 - DNA, 12 bp, Homo sapiens
cgaggacaggga

SEQ ID NO: 3281824 - DNA, 23 bp, Homo sapiens
cgaggaccactttggagactggg

SEQ ID NO: 3281825 - DNA, 17 bp, Homo sapiens
cgaggagccaggcaact

SEQ ID NO: 3281826 - DNA, 13 bp, Homo sapiens
cgaggagctgggc

SEQ ID NO: 3281827 - DNA, 15 bp, Homo sapiens
cgaggagctgggccc

SEQ ID NO: 3281828 - DNA, 15 bp, Homo sapiens
cgaggaggcgcggcc

SEQ ID NO: 3281829 - DNA, 17 bp, Homo sapiens
cgaggaggcgcggcctc

SEQ ID NO: 3281830 - DNA, 23 bp, Homo sapiens
cgaggaggtgcctggagtgccca

SEQ ID NO: 3281831 - DNA, 15 bp, Homo sapiens
cgaggcaccggcgct

SEQ ID NO: 3281832 - DNA, 19 bp, Homo sapiens
cgaggcaccggcgctgcag

SEQ ID NO: 3281833 - DNA, 19 bp, Homo sapiens
cgaggccagtacctttcca

SEQ ID NO: 3281834 - DNA, 12 bp, Homo sapiens
cgaggcccagcg

SEQ ID NO: 3281835 - DNA, 21 bp, Homo sapiens
cgaggcctgcaaaccttcctg

SEQ ID NO: 3281836 - DNA, 18 bp, Homo sapiens
cgaggccttctctgaagg

SEQ ID NO: 3281837 - DNA, 19 bp, Homo sapiens
cgaggccttctctgaagga

SEQ ID NO: 3281838 - DNA, 12 bp, Homo sapiens
cgaggctggtgc

SEQ ID NO: 3281839 - DNA, 17 bp, Homo sapiens
ccttaggaggccgaggc

SEQ ID NO: 3281840 - DNA, 13 bp, Homo sapiens
ccttaggccttcc

SEQ ID NO: 3281841 - DNA, 20 bp, Homo sapiens
ccttagggaagctggcctga

SEQ ID NO: 3281842 - DNA, 23 bp, Homo sapiens
ccttagggtggctttaattgtat

SEQ ID NO: 3281843 - DNA, 17 bp, Homo sapiens
ccttagtccccctggtc

SEQ ID NO: 3281844 - DNA, 22 bp, Homo sapiens
ccttagtgggccagggctgccc

SEQ ID NO: 3281845 - DNA, 14 bp, Homo sapiens
ccttatagttactg

SEQ ID NO: 3281846 - DNA, 21 bp, Homo sapiens
ccttatagttactgtgtaatt

SEQ ID NO: 3281847 - DNA, 13 bp, Homo sapiens
ccttatcagagct

SEQ ID NO: 3281848 - DNA, 14 bp, Homo sapiens
ccttatccccactt

SEQ ID NO: 3281849 - DNA, 19 bp, Homo sapiens
ccttatgacttgctacttt

SEQ ID NO: 3281850 - DNA, 14 bp, Homo sapiens
ccttattcttctca

SEQ ID NO: 3281851 - DNA, 19 bp, Homo sapiens
ccttattggatatttgata

SEQ ID NO: 3281852 - DNA, 15 bp, Homo sapiens
ccttattgtacctct

SEQ ID NO: 3281853 - DNA, 14 bp, Homo sapiens
ccttatttccctat

SEQ ID NO: 3281854 - DNA, 14 bp, Homo sapiens
ccttattttcaaga

SEQ ID NO: 3281855 - DNA, 14 bp, Homo sapiens
ccttattttgtatt

SEQ ID NO: 3281856 - DNA, 22 bp, Homo sapiens
ccttatttttagccataatttt

SEQ ID NO: 3281857 - DNA, 14 bp, Homo sapiens
ccttcaaccattcc

SEQ ID NO: 3281858 - DNA, 15 bp, Homo sapiens
ccttcaacccagtgg

SEQ ID NO: 3281859 - DNA, 24 bp, Homo sapiens
ccttcaactgaaaagactcagtgt

SEQ ID NO: 3281860 - DNA, 19 bp, Homo sapiens
ccttcaagacgaggggcag

SEQ ID NO: 3281861 - DNA, 22 bp, Homo sapiens
ccttcaagacgaggggcaggga

SEQ ID NO: 3281862 - DNA, 13 bp, Homo sapiens
ccttcaagtgcca

SEQ ID NO: 3281863 - DNA, 14 bp, Homo sapiens
ccttcaagtgccaa

SEQ ID NO: 3281864 - DNA, 17 bp, Homo sapiens
ccttcaagttagctcag

SEQ ID NO: 3281865 - DNA, 20 bp, Homo sapiens
ccttcaattcctgggcccca

SEQ ID NO: 3281866 - DNA, 17 bp, Homo sapiens
ccttcacaccccaggcc

SEQ ID NO: 3281867 - DNA, 16 bp, Homo sapiens
ccttcacattttttat

SEQ ID NO: 3281868 - DNA, 20 bp, Homo sapiens
ccttcactccggtgtgcctg

SEQ ID NO: 3281869 - DNA, 19 bp, Homo sapiens
ccttcactgccatgatagc

SEQ ID NO: 3281870 - DNA, 17 bp, Homo sapiens
ccttcagacaccctcaa

SEQ ID NO: 3281871 - DNA, 11 bp, Homo sapiens
ccttcagaggc

SEQ ID NO: 3281872 - DNA, 16 bp, Homo sapiens
ccttcagatggaaact

SEQ ID NO: 3281873 - DNA, 12 bp, Homo sapiens
ccttcagctcca

SEQ ID NO: 3281874 - DNA, 13 bp, Homo sapiens
ccttcaggaagca

SEQ ID NO: 3281875 - DNA, 12 bp, Homo sapiens
ccttcagggcca

SEQ ID NO: 3281876 - DNA, 13 bp, Homo sapiens
ccttcagggccag

SEQ ID NO: 3281877 - DNA, 16 bp, Homo sapiens
cctgcgttggagccac

SEQ ID NO: 3281878 - DNA, 15 bp, Homo sapiens
cctgctacaggaggg

SEQ ID NO: 3281879 - DNA, 16 bp, Homo sapiens
cctgctactcctgtgc

SEQ ID NO: 3281880 - DNA, 13 bp, Homo sapiens
cctgctagagcaa

SEQ ID NO: 3281881 - DNA, 23 bp, Homo sapiens
cctgctagagcaacccctgtacc

SEQ ID NO: 3281882 - DNA, 17 bp, Homo sapiens
cctgctcaactctaccc

SEQ ID NO: 3281883 - DNA, 19 bp, Homo sapiens
cctgctcacgtcaaatgca

SEQ ID NO: 3281884 - DNA, 15 bp, Homo sapiens
cctgctccaccagca

SEQ ID NO: 3281885 - DNA, 17 bp, Homo sapiens
cctgctccaccagcagc

SEQ ID NO: 3281886 - DNA, 19 bp, Homo sapiens
cctgctccacgaagcctta

SEQ ID NO: 3281887 - DNA, 22 bp, Homo sapiens
cctgctcccattcctccctccg

SEQ ID NO: 3281888 - DNA, 15 bp, Homo sapiens
cctgctccgctgctc

SEQ ID NO: 3281889 - DNA, 15 bp, Homo sapiens
cctgctcctccctgc

SEQ ID NO: 3281890 - DNA, 22 bp, Homo sapiens
cctgctcctccctggctgccct

SEQ ID NO: 3281891 - DNA, 22 bp, Homo sapiens
cctgctcctcctgccctgtccc

SEQ ID NO: 3281892 - DNA, 17 bp, Homo sapiens
cctgctcctgcagcatg

SEQ ID NO: 3281893 - DNA, 20 bp, Homo sapiens
cctgctctaacacctgccta

SEQ ID NO: 3281894 - DNA, 16 bp, Homo sapiens
cctgctctacccatga

SEQ ID NO: 3281895 - DNA, 20 bp, Homo sapiens
cctgctctacccatgagcct

SEQ ID NO: 3281896 - DNA, 23 bp, Homo sapiens
cctgctctttctacatgactggg

SEQ ID NO: 3281897 - DNA, 13 bp, Homo sapiens
cctgctgagagcc

SEQ ID NO: 3281898 - DNA, 22 bp, Homo sapiens
cctgctgcaggggctctggaga

SEQ ID NO: 3281899 - DNA, 16 bp, Homo sapiens
cctgctgccagtgcag

SEQ ID NO: 3281900 - DNA, 19 bp, Homo sapiens
cctgctgccagtgcagcca

SEQ ID NO: 3281901 - DNA, 21 bp, Homo sapiens
cctgctgccagtgcagccact

SEQ ID NO: 3281902 - DNA, 22 bp, Homo sapiens
cctgctgccagtgcagccactg

SEQ ID NO: 3281903 - DNA, 22 bp, Homo sapiens
cctgctgcccaatctccatctg

SEQ ID NO: 3281904 - DNA, 17 bp, Homo sapiens
cctgctgcccaggctgt

SEQ ID NO: 3281905 - DNA, 13 bp, Homo sapiens
cctgctgccccag

SEQ ID NO: 3281906 - DNA, 14 bp, Homo sapiens
cctgctgccgcctc

SEQ ID NO: 3281907 - DNA, 18 bp, Homo sapiens
cctgctgccgcctcccag

SEQ ID NO: 3281908 - DNA, 17 bp, Homo sapiens
cctgctgcggaggagct

SEQ ID NO: 3281909 - DNA, 22 bp, Homo sapiens
cctgctgcggaggagctgcctg

SEQ ID NO: 3281910 - DNA, 20 bp, Homo sapiens
cctgctgcgtccccactccc

SEQ ID NO: 3281911 - DNA, 22 bp, Homo sapiens
cctgctgcgtccccactccctt

SEQ ID NO: 3281912 - DNA, 20 bp, Homo sapiens
cctgctgctgccagggcttc

SEQ ID NO: 3281913 - DNA, 11 bp, Homo sapiens
cctgctgctgt

SEQ ID NO: 3281914 - DNA, 21 bp, Homo sapiens
cctgctgctgtaactgctgag

SEQ ID NO: 3281915 - DNA, 12 bp, Homo sapiens
cctgctggacag

SEQ ID NO: 3281916 - DNA, 17 bp, Homo sapiens
cctgctggacagagact

SEQ ID NO: 3281917 - DNA, 14 bp, Homo sapiens
cctgctggacagcc

SEQ ID NO: 3281918 - DNA, 15 bp, Homo sapiens
cctgctggacagcct

SEQ ID NO: 3281919 - DNA, 16 bp, Homo sapiens
cctgctggacagcctc

SEQ ID NO: 3281920 - DNA, 17 bp, Homo sapiens
cctgctggacagcctcc

SEQ ID NO: 3281921 - DNA, 18 bp, Homo sapiens
cctgctggacagcctccg

SEQ ID NO: 3281922 - DNA, 12 bp, Homo sapiens
cctgctggctgc

SEQ ID NO: 3281923 - DNA, 13 bp, Homo sapiens
cctgctggcttcc

SEQ ID NO: 3281924 - DNA, 20 bp, Homo sapiens
cctgctggcttccagcttca

SEQ ID NO: 3281925 - DNA, 21 bp, Homo sapiens
cctgctggcttccagcttcag

SEQ ID NO: 3281926 - DNA, 20 bp, Homo sapiens
cctgctgggaaccccgcagc

SEQ ID NO: 3281927 - DNA, 21 bp, Homo sapiens
cctgctggggatccccgcctg

SEQ ID NO: 3281928 - DNA, 23 bp, Homo sapiens
cctgctggggatccccgcctggc

SEQ ID NO: 3281929 - DNA, 16 bp, Homo sapiens
cctgctggggccgcca

SEQ ID NO: 3281930 - DNA, 15 bp, Homo sapiens
cctgctggtacctgc

SEQ ID NO: 3281931 - DNA, 21 bp, Homo sapiens
cctgctgtagtcctttctgcc

SEQ ID NO: 3281932 - DNA, 22 bp, Homo sapiens
cctgctgtagtcctttctgcct

SEQ ID NO: 3281933 - DNA, 18 bp, Homo sapiens
cctgctgtcttccccacc

SEQ ID NO: 3281934 - DNA, 20 bp, Homo sapiens
cctgctgtgattccactaca

SEQ ID NO: 3281935 - DNA, 22 bp, Homo sapiens
cctgctgtgccatgctgggcca

SEQ ID NO: 3281936 - DNA, 16 bp, Homo sapiens
ccttctgacggccctg

SEQ ID NO: 3281937 - DNA, 18 bp, Homo sapiens
ccttctgacggccctgca

SEQ ID NO: 3281938 - DNA, 22 bp, Homo sapiens
ccttctgatgtctctaaagcac

SEQ ID NO: 3281939 - DNA, 17 bp, Homo sapiens
ccttctgctgcccaggc

SEQ ID NO: 3281940 - DNA, 20 bp, Homo sapiens
ccttctgctgcccaggccac

SEQ ID NO: 3281941 - DNA, 16 bp, Homo sapiens
ccttctggtatcttgt

SEQ ID NO: 3281942 - DNA, 14 bp, Homo sapiens
ccttctgtccccag

SEQ ID NO: 3281943 - DNA, 15 bp, Homo sapiens
ccttctgtccccagc

SEQ ID NO: 3281944 - DNA, 21 bp, Homo sapiens
ccttctgtcctactctgtgtc

SEQ ID NO: 3281945 - DNA, 22 bp, Homo sapiens
ccttctgtcctactctgtgtca

SEQ ID NO: 3281946 - DNA, 22 bp, Homo sapiens
ccttctgtcctggtgtcactta

SEQ ID NO: 3281947 - DNA, 23 bp, Homo sapiens
ccttcttcacccagctaatctgt

SEQ ID NO: 3281948 - DNA, 18 bp, Homo sapiens
ccttcttctttttgctgt

SEQ ID NO: 3281949 - DNA, 21 bp, Homo sapiens
ccttcttctttttgctgttgt

SEQ ID NO: 3281950 - DNA, 15 bp, Homo sapiens
ccttcttgggcccca

SEQ ID NO: 3281951 - DNA, 15 bp, Homo sapiens
ccttcttgtcaccag

SEQ ID NO: 3281952 - DNA, 16 bp, Homo sapiens
ccttctttctggactg

SEQ ID NO: 3281953 - DNA, 19 bp, Homo sapiens
ccttctttctggactggcg

SEQ ID NO: 3281954 - DNA, 13 bp, Homo sapiens
ccttctttgataa

SEQ ID NO: 3281955 - DNA, 16 bp, Homo sapiens
ccttctttgcagggct

SEQ ID NO: 3281956 - DNA, 14 bp, Homo sapiens
ccttcttttatgag

SEQ ID NO: 3281957 - DNA, 15 bp, Homo sapiens
ccttgaaaatatttt

SEQ ID NO: 3281958 - DNA, 22 bp, Homo sapiens
ccttgaagaactgcaggccctg

SEQ ID NO: 3281959 - DNA, 12 bp, Homo sapiens
ccttgaatgtgg

SEQ ID NO: 3281960 - DNA, 14 bp, Homo sapiens
ccttgacacctgct

SEQ ID NO: 3281961 - DNA, 13 bp, Homo sapiens
ccttgacagggca

SEQ ID NO: 3281962 - DNA, 18 bp, Homo sapiens
ccttgacagggcacaccg

SEQ ID NO: 3281963 - DNA, 21 bp, Homo sapiens
ccttgagagtatcaggtctcc

SEQ ID NO: 3281964 - DNA, 23 bp, Homo sapiens
ccttgaggtcttttgacatgtgg

SEQ ID NO: 3281965 - DNA, 14 bp, Homo sapiens
ccttgagtggggtt

SEQ ID NO: 3281966 - DNA, 17 bp, Homo sapiens
ccttgataaatatatat

SEQ ID NO: 3281967 - DNA, 19 bp, Homo sapiens
cctctgagcccagctgcct

SEQ ID NO: 3281968 - DNA, 21 bp, Homo sapiens
cctctgagcccagctgcctgg

SEQ ID NO: 3281969 - DNA, 14 bp, Homo sapiens
cctctgagccttgg

SEQ ID NO: 3281970 - DNA, 16 bp, Homo sapiens
cctctgagccttggtg

SEQ ID NO: 3281971 - DNA, 14 bp, Homo sapiens
cctctgatacctca

SEQ ID NO: 3281972 - DNA, 24 bp, Homo sapiens
cctctgattttggcatgtggagac

SEQ ID NO: 3281973 - DNA, 14 bp, Homo sapiens
cctctgcagaacag

SEQ ID NO: 3281974 - DNA, 22 bp, Homo sapiens
cctctgccaaaggatgtgatat

SEQ ID NO: 3281975 - DNA, 13 bp, Homo sapiens
cctctgccaccag

SEQ ID NO: 3281976 - DNA, 15 bp, Homo sapiens
cctctgcccctccca

SEQ ID NO: 3281977 - DNA, 15 bp, Homo sapiens
cctctgcccttcctg

SEQ ID NO: 3281978 - DNA, 22 bp, Homo sapiens
cctctgccggtcgggcagccag

SEQ ID NO: 3281979 - DNA, 12 bp, Homo sapiens
cctctgcctgtc

SEQ ID NO: 3281980 - DNA, 15 bp, Homo sapiens
cctctgcctgtctcc

SEQ ID NO: 3281981 - DNA, 20 bp, Homo sapiens
cctctgcggaccccagctgt

SEQ ID NO: 3281982 - DNA, 20 bp, Homo sapiens
cctctgcggggcagggcctt

SEQ ID NO: 3281983 - DNA, 20 bp, Homo sapiens
cctctgctcaccgcccatca

SEQ ID NO: 3281984 - DNA, 23 bp, Homo sapiens
cctctgctcaccgcccatcaggg

SEQ ID NO: 3281985 - DNA, 11 bp, Homo sapiens
cctctgctccc

SEQ ID NO: 3281986 - DNA, 14 bp, Homo sapiens
cctctgctccctct

SEQ ID NO: 3281987 - DNA, 22 bp, Homo sapiens
cctctgctcctggagcctttga

SEQ ID NO: 3281988 - DNA, 14 bp, Homo sapiens
cctctgctgctgtc

SEQ ID NO: 3281989 - DNA, 19 bp, Homo sapiens
cctctgctgctgtccctcc

SEQ ID NO: 3281990 - DNA, 17 bp, Homo sapiens
cctctgctggttcctga

SEQ ID NO: 3281991 - DNA, 15 bp, Homo sapiens
cctctgcttttatct

SEQ ID NO: 3281992 - DNA, 14 bp, Homo sapiens
cctctggactggct

SEQ ID NO: 3281993 - DNA, 15 bp, Homo sapiens
cctctggactggcta

SEQ ID NO: 3281994 - DNA, 22 bp, Homo sapiens
cctctggaggggtgtggctcct

SEQ ID NO: 3281995 - DNA, 12 bp, Homo sapiens
cctctggccagg

SEQ ID NO: 3281996 - DNA, 11 bp, Homo sapiens
cctctggccct

SEQ ID NO: 3281997 - DNA, 13 bp, Homo sapiens
cctctggccctcg

SEQ ID NO: 3281998 - DNA, 14 bp, Homo sapiens
cctctggccctgtg

SEQ ID NO: 3281999 - DNA, 17 bp, Homo sapiens
cctctggccgccacccc

SEQ ID NO: 3282000 - DNA, 20 bp, Homo sapiens
cctctggccgcctaggctca

SEQ ID NO: 3282001 - DNA, 23 bp, Homo sapiens
cctctggctagaggccagcccca

SEQ ID NO: 3282002 - DNA, 24 bp, Homo sapiens
cctctggctagaggccagccccac

SEQ ID NO: 3282003 - DNA, 12 bp, Homo sapiens
cctctggctcca

SEQ ID NO: 3282004 - DNA, 18 bp, Homo sapiens
cctctggctccacacctc

SEQ ID NO: 3282005 - DNA, 13 bp, Homo sapiens
cctctggcttccc

SEQ ID NO: 3282006 - DNA, 22 bp, Homo sapiens
cctctggcttgggcagggtctg

SEQ ID NO: 3282007 - DNA, 12 bp, Homo sapiens
cctctgggaacc

SEQ ID NO: 3282008 - DNA, 17 bp, Homo sapiens
cctctgggaacctccca

SEQ ID NO: 3282009 - DNA, 18 bp, Homo sapiens
cctctgggaacctcccag

SEQ ID NO: 3282010 - DNA, 17 bp, Homo sapiens
cctctggggaccccaac

SEQ ID NO: 3282011 - DNA, 23 bp, Homo sapiens
cctctggggaccccaacctcaga

SEQ ID NO: 3282012 - DNA, 18 bp, Homo sapiens
cctctggggctctagggt

SEQ ID NO: 3282013 - DNA, 23 bp, Homo sapiens
cctctggtccacactagaaagaa

SEQ ID NO: 3282014 - DNA, 17 bp, Homo sapiens
cctctggtcgctcctgc

SEQ ID NO: 3282015 - DNA, 19 bp, Homo sapiens
cctctggtcgctcctgccc

SEQ ID NO: 3282016 - DNA, 19 bp, Homo sapiens
cctctgtcatcactccctg

SEQ ID NO: 3282017 - DNA, 18 bp, Homo sapiens
cctctgtcctgcttctga

SEQ ID NO: 3282018 - DNA, 23 bp, Homo sapiens
cctctgtctcatcctcctggaac

SEQ ID NO: 3282019 - DNA, 24 bp, Homo sapiens
cctctgtctcatcctcctggaacc

SEQ ID NO: 3282020 - DNA, 23 bp, Homo sapiens
cctctgtgaggaaagcacacagt

SEQ ID NO: 3282021 - DNA, 15 bp, Homo sapiens
cctctgtgctgtgtg

SEQ ID NO: 3282022 - DNA, 18 bp, Homo sapiens
cctctgtgtctgctctca

SEQ ID NO: 3282023 - DNA, 17 bp, Homo sapiens
cctcttaaagctgcctg

SEQ ID NO: 3282024 - DNA, 20 bp, Homo sapiens
cctcttaaagctgcctgtag

SEQ ID NO: 3282025 - DNA, 15 bp, Homo sapiens
cctcttaaattatat

SEQ ID NO: 3282026 - DNA, 23 bp, Homo sapiens
cctcttaaattatatatttattt

SEQ ID NO: 3282027 - DNA, 18 bp, Homo sapiens
cctcttaccgtagcctcc

SEQ ID NO: 3282028 - DNA, 17 bp, Homo sapiens
cctcttcaccccccact

SEQ ID NO: 3282029 - DNA, 17 bp, Homo sapiens
cctcttcaccccggcag

SEQ ID NO: 3282030 - DNA, 23 bp, Homo sapiens
cctcttcaccccggcaggccctg

SEQ ID NO: 3282031 - DNA, 12 bp, Homo sapiens
cctcttccccac

SEQ ID NO: 3282032 - DNA, 14 bp, Homo sapiens
cctcttccccagaa

SEQ ID NO: 3282033 - DNA, 22 bp, Homo sapiens
cctcttccccagaaaggagact

SEQ ID NO: 3282034 - DNA, 15 bp, Homo sapiens
cctcttcccccttcc

SEQ ID NO: 3282035 - DNA, 15 bp, Homo sapiens
cctcttccccttgcc

SEQ ID NO: 3282036 - DNA, 17 bp, Homo sapiens
cctcttccccttgccct

SEQ ID NO: 3282037 - DNA, 23 bp, Homo sapiens
cctgcagcatggtccctgcctta

SEQ ID NO: 3282038 - DNA, 21 bp, Homo sapiens
cctgcagcccaaaacccaggg

SEQ ID NO: 3282039 - DNA, 22 bp, Homo sapiens
cctgcagccccgcgcctccttc

SEQ ID NO: 3282040 - DNA, 20 bp, Homo sapiens
cctgcaggaacgagcactgg

SEQ ID NO: 3282041 - DNA, 16 bp, Homo sapiens
cctgcaggccaagagc

SEQ ID NO: 3282042 - DNA, 21 bp, Homo sapiens
cctgcaggccaagagcagagg

SEQ ID NO: 3282043 - DNA, 15 bp, Homo sapiens
cctgcagggccaagc

SEQ ID NO: 3282044 - DNA, 15 bp, Homo sapiens
cctgcagtcttctgg

SEQ ID NO: 3282045 - DNA, 16 bp, Homo sapiens
cctgcagtcttctggg

SEQ ID NO: 3282046 - DNA, 20 bp, Homo sapiens
cctgcagtgttcgcttggct

SEQ ID NO: 3282047 - DNA, 21 bp, Homo sapiens
cctgcatccccttggctgtga

SEQ ID NO: 3282048 - DNA, 15 bp, Homo sapiens
cctgcatctggggcc

SEQ ID NO: 3282049 - DNA, 16 bp, Homo sapiens
cctgcatttctgagtt

SEQ ID NO: 3282050 - DNA, 17 bp, Homo sapiens
cctgccaagactcctca

SEQ ID NO: 3282051 - DNA, 13 bp, Homo sapiens
cctgccaattgct

SEQ ID NO: 3282052 - DNA, 19 bp, Homo sapiens
cctgccacatacaggtgct

SEQ ID NO: 3282053 - DNA, 22 bp, Homo sapiens
cctgccaccctggggagaaagt

SEQ ID NO: 3282054 - DNA, 14 bp, Homo sapiens
cctgccaccctgta

SEQ ID NO: 3282055 - DNA, 22 bp, Homo sapiens
cctgccagcaggccagggactc

SEQ ID NO: 3282056 - DNA, 15 bp, Homo sapiens
cctgccagccccaca

SEQ ID NO: 3282057 - DNA, 18 bp, Homo sapiens
cctgccagccccacacag

SEQ ID NO: 3282058 - DNA, 13 bp, Homo sapiens
cctgccagcctgg

SEQ ID NO: 3282059 - DNA, 14 bp, Homo sapiens
cctgccagcctggc

SEQ ID NO: 3282060 - DNA, 14 bp, Homo sapiens
cctgccagctgcct

SEQ ID NO: 3282061 - DNA, 16 bp, Homo sapiens
cctgccagctgccttc

SEQ ID NO: 3282062 - DNA, 14 bp, Homo sapiens
cctgccaggcaggg

SEQ ID NO: 3282063 - DNA, 22 bp, Homo sapiens
cctgccaggcaggggtgggggt

SEQ ID NO: 3282064 - DNA, 16 bp, Homo sapiens
cctgccatcatgcctg

SEQ ID NO: 3282065 - DNA, 19 bp, Homo sapiens
cctgccatgccaggaacct

SEQ ID NO: 3282066 - DNA, 14 bp, Homo sapiens
cctgccatgggcca

SEQ ID NO: 3282067 - DNA, 17 bp, Homo sapiens
cctgccatgggccagcc

SEQ ID NO: 3282068 - DNA, 21 bp, Homo sapiens
cctgccatgggccagcctagc

SEQ ID NO: 3282069 - DNA, 23 bp, Homo sapiens
cctgccatgggccagcctagccc

SEQ ID NO: 3282070 - DNA, 16 bp, Homo sapiens
cctgccattcttctgg

SEQ ID NO: 3282071 - DNA, 23 bp, Homo sapiens
cctgccattcttctggtgctact

SEQ ID NO: 3282072 - DNA, 17 bp, Homo sapiens
cctgcccaatgctttgg

SEQ ID NO: 3282073 - DNA, 20 bp, Homo sapiens
cctgcccacaactcccttgc

SEQ ID NO: 3282074 - DNA, 17 bp, Homo sapiens
cctgcccactgctgcag

SEQ ID NO: 3282075 - DNA, 14 bp, Homo sapiens
cctgcccagatgcc

SEQ ID NO: 3282076 - DNA, 20 bp, Homo sapiens
cctgcccagatgccctttgg

SEQ ID NO: 3282077 - DNA, 13 bp, Homo sapiens
cctgcccaggccc

SEQ ID NO: 3282078 - DNA, 19 bp, Homo sapiens
cctgcccaggcccctgcca

SEQ ID NO: 3282079 - DNA, 23 bp, Homo sapiens
cctgcccaggccggccagcctca

SEQ ID NO: 3282080 - DNA, 12 bp, Homo sapiens
cctgcccagtcc

SEQ ID NO: 3282081 - DNA, 19 bp, Homo sapiens
cctgcccagtcccccaacc

SEQ ID NO: 3282082 - DNA, 12 bp, Homo sapiens
cctgcccagtgt

SEQ ID NO: 3282083 - DNA, 13 bp, Homo sapiens
cctgcccagtgtt

SEQ ID NO: 3282084 - DNA, 22 bp, Homo sapiens
cctgcccagttgcactcaggtg

SEQ ID NO: 3282085 - DNA, 16 bp, Homo sapiens
cctgcccatgggagct

SEQ ID NO: 3282086 - DNA, 23 bp, Homo sapiens
cctgcccatgtcgcgctcagcat

SEQ ID NO: 3282087 - DNA, 23 bp, Homo sapiens
cctgccccaaataacttcagtcc

SEQ ID NO: 3282088 - DNA, 17 bp, Homo sapiens
cctgccccacacggact

SEQ ID NO: 3282089 - DNA, 12 bp, Homo sapiens
cctgccccagcc

SEQ ID NO: 3282090 - DNA, 15 bp, Homo sapiens
cctgccccagcccaa

SEQ ID NO: 3282091 - DNA, 17 bp, Homo sapiens
cctgccccagggctccc

SEQ ID NO: 3282092 - DNA, 13 bp, Homo sapiens
cctgcccccagcc

SEQ ID NO: 3282093 - DNA, 17 bp, Homo sapiens
cctgcccccagccccgg

SEQ ID NO: 3282094 - DNA, 23 bp, Homo sapiens
cctgcccccatctccccaggcct

SEQ ID NO: 3282095 - DNA, 14 bp, Homo sapiens
cctgccccccaagg

SEQ ID NO: 3282096 - DNA, 15 bp, Homo sapiens
cctgccccctggctg

SEQ ID NO: 3282097 - DNA, 16 bp, Homo sapiens
cctgccccctggctga

SEQ ID NO: 3282098 - DNA, 16 bp, Homo sapiens
cctgccccctggtgga

SEQ ID NO: 3282099 - DNA, 18 bp, Homo sapiens
cctgccccgcccccagtc

SEQ ID NO: 3282100 - DNA, 14 bp, Homo sapiens
cccagcccctccac

SEQ ID NO: 3282101 - DNA, 22 bp, Homo sapiens
cccagccccttctcccagcaca

SEQ ID NO: 3282102 - DNA, 18 bp, Homo sapiens
cccagccctatggatgtg

SEQ ID NO: 3282103 - DNA, 20 bp, Homo sapiens
cccagccctccccgcagtgg

SEQ ID NO: 3282104 - DNA, 14 bp, Homo sapiens
cccagccctgctgg

SEQ ID NO: 3282105 - DNA, 17 bp, Homo sapiens
cccagccctgctgggga

SEQ ID NO: 3282106 - DNA, 14 bp, Homo sapiens
cccagccctggctc

SEQ ID NO: 3282107 - DNA, 16 bp, Homo sapiens
cccagccctggctctg

SEQ ID NO: 3282108 - DNA, 21 bp, Homo sapiens
cccagccctgggaaccactcc

SEQ ID NO: 3282109 - DNA, 23 bp, Homo sapiens
cccagccctgggaaccactccca

SEQ ID NO: 3282110 - DNA, 17 bp, Homo sapiens
cccagccctgtcctggt

SEQ ID NO: 3282111 - DNA, 16 bp, Homo sapiens
cccagcccttctgcct

SEQ ID NO: 3282112 - DNA, 17 bp, Homo sapiens
cccagcccttctgcctt

SEQ ID NO: 3282113 - DNA, 20 bp, Homo sapiens
cccagcccttctgcctttct

SEQ ID NO: 3282114 - DNA, 21 bp, Homo sapiens
cccagccggcctctctggcct

SEQ ID NO: 3282115 - DNA, 22 bp, Homo sapiens
cccagccgtcgtctccctcgac

SEQ ID NO: 3282116 - DNA, 15 bp, Homo sapiens
cctccacagcgaggg

SEQ ID NO: 3282117 - DNA, 21 bp, Homo sapiens
cctccacagcgagggcagctg

SEQ ID NO: 3282118 - DNA, 21 bp, Homo sapiens
cctccacatcccagcagccca

SEQ ID NO: 3282119 - DNA, 15 bp, Homo sapiens
cctccacatcctgtg

SEQ ID NO: 3282120 - DNA, 16 bp, Homo sapiens
cctccacatcctgtgt

SEQ ID NO: 3282121 - DNA, 17 bp, Homo sapiens
cctccaccaccactggc

SEQ ID NO: 3282122 - DNA, 13 bp, Homo sapiens
cctccacccagcc

SEQ ID NO: 3282123 - DNA, 14 bp, Homo sapiens
cctccaccttccat

SEQ ID NO: 3282124 - DNA, 12 bp, Homo sapiens
cctccacgtgat

SEQ ID NO: 3282125 - DNA, 12 bp, Homo sapiens
cctccactcccc

SEQ ID NO: 3282126 - DNA, 21 bp, Homo sapiens
cctccactcccccacctgaca

SEQ ID NO: 3282127 - DNA, 22 bp, Homo sapiens
cctccactggggaatgctccca

SEQ ID NO: 3282128 - DNA, 12 bp, Homo sapiens
cctccagaagcc

SEQ ID NO: 3282129 - DNA, 17 bp, Homo sapiens
cctccagaagcctctgg

SEQ ID NO: 3282130 - DNA, 18 bp, Homo sapiens
cctccagaagcctctggc

SEQ ID NO: 3282131 - DNA, 14 bp, Homo sapiens
cctccagaccacca

SEQ ID NO: 3282132 - DNA, 17 bp, Homo sapiens
cctccagaccaccagcc

SEQ ID NO: 3282133 - DNA, 18 bp, Homo sapiens
cctccagaccaccagccg

SEQ ID NO: 3282134 - DNA, 17 bp, Homo sapiens
cctccagagacaacagg

SEQ ID NO: 3282135 - DNA, 14 bp, Homo sapiens
cctccagagccagc

SEQ ID NO: 3282136 - DNA, 14 bp, Homo sapiens
cctccagcccctgt

SEQ ID NO: 3282137 - DNA, 14 bp, Homo sapiens
cctccagcccggga

SEQ ID NO: 3282138 - DNA, 15 bp, Homo sapiens
cctccagcccgggag

SEQ ID NO: 3282139 - DNA, 17 bp, Homo sapiens
cctccagcccgggagcc

SEQ ID NO: 3282140 - DNA, 22 bp, Homo sapiens
cctccagcctttggccttggct

SEQ ID NO: 3282141 - DNA, 14 bp, Homo sapiens
cctccagctgcacc

SEQ ID NO: 3282142 - DNA, 17 bp, Homo sapiens
cctccaggaagaagcag

SEQ ID NO: 3282143 - DNA, 20 bp, Homo sapiens
cctccaggaagaagcagggg

SEQ ID NO: 3282144 - DNA, 14 bp, Homo sapiens
cctccaggagagag

SEQ ID NO: 3282145 - DNA, 15 bp, Homo sapiens
cctccaggagagagc

SEQ ID NO: 3282146 - DNA, 18 bp, Homo sapiens
cctccaggagagagccag

SEQ ID NO: 3282147 - DNA, 19 bp, Homo sapiens
cctccaggagagagccagg

SEQ ID NO: 3282148 - DNA, 13 bp, Homo sapiens
cctccaggcaaaa

SEQ ID NO: 3282149 - DNA, 19 bp, Homo sapiens
cctccaggcctgcctccca

SEQ ID NO: 3282150 - DNA, 17 bp, Homo sapiens
cctccaggcctgttgct

SEQ ID NO: 3282151 - DNA, 16 bp, Homo sapiens
cctccagggcccccca

SEQ ID NO: 3282152 - DNA, 19 bp, Homo sapiens
cctccaggtgtgcacgtgg

SEQ ID NO: 3282153 - DNA, 12 bp, Homo sapiens
cctccatccctg

SEQ ID NO: 3282154 - DNA, 16 bp, Homo sapiens
cctccatccctggccc

SEQ ID NO: 3282155 - DNA, 21 bp, Homo sapiens
cctccatcctatccactgggc

SEQ ID NO: 3282156 - DNA, 16 bp, Homo sapiens
cctccatctttctaca

SEQ ID NO: 3282157 - DNA, 14 bp, Homo sapiens
cctccatgctcctc

SEQ ID NO: 3282158 - DNA, 18 bp, Homo sapiens
cctccatgctcctcacct

SEQ ID NO: 3282159 - DNA, 19 bp, Homo sapiens
cctccatgctcctcacctg

SEQ ID NO: 3282160 - DNA, 19 bp, Homo sapiens
cctccatgctgcctccaga

SEQ ID NO: 3282161 - DNA, 12 bp, Homo sapiens
cctccatgtggg

SEQ ID NO: 3282162 - DNA, 18 bp, Homo sapiens
cctcccaaagtgctggga

SEQ ID NO: 3282163 - DNA, 18 bp, Homo sapiens
cctcccaacccagccgtc

SEQ ID NO: 3282164 - DNA, 23 bp, Homo sapiens
cctcccacaattaaaccgcatgt

SEQ ID NO: 3282165 - DNA, 21 bp, Homo sapiens
cctcccacacttgctggggct

SEQ ID NO: 3282166 - DNA, 13 bp, Homo sapiens
cctcccaccccca

SEQ ID NO: 3282167 - DNA, 13 bp, Homo sapiens
cctcccacctcca

SEQ ID NO: 3282168 - DNA, 14 bp, Homo sapiens
cctcccacctccag

SEQ ID NO: 3282169 - DNA, 16 bp, Homo sapiens
cctcccacctccgtgt

SEQ ID NO: 3282170 - DNA, 15 bp, Homo sapiens
cctcccacctctgtg

SEQ ID NO: 3282171 - DNA, 19 bp, Homo sapiens
cctcccactcttgaagagg

SEQ ID NO: 3282172 - DNA, 20 bp, Homo sapiens
cctcccagaggagccaccag

SEQ ID NO: 3282173 - DNA, 12 bp, Homo sapiens
cctcccagaggt

SEQ ID NO: 3282174 - DNA, 23 bp, Homo sapiens
cctcccagaggtccagcccatct

SEQ ID NO: 3282175 - DNA, 12 bp, Homo sapiens
cctcccagcgtg

SEQ ID NO: 3282176 - DNA, 17 bp, Homo sapiens
cctcccagcgtgtgtat

SEQ ID NO: 3282177 - DNA, 20 bp, Homo sapiens
cctccccaaatcaatacact

SEQ ID NO: 3282178 - DNA, 12 bp, Homo sapiens
cctccccagccc

SEQ ID NO: 3282179 - DNA, 21 bp, Homo sapiens
cctccccattagagtcagcct

SEQ ID NO: 3282180 - DNA, 15 bp, Homo sapiens
cctccccatttccca

SEQ ID NO: 3282181 - DNA, 20 bp, Homo sapiens
cctccccatttcccatctgc

SEQ ID NO: 3282182 - DNA, 21 bp, Homo sapiens
cctccccatttcccatctgca

SEQ ID NO: 3282183 - DNA, 23 bp, Homo sapiens
cctccccatttcccatctgcacc

SEQ ID NO: 3282184 - DNA, 14 bp, Homo sapiens
cctcccccacccct

SEQ ID NO: 3282185 - DNA, 13 bp, Homo sapiens
cctccccctgcca

SEQ ID NO: 3282186 - DNA, 16 bp, Homo sapiens
cctccccctggcactg

SEQ ID NO: 3282187 - DNA, 14 bp, Homo sapiens
cctccccctgtccc

SEQ ID NO: 3282188 - DNA, 21 bp, Homo sapiens
cctccccgcagtgggaagtga

SEQ ID NO: 3282189 - DNA, 18 bp, Homo sapiens
cctccccgcctggccagg

SEQ ID NO: 3282190 - DNA, 20 bp, Homo sapiens
cctccccgcctggccagggc

SEQ ID NO: 3282191 - DNA, 22 bp, Homo sapiens
cctccccgcctggccagggcag

SEQ ID NO: 3282192 - DNA, 15 bp, Homo sapiens
cctccccgctgggaa

SEQ ID NO: 3282193 - DNA, 17 bp, Homo sapiens
cctccccggcaccctct

SEQ ID NO: 3282194 - DNA, 23 bp, Homo sapiens
cctccccggctcgagcagtcctg

SEQ ID NO: 3282195 - DNA, 9 bp, Homo sapiens
cctcccctc

SEQ ID NO: 3282196 - DNA, 18 bp, Homo sapiens
cctcccctcacagcctct

SEQ ID NO: 3282197 - DNA, 19 bp, Homo sapiens
cctcccctcacagcctctg

SEQ ID NO: 3282198 - DNA, 12 bp, Homo sapiens
cctcccctccat

SEQ ID NO: 3282199 - DNA, 16 bp, Homo sapiens
cctcccctccatccct

SEQ ID NO: 3282200 - DNA, 14 bp, Homo sapiens
cctcccctcccagt

SEQ ID NO: 3282201 - DNA, 19 bp, Homo sapiens
cctcccctcccctgctgca

SEQ ID NO: 3282202 - DNA, 12 bp, Homo sapiens
cctcccctcctt

SEQ ID NO: 3282203 - DNA, 14 bp, Homo sapiens
cctcccctccttgt

SEQ ID NO: 3282204 - DNA, 16 bp, Homo sapiens
cctcccctctcttgca

SEQ ID NO: 3282205 - DNA, 14 bp, Homo sapiens
cctcccctcttgag

SEQ ID NO: 3282206 - DNA, 13 bp, Homo sapiens
cctcccctgccac

SEQ ID NO: 3282207 - DNA, 16 bp, Homo sapiens
cctcccctgctgcagg

SEQ ID NO: 3282208 - DNA, 15 bp, Homo sapiens
cctcccgaagccacc

SEQ ID NO: 3282209 - DNA, 14 bp, Homo sapiens
cctcccgaggaggg

SEQ ID NO: 3282210 - DNA, 20 bp, Homo sapiens
cctcccgagtagctgggact

SEQ ID NO: 3282211 - DNA, 15 bp, Homo sapiens
cctcccggcatggga

SEQ ID NO: 3282212 - DNA, 19 bp, Homo sapiens
cctcccgtagtctcctggg

SEQ ID NO: 3282213 - DNA, 18 bp, Homo sapiens
cctccctactcccctggg

SEQ ID NO: 3282214 - DNA, 15 bp, Homo sapiens
cctccctagccagca

SEQ ID NO: 3282215 - DNA, 16 bp, Homo sapiens
cctccctcccgtcctt

SEQ ID NO: 3282216 - DNA, 12 bp, Homo sapiens
cctccctccttc

SEQ ID NO: 3282217 - DNA, 13 bp, Homo sapiens
cctccctctaatt

SEQ ID NO: 3282218 - DNA, 22 bp, Homo sapiens
cctccctctcccaggcccgaga

SEQ ID NO: 3282219 - DNA, 18 bp, Homo sapiens
cctccctctgatttttca

SEQ ID NO: 3282220 - DNA, 22 bp, Homo sapiens
cctccctctgccccaagcagcc

SEQ ID NO: 3282221 - DNA, 18 bp, Homo sapiens
cctccctgactccctgtg

SEQ ID NO: 3282222 - DNA, 14 bp, Homo sapiens
cctccctgcccagg

SEQ ID NO: 3282223 - DNA, 15 bp, Homo sapiens
cctccctgcccccca

SEQ ID NO: 3282224 - DNA, 18 bp, Homo sapiens
cctccctgcccctccctt

SEQ ID NO: 3282225 - DNA, 19 bp, Homo sapiens
cctccctgctcagtgcttg

SEQ ID NO: 3282226 - DNA, 15 bp, Homo sapiens
cctccctgctgtgcc

SEQ ID NO: 3282227 - DNA, 18 bp, Homo sapiens
cctccctggctcccatga

SEQ ID NO: 3282228 - DNA, 15 bp, Homo sapiens
cctccctggctgccc

SEQ ID NO: 3282229 - DNA, 16 bp, Homo sapiens
cctccctggctgccct

SEQ ID NO: 3282230 - DNA, 20 bp, Homo sapiens
cctccctggctgccctggcc

SEQ ID NO: 3282231 - DNA, 21 bp, Homo sapiens
cctccctggctgccctggccc

SEQ ID NO: 3282232 - DNA, 23 bp, Homo sapiens
cctccctggctgccctggccctg

SEQ ID NO: 3282233 - DNA, 20 bp, Homo sapiens
cctccctgtctctgcatctg

SEQ ID NO: 3282234 - DNA, 15 bp, Homo sapiens
cctcccttccgaccc

SEQ ID NO: 3282235 - DNA, 20 bp, Homo sapiens
cctcccttccgaccctctgg

SEQ ID NO: 3282236 - DNA, 21 bp, Homo sapiens
cctcccttccgaccctctggg

SEQ ID NO: 3282237 - DNA, 22 bp, Homo sapiens
cctcccttccgaccctctggga

SEQ ID NO: 3282238 - DNA, 16 bp, Homo sapiens
cctcccttccttttcc

SEQ ID NO: 3282239 - DNA, 17 bp, Homo sapiens
cctcccttccttttccc

SEQ ID NO: 3282240 - DNA, 14 bp, Homo sapiens
cctcccttgtcctt

SEQ ID NO: 3282241 - DNA, 17 bp, Homo sapiens
cctcccttgtccttgaa

SEQ ID NO: 3282242 - DNA, 20 bp, Homo sapiens
cctccgaccacttccagggg

SEQ ID NO: 3282243 - DNA, 18 bp, Homo sapiens
cctctcaggatccaagct

SEQ ID NO: 3282244 - DNA, 19 bp, Homo sapiens
cctctcagggcctggcagg

SEQ ID NO: 3282245 - DNA, 20 bp, Homo sapiens
cctctcagggcctggcaggc

SEQ ID NO: 3282246 - DNA, 12 bp, Homo sapiens
cctctccaaggg

SEQ ID NO: 3282247 - DNA, 23 bp, Homo sapiens
cctctccaagtctctctgtgaat

SEQ ID NO: 3282248 - DNA, 14 bp, Homo sapiens
cctctccactccat

SEQ ID NO: 3282249 - DNA, 15 bp, Homo sapiens
cctctccactccatg

SEQ ID NO: 3282250 - DNA, 21 bp, Homo sapiens
cctctccagtttgcacctgtc

SEQ ID NO: 3282251 - DNA, 23 bp, Homo sapiens
cctctccagtttgcacctgtccc

SEQ ID NO: 3282252 - DNA, 17 bp, Homo sapiens
cctctccatatctcctt

SEQ ID NO: 3282253 - DNA, 22 bp, Homo sapiens
cctctcccacagagtgctggac

SEQ ID NO: 3282254 - DNA, 16 bp, Homo sapiens
cctctcccaggcccga

SEQ ID NO: 3282255 - DNA, 14 bp, Homo sapiens
cctctcccatcccc

SEQ ID NO: 3282256 - DNA, 15 bp, Homo sapiens
cctctcccatccccc

SEQ ID NO: 3282257 - DNA, 20 bp, Homo sapiens
cctctcccatccccctgccc

SEQ ID NO: 3282258 - DNA, 21 bp, Homo sapiens
cctctccccaggtccagctct

SEQ ID NO: 3282259 - DNA, 14 bp, Homo sapiens
cctctcccctccag

SEQ ID NO: 3282260 - DNA, 15 bp, Homo sapiens
cctctcccctccagc

SEQ ID NO: 3282261 - DNA, 19 bp, Homo sapiens
cctctcccggctgcctgcc

SEQ ID NO: 3282262 - DNA, 13 bp, Homo sapiens
cctctccctgcca

SEQ ID NO: 3282263 - DNA, 13 bp, Homo sapiens
cctctccctgttg

SEQ ID NO: 3282264 - DNA, 18 bp, Homo sapiens
cctctcctgcccaagcac

SEQ ID NO: 3282265 - DNA, 14 bp, Homo sapiens
cctctcctgcccag

SEQ ID NO: 3282266 - DNA, 23 bp, Homo sapiens
cctctccttcatgacagcctcca

SEQ ID NO: 3282267 - DNA, 13 bp, Homo sapiens
cctctccttcctg

SEQ ID NO: 3282268 - DNA, 15 bp, Homo sapiens
cctctccttcctgtg

SEQ ID NO: 3282269 - DNA, 21 bp, Homo sapiens
cctctccttgggctcctggct

SEQ ID NO: 3282270 - DNA, 22 bp, Homo sapiens
cctctccttgggctcctggctg

SEQ ID NO: 3282271 - DNA, 16 bp, Homo sapiens
cctctcgagggcaggg

SEQ ID NO: 3282272 - DNA, 16 bp, Homo sapiens
cctctctccctctccc

SEQ ID NO: 3282273 - DNA, 23 bp, Homo sapiens
cctctctgcagacttcccagcta

SEQ ID NO: 3282274 - DNA, 14 bp, Homo sapiens
cctctctgcccctg

SEQ ID NO: 3282275 - DNA, 18 bp, Homo sapiens
cctctctgcccctgatca

SEQ ID NO: 3282276 - DNA, 10 bp, Homo sapiens
cctctctgct

SEQ ID NO: 3282277 - DNA, 14 bp, Homo sapiens
cctctctgctcctt

SEQ ID NO: 3282278 - DNA, 17 bp, Homo sapiens
cctctctgctccttcac

SEQ ID NO: 3282279 - DNA, 10 bp, Homo sapiens
cctctctggt

SEQ ID NO: 3282280 - DNA, 13 bp, Homo sapiens
cctctctgtccct

SEQ ID NO: 3282281 - DNA, 17 bp, Homo sapiens
cctctctgtcccttgct

SEQ ID NO: 3282282 - DNA, 20 bp, Homo sapiens
cctctcttatagaatattta

SEQ ID NO: 3282283 - DNA, 14 bp, Homo sapiens
cctctcttgcaccc

SEQ ID NO: 3282284 - DNA, 19 bp, Homo sapiens
cctctcttggcaattcctc

SEQ ID NO: 3282285 - DNA, 20 bp, Homo sapiens
cctctcttggctctactcca

SEQ ID NO: 3282286 - DNA, 19 bp, Homo sapiens
cctctctttgttctcagct

SEQ ID NO: 3282287 - DNA, 13 bp, Homo sapiens
cctctgacacaca

SEQ ID NO: 3282288 - DNA, 18 bp, Homo sapiens
cctctgacacacagctct

SEQ ID NO: 3282289 - DNA, 20 bp, Homo sapiens
cctctgacacacagctctgt

SEQ ID NO: 3282290 - DNA, 18 bp, Homo sapiens
cctctgaccaacaggctg

SEQ ID NO: 3282291 - DNA, 16 bp, Homo sapiens
cctctgacccctcctc

SEQ ID NO: 3282292 - DNA, 22 bp, Homo sapiens
cctctgacccctcctcactggc

SEQ ID NO: 3282293 - DNA, 19 bp, Homo sapiens
cctctgacctgcaggccaa

SEQ ID NO: 3282294 - DNA, 14 bp, Homo sapiens
cctctgagcccaag

SEQ ID NO: 3282295 - DNA, 16 bp, Homo sapiens
cctctgagcccaagct

SEQ ID NO: 3282296 - DNA, 13 bp, Homo sapiens
cctctgagcccag

SEQ ID NO: 3282297 - DNA, 16 bp, Homo sapiens
cctctgagcccagctg

SEQ ID NO: 3282298 - DNA, 18 bp, Homo sapiens
cctctgagcccagctgcc

SEQ ID NO: 3282299 - DNA, 13 bp, Homo sapiens
cccatttttactt

SEQ ID NO: 3282300 - DNA, 16 bp, Homo sapiens
ccccaaaattatcagt

SEQ ID NO: 3282301 - DNA, 16 bp, Homo sapiens
ccccaaacccagaaag

SEQ ID NO: 3282302 - DNA, 17 bp, Homo sapiens
ccccaaacccagaaaga

SEQ ID NO: 3282303 - DNA, 19 bp, Homo sapiens
ccccaaacgggctgccctg

SEQ ID NO: 3282304 - DNA, 16 bp, Homo sapiens
ccccaaagctttcctg

SEQ ID NO: 3282305 - DNA, 18 bp, Homo sapiens
ccccaaagctttcctgcc

SEQ ID NO: 3282306 - DNA, 19 bp, Homo sapiens
ccccaaagctttcctgccc

SEQ ID NO: 3282307 - DNA, 19 bp, Homo sapiens
ccccaaaggaaaaagcaca

SEQ ID NO: 3282308 - DNA, 13 bp, Homo sapiens
ccccaacactcca

SEQ ID NO: 3282309 - DNA, 20 bp, Homo sapiens
ccccaacagcgacatagccc

SEQ ID NO: 3282310 - DNA, 18 bp, Homo sapiens
ccccaaccatcttcactg

SEQ ID NO: 3282311 - DNA, 17 bp, Homo sapiens
ccccaacccacctctgg

SEQ ID NO: 3282312 - DNA, 16 bp, Homo sapiens
ccccaaccccgcggtg

SEQ ID NO: 3282313 - DNA, 22 bp, Homo sapiens
ccccaaccccgcggtgctctgg

SEQ ID NO: 3282314 - DNA, 13 bp, Homo sapiens
ccccaacccctga

SEQ ID NO: 3282315 - DNA, 13 bp, Homo sapiens
ccccaacctcaga

SEQ ID NO: 3282316 - DNA, 21 bp, Homo sapiens
ccccaacctcagggctcccag

SEQ ID NO: 3282317 - DNA, 22 bp, Homo sapiens
ccccaacctcagggctcccagg

SEQ ID NO: 3282318 - DNA, 14 bp, Homo sapiens
ccccaactctgagc

SEQ ID NO: 3282319 - DNA, 19 bp, Homo sapiens
ccccaactctgagcccatg

SEQ ID NO: 3282320 - DNA, 14 bp, Homo sapiens
ccccaagctgtttt

SEQ ID NO: 3282321 - DNA, 20 bp, Homo sapiens
ccccaagggccctggcaccc

SEQ ID NO: 3282322 - DNA, 18 bp, Homo sapiens
ccccaataaaggcagctg

SEQ ID NO: 3282323 - DNA, 19 bp, Homo sapiens
ccccaataaaggcagctgc

SEQ ID NO: 3282324 - DNA, 24 bp, Homo sapiens
ccccaataaaggcagctgcctctg

SEQ ID NO: 3282325 - DNA, 22 bp, Homo sapiens
ccccaattactattccctttga

SEQ ID NO: 3282326 - DNA, 12 bp, Homo sapiens
ccccacaacttt

SEQ ID NO: 3282327 - DNA, 18 bp, Homo sapiens
ccccacaagtgccctcca

SEQ ID NO: 3282328 - DNA, 15 bp, Homo sapiens
ccccacaccccagcc

SEQ ID NO: 3282329 - DNA, 16 bp, Homo sapiens
ccccacacctcagttc

SEQ ID NO: 3282330 - DNA, 17 bp, Homo sapiens
ccccacacctccctact

SEQ ID NO: 3282331 - DNA, 14 bp, Homo sapiens
ccccacagttgtgt

SEQ ID NO: 3282332 - DNA, 14 bp, Homo sapiens
ccccaccagctcgt

SEQ ID NO: 3282333 - DNA, 12 bp, Homo sapiens
ccccacccacct

SEQ ID NO: 3282334 - DNA, 23 bp, Homo sapiens
ccccacccacctccacccagccc

SEQ ID NO: 3282335 - DNA, 13 bp, Homo sapiens
ccccacccaggag

SEQ ID NO: 3282336 - DNA, 16 bp, Homo sapiens
ccccacccccagctca

SEQ ID NO: 3282337 - DNA, 18 bp, Homo sapiens
ccccacccccgccatgca

SEQ ID NO: 3282338 - DNA, 19 bp, Homo sapiens
ccccaccccggggaccctg

SEQ ID NO: 3282339 - DNA, 14 bp, Homo sapiens
ccccacccctaagt

SEQ ID NO: 3282340 - DNA, 14 bp, Homo sapiens
ccccacccctgccc

SEQ ID NO: 3282341 - DNA, 15 bp, Homo sapiens
ccccaccccttcccc

SEQ ID NO: 3282342 - DNA, 16 bp, Homo sapiens
ccccaccctgccactc

SEQ ID NO: 3282343 - DNA, 15 bp, Homo sapiens
ccccaccctgggccc

SEQ ID NO: 3282344 - DNA, 20 bp, Homo sapiens
ccccaccctgggccctgggc

SEQ ID NO: 3282345 - DNA, 17 bp, Homo sapiens
ccccaccgccgtggagt

SEQ ID NO: 3282346 - DNA, 13 bp, Homo sapiens
ccccacctctcca

SEQ ID NO: 3282347 - DNA, 13 bp, Homo sapiens
ccccacgagggct

SEQ ID NO: 3282348 - DNA, 22 bp, Homo sapiens
ccccacgagtcacctgcaagcc

SEQ ID NO: 3282349 - DNA, 23 bp, Homo sapiens
ccccactactgcagcacctccag

SEQ ID NO: 3282350 - DNA, 18 bp, Homo sapiens
ccccactcaccagtgtcc

SEQ ID NO: 3282351 - DNA, 15 bp, Homo sapiens
ccccactcaccccct

SEQ ID NO: 3282352 - DNA, 14 bp, Homo sapiens
ccccactccccacc

SEQ ID NO: 3282353 - DNA, 23 bp, Homo sapiens
ccccactccctggctctcagaag

SEQ ID NO: 3282354 - DNA, 23 bp, Homo sapiens
ccccactcccttgctggccccag

SEQ ID NO: 3282355 - DNA, 19 bp, Homo sapiens
ccccactcctctcccacag

SEQ ID NO: 3282356 - DNA, 15 bp, Homo sapiens
ccccactgacagcct

SEQ ID NO: 3282357 - DNA, 21 bp, Homo sapiens
ccccactgacagcctcccacc

SEQ ID NO: 3282358 - DNA, 11 bp, Homo sapiens
ccccactgatg

SEQ ID NO: 3282359 - DNA, 19 bp, Homo sapiens
ccccactgggccagccctg

SEQ ID NO: 3282360 - DNA, 23 bp, Homo sapiens
ccccactgggccagccctgcagc

SEQ ID NO: 3282361 - DNA, 21 bp, Homo sapiens
ccccactgtccccctacccac

SEQ ID NO: 3282362 - DNA, 14 bp, Homo sapiens
ccccacttgcctct

SEQ ID NO: 3282363 - DNA, 16 bp, Homo sapiens
ccccagaaggcaggga

SEQ ID NO: 3282364 - DNA, 17 bp, Homo sapiens
ccccagaccccagggca

SEQ ID NO: 3282365 - DNA, 17 bp, Homo sapiens
ccccagacgcatagact

SEQ ID NO: 3282366 - DNA, 19 bp, Homo sapiens
ccccagactcagctggaag

SEQ ID NO: 3282367 - DNA, 21 bp, Homo sapiens
ccccagagagaggatgtggaa

SEQ ID NO: 3282368 - DNA, 16 bp, Homo sapiens
ccccagagatgccagc

SEQ ID NO: 3282369 - DNA, 19 bp, Homo sapiens
ccccagagatgccagccct

SEQ ID NO: 3282370 - DNA, 22 bp, Homo sapiens
ccccagagatgccagcccttca

SEQ ID NO: 3282371 - DNA, 22 bp, Homo sapiens
ccccagagcacccccaagcctg

SEQ ID NO: 3282372 - DNA, 21 bp, Homo sapiens
ccccagagctgtttatggcct

SEQ ID NO: 3282373 - DNA, 17 bp, Homo sapiens
ccccagaggccctggag

SEQ ID NO: 3282374 - DNA, 18 bp, Homo sapiens
ccccagatagagctgggt

SEQ ID NO: 3282375 - DNA, 17 bp, Homo sapiens
ccccagatctgcctggg

SEQ ID NO: 3282376 - DNA, 19 bp, Homo sapiens
ccccagatctgcctgggcc

SEQ ID NO: 3282377 - DNA, 22 bp, Homo sapiens
ccccagatctgcctgggcctgt

SEQ ID NO: 3282378 - DNA, 22 bp, Homo sapiens
ccccagcactaaggccgtgtct

SEQ ID NO: 3282379 - DNA, 13 bp, Homo sapiens
ccccagcagccct

SEQ ID NO: 3282380 - DNA, 20 bp, Homo sapiens
ccccagcagccctcaacagg

SEQ ID NO: 3282381 - DNA, 23 bp, Homo sapiens
ccccagcagttgaatgacaacag

SEQ ID NO: 3282382 - DNA, 12 bp, Homo sapiens
ccccagcatcac

SEQ ID NO: 3282383 - DNA, 19 bp, Homo sapiens
ccccagcattccagcccct

SEQ ID NO: 3282384 - DNA, 9 bp, Homo sapiens
ccccagcca

SEQ ID NO: 3282385 - DNA, 11 bp, Homo sapiens
ccccagccaga

SEQ ID NO: 3282386 - DNA, 13 bp, Homo sapiens
ccccagccaggct

SEQ ID NO: 3282387 - DNA, 14 bp, Homo sapiens
ccccagcccaaagg

SEQ ID NO: 3282388 - DNA, 12 bp, Homo sapiens
ccccagcccagg

SEQ ID NO: 3282389 - DNA, 18 bp, Homo sapiens
ccccagcccctagcccag

SEQ ID NO: 3282390 - DNA, 20 bp, Homo sapiens
ccccagcccctagcccagga

SEQ ID NO: 3282391 - DNA, 14 bp, Homo sapiens
ccccagccccttct

SEQ ID NO: 3282392 - DNA, 22 bp, Homo sapiens
ccccagccccttctcccagcac

SEQ ID NO: 3282393 - DNA, 14 bp, Homo sapiens
ccccagccctgctg

SEQ ID NO: 3282394 - DNA, 16 bp, Homo sapiens
ccccagccctgctggg

SEQ ID NO: 3282395 - DNA, 20 bp, Homo sapiens
ccccagccctgctggggatc

SEQ ID NO: 3282396 - DNA, 12 bp, Homo sapiens
ccccagccctgg

SEQ ID NO: 3282397 - DNA, 16 bp, Homo sapiens
ccccagccctggctct

SEQ ID NO: 3282398 - DNA, 15 bp, Homo sapiens
ccccagccctgggaa

SEQ ID NO: 3282399 - DNA, 16 bp, Homo sapiens
ccccagcccttctgcc

SEQ ID NO: 3282400 - DNA, 14 bp, Homo sapiens
ccccagcctctggc

SEQ ID NO: 3282401 - DNA, 15 bp, Homo sapiens
ccccagcctctggca

SEQ ID NO: 3282402 - DNA, 16 bp, Homo sapiens
ccccagcctctggcat

SEQ ID NO: 3282403 - DNA, 17 bp, Homo sapiens
ccccagcctgacctgag

SEQ ID NO: 3282404 - DNA, 22 bp, Homo sapiens
ccccagctaccctttttctcca

SEQ ID NO: 3282405 - DNA, 14 bp, Homo sapiens
ccccagctcaatgg

SEQ ID NO: 3282406 - DNA, 13 bp, Homo sapiens
ccccagctcaggg

SEQ ID NO: 3282407 - DNA, 17 bp, Homo sapiens
ccccagctcaggggcag

SEQ ID NO: 3282408 - DNA, 12 bp, Homo sapiens
ccccagctggga

SEQ ID NO: 3282409 - DNA, 14 bp, Homo sapiens
ccccagctgtgagc

SEQ ID NO: 3282410 - DNA, 13 bp, Homo sapiens
ccccagctttgcc

SEQ ID NO: 3282411 - DNA, 14 bp, Homo sapiens
ccccagctttgccc

SEQ ID NO: 3282412 - DNA, 14 bp, Homo sapiens
ccccaggccaggtg

SEQ ID NO: 3282413 - DNA, 14 bp, Homo sapiens
ccccaggccctccc

SEQ ID NO: 3282414 - DNA, 15 bp, Homo sapiens
ccccaggcctccagc

SEQ ID NO: 3282415 - DNA, 16 bp, Homo sapiens
ccccaggcctccagcc

SEQ ID NO: 3282416 - DNA, 17 bp, Homo sapiens
ccccaggcctccagcct

SEQ ID NO: 3282417 - DNA, 18 bp, Homo sapiens
ccccaggcctccagcctc

SEQ ID NO: 3282418 - DNA, 21 bp, Homo sapiens
ccccaggcctgaaagaggctg

SEQ ID NO: 3282419 - DNA, 23 bp, Homo sapiens
ccccaggcctgaaagaggctgag

SEQ ID NO: 3282420 - DNA, 15 bp, Homo sapiens
ccccaggcctgtcca

SEQ ID NO: 3282421 - DNA, 16 bp, Homo sapiens
ccccaggcctgtccac

SEQ ID NO: 3282422 - DNA, 23 bp, Homo sapiens
ccccaggcctgtccaccctgcca

SEQ ID NO: 3282423 - DNA, 19 bp, Homo sapiens
ccccaggctggacatgctg

SEQ ID NO: 3282424 - DNA, 18 bp, Homo sapiens
ccccagggaaggaaaaat

SEQ ID NO: 3282425 - DNA, 17 bp, Homo sapiens
cccaggtcttccagacc

SEQ ID NO: 3282426 - DNA, 21 bp, Homo sapiens
cccaggtggaaggcagacagc

SEQ ID NO: 3282427 - DNA, 19 bp, Homo sapiens
cccaggtggagggcacagc

SEQ ID NO: 3282428 - DNA, 18 bp, Homo sapiens
cccaggttcccccagcaa

SEQ ID NO: 3282429 - DNA, 13 bp, Homo sapiens
cccaggtttctat

SEQ ID NO: 3282430 - DNA, 21 bp, Homo sapiens
cccagtatacctcatttttca

SEQ ID NO: 3282431 - DNA, 23 bp, Homo sapiens
cccagtccaaatgtcctccagaa

SEQ ID NO: 3282432 - DNA, 21 bp, Homo sapiens
cccagtccccaacctgcactc

SEQ ID NO: 3282433 - DNA, 21 bp, Homo sapiens
cccagtccccacccctgcccc

SEQ ID NO: 3282434 - DNA, 14 bp, Homo sapiens
cccagtcccccaac

SEQ ID NO: 3282435 - DNA, 18 bp, Homo sapiens
cccagtctggaatgcagt

SEQ ID NO: 3282436 - DNA, 13 bp, Homo sapiens
cccagtcttcctt

SEQ ID NO: 3282437 - DNA, 14 bp, Homo sapiens
cccagtgaagcctc

SEQ ID NO: 3282438 - DNA, 17 bp, Homo sapiens
cccagtgaagcctctga

SEQ ID NO: 3282439 - DNA, 20 bp, Homo sapiens
cccagtgacaaagactcctc

SEQ ID NO: 3282440 - DNA, 19 bp, Homo sapiens
cccagtgacacttcagaga

SEQ ID NO: 3282441 - DNA, 23 bp, Homo sapiens
cccagtgagtctctggggcaggc

SEQ ID NO: 3282442 - DNA, 12 bp, Homo sapiens
cccagtgccact

SEQ ID NO: 3282443 - DNA, 14 bp, Homo sapiens
cccagtgccactgc

SEQ ID NO: 3282444 - DNA, 17 bp, Homo sapiens
cccagtgccactgcccc

SEQ ID NO: 3282445 - DNA, 18 bp, Homo sapiens
cccagtgccactgccccc

SEQ ID NO: 3282446 - DNA, 13 bp, Homo sapiens
cccagtgcccaca

SEQ ID NO: 3282447 - DNA, 12 bp, Homo sapiens
cccagtgctgcc

SEQ ID NO: 3282448 - DNA, 15 bp, Homo sapiens
cccagtgctgccatg

SEQ ID NO: 3282449 - DNA, 16 bp, Homo sapiens
cccagtgctgccatgc

SEQ ID NO: 3282450 - DNA, 22 bp, Homo sapiens
cccagtgctgccatgccactgc

SEQ ID NO: 3282451 - DNA, 18 bp, Homo sapiens
cccagtgggacagaggag

SEQ ID NO: 3282452 - DNA, 18 bp, Homo sapiens
cccagtgggaggggcagg

SEQ ID NO: 3282453 - DNA, 19 bp, Homo sapiens
cccagtgggaggggcaggc

SEQ ID NO: 3282454 - DNA, 20 bp, Homo sapiens
cccagtgggaggggcaggct

SEQ ID NO: 3282455 - DNA, 17 bp, Homo sapiens
cccagtgggtctgggat

SEQ ID NO: 3282456 - DNA, 17 bp, Homo sapiens
cccagtgttgtttgtaa

SEQ ID NO: 3282457 - DNA, 13 bp, Homo sapiens
cccagttctgctc

SEQ ID NO: 3282458 - DNA, 21 bp, Homo sapiens
cccagttctgctcctctccag

SEQ ID NO: 3282459 - DNA, 20 bp, Homo sapiens
cccagttgcactcaggtgac

SEQ ID NO: 3282460 - DNA, 24 bp, Homo sapiens
cccagttggggaagccaggtgagc

SEQ ID NO: 3282461 - DNA, 14 bp, Homo sapiens
cccataactcaatg

SEQ ID NO: 3282462 - DNA, 23 bp, Homo sapiens
cccataattttttttttcctttt

SEQ ID NO: 3282463 - DNA, 18 bp, Homo sapiens
cccatacttttggctcct

SEQ ID NO: 3282464 - DNA, 22 bp, Homo sapiens
cccatagaaacatgacactgac

SEQ ID NO: 3282465 - DNA, 13 bp, Homo sapiens
cccatagcttcca

SEQ ID NO: 3282466 - DNA, 17 bp, Homo sapiens
cccataggccaccccct

SEQ ID NO: 3282467 - DNA, 15 bp, Homo sapiens
cccatagtggggcct

SEQ ID NO: 3282468 - DNA, 20 bp, Homo sapiens
cccatagtggggcctgggag

SEQ ID NO: 3282469 - DNA, 15 bp, Homo sapiens
cccatattgtaaaac

SEQ ID NO: 3282470 - DNA, 18 bp, Homo sapiens
cccatattgtaaaacagg

SEQ ID NO: 3282471 - DNA, 19 bp, Homo sapiens
cccatattgtaaaacaggt

SEQ ID NO: 3282472 - DNA, 22 bp, Homo sapiens
cccatcacagggttgggcccag

SEQ ID NO: 3282473 - DNA, 17 bp, Homo sapiens
cccatcacctactccag

SEQ ID NO: 3282474 - DNA, 14 bp, Homo sapiens
cccatcatgtggcc

SEQ ID NO: 3282475 - DNA, 19 bp, Homo sapiens
cccatcatgtggccccacc

SEQ ID NO: 3282476 - DNA, 22 bp, Homo sapiens
cccatcattacccttccctgca

SEQ ID NO: 3282477 - DNA, 14 bp, Homo sapiens
cccatccaggcagt

SEQ ID NO: 3282478 - DNA, 14 bp, Homo sapiens
cccatccagttcat

SEQ ID NO: 3282479 - DNA, 21 bp, Homo sapiens
cccatccagttcatgagaatc

SEQ ID NO: 3282480 - DNA, 14 bp, Homo sapiens
cccatccattaggc

SEQ ID NO: 3282481 - DNA, 13 bp, Homo sapiens
cccatcccacacc

SEQ ID NO: 3282482 - DNA, 19 bp, Homo sapiens
cccatccccatcctccagc

SEQ ID NO: 3282483 - DNA, 16 bp, Homo sapiens
cccatccccctgccct

SEQ ID NO: 3282484 - DNA, 21 bp, Homo sapiens
cccatcccctggactgggagg

SEQ ID NO: 3282485 - DNA, 17 bp, Homo sapiens
cccatccccttcctaaa

SEQ ID NO: 3282486 - DNA, 15 bp, Homo sapiens
cccatccctccccag

SEQ ID NO: 3282487 - DNA, 15 bp, Homo sapiens
cccatccctgcctgg

SEQ ID NO: 3282488 - DNA, 16 bp, Homo sapiens
cccatcctcatccctg

SEQ ID NO: 3282489 - DNA, 14 bp, Homo sapiens
cccatcctccagct

SEQ ID NO: 3282490 - DNA, 13 bp, Homo sapiens
cccatcggaagtt

SEQ ID NO: 3282491 - DNA, 17 bp, Homo sapiens
cccatctcagcctcctg

SEQ ID NO: 3282492 - DNA, 20 bp, Homo sapiens
cccatctcagcctcctgagc

SEQ ID NO: 3282493 - DNA, 18 bp, Homo sapiens
cccatctcaggtgccact

SEQ ID NO: 3282494 - DNA, 14 bp, Homo sapiens
cccatctcatcctg

SEQ ID NO: 3282495 - DNA, 22 bp, Homo sapiens
cccatctccaagataagcctga

SEQ ID NO: 3282496 - DNA, 15 bp, Homo sapiens
cccatctccccaggc

SEQ ID NO: 3282497 - DNA, 22 bp, Homo sapiens
cccatctccccaggcctccagc

SEQ ID NO: 3282498 - DNA, 14 bp, Homo sapiens
cccatctccctgcc

SEQ ID NO: 3282499 - DNA, 13 bp, Homo sapiens
cccatctcggagc

SEQ ID NO: 3282500 - DNA, 13 bp, Homo sapiens
cccatctctccct

SEQ ID NO: 3282501 - DNA, 21 bp, Homo sapiens
cccatctctccctcccctgcc

SEQ ID NO: 3282502 - DNA, 23 bp, Homo sapiens
cccatctgggagtccccttttct

SEQ ID NO: 3282503 - DNA, 22 bp, Homo sapiens
cccatctgggtccttgcacccc

SEQ ID NO: 3282504 - DNA, 19 bp, Homo sapiens
cccatctgtagtaatttat

SEQ ID NO: 3282505 - DNA, 16 bp, Homo sapiens
cccatcttccacctgt

SEQ ID NO: 3282506 - DNA, 18 bp, Homo sapiens
cccatcttcctgctgctg

SEQ ID NO: 3282507 - DNA, 19 bp, Homo sapiens
cccatcttcctgctgctgt

SEQ ID NO: 3282508 - DNA, 20 bp, Homo sapiens
cccatcttcctgctgctgta

SEQ ID NO: 3282509 - DNA, 22 bp, Homo sapiens
cccatgaagacaggacagtgct

SEQ ID NO: 3282510 - DNA, 16 bp, Homo sapiens
cccatgacccacccct

SEQ ID NO: 3282511 - DNA, 20 bp, Homo sapiens
cccatgacccacccctgtgc

SEQ ID NO: 3282512 - DNA, 23 bp, Homo sapiens
cccatgacccacccctgtgctcc

SEQ ID NO: 3282513 - DNA, 14 bp, Homo sapiens
cccatgagcctcag

SEQ ID NO: 3282514 - DNA, 16 bp, Homo sapiens
cccatgagcctcagca

SEQ ID NO: 3282515 - DNA, 22 bp, Homo sapiens
cccatgagcctcagcatcctgg

SEQ ID NO: 3282516 - DNA, 21 bp, Homo sapiens
cccatgagcctgcccgctgca

SEQ ID NO: 3282517 - DNA, 14 bp, Homo sapiens
cccatgcccacctg

SEQ ID NO: 3282518 - DNA, 18 bp, Homo sapiens
cccatgcccacctgccca

SEQ ID NO: 3282519 - DNA, 13 bp, Homo sapiens
cccatgctctgcc

SEQ ID NO: 3282520 - DNA, 15 bp, Homo sapiens
cccatgctctgcccc

SEQ ID NO: 3282521 - DNA, 16 bp, Homo sapiens
cccatggacactccag

SEQ ID NO: 3282522 - DNA, 20 bp, Homo sapiens
cccatggacactccagtgcc

SEQ ID NO: 3282523 - DNA, 17 bp, Homo sapiens
cccatggcccccaataa

SEQ ID NO: 3282524 - DNA, 21 bp, Homo sapiens
cccatggccctgtgctaatcc

SEQ ID NO: 3282525 - DNA, 16 bp, Homo sapiens
cccatgggagccaggc

SEQ ID NO: 3282526 - DNA, 15 bp, Homo sapiens
cccatgtagccccct

SEQ ID NO: 3282527 - DNA, 21 bp, Homo sapiens
cccatgtagccccctggcctc

SEQ ID NO: 3282528 - DNA, 22 bp, Homo sapiens
cccatgtagccccctggcctct

SEQ ID NO: 3282529 - DNA, 16 bp, Homo sapiens
cccatgtcaccggtca

SEQ ID NO: 3282530 - DNA, 19 bp, Homo sapiens
cccatgtcgcgctcagcat

SEQ ID NO: 3282531 - DNA, 19 bp, Homo sapiens
cccatgtgcctgcaccagg

SEQ ID NO: 3282532 - DNA, 14 bp, Homo sapiens
cccatgtgccttta

SEQ ID NO: 3282533 - DNA, 15 bp, Homo sapiens
cccatgtggctgaag

SEQ ID NO: 3282534 - DNA, 19 bp, Homo sapiens
cccatgtgtacattctgcc

SEQ ID NO: 3282535 - DNA, 21 bp, Homo sapiens
cccatgtgtacattctgccta

SEQ ID NO: 3282536 - DNA, 17 bp, Homo sapiens
cccatgtgtcccctcac

SEQ ID NO: 3282537 - DNA, 23 bp, Homo sapiens
cccatgttagctacacagtgcag

SEQ ID NO: 3282538 - DNA, 18 bp, Homo sapiens
cccatgttctgcccccag

SEQ ID NO: 3282539 - DNA, 19 bp, Homo sapiens
cccatgttctgcccccagc

SEQ ID NO: 3282540 - DNA, 18 bp, Homo sapiens
cccatgttgtaatgctgc

SEQ ID NO: 3282541 - DNA, 19 bp, Homo sapiens
cccatgttgtaatgctgca

SEQ ID NO: 3282542 - DNA, 21 bp, Homo sapiens
cccattaaggggaagaatgaa

SEQ ID NO: 3282543 - DNA, 20 bp, Homo sapiens
cccattcggggctgacgatg

SEQ ID NO: 3282544 - DNA, 21 bp, Homo sapiens
cccattctgcctgcccaggcc

SEQ ID NO: 3282545 - DNA, 20 bp, Homo sapiens
cccattctttgcttgaacac

SEQ ID NO: 3282546 - DNA, 13 bp, Homo sapiens
cccatttcagctg

SEQ ID NO: 3282547 - DNA, 21 bp, Homo sapiens
cccatttcaggaatttaaaat

SEQ ID NO: 3282548 - DNA, 19 bp, Homo sapiens
cccatttcccatctgcacc

SEQ ID NO: 3282549 - DNA, 13 bp, Homo sapiens
cccatttcctgta

SEQ ID NO: 3282550 - DNA, 16 bp, Homo sapiens
cccatttctatttatt

SEQ ID NO: 3282551 - DNA, 16 bp, Homo sapiens
cccatttgtgccagag

SEQ ID NO: 3282552 - DNA, 18 bp, Homo sapiens
cccatttgtgccagagga

SEQ ID NO: 3282553 - DNA, 18 bp, Homo sapiens
cccacgattggccacctg

SEQ ID NO: 3282554 - DNA, 22 bp, Homo sapiens
cccacgattttctccagctcag

SEQ ID NO: 3282555 - DNA, 15 bp, Homo sapiens
cccacgcagaggacg

SEQ ID NO: 3282556 - DNA, 14 bp, Homo sapiens
cccacgctggagtg

SEQ ID NO: 3282557 - DNA, 20 bp, Homo sapiens
cccacgctggagtgcagtga

SEQ ID NO: 3282558 - DNA, 14 bp, Homo sapiens
cccacggaggagtt

SEQ ID NO: 3282559 - DNA, 20 bp, Homo sapiens
cccacggagtcgtggggtgt

SEQ ID NO: 3282560 - DNA, 17 bp, Homo sapiens
cccacggccgctccagg

SEQ ID NO: 3282561 - DNA, 14 bp, Homo sapiens
cccacgtctggcca

SEQ ID NO: 3282562 - DNA, 15 bp, Homo sapiens
cccacgttctcacac

SEQ ID NO: 3282563 - DNA, 17 bp, Homo sapiens
cccacgttctcacaccc

SEQ ID NO: 3282564 - DNA, 20 bp, Homo sapiens
cccacgttctcacacccacc

SEQ ID NO: 3282565 - DNA, 22 bp, Homo sapiens
cccactactcaatactacctct

SEQ ID NO: 3282566 - DNA, 18 bp, Homo sapiens
cccactactgcagcacct

SEQ ID NO: 3282567 - DNA, 18 bp, Homo sapiens
cccactatccttcgtgaa

SEQ ID NO: 3282568 - DNA, 17 bp, Homo sapiens
cccactccccaccttca

SEQ ID NO: 3282569 - DNA, 20 bp, Homo sapiens
cccactccctggctctcaga

SEQ ID NO: 3282570 - DNA, 17 bp, Homo sapiens
cccactcctctcccaca

SEQ ID NO: 3282571 - DNA, 22 bp, Homo sapiens
cccactcgggtctgcagacctg

SEQ ID NO: 3282572 - DNA, 13 bp, Homo sapiens
cccactctacctc

SEQ ID NO: 3282573 - DNA, 21 bp, Homo sapiens
cccactctaggggtcaggctc

SEQ ID NO: 3282574 - DNA, 14 bp, Homo sapiens
cccactctccccac

SEQ ID NO: 3282575 - DNA, 15 bp, Homo sapiens
cccactctccccaca

SEQ ID NO: 3282576 - DNA, 19 bp, Homo sapiens
ccattgaagccgactctgg

SEQ ID NO: 3282577 - DNA, 20 bp, Homo sapiens
ccattgaagccgactctggc

SEQ ID NO: 3282578 - DNA, 11 bp, Homo sapiens
ccattgaaggc

SEQ ID NO: 3282579 - DNA, 22 bp, Homo sapiens
ccattgacttagaggcaacagg

SEQ ID NO: 3282580 - DNA, 14 bp, Homo sapiens
ccattgagtccctg

SEQ ID NO: 3282581 - DNA, 17 bp, Homo sapiens
ccattgccaccaggaga

SEQ ID NO: 3282582 - DNA, 14 bp, Homo sapiens
ccattgcggcccca

SEQ ID NO: 3282583 - DNA, 17 bp, Homo sapiens
ccattgcttattatgta

SEQ ID NO: 3282584 - DNA, 14 bp, Homo sapiens
ccattggtccaaga

SEQ ID NO: 3282585 - DNA, 13 bp, Homo sapiens
ccattggtgttgt

SEQ ID NO: 3282586 - DNA, 16 bp, Homo sapiens
ccattgtcttgttctg

SEQ ID NO: 3282587 - DNA, 20 bp, Homo sapiens
ccattgtcttgttctgtgat

SEQ ID NO: 3282588 - DNA, 14 bp, Homo sapiens
ccattgtctttata

SEQ ID NO: 3282589 - DNA, 20 bp, Homo sapiens
ccattgtctttatatgaaca

SEQ ID NO: 3282590 - DNA, 20 bp, Homo sapiens
ccatttacatgttttaaaga

SEQ ID NO: 3282591 - DNA, 17 bp, Homo sapiens
ccatttcaattctcaaa

SEQ ID NO: 3282592 - DNA, 17 bp, Homo sapiens
ccatttcaggaatttaa

SEQ ID NO: 3282593 - DNA, 16 bp, Homo sapiens
ccatttcagtggcttc

SEQ ID NO: 3282594 - DNA, 15 bp, Homo sapiens
ccatttcccacatct

SEQ ID NO: 3282595 - DNA, 16 bp, Homo sapiens
ccatttcccacatctt

SEQ ID NO: 3282596 - DNA, 17 bp, Homo sapiens
ccatttcccacatcttt

SEQ ID NO: 3282597 - DNA, 22 bp, Homo sapiens
ccatttcccttctggacactga

SEQ ID NO: 3282598 - DNA, 12 bp, Homo sapiens
ccatttcctgta

SEQ ID NO: 3282599 - DNA, 12 bp, Homo sapiens
ccatttctattt

SEQ ID NO: 3282600 - DNA, 17 bp, Homo sapiens
ccatttctatttattta

SEQ ID NO: 3282601 - DNA, 14 bp, Homo sapiens
ccatttctcactga

SEQ ID NO: 3282602 - DNA, 12 bp, Homo sapiens
ccatttctgatg

SEQ ID NO: 3282603 - DNA, 14 bp, Homo sapiens
ccatttgcctttct

SEQ ID NO: 3282604 - DNA, 15 bp, Homo sapiens
ccatttgcctttctg

SEQ ID NO: 3282605 - DNA, 18 bp, Homo sapiens
ccatttgctactgtacat

SEQ ID NO: 3282606 - DNA, 21 bp, Homo sapiens
ccatttggtgtggattttcta

SEQ ID NO: 3282607 - DNA, 20 bp, Homo sapiens
ccatttgtaaaactccggat

SEQ ID NO: 3282608 - DNA, 20 bp, Homo sapiens
ccatttgtaattaaattatg

SEQ ID NO: 3282609 - DNA, 16 bp, Homo sapiens
ccatttgtgccagagg

SEQ ID NO: 3282610 - DNA, 22 bp, Homo sapiens
ccatttgtgttttgaaagccca

SEQ ID NO: 3282611 - DNA, 18 bp, Homo sapiens
ccattttaacgctgccta

SEQ ID NO: 3282612 - DNA, 14 bp, Homo sapiens
ccattttaatttta

SEQ ID NO: 3282613 - DNA, 20 bp, Homo sapiens
ccattttattaaacattttc

SEQ ID NO: 3282614 - DNA, 19 bp, Homo sapiens
ccattttgcccttccatag

SEQ ID NO: 3282615 - DNA, 14 bp, Homo sapiens
ccatttttaatgat

SEQ ID NO: 3282616 - DNA, 15 bp, Homo sapiens
ccatttttcctctgt

SEQ ID NO: 3282617 - DNA, 20 bp, Homo sapiens
ccatttttgctctatgggaa

SEQ ID NO: 3282618 - DNA, 23 bp, Homo sapiens
ccattttttcttcccttttccct

SEQ ID NO: 3282619 - DNA, 17 bp, Homo sapiens
cccaaaacccagggcaa

SEQ ID NO: 3282620 - DNA, 17 bp, Homo sapiens
cccaaaattatcagtgc

SEQ ID NO: 3282621 - DNA, 19 bp, Homo sapiens
cccaaacccttaactgaca

SEQ ID NO: 3282622 - DNA, 22 bp, Homo sapiens
cccaaacgccctttcctcctca

SEQ ID NO: 3282623 - DNA, 23 bp, Homo sapiens
cccaaacgccctttcctcctcag

SEQ ID NO: 3282624 - DNA, 21 bp, Homo sapiens
cccaaagaatgtttatagcaa

SEQ ID NO: 3282625 - DNA, 21 bp, Homo sapiens
cccaaagagcacaaacatttt

SEQ ID NO: 3282626 - DNA, 13 bp, Homo sapiens
cccaaagcacatg

SEQ ID NO: 3282627 - DNA, 19 bp, Homo sapiens
cccaaagcggtccctgtcc

SEQ ID NO: 3282628 - DNA, 15 bp, Homo sapiens
cccaaagctcagact

SEQ ID NO: 3282629 - DNA, 14 bp, Homo sapiens
cccaaagctttcct

SEQ ID NO: 3282630 - DNA, 22 bp, Homo sapiens
cccaaaggggacaggcctcacc

SEQ ID NO: 3282631 - DNA, 21 bp, Homo sapiens
cccaaataacttcagtcctgc

SEQ ID NO: 3282632 - DNA, 16 bp, Homo sapiens
cccaaatcaatacact

SEQ ID NO: 3282633 - DNA, 16 bp, Homo sapiens
cccaaatttgattgat

SEQ ID NO: 3282634 - DNA, 19 bp, Homo sapiens
cccaaatttgattgatttg

SEQ ID NO: 3282635 - DNA, 14 bp, Homo sapiens
cccaacactccagg

SEQ ID NO: 3282636 - DNA, 16 bp, Homo sapiens
cccaacactccaggcc

SEQ ID NO: 3282637 - DNA, 18 bp, Homo sapiens
cccaacactccaggccct

SEQ ID NO: 3282638 - DNA, 22 bp, Homo sapiens
cccaacactccaggccctgccc

SEQ ID NO: 3282639 - DNA, 16 bp, Homo sapiens
cccaacactgtgccct

SEQ ID NO: 3282640 - DNA, 19 bp, Homo sapiens
cccaacactgtgccctggt

SEQ ID NO: 3282641 - DNA, 19 bp, Homo sapiens
cccaacagccttagctgcc

SEQ ID NO: 3282642 - DNA, 17 bp, Homo sapiens
cccaaccagtgccaagg

SEQ ID NO: 3282643 - DNA, 15 bp, Homo sapiens
cccaacccaataaaa

SEQ ID NO: 3282644 - DNA, 20 bp, Homo sapiens
cccaacccacctctggccct

SEQ ID NO: 3282645 - DNA, 21 bp, Homo sapiens
cccaacccacctctggccctg

SEQ ID NO: 3282646 - DNA, 17 bp, Homo sapiens
cccaacccccctcctgc

SEQ ID NO: 3282647 - DNA, 20 bp, Homo sapiens
cccaacccccctcctgctcc

SEQ ID NO: 3282648 - DNA, 22 bp, Homo sapiens
cccaacccccctcctgctcctc

SEQ ID NO: 3282649 - DNA, 12 bp, Homo sapiens
cccaacccctga

SEQ ID NO: 3282650 - DNA, 14 bp, Homo sapiens
cccaacccctgagg

SEQ ID NO: 3282651 - DNA, 16 bp, Homo sapiens
cccaacccctgaggaa

SEQ ID NO: 3282652 - DNA, 15 bp, Homo sapiens
cccaacctcagggct

SEQ ID NO: 3282653 - DNA, 19 bp, Homo sapiens
cccaacctcagggctccca

SEQ ID NO: 3282654 - DNA, 20 bp, Homo sapiens
cccaacctcagggctcccag

SEQ ID NO: 3282655 - DNA, 22 bp, Homo sapiens
cccaacctcagggctcccaggg

SEQ ID NO: 3282656 - DNA, 16 bp, Homo sapiens
cccaacctcctgacct

SEQ ID NO: 3282657 - DNA, 17 bp, Homo sapiens
cccaactcgcctgtgga

SEQ ID NO: 3282658 - DNA, 15 bp, Homo sapiens
cccaactctgagccc

SEQ ID NO: 3282659 - DNA, 11 bp, Homo sapiens
cccaactgtct

SEQ ID NO: 3282660 - DNA, 13 bp, Homo sapiens
cccaactgtcttt

SEQ ID NO: 3282661 - DNA, 15 bp, Homo sapiens
cccaactgtcttttt

SEQ ID NO: 3282662 - DNA, 17 bp, Homo sapiens
cccaactgtgagcaagg

SEQ ID NO: 3282663 - DNA, 19 bp, Homo sapiens
cccaagacagatgccccag

SEQ ID NO: 3282664 - DNA, 18 bp, Homo sapiens
cccaagaggtctgagccc

SEQ ID NO: 3282665 - DNA, 20 bp, Homo sapiens
cccaagaggtctgagccctg

SEQ ID NO: 3282666 - DNA, 22 bp, Homo sapiens
cccaagcctgctggctgcggcc

SEQ ID NO: 3282667 - DNA, 17 bp, Homo sapiens
cccaagctctgctcctc

SEQ ID NO: 3282668 - DNA, 19 bp, Homo sapiens
cccaagctgttttcttcta

SEQ ID NO: 3282669 - DNA, 21 bp, Homo sapiens
ccagcctggcttctggagccc

SEQ ID NO: 3282670 - DNA, 19 bp, Homo sapiens
ccagcctgggactcccagt

SEQ ID NO: 3282671 - DNA, 16 bp, Homo sapiens
ccagcctgggcagcca

SEQ ID NO: 3282672 - DNA, 22 bp, Homo sapiens
ccagcctgggcagccaggctgc

SEQ ID NO: 3282673 - DNA, 23 bp, Homo sapiens
ccagcctgggcagccaggctgcc

SEQ ID NO: 3282674 - DNA, 18 bp, Homo sapiens
ccagcctggggcctggca

SEQ ID NO: 3282675 - DNA, 19 bp, Homo sapiens
ccagcctggggcctggcag

SEQ ID NO: 3282676 - DNA, 13 bp, Homo sapiens
ccagcctggggct

SEQ ID NO: 3282677 - DNA, 17 bp, Homo sapiens
ccagcctggggctccct

SEQ ID NO: 3282678 - DNA, 22 bp, Homo sapiens
ccagcctggtgcccatcctccc

SEQ ID NO: 3282679 - DNA, 18 bp, Homo sapiens
ccagcctgtgtgttctgt

SEQ ID NO: 3282680 - DNA, 19 bp, Homo sapiens
ccagccttcttccatccca

SEQ ID NO: 3282681 - DNA, 16 bp, Homo sapiens
ccagcgcggccagcgt

SEQ ID NO: 3282682 - DNA, 21 bp, Homo sapiens
ccagcgcggccagcgtcccag

SEQ ID NO: 3282683 - DNA, 14 bp, Homo sapiens
ccagcgctgagtgg

SEQ ID NO: 3282684 - DNA, 20 bp, Homo sapiens
ccagcggccccccgcacagc

SEQ ID NO: 3282685 - DNA, 23 bp, Homo sapiens
ccagcggccccccgcacagccac

SEQ ID NO: 3282686 - DNA, 15 bp, Homo sapiens
ccagcgggcacaggg

SEQ ID NO: 3282687 - DNA, 20 bp, Homo sapiens
ccagcgggcacagggcacca

SEQ ID NO: 3282688 - DNA, 21 bp, Homo sapiens
ccagcgggcacagggcaccag

SEQ ID NO: 3282689 - DNA, 22 bp, Homo sapiens
ccagcgggcacagggcaccaga

SEQ ID NO: 3282690 - DNA, 12 bp, Homo sapiens
ccagcgggcaga

SEQ ID NO: 3282691 - DNA, 15 bp, Homo sapiens
ccagcgtcccagggt

SEQ ID NO: 3282692 - DNA, 23 bp, Homo sapiens
ccagcgtcctcgttcaaaacatt

SEQ ID NO: 3282693 - DNA, 20 bp, Homo sapiens
ccagcgtgacggagcccaca

SEQ ID NO: 3282694 - DNA, 23 bp, Homo sapiens
ccagctaaggacatttcccaggg

SEQ ID NO: 3282695 - DNA, 19 bp, Homo sapiens
ccagctaaggagtccctgg

SEQ ID NO: 3282696 - DNA, 22 bp, Homo sapiens
ccagctaatctgtagggctgga

SEQ ID NO: 3282697 - DNA, 21 bp, Homo sapiens
ccagctaccctttttctccag

SEQ ID NO: 3282698 - DNA, 22 bp, Homo sapiens
ccagctaccctttttctccagc

SEQ ID NO: 3282699 - DNA, 20 bp, Homo sapiens
ccagctactctgtccaggcc

SEQ ID NO: 3282700 - DNA, 17 bp, Homo sapiens
ccagctacttgggaggc

SEQ ID NO: 3282701 - DNA, 15 bp, Homo sapiens
ccagctatctgtcat

SEQ ID NO: 3282702 - DNA, 17 bp, Homo sapiens
ccagctcaatggactgg

SEQ ID NO: 3282703 - DNA, 22 bp, Homo sapiens
ccagctcaatggactggaaggg

SEQ ID NO: 3282704 - DNA, 13 bp, Homo sapiens
ccagctcacagtg

SEQ ID NO: 3282705 - DNA, 15 bp, Homo sapiens
ccagctcaccagccc

SEQ ID NO: 3282706 - DNA, 19 bp, Homo sapiens
ccagctcagaacccagggc

SEQ ID NO: 3282707 - DNA, 21 bp, Homo sapiens
ccagctcagaacccagggctc

SEQ ID NO: 3282708 - DNA, 21 bp, Homo sapiens
ccagctcatctccaaggatcc

SEQ ID NO: 3282709 - DNA, 19 bp, Homo sapiens
ccagctccaagacctgttg

SEQ ID NO: 3282710 - DNA, 15 bp, Homo sapiens
ccagctccaggggcc

SEQ ID NO: 3282711 - DNA, 14 bp, Homo sapiens
ccagctccccccgc

SEQ ID NO: 3282712 - DNA, 17 bp, Homo sapiens
ccagctccctagactgc

SEQ ID NO: 3282713 - DNA, 20 bp, Homo sapiens
ccagctcctttctcctgtga

SEQ ID NO: 3282714 - DNA, 17 bp, Homo sapiens
ccagctcgcacccccct

SEQ ID NO: 3282715 - DNA, 17 bp, Homo sapiens
ccagctctgacatccct

SEQ ID NO: 3282716 - DNA, 23 bp, Homo sapiens
ccagctctgacatcccttcctgg

SEQ ID NO: 3282717 - DNA, 14 bp, Homo sapiens
ccagctctgagggg

SEQ ID NO: 3282718 - DNA, 19 bp, Homo sapiens
ccagctctgtggcctgtgt

SEQ ID NO: 3282719 - DNA, 22 bp, Homo sapiens
ccagctctgtggcctgtgtcca

SEQ ID NO: 3282720 - DNA, 17 bp, Homo sapiens
ccagctgaaggcagtgg

SEQ ID NO: 3282721 - DNA, 14 bp, Homo sapiens
ccagctgactaaac

SEQ ID NO: 3282722 - DNA, 17 bp, Homo sapiens
ccagctgactaaacttt

SEQ ID NO: 3282723 - DNA, 13 bp, Homo sapiens
ccagctgactgtg

SEQ ID NO: 3282724 - DNA, 17 bp, Homo sapiens
ccagctgcaccagagca

SEQ ID NO: 3282725 - DNA, 23 bp, Homo sapiens
ccagctgcagatgccacacctgc

SEQ ID NO: 3282726 - DNA, 12 bp, Homo sapiens
ccagctgcctgg

SEQ ID NO: 3282727 - DNA, 18 bp, Homo sapiens
ccagctgcctgtgcctgc

SEQ ID NO: 3282728 - DNA, 20 bp, Homo sapiens
ccagctgcctgtgcctgcca

SEQ ID NO: 3282729 - DNA, 24 bp, Homo sapiens
ccagctgcctgtgcctgccatggg

SEQ ID NO: 3282730 - DNA, 11 bp, Homo sapiens
ccagctgcctt

SEQ ID NO: 3282731 - DNA, 20 bp, Homo sapiens
ccagctgccttcctcatccc

SEQ ID NO: 3282732 - DNA, 22 bp, Homo sapiens
ccagctgctctgccccttgggc

SEQ ID NO: 3282733 - DNA, 17 bp, Homo sapiens
ccagctgctgctctccc

SEQ ID NO: 3282734 - DNA, 16 bp, Homo sapiens
ccagctgctgctctga

SEQ ID NO: 3282735 - DNA, 12 bp, Homo sapiens
ccagctggcctg

SEQ ID NO: 3282736 - DNA, 15 bp, Homo sapiens
ccagctggcctggac

SEQ ID NO: 3282737 - DNA, 19 bp, Homo sapiens
ccagctgggaggcaagagg

SEQ ID NO: 3282738 - DNA, 16 bp, Homo sapiens
ccagctggggcgtggg

SEQ ID NO: 3282739 - DNA, 19 bp, Homo sapiens
ccagctggggcgtggggag

SEQ ID NO: 3282740 - DNA, 18 bp, Homo sapiens
ccagctgtagccatggct

SEQ ID NO: 3282741 - DNA, 19 bp, Homo sapiens
ccagctgtagccatggctc

SEQ ID NO: 3282742 - DNA, 22 bp, Homo sapiens
ccagctgtagccatggctcagg

SEQ ID NO: 3282743 - DNA, 18 bp, Homo sapiens
ccagctgtgagccttggc

SEQ ID NO: 3282744 - DNA, 15 bp, Homo sapiens
ccagctgtgcacttt

SEQ ID NO: 3282745 - DNA, 17 bp, Homo sapiens
ccagctgtgctgtggag

SEQ ID NO: 3282746 - DNA, 15 bp, Homo sapiens
ccagcttctcctgcg

SEQ ID NO: 3282747 - DNA, 16 bp, Homo sapiens
ccagcttggggccacc

SEQ ID NO: 3282748 - DNA, 12 bp, Homo sapiens
ccagctttccct

SEQ ID NO: 3282749 - DNA, 18 bp, Homo sapiens
ccagctttctccccgcta

SEQ ID NO: 3282750 - DNA, 17 bp, Homo sapiens
ccagcttttactgtttt

SEQ ID NO: 3282751 - DNA, 18 bp, Homo sapiens
ccagcttttcctcccttg

SEQ ID NO: 3282752 - DNA, 19 bp, Homo sapiens
ccaggaaactccacatctg

SEQ ID NO: 3282753 - DNA, 14 bp, Homo sapiens
ccaggaagaagcag

SEQ ID NO: 3282754 - DNA, 15 bp, Homo sapiens
ccaggaagcccacac

SEQ ID NO: 3282755 - DNA, 16 bp, Homo sapiens
ccaggaagcccacact

SEQ ID NO: 3282756 - DNA, 22 bp, Homo sapiens
ccaggaagcccacactatgcac

SEQ ID NO: 3282757 - DNA, 18 bp, Homo sapiens
ccaggaaggacagactgg

SEQ ID NO: 3282758 - DNA, 19 bp, Homo sapiens
ccaggaaggcagctgctct

SEQ ID NO: 3282759 - DNA, 14 bp, Homo sapiens
ccaggaatatgaca

SEQ ID NO: 3282760 - DNA, 19 bp, Homo sapiens
ccaggaatgcctcctccct

SEQ ID NO: 3282761 - DNA, 22 bp, Homo sapiens
ccaggaattagagaagctgaaa

SEQ ID NO: 3282762 - DNA, 17 bp, Homo sapiens
ccaggacaccacaccca

SEQ ID NO: 3282763 - DNA, 22 bp, Homo sapiens
ccaggacaccacacccagcctc

SEQ ID NO: 3282764 - DNA, 16 bp, Homo sapiens
ccaggacatctcctgg

SEQ ID NO: 3282765 - DNA, 17 bp, Homo sapiens
ccaggacatctcctggc

SEQ ID NO: 3282766 - DNA, 18 bp, Homo sapiens
ccaggacatctcctggct

SEQ ID NO: 3282767 - DNA, 23 bp, Homo sapiens
ccaggacatgcaataaaatttaa

SEQ ID NO: 3282768 - DNA, 15 bp, Homo sapiens
ccaggaccacacagt

SEQ ID NO: 3282769 - DNA, 15 bp, Homo sapiens
ccaggacgcttctga

SEQ ID NO: 3282770 - DNA, 19 bp, Homo sapiens
ccaggacgcttctgaatgc

SEQ ID NO: 3282771 - DNA, 22 bp, Homo sapiens
ccaggacgtcctatctccccca

SEQ ID NO: 3282772 - DNA, 16 bp, Homo sapiens
ccaggactccactgga

SEQ ID NO: 3282773 - DNA, 22 bp, Homo sapiens
ccaggactccctcctcacctct

SEQ ID NO: 3282774 - DNA, 13 bp, Homo sapiens
ccaggactgagcc

SEQ ID NO: 3282775 - DNA, 14 bp, Homo sapiens
ccaggactgagccc

SEQ ID NO: 3282776 - DNA, 23 bp, Homo sapiens
ccaggagacagaccacttgccac

SEQ ID NO: 3282777 - DNA, 15 bp, Homo sapiens
ccaggagagagaaag

SEQ ID NO: 3282778 - DNA, 17 bp, Homo sapiens
ccaggagagagaaagcc

SEQ ID NO: 3282779 - DNA, 18 bp, Homo sapiens
ccaggagcagatggacag

SEQ ID NO: 3282780 - DNA, 19 bp, Homo sapiens
ccaggagcagatggacagc

SEQ ID NO: 3282781 - DNA, 16 bp, Homo sapiens
ccaggagcaggcacgg

SEQ ID NO: 3282782 - DNA, 18 bp, Homo sapiens
ccaggagctcttcaggcc

SEQ ID NO: 3282783 - DNA, 21 bp, Homo sapiens
ccaggagctcttcaggcctcc

SEQ ID NO: 3282784 - DNA, 23 bp, Homo sapiens
ccaggagctcttcaggcctccct

SEQ ID NO: 3282785 - DNA, 23 bp, Homo sapiens
ccaggagctgtcaccaaggaaac

SEQ ID NO: 3282786 - DNA, 17 bp, Homo sapiens
ccaggaggtagtttctc

SEQ ID NO: 3282787 - DNA, 19 bp, Homo sapiens
ccaggaggttggtgactga

SEQ ID NO: 3282788 - DNA, 20 bp, Homo sapiens
ccaggaggttggtgactgaa

SEQ ID NO: 3282789 - DNA, 21 bp, Homo sapiens
ccaggagtttaagaccagcct

SEQ ID NO: 3282790 - DNA, 20 bp, Homo sapiens
ccaggagtttgaggctgcag

SEQ ID NO: 3282791 - DNA, 22 bp, Homo sapiens
ccaggagtttgaggctgcagcg

SEQ ID NO: 3282792 - DNA, 14 bp, Homo sapiens
ccaggataaggaga

SEQ ID NO: 3282793 - DNA, 20 bp, Homo sapiens
ccaggatactggcacagagg

SEQ ID NO: 3282794 - DNA, 16 bp, Homo sapiens
ccaggatatttctgag

SEQ ID NO: 3282795 - DNA, 15 bp, Homo sapiens
ccaggatcatggtgt

SEQ ID NO: 3282796 - DNA, 16 bp, Homo sapiens
ccagttgcccagagca

SEQ ID NO: 3282797 - DNA, 12 bp, Homo sapiens
ccagttgggact

SEQ ID NO: 3282798 - DNA, 20 bp, Homo sapiens
ccagttggtggggccaggcc

SEQ ID NO: 3282799 - DNA, 22 bp, Homo sapiens
ccagttggtggggccaggccag

SEQ ID NO: 3282800 - DNA, 22 bp, Homo sapiens
ccagtttaagacaccaaatata

SEQ ID NO: 3282801 - DNA, 20 bp, Homo sapiens
ccagtttaatgaactaccat

SEQ ID NO: 3282802 - DNA, 21 bp, Homo sapiens
ccagtttcaggtgtttagttg

SEQ ID NO: 3282803 - DNA, 22 bp, Homo sapiens
ccagtttgggtaaaatactttt

SEQ ID NO: 3282804 - DNA, 15 bp, Homo sapiens
ccataaaaccctata

SEQ ID NO: 3282805 - DNA, 20 bp, Homo sapiens
ccataaacggttcctggtga

SEQ ID NO: 3282806 - DNA, 21 bp, Homo sapiens
ccataaagggtgtaggggcca

SEQ ID NO: 3282807 - DNA, 15 bp, Homo sapiens
ccataaatgtgttcc

SEQ ID NO: 3282808 - DNA, 13 bp, Homo sapiens
ccataacttgaaa

SEQ ID NO: 3282809 - DNA, 15 bp, Homo sapiens
ccataaggaatgtag

SEQ ID NO: 3282810 - DNA, 15 bp, Homo sapiens
ccataagggactgtg

SEQ ID NO: 3282811 - DNA, 20 bp, Homo sapiens
ccataaggtttcgtttctgt

SEQ ID NO: 3282812 - DNA, 21 bp, Homo sapiens
ccataattttcttcatgcaat

SEQ ID NO: 3282813 - DNA, 23 bp, Homo sapiens
ccataattttcttcatgcaatga

SEQ ID NO: 3282814 - DNA, 23 bp, Homo sapiens
ccataattttgcatactgaaaat

SEQ ID NO: 3282815 - DNA, 23 bp, Homo sapiens
ccatacaatgactagtcacctgg

SEQ ID NO: 3282816 - DNA, 19 bp, Homo sapiens
ccatactttgtctgaaaaa

SEQ ID NO: 3282817 - DNA, 17 bp, Homo sapiens
ccatacttttgagaggg

SEQ ID NO: 3282818 - DNA, 13 bp, Homo sapiens
ccatagaaacatg

SEQ ID NO: 3282819 - DNA, 16 bp, Homo sapiens
ccatagaaacatgaca

SEQ ID NO: 3282820 - DNA, 18 bp, Homo sapiens
ccatagaaacatgacact

SEQ ID NO: 3282821 - DNA, 21 bp, Homo sapiens
ccatagaaacatgacactgac

SEQ ID NO: 3282822 - DNA, 22 bp, Homo sapiens
ccatagaaacatgacactgacc

SEQ ID NO: 3282823 - DNA, 16 bp, Homo sapiens
ccatagacatgaaagg

SEQ ID NO: 3282824 - DNA, 13 bp, Homo sapiens
ccatagagtttaa

SEQ ID NO: 3282825 - DNA, 16 bp, Homo sapiens
ccatagagtttaacac

SEQ ID NO: 3282826 - DNA, 17 bp, Homo sapiens
ccatagagtttaacaca

SEQ ID NO: 3282827 - DNA, 21 bp, Homo sapiens
ccatagatcttctgaaatgaa

SEQ ID NO: 3282828 - DNA, 12 bp, Homo sapiens
ccatagctcctc

SEQ ID NO: 3282829 - DNA, 16 bp, Homo sapiens
ccatagctgatcatgt

SEQ ID NO: 3282830 - DNA, 14 bp, Homo sapiens
ccataggacatact

SEQ ID NO: 3282831 - DNA, 15 bp, Homo sapiens
ccatagtaccattta

SEQ ID NO: 3282832 - DNA, 19 bp, Homo sapiens
ccatagtcagcagcagctc

SEQ ID NO: 3282833 - DNA, 21 bp, Homo sapiens
ccatagtcagcagcagctctg

SEQ ID NO: 3282834 - DNA, 18 bp, Homo sapiens
ccatagtggggcctggga

SEQ ID NO: 3282835 - DNA, 18 bp, Homo sapiens
ccatagtgtcacttccac

SEQ ID NO: 3282836 - DNA, 16 bp, Homo sapiens
ccatatcttaaagaaa

SEQ ID NO: 3282837 - DNA, 15 bp, Homo sapiens
ccatatcttgccttc

SEQ ID NO: 3282838 - DNA, 16 bp, Homo sapiens
ccatatcttgccttca

SEQ ID NO: 3282839 - DNA, 14 bp, Homo sapiens
ccatatcttgcgaa

SEQ ID NO: 3282840 - DNA, 22 bp, Homo sapiens
ccatatcttgcgaatccaagct

SEQ ID NO: 3282841 - DNA, 14 bp, Homo sapiens
ccatatgaattgta

SEQ ID NO: 3282842 - DNA, 14 bp, Homo sapiens
ccatatgcagaaat

SEQ ID NO: 3282843 - DNA, 15 bp, Homo sapiens
ccatatgctccagga

SEQ ID NO: 3282844 - DNA, 22 bp, Homo sapiens
ccatatgtgtgaattctgcaac

SEQ ID NO: 3282845 - DNA, 18 bp, Homo sapiens
ccatattctgttggccag

SEQ ID NO: 3282846 - DNA, 22 bp, Homo sapiens
ccatattggcatggatttctgt

SEQ ID NO: 3282847 - DNA, 18 bp, Homo sapiens
ccatattgtaaaacaggt

SEQ ID NO: 3282848 - DNA, 14 bp, Homo sapiens
ccatatttggaaga

SEQ ID NO: 3282849 - DNA, 21 bp, Homo sapiens
ccatattttattgtattttga

SEQ ID NO: 3282850 - DNA, 15 bp, Homo sapiens
ccatcaaaaatattc

SEQ ID NO: 3282851 - DNA, 12 bp, Homo sapiens
ccatcaataaat

SEQ ID NO: 3282852 - DNA, 16 bp, Homo sapiens
ccatcacaatacagat

SEQ ID NO: 3282853 - DNA, 18 bp, Homo sapiens
ccatcacaggatgccagc

SEQ ID NO: 3282854 - DNA, 20 bp, Homo sapiens
ccatcacaggatgccagccc

SEQ ID NO: 3282855 - DNA, 17 bp, Homo sapiens
ccatcaccataacctct

SEQ ID NO: 3282856 - DNA, 13 bp, Homo sapiens
ccatcaccctctt

SEQ ID NO: 3282857 - DNA, 16 bp, Homo sapiens
ccatcaccctcttcct

SEQ ID NO: 3282858 - DNA, 16 bp, Homo sapiens
ccatcaccgctgggtg

SEQ ID NO: 3282859 - DNA, 18 bp, Homo sapiens
ccatcactagaagaaaag

SEQ ID NO: 3282860 - DNA, 13 bp, Homo sapiens
ccatcagcggcgc

SEQ ID NO: 3282861 - DNA, 23 bp, Homo sapiens
ccatcagcggcgcgccctgcaga

SEQ ID NO: 3282862 - DNA, 19 bp, Homo sapiens
ccatcagctgtaagaagag

SEQ ID NO: 3282863 - DNA, 20 bp, Homo sapiens
ccatcagggttctcttagca

SEQ ID NO: 3282864 - DNA, 18 bp, Homo sapiens
ccatcatatcccctgtgc

SEQ ID NO: 3282865 - DNA, 18 bp, Homo sapiens
ccatcatatgcctgaccc

SEQ ID NO: 3282866 - DNA, 23 bp, Homo sapiens
ccatcatcctttgttctgagcat

SEQ ID NO: 3282867 - DNA, 22 bp, Homo sapiens
ccatcatgcccggtcccacccc

SEQ ID NO: 3282868 - DNA, 13 bp, Homo sapiens
ccatcatgtctgg

SEQ ID NO: 3282869 - DNA, 16 bp, Homo sapiens
ccatcatgtctggcta

SEQ ID NO: 3282870 - DNA, 15 bp, Homo sapiens
ccatcatgtggccca

SEQ ID NO: 3282871 - DNA, 17 bp, Homo sapiens
ccatcattataaacgtg

SEQ ID NO: 3282872 - DNA, 15 bp, Homo sapiens
ccatccaaggccagg

SEQ ID NO: 3282873 - DNA, 17 bp, Homo sapiens
ccatccacctttcccaa

SEQ ID NO: 3282874 - DNA, 12 bp, Homo sapiens
ccatccaggcag

SEQ ID NO: 3282875 - DNA, 19 bp, Homo sapiens
ccatccaggttcagcttgt

SEQ ID NO: 3282876 - DNA, 16 bp, Homo sapiens
ccatcccaaccagtgc

SEQ ID NO: 3282877 - DNA, 14 bp, Homo sapiens
ccatcccacaccct

SEQ ID NO: 3282878 - DNA, 16 bp, Homo sapiens
ccatcccacaccctgg

SEQ ID NO: 3282879 - DNA, 22 bp, Homo sapiens
ccatcccaggacaccacaccca

SEQ ID NO: 3282880 - DNA, 13 bp, Homo sapiens
ccatccccaccag

SEQ ID NO: 3282881 - DNA, 14 bp, Homo sapiens
ccatccccaccagc

SEQ ID NO: 3282882 - DNA, 14 bp, Homo sapiens
ccatccccctgccc

SEQ ID NO: 3282883 - DNA, 16 bp, Homo sapiens
ccatccctccccagtt

SEQ ID NO: 3282884 - DNA, 12 bp, Homo sapiens
ccatccctcggg

SEQ ID NO: 3282885 - DNA, 22 bp, Homo sapiens
ccatccctcgtggtccccaaca

SEQ ID NO: 3282886 - DNA, 19 bp, Homo sapiens
ccatccctgccacatacag

SEQ ID NO: 3282887 - DNA, 12 bp, Homo sapiens
ccatccctgcct

SEQ ID NO: 3282888 - DNA, 13 bp, Homo sapiens
ccatccctggccc

SEQ ID NO: 3282889 - DNA, 23 bp, Homo sapiens
ccatccctggccccctccctgga

SEQ ID NO: 3282890 - DNA, 20 bp, Homo sapiens
ccatccctgggcccctccac

SEQ ID NO: 3282891 - DNA, 13 bp, Homo sapiens
ccatccctgtcat

SEQ ID NO: 3282892 - DNA, 16 bp, Homo sapiens
ccatcccttttcctgt

SEQ ID NO: 3282893 - DNA, 22 bp, Homo sapiens
ccatcccttttcctgtcagtgt

SEQ ID NO: 3282894 - DNA, 23 bp, Homo sapiens
ccatccgactgcccctgctgtgc

SEQ ID NO: 3282895 - DNA, 22 bp, Homo sapiens
ccatccggtcccctgcctggaa

SEQ ID NO: 3282896 - DNA, 22 bp, Homo sapiens
ccatcctaccctcgggcccacc

SEQ ID NO: 3282897 - DNA, 17 bp, Homo sapiens
ccatcctcatccctgac

SEQ ID NO: 3282898 - DNA, 13 bp, Homo sapiens
ccatcctccagct

SEQ ID NO: 3282899 - DNA, 17 bp, Homo sapiens
ccatcctccagcttctg

SEQ ID NO: 3282900 - DNA, 18 bp, Homo sapiens
ccatcctgaggctccact

SEQ ID NO: 3282901 - DNA, 20 bp, Homo sapiens
ccatcctgaggctccacttg

SEQ ID NO: 3282902 - DNA, 12 bp, Homo sapiens
ccatcctggcta

SEQ ID NO: 3282903 - DNA, 12 bp, Homo sapiens
ccatcctggggc

SEQ ID NO: 3282904 - DNA, 15 bp, Homo sapiens
ccatcctggggcagc

SEQ ID NO: 3282905 - DNA, 14 bp, Homo sapiens
ccatctagtcacaa

SEQ ID NO: 3282906 - DNA, 20 bp, Homo sapiens
ccatctagtcacaaagactc

SEQ ID NO: 3282907 - DNA, 12 bp, Homo sapiens
ccatctcagcct

SEQ ID NO: 3282908 - DNA, 15 bp, Homo sapiens
ccatctcagcctcct

SEQ ID NO: 3282909 - DNA, 12 bp, Homo sapiens
ccatctcaggag

SEQ ID NO: 3282910 - DNA, 13 bp, Homo sapiens
ccatctcaggaga

SEQ ID NO: 3282911 - DNA, 14 bp, Homo sapiens
ccatctcaggagat

SEQ ID NO: 3282912 - DNA, 17 bp, Homo sapiens
ccatctcaggagatgga

SEQ ID NO: 3282913 - DNA, 14 bp, Homo sapiens
ccatctcaggtgcc

SEQ ID NO: 3282914 - DNA, 17 bp, Homo sapiens
ccatctcaggtgccact

SEQ ID NO: 3282915 - DNA, 13 bp, Homo sapiens
ccatctcatcctg

SEQ ID NO: 3282916 - DNA, 21 bp, Homo sapiens
ccatctccaagataagcctga

SEQ ID NO: 3282917 - DNA, 16 bp, Homo sapiens
ccatctcccaccctgt

SEQ ID NO: 3282918 - DNA, 12 bp, Homo sapiens
ccatctccccag

SEQ ID NO: 3282919 - DNA, 14 bp, Homo sapiens
ccatctccccaggc

SEQ ID NO: 3282920 - DNA, 16 bp, Homo sapiens
ccatctccccaggcct

SEQ ID NO: 3282921 - DNA, 17 bp, Homo sapiens
ccatctccccaggcctc

SEQ ID NO: 3282922 - DNA, 18 bp, Homo sapiens
ccatctccccaggcctcc

SEQ ID NO: 3282923 - DNA, 20 bp, Homo sapiens
ccatctccccaggcctccag

SEQ ID NO: 3282924 - DNA, 14 bp, Homo sapiens
ccatctccctgcct

SEQ ID NO: 3282925 - DNA, 18 bp, Homo sapiens
ccatctcctttcagggaa

SEQ ID NO: 3282926 - DNA, 15 bp, Homo sapiens
ccaggggtctccctg

SEQ ID NO: 3282927 - DNA, 16 bp, Homo sapiens
ccaggggtctccctgg

SEQ ID NO: 3282928 - DNA, 21 bp, Homo sapiens
ccaggggtctccctggctccc

SEQ ID NO: 3282929 - DNA, 15 bp, Homo sapiens
ccaggggtgccccct

SEQ ID NO: 3282930 - DNA, 16 bp, Homo sapiens
ccaggggtgccccctc

SEQ ID NO: 3282931 - DNA, 18 bp, Homo sapiens
ccaggggtgccccctcct

SEQ ID NO: 3282932 - DNA, 23 bp, Homo sapiens
ccagggtacccgcctgagctcct

SEQ ID NO: 3282933 - DNA, 18 bp, Homo sapiens
ccagggtccctctgtgta

SEQ ID NO: 3282934 - DNA, 19 bp, Homo sapiens
ccagggtccgcaccagctg

SEQ ID NO: 3282935 - DNA, 23 bp, Homo sapiens
ccagggtccgcaccagctgctct

SEQ ID NO: 3282936 - DNA, 16 bp, Homo sapiens
ccagggtctgtgtgaa

SEQ ID NO: 3282937 - DNA, 14 bp, Homo sapiens
ccagggtcttccct

SEQ ID NO: 3282938 - DNA, 22 bp, Homo sapiens
ccagggtgcccagaacttccct

SEQ ID NO: 3282939 - DNA, 17 bp, Homo sapiens
ccagggtttacccagtg

SEQ ID NO: 3282940 - DNA, 23 bp, Homo sapiens
ccaggtacaggagaggcagcatg

SEQ ID NO: 3282941 - DNA, 20 bp, Homo sapiens
ccaggtaccacccttcagac

SEQ ID NO: 3282942 - DNA, 22 bp, Homo sapiens
ccaggtaccacccttcagaccc

SEQ ID NO: 3282943 - DNA, 19 bp, Homo sapiens
ccaggtatccaaaaatgtg

SEQ ID NO: 3282944 - DNA, 14 bp, Homo sapiens
ccaggtatggctct

SEQ ID NO: 3282945 - DNA, 23 bp, Homo sapiens
ccaggtcaggatgcacatttctg

SEQ ID NO: 3282946 - DNA, 19 bp, Homo sapiens
ccaggtccagctctggagg

SEQ ID NO: 3282947 - DNA, 17 bp, Homo sapiens
ccaggtccattttgcct

SEQ ID NO: 3282948 - DNA, 20 bp, Homo sapiens
ccaggtgagctctgaccctt

SEQ ID NO: 3282949 - DNA, 22 bp, Homo sapiens
ccaggtgcagtggctcacgcct

SEQ ID NO: 3282950 - DNA, 16 bp, Homo sapiens
ccaggtggagggcaca

SEQ ID NO: 3282951 - DNA, 20 bp, Homo sapiens
ccaggtggagggcacagccc

SEQ ID NO: 3282952 - DNA, 13 bp, Homo sapiens
ccaggtgtgcctg

SEQ ID NO: 3282953 - DNA, 22 bp, Homo sapiens
ccaggtgtgtccacctgggcat

SEQ ID NO: 3282954 - DNA, 17 bp, Homo sapiens
ccaggtgttactgtaat

SEQ ID NO: 3282955 - DNA, 13 bp, Homo sapiens
ccaggtgtttata

SEQ ID NO: 3282956 - DNA, 21 bp, Homo sapiens
ccaggttagcctttgccctgt

SEQ ID NO: 3282957 - DNA, 16 bp, Homo sapiens
ccaggttcccccagca

SEQ ID NO: 3282958 - DNA, 21 bp, Homo sapiens
ccaggttctccgttagctcct

SEQ ID NO: 3282959 - DNA, 13 bp, Homo sapiens
ccaggttgaaaga

SEQ ID NO: 3282960 - DNA, 16 bp, Homo sapiens
ccaggttgaaagacct

SEQ ID NO: 3282961 - DNA, 20 bp, Homo sapiens
ccaggttttctgggtgtcca

SEQ ID NO: 3282962 - DNA, 17 bp, Homo sapiens
ccaggtttttggtctga

SEQ ID NO: 3282963 - DNA, 19 bp, Homo sapiens
ccagtaacgcgtcttcctg

SEQ ID NO: 3282964 - DNA, 20 bp, Homo sapiens
ccagtaacttttttgtgtat

SEQ ID NO: 3282965 - DNA, 18 bp, Homo sapiens
ccagtacctagctggctc

SEQ ID NO: 3282966 - DNA, 22 bp, Homo sapiens
ccagtagaccttgttacttctg

SEQ ID NO: 3282967 - DNA, 20 bp, Homo sapiens
ccagtatacctcatttttca

SEQ ID NO: 3282968 - DNA, 13 bp, Homo sapiens
ccagtatcgctca

SEQ ID NO: 3282969 - DNA, 12 bp, Homo sapiens
ccagtattcttg

SEQ ID NO: 3282970 - DNA, 14 bp, Homo sapiens
ccagtattcttgtc

SEQ ID NO: 3282971 - DNA, 17 bp, Homo sapiens
ccagtattgaaaacttc

SEQ ID NO: 3282972 - DNA, 19 bp, Homo sapiens
ccagtattgaaaacttcaa

SEQ ID NO: 3282973 - DNA, 14 bp, Homo sapiens
ccagtcacatgacc

SEQ ID NO: 3282974 - DNA, 21 bp, Homo sapiens
ccagtcaggctgcagaggcac

SEQ ID NO: 3282975 - DNA, 19 bp, Homo sapiens
ccagtccaggctgccgtgg

SEQ ID NO: 3282976 - DNA, 20 bp, Homo sapiens
ccagtccccaacctgcactc

SEQ ID NO: 3282977 - DNA, 15 bp, Homo sapiens
ccagtccccagccct

SEQ ID NO: 3282978 - DNA, 15 bp, Homo sapiens
ccagtcccccaaccc

SEQ ID NO: 3282979 - DNA, 16 bp, Homo sapiens
ccagtcccccaacccc

SEQ ID NO: 3282980 - DNA, 23 bp, Homo sapiens
ccagtcccccaaccccagccgct

SEQ ID NO: 3282981 - DNA, 15 bp, Homo sapiens
ccagtccccctatcc

SEQ ID NO: 3282982 - DNA, 15 bp, Homo sapiens
ccagtccccgtgccc

SEQ ID NO: 3282983 - DNA, 17 bp, Homo sapiens
ccagtccccgtgccccg

SEQ ID NO: 3282984 - DNA, 21 bp, Homo sapiens
ccagtcctccactcgacccag

SEQ ID NO: 3282985 - DNA, 18 bp, Homo sapiens
ccagtcctccagaccacc

SEQ ID NO: 3282986 - DNA, 19 bp, Homo sapiens
ccagtcctccagaccacca

SEQ ID NO: 3282987 - DNA, 15 bp, Homo sapiens
ccagtcctgcctggc

SEQ ID NO: 3282988 - DNA, 17 bp, Homo sapiens
ccagtcctgcctggcca

SEQ ID NO: 3282989 - DNA, 21 bp, Homo sapiens
ccagtcctgcctggccaggca

SEQ ID NO: 3282990 - DNA, 22 bp, Homo sapiens
ccagtctcagacactaaatgca

SEQ ID NO: 3282991 - DNA, 13 bp, Homo sapiens
ccagtctcccagg

SEQ ID NO: 3282992 - DNA, 19 bp, Homo sapiens
ccagtctcccaggccccct

SEQ ID NO: 3282993 - DNA, 12 bp, Homo sapiens
ccagtctcctca

SEQ ID NO: 3282994 - DNA, 15 bp, Homo sapiens
ccagtctcctcactc

SEQ ID NO: 3282995 - DNA, 22 bp, Homo sapiens
ccagtctcctcactctgtccct

SEQ ID NO: 3282996 - DNA, 19 bp, Homo sapiens
ccagtctggaatgcagtgg

SEQ ID NO: 3282997 - DNA, 18 bp, Homo sapiens
ccagtctgggctgccggg

SEQ ID NO: 3282998 - DNA, 15 bp, Homo sapiens
ccagtctgtctactg

SEQ ID NO: 3282999 - DNA, 16 bp, Homo sapiens
ccagtctgtctactgt

SEQ ID NO: 3283000 - DNA, 17 bp, Homo sapiens
ccagtctgtctactgtg

SEQ ID NO: 3283001 - DNA, 12 bp, Homo sapiens
ccagtctgtgga

SEQ ID NO: 3283002 - DNA, 12 bp, Homo sapiens
ccagtcttcctt

SEQ ID NO: 3283003 - DNA, 17 bp, Homo sapiens
ccagtcttccttgtctc

SEQ ID NO: 3283004 - DNA, 18 bp, Homo sapiens
ccagtctttaaaggccca

SEQ ID NO: 3283005 - DNA, 21 bp, Homo sapiens
ccagtctttaaaggcccagcc

SEQ ID NO: 3283006 - DNA, 14 bp, Homo sapiens
ccagtgaaatgtga

SEQ ID NO: 3283007 - DNA, 15 bp, Homo sapiens
ccagtgaagcctctg

SEQ ID NO: 3283008 - DNA, 15 bp, Homo sapiens
ccagtgaatctgttt

SEQ ID NO: 3283009 - DNA, 16 bp, Homo sapiens
ccagtgaatctgtttc

SEQ ID NO: 3283010 - DNA, 17 bp, Homo sapiens
ccagtgaatctgtttca

SEQ ID NO: 3283011 - DNA, 20 bp, Homo sapiens
ccagtgaattcttgaaggaa

SEQ ID NO: 3283012 - DNA, 11 bp, Homo sapiens
ccagtgacact

SEQ ID NO: 3283013 - DNA, 24 bp, Homo sapiens
ccagtgacacttcagagagctggt

SEQ ID NO: 3283014 - DNA, 17 bp, Homo sapiens
ccagtgacagacaggct

SEQ ID NO: 3283015 - DNA, 19 bp, Homo sapiens
ccagtgagtctctggggca

SEQ ID NO: 3283016 - DNA, 15 bp, Homo sapiens
ccagtgcaacagcac

SEQ ID NO: 3283017 - DNA, 17 bp, Homo sapiens
ccagtgcagaaatgaaa

SEQ ID NO: 3283018 - DNA, 17 bp, Homo sapiens
ccagtgcagccactggc

SEQ ID NO: 3283019 - DNA, 18 bp, Homo sapiens
ccagtgccactgcccccc

SEQ ID NO: 3283020 - DNA, 14 bp, Homo sapiens
ccagtgccattcca

SEQ ID NO: 3283021 - DNA, 19 bp, Homo sapiens
ccagtgcccaaagtctgtg

SEQ ID NO: 3283022 - DNA, 23 bp, Homo sapiens
ccagtgcccacaggatcagtctg

SEQ ID NO: 3283023 - DNA, 12 bp, Homo sapiens
ccagtgctgcca

SEQ ID NO: 3283024 - DNA, 14 bp, Homo sapiens
ccagtgctgctgta

SEQ ID NO: 3283025 - DNA, 12 bp, Homo sapiens
ccagtgggacag

SEQ ID NO: 3283026 - DNA, 16 bp, Homo sapiens
ccagtgggacagagga

SEQ ID NO: 3283027 - DNA, 17 bp, Homo sapiens
ccagtgggacagaggag

SEQ ID NO: 3283028 - DNA, 17 bp, Homo sapiens
ccagtgggaggggcagg

SEQ ID NO: 3283029 - DNA, 20 bp, Homo sapiens
ccagtgggaggggcaggctg

SEQ ID NO: 3283030 - DNA, 23 bp, Homo sapiens
ccagtgggaggggcaggctgaca

SEQ ID NO: 3283031 - DNA, 14 bp, Homo sapiens
ccagtggggcctgt

SEQ ID NO: 3283032 - DNA, 16 bp, Homo sapiens
ccagtggggcctgtgg

SEQ ID NO: 3283033 - DNA, 16 bp, Homo sapiens
ccagtgtaatccccca

SEQ ID NO: 3283034 - DNA, 12 bp, Homo sapiens
ccagtgtacata

SEQ ID NO: 3283035 - DNA, 14 bp, Homo sapiens
ccagtgtagccttg

SEQ ID NO: 3283036 - DNA, 15 bp, Homo sapiens
ccagtgtagccttgc

SEQ ID NO: 3283037 - DNA, 22 bp, Homo sapiens
ccagtgtcacctctctcagagc

SEQ ID NO: 3283038 - DNA, 14 bp, Homo sapiens
ccagtgtcccctcc

SEQ ID NO: 3283039 - DNA, 22 bp, Homo sapiens
ccagtgtctgggtttttcttgt

SEQ ID NO: 3283040 - DNA, 15 bp, Homo sapiens
ccagtgtctgtcccg

SEQ ID NO: 3283041 - DNA, 21 bp, Homo sapiens
ccagtgtctgtcccggggtcc

SEQ ID NO: 3283042 - DNA, 12 bp, Homo sapiens
ccagtgtctttc

SEQ ID NO: 3283043 - DNA, 14 bp, Homo sapiens
ccagtgtctttctt

SEQ ID NO: 3283044 - DNA, 18 bp, Homo sapiens
ccagtgtgggcttgacca

SEQ ID NO: 3283045 - DNA, 20 bp, Homo sapiens
ccagtgtgggcttgaccagg

SEQ ID NO: 3283046 - DNA, 18 bp, Homo sapiens
ccagtgttgtttgtaaat

SEQ ID NO: 3283047 - DNA, 22 bp, Homo sapiens
ccagtgttgtttgtaaataaga

SEQ ID NO: 3283048 - DNA, 15 bp, Homo sapiens
ccagttcaaagtgta

SEQ ID NO: 3283049 - DNA, 16 bp, Homo sapiens
ccagttcctcttttgt

SEQ ID NO: 3283050 - DNA, 18 bp, Homo sapiens
ccagttctgaataacttg

SEQ ID NO: 3283051 - DNA, 13 bp, Homo sapiens
ccagttctgctcc

SEQ ID NO: 3283052 - DNA, 15 bp, Homo sapiens
ccagttctgctcctc

SEQ ID NO: 3283053 - DNA, 20 bp, Homo sapiens
ccagttctgctcctctccag

SEQ ID NO: 3283054 - DNA, 15 bp, Homo sapiens
ccagttgcccagagc

SEQ ID NO: 3283055 - DNA, 16 bp, Homo sapiens
ccacaggggcaggcct

SEQ ID NO: 3283056 - DNA, 18 bp, Homo sapiens
ccacaggggcaggcctgg

SEQ ID NO: 3283057 - DNA, 22 bp, Homo sapiens
ccacaggggcaggcctgggacc

SEQ ID NO: 3283058 - DNA, 22 bp, Homo sapiens
ccacagggttcaaaatgtctgt

SEQ ID NO: 3283059 - DNA, 15 bp, Homo sapiens
ccacaggtctagact

SEQ ID NO: 3283060 - DNA, 18 bp, Homo sapiens
ccacagtgctgcttctct

SEQ ID NO: 3283061 - DNA, 15 bp, Homo sapiens
ccacagttgtgttca

SEQ ID NO: 3283062 - DNA, 14 bp, Homo sapiens
ccacagttttagtt

SEQ ID NO: 3283063 - DNA, 12 bp, Homo sapiens
ccacatacctct

SEQ ID NO: 3283064 - DNA, 19 bp, Homo sapiens
ccacatccaactccagcaa

SEQ ID NO: 3283065 - DNA, 18 bp, Homo sapiens
ccacatcccagcagccca

SEQ ID NO: 3283066 - DNA, 12 bp, Homo sapiens
ccacatcccagg

SEQ ID NO: 3283067 - DNA, 15 bp, Homo sapiens
ccacatcccaggctt

SEQ ID NO: 3283068 - DNA, 18 bp, Homo sapiens
ccacatcccaggcttcac

SEQ ID NO: 3283069 - DNA, 13 bp, Homo sapiens
ccacatcctgtgt

SEQ ID NO: 3283070 - DNA, 12 bp, Homo sapiens
ccacatctgcct

SEQ ID NO: 3283071 - DNA, 13 bp, Homo sapiens
ccacatctgcctt

SEQ ID NO: 3283072 - DNA, 22 bp, Homo sapiens
ccacatctgccttaaaaccaaa

SEQ ID NO: 3283073 - DNA, 16 bp, Homo sapiens
ccacatcttgctctgc

SEQ ID NO: 3283074 - DNA, 14 bp, Homo sapiens
ccacatgaaaccta

SEQ ID NO: 3283075 - DNA, 21 bp, Homo sapiens
ccacatgaggccatctcagga

SEQ ID NO: 3283076 - DNA, 22 bp, Homo sapiens
ccacatgaggccatctcaggag

SEQ ID NO: 3283077 - DNA, 15 bp, Homo sapiens
ccacatggagccccc

SEQ ID NO: 3283078 - DNA, 16 bp, Homo sapiens
ccacatgtgcacatgc

SEQ ID NO: 3283079 - DNA, 22 bp, Homo sapiens
ccacatgttactggataaattg

SEQ ID NO: 3283080 - DNA, 22 bp, Homo sapiens
ccacattccaaaagggggcctg

SEQ ID NO: 3283081 - DNA, 16 bp, Homo sapiens
ccacatttagtcctgt

SEQ ID NO: 3283082 - DNA, 19 bp, Homo sapiens
ccacatttagtcctgtact

SEQ ID NO: 3283083 - DNA, 15 bp, Homo sapiens
ccacatttctaaaat

SEQ ID NO: 3283084 - DNA, 12 bp, Homo sapiens
ccacatttctga

SEQ ID NO: 3283085 - DNA, 21 bp, Homo sapiens
ccacatttctgatcagaggtg

SEQ ID NO: 3283086 - DNA, 19 bp, Homo sapiens
ccacatttggaatactttt

SEQ ID NO: 3283087 - DNA, 22 bp, Homo sapiens
ccacatttggaatactttttgt

SEQ ID NO: 3283088 - DNA, 16 bp, Homo sapiens
ccacatttgtcacaga

SEQ ID NO: 3283089 - DNA, 16 bp, Homo sapiens
ccacattttatattta

SEQ ID NO: 3283090 - DNA, 22 bp, Homo sapiens
ccaccaaactgcacacacagct

SEQ ID NO: 3283091 - DNA, 19 bp, Homo sapiens
ccaccaaagctgcccactg

SEQ ID NO: 3283092 - DNA, 19 bp, Homo sapiens
ccaccaacactgctcacag

SEQ ID NO: 3283093 - DNA, 21 bp, Homo sapiens
ccaccaataaatcagaccatg

SEQ ID NO: 3283094 - DNA, 17 bp, Homo sapiens
ccaccacacccagccca

SEQ ID NO: 3283095 - DNA, 15 bp, Homo sapiens
ccaccacagccagca

SEQ ID NO: 3283096 - DNA, 18 bp, Homo sapiens
ccaccacagccagcacct

SEQ ID NO: 3283097 - DNA, 20 bp, Homo sapiens
ccaccacagccagcacctgg

SEQ ID NO: 3283098 - DNA, 15 bp, Homo sapiens
ccaccaccactggcc

SEQ ID NO: 3283099 - DNA, 20 bp, Homo sapiens
ccaccaccctttgctgactc

SEQ ID NO: 3283100 - DNA, 17 bp, Homo sapiens
ccaccacctccctcacc

SEQ ID NO: 3283101 - DNA, 13 bp, Homo sapiens
ccaccacgtctgc

SEQ ID NO: 3283102 - DNA, 15 bp, Homo sapiens
ccaccactccactcc

SEQ ID NO: 3283103 - DNA, 18 bp, Homo sapiens
ccaccactgcctgactgc

SEQ ID NO: 3283104 - DNA, 20 bp, Homo sapiens
ccaccagagaccgtcctcac

SEQ ID NO: 3283105 - DNA, 13 bp, Homo sapiens
ccaccagatgctg

SEQ ID NO: 3283106 - DNA, 11 bp, Homo sapiens
ccaccagcagc

SEQ ID NO: 3283107 - DNA, 18 bp, Homo sapiens
ccaccagccgccccagcc

SEQ ID NO: 3283108 - DNA, 20 bp, Homo sapiens
ccaccagcttaagcgttcat

SEQ ID NO: 3283109 - DNA, 13 bp, Homo sapiens
ccaccaggagaac

SEQ ID NO: 3283110 - DNA, 19 bp, Homo sapiens
ccaccaggagaaccactac

SEQ ID NO: 3283111 - DNA, 22 bp, Homo sapiens
ccaccaggcatccggcccttac

SEQ ID NO: 3283112 - DNA, 13 bp, Homo sapiens
ccaccaggccacc

SEQ ID NO: 3283113 - DNA, 21 bp, Homo sapiens
ccaccaggccacctccccagc

SEQ ID NO: 3283114 - DNA, 18 bp, Homo sapiens
ccaccaggctggcgcagc

SEQ ID NO: 3283115 - DNA, 21 bp, Homo sapiens
ccaccaggctggcgcagccaa

SEQ ID NO: 3283116 - DNA, 17 bp, Homo sapiens
ccaccatatgaattgta

SEQ ID NO: 3283117 - DNA, 20 bp, Homo sapiens
ccaccatatgaattgtacag

SEQ ID NO: 3283118 - DNA, 23 bp, Homo sapiens
ccaccatattcagtgctgtggcc

SEQ ID NO: 3283119 - DNA, 18 bp, Homo sapiens
ccaccatcaccaccgcct

SEQ ID NO: 3283120 - DNA, 13 bp, Homo sapiens
ccaccatccccac

SEQ ID NO: 3283121 - DNA, 14 bp, Homo sapiens
ccaccatcctgcag

SEQ ID NO: 3283122 - DNA, 23 bp, Homo sapiens
ccaccattcctgcctttaagcca

SEQ ID NO: 3283123 - DNA, 14 bp, Homo sapiens
ccaccattcctgga

SEQ ID NO: 3283124 - DNA, 15 bp, Homo sapiens
ccaccattcctggaa

SEQ ID NO: 3283125 - DNA, 13 bp, Homo sapiens
ccacccaacccta

SEQ ID NO: 3283126 - DNA, 16 bp, Homo sapiens
ccacccaaccctatct

SEQ ID NO: 3283127 - DNA, 21 bp, Homo sapiens
ccacccaaccctatctcctga

SEQ ID NO: 3283128 - DNA, 23 bp, Homo sapiens
ccacccacaatcacaagaagatt

SEQ ID NO: 3283129 - DNA, 13 bp, Homo sapiens
ccacccacctcag

SEQ ID NO: 3283130 - DNA, 13 bp, Homo sapiens
ccacccacctcca

SEQ ID NO: 3283131 - DNA, 11 bp, Homo sapiens
ccacccagccc

SEQ ID NO: 3283132 - DNA, 21 bp, Homo sapiens
ccacccaggagccccgaggcc

SEQ ID NO: 3283133 - DNA, 23 bp, Homo sapiens
ccacccaggagccccgaggcctt

SEQ ID NO: 3283134 - DNA, 12 bp, Homo sapiens
ccacccaggagg

SEQ ID NO: 3283135 - DNA, 23 bp, Homo sapiens
ccacccaggagggagggggctat

SEQ ID NO: 3283136 - DNA, 12 bp, Homo sapiens
ccacccaggctg

SEQ ID NO: 3283137 - DNA, 14 bp, Homo sapiens
ccacccaggctgca

SEQ ID NO: 3283138 - DNA, 17 bp, Homo sapiens
ccacccaggctgcactg

SEQ ID NO: 3283139 - DNA, 12 bp, Homo sapiens
ccacccagtgct

SEQ ID NO: 3283140 - DNA, 15 bp, Homo sapiens
ccacccagtgctgcc

SEQ ID NO: 3283141 - DNA, 20 bp, Homo sapiens
ccacccagtgctgccatgcc

SEQ ID NO: 3283142 - DNA, 22 bp, Homo sapiens
ccacccagtgctgccatgccac

SEQ ID NO: 3283143 - DNA, 15 bp, Homo sapiens
ccacccatcttcctg

SEQ ID NO: 3283144 - DNA, 18 bp, Homo sapiens
ccacccatcttcctgctg

SEQ ID NO: 3283145 - DNA, 14 bp, Homo sapiens
ccacccatgtcacc

SEQ ID NO: 3283146 - DNA, 12 bp, Homo sapiens
ccaccccacgcc

SEQ ID NO: 3283147 - DNA, 15 bp, Homo sapiens
ccacccccagccagg

SEQ ID NO: 3283148 - DNA, 12 bp, Homo sapiens
ccacccccatct

SEQ ID NO: 3283149 - DNA, 15 bp, Homo sapiens
ccaccccctcaagcc

SEQ ID NO: 3283150 - DNA, 16 bp, Homo sapiens
ccaccccctgcccaca

SEQ ID NO: 3283151 - DNA, 14 bp, Homo sapiens
ccaccccctgccct

SEQ ID NO: 3283152 - DNA, 18 bp, Homo sapiens
ccaccccctgccctgcac

SEQ ID NO: 3283153 - DNA, 13 bp, Homo sapiens
ccacccccttctc

SEQ ID NO: 3283154 - DNA, 19 bp, Homo sapiens
ccacccccttctctgctcc

SEQ ID NO: 3283155 - DNA, 23 bp, Homo sapiens
ccacccccttctctgctccacca

SEQ ID NO: 3283156 - DNA, 17 bp, Homo sapiens
ccaccccggcctccact

SEQ ID NO: 3283157 - DNA, 19 bp, Homo sapiens
ccaccccggggaccctgtg

SEQ ID NO: 3283158 - DNA, 18 bp, Homo sapiens
ccaagtcctccctctcta

SEQ ID NO: 3283159 - DNA, 21 bp, Homo sapiens
ccaagtctctctgtgaataca

SEQ ID NO: 3283160 - DNA, 16 bp, Homo sapiens
ccaagtgcaaaagaaa

SEQ ID NO: 3283161 - DNA, 15 bp, Homo sapiens
ccaagtgccagaggt

SEQ ID NO: 3283162 - DNA, 16 bp, Homo sapiens
ccaagtgccagtcttg

SEQ ID NO: 3283163 - DNA, 22 bp, Homo sapiens
ccaagtgtctagagtcatgtga

SEQ ID NO: 3283164 - DNA, 14 bp, Homo sapiens
ccaagtgtgaacaa

SEQ ID NO: 3283165 - DNA, 15 bp, Homo sapiens
ccaagttataaatca

SEQ ID NO: 3283166 - DNA, 18 bp, Homo sapiens
ccaagttatctttccctc

SEQ ID NO: 3283167 - DNA, 17 bp, Homo sapiens
ccaagttgtgcttgagc

SEQ ID NO: 3283168 - DNA, 20 bp, Homo sapiens
ccaagtttccatagcaacag

SEQ ID NO: 3283169 - DNA, 15 bp, Homo sapiens
ccaataaaactgatg

SEQ ID NO: 3283170 - DNA, 10 bp, Homo sapiens
ccaataaagc

SEQ ID NO: 3283171 - DNA, 18 bp, Homo sapiens
ccaataaagcttttggaa

SEQ ID NO: 3283172 - DNA, 16 bp, Homo sapiens
ccaacgcccctgtggc

SEQ ID NO: 3283173 - DNA, 23 bp, Homo sapiens
ccaacgcccctgtggccaactgc

SEQ ID NO: 3283174 - DNA, 15 bp, Homo sapiens
ccaacggcaacagca

SEQ ID NO: 3283175 - DNA, 16 bp, Homo sapiens
ccaacgggaaaggaaa

SEQ ID NO: 3283176 - DNA, 19 bp, Homo sapiens
ccaacgttactcagggctc

SEQ ID NO: 3283177 - DNA, 14 bp, Homo sapiens
ccaactaagccctc

SEQ ID NO: 3283178 - DNA, 14 bp, Homo sapiens
ccaactactaatag

SEQ ID NO: 3283179 - DNA, 12 bp, Homo sapiens
attggagctgac

SEQ ID NO: 3283180 - DNA, 11 bp, Homo sapiens
attggatattt

SEQ ID NO: 3283181 - DNA, 18 bp, Homo sapiens
attggattattcatttaa

SEQ ID NO: 3283182 - DNA, 17 bp, Homo sapiens
attggattatttaataa

SEQ ID NO: 3283183 - DNA, 22 bp, Homo sapiens
attggattatttaataacatta

SEQ ID NO: 3283184 - DNA, 18 bp, Homo sapiens
attggcacccctttctag

SEQ ID NO: 3283185 - DNA, 18 bp, Homo sapiens
attggccacctgtagcca

SEQ ID NO: 3283186 - DNA, 12 bp, Homo sapiens
attggcctgtag

SEQ ID NO: 3283187 - DNA, 22 bp, Homo sapiens
attggcttgtagaattgttata

SEQ ID NO: 3283188 - DNA, 18 bp, Homo sapiens
attggcttgtgtgtttca

SEQ ID NO: 3283189 - DNA, 22 bp, Homo sapiens
attggcttgtgtgtttcacttt

SEQ ID NO: 3283190 - DNA, 14 bp, Homo sapiens
attggctttgtgct

SEQ ID NO: 3283191 - DNA, 15 bp, Homo sapiens
attgggacaacagtg

SEQ ID NO: 3283192 - DNA, 12 bp, Homo sapiens
attgggagaggt

SEQ ID NO: 3283193 - DNA, 18 bp, Homo sapiens
attgggagcttgggaatg

SEQ ID NO: 3283194 - DNA, 21 bp, Homo sapiens
attgggagcttgggaatggat

SEQ ID NO: 3283195 - DNA, 22 bp, Homo sapiens
attgggatgtgagccccagggg

SEQ ID NO: 3283196 - DNA, 17 bp, Homo sapiens
attgggcaagtgattga

SEQ ID NO: 3283197 - DNA, 19 bp, Homo sapiens
attgggccttttggatatg

SEQ ID NO: 3283198 - DNA, 21 bp, Homo sapiens
ccaggatcccaagcctcctgc

SEQ ID NO: 3283199 - DNA, 18 bp, Homo sapiens
ccaggatcgttttttccc

SEQ ID NO: 3283200 - DNA, 17 bp, Homo sapiens
ccaggatgacacctcca

SEQ ID NO: 3283201 - DNA, 23 bp, Homo sapiens
ccaggatggactcttctcggctc

SEQ ID NO: 3283202 - DNA, 14 bp, Homo sapiens
ccaggatggagggg

SEQ ID NO: 3283203 - DNA, 20 bp, Homo sapiens
ccaggatggtctcgatctcc

SEQ ID NO: 3283204 - DNA, 15 bp, Homo sapiens
ccaggattcccccag

SEQ ID NO: 3283205 - DNA, 23 bp, Homo sapiens
ccaggattttaacaaaagcaaga

SEQ ID NO: 3283206 - DNA, 19 bp, Homo sapiens
ccaggcacagggcccgcag

SEQ ID NO: 3283207 - DNA, 19 bp, Homo sapiens
ccaggcacccagctttgtc

SEQ ID NO: 3283208 - DNA, 14 bp, Homo sapiens
ccaggcacccttct

SEQ ID NO: 3283209 - DNA, 13 bp, Homo sapiens
ccaggcacctggc

SEQ ID NO: 3283210 - DNA, 15 bp, Homo sapiens
ccaggcacctggcct

SEQ ID NO: 3283211 - DNA, 18 bp, Homo sapiens
ccaggcacctggcctgct

SEQ ID NO: 3283212 - DNA, 20 bp, Homo sapiens
ccaggcacctggcctgctgg

SEQ ID NO: 3283213 - DNA, 12 bp, Homo sapiens
ccaggcactgcc

SEQ ID NO: 3283214 - DNA, 22 bp, Homo sapiens
ccaggcacttaaagccttttcc

SEQ ID NO: 3283215 - DNA, 14 bp, Homo sapiens
ccaggcagagctga

SEQ ID NO: 3283216 - DNA, 17 bp, Homo sapiens
ccaggcagatctgtgcc

SEQ ID NO: 3283217 - DNA, 23 bp, Homo sapiens
ccaggcagatctgtgccccatgc

SEQ ID NO: 3283218 - DNA, 15 bp, Homo sapiens
ccaggcaggggtggg

SEQ ID NO: 3283219 - DNA, 18 bp, Homo sapiens
ccaggcaggtagccaggg

SEQ ID NO: 3283220 - DNA, 15 bp, Homo sapiens
ccaggcatctccttg

SEQ ID NO: 3283221 - DNA, 16 bp, Homo sapiens
ccaggcatctccttgg

SEQ ID NO: 3283222 - DNA, 13 bp, Homo sapiens
ccaggccaacagc

SEQ ID NO: 3283223 - DNA, 18 bp, Homo sapiens
ccaggccaacagcacctc

SEQ ID NO: 3283224 - DNA, 11 bp, Homo sapiens
ccaggccacag

SEQ ID NO: 3283225 - DNA, 14 bp, Homo sapiens
ccaggccacagccg

SEQ ID NO: 3283226 - DNA, 12 bp, Homo sapiens
ccaggccactgt

SEQ ID NO: 3283227 - DNA, 17 bp, Homo sapiens
ccaggccactgtggcca

SEQ ID NO: 3283228 - DNA, 18 bp, Homo sapiens
ccaggccactgtggccag

SEQ ID NO: 3283229 - DNA, 19 bp, Homo sapiens
ccaggccactgtggccaga

SEQ ID NO: 3283230 - DNA, 12 bp, Homo sapiens
ccaggccagagg

SEQ ID NO: 3283231 - DNA, 12 bp, Homo sapiens
ccaggccaggac

SEQ ID NO: 3283232 - DNA, 14 bp, Homo sapiens
ccaggccaggacca

SEQ ID NO: 3283233 - DNA, 22 bp, Homo sapiens
ccaggccaggaccacacagtcc

SEQ ID NO: 3283234 - DNA, 17 bp, Homo sapiens
ccaggccattctgccgc

SEQ ID NO: 3283235 - DNA, 12 bp, Homo sapiens
ccaggcccagcc

SEQ ID NO: 3283236 - DNA, 13 bp, Homo sapiens
ccaggcccagcca

SEQ ID NO: 3283237 - DNA, 14 bp, Homo sapiens
ccaggcccagccag

SEQ ID NO: 3283238 - DNA, 12 bp, Homo sapiens
ccaggcccaggc

SEQ ID NO: 3283239 - DNA, 16 bp, Homo sapiens
ccaggcccaggcagag

SEQ ID NO: 3283240 - DNA, 18 bp, Homo sapiens
ccaggcccaggcagagct

SEQ ID NO: 3283241 - DNA, 21 bp, Homo sapiens
ccaggcccatctcaggtgcca

SEQ ID NO: 3283242 - DNA, 12 bp, Homo sapiens
ccaggcccctga

SEQ ID NO: 3283243 - DNA, 14 bp, Homo sapiens
ccaggcccctgagg

SEQ ID NO: 3283244 - DNA, 14 bp, Homo sapiens
ccaggcccctgcca

SEQ ID NO: 3283245 - DNA, 23 bp, Homo sapiens
ccaggcccctgccaccctgggga

SEQ ID NO: 3283246 - DNA, 21 bp, Homo sapiens
ccaggcccgcaccccggcctc

SEQ ID NO: 3283247 - DNA, 24 bp, Homo sapiens
ccaggcccgcaccccggcctcagg

SEQ ID NO: 3283248 - DNA, 20 bp, Homo sapiens
ccaggccctccatgggctag

SEQ ID NO: 3283249 - DNA, 14 bp, Homo sapiens
ccaggccctccctg

SEQ ID NO: 3283250 - DNA, 24 bp, Homo sapiens
ccaggccgcaccatttctgtcact

SEQ ID NO: 3283251 - DNA, 20 bp, Homo sapiens
ccaggccgttccccttggct

SEQ ID NO: 3283252 - DNA, 19 bp, Homo sapiens
ccaggcctacctcactctc

SEQ ID NO: 3283253 - DNA, 13 bp, Homo sapiens
ccaggcctccagc

SEQ ID NO: 3283254 - DNA, 14 bp, Homo sapiens
ccaggcctccagcc

SEQ ID NO: 3283255 - DNA, 21 bp, Homo sapiens
ccaggcctccagcctctcccg

SEQ ID NO: 3283256 - DNA, 18 bp, Homo sapiens
ccaggcctctgtgtcctt

SEQ ID NO: 3283257 - DNA, 18 bp, Homo sapiens
ccaggcctcttggcagtc

SEQ ID NO: 3283258 - DNA, 14 bp, Homo sapiens
ccaggcctgcagca

SEQ ID NO: 3283259 - DNA, 16 bp, Homo sapiens
ccaggcctgcagcagg

SEQ ID NO: 3283260 - DNA, 16 bp, Homo sapiens
ccaggcctgcctccca

SEQ ID NO: 3283261 - DNA, 17 bp, Homo sapiens
ccaggcctgggtctgtg

SEQ ID NO: 3283262 - DNA, 19 bp, Homo sapiens
ccaggcctgggtctgtgtc

SEQ ID NO: 3283263 - DNA, 16 bp, Homo sapiens
ccaggcctgtccaccc

SEQ ID NO: 3283264 - DNA, 18 bp, Homo sapiens
ccaggcctgtccaccctg

SEQ ID NO: 3283265 - DNA, 21 bp, Homo sapiens
ccaggcctgtccaccctgcca

SEQ ID NO: 3283266 - DNA, 19 bp, Homo sapiens
ccaggcgttggtgccactt

SEQ ID NO: 3283267 - DNA, 20 bp, Homo sapiens
ccaggcgttggtgccacttc

SEQ ID NO: 3283268 - DNA, 22 bp, Homo sapiens
ccaggctatggttgccacccca

SEQ ID NO: 3283269 - DNA, 23 bp, Homo sapiens
ccaggctatggttgccaccccaa

SEQ ID NO: 3283270 - DNA, 17 bp, Homo sapiens
ccaggctccgcccttag

SEQ ID NO: 3283271 - DNA, 23 bp, Homo sapiens
ccaggctccgcccttagtccccc

SEQ ID NO: 3283272 - DNA, 14 bp, Homo sapiens
ccaggctcttcctg

SEQ ID NO: 3283273 - DNA, 12 bp, Homo sapiens
ccaggctgcact

SEQ ID NO: 3283274 - DNA, 15 bp, Homo sapiens
ccaggctgcactgca

SEQ ID NO: 3283275 - DNA, 18 bp, Homo sapiens
ccaggctgcactgcagtg

SEQ ID NO: 3283276 - DNA, 20 bp, Homo sapiens
ccaggctgcccccaacactc

SEQ ID NO: 3283277 - DNA, 13 bp, Homo sapiens
ccaggctggacat

SEQ ID NO: 3283278 - DNA, 18 bp, Homo sapiens
ccaggctggagtgcagtg

SEQ ID NO: 3283279 - DNA, 15 bp, Homo sapiens
ccaggctggcgcagc

SEQ ID NO: 3283280 - DNA, 16 bp, Homo sapiens
ccaggctggcgcagcc

SEQ ID NO: 3283281 - DNA, 17 bp, Homo sapiens
ccaggctggcgcagcca

SEQ ID NO: 3283282 - DNA, 18 bp, Homo sapiens
ccaggctggcgtgcagtg

SEQ ID NO: 3283283 - DNA, 11 bp, Homo sapiens
ccaggctggga

SEQ ID NO: 3283284 - DNA, 20 bp, Homo sapiens
ccaggctggtctaaaactcc

SEQ ID NO: 3283285 - DNA, 15 bp, Homo sapiens
ccaggctggtctcaa

SEQ ID NO: 3283286 - DNA, 20 bp, Homo sapiens
ccaggctgtatcccatgagc

SEQ ID NO: 3283287 - DNA, 24 bp, Homo sapiens
ccaggctgtatcccatgagcctca

SEQ ID NO: 3283288 - DNA, 16 bp, Homo sapiens
ccaggcttcaccctga

SEQ ID NO: 3283289 - DNA, 14 bp, Homo sapiens
ccaggcttggcctt

SEQ ID NO: 3283290 - DNA, 17 bp, Homo sapiens
ccagggaagagaaagtg

SEQ ID NO: 3283291 - DNA, 17 bp, Homo sapiens
ccagggaagctggccga

SEQ ID NO: 3283292 - DNA, 21 bp, Homo sapiens
ccagggaatcagggaccagct

SEQ ID NO: 3283293 - DNA, 18 bp, Homo sapiens
ccagggagcctttggttc

SEQ ID NO: 3283294 - DNA, 15 bp, Homo sapiens
ccagggagctgatgt

SEQ ID NO: 3283295 - DNA, 14 bp, Homo sapiens
ccagggaggagagg

SEQ ID NO: 3283296 - DNA, 15 bp, Homo sapiens
ccagggaggagtcag

SEQ ID NO: 3283297 - DNA, 24 bp, Homo sapiens
ccagggagggaagtgtgagcgcct

SEQ ID NO: 3283298 - DNA, 13 bp, Homo sapiens
ccagggatgctgg

SEQ ID NO: 3283299 - DNA, 18 bp, Homo sapiens
ccagggatgctgggctgg

SEQ ID NO: 3283300 - DNA, 20 bp, Homo sapiens
ccagggatgctgggctgggc

SEQ ID NO: 3283301 - DNA, 23 bp, Homo sapiens
ccagggcaccctgtggccctggc

SEQ ID NO: 3283302 - DNA, 14 bp, Homo sapiens
ccagggcagggcca

SEQ ID NO: 3283303 - DNA, 16 bp, Homo sapiens
ccagggcagggccacc

SEQ ID NO: 3283304 - DNA, 23 bp, Homo sapiens
ccagggcagggccaccccactct

SEQ ID NO: 3283305 - DNA, 14 bp, Homo sapiens
ccagggcagtgcta

SEQ ID NO: 3283306 - DNA, 22 bp, Homo sapiens
ccagggcagtgctagtgagctg

SEQ ID NO: 3283307 - DNA, 23 bp, Homo sapiens
ccagggcagtgctagtgagctgg

SEQ ID NO: 3283308 - DNA, 16 bp, Homo sapiens
ccagggccacgctcca

SEQ ID NO: 3283309 - DNA, 17 bp, Homo sapiens
ccagggccagggccctg

SEQ ID NO: 3283310 - DNA, 22 bp, Homo sapiens
ccagggcccctcaccctgcctt

SEQ ID NO: 3283311 - DNA, 22 bp, Homo sapiens
ccagggcccctccctctgcccc

SEQ ID NO: 3283312 - DNA, 17 bp, Homo sapiens
ccagggcccttgtacaa

SEQ ID NO: 3283313 - DNA, 22 bp, Homo sapiens
ccagggcctactgccacccgct

SEQ ID NO: 3283314 - DNA, 20 bp, Homo sapiens
ccagggctcctgcacttact

SEQ ID NO: 3283315 - DNA, 16 bp, Homo sapiens
ccagggctctgcccca

SEQ ID NO: 3283316 - DNA, 19 bp, Homo sapiens
ccagggctgccctgagaag

SEQ ID NO: 3283317 - DNA, 23 bp, Homo sapiens
ccagggctgccctgagaagctgc

SEQ ID NO: 3283318 - DNA, 13 bp, Homo sapiens
ccaggggaacctg

SEQ ID NO: 3283319 - DNA, 14 bp, Homo sapiens
ccaggggaggagcc

SEQ ID NO: 3283320 - DNA, 16 bp, Homo sapiens
ccaggggaggccaagt

SEQ ID NO: 3283321 - DNA, 13 bp, Homo sapiens
ccaggggcaggac

SEQ ID NO: 3283322 - DNA, 12 bp, Homo sapiens
ccaggggcctgc

SEQ ID NO: 3283323 - DNA, 15 bp, Homo sapiens
ccaggggcctgcaga

SEQ ID NO: 3283324 - DNA, 23 bp, Homo sapiens
ccagggggactagcccctgtgga

SEQ ID NO: 3283325 - DNA, 20 bp, Homo sapiens
ccaggggggcctcctcctag

SEQ ID NO: 3283326 - DNA, 17 bp, Homo sapiens
ccaggggtcccagccac

SEQ ID NO: 3283327 - DNA, 17 bp, Homo sapiens
ccagacgcatagactga

SEQ ID NO: 3283328 - DNA, 21 bp, Homo sapiens
ccagacgcatagactgaggta

SEQ ID NO: 3283329 - DNA, 16 bp, Homo sapiens
ccagacgtggtggctc

SEQ ID NO: 3283330 - DNA, 22 bp, Homo sapiens
ccagacgtggtggctcacacct

SEQ ID NO: 3283331 - DNA, 14 bp, Homo sapiens
ccagactacagggc

SEQ ID NO: 3283332 - DNA, 14 bp, Homo sapiens
ccagactcagctgg

SEQ ID NO: 3283333 - DNA, 15 bp, Homo sapiens
ccagactctaggtta

SEQ ID NO: 3283334 - DNA, 22 bp, Homo sapiens
ccagactctgagctgctcaccg

SEQ ID NO: 3283335 - DNA, 13 bp, Homo sapiens
ccagactgcaggt

SEQ ID NO: 3283336 - DNA, 22 bp, Homo sapiens
ccagactgcaggttggacccca

SEQ ID NO: 3283337 - DNA, 11 bp, Homo sapiens
ccagactggaa

SEQ ID NO: 3283338 - DNA, 14 bp, Homo sapiens
ccagacttccttga

SEQ ID NO: 3283339 - DNA, 12 bp, Homo sapiens
ccagagaacagc

SEQ ID NO: 3283340 - DNA, 24 bp, Homo sapiens
ccagagaatagatcagtatttcac

SEQ ID NO: 3283341 - DNA, 16 bp, Homo sapiens
ccagagaattcttaga

SEQ ID NO: 3283342 - DNA, 10 bp, Homo sapiens
ccagagacat

SEQ ID NO: 3283343 - DNA, 19 bp, Homo sapiens
ccagagaccgtcctcaccc

SEQ ID NO: 3283344 - DNA, 18 bp, Homo sapiens
ccagagagcaactctgag

SEQ ID NO: 3283345 - DNA, 21 bp, Homo sapiens
ccagagagcaactctgagatc

SEQ ID NO: 3283346 - DNA, 21 bp, Homo sapiens
ccagagagcctggtgctgctg

SEQ ID NO: 3283347 - DNA, 13 bp, Homo sapiens
ccagagagggccc

SEQ ID NO: 3283348 - DNA, 15 bp, Homo sapiens
ccagagagggcccag

SEQ ID NO: 3283349 - DNA, 21 bp, Homo sapiens
ccagagagggcccagctgtag

SEQ ID NO: 3283350 - DNA, 23 bp, Homo sapiens
ccagagagggcccagctgtagcc

SEQ ID NO: 3283351 - DNA, 18 bp, Homo sapiens
ccagagatgccagccctt

SEQ ID NO: 3283352 - DNA, 20 bp, Homo sapiens
ccagagatgccagcccttca

SEQ ID NO: 3283353 - DNA, 12 bp, Homo sapiens
ccagagatgtca

SEQ ID NO: 3283354 - DNA, 22 bp, Homo sapiens
ccagagcaacgaccagggccga

SEQ ID NO: 3283355 - DNA, 22 bp, Homo sapiens
ccagagcactgggttgcagggg

SEQ ID NO: 3283356 - DNA, 14 bp, Homo sapiens
ccagagcactttag

SEQ ID NO: 3283357 - DNA, 12 bp, Homo sapiens
ccagagcagagt

SEQ ID NO: 3283358 - DNA, 15 bp, Homo sapiens
ccagagcagagttta

SEQ ID NO: 3283359 - DNA, 16 bp, Homo sapiens
ccagagcagagtttac

SEQ ID NO: 3283360 - DNA, 22 bp, Homo sapiens
ccagagcagatgcagagagcca

SEQ ID NO: 3283361 - DNA, 14 bp, Homo sapiens
ccagagcaggaagc

SEQ ID NO: 3283362 - DNA, 20 bp, Homo sapiens
ccagagcatttccaacacca

SEQ ID NO: 3283363 - DNA, 15 bp, Homo sapiens
ccagagccaaatttt

SEQ ID NO: 3283364 - DNA, 12 bp, Homo sapiens
ccagagccacct

SEQ ID NO: 3283365 - DNA, 20 bp, Homo sapiens
ccagagccagatgcaggaca

SEQ ID NO: 3283366 - DNA, 14 bp, Homo sapiens
ccagagccagcctg

SEQ ID NO: 3283367 - DNA, 14 bp, Homo sapiens
ccagagcccacctt

SEQ ID NO: 3283368 - DNA, 22 bp, Homo sapiens
ccagagcccaccttggctcaag

SEQ ID NO: 3283369 - DNA, 14 bp, Homo sapiens
ccagagccccacac

SEQ ID NO: 3283370 - DNA, 19 bp, Homo sapiens
ccagagccccacacggagg

SEQ ID NO: 3283371 - DNA, 19 bp, Homo sapiens
ccagagcctggctgcccat

SEQ ID NO: 3283372 - DNA, 12 bp, Homo sapiens
ccagagccttca

SEQ ID NO: 3283373 - DNA, 16 bp, Homo sapiens
ccagagcgaggaaagg

SEQ ID NO: 3283374 - DNA, 23 bp, Homo sapiens
ccagagcgaggaaaggattttac

SEQ ID NO: 3283375 - DNA, 14 bp, Homo sapiens
ccagagctggaagg

SEQ ID NO: 3283376 - DNA, 15 bp, Homo sapiens
ccagagctggaaggc

SEQ ID NO: 3283377 - DNA, 21 bp, Homo sapiens
ccagagctggaaggcagggca

SEQ ID NO: 3283378 - DNA, 23 bp, Homo sapiens
ccagagctggaaggcagggcaga

SEQ ID NO: 3283379 - DNA, 14 bp, Homo sapiens
ccagagctgtgcca

SEQ ID NO: 3283380 - DNA, 19 bp, Homo sapiens
ccagagctgtttatggcct

SEQ ID NO: 3283381 - DNA, 17 bp, Homo sapiens
ccagaggaacctgaggc

SEQ ID NO: 3283382 - DNA, 14 bp, Homo sapiens
ccagaggaactgtc

SEQ ID NO: 3283383 - DNA, 19 bp, Homo sapiens
ccagaggaactgtccagag

SEQ ID NO: 3283384 - DNA, 18 bp, Homo sapiens
ccagaggaaggaaaagga

SEQ ID NO: 3283385 - DNA, 17 bp, Homo sapiens
ccagaggaatcctggca

SEQ ID NO: 3283386 - DNA, 19 bp, Homo sapiens
ccagaggaatcctggcagc

SEQ ID NO: 3283387 - DNA, 20 bp, Homo sapiens
ccagaggaatcctggcagcc

SEQ ID NO: 3283388 - DNA, 20 bp, Homo sapiens
ccagaggactcccaaccctg

SEQ ID NO: 3283389 - DNA, 16 bp, Homo sapiens
ccagaggagccaccag

SEQ ID NO: 3283390 - DNA, 12 bp, Homo sapiens
ccagaggcaggc

SEQ ID NO: 3283391 - DNA, 22 bp, Homo sapiens
ccagaggcccccagcccagggc

SEQ ID NO: 3283392 - DNA, 13 bp, Homo sapiens
ccagaggccctgg

SEQ ID NO: 3283393 - DNA, 15 bp, Homo sapiens
ccagaggccctggag

SEQ ID NO: 3283394 - DNA, 16 bp, Homo sapiens
ccagaggccctggagg

SEQ ID NO: 3283395 - DNA, 23 bp, Homo sapiens
ccagaggccctggaggtctccag

SEQ ID NO: 3283396 - DNA, 13 bp, Homo sapiens
ccagaggctgagt

SEQ ID NO: 3283397 - DNA, 12 bp, Homo sapiens
ccagaggctggg

SEQ ID NO: 3283398 - DNA, 22 bp, Homo sapiens
ccagagggagcaggccggaacc

SEQ ID NO: 3283399 - DNA, 18 bp, Homo sapiens
ccagagggagctggaacc

SEQ ID NO: 3283400 - DNA, 23 bp, Homo sapiens
ccagagggagtgacagaggcagc

SEQ ID NO: 3283401 - DNA, 13 bp, Homo sapiens
ccagagggcagtg

SEQ ID NO: 3283402 - DNA, 17 bp, Homo sapiens
ccagagggcccaggcag

SEQ ID NO: 3283403 - DNA, 13 bp, Homo sapiens
ccagaggggaagg

SEQ ID NO: 3283404 - DNA, 14 bp, Homo sapiens
ccagaggggaagga

SEQ ID NO: 3283405 - DNA, 22 bp, Homo sapiens
ccagaggtaacagaacagcttc

SEQ ID NO: 3283406 - DNA, 23 bp, Homo sapiens
ccagaggtaacagaacagcttca

SEQ ID NO: 3283407 - DNA, 16 bp, Homo sapiens
ccagcaccctctcctg

SEQ ID NO: 3283408 - DNA, 17 bp, Homo sapiens
ccagcacctgcctcctc

SEQ ID NO: 3283409 - DNA, 15 bp, Homo sapiens
ccagcacctggcatc

SEQ ID NO: 3283410 - DNA, 21 bp, Homo sapiens
ccagcaccttaggaggccgag

SEQ ID NO: 3283411 - DNA, 17 bp, Homo sapiens
ccagcaccttctttctg

SEQ ID NO: 3283412 - DNA, 20 bp, Homo sapiens
ccagcactaaggccgtgtct

SEQ ID NO: 3283413 - DNA, 13 bp, Homo sapiens
ccagcactcccct

SEQ ID NO: 3283414 - DNA, 19 bp, Homo sapiens
ccagcactccccttgcctt

SEQ ID NO: 3283415 - DNA, 17 bp, Homo sapiens
ccagcacttccatggga

SEQ ID NO: 3283416 - DNA, 15 bp, Homo sapiens
ccagcacttgtatat

SEQ ID NO: 3283417 - DNA, 17 bp, Homo sapiens
ccagcagcagaatggaa

SEQ ID NO: 3283418 - DNA, 14 bp, Homo sapiens
ccagcagcagcagg

SEQ ID NO: 3283419 - DNA, 18 bp, Homo sapiens
ccagcagcagcaggtgat

SEQ ID NO: 3283420 - DNA, 12 bp, Homo sapiens
ccagcagcatgg

SEQ ID NO: 3283421 - DNA, 12 bp, Homo sapiens
ccagcagctgcg

SEQ ID NO: 3283422 - DNA, 18 bp, Homo sapiens
ccagcagctgcgggtctg

SEQ ID NO: 3283423 - DNA, 21 bp, Homo sapiens
ccagcaggagagactgagcag

SEQ ID NO: 3283424 - DNA, 22 bp, Homo sapiens
ccagcaggagagactgagcagc

SEQ ID NO: 3283425 - DNA, 23 bp, Homo sapiens
ccagcaggagagactgagcagcc

SEQ ID NO: 3283426 - DNA, 20 bp, Homo sapiens
ccagcaggccagggactcag

SEQ ID NO: 3283427 - DNA, 23 bp, Homo sapiens
ccagcaggccggatcggtactgt

SEQ ID NO: 3283428 - DNA, 23 bp, Homo sapiens
ccagcagggggagaaacccttca

SEQ ID NO: 3283429 - DNA, 16 bp, Homo sapiens
ccagcaggggggctgt

SEQ ID NO: 3283430 - DNA, 23 bp, Homo sapiens
ccagcaggggggctgtgccaacc

SEQ ID NO: 3283431 - DNA, 15 bp, Homo sapiens
ccagcagttctgtta

SEQ ID NO: 3283432 - DNA, 22 bp, Homo sapiens
ccagcagttgaatgacaacaga

SEQ ID NO: 3283433 - DNA, 22 bp, Homo sapiens
ccagcagttttcaagtcaaatt

SEQ ID NO: 3283434 - DNA, 18 bp, Homo sapiens
ccagcatccacactgccg

SEQ ID NO: 3283435 - DNA, 19 bp, Homo sapiens
ccagcatccaccttggctc

SEQ ID NO: 3283436 - DNA, 20 bp, Homo sapiens
ccagcatccaccttggctct

SEQ ID NO: 3283437 - DNA, 13 bp, Homo sapiens
ccagcatccagcc

SEQ ID NO: 3283438 - DNA, 16 bp, Homo sapiens
ccagcatccagcctgt

SEQ ID NO: 3283439 - DNA, 12 bp, Homo sapiens
ccagcatccctg

SEQ ID NO: 3283440 - DNA, 23 bp, Homo sapiens
ccagcatccctggagcaggagcc

SEQ ID NO: 3283441 - DNA, 16 bp, Homo sapiens
ccagcatctcccagca

SEQ ID NO: 3283442 - DNA, 21 bp, Homo sapiens
ccagcattccagcccctctgg

SEQ ID NO: 3283443 - DNA, 19 bp, Homo sapiens
ccagccaaaccctgtctga

SEQ ID NO: 3283444 - DNA, 17 bp, Homo sapiens
ccagccaactctgggaa

SEQ ID NO: 3283445 - DNA, 22 bp, Homo sapiens
ccagccaacttttgcatgtttt

SEQ ID NO: 3283446 - DNA, 14 bp, Homo sapiens
ccagccaagggtcc

SEQ ID NO: 3283447 - DNA, 22 bp, Homo sapiens
ccagccaagggtcctcacccct

SEQ ID NO: 3283448 - DNA, 10 bp, Homo sapiens
ccagccacag

SEQ ID NO: 3283449 - DNA, 17 bp, Homo sapiens
ccagccacagacccctg

SEQ ID NO: 3283450 - DNA, 20 bp, Homo sapiens
ccagccacagacccctggga

SEQ ID NO: 3283451 - DNA, 23 bp, Homo sapiens
ccagccacagacccctgggagct

SEQ ID NO: 3283452 - DNA, 22 bp, Homo sapiens
ccagccaccccgggctctctgc

SEQ ID NO: 3283453 - DNA, 19 bp, Homo sapiens
ccagccagagttcctgcgg

SEQ ID NO: 3283454 - DNA, 14 bp, Homo sapiens
ccagccaggagcag

SEQ ID NO: 3283455 - DNA, 16 bp, Homo sapiens
ccagccaggccaacag

SEQ ID NO: 3283456 - DNA, 18 bp, Homo sapiens
ccagccagttggtggggc

SEQ ID NO: 3283457 - DNA, 16 bp, Homo sapiens
ccagccataaaagcat

SEQ ID NO: 3283458 - DNA, 18 bp, Homo sapiens
ccagccatcaaaatgctt

SEQ ID NO: 3283459 - DNA, 17 bp, Homo sapiens
ccagccatctgcccagg

SEQ ID NO: 3283460 - DNA, 18 bp, Homo sapiens
ccagccatctgcccaggg

SEQ ID NO: 3283461 - DNA, 21 bp, Homo sapiens
ccagccatctgcccaggggtg

SEQ ID NO: 3283462 - DNA, 12 bp, Homo sapiens
ccagcccaaagg

SEQ ID NO: 3283463 - DNA, 15 bp, Homo sapiens
ccagcccaccctgct

SEQ ID NO: 3283464 - DNA, 17 bp, Homo sapiens
ccagcccacttctgcca

SEQ ID NO: 3283465 - DNA, 12 bp, Homo sapiens
ccagcccagagc

SEQ ID NO: 3283466 - DNA, 16 bp, Homo sapiens
ccagcccagagccacc

SEQ ID NO: 3283467 - DNA, 16 bp, Homo sapiens
ccagcccagccaggcc

SEQ ID NO: 3283468 - DNA, 15 bp, Homo sapiens
ccagcccagggctcc

SEQ ID NO: 3283469 - DNA, 17 bp, Homo sapiens
ccagcccagggctcctg

SEQ ID NO: 3283470 - DNA, 18 bp, Homo sapiens
ccagcccatggcccccaa

SEQ ID NO: 3283471 - DNA, 21 bp, Homo sapiens
ccagcccatggcccccaataa

SEQ ID NO: 3283472 - DNA, 22 bp, Homo sapiens
ccagcccatggcccccaataaa

SEQ ID NO: 3283473 - DNA, 17 bp, Homo sapiens
ccagccccacccccagc

SEQ ID NO: 3283474 - DNA, 19 bp, Homo sapiens
ccagccccactgccagcag

SEQ ID NO: 3283475 - DNA, 20 bp, Homo sapiens
ccagccccactgccagcagc

SEQ ID NO: 3283476 - DNA, 22 bp, Homo sapiens
ccagccccagacaacagcccag

SEQ ID NO: 3283477 - DNA, 16 bp, Homo sapiens
ccagccccagtgccca

SEQ ID NO: 3283478 - DNA, 19 bp, Homo sapiens
ccagcccccaggaagacat

SEQ ID NO: 3283479 - DNA, 15 bp, Homo sapiens
ccagccccctggatg

SEQ ID NO: 3283480 - DNA, 20 bp, Homo sapiens
ccaaacatagcccctgcccc

SEQ ID NO: 3283481 - DNA, 18 bp, Homo sapiens
aaaccttttttaagattt

SEQ ID NO: 3283482 - DNA, 23 bp, Homo sapiens
aaactttttttctgtaccagtta

SEQ ID NO: 3283483 - DNA, 21 bp, Homo sapiens
aaagaaaaaaaaaaaagccag

SEQ ID NO: 3283484 - DNA, 22 bp, Homo sapiens
aaacactgtggaactaataaat

SEQ ID NO: 3283485 - DNA, 21 bp, Homo sapiens
aaacacttatcttctggatta

SEQ ID NO: 3283486 - DNA, 14 bp, Homo sapiens
aaacactttctctt

SEQ ID NO: 3283487 - DNA, 13 bp, Homo sapiens
aaacagaaacaaa

SEQ ID NO: 3283488 - DNA, 21 bp, Homo sapiens
aaacagaaacaaaaacactaa

SEQ ID NO: 3283489 - DNA, 21 bp, Homo sapiens
aaacagaacatcattagaaca

SEQ ID NO: 3283490 - DNA, 14 bp, Homo sapiens
aaacagacaatatg

SEQ ID NO: 3283491 - DNA, 18 bp, Homo sapiens
aaacagagaaagggtaat

SEQ ID NO: 3283492 - DNA, 15 bp, Homo sapiens
aaacagagacaggcc

SEQ ID NO: 3283493 - DNA, 16 bp, Homo sapiens
aaacagagatgtgata

SEQ ID NO: 3283494 - DNA, 15 bp, Homo sapiens
aaacagagcctgcct

SEQ ID NO: 3283495 - DNA, 17 bp, Homo sapiens
aaacagagcctgcctaa

SEQ ID NO: 3283496 - DNA, 23 bp, Homo sapiens
aaacagagcctgcctaaccaggc

SEQ ID NO: 3283497 - DNA, 15 bp, Homo sapiens
aaacagagtggcctc

SEQ ID NO: 3283498 - DNA, 13 bp, Homo sapiens
aaacagataccat

SEQ ID NO: 3283499 - DNA, 12 bp, Homo sapiens
aaacagatattg

SEQ ID NO: 3283500 - DNA, 22 bp, Homo sapiens
aaacagattcaggccagcccag

SEQ ID NO: 3283501 - DNA, 15 bp, Homo sapiens
aaacagcatgaataa

SEQ ID NO: 3283502 - DNA, 19 bp, Homo sapiens
aaacagcatgaataaaaca

SEQ ID NO: 3283503 - DNA, 16 bp, Homo sapiens
aaacagcattgctttc

SEQ ID NO: 3283504 - DNA, 21 bp, Homo sapiens
aaacagccccagtcttccttg

SEQ ID NO: 3283505 - DNA, 15 bp, Homo sapiens
aaacagctaaatttg

SEQ ID NO: 3283506 - DNA, 17 bp, Homo sapiens
aaacagctaatgggaca

SEQ ID NO: 3283507 - DNA, 14 bp, Homo sapiens
aaacagctatttaa

SEQ ID NO: 3283508 - DNA, 18 bp, Homo sapiens
aaacagctatttaagggg

SEQ ID NO: 3283509 - DNA, 11 bp, Homo sapiens
aaacagctcag

SEQ ID NO: 3283510 - DNA, 21 bp, Homo sapiens
aaacagcttcatgcctttgta

SEQ ID NO: 3283511 - DNA, 22 bp, Homo sapiens
aaacagcttcatgcctttgtaa

SEQ ID NO: 3283512 - DNA, 12 bp, Homo sapiens
aaacagctttca

SEQ ID NO: 3283513 - DNA, 14 bp, Homo sapiens
aaacaggaatttta

SEQ ID NO: 3283514 - DNA, 17 bp, Homo sapiens
aaacaggaattttattt

SEQ ID NO: 3283515 - DNA, 11 bp, Homo sapiens
aaacaggcagt

SEQ ID NO: 3283516 - DNA, 21 bp, Homo sapiens
aaacaggcagttggccagaga

SEQ ID NO: 3283517 - DNA, 15 bp, Homo sapiens
aaacagggctgcctt

SEQ ID NO: 3283518 - DNA, 18 bp, Homo sapiens
aaacaggtggtgagaaat

SEQ ID NO: 3283519 - DNA, 20 bp, Homo sapiens
aaacagtagttgtattcttc

SEQ ID NO: 3283520 - DNA, 23 bp, Homo sapiens
aaacagtagttgtattcttctgt

SEQ ID NO: 3283521 - DNA, 19 bp, Homo sapiens
aaacagtatattctttggt

SEQ ID NO: 3283522 - DNA, 14 bp, Homo sapiens
aaacagtgagcctg

SEQ ID NO: 3283523 - DNA, 20 bp, Homo sapiens
aaacagtgggagccctgacc

SEQ ID NO: 3283524 - DNA, 14 bp, Homo sapiens
aaacagttaacttt

SEQ ID NO: 3283525 - DNA, 11 bp, Homo sapiens
aaacagttcca

SEQ ID NO: 3283526 - DNA, 16 bp, Homo sapiens
aaacagttggtaactt

SEQ ID NO: 3283527 - DNA, 20 bp, Homo sapiens
aaacataaaaaccaaaccca

SEQ ID NO: 3283528 - DNA, 21 bp, Homo sapiens
aaacataaaaagcagaatttt

SEQ ID NO: 3283529 - DNA, 22 bp, Homo sapiens
aaacataataaatcacacattc

SEQ ID NO: 3283530 - DNA, 14 bp, Homo sapiens
aaacatagaaatgg

SEQ ID NO: 3283531 - DNA, 13 bp, Homo sapiens
aaacatatgattt

SEQ ID NO: 3283532 - DNA, 17 bp, Homo sapiens
aaacatatgatttcact

SEQ ID NO: 3283533 - DNA, 14 bp, Homo sapiens
aaacatatttcatt

SEQ ID NO: 3283534 - DNA, 14 bp, Homo sapiens
aaacatcaaataaa

SEQ ID NO: 3283535 - DNA, 16 bp, Homo sapiens
aaacatcaaataaatt

SEQ ID NO: 3283536 - DNA, 14 bp, Homo sapiens
aaacatcagtttct

SEQ ID NO: 3283537 - DNA, 17 bp, Homo sapiens
aaacatccaatattttc

SEQ ID NO: 3283538 - DNA, 22 bp, Homo sapiens
aaacatgagttattcataaaga

SEQ ID NO: 3283539 - DNA, 19 bp, Homo sapiens
aaacatgcttgaataactg

SEQ ID NO: 3283540 - DNA, 13 bp, Homo sapiens
aaacatgtatgtg

SEQ ID NO: 3283541 - DNA, 21 bp, Homo sapiens
aaacatgttaatgacaatatt

SEQ ID NO: 3283542 - DNA, 17 bp, Homo sapiens
aaacatgttagaagcaa

SEQ ID NO: 3283543 - DNA, 17 bp, Homo sapiens
aaacattaaaaatggaa

SEQ ID NO: 3283544 - DNA, 15 bp, Homo sapiens
aaacattaaaagaag

SEQ ID NO: 3283545 - DNA, 17 bp, Homo sapiens
aaacattaattttgtgc

SEQ ID NO: 3283546 - DNA, 18 bp, Homo sapiens
aaacattacagttcataa

SEQ ID NO: 3283547 - DNA, 23 bp, Homo sapiens
aaacattcacacagggctctttg

SEQ ID NO: 3283548 - DNA, 19 bp, Homo sapiens
aaacattgacgattccttc

SEQ ID NO: 3283549 - DNA, 14 bp, Homo sapiens
aaacattgcttttg

SEQ ID NO: 3283550 - DNA, 11 bp, Homo sapiens
aaacattgtaa

SEQ ID NO: 3283551 - DNA, 13 bp, Homo sapiens
aaacattgtaaat

SEQ ID NO: 3283552 - DNA, 19 bp, Homo sapiens
aaacattgtgttgacatta

SEQ ID NO: 3283553 - DNA, 17 bp, Homo sapiens
aaacattgttttgtgta

SEQ ID NO: 3283554 - DNA, 21 bp, Homo sapiens
aaacatttcataatttgtttc

SEQ ID NO: 3283555 - DNA, 23 bp, Homo sapiens
aaacatttcataatttgtttcca

SEQ ID NO: 3283556 - DNA, 12 bp, Homo sapiens
aaacatttgctg

SEQ ID NO: 3283557 - DNA, 14 bp, Homo sapiens
aaacattttatttt

SEQ ID NO: 3283558 - DNA, 15 bp, Homo sapiens
aaacattttgaagtg

SEQ ID NO: 3283559 - DNA, 13 bp, Homo sapiens
aaacatttttaat

SEQ ID NO: 3283560 - DNA, 22 bp, Homo sapiens
aaacatttttaatttaacaaac

SEQ ID NO: 3283561 - DNA, 14 bp, Homo sapiens
aaaccaaacttgtt

SEQ ID NO: 3283562 - DNA, 18 bp, Homo sapiens
aaaccaacctttaaaatt

SEQ ID NO: 3283563 - DNA, 21 bp, Homo sapiens
aaaccaacctttaaaattgtc

SEQ ID NO: 3283564 - DNA, 17 bp, Homo sapiens
aaaccaactctaatatt

SEQ ID NO: 3283565 - DNA, 20 bp, Homo sapiens
aaaccaagtcggaacagcag

SEQ ID NO: 3283566 - DNA, 19 bp, Homo sapiens
aaaccaatggtgatcctct

SEQ ID NO: 3283567 - DNA, 13 bp, Homo sapiens
aaaccaatttctt

SEQ ID NO: 3283568 - DNA, 19 bp, Homo sapiens
aaaccacagtttcattatt

SEQ ID NO: 3283569 - DNA, 21 bp, Homo sapiens
aaaccacagtttcattattct

SEQ ID NO: 3283570 - DNA, 20 bp, Homo sapiens
aaaccacctcagaaaggatt

SEQ ID NO: 3283571 - DNA, 16 bp, Homo sapiens
aaaccagaaaagcaat

SEQ ID NO: 3283572 - DNA, 12 bp, Homo sapiens
aaaccagggagc

SEQ ID NO: 3283573 - DNA, 23 bp, Homo sapiens
aaaccagtttagatttcaagaaa

SEQ ID NO: 3283574 - DNA, 13 bp, Homo sapiens
aaaccatgactgt

SEQ ID NO: 3283575 - DNA, 21 bp, Homo sapiens
aaaccatgactgtgaccacct

SEQ ID NO: 3283576 - DNA, 16 bp, Homo sapiens
aaaccatgagaatttg

SEQ ID NO: 3283577 - DNA, 17 bp, Homo sapiens
aaaccatgagaatttgc

SEQ ID NO: 3283578 - DNA, 15 bp, Homo sapiens
aaaccatgcaaatgc

SEQ ID NO: 3283579 - DNA, 17 bp, Homo sapiens
aaaccatttttaaagta

SEQ ID NO: 3283580 - DNA, 16 bp, Homo sapiens
aaaccatttttgttac

SEQ ID NO: 3283581 - DNA, 18 bp, Homo sapiens
aaaccatttttgttactc

SEQ ID NO: 3283582 - DNA, 23 bp, Homo sapiens
aaaccatttttgttactctcttc

SEQ ID NO: 3283583 - DNA, 16 bp, Homo sapiens
aaacccaaagccctgg

SEQ ID NO: 3283584 - DNA, 15 bp, Homo sapiens
aaacccaatccaaat

SEQ ID NO: 3283585 - DNA, 11 bp, Homo sapiens
aaacccacagt

SEQ ID NO: 3283586 - DNA, 11 bp, Homo sapiens
aaaccctaggt

SEQ ID NO: 3283587 - DNA, 19 bp, Homo sapiens
aaaccctcacaacccctga

SEQ ID NO: 3283588 - DNA, 15 bp, Homo sapiens
aaaccgtcctctttt

SEQ ID NO: 3283589 - DNA, 19 bp, Homo sapiens
aaacctaagtcctttatgt

SEQ ID NO: 3283590 - DNA, 18 bp, Homo sapiens
aaacctacacactgtcat

SEQ ID NO: 3283591 - DNA, 17 bp, Homo sapiens
aaacctagagaagataa

SEQ ID NO: 3283592 - DNA, 16 bp, Homo sapiens
aaacctaggatggata

SEQ ID NO: 3283593 - DNA, 17 bp, Homo sapiens
aaacctatcctcactgc

SEQ ID NO: 3283594 - DNA, 17 bp, Homo sapiens
aaacctcaaaatgtcta

SEQ ID NO: 3283595 - DNA, 12 bp, Homo sapiens
aaacctcaccct

SEQ ID NO: 3283596 - DNA, 23 bp, Homo sapiens
aaacctcactgagaggcctggag

SEQ ID NO: 3283597 - DNA, 16 bp, Homo sapiens
aaacctgaaaaaaagt

SEQ ID NO: 3283598 - DNA, 22 bp, Homo sapiens
aaacctgaaaaaaagtttacaa

SEQ ID NO: 3283599 - DNA, 23 bp, Homo sapiens
aaacctgaactttcattggattt

SEQ ID NO: 3283600 - DNA, 15 bp, Homo sapiens
aaacctgaagactga

SEQ ID NO: 3283601 - DNA, 23 bp, Homo sapiens
aaacctgaggatgcaacaaatat

SEQ ID NO: 3283602 - DNA, 21 bp, Homo sapiens
aaacctgggattcaggaatgt

SEQ ID NO: 3283603 - DNA, 22 bp, Homo sapiens
aaacctggggtgaatacttatt

SEQ ID NO: 3283604 - DNA, 18 bp, Homo sapiens
aaacctgtcaatgataca

SEQ ID NO: 3283605 - DNA, 22 bp, Homo sapiens
aaacctgttcaggcaggctttc

SEQ ID NO: 3283606 - DNA, 13 bp, Homo sapiens
aaaccttcctggg

SEQ ID NO: 3283607 - DNA, 14 bp, Homo sapiens
aaaccttctgcctt

SEQ ID NO: 3283608 - DNA, 15 bp, Homo sapiens
aaaccttgtaaaaaa

SEQ ID NO: 3283609 - DNA, 19 bp, Homo sapiens
aaaccttgtaaaaaaagca

SEQ ID NO: 3283610 - DNA, 20 bp, Homo sapiens
aaaccttgtaaaaaaagcaa

SEQ ID NO: 3283611 - DNA, 17 bp, Homo sapiens
aaacctttagggcagct

SEQ ID NO: 3283612 - DNA, 15 bp, Homo sapiens
aaaccttttattata

SEQ ID NO: 3283613 - DNA, 15 bp, Homo sapiens
aaaccttttttaaga

SEQ ID NO: 3283614 - DNA, 14 bp, Homo sapiens
aaaaaaaaatgttc

SEQ ID NO: 3283615 - DNA, 14 bp, Homo sapiens
aaaaaaaaccttgt

SEQ ID NO: 3283616 - DNA, 13 bp, Homo sapiens
aaaaaaaattgta

SEQ ID NO: 3283617 - DNA, 13 bp, Homo sapiens
aaaaaaacacaaa

SEQ ID NO: 3283618 - DNA, 10 bp, Homo sapiens
aaaaaaagaa

SEQ ID NO: 3283619 - DNA, 13 bp, Homo sapiens
aaaaaaagaaaag

SEQ ID NO: 3283620 - DNA, 12 bp, Homo sapiens
aaaaaaagatga

SEQ ID NO: 3283621 - DNA, 12 bp, Homo sapiens
aaaaaaataata

SEQ ID NO: 3283622 - DNA, 12 bp, Homo sapiens
aaaaaaatcaca

SEQ ID NO: 3283623 - DNA, 12 bp, Homo sapiens
aaaaaaatgttg

SEQ ID NO: 3283624 - DNA, 13 bp, Homo sapiens
aaaaaaattctgt

SEQ ID NO: 3283625 - DNA, 12 bp, Homo sapiens
aaaaaacatttt

SEQ ID NO: 3283626 - DNA, 15 bp, Homo sapiens
aaaaaaccttgtaaa

SEQ ID NO: 3283627 - DNA, 20 bp, Homo sapiens
aaaaaactcttaatctgtgt

SEQ ID NO: 3283628 - DNA, 10 bp, Homo sapiens
aaaaaagaaa

SEQ ID NO: 3283629 - DNA, 20 bp, Homo sapiens
aaaaaagaagttactttgta

SEQ ID NO: 3283630 - DNA, 12 bp, Homo sapiens
aaaaaagactga

SEQ ID NO: 3283631 - DNA, 15 bp, Homo sapiens
aaaaaagagaattag

SEQ ID NO: 3283632 - DNA, 11 bp, Homo sapiens
aaaaaagatga

SEQ ID NO: 3283633 - DNA, 11 bp, Homo sapiens
aaaaaagcaca

SEQ ID NO: 3283634 - DNA, 15 bp, Homo sapiens
aaaaaagcacataca

SEQ ID NO: 3283635 - DNA, 17 bp, Homo sapiens
aaaaaagtctctattta

SEQ ID NO: 3283636 - DNA, 11 bp, Homo sapiens
aaaaaattaag

SEQ ID NO: 3283637 - DNA, 21 bp, Homo sapiens
aaaaaattattcatgctctca

SEQ ID NO: 3283638 - DNA, 12 bp, Homo sapiens
aaaaaatttaaa

SEQ ID NO: 3283639 - DNA, 14 bp, Homo sapiens
aaaaaatttaagtg

SEQ ID NO: 3283640 - DNA, 15 bp, Homo sapiens
aaaaacaatcttatt

SEQ ID NO: 3283641 - DNA, 18 bp, Homo sapiens
aaaaacacctagctttat

SEQ ID NO: 3283642 - DNA, 19 bp, Homo sapiens
aaaaacaggtatatacttt

SEQ ID NO: 3283643 - DNA, 13 bp, Homo sapiens
aaaaacatgtatg

SEQ ID NO: 3283644 - DNA, 16 bp, Homo sapiens
aaaaacatgtatgtgc

SEQ ID NO: 3283645 - DNA, 11 bp, Homo sapiens
aaaaacattat

SEQ ID NO: 3283646 - DNA, 13 bp, Homo sapiens
aaaaacattgttt

SEQ ID NO: 3283647 - DNA, 16 bp, Homo sapiens
aaaaacattttgaagt

SEQ ID NO: 3283648 - DNA, 16 bp, Homo sapiens
aaaaaccacacaaaga

SEQ ID NO: 3283649 - DNA, 16 bp, Homo sapiens
aaaaaccgttcaaatt

SEQ ID NO: 3283650 - DNA, 19 bp, Homo sapiens
aaaaacctgaactttcatt

SEQ ID NO: 3283651 - DNA, 13 bp, Homo sapiens
aaaaactacacat

SEQ ID NO: 3283652 - DNA, 20 bp, Homo sapiens
aaaaactctgggaaataaga

SEQ ID NO: 3283653 - DNA, 12 bp, Homo sapiens
aaaaactgaatg

SEQ ID NO: 3283654 - DNA, 17 bp, Homo sapiens
aaaaactgctgtaaaca

SEQ ID NO: 3283655 - DNA, 11 bp, Homo sapiens
aaaaagaaaag

SEQ ID NO: 3283656 - DNA, 15 bp, Homo sapiens
aaaaagaaatgacta

SEQ ID NO: 3283657 - DNA, 18 bp, Homo sapiens
aaaaagaagttactttgt

SEQ ID NO: 3283658 - DNA, 19 bp, Homo sapiens
aaaaagaagttactttgta

SEQ ID NO: 3283659 - DNA, 13 bp, Homo sapiens
aaaaagaatagaa

SEQ ID NO: 3283660 - DNA, 13 bp, Homo sapiens
aaaaagacaaaca

SEQ ID NO: 3283661 - DNA, 14 bp, Homo sapiens
aaaaagactgaaca

SEQ ID NO: 3283662 - DNA, 23 bp, Homo sapiens
aaaaagactgaacatgtttacag

SEQ ID NO: 3283663 - DNA, 19 bp, Homo sapiens
aaaaagagaattagattat

SEQ ID NO: 3283664 - DNA, 15 bp, Homo sapiens
aaaaagattcttttt

SEQ ID NO: 3283665 - DNA, 15 bp, Homo sapiens
aaaaagcaagggaga

SEQ ID NO: 3283666 - DNA, 14 bp, Homo sapiens
aaaaagcacaagaa

SEQ ID NO: 3283667 - DNA, 12 bp, Homo sapiens
aaaaagcacata

SEQ ID NO: 3283668 - DNA, 15 bp, Homo sapiens
aaaaagcacatacat

SEQ ID NO: 3283669 - DNA, 20 bp, Homo sapiens
aaaaagcatgatgggaaaat

SEQ ID NO: 3283670 - DNA, 17 bp, Homo sapiens
aaaaagccagtttgggt

SEQ ID NO: 3283671 - DNA, 17 bp, Homo sapiens
aaaaagcctccaagggt

SEQ ID NO: 3283672 - DNA, 20 bp, Homo sapiens
aaaaagcctccaagggtttc

SEQ ID NO: 3283673 - DNA, 20 bp, Homo sapiens
aaaaagcctgcaatttcata

SEQ ID NO: 3283674 - DNA, 13 bp, Homo sapiens
aaaaaggaaaaat

SEQ ID NO: 3283675 - DNA, 17 bp, Homo sapiens
aaaaaggaaaagttaaa

SEQ ID NO: 3283676 - DNA, 19 bp, Homo sapiens
aaaaaggaaatttgtttgt

SEQ ID NO: 3283677 - DNA, 22 bp, Homo sapiens
aaaaagggcagggcatctcctg

SEQ ID NO: 3283678 - DNA, 20 bp, Homo sapiens
aaaaaggtataaataataat

SEQ ID NO: 3283679 - DNA, 21 bp, Homo sapiens
aaaaagtaagtaccactcagg

SEQ ID NO: 3283680 - DNA, 13 bp, Homo sapiens
aaaaagtattttt

SEQ ID NO: 3283681 - DNA, 17 bp, Homo sapiens
aaaaagtctctatttaa

SEQ ID NO: 3283682 - DNA, 18 bp, Homo sapiens
aaaaagtctctatttaaa

SEQ ID NO: 3283683 - DNA, 21 bp, Homo sapiens
aaaaagtctctatttaaattc

SEQ ID NO: 3283684 - DNA, 16 bp, Homo sapiens
aaaaagtgacacagca

SEQ ID NO: 3283685 - DNA, 19 bp, Homo sapiens
aaaaagtgacacagcagct

SEQ ID NO: 3283686 - DNA, 20 bp, Homo sapiens
aaaaagtgacacagcagctt

SEQ ID NO: 3283687 - DNA, 23 bp, Homo sapiens
aaaaagtgacacagcagcttcac

SEQ ID NO: 3283688 - DNA, 22 bp, Homo sapiens
aaaaagtgttgatcaaccattc

SEQ ID NO: 3283689 - DNA, 12 bp, Homo sapiens
aaaaagtgttta

SEQ ID NO: 3283690 - DNA, 19 bp, Homo sapiens
aaaaagttattatgtagct

SEQ ID NO: 3283691 - DNA, 13 bp, Homo sapiens
aaaaagttcagag

SEQ ID NO: 3283692 - DNA, 13 bp, Homo sapiens
aaaaagttccttc

SEQ ID NO: 3283693 - DNA, 12 bp, Homo sapiens
aaaaataaaagc

SEQ ID NO: 3283694 - DNA, 18 bp, Homo sapiens
aaaaataaatatatctac

SEQ ID NO: 3283695 - DNA, 24 bp, Homo sapiens
aaaaataaatatatctaccccaga

SEQ ID NO: 3283696 - DNA, 12 bp, Homo sapiens
aaaaataaatgg

SEQ ID NO: 3283697 - DNA, 18 bp, Homo sapiens
aaaaatagtcttccacaa

SEQ ID NO: 3283698 - DNA, 13 bp, Homo sapiens
aaaaatatattta

SEQ ID NO: 3283699 - DNA, 15 bp, Homo sapiens
aaaaatatatttaat

SEQ ID NO: 3283700 - DNA, 20 bp, Homo sapiens
aaaaatatggaacttctaat

SEQ ID NO: 3283701 - DNA, 23 bp, Homo sapiens
aaaaatattgtttctgcattcat

SEQ ID NO: 3283702 - DNA, 13 bp, Homo sapiens
aaaaatattttct

SEQ ID NO: 3283703 - DNA, 12 bp, Homo sapiens
aaaaatctagtt

SEQ ID NO: 3283704 - DNA, 13 bp, Homo sapiens
aaaaatctagttt

SEQ ID NO: 3283705 - DNA, 15 bp, Homo sapiens
aaaaatctagttttt

SEQ ID NO: 3283706 - DNA, 13 bp, Homo sapiens
aaaaatcttgtgc

SEQ ID NO: 3283707 - DNA, 12 bp, Homo sapiens
aaaaatgaaagc

SEQ ID NO: 3283708 - DNA, 15 bp, Homo sapiens
aaaaatgaaagtgac

SEQ ID NO: 3283709 - DNA, 18 bp, Homo sapiens
aaaaatgaaagtgacttt

SEQ ID NO: 3283710 - DNA, 20 bp, Homo sapiens
aaaaatgaatgtctaaaatt

SEQ ID NO: 3283711 - DNA, 15 bp, Homo sapiens
aaaaatgacaacaga

SEQ ID NO: 3283712 - DNA, 14 bp, Homo sapiens
aaaaatgacagact

SEQ ID NO: 3283713 - DNA, 17 bp, Homo sapiens
aaaaatgacagatgttg

SEQ ID NO: 3283714 - DNA, 21 bp, Homo sapiens
aaaaatgcacgtagctgaggc

SEQ ID NO: 3283715 - DNA, 14 bp, Homo sapiens
aaaaatgcctttga

SEQ ID NO: 3283716 - DNA, 14 bp, Homo sapiens
aaaaatgctgctct

SEQ ID NO: 3283717 - DNA, 17 bp, Homo sapiens
aaaaatggaaaaaaaca

SEQ ID NO: 3283718 - DNA, 19 bp, Homo sapiens
aaaaatggtatcaaaatta

SEQ ID NO: 3283719 - DNA, 14 bp, Homo sapiens
aaaaatggttgatg

SEQ ID NO: 3283720 - DNA, 21 bp, Homo sapiens
aaaaatggttgatggaaaata

SEQ ID NO: 3283721 - DNA, 22 bp, Homo sapiens
aaaaatggttgatggaaaataa

SEQ ID NO: 3283722 - DNA, 13 bp, Homo sapiens
aaaaatgtaaata

SEQ ID NO: 3283723 - DNA, 15 bp, Homo sapiens
aaaaatgtacattta

SEQ ID NO: 3283724 - DNA, 17 bp, Homo sapiens
aaaaatgtacatttatt

SEQ ID NO: 3283725 - DNA, 14 bp, Homo sapiens
aaaaattactaatt

SEQ ID NO: 3283726 - DNA, 18 bp, Homo sapiens
aaaaattactaattttac

SEQ ID NO: 3283727 - DNA, 15 bp, Homo sapiens
aaaaattatggaata

SEQ ID NO: 3283728 - DNA, 14 bp, Homo sapiens
aaaaattattcatg

SEQ ID NO: 3283729 - DNA, 21 bp, Homo sapiens
aaaaattcagagtccttgcaa

SEQ ID NO: 3283730 - DNA, 18 bp, Homo sapiens
aaaaattcctaagaatca

SEQ ID NO: 3283731 - DNA, 19 bp, Homo sapiens
aaaaattcctttgtgtttc

SEQ ID NO: 3283732 - DNA, 22 bp, Homo sapiens
aaaaatttaagcattgtttgct

SEQ ID NO: 3283733 - DNA, 13 bp, Homo sapiens
aaaaatttaagtg

SEQ ID NO: 3283734 - DNA, 11 bp, Homo sapiens
aaaaattttta

SEQ ID NO: 3283735 - DNA, 15 bp, Homo sapiens
aaaacaaatcactgt

SEQ ID NO: 3283736 - DNA, 22 bp, Homo sapiens
aaaacaactatggatcagaata

SEQ ID NO: 3283737 - DNA, 16 bp, Homo sapiens
aaaacaacttggcatt

SEQ ID NO: 3283738 - DNA, 22 bp, Homo sapiens
aaaacacctagctttattcttc

SEQ ID NO: 3283739 - DNA, 18 bp, Homo sapiens
aaaacactgccatcttag

SEQ ID NO: 3283740 - DNA, 13 bp, Homo sapiens
aaaacactgtgga

SEQ ID NO: 3283741 - DNA, 17 bp, Homo sapiens
aaaacagacactggcat

SEQ ID NO: 3283742 - DNA, 20 bp, Homo sapiens
aaaacagattctatattatt

SEQ ID NO: 3283743 - DNA, 15 bp, Homo sapiens
aaaacaggcaaattc

SEQ ID NO: 3283744 - DNA, 18 bp, Homo sapiens
aaaacagggccacataga

SEQ ID NO: 3283745 - DNA, 19 bp, Homo sapiens
tttttgaactaagaaactt

SEQ ID NO: 3283746 - DNA, 15 bp, Homo sapiens
tttttgataaagcct

SEQ ID NO: 3283747 - DNA, 19 bp, Homo sapiens
tttttgatcatccctttct

SEQ ID NO: 3283748 - DNA, 9 bp, Homo sapiens
tttttgcag

SEQ ID NO: 3283749 - DNA, 16 bp, Homo sapiens
tttttgcagtaactgt

SEQ ID NO: 3283750 - DNA, 13 bp, Homo sapiens
tttttgcatgaaa

SEQ ID NO: 3283751 - DNA, 17 bp, Homo sapiens
tttttgcatttaaaaca

SEQ ID NO: 3283752 - DNA, 20 bp, Homo sapiens
tttttgctataatcattagt

SEQ ID NO: 3283753 - DNA, 22 bp, Homo sapiens
tttttggactcagcccacctgc

SEQ ID NO: 3283754 - DNA, 19 bp, Homo sapiens
tttttggcctgtttgatgt

SEQ ID NO: 3283755 - DNA, 20 bp, Homo sapiens
tttttggcctgtttgatgta

SEQ ID NO: 3283756 - DNA, 20 bp, Homo sapiens
tttttggcgtggctgactta

SEQ ID NO: 3283757 - DNA, 22 bp, Homo sapiens
tttttggggaaaaaagcacata

SEQ ID NO: 3283758 - DNA, 19 bp, Homo sapiens
tttttggtataatgtttaa

SEQ ID NO: 3283759 - DNA, 19 bp, Homo sapiens
tttttggtggatgtaaata

SEQ ID NO: 3283760 - DNA, 13 bp, Homo sapiens
tttttgtaaactg

SEQ ID NO: 3283761 - DNA, 14 bp, Homo sapiens
tttttgtaaactgt

SEQ ID NO: 3283762 - DNA, 14 bp, Homo sapiens
tttttgtaactaca

SEQ ID NO: 3283763 - DNA, 16 bp, Homo sapiens
tttttgtaatgcactg

SEQ ID NO: 3283764 - DNA, 14 bp, Homo sapiens
tttttgtactgtaa

SEQ ID NO: 3283765 - DNA, 15 bp, Homo sapiens
tttttgtatgtgaac

SEQ ID NO: 3283766 - DNA, 18 bp, Homo sapiens
tttttgtcattttatgaa

SEQ ID NO: 3283767 - DNA, 20 bp, Homo sapiens
tttttgtctatgaagttgct

SEQ ID NO: 3283768 - DNA, 13 bp, Homo sapiens
tttttgtctcaat

SEQ ID NO: 3283769 - DNA, 16 bp, Homo sapiens
tttttgtcttattgaa

SEQ ID NO: 3283770 - DNA, 17 bp, Homo sapiens
tttttgtcttattgaaa

SEQ ID NO: 3283771 - DNA, 12 bp, Homo sapiens
tttttgtgtatg

SEQ ID NO: 3283772 - DNA, 14 bp, Homo sapiens
tttttgtgtatgta

SEQ ID NO: 3283773 - DNA, 18 bp, Homo sapiens
tttttgtgtatgtactta

SEQ ID NO: 3283774 - DNA, 19 bp, Homo sapiens
tttttgttggagtgtttct

SEQ ID NO: 3283775 - DNA, 20 bp, Homo sapiens
tttttgtttctgagaaaaga

SEQ ID NO: 3283776 - DNA, 12 bp, Homo sapiens
tttttgtttgcc

SEQ ID NO: 3283777 - DNA, 16 bp, Homo sapiens
tttttgttttttgtaa

SEQ ID NO: 3283778 - DNA, 15 bp, Homo sapiens
ttttttaaataaact

SEQ ID NO: 3283779 - DNA, 16 bp, Homo sapiens
ttttttaaataaactt

SEQ ID NO: 3283780 - DNA, 11 bp, Homo sapiens
ttttttaagat

SEQ ID NO: 3283781 - DNA, 20 bp, Homo sapiens
ttttttaagctatcagcaat

SEQ ID NO: 3283782 - DNA, 12 bp, Homo sapiens
ttttttatgaag

SEQ ID NO: 3283783 - DNA, 18 bp, Homo sapiens
ttttttcaatatttatta

SEQ ID NO: 3283784 - DNA, 12 bp, Homo sapiens
ttttttcagttg

SEQ ID NO: 3283785 - DNA, 11 bp, Homo sapiens
ttttttcctaa

SEQ ID NO: 3283786 - DNA, 11 bp, Homo sapiens
ttttttctacc

SEQ ID NO: 3283787 - DNA, 12 bp, Homo sapiens
ttttttcttcta

SEQ ID NO: 3283788 - DNA, 14 bp, Homo sapiens
ttttttcttttgta

SEQ ID NO: 3283789 - DNA, 9 bp, Homo sapiens
ttttttgca

SEQ ID NO: 3283790 - DNA, 10 bp, Homo sapiens
ttttttgcag

SEQ ID NO: 3283791 - DNA, 13 bp, Homo sapiens
ttttttggtataa

SEQ ID NO: 3283792 - DNA, 21 bp, Homo sapiens
ttttttggtataatgtttaaa

SEQ ID NO: 3283793 - DNA, 12 bp, Homo sapiens
ttttttgtagtt

SEQ ID NO: 3283794 - DNA, 13 bp, Homo sapiens
ttttttgttcaat

SEQ ID NO: 3283795 - DNA, 18 bp, Homo sapiens
ttttttgttttacaatgt

SEQ ID NO: 3283796 - DNA, 12 bp, Homo sapiens
tttttttcaatg

SEQ ID NO: 3283797 - DNA, 13 bp, Homo sapiens
tttttttgtaaac

SEQ ID NO: 3283798 - DNA, 11 bp, Homo sapiens
ttttttttgca

SEQ ID NO: 3283799 - DNA, 12 bp, Homo sapiens
ttttttttgcag

SEQ ID NO: 3283800 - DNA, 13 bp, Homo sapiens
tttttttttaaac

SEQ ID NO: 3283801 - DNA, 11 bp, Homo sapiens
ttttgtacatg

SEQ ID NO: 3283802 - DNA, 13 bp, Homo sapiens
ttttgtactgtaa

SEQ ID NO: 3283803 - DNA, 16 bp, Homo sapiens
ttttgtacttggaagt

SEQ ID NO: 3283804 - DNA, 16 bp, Homo sapiens
ttttgtataaaataga

SEQ ID NO: 3283805 - DNA, 16 bp, Homo sapiens
ttttgtataattggat

SEQ ID NO: 3283806 - DNA, 13 bp, Homo sapiens
ttttgtatacaaa

SEQ ID NO: 3283807 - DNA, 15 bp, Homo sapiens
ttttgtatacaaata

SEQ ID NO: 3283808 - DNA, 21 bp, Homo sapiens
ttttgtatacaaatatattgt

SEQ ID NO: 3283809 - DNA, 14 bp, Homo sapiens
ttttgtatgttaaa

SEQ ID NO: 3283810 - DNA, 20 bp, Homo sapiens
ttttgtattacatctaatgc

SEQ ID NO: 3283811 - DNA, 16 bp, Homo sapiens
ttttgtccccagggcc

SEQ ID NO: 3283812 - DNA, 15 bp, Homo sapiens
ttttgtctatgaagt

SEQ ID NO: 3283813 - DNA, 13 bp, Homo sapiens
ttttgtcttatat

SEQ ID NO: 3283814 - DNA, 16 bp, Homo sapiens
ttttgtcttattctta

SEQ ID NO: 3283815 - DNA, 13 bp, Homo sapiens
ttttgtcttgaat

SEQ ID NO: 3283816 - DNA, 18 bp, Homo sapiens
ttttgtgatgaataaaat

SEQ ID NO: 3283817 - DNA, 19 bp, Homo sapiens
ttttgtgatgatgctgtga

SEQ ID NO: 3283818 - DNA, 21 bp, Homo sapiens
ttttgtgatgtcccaacttgt

SEQ ID NO: 3283819 - DNA, 21 bp, Homo sapiens
ttttgtggtcattaagcattg

SEQ ID NO: 3283820 - DNA, 22 bp, Homo sapiens
ttttgtggttctattttacttt

SEQ ID NO: 3283821 - DNA, 16 bp, Homo sapiens
ttttgtggtttggaat

SEQ ID NO: 3283822 - DNA, 11 bp, Homo sapiens
ttttgtgtatg

SEQ ID NO: 3283823 - DNA, 15 bp, Homo sapiens
ttttgtgtatgtact

SEQ ID NO: 3283824 - DNA, 18 bp, Homo sapiens
ttttgtgtgaccaactgt

SEQ ID NO: 3283825 - DNA, 16 bp, Homo sapiens
ttttgtgttgtacaat

SEQ ID NO: 3283826 - DNA, 14 bp, Homo sapiens
ttttgttaaagctg

SEQ ID NO: 3283827 - DNA, 14 bp, Homo sapiens
ttttgttaatgctc

SEQ ID NO: 3283828 - DNA, 10 bp, Homo sapiens
ttttgttact

SEQ ID NO: 3283829 - DNA, 13 bp, Homo sapiens
ttttgttactgtt

SEQ ID NO: 3283830 - DNA, 19 bp, Homo sapiens
ttttgttactgttcttgct

SEQ ID NO: 3283831 - DNA, 22 bp, Homo sapiens
ttttgttactgttcttgctgct

SEQ ID NO: 3283832 - DNA, 23 bp, Homo sapiens
ttttgttactgttcttgctgcta

SEQ ID NO: 3283833 - DNA, 16 bp, Homo sapiens
ttttgttagcaaagat

SEQ ID NO: 3283834 - DNA, 18 bp, Homo sapiens
ttttgttatcagtcaata

SEQ ID NO: 3283835 - DNA, 11 bp, Homo sapiens
ttttgttattc

SEQ ID NO: 3283836 - DNA, 20 bp, Homo sapiens
ttttgttattccatcaataa

SEQ ID NO: 3283837 - DNA, 23 bp, Homo sapiens
ttttgttattccatcaataaatg

SEQ ID NO: 3283838 - DNA, 15 bp, Homo sapiens
ttttgttcacaacct

SEQ ID NO: 3283839 - DNA, 21 bp, Homo sapiens
ttttgttccacaagttaaata

SEQ ID NO: 3283840 - DNA, 16 bp, Homo sapiens
ttttgttgtaaaaaga

SEQ ID NO: 3283841 - DNA, 19 bp, Homo sapiens
ttttgttgtaaaaagaaaa

SEQ ID NO: 3283842 - DNA, 13 bp, Homo sapiens
ttttgttgtgtgt

SEQ ID NO: 3283843 - DNA, 15 bp, Homo sapiens
ttttgtttcttccaa

SEQ ID NO: 3283844 - DNA, 16 bp, Homo sapiens
ttttgtttggtaaatg

SEQ ID NO: 3283845 - DNA, 13 bp, Homo sapiens
ttttgttttacaa

SEQ ID NO: 3283846 - DNA, 20 bp, Homo sapiens
ttttgtttttattttcaaga

SEQ ID NO: 3283847 - DNA, 19 bp, Homo sapiens
ttttgtttttgtaatgcac

SEQ ID NO: 3283848 - DNA, 17 bp, Homo sapiens
tttttaaaaaaagaaaa

SEQ ID NO: 3283849 - DNA, 18 bp, Homo sapiens
tttttaaaaagtactctt

SEQ ID NO: 3283850 - DNA, 16 bp, Homo sapiens
tttttaaaacactaaa

SEQ ID NO: 3283851 - DNA, 22 bp, Homo sapiens
tttttaaaacactaaaagcagc

SEQ ID NO: 3283852 - DNA, 17 bp, Homo sapiens
tttttaaaatatttatt

SEQ ID NO: 3283853 - DNA, 14 bp, Homo sapiens
tttttaaaatggtg

SEQ ID NO: 3283854 - DNA, 20 bp, Homo sapiens
tttttaaagtgtttctgtta

SEQ ID NO: 3283855 - DNA, 15 bp, Homo sapiens
tttttaaagttttgt

SEQ ID NO: 3283856 - DNA, 16 bp, Homo sapiens
tttttaaataaaagca

SEQ ID NO: 3283857 - DNA, 17 bp, Homo sapiens
tttttaaataaaagcac

SEQ ID NO: 3283858 - DNA, 13 bp, Homo sapiens
tttttaaataaac

SEQ ID NO: 3283859 - DNA, 16 bp, Homo sapiens
tttttaaataaacttt

SEQ ID NO: 3283860 - DNA, 23 bp, Homo sapiens
tttttaaataaactttttttcaa

SEQ ID NO: 3283861 - DNA, 14 bp, Homo sapiens
tttttaaatgtgaa

SEQ ID NO: 3283862 - DNA, 15 bp, Homo sapiens
tttttaaatgtgaat

SEQ ID NO: 3283863 - DNA, 22 bp, Homo sapiens
tttttaacaaaaaacagattct

SEQ ID NO: 3283864 - DNA, 13 bp, Homo sapiens
tttttaacctgtt

SEQ ID NO: 3283865 - DNA, 19 bp, Homo sapiens
ttttgactaaagctatgtt

SEQ ID NO: 3283866 - DNA, 18 bp, Homo sapiens
ttttgacttaatgtgatt

SEQ ID NO: 3283867 - DNA, 18 bp, Homo sapiens
ttttgaggcttctccttc

SEQ ID NO: 3283868 - DNA, 18 bp, Homo sapiens
ttttgagggcatgaagct

SEQ ID NO: 3283869 - DNA, 13 bp, Homo sapiens
ttttgataacaat

SEQ ID NO: 3283870 - DNA, 18 bp, Homo sapiens
ttttgataataatattgt

SEQ ID NO: 3283871 - DNA, 17 bp, Homo sapiens
ttttgatcatccctttc

SEQ ID NO: 3283872 - DNA, 21 bp, Homo sapiens
ttttgatcctctactgtgcat

SEQ ID NO: 3283873 - DNA, 20 bp, Homo sapiens
ttttgatgtttgtggcctca

SEQ ID NO: 3283874 - DNA, 15 bp, Homo sapiens
ttttgattattgtat

SEQ ID NO: 3283875 - DNA, 17 bp, Homo sapiens
ttttgcaatggctatat

SEQ ID NO: 3283876 - DNA, 17 bp, Homo sapiens
ttttgcacagccaaatt

SEQ ID NO: 3283877 - DNA, 20 bp, Homo sapiens
ttttgcacatgtttcctcta

SEQ ID NO: 3283878 - DNA, 17 bp, Homo sapiens
ttttgcacccctcccat

SEQ ID NO: 3283879 - DNA, 14 bp, Homo sapiens
ttttgcagcagtga

SEQ ID NO: 3283880 - DNA, 14 bp, Homo sapiens
ttttgcagtaactg

SEQ ID NO: 3283881 - DNA, 15 bp, Homo sapiens
ttttgcagtaactgt

SEQ ID NO: 3283882 - DNA, 16 bp, Homo sapiens
ttttgcagtaactgtt

SEQ ID NO: 3283883 - DNA, 22 bp, Homo sapiens
ttttgcataagattaaaggaag

SEQ ID NO: 3283884 - DNA, 15 bp, Homo sapiens
ttttgcatactgaaa

SEQ ID NO: 3283885 - DNA, 13 bp, Homo sapiens
ttttgcatgaaat

SEQ ID NO: 3283886 - DNA, 21 bp, Homo sapiens
ttttgcatgcatgcaaatgag

SEQ ID NO: 3283887 - DNA, 14 bp, Homo sapiens
ttttgccacagctt

SEQ ID NO: 3283888 - DNA, 15 bp, Homo sapiens
ttttgccattaaact

SEQ ID NO: 3283889 - DNA, 17 bp, Homo sapiens
ttttgccgctgagatat

SEQ ID NO: 3283890 - DNA, 22 bp, Homo sapiens
ttttgcctggctgtggaggcct

SEQ ID NO: 3283891 - DNA, 13 bp, Homo sapiens
ttttgctggaata

SEQ ID NO: 3283892 - DNA, 23 bp, Homo sapiens
ttttgctggaattcctaactttt

SEQ ID NO: 3283893 - DNA, 12 bp, Homo sapiens
ttttgctgtata

SEQ ID NO: 3283894 - DNA, 13 bp, Homo sapiens
ttttgctgtatat

SEQ ID NO: 3283895 - DNA, 12 bp, Homo sapiens
ttttgctttggt

SEQ ID NO: 3283896 - DNA, 13 bp, Homo sapiens
ttttgctttggtt

SEQ ID NO: 3283897 - DNA, 13 bp, Homo sapiens
ttttggaaactgc

SEQ ID NO: 3283898 - DNA, 15 bp, Homo sapiens
ttttggaggtgctta

SEQ ID NO: 3283899 - DNA, 19 bp, Homo sapiens
ttttggcaaacgctaaaga

SEQ ID NO: 3283900 - DNA, 14 bp, Homo sapiens
ttttggcctgtttg

SEQ ID NO: 3283901 - DNA, 15 bp, Homo sapiens
ttttggctagagttt

SEQ ID NO: 3283902 - DNA, 18 bp, Homo sapiens
ttttggctctttcagaga

SEQ ID NO: 3283903 - DNA, 14 bp, Homo sapiens
ttttggctgacttc

SEQ ID NO: 3283904 - DNA, 16 bp, Homo sapiens
ttttggggaaaaaagc

SEQ ID NO: 3283905 - DNA, 17 bp, Homo sapiens
ttttggggaaaaaagca

SEQ ID NO: 3283906 - DNA, 14 bp, Homo sapiens
ttttgggtgaatct

SEQ ID NO: 3283907 - DNA, 16 bp, Homo sapiens
ttttgggtgaatcttg

SEQ ID NO: 3283908 - DNA, 14 bp, Homo sapiens
ttttggtataatgt

SEQ ID NO: 3283909 - DNA, 22 bp, Homo sapiens
ttttggttgtcaatattaaata

SEQ ID NO: 3283910 - DNA, 14 bp, Homo sapiens
ttttggtttacctg

SEQ ID NO: 3283911 - DNA, 21 bp, Homo sapiens
ttttgtaaactgtatcaaatc

SEQ ID NO: 3283912 - DNA, 13 bp, Homo sapiens
ttttgtaaattaa

SEQ ID NO: 3283913 - DNA, 14 bp, Homo sapiens
ttttgtaagacaaa

SEQ ID NO: 3283914 - DNA, 20 bp, Homo sapiens
ttttgtaagatgctgggttg

SEQ ID NO: 3283915 - DNA, 21 bp, Homo sapiens
ttttgtaatgcactgttttta

SEQ ID NO: 3283916 - DNA, 16 bp, Homo sapiens
ttttgtaatgtgaaaa

SEQ ID NO: 3283917 - DNA, 18 bp, Homo sapiens
ttttgtaatgtgaaaagt

SEQ ID NO: 3283918 - DNA, 15 bp, Homo sapiens
ttttgtaattgtgta

SEQ ID NO: 3283919 - DNA, 15 bp, Homo sapiens
ttttgtacactgctg

SEQ ID NO: 3283920 - DNA, 16 bp, Homo sapiens
ttttgtacactgctgt

SEQ ID NO: 3283921 - DNA, 17 bp, Homo sapiens
ttttgtacactgctgta

SEQ ID NO: 3283922 - DNA, 12 bp, Homo sapiens
ttttgtacatct

SEQ ID NO: 3283923 - DNA, 21 bp, Homo sapiens
ttttgtacatctggcttattt

SEQ ID NO: 3283924 - DNA, 18 bp, Homo sapiens
tcttgctcccttcagccc

SEQ ID NO: 3283925 - DNA, 19 bp, Homo sapiens
tcttgctcccttcagcccc

SEQ ID NO: 3283926 - DNA, 18 bp, Homo sapiens
tcttgctctatctctcaa

SEQ ID NO: 3283927 - DNA, 23 bp, Homo sapiens
tcttgctctgctgacagacacag

SEQ ID NO: 3283928 - DNA, 19 bp, Homo sapiens
tcttgctgatggctgctag

SEQ ID NO: 3283929 - DNA, 21 bp, Homo sapiens
tcttgctgatggctgctagat

SEQ ID NO: 3283930 - DNA, 22 bp, Homo sapiens
tcttgctgctagaactttttta

SEQ ID NO: 3283931 - DNA, 19 bp, Homo sapiens
tcttgctggattaatgttt

SEQ ID NO: 3283932 - DNA, 17 bp, Homo sapiens
tcttgctgtctctgctc

SEQ ID NO: 3283933 - DNA, 18 bp, Homo sapiens
tcttgcttccctaatcta

SEQ ID NO: 3283934 - DNA, 23 bp, Homo sapiens
tcttgcttccctaatctatggtc

SEQ ID NO: 3283935 - DNA, 11 bp, Homo sapiens
tcttgcttctt

SEQ ID NO: 3283936 - DNA, 18 bp, Homo sapiens
tcttgcttctttctagaa

SEQ ID NO: 3283937 - DNA, 20 bp, Homo sapiens
tcttgcttggggaacttgtg

SEQ ID NO: 3283938 - DNA, 21 bp, Homo sapiens
tcttgcttgtcattgactctt

SEQ ID NO: 3283939 - DNA, 12 bp, Homo sapiens
tctgtccccagc

SEQ ID NO: 3283940 - DNA, 22 bp, Homo sapiens
tctgtccccagccctgtcctgg

SEQ ID NO: 3283941 - DNA, 14 bp, Homo sapiens
tctgtcccttgctg

SEQ ID NO: 3283942 - DNA, 20 bp, Homo sapiens
tctgtccgttcacatgtgtg

SEQ ID NO: 3283943 - DNA, 19 bp, Homo sapiens
tctgtcctactctgtgtca

SEQ ID NO: 3283944 - DNA, 21 bp, Homo sapiens
tctgtcctgggagtgagctgg

SEQ ID NO: 3283945 - DNA, 13 bp, Homo sapiens
tctgtcctgtgac

SEQ ID NO: 3283946 - DNA, 16 bp, Homo sapiens
tctgtcgcccagtctg

SEQ ID NO: 3283947 - DNA, 17 bp, Homo sapiens
tctgtcgccttagcatg

SEQ ID NO: 3283948 - DNA, 15 bp, Homo sapiens
tctgtctactgtggt

SEQ ID NO: 3283949 - DNA, 22 bp, Homo sapiens
tctgtctcagacttttgtacat

SEQ ID NO: 3283950 - DNA, 19 bp, Homo sapiens
tctgtctcatcctcctgga

SEQ ID NO: 3283951 - DNA, 17 bp, Homo sapiens
tctgtctccaagacctt

SEQ ID NO: 3283952 - DNA, 16 bp, Homo sapiens
tctgtctggtggcccc

SEQ ID NO: 3283953 - DNA, 14 bp, Homo sapiens
tctgtcttcacagc

SEQ ID NO: 3283954 - DNA, 20 bp, Homo sapiens
tctgtctttatgtttttcta

SEQ ID NO: 3283955 - DNA, 14 bp, Homo sapiens
tctgtctttcaaaa

SEQ ID NO: 3283956 - DNA, 11 bp, Homo sapiens
tctgtctttcc

SEQ ID NO: 3283957 - DNA, 22 bp, Homo sapiens
tctgtgaaaacatatttgtgaa

SEQ ID NO: 3283958 - DNA, 16 bp, Homo sapiens
tctgtgaaagtacatt

SEQ ID NO: 3283959 - DNA, 12 bp, Homo sapiens
tctgtgaaatat

SEQ ID NO: 3283960 - DNA, 20 bp, Homo sapiens
tctgtgaaatgctggcattt

SEQ ID NO: 3283961 - DNA, 21 bp, Homo sapiens
tctgtgaacgatttagaaaga

SEQ ID NO: 3283962 - DNA, 19 bp, Homo sapiens
tctgtgaagaggaacagtg

SEQ ID NO: 3283963 - DNA, 12 bp, Homo sapiens
tctgtgaataca

SEQ ID NO: 3283964 - DNA, 15 bp, Homo sapiens
tctgtgaatgctaag

SEQ ID NO: 3283965 - DNA, 15 bp, Homo sapiens
tctgtgaccaaaata

SEQ ID NO: 3283966 - DNA, 23 bp, Homo sapiens
tctgtgaccaaaataccttggtc

SEQ ID NO: 3283967 - DNA, 15 bp, Homo sapiens
tctgtgacctcaggc

SEQ ID NO: 3283968 - DNA, 14 bp, Homo sapiens
tctgtgacgcagac

SEQ ID NO: 3283969 - DNA, 21 bp, Homo sapiens
tctgtgacgcagacagagggg

SEQ ID NO: 3283970 - DNA, 23 bp, Homo sapiens
tctgtgagatgctagaactccct

SEQ ID NO: 3283971 - DNA, 14 bp, Homo sapiens
tctgtgatcattta

SEQ ID NO: 3283972 - DNA, 17 bp, Homo sapiens
tctgtgatgacattccc

SEQ ID NO: 3283973 - DNA, 21 bp, Homo sapiens
tctgtgcaggatatttgcact

SEQ ID NO: 3283974 - DNA, 17 bp, Homo sapiens
tctgtgccatagaacaa

SEQ ID NO: 3283975 - DNA, 18 bp, Homo sapiens
tctgtgccatagaacaag

SEQ ID NO: 3283976 - DNA, 22 bp, Homo sapiens
tctgtgccccatgcctgtccag

SEQ ID NO: 3283977 - DNA, 16 bp, Homo sapiens
tctgtgccttcgtctt

SEQ ID NO: 3283978 - DNA, 16 bp, Homo sapiens
tctgtgcgtgaaacac

SEQ ID NO: 3283979 - DNA, 18 bp, Homo sapiens
tctgtgctgtgcctgcta

SEQ ID NO: 3283980 - DNA, 23 bp, Homo sapiens
tctgtggagctgccacagagaag

SEQ ID NO: 3283981 - DNA, 18 bp, Homo sapiens
tctgtggatggtcattgc

SEQ ID NO: 3283982 - DNA, 12 bp, Homo sapiens
tctgtggcctgt

SEQ ID NO: 3283983 - DNA, 14 bp, Homo sapiens
tctgtggcctgtgt

SEQ ID NO: 3283984 - DNA, 12 bp, Homo sapiens
tctgtgggcccc

SEQ ID NO: 3283985 - DNA, 19 bp, Homo sapiens
tctgtgggcccctcaacag

SEQ ID NO: 3283986 - DNA, 19 bp, Homo sapiens
tctgtggttcctctgctca

SEQ ID NO: 3283987 - DNA, 20 bp, Homo sapiens
tctgtggttcctctgctcac

SEQ ID NO: 3283988 - DNA, 20 bp, Homo sapiens
tctgtgtatatctcttggaa

SEQ ID NO: 3283989 - DNA, 21 bp, Homo sapiens
tctgtgtatatctcttggaaa

SEQ ID NO: 3283990 - DNA, 19 bp, Homo sapiens
tctgtgtatattatttggc

SEQ ID NO: 3283991 - DNA, 15 bp, Homo sapiens
tctgtgtccttccct

SEQ ID NO: 3283992 - DNA, 14 bp, Homo sapiens
tctgtgtctaagat

SEQ ID NO: 3283993 - DNA, 13 bp, Homo sapiens
tctgtgtgaaaat

SEQ ID NO: 3283994 - DNA, 13 bp, Homo sapiens
tctgtgtgaatgt

SEQ ID NO: 3283995 - DNA, 21 bp, Homo sapiens
tctgtgtgcacaaatatttat

SEQ ID NO: 3283996 - DNA, 19 bp, Homo sapiens
tctgtgtgggactgtacac

SEQ ID NO: 3283997 - DNA, 21 bp, Homo sapiens
tctgtgtgggactgtacacac

SEQ ID NO: 3283998 - DNA, 15 bp, Homo sapiens
tctgtgtgtatattg

SEQ ID NO: 3283999 - DNA, 14 bp, Homo sapiens
tctgtgtgtgttct

SEQ ID NO: 3284000 - DNA, 12 bp, Homo sapiens
tctgtgttcatt

SEQ ID NO: 3284001 - DNA, 21 bp, Homo sapiens
tctgtgttgcattattcattt

SEQ ID NO: 3284002 - DNA, 12 bp, Homo sapiens
tctgtgtttaaa

SEQ ID NO: 3284003 - DNA, 17 bp, Homo sapiens
tctgtgtttaatttctt

SEQ ID NO: 3284004 - DNA, 22 bp, Homo sapiens
tctgtgtttaatttcttcaaaa

SEQ ID NO: 3284005 - DNA, 12 bp, Homo sapiens
tctgtgtttaca

SEQ ID NO: 3284006 - DNA, 15 bp, Homo sapiens
tctgtgtttacagac

SEQ ID NO: 3284007 - DNA, 18 bp, Homo sapiens
tctgtgttttgaaagaat

SEQ ID NO: 3284008 - DNA, 14 bp, Homo sapiens
tctgtgttttgaat

SEQ ID NO: 3284009 - DNA, 21 bp, Homo sapiens
tctgttaaggttgaactttgc

SEQ ID NO: 3284010 - DNA, 21 bp, Homo sapiens
tctgttaccatgtcactgtgg

SEQ ID NO: 3284011 - DNA, 15 bp, Homo sapiens
tctgttacccaggct

SEQ ID NO: 3284012 - DNA, 20 bp, Homo sapiens
tctgttagctgggtttacat

SEQ ID NO: 3284013 - DNA, 19 bp, Homo sapiens
tctgttatatcccctgcta

SEQ ID NO: 3284014 - DNA, 17 bp, Homo sapiens
tctgttatgtactgtac

SEQ ID NO: 3284015 - DNA, 19 bp, Homo sapiens
tctgttatgtactgtacta

SEQ ID NO: 3284016 - DNA, 15 bp, Homo sapiens
tctgttattaacaaa

SEQ ID NO: 3284017 - DNA, 21 bp, Homo sapiens
tctgttcacttttcctccctc

SEQ ID NO: 3284018 - DNA, 13 bp, Homo sapiens
tctgttccaaatt

SEQ ID NO: 3284019 - DNA, 14 bp, Homo sapiens
tctgttccaaattc

SEQ ID NO: 3284020 - DNA, 23 bp, Homo sapiens
tctgttccaaattcagtttcata

SEQ ID NO: 3284021 - DNA, 23 bp, Homo sapiens
tctgttcccctgtcctgtgaatg

SEQ ID NO: 3284022 - DNA, 20 bp, Homo sapiens
tctgttctagttttttactt

SEQ ID NO: 3284023 - DNA, 24 bp, Homo sapiens
tctgttctgctgggagttctagaa

SEQ ID NO: 3284024 - DNA, 14 bp, Homo sapiens
tctgttcttgctac

SEQ ID NO: 3284025 - DNA, 22 bp, Homo sapiens
tctgttgcaattaggattttga

SEQ ID NO: 3284026 - DNA, 18 bp, Homo sapiens
tctgttggcaggctggcc

SEQ ID NO: 3284027 - DNA, 20 bp, Homo sapiens
tctgttggcaggctggccag

SEQ ID NO: 3284028 - DNA, 20 bp, Homo sapiens
tctgttggccagtgtgacaa

SEQ ID NO: 3284029 - DNA, 21 bp, Homo sapiens
tctgttggtgccacgctttga

SEQ ID NO: 3284030 - DNA, 16 bp, Homo sapiens
tctgttgtaacttatg

SEQ ID NO: 3284031 - DNA, 15 bp, Homo sapiens
tctgttgttccattt

SEQ ID NO: 3284032 - DNA, 17 bp, Homo sapiens
tctgttgttccatttta

SEQ ID NO: 3284033 - DNA, 14 bp, Homo sapiens
tctgtttaggaaga

SEQ ID NO: 3284034 - DNA, 23 bp, Homo sapiens
tctgtttatggccacatttaata

SEQ ID NO: 3284035 - DNA, 19 bp, Homo sapiens
tctgtttggactgcagaag

SEQ ID NO: 3284036 - DNA, 18 bp, Homo sapiens
tctgtttggcacttgtat

SEQ ID NO: 3284037 - DNA, 19 bp, Homo sapiens
tctgtttggcacttgtatt

SEQ ID NO: 3284038 - DNA, 21 bp, Homo sapiens
tctgtttggcacttgtattta

SEQ ID NO: 3284039 - DNA, 12 bp, Homo sapiens
tctgtttgttaa

SEQ ID NO: 3284040 - DNA, 17 bp, Homo sapiens
tctgttttgaaggcaaa

SEQ ID NO: 3284041 - DNA, 12 bp, Homo sapiens
tctgtttttgta

SEQ ID NO: 3284042 - DNA, 16 bp, Homo sapiens
tctgtttttgtatctt

SEQ ID NO: 3284043 - DNA, 19 bp, Homo sapiens
tcttaaaaagttgttcaac

SEQ ID NO: 3284044 - DNA, 21 bp, Homo sapiens
tcttaaaaagttgttcaacta

SEQ ID NO: 3284045 - DNA, 17 bp, Homo sapiens
tcttaaaagtactttaa

SEQ ID NO: 3284046 - DNA, 14 bp, Homo sapiens
tcttaaacaatgta

SEQ ID NO: 3284047 - DNA, 15 bp, Homo sapiens
tcttaaacaatgtat

SEQ ID NO: 3284048 - DNA, 21 bp, Homo sapiens
tcttaaacataataaatcaca

SEQ ID NO: 3284049 - DNA, 16 bp, Homo sapiens
tcttaaaccaaccttt

SEQ ID NO: 3284050 - DNA, 21 bp, Homo sapiens
tcttaaaccaacctttaaaat

SEQ ID NO: 3284051 - DNA, 23 bp, Homo sapiens
tcttaaaccaacctttaaaattg

SEQ ID NO: 3284052 - DNA, 16 bp, Homo sapiens
tcttaaagaaacagct

SEQ ID NO: 3284053 - DNA, 17 bp, Homo sapiens
tcttaaagaaacagctt

SEQ ID NO: 3284054 - DNA, 18 bp, Homo sapiens
tcttaaagaaacagcttt

SEQ ID NO: 3284055 - DNA, 23 bp, Homo sapiens
tcttaaagaaacagctttcaagt

SEQ ID NO: 3284056 - DNA, 19 bp, Homo sapiens
tcttaaagctgcctgtagt

SEQ ID NO: 3284057 - DNA, 20 bp, Homo sapiens
tcttaaagctgcctgtagtt

SEQ ID NO: 3284058 - DNA, 13 bp, Homo sapiens
aaaaaaaaagttc

SEQ ID NO: 3284059 - DNA, 13 bp, Homo sapiens
aaaaaaaagcttc

SEQ ID NO: 3284060 - DNA, 18 bp, Homo sapiens
aaaaaaacagtggatcac

SEQ ID NO: 3284061 - DNA, 13 bp, Homo sapiens
aaaaaaacataaa

SEQ ID NO: 3284062 - DNA, 12 bp, Homo sapiens
aaaaaaacatta

SEQ ID NO: 3284063 - DNA, 12 bp, Homo sapiens
aaaaaaagaagt

SEQ ID NO: 3284064 - DNA, 10 bp, Homo sapiens
aaaaaaagag

SEQ ID NO: 3284065 - DNA, 14 bp, Homo sapiens
aaaaaaagatctgt

SEQ ID NO: 3284066 - DNA, 12 bp, Homo sapiens
aaaaaaagcata

SEQ ID NO: 3284067 - DNA, 13 bp, Homo sapiens
aaaaaaagcctcc

SEQ ID NO: 3284068 - DNA, 10 bp, Homo sapiens
aaaaaaagtg

SEQ ID NO: 3284069 - DNA, 11 bp, Homo sapiens
aaaaaaagtgc

SEQ ID NO: 3284070 - DNA, 12 bp, Homo sapiens
aaaaaaatgaca

SEQ ID NO: 3284071 - DNA, 12 bp, Homo sapiens
aaaaaaatgact

SEQ ID NO: 3284072 - DNA, 11 bp, Homo sapiens
aaaaaaattta

SEQ ID NO: 3284073 - DNA, 22 bp, Homo sapiens
aaaaaacagccaccgtttcttc

SEQ ID NO: 3284074 - DNA, 12 bp, Homo sapiens
aaaaaagcaaaa

SEQ ID NO: 3284075 - DNA, 14 bp, Homo sapiens
aaaaaagcaaaaat

SEQ ID NO: 3284076 - DNA, 12 bp, Homo sapiens
aaaaaagcctcc

SEQ ID NO: 3284077 - DNA, 13 bp, Homo sapiens
aaaaaagcctcca

SEQ ID NO: 3284078 - DNA, 19 bp, Homo sapiens
aaaaaagggacagcatgcc

SEQ ID NO: 3284079 - DNA, 11 bp, Homo sapiens
aaaaaagtctc

SEQ ID NO: 3284080 - DNA, 12 bp, Homo sapiens
aaaaaagtgcat

SEQ ID NO: 3284081 - DNA, 13 bp, Homo sapiens
aaaaaagttgaag

SEQ ID NO: 3284082 - DNA, 20 bp, Homo sapiens
aaaaaagtttacaagtgtat

SEQ ID NO: 3284083 - DNA, 18 bp, Homo sapiens
aaaaaagttttgatgaaa

SEQ ID NO: 3284084 - DNA, 12 bp, Homo sapiens
aaaaaataacac

SEQ ID NO: 3284085 - DNA, 12 bp, Homo sapiens
aaaaaataatta

SEQ ID NO: 3284086 - DNA, 10 bp, Homo sapiens
aaaaaataca

SEQ ID NO: 3284087 - DNA, 13 bp, Homo sapiens
aaaaaatatttat

SEQ ID NO: 3284088 - DNA, 11 bp, Homo sapiens
aaaaaatcttc

SEQ ID NO: 3284089 - DNA, 18 bp, Homo sapiens
aaaaaatgagacttactg

SEQ ID NO: 3284090 - DNA, 12 bp, Homo sapiens
aaaaaatggaaa

SEQ ID NO: 3284091 - DNA, 12 bp, Homo sapiens
aaaaaatggttc

SEQ ID NO: 3284092 - DNA, 13 bp, Homo sapiens
aaaaaatgtaaca

SEQ ID NO: 3284093 - DNA, 18 bp, Homo sapiens
aaacagagtggcctccct

SEQ ID NO: 3284094 - DNA, 15 bp, Homo sapiens
aaacagatataaatg

SEQ ID NO: 3284095 - DNA, 21 bp, Homo sapiens
aaacagatgatgagaatttct

SEQ ID NO: 3284096 - DNA, 21 bp, Homo sapiens
aaacagattcaggccagccca

SEQ ID NO: 3284097 - DNA, 19 bp, Homo sapiens
aaacagatttttacaaatg

SEQ ID NO: 3284098 - DNA, 11 bp, Homo sapiens
aaacagcatga

SEQ ID NO: 3284099 - DNA, 14 bp, Homo sapiens
aaacagcatgaata

SEQ ID NO: 3284100 - DNA, 14 bp, Homo sapiens
aaacagcattgctt

SEQ ID NO: 3284101 - DNA, 17 bp, Homo sapiens
aaacagcattgctttct

SEQ ID NO: 3284102 - DNA, 13 bp, Homo sapiens
aaacagctcagcc

SEQ ID NO: 3284103 - DNA, 20 bp, Homo sapiens
aaacagctgcattagaaaaa

SEQ ID NO: 3284104 - DNA, 18 bp, Homo sapiens
aaacagcttcatgccttt

SEQ ID NO: 3284105 - DNA, 20 bp, Homo sapiens
aaacagcttcatgcctttgt

SEQ ID NO: 3284106 - DNA, 14 bp, Homo sapiens
aaacagctttcaag

SEQ ID NO: 3284107 - DNA, 18 bp, Homo sapiens
aaacagctttcaagtgcc

SEQ ID NO: 3284108 - DNA, 15 bp, Homo sapiens
aaacaggaatgtctg

SEQ ID NO: 3284109 - DNA, 17 bp, Homo sapiens
aaacaggaatgtctgga

SEQ ID NO: 3284110 - DNA, 16 bp, Homo sapiens
aaacaggaattttatt

SEQ ID NO: 3284111 - DNA, 17 bp, Homo sapiens
aaacaggagacaggaag

SEQ ID NO: 3284112 - DNA, 14 bp, Homo sapiens
aaacaggcccagca

SEQ ID NO: 3284113 - DNA, 18 bp, Homo sapiens
aaacaggtatatactttg

SEQ ID NO: 3284114 - DNA, 21 bp, Homo sapiens
aaacaggtatatactttgaaa

SEQ ID NO: 3284115 - DNA, 16 bp, Homo sapiens
aaacagtctcccttcc

SEQ ID NO: 3284116 - DNA, 19 bp, Homo sapiens
aaacagttggtaacttttg

SEQ ID NO: 3284117 - DNA, 14 bp, Homo sapiens
aaacataaaaagca

SEQ ID NO: 3284118 - DNA, 22 bp, Homo sapiens
aaacataaaaagcagaatttta

SEQ ID NO: 3284119 - DNA, 14 bp, Homo sapiens
aaacataataaatc

SEQ ID NO: 3284120 - DNA, 20 bp, Homo sapiens
aaacataatcttctgccttc

SEQ ID NO: 3284121 - DNA, 21 bp, Homo sapiens
aaacataattcttgtatatta

SEQ ID NO: 3284122 - DNA, 14 bp, Homo sapiens
aaacataattgtgg

SEQ ID NO: 3284123 - DNA, 16 bp, Homo sapiens
aaacataattgtggat

SEQ ID NO: 3284124 - DNA, 15 bp, Homo sapiens
aaacatatttcattt

SEQ ID NO: 3284125 - DNA, 18 bp, Homo sapiens
aaacatcaaataaatttc

SEQ ID NO: 3284126 - DNA, 14 bp, Homo sapiens
aaacatcacacaca

SEQ ID NO: 3284127 - DNA, 18 bp, Homo sapiens
aaacatcagacctgtctt

SEQ ID NO: 3284128 - DNA, 17 bp, Homo sapiens
aaacatgacactgacct

SEQ ID NO: 3284129 - DNA, 16 bp, Homo sapiens
aaacatgagttattca

SEQ ID NO: 3284130 - DNA, 15 bp, Homo sapiens
aaacatgcagtactt

SEQ ID NO: 3284131 - DNA, 24 bp, Homo sapiens
aaacatgctaaatagttctatcag

SEQ ID NO: 3284132 - DNA, 16 bp, Homo sapiens
aaacatgttaatgaca

SEQ ID NO: 3284133 - DNA, 16 bp, Homo sapiens
aaacatgttagaagca

SEQ ID NO: 3284134 - DNA, 14 bp, Homo sapiens
aaacattaaaagaa

SEQ ID NO: 3284135 - DNA, 16 bp, Homo sapiens
aaacattaaatgtctt

SEQ ID NO: 3284136 - DNA, 20 bp, Homo sapiens
aaacattaaatgtcttatat

SEQ ID NO: 3284137 - DNA, 16 bp, Homo sapiens
aaacattaattttgtg

SEQ ID NO: 3284138 - DNA, 20 bp, Homo sapiens
aaacattaattttgtgcatt

SEQ ID NO: 3284139 - DNA, 23 bp, Homo sapiens
aaacattaattttgtgcattctt

SEQ ID NO: 3284140 - DNA, 17 bp, Homo sapiens
aaacattagtgaaaatt

SEQ ID NO: 3284141 - DNA, 11 bp, Homo sapiens
aaacattccaa

SEQ ID NO: 3284142 - DNA, 12 bp, Homo sapiens
aaacattccaag

SEQ ID NO: 3284143 - DNA, 13 bp, Homo sapiens
aaacattcccctc

SEQ ID NO: 3284144 - DNA, 23 bp, Homo sapiens
aaacattctgatttggaaaaaga

SEQ ID NO: 3284145 - DNA, 23 bp, Homo sapiens
aaacattgtaaatatttactctt

SEQ ID NO: 3284146 - DNA, 23 bp, Homo sapiens
aaacattgttttgtgtaacatat

SEQ ID NO: 3284147 - DNA, 18 bp, Homo sapiens
aaacatttcataatttgt

SEQ ID NO: 3284148 - DNA, 22 bp, Homo sapiens
aaacatttcataatttgtttcc

SEQ ID NO: 3284149 - DNA, 14 bp, Homo sapiens
aaacattttaaaaa

SEQ ID NO: 3284150 - DNA, 21 bp, Homo sapiens
aaacattttatttttaaaata

SEQ ID NO: 3284151 - DNA, 23 bp, Homo sapiens
aaacattttatttttaaaatatt

SEQ ID NO: 3284152 - DNA, 14 bp, Homo sapiens
aaacattttcatgc

SEQ ID NO: 3284153 - DNA, 23 bp, Homo sapiens
aaacatttttaatttaacaaact

SEQ ID NO: 3284154 - DNA, 20 bp, Homo sapiens
aaaccaaagagggcttcctc

SEQ ID NO: 3284155 - DNA, 14 bp, Homo sapiens
aaaccaacctttaa

SEQ ID NO: 3284156 - DNA, 20 bp, Homo sapiens
aaaccaacctttaaaattgt

SEQ ID NO: 3284157 - DNA, 21 bp, Homo sapiens
aaaccaatcttaaacataata

SEQ ID NO: 3284158 - DNA, 17 bp, Homo sapiens
aaaccaatttcttcctt

SEQ ID NO: 3284159 - DNA, 15 bp, Homo sapiens
aaaccacaaaggcca

SEQ ID NO: 3284160 - DNA, 19 bp, Homo sapiens
aaaccacaaaggccaaact

SEQ ID NO: 3284161 - DNA, 21 bp, Homo sapiens
aaaccacaactgacacaggaa

SEQ ID NO: 3284162 - DNA, 12 bp, Homo sapiens
aaaccacacaaa

SEQ ID NO: 3284163 - DNA, 14 bp, Homo sapiens
aaaccacacaaaga

SEQ ID NO: 3284164 - DNA, 23 bp, Homo sapiens
aaaccaccagtgcccaaagtctg

SEQ ID NO: 3284165 - DNA, 22 bp, Homo sapiens
aaaccacttaaacgaagagttc

SEQ ID NO: 3284166 - DNA, 19 bp, Homo sapiens
aaaccagatctgtctccaa

SEQ ID NO: 3284167 - DNA, 16 bp, Homo sapiens
aaaccaggaccctgtc

SEQ ID NO: 3284168 - DNA, 19 bp, Homo sapiens
aaaccagtgtagccttgcc

SEQ ID NO: 3284169 - DNA, 20 bp, Homo sapiens
aaaccagtttagatttcaag

SEQ ID NO: 3284170 - DNA, 23 bp, Homo sapiens
aaaccatattttattgtattttg

SEQ ID NO: 3284171 - DNA, 14 bp, Homo sapiens
aaaccatctggcct

SEQ ID NO: 3284172 - DNA, 15 bp, Homo sapiens
aaaccatgagaattt

SEQ ID NO: 3284173 - DNA, 21 bp, Homo sapiens
aaaccatgagaatttgcaaca

SEQ ID NO: 3284174 - DNA, 12 bp, Homo sapiens
aaaccattgtaa

SEQ ID NO: 3284175 - DNA, 14 bp, Homo sapiens
aaaccattgtaact

SEQ ID NO: 3284176 - DNA, 20 bp, Homo sapiens
aaaccattttcccatcatcc

SEQ ID NO: 3284177 - DNA, 23 bp, Homo sapiens
aaaccattttcccatcatccttt

SEQ ID NO: 3284178 - DNA, 17 bp, Homo sapiens
aaacccaatcagatgcc

SEQ ID NO: 3284179 - DNA, 13 bp, Homo sapiens
aaacccacaaaaa

SEQ ID NO: 3284180 - DNA, 23 bp, Homo sapiens
aaaccccatttgctttcttttct

SEQ ID NO: 3284181 - DNA, 13 bp, Homo sapiens
aaacccctgtccc

SEQ ID NO: 3284182 - DNA, 18 bp, Homo sapiens
aaaccctagccttgcttg

SEQ ID NO: 3284183 - DNA, 21 bp, Homo sapiens
aaaccctaggttcccggtccc

SEQ ID NO: 3284184 - DNA, 22 bp, Homo sapiens
aaaccctggtggtattttattt

SEQ ID NO: 3284185 - DNA, 16 bp, Homo sapiens
aaacccttaactgaca

SEQ ID NO: 3284186 - DNA, 22 bp, Homo sapiens
aaacctcaaaatgtctaagata

SEQ ID NO: 3284187 - DNA, 20 bp, Homo sapiens
aaacctcattggccagctca

SEQ ID NO: 3284188 - DNA, 18 bp, Homo sapiens
aaacctgaagactgagga

SEQ ID NO: 3284189 - DNA, 14 bp, Homo sapiens
aaacctgatgttaa

SEQ ID NO: 3284190 - DNA, 19 bp, Homo sapiens
aaacctgatgttaaaattc

SEQ ID NO: 3284191 - DNA, 12 bp, Homo sapiens
aaacctgggacc

SEQ ID NO: 3284192 - DNA, 18 bp, Homo sapiens
aaacctggggtgaatact

SEQ ID NO: 3284193 - DNA, 12 bp, Homo sapiens
aaacctggttca

SEQ ID NO: 3284194 - DNA, 21 bp, Homo sapiens
aaacctggttcatatttatac

SEQ ID NO: 3284195 - DNA, 22 bp, Homo sapiens
aaacctggttcatatttatact

SEQ ID NO: 3284196 - DNA, 18 bp, Homo sapiens
aaacctgtctccactgtg

SEQ ID NO: 3284197 - DNA, 16 bp, Homo sapiens
aaaccttattgtacct

SEQ ID NO: 3284198 - DNA, 17 bp, Homo sapiens
aaaccttgtaaaaaaag

SEQ ID NO: 3284199 - DNA, 19 bp, Homo sapiens
aaaccttttttaagatttt

SEQ ID NO: 3284200 - DNA, 21 bp, Homo sapiens
aaaccttttttaagatttttc

SEQ ID NO: 3284201 - DNA, 16 bp, Homo sapiens
aaacgaaaataaagta

SEQ ID NO: 3284202 - DNA, 21 bp, Homo sapiens
aaacgacactctctggaagcc

SEQ ID NO: 3284203 - DNA, 23 bp, Homo sapiens
aaacgagggctgatggaggaaaa

SEQ ID NO: 3284204 - DNA, 20 bp, Homo sapiens
aaacgcatggagtgtgtatt

SEQ ID NO: 3284205 - DNA, 22 bp, Homo sapiens
aaacgccccgggcaaagggtct

SEQ ID NO: 3284206 - DNA, 22 bp, Homo sapiens
aaacgcctcttttccctctcta

SEQ ID NO: 3284207 - DNA, 22 bp, Homo sapiens
aaacgctaaagagcccttgcct

SEQ ID NO: 3284208 - DNA, 12 bp, Homo sapiens
aaacgctacctc

SEQ ID NO: 3284209 - DNA, 18 bp, Homo sapiens
aaacgctgtcaaaagttg

SEQ ID NO: 3284210 - DNA, 19 bp, Homo sapiens
aaacgggaacatgccccct

SEQ ID NO: 3284211 - DNA, 17 bp, Homo sapiens
aaacggttcagtttctt

SEQ ID NO: 3284212 - DNA, 19 bp, Homo sapiens
aaacgtggtcaccttcgag

SEQ ID NO: 3284213 - DNA, 14 bp, Homo sapiens
aaacgtttcagtaa

SEQ ID NO: 3284214 - DNA, 17 bp, Homo sapiens
aaactaaaaaaaaaaag

SEQ ID NO: 3284215 - DNA, 15 bp, Homo sapiens
aaactaaaaatattc

SEQ ID NO: 3284216 - DNA, 18 bp, Homo sapiens
aaactaaaagacatttgt

SEQ ID NO: 3284217 - DNA, 13 bp, Homo sapiens
aaactaaaatcat

SEQ ID NO: 3284218 - DNA, 17 bp, Homo sapiens
aaagactatctaaatgt

SEQ ID NO: 3284219 - DNA, 14 bp, Homo sapiens
aaagactcagccaa

SEQ ID NO: 3284220 - DNA, 15 bp, Homo sapiens
aaagactcagtgttc

SEQ ID NO: 3284221 - DNA, 16 bp, Homo sapiens
aaagactcctctgggc

SEQ ID NO: 3284222 - DNA, 21 bp, Homo sapiens
aaagactgaaatgcctggaag

SEQ ID NO: 3284223 - DNA, 14 bp, Homo sapiens
aaagactgaacatg

SEQ ID NO: 3284224 - DNA, 15 bp, Homo sapiens
aaagactgaacatgt

SEQ ID NO: 3284225 - DNA, 17 bp, Homo sapiens
aaagactgaacatgttt

SEQ ID NO: 3284226 - DNA, 18 bp, Homo sapiens
aaagactgaacatgttta

SEQ ID NO: 3284227 - DNA, 20 bp, Homo sapiens
aaagactgaacatgtttaca

SEQ ID NO: 3284228 - DNA, 13 bp, Homo sapiens
aaagactgtactg

SEQ ID NO: 3284229 - DNA, 18 bp, Homo sapiens
aaagacttggttggtagg

SEQ ID NO: 3284230 - DNA, 22 bp, Homo sapiens
aaagagaaacagttggtaactt

SEQ ID NO: 3284231 - DNA, 16 bp, Homo sapiens
aaagagaaaccgggag

SEQ ID NO: 3284232 - DNA, 11 bp, Homo sapiens
aaagagaaact

SEQ ID NO: 3284233 - DNA, 14 bp, Homo sapiens
aaagagaaactttg

SEQ ID NO: 3284234 - DNA, 13 bp, Homo sapiens
aaagagacagtga

SEQ ID NO: 3284235 - DNA, 18 bp, Homo sapiens
aaagagacctacctcagg

SEQ ID NO: 3284236 - DNA, 21 bp, Homo sapiens
aaagagacctacctcaggttg

SEQ ID NO: 3284237 - DNA, 18 bp, Homo sapiens
aaagagagaaacactgaa

SEQ ID NO: 3284238 - DNA, 16 bp, Homo sapiens
aaagagagaagccagc

SEQ ID NO: 3284239 - DNA, 12 bp, Homo sapiens
aaagagaggtta

SEQ ID NO: 3284240 - DNA, 14 bp, Homo sapiens
aaagagatacagag

SEQ ID NO: 3284241 - DNA, 19 bp, Homo sapiens
aaagagcacaaacattttt

SEQ ID NO: 3284242 - DNA, 19 bp, Homo sapiens
aaagagcatggatgcattt

SEQ ID NO: 3284243 - DNA, 15 bp, Homo sapiens
aaagagcccttgcct

SEQ ID NO: 3284244 - DNA, 18 bp, Homo sapiens
aaagagcccttgcctccc

SEQ ID NO: 3284245 - DNA, 15 bp, Homo sapiens
aaagagctgcctgga

SEQ ID NO: 3284246 - DNA, 16 bp, Homo sapiens
aaagagctgcctggat

SEQ ID NO: 3284247 - DNA, 19 bp, Homo sapiens
aaagagctgcctggatgag

SEQ ID NO: 3284248 - DNA, 21 bp, Homo sapiens
aaagagctgtctatgcagcct

SEQ ID NO: 3284249 - DNA, 23 bp, Homo sapiens
aaagagctgtctatgcagcctgc

SEQ ID NO: 3284250 - DNA, 19 bp, Homo sapiens
aaagaggactcgcttgtaa

SEQ ID NO: 3284251 - DNA, 16 bp, Homo sapiens
aaagaggctgaaagag

SEQ ID NO: 3284252 - DNA, 20 bp, Homo sapiens
aaagaggctgaaagaggcca

SEQ ID NO: 3284253 - DNA, 19 bp, Homo sapiens
aaagaggctgaggcctgga

SEQ ID NO: 3284254 - DNA, 20 bp, Homo sapiens
aaagaggctgaggcctggac

SEQ ID NO: 3284255 - DNA, 16 bp, Homo sapiens
aaagaggtgaaaatga

SEQ ID NO: 3284256 - DNA, 17 bp, Homo sapiens
aaagaggtgaaaatgaa

SEQ ID NO: 3284257 - DNA, 18 bp, Homo sapiens
aaagagtagaattgcatt

SEQ ID NO: 3284258 - DNA, 15 bp, Homo sapiens
aaagagtctagattc

SEQ ID NO: 3284259 - DNA, 14 bp, Homo sapiens
aaagagtcttccaa

SEQ ID NO: 3284260 - DNA, 23 bp, Homo sapiens
aaagagttctggaaaagaactgt

SEQ ID NO: 3284261 - DNA, 24 bp, Homo sapiens
aaagagttctggaaaagaactgtt

SEQ ID NO: 3284262 - DNA, 19 bp, Homo sapiens
aaagagttggcatgaaagt

SEQ ID NO: 3284263 - DNA, 15 bp, Homo sapiens
aaagataaagaccag

SEQ ID NO: 3284264 - DNA, 13 bp, Homo sapiens
aaagataaagatg

SEQ ID NO: 3284265 - DNA, 15 bp, Homo sapiens
aaagataaagatgat

SEQ ID NO: 3284266 - DNA, 15 bp, Homo sapiens
aaagataagaaatac

SEQ ID NO: 3284267 - DNA, 17 bp, Homo sapiens
aaagataatattactgt

SEQ ID NO: 3284268 - DNA, 20 bp, Homo sapiens
aaagataattgctatttatt

SEQ ID NO: 3284269 - DNA, 20 bp, Homo sapiens
aaagatacgactttattttc

SEQ ID NO: 3284270 - DNA, 19 bp, Homo sapiens
aaagatatggagaattgct

SEQ ID NO: 3284271 - DNA, 23 bp, Homo sapiens
aaagatatggagaattgctgaag

SEQ ID NO: 3284272 - DNA, 16 bp, Homo sapiens
aaagatatttttatct

SEQ ID NO: 3284273 - DNA, 14 bp, Homo sapiens
aaagatcaaaataa

SEQ ID NO: 3284274 - DNA, 16 bp, Homo sapiens
aaagatcaaaataaaa

SEQ ID NO: 3284275 - DNA, 17 bp, Homo sapiens
aaagatcaaaataaaaa

SEQ ID NO: 3284276 - DNA, 13 bp, Homo sapiens
aaagatctgtttt

SEQ ID NO: 3284277 - DNA, 15 bp, Homo sapiens
aaagatgagtaattt

SEQ ID NO: 3284278 - DNA, 11 bp, Homo sapiens
aaagatgagtt

SEQ ID NO: 3284279 - DNA, 20 bp, Homo sapiens
aaagatgcaaggaccaggac

SEQ ID NO: 3284280 - DNA, 15 bp, Homo sapiens
aaagatggagtttct

SEQ ID NO: 3284281 - DNA, 21 bp, Homo sapiens
aaagatggagtttctaaggtc

SEQ ID NO: 3284282 - DNA, 14 bp, Homo sapiens
aaagatggataaac

SEQ ID NO: 3284283 - DNA, 16 bp, Homo sapiens
aaagatggatgtgctt

SEQ ID NO: 3284284 - DNA, 19 bp, Homo sapiens
aaagatggttaaacatttt

SEQ ID NO: 3284285 - DNA, 20 bp, Homo sapiens
aaagatgtccttggagatga

SEQ ID NO: 3284286 - DNA, 20 bp, Homo sapiens
aaagatgtttgtcagatatg

SEQ ID NO: 3284287 - DNA, 19 bp, Homo sapiens
aaagattaaatgtgtcatt

SEQ ID NO: 3284288 - DNA, 13 bp, Homo sapiens
aaagattagcaag

SEQ ID NO: 3284289 - DNA, 18 bp, Homo sapiens
aaagattagcaaggtcat

SEQ ID NO: 3284290 - DNA, 17 bp, Homo sapiens
aaagattatgatgcata

SEQ ID NO: 3284291 - DNA, 23 bp, Homo sapiens
aaagattctctttaaaaaagact

SEQ ID NO: 3284292 - DNA, 13 bp, Homo sapiens
aaagattctgtct

SEQ ID NO: 3284293 - DNA, 17 bp, Homo sapiens
aaagattgctgaaaaag

SEQ ID NO: 3284294 - DNA, 14 bp, Homo sapiens
aaagattgtactta

SEQ ID NO: 3284295 - DNA, 18 bp, Homo sapiens
aaagattgtacttagcca

SEQ ID NO: 3284296 - DNA, 21 bp, Homo sapiens
aaagatttaagcacaaacttt

SEQ ID NO: 3284297 - DNA, 15 bp, Homo sapiens
aaagattttaatcaa

SEQ ID NO: 3284298 - DNA, 18 bp, Homo sapiens
aaagattttaatcaagtt

SEQ ID NO: 3284299 - DNA, 12 bp, Homo sapiens
aaagattttatt

SEQ ID NO: 3284300 - DNA, 18 bp, Homo sapiens
aaagattttattgtataa

SEQ ID NO: 3284301 - DNA, 13 bp, Homo sapiens
aaagattttcaga

SEQ ID NO: 3284302 - DNA, 21 bp, Homo sapiens
aaagattttcagaaaatatta

SEQ ID NO: 3284303 - DNA, 14 bp, Homo sapiens
aaagcaaaaatgac

SEQ ID NO: 3284304 - DNA, 17 bp, Homo sapiens
aaagcaaaaggctgaga

SEQ ID NO: 3284305 - DNA, 23 bp, Homo sapiens
aaagcaacaaagattgagaagcc

SEQ ID NO: 3284306 - DNA, 15 bp, Homo sapiens
aaagcaagaaacagt

SEQ ID NO: 3284307 - DNA, 22 bp, Homo sapiens
aaagcaagggctccagcatcca

SEQ ID NO: 3284308 - DNA, 15 bp, Homo sapiens
aaagcaataaatgaa

SEQ ID NO: 3284309 - DNA, 17 bp, Homo sapiens
aaagcaataaatgaatg

SEQ ID NO: 3284310 - DNA, 19 bp, Homo sapiens
aaagcaattgccctgtaac

SEQ ID NO: 3284311 - DNA, 18 bp, Homo sapiens
aaagcacaagtacttttg

SEQ ID NO: 3284312 - DNA, 15 bp, Homo sapiens
aaagcacaggagaca

SEQ ID NO: 3284313 - DNA, 14 bp, Homo sapiens
aaagcacagtgtta

SEQ ID NO: 3284314 - DNA, 17 bp, Homo sapiens
aaagcacagtttgaaca

SEQ ID NO: 3284315 - DNA, 15 bp, Homo sapiens
aaagcacatacatta

SEQ ID NO: 3284316 - DNA, 20 bp, Homo sapiens
aaagcacatacattaaaact

SEQ ID NO: 3284317 - DNA, 15 bp, Homo sapiens
aaagcacatgcttag

SEQ ID NO: 3284318 - DNA, 23 bp, Homo sapiens
aaagcacatgcttagcttatctt

SEQ ID NO: 3284319 - DNA, 16 bp, Homo sapiens
aaagcacattgaaaga

SEQ ID NO: 3284320 - DNA, 22 bp, Homo sapiens
aaagcactagagaatgcacaga

SEQ ID NO: 3284321 - DNA, 22 bp, Homo sapiens
aaagcactgacctgtcatgccc

SEQ ID NO: 3284322 - DNA, 19 bp, Homo sapiens
aaagcacttggactcttgc

SEQ ID NO: 3284323 - DNA, 15 bp, Homo sapiens
aaagcactttgcact

SEQ ID NO: 3284324 - DNA, 17 bp, Homo sapiens
aaagcacttttgttatt

SEQ ID NO: 3284325 - DNA, 14 bp, Homo sapiens
aaagcagaagcaac

SEQ ID NO: 3284326 - DNA, 15 bp, Homo sapiens
aaagcagaattttaa

SEQ ID NO: 3284327 - DNA, 21 bp, Homo sapiens
aaagcagaattttaatgtgaa

SEQ ID NO: 3284328 - DNA, 21 bp, Homo sapiens
aaagcagagtggactgcattt

SEQ ID NO: 3284329 - DNA, 21 bp, Homo sapiens
aaagcagcctcattctgaggc

SEQ ID NO: 3284330 - DNA, 12 bp, Homo sapiens
aaagcagcctga

SEQ ID NO: 3284331 - DNA, 22 bp, Homo sapiens
aaagcaggggctacaagaggga

SEQ ID NO: 3284332 - DNA, 14 bp, Homo sapiens
aaagcataaaaaca

SEQ ID NO: 3284333 - DNA, 21 bp, Homo sapiens
aaagcataaagctcaaatgaa

SEQ ID NO: 3284334 - DNA, 18 bp, Homo sapiens
aaagcataagtatacagt

SEQ ID NO: 3284335 - DNA, 16 bp, Homo sapiens
aaagcatcacctcagg

SEQ ID NO: 3284336 - DNA, 17 bp, Homo sapiens
aaagcatcacctcaggc

SEQ ID NO: 3284337 - DNA, 18 bp, Homo sapiens
aaagcatgatgggaaaat

SEQ ID NO: 3284338 - DNA, 22 bp, Homo sapiens
aaagcatgatgggaaaatattt

SEQ ID NO: 3284339 - DNA, 13 bp, Homo sapiens
aaagcatgtctca

SEQ ID NO: 3284340 - DNA, 17 bp, Homo sapiens
aaagcattgcttttatt

SEQ ID NO: 3284341 - DNA, 21 bp, Homo sapiens
aaagcattgcttttattttga

SEQ ID NO: 3284342 - DNA, 18 bp, Homo sapiens
aaagcattttcagtcttg

SEQ ID NO: 3284343 - DNA, 19 bp, Homo sapiens
aaagcattttcagtcttgt

SEQ ID NO: 3284344 - DNA, 12 bp, Homo sapiens
aaatatgtacaa

SEQ ID NO: 3284345 - DNA, 16 bp, Homo sapiens
aaatatgtacatttgt

SEQ ID NO: 3284346 - DNA, 16 bp, Homo sapiens
aaatatgtatcctcta

SEQ ID NO: 3284347 - DNA, 14 bp, Homo sapiens
aaatattacagtga

SEQ ID NO: 3284348 - DNA, 22 bp, Homo sapiens
aaatattaccaaaaaagtattt

SEQ ID NO: 3284349 - DNA, 15 bp, Homo sapiens
aaatattatgtgttt

SEQ ID NO: 3284350 - DNA, 21 bp, Homo sapiens
aaatattatttgtgtttccta

SEQ ID NO: 3284351 - DNA, 20 bp, Homo sapiens
aaatattattttatgaaagg

SEQ ID NO: 3284352 - DNA, 19 bp, Homo sapiens
aaatattcctccaaatctc

SEQ ID NO: 3284353 - DNA, 15 bp, Homo sapiens
aaatattcctgcatt

SEQ ID NO: 3284354 - DNA, 14 bp, Homo sapiens
aaatattctatatg

SEQ ID NO: 3284355 - DNA, 21 bp, Homo sapiens
aaatattgtcatgtttattct

SEQ ID NO: 3284356 - DNA, 22 bp, Homo sapiens
aaatattgtttctgcattcatt

SEQ ID NO: 3284357 - DNA, 15 bp, Homo sapiens
aaatatttatatatt

SEQ ID NO: 3284358 - DNA, 16 bp, Homo sapiens
aaatatttattaaata

SEQ ID NO: 3284359 - DNA, 18 bp, Homo sapiens
aaatatttattaaataaa

SEQ ID NO: 3284360 - DNA, 23 bp, Homo sapiens
aaatatttattaaataaaatcaa

SEQ ID NO: 3284361 - DNA, 15 bp, Homo sapiens
aaatatttatttatt

SEQ ID NO: 3284362 - DNA, 13 bp, Homo sapiens
aaatatttatttt

SEQ ID NO: 3284363 - DNA, 17 bp, Homo sapiens
aaatatttcagatatca

SEQ ID NO: 3284364 - DNA, 12 bp, Homo sapiens
aaatatttcctt

SEQ ID NO: 3284365 - DNA, 20 bp, Homo sapiens
aaatatttgaatgaaaacat

SEQ ID NO: 3284366 - DNA, 23 bp, Homo sapiens
aaatatttgaatgaaaacatttt

SEQ ID NO: 3284367 - DNA, 17 bp, Homo sapiens
aaatatttggtctctat

SEQ ID NO: 3284368 - DNA, 20 bp, Homo sapiens
aaatatttgtctttaaacag

SEQ ID NO: 3284369 - DNA, 16 bp, Homo sapiens
aaatattttagaagct

SEQ ID NO: 3284370 - DNA, 12 bp, Homo sapiens
aaatattttcat

SEQ ID NO: 3284371 - DNA, 22 bp, Homo sapiens
aaatattttcatgtattttaca

SEQ ID NO: 3284372 - DNA, 12 bp, Homo sapiens
aaatattttcta

SEQ ID NO: 3284373 - DNA, 15 bp, Homo sapiens
aaatattttctattt

SEQ ID NO: 3284374 - DNA, 21 bp, Homo sapiens
aaatattttgataataaattg

SEQ ID NO: 3284375 - DNA, 12 bp, Homo sapiens
aaatatttttgg

SEQ ID NO: 3284376 - DNA, 17 bp, Homo sapiens
aaatatttttggggcat

SEQ ID NO: 3284377 - DNA, 23 bp, Homo sapiens
aaatatttttggggcatcctgga

SEQ ID NO: 3284378 - DNA, 17 bp, Homo sapiens
aaatcaacagaagcatt

SEQ ID NO: 3284379 - DNA, 16 bp, Homo sapiens
aaatcaagtcctttaa

SEQ ID NO: 3284380 - DNA, 23 bp, Homo sapiens
aaatcaattactggtccaaaaga

SEQ ID NO: 3284381 - DNA, 14 bp, Homo sapiens
aaatcacacattca

SEQ ID NO: 3284382 - DNA, 18 bp, Homo sapiens
aaatcactaacattatat

SEQ ID NO: 3284383 - DNA, 18 bp, Homo sapiens
aaatcagagagcaaggca

SEQ ID NO: 3284384 - DNA, 20 bp, Homo sapiens
aaatcagccgcaaggatcct

SEQ ID NO: 3284385 - DNA, 16 bp, Homo sapiens
aaatcagtaagaggtg

SEQ ID NO: 3284386 - DNA, 22 bp, Homo sapiens
aaatcagtatttttttttaatt

SEQ ID NO: 3284387 - DNA, 14 bp, Homo sapiens
aaatcataaagtca

SEQ ID NO: 3284388 - DNA, 15 bp, Homo sapiens
aaatcatgggccaga

SEQ ID NO: 3284389 - DNA, 13 bp, Homo sapiens
aaatcatgtatgt

SEQ ID NO: 3284390 - DNA, 17 bp, Homo sapiens
aaatcatgtgctcagaa

SEQ ID NO: 3284391 - DNA, 23 bp, Homo sapiens
aaatcatgttgatcatgtacttt

SEQ ID NO: 3284392 - DNA, 14 bp, Homo sapiens
aaatcattgtagaa

SEQ ID NO: 3284393 - DNA, 15 bp, Homo sapiens
aaatcattgtagaaa

SEQ ID NO: 3284394 - DNA, 20 bp, Homo sapiens
aaatcattgtagaaacacag

SEQ ID NO: 3284395 - DNA, 18 bp, Homo sapiens
aaatcattgtcaaaatta

SEQ ID NO: 3284396 - DNA, 20 bp, Homo sapiens
aaatcatttcagtatcatct

SEQ ID NO: 3284397 - DNA, 17 bp, Homo sapiens
aaatccaataatcagaa

SEQ ID NO: 3284398 - DNA, 15 bp, Homo sapiens
aaatccagaaagaaa

SEQ ID NO: 3284399 - DNA, 17 bp, Homo sapiens
aaatccagaagttttaa

SEQ ID NO: 3284400 - DNA, 23 bp, Homo sapiens
aaatccatatcttaaagaaacag

SEQ ID NO: 3284401 - DNA, 13 bp, Homo sapiens
aaatccattgttt

SEQ ID NO: 3284402 - DNA, 22 bp, Homo sapiens
aaatcctaagacacaaatgcat

SEQ ID NO: 3284403 - DNA, 17 bp, Homo sapiens
aaatcctcatgttactc

SEQ ID NO: 3284404 - DNA, 16 bp, Homo sapiens
aaatcctttactgtta

SEQ ID NO: 3284405 - DNA, 18 bp, Homo sapiens
aaatcctttttctttata

SEQ ID NO: 3284406 - DNA, 14 bp, Homo sapiens
aaatcgattggctt

SEQ ID NO: 3284407 - DNA, 22 bp, Homo sapiens
aaatcgttggaaaataaattca

SEQ ID NO: 3284408 - DNA, 22 bp, Homo sapiens
aaatctaaaacaaaatctgaac

SEQ ID NO: 3284409 - DNA, 16 bp, Homo sapiens
aaatctaaagttgctc

SEQ ID NO: 3284410 - DNA, 15 bp, Homo sapiens
aaatctaaatctatt

SEQ ID NO: 3284411 - DNA, 15 bp, Homo sapiens
aaatctaagctgtgt

SEQ ID NO: 3284412 - DNA, 18 bp, Homo sapiens
aaatctaatattaaaaat

SEQ ID NO: 3284413 - DNA, 17 bp, Homo sapiens
aaatctaatctcttatt

SEQ ID NO: 3284414 - DNA, 23 bp, Homo sapiens
aaatctacagatcctttttccat

SEQ ID NO: 3284415 - DNA, 13 bp, Homo sapiens
aaatctaccactg

SEQ ID NO: 3284416 - DNA, 20 bp, Homo sapiens
aaatctagttttttttgtaa

SEQ ID NO: 3284417 - DNA, 15 bp, Homo sapiens
aaatctattctgtgt

SEQ ID NO: 3284418 - DNA, 13 bp, Homo sapiens
aaatctcaaattt

SEQ ID NO: 3284419 - DNA, 23 bp, Homo sapiens
aaatctcaaatttggattgctaa

SEQ ID NO: 3284420 - DNA, 20 bp, Homo sapiens
aaatctcagaatttatctcc

SEQ ID NO: 3284421 - DNA, 18 bp, Homo sapiens
aaatctcccacaagtata

SEQ ID NO: 3284422 - DNA, 16 bp, Homo sapiens
aaatctcccattttgg

SEQ ID NO: 3284423 - DNA, 21 bp, Homo sapiens
aaatctcccattttggaattt

SEQ ID NO: 3284424 - DNA, 14 bp, Homo sapiens
aaatctcctatttt

SEQ ID NO: 3284425 - DNA, 12 bp, Homo sapiens
aaatctctaata

SEQ ID NO: 3284426 - DNA, 16 bp, Homo sapiens
aaatctcttgcttgtc

SEQ ID NO: 3284427 - DNA, 13 bp, Homo sapiens
aaatctgaacatt

SEQ ID NO: 3284428 - DNA, 11 bp, Homo sapiens
aaatctgaaga

SEQ ID NO: 3284429 - DNA, 13 bp, Homo sapiens
aaatctgaagacc

SEQ ID NO: 3284430 - DNA, 23 bp, Homo sapiens
aaatctgaagaggcttctcctgt

SEQ ID NO: 3284431 - DNA, 20 bp, Homo sapiens
aaatctgctggagtttcatg

SEQ ID NO: 3284432 - DNA, 12 bp, Homo sapiens
aaatctggaagc

SEQ ID NO: 3284433 - DNA, 15 bp, Homo sapiens
aaatctggtcttgtt

SEQ ID NO: 3284434 - DNA, 20 bp, Homo sapiens
aaatctggtcttgttagaaa

SEQ ID NO: 3284435 - DNA, 23 bp, Homo sapiens
aaatctgtaagctctttgaaaca

SEQ ID NO: 3284436 - DNA, 19 bp, Homo sapiens
aaatctgtatatgttgtaa

SEQ ID NO: 3284437 - DNA, 12 bp, Homo sapiens
aaatctgtgtat

SEQ ID NO: 3284438 - DNA, 18 bp, Homo sapiens
aaatctgtgtatattatt

SEQ ID NO: 3284439 - DNA, 19 bp, Homo sapiens
aaatctgtttgatccctgt

SEQ ID NO: 3284440 - DNA, 17 bp, Homo sapiens
aaatcttaaacaatgta

SEQ ID NO: 3284441 - DNA, 21 bp, Homo sapiens
aaatcttaaacaatgtataaa

SEQ ID NO: 3284442 - DNA, 18 bp, Homo sapiens
aaatctttgttgaagttt

SEQ ID NO: 3284443 - DNA, 17 bp, Homo sapiens
aaatgaaaatcgtgaca

SEQ ID NO: 3284444 - DNA, 15 bp, Homo sapiens
aaatgaaagcatgtg

SEQ ID NO: 3284445 - DNA, 15 bp, Homo sapiens
aaatgaaatgtatgc

SEQ ID NO: 3284446 - DNA, 14 bp, Homo sapiens
aaatgaaattgtaa

SEQ ID NO: 3284447 - DNA, 15 bp, Homo sapiens
aaatgaaattgtaaa

SEQ ID NO: 3284448 - DNA, 16 bp, Homo sapiens
aaatgaaatttaaaca

SEQ ID NO: 3284449 - DNA, 16 bp, Homo sapiens
aaatgaagaaggaagc

SEQ ID NO: 3284450 - DNA, 17 bp, Homo sapiens
aaatgaataagctttct

SEQ ID NO: 3284451 - DNA, 17 bp, Homo sapiens
aaatgaataatttccca

SEQ ID NO: 3284452 - DNA, 18 bp, Homo sapiens
aaatgaataatttcccaa

SEQ ID NO: 3284453 - DNA, 16 bp, Homo sapiens
aaatgaatatctatta

SEQ ID NO: 3284454 - DNA, 17 bp, Homo sapiens
aaatgaatatctattaa

SEQ ID NO: 3284455 - DNA, 14 bp, Homo sapiens
aaatgaatattttg

SEQ ID NO: 3284456 - DNA, 16 bp, Homo sapiens
aaatgaatattttgat

SEQ ID NO: 3284457 - DNA, 15 bp, Homo sapiens
aaatgaatgttgtct

SEQ ID NO: 3284458 - DNA, 16 bp, Homo sapiens
aaatgacaacagaaaa

SEQ ID NO: 3284459 - DNA, 23 bp, Homo sapiens
aaatgacaacagaaaaacaatct

SEQ ID NO: 3284460 - DNA, 19 bp, Homo sapiens
aaatgacagattctgacat

SEQ ID NO: 3284461 - DNA, 17 bp, Homo sapiens
aaatgactaaaaatatt

SEQ ID NO: 3284462 - DNA, 20 bp, Homo sapiens
aaatgactaaaaatattata

SEQ ID NO: 3284463 - DNA, 13 bp, Homo sapiens
aaatgacttattt

SEQ ID NO: 3284464 - DNA, 17 bp, Homo sapiens
aaatgaggaaaagaaaa

SEQ ID NO: 3284465 - DNA, 14 bp, Homo sapiens
aaatgaggacatgt

SEQ ID NO: 3284466 - DNA, 14 bp, Homo sapiens
aaatgagtaacatt

SEQ ID NO: 3284467 - DNA, 18 bp, Homo sapiens
aaatgagtaacatttgct

SEQ ID NO: 3284468 - DNA, 22 bp, Homo sapiens
aaatgattgtaaaatagcttgt

SEQ ID NO: 3284469 - DNA, 23 bp, Homo sapiens
aaatgatttttacaagttttaaa

SEQ ID NO: 3284470 - DNA, 19 bp, Homo sapiens
aaatttattttaatgtaaa

SEQ ID NO: 3284471 - DNA, 21 bp, Homo sapiens
aaatttcaaaagacatgttgt

SEQ ID NO: 3284472 - DNA, 15 bp, Homo sapiens
aaatttcacaatata

SEQ ID NO: 3284473 - DNA, 12 bp, Homo sapiens
aaatttcagatt

SEQ ID NO: 3284474 - DNA, 15 bp, Homo sapiens
aaatttcttttgcta

SEQ ID NO: 3284475 - DNA, 22 bp, Homo sapiens
aaatttgaagtattagacttct

SEQ ID NO: 3284476 - DNA, 20 bp, Homo sapiens
aaatttgaatgggtccattt

SEQ ID NO: 3284477 - DNA, 15 bp, Homo sapiens
aaatttgatacttat

SEQ ID NO: 3284478 - DNA, 18 bp, Homo sapiens
aaatttgatacttatatt

SEQ ID NO: 3284479 - DNA, 14 bp, Homo sapiens
aaatttgattgatt

SEQ ID NO: 3284480 - DNA, 20 bp, Homo sapiens
aaatttggctcacttgcctt

SEQ ID NO: 3284481 - DNA, 21 bp, Homo sapiens
aaatttggctcacttgcctta

SEQ ID NO: 3284482 - DNA, 15 bp, Homo sapiens
aaatttggttctaat

SEQ ID NO: 3284483 - DNA, 16 bp, Homo sapiens
aaatttggttctaata

SEQ ID NO: 3284484 - DNA, 14 bp, Homo sapiens
aaatttgtaagttt

SEQ ID NO: 3284485 - DNA, 24 bp, Homo sapiens
aaatttgtacaggactgtaaagat

SEQ ID NO: 3284486 - DNA, 18 bp, Homo sapiens
aaatttgtctgaaacatt

SEQ ID NO: 3284487 - DNA, 18 bp, Homo sapiens
aaatttgttataatgaat

SEQ ID NO: 3284488 - DNA, 20 bp, Homo sapiens
aaatttgttatacttcaaaa

SEQ ID NO: 3284489 - DNA, 18 bp, Homo sapiens
aaatttgttgaaattatg

SEQ ID NO: 3284490 - DNA, 12 bp, Homo sapiens
aaatttgtttaa

SEQ ID NO: 3284491 - DNA, 14 bp, Homo sapiens
aaatttgtttgaaa

SEQ ID NO: 3284492 - DNA, 13 bp, Homo sapiens
aaatttgtttgta

SEQ ID NO: 3284493 - DNA, 14 bp, Homo sapiens
aaattttaaaaaag

SEQ ID NO: 3284494 - DNA, 22 bp, Homo sapiens
aaattttaaagccattctgatt

SEQ ID NO: 3284495 - DNA, 23 bp, Homo sapiens
aaattttaaggccacggccttgt

SEQ ID NO: 3284496 - DNA, 22 bp, Homo sapiens
aaattttataagcaaatttcaa

SEQ ID NO: 3284497 - DNA, 22 bp, Homo sapiens
aaattttataggactgttcttt

SEQ ID NO: 3284498 - DNA, 18 bp, Homo sapiens
aaattttcttcagttggt

SEQ ID NO: 3284499 - DNA, 23 bp, Homo sapiens
aaattttgagcaaagaaacttgt

SEQ ID NO: 3284500 - DNA, 12 bp, Homo sapiens
aaattttgcaaa

SEQ ID NO: 3284501 - DNA, 22 bp, Homo sapiens
aaattttgcttttaattaaata

SEQ ID NO: 3284502 - DNA, 23 bp, Homo sapiens
aaattttgtgatgaataaaataa

SEQ ID NO: 3284503 - DNA, 16 bp, Homo sapiens
aaatttttatttttga

SEQ ID NO: 3284504 - DNA, 17 bp, Homo sapiens
aaatttttcagatgctt

SEQ ID NO: 3284505 - DNA, 18 bp, Homo sapiens
aaatttttcagatgcttc

SEQ ID NO: 3284506 - DNA, 13 bp, Homo sapiens
aaatttttgaaaa

SEQ ID NO: 3284507 - DNA, 13 bp, Homo sapiens
aaattttttgaaa

SEQ ID NO: 3284508 - DNA, 15 bp, Homo sapiens
aacaaaaaacagatt

SEQ ID NO: 3284509 - DNA, 13 bp, Homo sapiens
aacaaaaagatgt

SEQ ID NO: 3284510 - DNA, 14 bp, Homo sapiens
aacaaaaattaggt

SEQ ID NO: 3284511 - DNA, 24 bp, Homo sapiens
aacaaaatttgactaattttacat

SEQ ID NO: 3284512 - DNA, 20 bp, Homo sapiens
aacaaacatggatacttcct

SEQ ID NO: 3284513 - DNA, 21 bp, Homo sapiens
aacaaacatggatacttcctg

SEQ ID NO: 3284514 - DNA, 20 bp, Homo sapiens
aacaaacattgtgttgacat

SEQ ID NO: 3284515 - DNA, 22 bp, Homo sapiens
aacaaacattgtgttgacatta

SEQ ID NO: 3284516 - DNA, 15 bp, Homo sapiens
aacaaaccaacatct

SEQ ID NO: 3284517 - DNA, 11 bp, Homo sapiens
aacaaaccatc

SEQ ID NO: 3284518 - DNA, 13 bp, Homo sapiens
aacaaactaaaaa

SEQ ID NO: 3284519 - DNA, 23 bp, Homo sapiens
aacaaactaaaaatattcctcca

SEQ ID NO: 3284520 - DNA, 12 bp, Homo sapiens
aacaaagctgtt

SEQ ID NO: 3284521 - DNA, 18 bp, Homo sapiens
aacaaagctgttaaactg

SEQ ID NO: 3284522 - DNA, 16 bp, Homo sapiens
aacaaaggttgagatg

SEQ ID NO: 3284523 - DNA, 21 bp, Homo sapiens
aacaaagtgactgtttggctt

SEQ ID NO: 3284524 - DNA, 13 bp, Homo sapiens
aacaaatatgcaa

SEQ ID NO: 3284525 - DNA, 15 bp, Homo sapiens
aacaaatcactgtat

SEQ ID NO: 3284526 - DNA, 23 bp, Homo sapiens
aacaaatctaatctcttattcta

SEQ ID NO: 3284527 - DNA, 21 bp, Homo sapiens
aacaaatgctctgtcttcaat

SEQ ID NO: 3284528 - DNA, 18 bp, Homo sapiens
aacaaattcatattctgt

SEQ ID NO: 3284529 - DNA, 14 bp, Homo sapiens
aacaacaattggta

SEQ ID NO: 3284530 - DNA, 19 bp, Homo sapiens
aacaacaattggtaaaact

SEQ ID NO: 3284531 - DNA, 22 bp, Homo sapiens
aacaacccacaccgtcttcctt

SEQ ID NO: 3284532 - DNA, 22 bp, Homo sapiens
aacaacctggccgcgtttagac

SEQ ID NO: 3284533 - DNA, 16 bp, Homo sapiens
aacaacttggcatttc

SEQ ID NO: 3284534 - DNA, 18 bp, Homo sapiens
aacaacttggcatttcta

SEQ ID NO: 3284535 - DNA, 21 bp, Homo sapiens
aacaactttctcttgtaaacg

SEQ ID NO: 3284536 - DNA, 12 bp, Homo sapiens
aacaagaaaaca

SEQ ID NO: 3284537 - DNA, 17 bp, Homo sapiens
aacaagaaccatttgca

SEQ ID NO: 3284538 - DNA, 21 bp, Homo sapiens
aacaagaagccacagacctag

SEQ ID NO: 3284539 - DNA, 18 bp, Homo sapiens
aacaagaatattgtatgt

SEQ ID NO: 3284540 - DNA, 19 bp, Homo sapiens
aacaagagcactacattca

SEQ ID NO: 3284541 - DNA, 17 bp, Homo sapiens
aacaagatctttcagga

SEQ ID NO: 3284542 - DNA, 15 bp, Homo sapiens
aacaagatttgtaat

SEQ ID NO: 3284543 - DNA, 20 bp, Homo sapiens
aacaaggaatgcctgtgcca

SEQ ID NO: 3284544 - DNA, 21 bp, Homo sapiens
aacaagtcacagctgcagctg

SEQ ID NO: 3284545 - DNA, 17 bp, Homo sapiens
aacaagtgcctcctgga

SEQ ID NO: 3284546 - DNA, 17 bp, Homo sapiens
aacaagttttaatgtat

SEQ ID NO: 3284547 - DNA, 16 bp, Homo sapiens
aacaataaaatttttt

SEQ ID NO: 3284548 - DNA, 20 bp, Homo sapiens
aacaataatatttcaagtgc

SEQ ID NO: 3284549 - DNA, 16 bp, Homo sapiens
aacaatacaaatggat

SEQ ID NO: 3284550 - DNA, 17 bp, Homo sapiens
aacaatacaaatggatt

SEQ ID NO: 3284551 - DNA, 13 bp, Homo sapiens
aacaatatataga

SEQ ID NO: 3284552 - DNA, 19 bp, Homo sapiens
aacaatcccaatctttcta

SEQ ID NO: 3284553 - DNA, 19 bp, Homo sapiens
aacaatctaacaataatat

SEQ ID NO: 3284554 - DNA, 20 bp, Homo sapiens
aacaatctggaagaaaaaaa

SEQ ID NO: 3284555 - DNA, 17 bp, Homo sapiens
aacaatcttattccgag

SEQ ID NO: 3284556 - DNA, 13 bp, Homo sapiens
aacaatctttgct

SEQ ID NO: 3284557 - DNA, 14 bp, Homo sapiens
aacaatctttgctg

SEQ ID NO: 3284558 - DNA, 17 bp, Homo sapiens
aacaatggaagatttgc

SEQ ID NO: 3284559 - DNA, 19 bp, Homo sapiens
aacaatgtataaagattgt

SEQ ID NO: 3284560 - DNA, 22 bp, Homo sapiens
aacaatgtataaagattgtact

SEQ ID NO: 3284561 - DNA, 23 bp, Homo sapiens
aacaatgtatgtgaaagtgtaaa

SEQ ID NO: 3284562 - DNA, 24 bp, Homo sapiens
aacaattggtaaaactcactgtga

SEQ ID NO: 3284563 - DNA, 22 bp, Homo sapiens
aacaattgtcgaaaagagtctt

SEQ ID NO: 3284564 - DNA, 18 bp, Homo sapiens
aacaattgtgtagccttt

SEQ ID NO: 3284565 - DNA, 20 bp, Homo sapiens
aacaatttcctttatattta

SEQ ID NO: 3284566 - DNA, 23 bp, Homo sapiens
aacaattttaggaggaccagagc

SEQ ID NO: 3284567 - DNA, 15 bp, Homo sapiens
aacacaaactgtaaa

SEQ ID NO: 3284568 - DNA, 16 bp, Homo sapiens
aacacaagtcctgtga

SEQ ID NO: 3284569 - DNA, 21 bp, Homo sapiens
aacacaatacctacaataaac

SEQ ID NO: 3284570 - DNA, 21 bp, Homo sapiens
aacacacagactttctgtgac

SEQ ID NO: 3284571 - DNA, 12 bp, Homo sapiens
aacacactgaaa

SEQ ID NO: 3284572 - DNA, 13 bp, Homo sapiens
aacacaggcagct

SEQ ID NO: 3284573 - DNA, 18 bp, Homo sapiens
aacacaggcagctttcta

SEQ ID NO: 3284574 - DNA, 14 bp, Homo sapiens
aacacagtattttc

SEQ ID NO: 3284575 - DNA, 19 bp, Homo sapiens
aacacagtttagtgcttta

SEQ ID NO: 3284576 - DNA, 21 bp, Homo sapiens
aacacattatcgggagcagtg

SEQ ID NO: 3284577 - DNA, 19 bp, Homo sapiens
aacacattcttattgacaa

SEQ ID NO: 3284578 - DNA, 14 bp, Homo sapiens
aacaccacagacac

SEQ ID NO: 3284579 - DNA, 15 bp, Homo sapiens
aacaccacagacaca

SEQ ID NO: 3284580 - DNA, 17 bp, Homo sapiens
aacaccacagacacaca

SEQ ID NO: 3284581 - DNA, 18 bp, Homo sapiens
aacaccagcccctgcccc

SEQ ID NO: 3284582 - DNA, 22 bp, Homo sapiens
aacaccagcccctgccccagcc

SEQ ID NO: 3284583 - DNA, 23 bp, Homo sapiens
aacaccagcccctgccccagccc

SEQ ID NO: 3284584 - DNA, 20 bp, Homo sapiens
aacacccagtctgttcccca

SEQ ID NO: 3284585 - DNA, 19 bp, Homo sapiens
aacacccccatccctcggg

SEQ ID NO: 3284586 - DNA, 12 bp, Homo sapiens
aacacccttcct

SEQ ID NO: 3284587 - DNA, 19 bp, Homo sapiens
aacacccttccttctgtaa

SEQ ID NO: 3284588 - DNA, 13 bp, Homo sapiens
aacacctcccagg

SEQ ID NO: 3284589 - DNA, 19 bp, Homo sapiens
aacaccttcctcctgcaga

SEQ ID NO: 3284590 - DNA, 14 bp, Homo sapiens
aacactaaaaataa

SEQ ID NO: 3284591 - DNA, 20 bp, Homo sapiens
aacactaaagatccaagaag

SEQ ID NO: 3284592 - DNA, 18 bp, Homo sapiens
aacactaacatataatgt

SEQ ID NO: 3284593 - DNA, 18 bp, Homo sapiens
aacactaactcaccagcc

SEQ ID NO: 3284594 - DNA, 14 bp, Homo sapiens
aacactaattcata

SEQ ID NO: 3284595 - DNA, 13 bp, Homo sapiens
aaccttccctcca

SEQ ID NO: 3284596 - DNA, 12 bp, Homo sapiens
aaccttcctggg

SEQ ID NO: 3284597 - DNA, 19 bp, Homo sapiens
aaccttccttcctgcttga

SEQ ID NO: 3284598 - DNA, 18 bp, Homo sapiens
aaccttgccttagaaaca

SEQ ID NO: 3284599 - DNA, 23 bp, Homo sapiens
aaccttgcctttctcgattttat

SEQ ID NO: 3284600 - DNA, 20 bp, Homo sapiens
aaccttgtaaaaaaagcaaa

SEQ ID NO: 3284601 - DNA, 23 bp, Homo sapiens
aaccttgttctatttttcaatca

SEQ ID NO: 3284602 - DNA, 13 bp, Homo sapiens
aaccttgttttgg

SEQ ID NO: 3284603 - DNA, 14 bp, Homo sapiens
aacctttaaaattg

SEQ ID NO: 3284604 - DNA, 19 bp, Homo sapiens
aacctttaaaattgtcacc

SEQ ID NO: 3284605 - DNA, 15 bp, Homo sapiens
aacctttaagaattt

SEQ ID NO: 3284606 - DNA, 14 bp, Homo sapiens
aacctttagggcag

SEQ ID NO: 3284607 - DNA, 18 bp, Homo sapiens
aacctttcaaatttcaca

SEQ ID NO: 3284608 - DNA, 23 bp, Homo sapiens
aacctttccgctgtcgccccagg

SEQ ID NO: 3284609 - DNA, 21 bp, Homo sapiens
aacctttgagtagatccattt

SEQ ID NO: 3284610 - DNA, 17 bp, Homo sapiens
aacctttgctatgtaag

SEQ ID NO: 3284611 - DNA, 14 bp, Homo sapiens
aacctttttcttga

SEQ ID NO: 3284612 - DNA, 17 bp, Homo sapiens
aaccttttttaagattt

SEQ ID NO: 3284613 - DNA, 22 bp, Homo sapiens
aaccttttttaagatttttctc

SEQ ID NO: 3284614 - DNA, 23 bp, Homo sapiens
aaccttttttaagatttttctca

SEQ ID NO: 3284615 - DNA, 15 bp, Homo sapiens
aacctttttttttga

SEQ ID NO: 3284616 - DNA, 18 bp, Homo sapiens
aacctttttttttgaaac

SEQ ID NO: 3284617 - DNA, 16 bp, Homo sapiens
aacgaaaatgaaagct

SEQ ID NO: 3284618 - DNA, 13 bp, Homo sapiens
aacgaagaaaaaa

SEQ ID NO: 3284619 - DNA, 16 bp, Homo sapiens
aacgaagagttccctt

SEQ ID NO: 3284620 - DNA, 16 bp, Homo sapiens
aacgagcactggccag

SEQ ID NO: 3284621 - DNA, 18 bp, Homo sapiens
aacgagcactggccagag

SEQ ID NO: 3284622 - DNA, 17 bp, Homo sapiens
aacgatgatgcttgtaa

SEQ ID NO: 3284623 - DNA, 22 bp, Homo sapiens
aacgatgatgcttgtaacaaga

SEQ ID NO: 3284624 - DNA, 16 bp, Homo sapiens
aacgatgtgtctgtat

SEQ ID NO: 3284625 - DNA, 13 bp, Homo sapiens
aacgatttagaaa

SEQ ID NO: 3284626 - DNA, 20 bp, Homo sapiens
aacgcaggagaatcactgca

SEQ ID NO: 3284627 - DNA, 23 bp, Homo sapiens
aacgccagtctcccaggccccct

SEQ ID NO: 3284628 - DNA, 20 bp, Homo sapiens
aacgccccgggcaaagggtc

SEQ ID NO: 3284629 - DNA, 12 bp, Homo sapiens
aacgcccctgtg

SEQ ID NO: 3284630 - DNA, 13 bp, Homo sapiens
aacgcccctgtgg

SEQ ID NO: 3284631 - DNA, 14 bp, Homo sapiens
aacgcccctgtggc

SEQ ID NO: 3284632 - DNA, 20 bp, Homo sapiens
aacggagccccaggcctctg

SEQ ID NO: 3284633 - DNA, 14 bp, Homo sapiens
aacgggaggctggg

SEQ ID NO: 3284634 - DNA, 16 bp, Homo sapiens
aacgggaggctgggca

SEQ ID NO: 3284635 - DNA, 15 bp, Homo sapiens
aacgggctgccctgc

SEQ ID NO: 3284636 - DNA, 15 bp, Homo sapiens
aacggttcctggtga

SEQ ID NO: 3284637 - DNA, 21 bp, Homo sapiens
aacggttcctggtgactcctg

SEQ ID NO: 3284638 - DNA, 19 bp, Homo sapiens
aacgtattggacctgccca

SEQ ID NO: 3284639 - DNA, 19 bp, Homo sapiens
aacgtcctctttagttttt

SEQ ID NO: 3284640 - DNA, 16 bp, Homo sapiens
aacgtgagagaaagag

SEQ ID NO: 3284641 - DNA, 13 bp, Homo sapiens
aacgtggtcacct

SEQ ID NO: 3284642 - DNA, 17 bp, Homo sapiens
aacgtgtcacacttgtg

SEQ ID NO: 3284643 - DNA, 15 bp, Homo sapiens
aacgttcgatttcta

SEQ ID NO: 3284644 - DNA, 18 bp, Homo sapiens
aacgtttcagtaataaaa

SEQ ID NO: 3284645 - DNA, 21 bp, Homo sapiens
aacgtttcagtaataaaacat

SEQ ID NO: 3284646 - DNA, 18 bp, Homo sapiens
aactaaaatcattgtcaa

SEQ ID NO: 3284647 - DNA, 22 bp, Homo sapiens
aactaaaatcattgtcaaaatt

SEQ ID NO: 3284648 - DNA, 12 bp, Homo sapiens
aactaaaatgta

SEQ ID NO: 3284649 - DNA, 13 bp, Homo sapiens
aactaaaatgtat

SEQ ID NO: 3284650 - DNA, 16 bp, Homo sapiens
aactaaactagttttt

SEQ ID NO: 3284651 - DNA, 23 bp, Homo sapiens
aactaaactcttaccatatgttt

SEQ ID NO: 3284652 - DNA, 13 bp, Homo sapiens
aactaaataatga

SEQ ID NO: 3284653 - DNA, 15 bp, Homo sapiens
aactaaataatgaat

SEQ ID NO: 3284654 - DNA, 21 bp, Homo sapiens
aactaaatgtgcaatagaagg

SEQ ID NO: 3284655 - DNA, 18 bp, Homo sapiens
aactaaatgttctatggt

SEQ ID NO: 3284656 - DNA, 21 bp, Homo sapiens
aactaaatttgatacttatat

SEQ ID NO: 3284657 - DNA, 14 bp, Homo sapiens
aactaaattttaaa

SEQ ID NO: 3284658 - DNA, 18 bp, Homo sapiens
aactaaattttaaagcca

SEQ ID NO: 3284659 - DNA, 18 bp, Homo sapiens
aactaagcagtccctgag

SEQ ID NO: 3284660 - DNA, 15 bp, Homo sapiens
aactaataaaagcat

SEQ ID NO: 3284661 - DNA, 12 bp, Homo sapiens
aactaattttgt

SEQ ID NO: 3284662 - DNA, 19 bp, Homo sapiens
aactaattttgttgaaaat

SEQ ID NO: 3284663 - DNA, 13 bp, Homo sapiens
aactacatgagaa

SEQ ID NO: 3284664 - DNA, 13 bp, Homo sapiens
aactacctctgga

SEQ ID NO: 3284665 - DNA, 18 bp, Homo sapiens
aactactaaagtgcctac

SEQ ID NO: 3284666 - DNA, 17 bp, Homo sapiens
aactactaatagaataa

SEQ ID NO: 3284667 - DNA, 14 bp, Homo sapiens
aactactgtacttt

SEQ ID NO: 3284668 - DNA, 13 bp, Homo sapiens
aactactgtgttc

SEQ ID NO: 3284669 - DNA, 14 bp, Homo sapiens
aactactgtgttcc

SEQ ID NO: 3284670 - DNA, 17 bp, Homo sapiens
aactactgtgttcctgg

SEQ ID NO: 3284671 - DNA, 17 bp, Homo sapiens
aactactttataactaa

SEQ ID NO: 3284672 - DNA, 20 bp, Homo sapiens
aactagaattagtatgtctg

SEQ ID NO: 3284673 - DNA, 19 bp, Homo sapiens
aactagaatttattcaatt

SEQ ID NO: 3284674 - DNA, 17 bp, Homo sapiens
aactagacaccaaagtt

SEQ ID NO: 3284675 - DNA, 13 bp, Homo sapiens
aactagatttgtc

SEQ ID NO: 3284676 - DNA, 15 bp, Homo sapiens
aactagatttgtcct

SEQ ID NO: 3284677 - DNA, 16 bp, Homo sapiens
aactaggtaatgtttt

SEQ ID NO: 3284678 - DNA, 23 bp, Homo sapiens
aactaggtaatgttttgtatata

SEQ ID NO: 3284679 - DNA, 16 bp, Homo sapiens
aactatattttcttta

SEQ ID NO: 3284680 - DNA, 13 bp, Homo sapiens
aactatcaaaatt

SEQ ID NO: 3284681 - DNA, 18 bp, Homo sapiens
aactatcctgacttctaa

SEQ ID NO: 3284682 - DNA, 12 bp, Homo sapiens
aactatctgtat

SEQ ID NO: 3284683 - DNA, 18 bp, Homo sapiens
aactatcttggtgaattt

SEQ ID NO: 3284684 - DNA, 16 bp, Homo sapiens
aactatgattattaac

SEQ ID NO: 3284685 - DNA, 17 bp, Homo sapiens
aactatgtggctgaaaa

SEQ ID NO: 3284686 - DNA, 19 bp, Homo sapiens
aactatgtgtttttctcat

SEQ ID NO: 3284687 - DNA, 12 bp, Homo sapiens
aactattaacct

SEQ ID NO: 3284688 - DNA, 14 bp, Homo sapiens
aactattaaccttt

SEQ ID NO: 3284689 - DNA, 18 bp, Homo sapiens
aactatttgtctttcagg

SEQ ID NO: 3284690 - DNA, 16 bp, Homo sapiens
aactcaagacaatgca

SEQ ID NO: 3284691 - DNA, 21 bp, Homo sapiens
aactcaccatgtaaaagagtc

SEQ ID NO: 3284692 - DNA, 17 bp, Homo sapiens
aactcacctaatgttta

SEQ ID NO: 3284693 - DNA, 17 bp, Homo sapiens
aactcacctctcaaggt

SEQ ID NO: 3284694 - DNA, 16 bp, Homo sapiens
aactcactgattctct

SEQ ID NO: 3284695 - DNA, 22 bp, Homo sapiens
aactcactgctcaagaagacat

SEQ ID NO: 3284696 - DNA, 15 bp, Homo sapiens
aactcactgtgatca

SEQ ID NO: 3284697 - DNA, 16 bp, Homo sapiens
aactcagggacagagc

SEQ ID NO: 3284698 - DNA, 16 bp, Homo sapiens
aactcatcataaaata

SEQ ID NO: 3284699 - DNA, 17 bp, Homo sapiens
aactcattgcagcagat

SEQ ID NO: 3284700 - DNA, 23 bp, Homo sapiens
aactcattgcagcagataacttt

SEQ ID NO: 3284701 - DNA, 15 bp, Homo sapiens
aactccacatctgcc

SEQ ID NO: 3284702 - DNA, 17 bp, Homo sapiens
aactccacatctgcctt

SEQ ID NO: 3284703 - DNA, 18 bp, Homo sapiens
aactccacatctgcctta

SEQ ID NO: 3284704 - DNA, 16 bp, Homo sapiens
aactccactctccttc

SEQ ID NO: 3284705 - DNA, 16 bp, Homo sapiens
aactccactggctcca

SEQ ID NO: 3284706 - DNA, 13 bp, Homo sapiens
aactccagagtca

SEQ ID NO: 3284707 - DNA, 17 bp, Homo sapiens
aactcccctgtttcaat

SEQ ID NO: 3284708 - DNA, 19 bp, Homo sapiens
aactccgcccccagcctat

SEQ ID NO: 3284709 - DNA, 23 bp, Homo sapiens
aactcctaattttaaataatttc

SEQ ID NO: 3284710 - DNA, 18 bp, Homo sapiens
aactcctgagaaatgtta

SEQ ID NO: 3284711 - DNA, 17 bp, Homo sapiens
aactccttattttgtat

SEQ ID NO: 3284712 - DNA, 12 bp, Homo sapiens
aactccttggcc

SEQ ID NO: 3284713 - DNA, 13 bp, Homo sapiens
aactccttggcct

SEQ ID NO: 3284714 - DNA, 15 bp, Homo sapiens
aactctaatagtgct

SEQ ID NO: 3284715 - DNA, 23 bp, Homo sapiens
aactctaatattgcttcttgtgt

SEQ ID NO: 3284716 - DNA, 14 bp, Homo sapiens
aactctacatttaa

SEQ ID NO: 3284717 - DNA, 14 bp, Homo sapiens
aactctacccctgc

SEQ ID NO: 3284718 - DNA, 18 bp, Homo sapiens
aactctacccctgctccc

SEQ ID NO: 3284719 - DNA, 14 bp, Homo sapiens
aactctatctgggc

SEQ ID NO: 3284720 - DNA, 18 bp, Homo sapiens
aactctatctgggcctgg

SEQ ID NO: 3284721 - DNA, 19 bp, Homo sapiens
aactctatctgggcctggg

SEQ ID NO: 3284722 - DNA, 18 bp, Homo sapiens
aacttcagaaacccggct

SEQ ID NO: 3284723 - DNA, 22 bp, Homo sapiens
aacttcagagggaaagtaaata

SEQ ID NO: 3284724 - DNA, 15 bp, Homo sapiens
aacttcagtcctggg

SEQ ID NO: 3284725 - DNA, 16 bp, Homo sapiens
aacttcatgtaatttt

SEQ ID NO: 3284726 - DNA, 20 bp, Homo sapiens
aacttcatgtcaacttctgg

SEQ ID NO: 3284727 - DNA, 14 bp, Homo sapiens
aacttcatttgatg

SEQ ID NO: 3284728 - DNA, 21 bp, Homo sapiens
aacttccaaggccctgctttt

SEQ ID NO: 3284729 - DNA, 22 bp, Homo sapiens
aacttccaggtgttactgtaat

SEQ ID NO: 3284730 - DNA, 15 bp, Homo sapiens
aacttcttatggaat

SEQ ID NO: 3284731 - DNA, 19 bp, Homo sapiens
aacttcttatggaattgat

SEQ ID NO: 3284732 - DNA, 18 bp, Homo sapiens
aacttcttcctgctggac

SEQ ID NO: 3284733 - DNA, 14 bp, Homo sapiens
aacttcttgtcaga

SEQ ID NO: 3284734 - DNA, 16 bp, Homo sapiens
aacttcttgtcagaca

SEQ ID NO: 3284735 - DNA, 17 bp, Homo sapiens
aacttcttgtcagacat

SEQ ID NO: 3284736 - DNA, 20 bp, Homo sapiens
aacttcttgtcagacataaa

SEQ ID NO: 3284737 - DNA, 18 bp, Homo sapiens
aacttcttttctcttcta

SEQ ID NO: 3284738 - DNA, 16 bp, Homo sapiens
aacttgaatgtgtcag

SEQ ID NO: 3284739 - DNA, 16 bp, Homo sapiens
aacttgactccatttc

SEQ ID NO: 3284740 - DNA, 14 bp, Homo sapiens
aacttgactgggtg

SEQ ID NO: 3284741 - DNA, 20 bp, Homo sapiens
aacttgatttgcatggattt

SEQ ID NO: 3284742 - DNA, 23 bp, Homo sapiens
aacttggaaaaatccagaaagaa

SEQ ID NO: 3284743 - DNA, 14 bp, Homo sapiens
aacttggattctct

SEQ ID NO: 3284744 - DNA, 15 bp, Homo sapiens
aacttggatttttga

SEQ ID NO: 3284745 - DNA, 12 bp, Homo sapiens
aacttggcactt

SEQ ID NO: 3284746 - DNA, 13 bp, Homo sapiens
aacttggcacttt

SEQ ID NO: 3284747 - DNA, 12 bp, Homo sapiens
aacttggctttc

SEQ ID NO: 3284748 - DNA, 20 bp, Homo sapiens
aacttggtcagagccactct

SEQ ID NO: 3284749 - DNA, 23 bp, Homo sapiens
aacttggtcagagccactctatg

SEQ ID NO: 3284750 - DNA, 16 bp, Homo sapiens
aacttggttctgcttc

SEQ ID NO: 3284751 - DNA, 17 bp, Homo sapiens
aacttggttctgcttca

SEQ ID NO: 3284752 - DNA, 14 bp, Homo sapiens
aacttgtaaataca

SEQ ID NO: 3284753 - DNA, 18 bp, Homo sapiens
aacttgtagctgtaaaac

SEQ ID NO: 3284754 - DNA, 21 bp, Homo sapiens
aacttgtctgggaattgtgtg

SEQ ID NO: 3284755 - DNA, 17 bp, Homo sapiens
aacttgtgaatgcttct

SEQ ID NO: 3284756 - DNA, 20 bp, Homo sapiens
aacttgtgtactgataaaat

SEQ ID NO: 3284757 - DNA, 21 bp, Homo sapiens
aacttgtgtactgataaaata

SEQ ID NO: 3284758 - DNA, 15 bp, Homo sapiens
aacttgttacttgca

SEQ ID NO: 3284759 - DNA, 18 bp, Homo sapiens
aacttgttattgtgaatg

SEQ ID NO: 3284760 - DNA, 20 bp, Homo sapiens
aacttgttattgtgaatgat

SEQ ID NO: 3284761 - DNA, 11 bp, Homo sapiens
aacttgttcat

SEQ ID NO: 3284762 - DNA, 14 bp, Homo sapiens
aacttgttcattta

SEQ ID NO: 3284763 - DNA, 16 bp, Homo sapiens
aacttgttcatttaga

SEQ ID NO: 3284764 - DNA, 21 bp, Homo sapiens
aacttgttcatttagataatt

SEQ ID NO: 3284765 - DNA, 17 bp, Homo sapiens
aacttgttgtggctctt

SEQ ID NO: 3284766 - DNA, 23 bp, Homo sapiens
aacttgtttacaacatttttgca

SEQ ID NO: 3284767 - DNA, 16 bp, Homo sapiens
aacttgtttgctgtga

SEQ ID NO: 3284768 - DNA, 17 bp, Homo sapiens
aacttgtttgctgtgaa

SEQ ID NO: 3284769 - DNA, 15 bp, Homo sapiens
aactttaaaaaatat

SEQ ID NO: 3284770 - DNA, 14 bp, Homo sapiens
aactttaatgtttt

SEQ ID NO: 3284771 - DNA, 19 bp, Homo sapiens
aactttaatgttttttgcc

SEQ ID NO: 3284772 - DNA, 20 bp, Homo sapiens
aactttaattctctttcaaa

SEQ ID NO: 3284773 - DNA, 17 bp, Homo sapiens
aactttacctatggaag

SEQ ID NO: 3284774 - DNA, 21 bp, Homo sapiens
aactttagaagtgcatttctg

SEQ ID NO: 3284775 - DNA, 14 bp, Homo sapiens
aactttatgtactg

SEQ ID NO: 3284776 - DNA, 17 bp, Homo sapiens
aactttatgtgtaaata

SEQ ID NO: 3284777 - DNA, 14 bp, Homo sapiens
aactttattaaata

SEQ ID NO: 3284778 - DNA, 23 bp, Homo sapiens
aactttattaaatacaaaacttc

SEQ ID NO: 3284779 - DNA, 16 bp, Homo sapiens
aactttcactttgaaa

SEQ ID NO: 3284780 - DNA, 19 bp, Homo sapiens
aactttcattccttcagat

SEQ ID NO: 3284781 - DNA, 23 bp, Homo sapiens
aactttcccaggttctgtttatg

SEQ ID NO: 3284782 - DNA, 14 bp, Homo sapiens
aactttctccctca

SEQ ID NO: 3284783 - DNA, 16 bp, Homo sapiens
aactttctccctcatc

SEQ ID NO: 3284784 - DNA, 18 bp, Homo sapiens
aactttctcttcatactt

SEQ ID NO: 3284785 - DNA, 14 bp, Homo sapiens
aactttctcttgta

SEQ ID NO: 3284786 - DNA, 16 bp, Homo sapiens
aactttgccaaaaaaa

SEQ ID NO: 3284787 - DNA, 12 bp, Homo sapiens
aactttgggaaa

SEQ ID NO: 3284788 - DNA, 14 bp, Homo sapiens
aactttgtaaaaat

SEQ ID NO: 3284789 - DNA, 11 bp, Homo sapiens
aacttttaatt

SEQ ID NO: 3284790 - DNA, 17 bp, Homo sapiens
aacttttcaatgacatt

SEQ ID NO: 3284791 - DNA, 12 bp, Homo sapiens
aacttttctacc

SEQ ID NO: 3284792 - DNA, 21 bp, Homo sapiens
aacttttggctaacagaaatt

SEQ ID NO: 3284793 - DNA, 15 bp, Homo sapiens
aacttttgtaaagaa

SEQ ID NO: 3284794 - DNA, 18 bp, Homo sapiens
aacttttgtaaagaaatt

SEQ ID NO: 3284795 - DNA, 14 bp, Homo sapiens
aacttttgtaaata

SEQ ID NO: 3284796 - DNA, 20 bp, Homo sapiens
aacttttgtgtaatgaaaat

SEQ ID NO: 3284797 - DNA, 16 bp, Homo sapiens
aacttttttaaataaa

SEQ ID NO: 3284798 - DNA, 17 bp, Homo sapiens
aacttttttaaataaac

SEQ ID NO: 3284799 - DNA, 19 bp, Homo sapiens
aacttttttaaataaactt

SEQ ID NO: 3284800 - DNA, 19 bp, Homo sapiens
aacttttttgagtcattga

SEQ ID NO: 3284801 - DNA, 18 bp, Homo sapiens
aacttttttgtgtatgta

SEQ ID NO: 3284802 - DNA, 19 bp, Homo sapiens
aacttttttgtgtatgtac

SEQ ID NO: 3284803 - DNA, 22 bp, Homo sapiens
aacttttttgtgtatgtactta

SEQ ID NO: 3284804 - DNA, 22 bp, Homo sapiens
aactttttttctgtaccagtta

SEQ ID NO: 3284805 - DNA, 16 bp, Homo sapiens
aagaaaaaaaaaatat

SEQ ID NO: 3284806 - DNA, 18 bp, Homo sapiens
aagaaaaaaaataacaca

SEQ ID NO: 3284807 - DNA, 13 bp, Homo sapiens
aagaaaaaagctt

SEQ ID NO: 3284808 - DNA, 16 bp, Homo sapiens
aagaaaaagataagaa

SEQ ID NO: 3284809 - DNA, 12 bp, Homo sapiens
aagaaaaccatt

SEQ ID NO: 3284810 - DNA, 11 bp, Homo sapiens
aagaaaagcac

SEQ ID NO: 3284811 - DNA, 16 bp, Homo sapiens
aagaaaagcacttttg

SEQ ID NO: 3284812 - DNA, 17 bp, Homo sapiens
aagaaaagcacttttgt

SEQ ID NO: 3284813 - DNA, 19 bp, Homo sapiens
aagaaaagcactttttaaa

SEQ ID NO: 3284814 - DNA, 14 bp, Homo sapiens
aagaaaagccaagc

SEQ ID NO: 3284815 - DNA, 16 bp, Homo sapiens
aagaaaagtggttgtt

SEQ ID NO: 3284816 - DNA, 17 bp, Homo sapiens
aagaaaatacaataaac

SEQ ID NO: 3284817 - DNA, 17 bp, Homo sapiens
aagaaaatatacatttg

SEQ ID NO: 3284818 - DNA, 12 bp, Homo sapiens
aagaaaatcttt

SEQ ID NO: 3284819 - DNA, 14 bp, Homo sapiens
aagaaaatctttgt

SEQ ID NO: 3284820 - DNA, 16 bp, Homo sapiens
aagaaaatgaagggat

SEQ ID NO: 3284821 - DNA, 18 bp, Homo sapiens
aagaaaatggctaataaa

SEQ ID NO: 3284822 - DNA, 14 bp, Homo sapiens
aagaaaattgagtt

SEQ ID NO: 3284823 - DNA, 17 bp, Homo sapiens
aagaaacaagctgtgca

SEQ ID NO: 3284824 - DNA, 20 bp, Homo sapiens
aagaaacaagctgtgcaggc

SEQ ID NO: 3284825 - DNA, 17 bp, Homo sapiens
aagaaactaaaaatata

SEQ ID NO: 3284826 - DNA, 24 bp, Homo sapiens
aagaaactaaaaatatagcaaatg

SEQ ID NO: 3284827 - DNA, 12 bp, Homo sapiens
aagaaacttttg

SEQ ID NO: 3284828 - DNA, 18 bp, Homo sapiens
aagaaacttttgtaaaga

SEQ ID NO: 3284829 - DNA, 20 bp, Homo sapiens
aagaaagactatctaaatgt

SEQ ID NO: 3284830 - DNA, 22 bp, Homo sapiens
aagaaagactatctaaatgttg

SEQ ID NO: 3284831 - DNA, 23 bp, Homo sapiens
aagaaagagcaacaatccatctc

SEQ ID NO: 3284832 - DNA, 16 bp, Homo sapiens
aagaaagcaaaagcaa

SEQ ID NO: 3284833 - DNA, 22 bp, Homo sapiens
aagaaagcttcaaactgcatga

SEQ ID NO: 3284834 - DNA, 15 bp, Homo sapiens
aagaaaggaacattt

SEQ ID NO: 3284835 - DNA, 12 bp, Homo sapiens
aagaaagtgtat

SEQ ID NO: 3284836 - DNA, 15 bp, Homo sapiens
aagaaagtgtatttg

SEQ ID NO: 3284837 - DNA, 13 bp, Homo sapiens
aagaaataaaaat

SEQ ID NO: 3284838 - DNA, 14 bp, Homo sapiens
aagaaataaatcag

SEQ ID NO: 3284839 - DNA, 14 bp, Homo sapiens
aagaaatgaacatt

SEQ ID NO: 3284840 - DNA, 16 bp, Homo sapiens
aagaaatgaacattcc

SEQ ID NO: 3284841 - DNA, 15 bp, Homo sapiens
aagaaatgactaatt

SEQ ID NO: 3284842 - DNA, 16 bp, Homo sapiens
aagaaatgactaatta

SEQ ID NO: 3284843 - DNA, 21 bp, Homo sapiens
aagaaatgattcaaattgctg

SEQ ID NO: 3284844 - DNA, 18 bp, Homo sapiens
aagaaatggattctattt

SEQ ID NO: 3284845 - DNA, 20 bp, Homo sapiens
aagaaatgtattcctgaaaa

SEQ ID NO: 3284846 - DNA, 17 bp, Homo sapiens
aagaaatgtcagatgcg

SEQ ID NO: 3284847 - DNA, 20 bp, Homo sapiens
aagaaattaggggttaaagc

SEQ ID NO: 3284848 - DNA, 16 bp, Homo sapiens
aagaaatttactatat

SEQ ID NO: 3284849 - DNA, 15 bp, Homo sapiens
aagcactttgcactt

SEQ ID NO: 3284850 - DNA, 23 bp, Homo sapiens
aagcacttttgttattccatcaa

SEQ ID NO: 3284851 - DNA, 16 bp, Homo sapiens
aagcactttttaaaaa

SEQ ID NO: 3284852 - DNA, 13 bp, Homo sapiens
aagcactttttgg

SEQ ID NO: 3284853 - DNA, 19 bp, Homo sapiens
aagcagaaaataaaggaag

SEQ ID NO: 3284854 - DNA, 15 bp, Homo sapiens
aagcagaattttaat

SEQ ID NO: 3284855 - DNA, 23 bp, Homo sapiens
aagcagacgtccatagctcctct

SEQ ID NO: 3284856 - DNA, 19 bp, Homo sapiens
aagcagagtgcacagctgt

SEQ ID NO: 3284857 - DNA, 21 bp, Homo sapiens
aagcagagtgcacagctgtcc

SEQ ID NO: 3284858 - DNA, 15 bp, Homo sapiens
aagcagagttttcat

SEQ ID NO: 3284859 - DNA, 17 bp, Homo sapiens
aagcagatggaatgctg

SEQ ID NO: 3284860 - DNA, 19 bp, Homo sapiens
aagcagatggaatgctgtg

SEQ ID NO: 3284861 - DNA, 20 bp, Homo sapiens
aagcagcatggaaaaatggt

SEQ ID NO: 3284862 - DNA, 12 bp, Homo sapiens
aagcagccagct

SEQ ID NO: 3284863 - DNA, 17 bp, Homo sapiens
aagcagcctctccccag

SEQ ID NO: 3284864 - DNA, 19 bp, Homo sapiens
aagcagcctgattgaaaag

SEQ ID NO: 3284865 - DNA, 19 bp, Homo sapiens
aagcagcgaccgccccctc

SEQ ID NO: 3284866 - DNA, 13 bp, Homo sapiens
aagcagcgggcta

SEQ ID NO: 3284867 - DNA, 19 bp, Homo sapiens
aagcagctgcattttttat

SEQ ID NO: 3284868 - DNA, 21 bp, Homo sapiens
aagcagctttaaacaaattca

SEQ ID NO: 3284869 - DNA, 14 bp, Homo sapiens
aagcaggaattatg

SEQ ID NO: 3284870 - DNA, 15 bp, Homo sapiens
aagcaggctggaggt

SEQ ID NO: 3284871 - DNA, 16 bp, Homo sapiens
aagcagggaatttcta

SEQ ID NO: 3284872 - DNA, 22 bp, Homo sapiens
aagcagggaatttctatctaaa

SEQ ID NO: 3284873 - DNA, 15 bp, Homo sapiens
aagcagggcagcagg

SEQ ID NO: 3284874 - DNA, 14 bp, Homo sapiens
aagcagtaaaaact

SEQ ID NO: 3284875 - DNA, 12 bp, Homo sapiens
aagcagtatttt

SEQ ID NO: 3284876 - DNA, 16 bp, Homo sapiens
aagcagtcccattcat

SEQ ID NO: 3284877 - DNA, 14 bp, Homo sapiens
aagcataaagctca

SEQ ID NO: 3284878 - DNA, 23 bp, Homo sapiens
aagcatacatgcaaaaagaaatg

SEQ ID NO: 3284879 - DNA, 17 bp, Homo sapiens
aagcatactttgtaaat

SEQ ID NO: 3284880 - DNA, 18 bp, Homo sapiens
aagcatactttgtaaata

SEQ ID NO: 3284881 - DNA, 21 bp, Homo sapiens
aagcatagataatattgtttg

SEQ ID NO: 3284882 - DNA, 16 bp, Homo sapiens
aagcatagatgttttg

SEQ ID NO: 3284883 - DNA, 14 bp, Homo sapiens
aagcatattttgct

SEQ ID NO: 3284884 - DNA, 17 bp, Homo sapiens
aagcatattttgctggt

SEQ ID NO: 3284885 - DNA, 15 bp, Homo sapiens
aagcatcacctcagg

SEQ ID NO: 3284886 - DNA, 19 bp, Homo sapiens
aagcatcagttctacggat

SEQ ID NO: 3284887 - DNA, 19 bp, Homo sapiens
aagcatccatgtgtggact

SEQ ID NO: 3284888 - DNA, 20 bp, Homo sapiens
aagcatcttgggggggtggc

SEQ ID NO: 3284889 - DNA, 15 bp, Homo sapiens
aagcatgatgggaaa

SEQ ID NO: 3284890 - DNA, 20 bp, Homo sapiens
aagcatgatgggaaaatatt

SEQ ID NO: 3284891 - DNA, 19 bp, Homo sapiens
aagcatgctttgctgctat

SEQ ID NO: 3284892 - DNA, 14 bp, Homo sapiens
aagcatggacattt

SEQ ID NO: 3284893 - DNA, 11 bp, Homo sapiens
aagcatggact

SEQ ID NO: 3284894 - DNA, 17 bp, Homo sapiens
aagcatgtctcaatagt

SEQ ID NO: 3284895 - DNA, 17 bp, Homo sapiens
aagcattaacttctctg

SEQ ID NO: 3284896 - DNA, 14 bp, Homo sapiens
aagcattctcccca

SEQ ID NO: 3284897 - DNA, 14 bp, Homo sapiens
aagcattgcctggc

SEQ ID NO: 3284898 - DNA, 21 bp, Homo sapiens
aagcattgcctggccttcctg

SEQ ID NO: 3284899 - DNA, 20 bp, Homo sapiens
aagcattgcttttattttga

SEQ ID NO: 3284900 - DNA, 11 bp, Homo sapiens
aagcattgttt

SEQ ID NO: 3284901 - DNA, 23 bp, Homo sapiens
aagcattgtttgcttattgttcc

SEQ ID NO: 3284902 - DNA, 12 bp, Homo sapiens
aagcatttataa

SEQ ID NO: 3284903 - DNA, 19 bp, Homo sapiens
aagcatttatcattcttgt

SEQ ID NO: 3284904 - DNA, 18 bp, Homo sapiens
aagcatttgtattttgtg

SEQ ID NO: 3284905 - DNA, 23 bp, Homo sapiens
aagcattttcagtcttgtagtgt

SEQ ID NO: 3284906 - DNA, 21 bp, Homo sapiens
aagccaaagaaaaataaccct

SEQ ID NO: 3284907 - DNA, 20 bp, Homo sapiens
aagccaaagaaatgaacatt

SEQ ID NO: 3284908 - DNA, 22 bp, Homo sapiens
aagccaaagaaatgaacattcc

SEQ ID NO: 3284909 - DNA, 17 bp, Homo sapiens
aagccaaagctaggcct

SEQ ID NO: 3284910 - DNA, 22 bp, Homo sapiens
aagccaaagtggcatgttttgt

SEQ ID NO: 3284911 - DNA, 13 bp, Homo sapiens
aagccaaatttat

SEQ ID NO: 3284912 - DNA, 17 bp, Homo sapiens
aagccaagctccctgga

SEQ ID NO: 3284913 - DNA, 13 bp, Homo sapiens
aagccaagggaaa

SEQ ID NO: 3284914 - DNA, 23 bp, Homo sapiens
aagccaagggaaaggggtgcttt

SEQ ID NO: 3284915 - DNA, 18 bp, Homo sapiens
aagccaagggaacctgtg

SEQ ID NO: 3284916 - DNA, 20 bp, Homo sapiens
aagccaagggaacctgtgtc

SEQ ID NO: 3284917 - DNA, 15 bp, Homo sapiens
aagccaatgtgaatt

SEQ ID NO: 3284918 - DNA, 21 bp, Homo sapiens
aagccacaaggctggccagca

SEQ ID NO: 3284919 - DNA, 18 bp, Homo sapiens
aagccaccatccccaccc

SEQ ID NO: 3284920 - DNA, 17 bp, Homo sapiens
aagccacctctccctca

SEQ ID NO: 3284921 - DNA, 19 bp, Homo sapiens
aagccactctgtcccttcc

SEQ ID NO: 3284922 - DNA, 17 bp, Homo sapiens
aagccactgaagctggg

SEQ ID NO: 3284923 - DNA, 13 bp, Homo sapiens
aagccacttgaaa

SEQ ID NO: 3284924 - DNA, 15 bp, Homo sapiens
aagccagagcctggg

SEQ ID NO: 3284925 - DNA, 16 bp, Homo sapiens
aagccagaggctgggt

SEQ ID NO: 3284926 - DNA, 20 bp, Homo sapiens
aagccagccaagctttaaat

SEQ ID NO: 3284927 - DNA, 19 bp, Homo sapiens
aagccagccacagacccct

SEQ ID NO: 3284928 - DNA, 23 bp, Homo sapiens
aagccagccacagacccctggga

SEQ ID NO: 3284929 - DNA, 16 bp, Homo sapiens
aagccagctctaggct

SEQ ID NO: 3284930 - DNA, 23 bp, Homo sapiens
aagccagctgccgaccagagccc

SEQ ID NO: 3284931 - DNA, 17 bp, Homo sapiens
aagccagctttccctgc

SEQ ID NO: 3284932 - DNA, 23 bp, Homo sapiens
aagccagggtctctccctcaggt

SEQ ID NO: 3284933 - DNA, 17 bp, Homo sapiens
aagccaggtgagctctg

SEQ ID NO: 3284934 - DNA, 18 bp, Homo sapiens
aagccaggtgagctctga

SEQ ID NO: 3284935 - DNA, 20 bp, Homo sapiens
aagccagtttgggtaaaata

SEQ ID NO: 3284936 - DNA, 18 bp, Homo sapiens
aagccatagcctccacgg

SEQ ID NO: 3284937 - DNA, 14 bp, Homo sapiens
aagccataggccca

SEQ ID NO: 3284938 - DNA, 16 bp, Homo sapiens
aagccataggcccagg

SEQ ID NO: 3284939 - DNA, 18 bp, Homo sapiens
aagccatgtactcaagta

SEQ ID NO: 3284940 - DNA, 22 bp, Homo sapiens
aagccattaaatgaatattttg

SEQ ID NO: 3284941 - DNA, 23 bp, Homo sapiens
aagccattcacttccccaatctt

SEQ ID NO: 3284942 - DNA, 18 bp, Homo sapiens
aagcccaatattataatt

SEQ ID NO: 3284943 - DNA, 21 bp, Homo sapiens
aagcccaggtgccagcctgag

SEQ ID NO: 3284944 - DNA, 18 bp, Homo sapiens
aagcccagtgctgctgta

SEQ ID NO: 3284945 - DNA, 23 bp, Homo sapiens
aagcccagtgctgctgtaaatac

SEQ ID NO: 3284946 - DNA, 19 bp, Homo sapiens
aagcccatgagtccttgaa

SEQ ID NO: 3284947 - DNA, 20 bp, Homo sapiens
aagcccatgagtccttgaaa

SEQ ID NO: 3284948 - DNA, 21 bp, Homo sapiens
aagccccaacgggaaaggaaa

SEQ ID NO: 3284949 - DNA, 17 bp, Homo sapiens
aagccccagggcctggg

SEQ ID NO: 3284950 - DNA, 18 bp, Homo sapiens
aagccccagggcctgggg

SEQ ID NO: 3284951 - DNA, 17 bp, Homo sapiens
aagccccatctcatcct

SEQ ID NO: 3284952 - DNA, 13 bp, Homo sapiens
aagccccttattt

SEQ ID NO: 3284953 - DNA, 18 bp, Homo sapiens
aagccccttatttttagc

SEQ ID NO: 3284954 - DNA, 21 bp, Homo sapiens
aagccccttgctctcccctgc

SEQ ID NO: 3284955 - DNA, 20 bp, Homo sapiens
aagccctcccaggtgttaac

SEQ ID NO: 3284956 - DNA, 17 bp, Homo sapiens
aagccctgaggcctgag

SEQ ID NO: 3284957 - DNA, 14 bp, Homo sapiens
aagccctggagaaa

SEQ ID NO: 3284958 - DNA, 11 bp, Homo sapiens
aagccctggca

SEQ ID NO: 3284959 - DNA, 14 bp, Homo sapiens
aagccctggcaaca

SEQ ID NO: 3284960 - DNA, 20 bp, Homo sapiens
aagccctgtcgagacacttg

SEQ ID NO: 3284961 - DNA, 18 bp, Homo sapiens
aagcccttcggtcacctg

SEQ ID NO: 3284962 - DNA, 17 bp, Homo sapiens
aagccgactctggccct

SEQ ID NO: 3284963 - DNA, 19 bp, Homo sapiens
aagccgactctggccctgg

SEQ ID NO: 3284964 - DNA, 14 bp, Homo sapiens
aagccgtctgactc

SEQ ID NO: 3284965 - DNA, 20 bp, Homo sapiens
aagccgtctgactccagagt

SEQ ID NO: 3284966 - DNA, 13 bp, Homo sapiens
aagccgtggcttc

SEQ ID NO: 3284967 - DNA, 15 bp, Homo sapiens
aagccgtggcttccc

SEQ ID NO: 3284968 - DNA, 23 bp, Homo sapiens
aagcctaaatgccttagaaatgt

SEQ ID NO: 3284969 - DNA, 22 bp, Homo sapiens
aagcctcaactagtcatttttt

SEQ ID NO: 3284970 - DNA, 20 bp, Homo sapiens
aagcctcatatttaaagaca

SEQ ID NO: 3284971 - DNA, 13 bp, Homo sapiens
aagcctccaaggg

SEQ ID NO: 3284972 - DNA, 12 bp, Homo sapiens
aagcctccacag

SEQ ID NO: 3284973 - DNA, 13 bp, Homo sapiens
aagcctccacagc

SEQ ID NO: 3284974 - DNA, 17 bp, Homo sapiens
aaggttttttttcagtt

SEQ ID NO: 3284975 - DNA, 15 bp, Homo sapiens
aagtaaaagaaaagc

SEQ ID NO: 3284976 - DNA, 13 bp, Homo sapiens
aagtaaaattgct

SEQ ID NO: 3284977 - DNA, 13 bp, Homo sapiens
aagtaaaccaaaa

SEQ ID NO: 3284978 - DNA, 12 bp, Homo sapiens
aagtaaactttt

SEQ ID NO: 3284979 - DNA, 20 bp, Homo sapiens
aagtaaactttttgttctgg

SEQ ID NO: 3284980 - DNA, 17 bp, Homo sapiens
aagtaaagccattaaat

SEQ ID NO: 3284981 - DNA, 12 bp, Homo sapiens
aagtaaagctaa

SEQ ID NO: 3284982 - DNA, 21 bp, Homo sapiens
aagtaaagctaaaatgatttt

SEQ ID NO: 3284983 - DNA, 14 bp, Homo sapiens
aagtaaaggcctcc

SEQ ID NO: 3284984 - DNA, 16 bp, Homo sapiens
aagtaaaggcctcctc

SEQ ID NO: 3284985 - DNA, 21 bp, Homo sapiens
aagtaaatacaagactgttgt

SEQ ID NO: 3284986 - DNA, 12 bp, Homo sapiens
aagtaaatctct

SEQ ID NO: 3284987 - DNA, 13 bp, Homo sapiens
aagtaaatctctt

SEQ ID NO: 3284988 - DNA, 14 bp, Homo sapiens
aagtaaattatgta

SEQ ID NO: 3284989 - DNA, 21 bp, Homo sapiens
aagtaaattgcctgatttgtt

SEQ ID NO: 3284990 - DNA, 16 bp, Homo sapiens
aagtaacatgcatact

SEQ ID NO: 3284991 - DNA, 21 bp, Homo sapiens
aagtaacatgcatactttatt

SEQ ID NO: 3284992 - DNA, 14 bp, Homo sapiens
aagtaactcatttg

SEQ ID NO: 3284993 - DNA, 21 bp, Homo sapiens
aagtaagaaagtgaagcaaat

SEQ ID NO: 3284994 - DNA, 14 bp, Homo sapiens
aagtaagaagacat

SEQ ID NO: 3284995 - DNA, 20 bp, Homo sapiens
aagtaagaagacatgaacca

SEQ ID NO: 3284996 - DNA, 21 bp, Homo sapiens
aagtaagagctaagttctaag

SEQ ID NO: 3284997 - DNA, 18 bp, Homo sapiens
aagtaaggtgcagttccc

SEQ ID NO: 3284998 - DNA, 20 bp, Homo sapiens
aagtaaggtgcttggagttt

SEQ ID NO: 3284999 - DNA, 20 bp, Homo sapiens
aagtaagtaccactcaggcc

SEQ ID NO: 3285000 - DNA, 17 bp, Homo sapiens
aagtaagtttcttcctg

SEQ ID NO: 3285001 - DNA, 19 bp, Homo sapiens
aagtaatacgttttgacat

SEQ ID NO: 3285002 - DNA, 16 bp, Homo sapiens
aagtaatataatggaa

SEQ ID NO: 3285003 - DNA, 21 bp, Homo sapiens
aagtaatgaatttttatgata

SEQ ID NO: 3285004 - DNA, 15 bp, Homo sapiens
aagtaattatcggga

SEQ ID NO: 3285005 - DNA, 15 bp, Homo sapiens
aagtacactctgctg

SEQ ID NO: 3285006 - DNA, 20 bp, Homo sapiens
aagtacatattaggaaaata

SEQ ID NO: 3285007 - DNA, 17 bp, Homo sapiens
aagtacatgaatacaaa

SEQ ID NO: 3285008 - DNA, 16 bp, Homo sapiens
aagtaccaatgctgtt

SEQ ID NO: 3285009 - DNA, 18 bp, Homo sapiens
aagtaccaatgctgttgt

SEQ ID NO: 3285010 - DNA, 24 bp, Homo sapiens
aagtaccaatgctgttgtaaacaa

SEQ ID NO: 3285011 - DNA, 15 bp, Homo sapiens
aagtaccacactgag

SEQ ID NO: 3285012 - DNA, 15 bp, Homo sapiens
aagtaccagcatgtt

SEQ ID NO: 3285013 - DNA, 19 bp, Homo sapiens
aagtaccagcatgttaact

SEQ ID NO: 3285014 - DNA, 22 bp, Homo sapiens
aagtaccctgatgccttttgga

SEQ ID NO: 3285015 - DNA, 13 bp, Homo sapiens
aagtactatgtat

SEQ ID NO: 3285016 - DNA, 17 bp, Homo sapiens
aagtacttccctcaggc

SEQ ID NO: 3285017 - DNA, 21 bp, Homo sapiens
aagtacttctccaccctgctc

SEQ ID NO: 3285018 - DNA, 11 bp, Homo sapiens
aagtacttctt

SEQ ID NO: 3285019 - DNA, 17 bp, Homo sapiens
aagtactttaaaaagga

SEQ ID NO: 3285020 - DNA, 20 bp, Homo sapiens
aagtagaaaagttgcagatg

SEQ ID NO: 3285021 - DNA, 21 bp, Homo sapiens
aagtagaaactactaattttt

SEQ ID NO: 3285022 - DNA, 12 bp, Homo sapiens
aagtagaagagg

SEQ ID NO: 3285023 - DNA, 18 bp, Homo sapiens
aagtagacaatcattgtt

SEQ ID NO: 3285024 - DNA, 20 bp, Homo sapiens
aagtagattatggccttttt

SEQ ID NO: 3285025 - DNA, 18 bp, Homo sapiens
aagtagcactgactattt

SEQ ID NO: 3285026 - DNA, 15 bp, Homo sapiens
aagtaggcatgaggg

SEQ ID NO: 3285027 - DNA, 20 bp, Homo sapiens
aagtagggatgcggatcctg

SEQ ID NO: 3285028 - DNA, 14 bp, Homo sapiens
aagtagtctgctca

SEQ ID NO: 3285029 - DNA, 15 bp, Homo sapiens
aagtagtctgctcac

SEQ ID NO: 3285030 - DNA, 17 bp, Homo sapiens
aagtagtgtatcacagt

SEQ ID NO: 3285031 - DNA, 12 bp, Homo sapiens
aagtagtttgta

SEQ ID NO: 3285032 - DNA, 14 bp, Homo sapiens
aagtataatctttc

SEQ ID NO: 3285033 - DNA, 21 bp, Homo sapiens
aagtatacagttcaataaact

SEQ ID NO: 3285034 - DNA, 12 bp, Homo sapiens
aagtatactttt

SEQ ID NO: 3285035 - DNA, 12 bp, Homo sapiens
aagtatagagag

SEQ ID NO: 3285036 - DNA, 18 bp, Homo sapiens
aagtatatacttttaaat

SEQ ID NO: 3285037 - DNA, 19 bp, Homo sapiens
aagtatatacttttaaatt

SEQ ID NO: 3285038 - DNA, 12 bp, Homo sapiens
aagtatatatta

SEQ ID NO: 3285039 - DNA, 16 bp, Homo sapiens
aagtatatattaggat

SEQ ID NO: 3285040 - DNA, 14 bp, Homo sapiens
aagtatattaaaca

SEQ ID NO: 3285041 - DNA, 16 bp, Homo sapiens
aagtatattcttattg

SEQ ID NO: 3285042 - DNA, 19 bp, Homo sapiens
aagtatcttctatttttat

SEQ ID NO: 3285043 - DNA, 20 bp, Homo sapiens
aagtatcttctatttttatc

SEQ ID NO: 3285044 - DNA, 21 bp, Homo sapiens
aagtatcttctatttttatca

SEQ ID NO: 3285045 - DNA, 17 bp, Homo sapiens
aagtatgagggaaaatg

SEQ ID NO: 3285046 - DNA, 21 bp, Homo sapiens
aagtatgagggaaaatgagta

SEQ ID NO: 3285047 - DNA, 22 bp, Homo sapiens
aagtatgtaaagtatgtaaaca

SEQ ID NO: 3285048 - DNA, 15 bp, Homo sapiens
aagtattaacttaca

SEQ ID NO: 3285049 - DNA, 17 bp, Homo sapiens
aagtattcaacaatttc

SEQ ID NO: 3285050 - DNA, 21 bp, Homo sapiens
aagtattcaacaatttcaata

SEQ ID NO: 3285051 - DNA, 12 bp, Homo sapiens
aagtattcacaa

SEQ ID NO: 3285052 - DNA, 18 bp, Homo sapiens
aagtattcttatttaatg

SEQ ID NO: 3285053 - DNA, 19 bp, Homo sapiens
aagtattcttatttaatga

SEQ ID NO: 3285054 - DNA, 22 bp, Homo sapiens
aagtattgcagtctaaaacttc

SEQ ID NO: 3285055 - DNA, 16 bp, Homo sapiens
aagtatttaaatgttc

SEQ ID NO: 3285056 - DNA, 21 bp, Homo sapiens
aagtatttaaatgttctaaca

SEQ ID NO: 3285057 - DNA, 11 bp, Homo sapiens
aagtatttagg

SEQ ID NO: 3285058 - DNA, 13 bp, Homo sapiens
aagtatttatata

SEQ ID NO: 3285059 - DNA, 16 bp, Homo sapiens
aagtatttatatattt

SEQ ID NO: 3285060 - DNA, 18 bp, Homo sapiens
aagtatttatatatttat

SEQ ID NO: 3285061 - DNA, 13 bp, Homo sapiens
aagtatttgggaa

SEQ ID NO: 3285062 - DNA, 15 bp, Homo sapiens
aagtattttgctgga

SEQ ID NO: 3285063 - DNA, 19 bp, Homo sapiens
aagtatttttataaatata

SEQ ID NO: 3285064 - DNA, 15 bp, Homo sapiens
aagtcaaattaataa

SEQ ID NO: 3285065 - DNA, 14 bp, Homo sapiens
aagtcaagaagaat

SEQ ID NO: 3285066 - DNA, 16 bp, Homo sapiens
aagtcaagcacatgta

SEQ ID NO: 3285067 - DNA, 13 bp, Homo sapiens
aagtcacagctgc

SEQ ID NO: 3285068 - DNA, 19 bp, Homo sapiens
aagtcaccactccattccc

SEQ ID NO: 3285069 - DNA, 23 bp, Homo sapiens
aagtcaccaggacttggggtcag

SEQ ID NO: 3285070 - DNA, 13 bp, Homo sapiens
aagtcagaagttt

SEQ ID NO: 3285071 - DNA, 12 bp, Homo sapiens
aagtcagacaga

SEQ ID NO: 3285072 - DNA, 20 bp, Homo sapiens
aagtcagacagatgtcagct

SEQ ID NO: 3285073 - DNA, 16 bp, Homo sapiens
aagtcagactgctggg

SEQ ID NO: 3285074 - DNA, 21 bp, Homo sapiens
aagtcagaggatggccagtgt

SEQ ID NO: 3285075 - DNA, 17 bp, Homo sapiens
aagtcagattgctggga

SEQ ID NO: 3285076 - DNA, 15 bp, Homo sapiens
aagtcagctccagct

SEQ ID NO: 3285077 - DNA, 22 bp, Homo sapiens
aagtcagctccagctttctgcc

SEQ ID NO: 3285078 - DNA, 15 bp, Homo sapiens
aagtcaggtccaatt

SEQ ID NO: 3285079 - DNA, 20 bp, Homo sapiens
aagtcagtcacgtttccttt

SEQ ID NO: 3285080 - DNA, 22 bp, Homo sapiens
aagtcagttgctcaaaaagaaa

SEQ ID NO: 3285081 - DNA, 19 bp, Homo sapiens
aagtcatctacttaataaa

SEQ ID NO: 3285082 - DNA, 21 bp, Homo sapiens
aagtcatctgtttaatttaca

SEQ ID NO: 3285083 - DNA, 13 bp, Homo sapiens
aagtcatcttgct

SEQ ID NO: 3285084 - DNA, 20 bp, Homo sapiens
aagtcatcttgctaccagta

SEQ ID NO: 3285085 - DNA, 20 bp, Homo sapiens
aagtcatggcaggtacagta

SEQ ID NO: 3285086 - DNA, 16 bp, Homo sapiens
aagtcattttaacttt

SEQ ID NO: 3285087 - DNA, 21 bp, Homo sapiens
aagtccaaatgtttacaggga

SEQ ID NO: 3285088 - DNA, 15 bp, Homo sapiens
aagtccacacaaaga

SEQ ID NO: 3285089 - DNA, 19 bp, Homo sapiens
aagtccattttttaaaaat

SEQ ID NO: 3285090 - DNA, 21 bp, Homo sapiens
aagtcccaaattcattgactt

SEQ ID NO: 3285091 - DNA, 18 bp, Homo sapiens
aagtcccagtatacctca

SEQ ID NO: 3285092 - DNA, 23 bp, Homo sapiens
aagtcctgaagaggcgggccagc

SEQ ID NO: 3285093 - DNA, 12 bp, Homo sapiens
aagtcctggcta

SEQ ID NO: 3285094 - DNA, 12 bp, Homo sapiens
aagtcgaaggat

SEQ ID NO: 3285095 - DNA, 15 bp, Homo sapiens
aagtcgaattaatag

SEQ ID NO: 3285096 - DNA, 16 bp, Homo sapiens
aagtctaaatatttcc

SEQ ID NO: 3285097 - DNA, 15 bp, Homo sapiens
aagtctacctgctgg

SEQ ID NO: 3285098 - DNA, 19 bp, Homo sapiens
aagtctacctgctggacag

SEQ ID NO: 3285099 - DNA, 23 bp, Homo sapiens
aagtctatttttttaactgaaaa

SEQ ID NO: 3285100 - DNA, 12 bp, Homo sapiens
aattaaatgtat

SEQ ID NO: 3285101 - DNA, 12 bp, Homo sapiens
aattaaatttaa

SEQ ID NO: 3285102 - DNA, 15 bp, Homo sapiens
aattaacctggtgct

SEQ ID NO: 3285103 - DNA, 11 bp, Homo sapiens
aattaacttga

SEQ ID NO: 3285104 - DNA, 17 bp, Homo sapiens
aattaacttgagtttta

SEQ ID NO: 3285105 - DNA, 14 bp, Homo sapiens
aattaagaaggcaa

SEQ ID NO: 3285106 - DNA, 23 bp, Homo sapiens
aattaagaaggcaaaaatgtaaa

SEQ ID NO: 3285107 - DNA, 13 bp, Homo sapiens
aattaagcaaatg

SEQ ID NO: 3285108 - DNA, 15 bp, Homo sapiens
aattaagcaaatgtt

SEQ ID NO: 3285109 - DNA, 16 bp, Homo sapiens
aattaaggcataagaa

SEQ ID NO: 3285110 - DNA, 18 bp, Homo sapiens
aattaagtaaaccaaaaa

SEQ ID NO: 3285111 - DNA, 13 bp, Homo sapiens
aattaagtactat

SEQ ID NO: 3285112 - DNA, 13 bp, Homo sapiens
aattaagtagaac

SEQ ID NO: 3285113 - DNA, 23 bp, Homo sapiens
aattaataaaaaatggaaagaat

SEQ ID NO: 3285114 - DNA, 15 bp, Homo sapiens
aattaataatcttat

SEQ ID NO: 3285115 - DNA, 22 bp, Homo sapiens
aattaatagtttgtctatttta

SEQ ID NO: 3285116 - DNA, 19 bp, Homo sapiens
aattaatatattaaaattc

SEQ ID NO: 3285117 - DNA, 13 bp, Homo sapiens
aattaatatcttt

SEQ ID NO: 3285118 - DNA, 17 bp, Homo sapiens
aattaatatctttctgc

SEQ ID NO: 3285119 - DNA, 12 bp, Homo sapiens
aattaattgtaa

SEQ ID NO: 3285120 - DNA, 13 bp, Homo sapiens
aattaatttgatt

SEQ ID NO: 3285121 - DNA, 22 bp, Homo sapiens
aattaatttgattaacaaatat

SEQ ID NO: 3285122 - DNA, 13 bp, Homo sapiens
aattaattttact

SEQ ID NO: 3285123 - DNA, 14 bp, Homo sapiens
aattacaattgtca

SEQ ID NO: 3285124 - DNA, 14 bp, Homo sapiens
aattacaattttat

SEQ ID NO: 3285125 - DNA, 12 bp, Homo sapiens
aattacagatgt

SEQ ID NO: 3285126 - DNA, 17 bp, Homo sapiens
aattacagcttcaccct

SEQ ID NO: 3285127 - DNA, 19 bp, Homo sapiens
aattacagcttttatggat

SEQ ID NO: 3285128 - DNA, 15 bp, Homo sapiens
aattacaggagggaa

SEQ ID NO: 3285129 - DNA, 17 bp, Homo sapiens
aattacagttaaagaag

SEQ ID NO: 3285130 - DNA, 13 bp, Homo sapiens
aattacataagtt

SEQ ID NO: 3285131 - DNA, 16 bp, Homo sapiens
aattacatacagattt

SEQ ID NO: 3285132 - DNA, 13 bp, Homo sapiens
aattacatatact

SEQ ID NO: 3285133 - DNA, 17 bp, Homo sapiens
aattacatgtaaaacat

SEQ ID NO: 3285134 - DNA, 21 bp, Homo sapiens
aattaccatgcttcacaatgt

SEQ ID NO: 3285135 - DNA, 18 bp, Homo sapiens
aattacctggatgttctt

SEQ ID NO: 3285136 - DNA, 16 bp, Homo sapiens
aattactaaattgtat

SEQ ID NO: 3285137 - DNA, 15 bp, Homo sapiens
aattactacaaaatt

SEQ ID NO: 3285138 - DNA, 14 bp, Homo sapiens
aattactgttttct

SEQ ID NO: 3285139 - DNA, 14 bp, Homo sapiens
aattactttggtag

SEQ ID NO: 3285140 - DNA, 11 bp, Homo sapiens
aattagaaaat

SEQ ID NO: 3285141 - DNA, 19 bp, Homo sapiens
aattagaaaatattctcta

SEQ ID NO: 3285142 - DNA, 17 bp, Homo sapiens
aattagacactttggaa

SEQ ID NO: 3285143 - DNA, 16 bp, Homo sapiens
aattagagaagctgaa

SEQ ID NO: 3285144 - DNA, 12 bp, Homo sapiens
aattagcaattg

SEQ ID NO: 3285145 - DNA, 14 bp, Homo sapiens
aattagccgggcgt

SEQ ID NO: 3285146 - DNA, 17 bp, Homo sapiens
aattaggaagtgattat

SEQ ID NO: 3285147 - DNA, 21 bp, Homo sapiens
aattaggaagtgtaacagctg

SEQ ID NO: 3285148 - DNA, 21 bp, Homo sapiens
aattaggaggctcaacaataa

SEQ ID NO: 3285149 - DNA, 17 bp, Homo sapiens
aattaggctgtaactac

SEQ ID NO: 3285150 - DNA, 19 bp, Homo sapiens
aattaggctgtaactactt

SEQ ID NO: 3285151 - DNA, 17 bp, Homo sapiens
aattaggggttaaagca

SEQ ID NO: 3285152 - DNA, 16 bp, Homo sapiens
aattagggtacattta

SEQ ID NO: 3285153 - DNA, 18 bp, Homo sapiens
aattaggtttttccttat

SEQ ID NO: 3285154 - DNA, 17 bp, Homo sapiens
aattagtatgtctgttt

SEQ ID NO: 3285155 - DNA, 20 bp, Homo sapiens
aattagtgccacttaatgta

SEQ ID NO: 3285156 - DNA, 15 bp, Homo sapiens
aattataacagttat

SEQ ID NO: 3285157 - DNA, 17 bp, Homo sapiens
aattataacagttatat

SEQ ID NO: 3285158 - DNA, 16 bp, Homo sapiens
aattataagtcacaaa

SEQ ID NO: 3285159 - DNA, 13 bp, Homo sapiens
aattatacaaatt

SEQ ID NO: 3285160 - DNA, 20 bp, Homo sapiens
aattatacaaattaaaaaga

SEQ ID NO: 3285161 - DNA, 13 bp, Homo sapiens
aattatagtttct

SEQ ID NO: 3285162 - DNA, 21 bp, Homo sapiens
aattatagtttctgaggcttt

SEQ ID NO: 3285163 - DNA, 14 bp, Homo sapiens
aattatatttgaaa

SEQ ID NO: 3285164 - DNA, 21 bp, Homo sapiens
aattatcagcaaagaaaaaaa

SEQ ID NO: 3285165 - DNA, 15 bp, Homo sapiens
aattatccagagttt

SEQ ID NO: 3285166 - DNA, 16 bp, Homo sapiens
aattatcctctttgta

SEQ ID NO: 3285167 - DNA, 15 bp, Homo sapiens
aattatcggaagcag

SEQ ID NO: 3285168 - DNA, 19 bp, Homo sapiens
aattatcgggaacagtgtt

SEQ ID NO: 3285169 - DNA, 20 bp, Homo sapiens
aattatcgggaacagtgttt

SEQ ID NO: 3285170 - DNA, 23 bp, Homo sapiens
aattatcgggaacagtgtttccc

SEQ ID NO: 3285171 - DNA, 14 bp, Homo sapiens
aattatctatacat

SEQ ID NO: 3285172 - DNA, 22 bp, Homo sapiens
aattatctatacatatctttat

SEQ ID NO: 3285173 - DNA, 17 bp, Homo sapiens
aattatctcctaattgt

SEQ ID NO: 3285174 - DNA, 20 bp, Homo sapiens
aattatctcctaattgtatg

SEQ ID NO: 3285175 - DNA, 17 bp, Homo sapiens
aattatgagattggttt

SEQ ID NO: 3285176 - DNA, 23 bp, Homo sapiens
aattatgagattggttttcctgt

SEQ ID NO: 3285177 - DNA, 15 bp, Homo sapiens
aattatggaatatca

SEQ ID NO: 3285178 - DNA, 20 bp, Homo sapiens
aattatgtaatatattgtac

SEQ ID NO: 3285179 - DNA, 16 bp, Homo sapiens
aattatgtatgtttac

SEQ ID NO: 3285180 - DNA, 21 bp, Homo sapiens
aattatgtatgtttacatatc

SEQ ID NO: 3285181 - DNA, 12 bp, Homo sapiens
aattatgtgcat

SEQ ID NO: 3285182 - DNA, 18 bp, Homo sapiens
aattatgttttaaacaca

SEQ ID NO: 3285183 - DNA, 20 bp, Homo sapiens
aattattaactacatttatg

SEQ ID NO: 3285184 - DNA, 13 bp, Homo sapiens
aattattatttat

SEQ ID NO: 3285185 - DNA, 22 bp, Homo sapiens
aattattatttatatatgtatt

SEQ ID NO: 3285186 - DNA, 12 bp, Homo sapiens
aattattatttg

SEQ ID NO: 3285187 - DNA, 13 bp, Homo sapiens
aattattcatgct

SEQ ID NO: 3285188 - DNA, 16 bp, Homo sapiens
aattattgatatatat

SEQ ID NO: 3285189 - DNA, 18 bp, Homo sapiens
aattattgatatatatta

SEQ ID NO: 3285190 - DNA, 20 bp, Homo sapiens
aattatttatttatggagga

SEQ ID NO: 3285191 - DNA, 18 bp, Homo sapiens
aattatttgtgtaataga

SEQ ID NO: 3285192 - DNA, 11 bp, Homo sapiens
aattattttaa

SEQ ID NO: 3285193 - DNA, 11 bp, Homo sapiens
aattattttgg

SEQ ID NO: 3285194 - DNA, 14 bp, Homo sapiens
aattcaaaaagtgt

SEQ ID NO: 3285195 - DNA, 16 bp, Homo sapiens
aattcaaaagttccaa

SEQ ID NO: 3285196 - DNA, 20 bp, Homo sapiens
aattcaaactggggcctcca

SEQ ID NO: 3285197 - DNA, 14 bp, Homo sapiens
aattcaaagctcta

SEQ ID NO: 3285198 - DNA, 18 bp, Homo sapiens
aattcaaagctctattaa

SEQ ID NO: 3285199 - DNA, 18 bp, Homo sapiens
aattcaaagcttgtgaaa

SEQ ID NO: 3285200 - DNA, 22 bp, Homo sapiens
aattcaactttgtaaaaatctt

SEQ ID NO: 3285201 - DNA, 20 bp, Homo sapiens
aattcaagaaaacaacttca

SEQ ID NO: 3285202 - DNA, 17 bp, Homo sapiens
aattcaaggaatttctt

SEQ ID NO: 3285203 - DNA, 12 bp, Homo sapiens
aattcaatgatt

SEQ ID NO: 3285204 - DNA, 21 bp, Homo sapiens
aattcaatgtgaacactggca

SEQ ID NO: 3285205 - DNA, 22 bp, Homo sapiens
aattcaatgtgaacactggcac

SEQ ID NO: 3285206 - DNA, 14 bp, Homo sapiens
aattcaattgtaaa

SEQ ID NO: 3285207 - DNA, 19 bp, Homo sapiens
aattcaattgtaaattgaa

SEQ ID NO: 3285208 - DNA, 23 bp, Homo sapiens
aattcaattgtaaattgaatcag

SEQ ID NO: 3285209 - DNA, 14 bp, Homo sapiens
aattcacaaacttt

SEQ ID NO: 3285210 - DNA, 20 bp, Homo sapiens
aattcagatatatttttcac

SEQ ID NO: 3285211 - DNA, 19 bp, Homo sapiens
aattcagatcaaaatgcct

SEQ ID NO: 3285212 - DNA, 17 bp, Homo sapiens
aattcagattgtcttgc

SEQ ID NO: 3285213 - DNA, 18 bp, Homo sapiens
aattcagattgtcttgca

SEQ ID NO: 3285214 - DNA, 15 bp, Homo sapiens
aattcagcaaaccat

SEQ ID NO: 3285215 - DNA, 12 bp, Homo sapiens
aattcagcaccc

SEQ ID NO: 3285216 - DNA, 15 bp, Homo sapiens
aattcagcaccctgg

SEQ ID NO: 3285217 - DNA, 18 bp, Homo sapiens
aattcagcaccctgggtg

SEQ ID NO: 3285218 - DNA, 23 bp, Homo sapiens
aattcagcactgatttcacaaca

SEQ ID NO: 3285219 - DNA, 13 bp, Homo sapiens
aattcagtttcat

SEQ ID NO: 3285220 - DNA, 15 bp, Homo sapiens
aattcagtttcataa

SEQ ID NO: 3285221 - DNA, 18 bp, Homo sapiens
aattcagtttttgtatct

SEQ ID NO: 3285222 - DNA, 17 bp, Homo sapiens
aattcataatcactcta

SEQ ID NO: 3285223 - DNA, 13 bp, Homo sapiens
aattcatattctg

SEQ ID NO: 3285224 - DNA, 15 bp, Homo sapiens
aattcattggctcct

SEQ ID NO: 3285225 - DNA, 12 bp, Homo sapiens
aattcatttgta

SEQ ID NO: 3285226 - DNA, 13 bp, Homo sapiens
aattcatttgtat

SEQ ID NO: 3285227 - DNA, 20 bp, Homo sapiens
aattcatttgtattgcttat

SEQ ID NO: 3285228 - DNA, 16 bp, Homo sapiens
acaaacttgatttctt

SEQ ID NO: 3285229 - DNA, 17 bp, Homo sapiens
acaaagaaacaaagatg

SEQ ID NO: 3285230 - DNA, 15 bp, Homo sapiens
acaaagacattgatt

SEQ ID NO: 3285231 - DNA, 22 bp, Homo sapiens
acaaagatgtttgtcagatatg

SEQ ID NO: 3285232 - DNA, 24 bp, Homo sapiens
acaaagatgtttgtcagatatgat

SEQ ID NO: 3285233 - DNA, 14 bp, Homo sapiens
acaaagcacagtgt

SEQ ID NO: 3285234 - DNA, 16 bp, Homo sapiens
acaaagcacagtttga

SEQ ID NO: 3285235 - DNA, 18 bp, Homo sapiens
acaaagcacagtttgaac

SEQ ID NO: 3285236 - DNA, 23 bp, Homo sapiens
acaaagcactagagaatgcacag

SEQ ID NO: 3285237 - DNA, 18 bp, Homo sapiens
acaaagccaaacaaaact

SEQ ID NO: 3285238 - DNA, 20 bp, Homo sapiens
acaaagccaaacaaaactga

SEQ ID NO: 3285239 - DNA, 17 bp, Homo sapiens
acaaagccaacagtcaa

SEQ ID NO: 3285240 - DNA, 20 bp, Homo sapiens
acaaagccaccctaccatga

SEQ ID NO: 3285241 - DNA, 18 bp, Homo sapiens
acaaagcccttccatgtc

SEQ ID NO: 3285242 - DNA, 18 bp, Homo sapiens
acaaagccttaaaatgca

SEQ ID NO: 3285243 - DNA, 18 bp, Homo sapiens
acaaagccttatcaagtg

SEQ ID NO: 3285244 - DNA, 15 bp, Homo sapiens
acaaagcgtgcacaa

SEQ ID NO: 3285245 - DNA, 16 bp, Homo sapiens
acaaagctgctaaatc

SEQ ID NO: 3285246 - DNA, 13 bp, Homo sapiens
acaaagctgttaa

SEQ ID NO: 3285247 - DNA, 20 bp, Homo sapiens
acaaagcttctatcccagga

SEQ ID NO: 3285248 - DNA, 15 bp, Homo sapiens
acaaagctttgctac

SEQ ID NO: 3285249 - DNA, 16 bp, Homo sapiens
acaaagctttgctaca

SEQ ID NO: 3285250 - DNA, 22 bp, Homo sapiens
acaaagggagggagcaagccct

SEQ ID NO: 3285251 - DNA, 15 bp, Homo sapiens
acaaagggccatcgt

SEQ ID NO: 3285252 - DNA, 19 bp, Homo sapiens
acaaaggtataattttatg

SEQ ID NO: 3285253 - DNA, 24 bp, Homo sapiens
acaaaggttgagatgtaaaaggta

SEQ ID NO: 3285254 - DNA, 14 bp, Homo sapiens
acaaagtaatttct

SEQ ID NO: 3285255 - DNA, 23 bp, Homo sapiens
acaaagttactaggtaacttcat

SEQ ID NO: 3285256 - DNA, 18 bp, Homo sapiens
acaaagtttcagagtata

SEQ ID NO: 3285257 - DNA, 23 bp, Homo sapiens
acaaatactcttaggaagagaaa

SEQ ID NO: 3285258 - DNA, 14 bp, Homo sapiens
acaaatagattttt

SEQ ID NO: 3285259 - DNA, 17 bp, Homo sapiens
acaaatatgctaatttg

SEQ ID NO: 3285260 - DNA, 13 bp, Homo sapiens
acaaatatttaga

SEQ ID NO: 3285261 - DNA, 20 bp, Homo sapiens
acaaatatttatatatttga

SEQ ID NO: 3285262 - DNA, 16 bp, Homo sapiens
acaaatattttcatgt

SEQ ID NO: 3285263 - DNA, 16 bp, Homo sapiens
acaaatcaacagaagc

SEQ ID NO: 3285264 - DNA, 14 bp, Homo sapiens
acaaatcagaagtc

SEQ ID NO: 3285265 - DNA, 20 bp, Homo sapiens
acaaatctgtgtatattatt

SEQ ID NO: 3285266 - DNA, 14 bp, Homo sapiens
acaaatctttaaga

SEQ ID NO: 3285267 - DNA, 19 bp, Homo sapiens
acaaatgccttgaactgtt

SEQ ID NO: 3285268 - DNA, 23 bp, Homo sapiens
acaaatgccttgaactgttgtct

SEQ ID NO: 3285269 - DNA, 15 bp, Homo sapiens
acaaatgctctgtct

SEQ ID NO: 3285270 - DNA, 20 bp, Homo sapiens
acaaatggtgaatggatttc

SEQ ID NO: 3285271 - DNA, 14 bp, Homo sapiens
acaaatgtattttg

SEQ ID NO: 3285272 - DNA, 15 bp, Homo sapiens
acaaatgtattttga

SEQ ID NO: 3285273 - DNA, 23 bp, Homo sapiens
acaaatgtattttgaagaatatt

SEQ ID NO: 3285274 - DNA, 12 bp, Homo sapiens
acaaatgtgtat

SEQ ID NO: 3285275 - DNA, 13 bp, Homo sapiens
acaaattaatttt

SEQ ID NO: 3285276 - DNA, 17 bp, Homo sapiens
acaaattcatattctgt

SEQ ID NO: 3285277 - DNA, 17 bp, Homo sapiens
acaaattgtcgttttta

SEQ ID NO: 3285278 - DNA, 17 bp, Homo sapiens
acaaatttatgcatttc

SEQ ID NO: 3285279 - DNA, 21 bp, Homo sapiens
acaaatttatgcatttcattc

SEQ ID NO: 3285280 - DNA, 15 bp, Homo sapiens
acaacaacctggtca

SEQ ID NO: 3285281 - DNA, 13 bp, Homo sapiens
acaacaagagttt

SEQ ID NO: 3285282 - DNA, 14 bp, Homo sapiens
acaacaatccttct

SEQ ID NO: 3285283 - DNA, 17 bp, Homo sapiens
acaacaccttcctcctg

SEQ ID NO: 3285284 - DNA, 16 bp, Homo sapiens
acaacacttaatagca

SEQ ID NO: 3285285 - DNA, 16 bp, Homo sapiens
acaacagaaaaacaat

SEQ ID NO: 3285286 - DNA, 13 bp, Homo sapiens
acaacagaagctt

SEQ ID NO: 3285287 - DNA, 19 bp, Homo sapiens
acaacagaagcttcagaag

SEQ ID NO: 3285288 - DNA, 14 bp, Homo sapiens
acaacagaataaag

SEQ ID NO: 3285289 - DNA, 16 bp, Homo sapiens
acaacagcagtctcct

SEQ ID NO: 3285290 - DNA, 23 bp, Homo sapiens
acaacagcagtctccttcagcac

SEQ ID NO: 3285291 - DNA, 18 bp, Homo sapiens
acaacagctcgatccaaa

SEQ ID NO: 3285292 - DNA, 16 bp, Homo sapiens
acaacagctgaagcac

SEQ ID NO: 3285293 - DNA, 19 bp, Homo sapiens
acaacatccatgtcctatg

SEQ ID NO: 3285294 - DNA, 15 bp, Homo sapiens
acaaccactggtctg

SEQ ID NO: 3285295 - DNA, 13 bp, Homo sapiens
acaaccattaaag

SEQ ID NO: 3285296 - DNA, 18 bp, Homo sapiens
acaaccattaaagtcaga

SEQ ID NO: 3285297 - DNA, 16 bp, Homo sapiens
acaacctccctcttgt

SEQ ID NO: 3285298 - DNA, 18 bp, Homo sapiens
acaacctccctcttgttt

SEQ ID NO: 3285299 - DNA, 20 bp, Homo sapiens
acaacctccctcttgttttg

SEQ ID NO: 3285300 - DNA, 22 bp, Homo sapiens
acaacctccctcttgttttgtt

SEQ ID NO: 3285301 - DNA, 23 bp, Homo sapiens
acaacctccctcttgttttgttt

SEQ ID NO: 3285302 - DNA, 20 bp, Homo sapiens
acaacctctctgatcttgtg

SEQ ID NO: 3285303 - DNA, 15 bp, Homo sapiens
acaacctgaaagaca

SEQ ID NO: 3285304 - DNA, 17 bp, Homo sapiens
acaacctgaaagacaaa

SEQ ID NO: 3285305 - DNA, 19 bp, Homo sapiens
acaacctgtgtgagagaat

SEQ ID NO: 3285306 - DNA, 18 bp, Homo sapiens
acaaccttctgtggctca

SEQ ID NO: 3285307 - DNA, 16 bp, Homo sapiens
acaacgtaaaaataaa

SEQ ID NO: 3285308 - DNA, 17 bp, Homo sapiens
acaactatggatcagaa

SEQ ID NO: 3285309 - DNA, 22 bp, Homo sapiens
acaactcccttaaggtctccaa

SEQ ID NO: 3285310 - DNA, 14 bp, Homo sapiens
acaactgacacagg

SEQ ID NO: 3285311 - DNA, 15 bp, Homo sapiens
acaactgacacagga

SEQ ID NO: 3285312 - DNA, 18 bp, Homo sapiens
acaactgcaataacttct

SEQ ID NO: 3285313 - DNA, 16 bp, Homo sapiens
acaactggacaagatt

SEQ ID NO: 3285314 - DNA, 17 bp, Homo sapiens
acaactggagttttttt

SEQ ID NO: 3285315 - DNA, 14 bp, Homo sapiens
acaacttaaataat

SEQ ID NO: 3285316 - DNA, 18 bp, Homo sapiens
acaacttcccagtgaatt

SEQ ID NO: 3285317 - DNA, 17 bp, Homo sapiens
acaacttggcatttcta

SEQ ID NO: 3285318 - DNA, 20 bp, Homo sapiens
acaactttgtcgtggttctt

SEQ ID NO: 3285319 - DNA, 19 bp, Homo sapiens
acaagaaacgtgtcacact

SEQ ID NO: 3285320 - DNA, 15 bp, Homo sapiens
acaagaactgaaacc

SEQ ID NO: 3285321 - DNA, 15 bp, Homo sapiens
acaagaaggaacaat

SEQ ID NO: 3285322 - DNA, 23 bp, Homo sapiens
acaagaagggttttccaccctgg

SEQ ID NO: 3285323 - DNA, 14 bp, Homo sapiens
acaagaatggatca

SEQ ID NO: 3285324 - DNA, 19 bp, Homo sapiens
acaagaccccgtctcaaaa

SEQ ID NO: 3285325 - DNA, 21 bp, Homo sapiens
acaagagacttaaaggacagg

SEQ ID NO: 3285326 - DNA, 14 bp, Homo sapiens
acaagagcagcctg

SEQ ID NO: 3285327 - DNA, 15 bp, Homo sapiens
acaagagcagcctgt

SEQ ID NO: 3285328 - DNA, 17 bp, Homo sapiens
acaagagtccctttgaa

SEQ ID NO: 3285329 - DNA, 13 bp, Homo sapiens
acaagatccattt

SEQ ID NO: 3285330 - DNA, 15 bp, Homo sapiens
acaagatctttcagg

SEQ ID NO: 3285331 - DNA, 18 bp, Homo sapiens
acaagatggaatttatca

SEQ ID NO: 3285332 - DNA, 20 bp, Homo sapiens
acaagatttccttgtgcaaa

SEQ ID NO: 3285333 - DNA, 11 bp, Homo sapiens
acaagcaacaa

SEQ ID NO: 3285334 - DNA, 17 bp, Homo sapiens
acaagcaatgcaagaaa

SEQ ID NO: 3285335 - DNA, 17 bp, Homo sapiens
acaagcactattttata

SEQ ID NO: 3285336 - DNA, 20 bp, Homo sapiens
acaagcactattttatattt

SEQ ID NO: 3285337 - DNA, 11 bp, Homo sapiens
acaagcagagg

SEQ ID NO: 3285338 - DNA, 20 bp, Homo sapiens
acaagcagagtgcacagctg

SEQ ID NO: 3285339 - DNA, 21 bp, Homo sapiens
acaagcagagtgcacagctgt

SEQ ID NO: 3285340 - DNA, 19 bp, Homo sapiens
acaagcatgcagctttgca

SEQ ID NO: 3285341 - DNA, 21 bp, Homo sapiens
acaagccaacttgtaaataca

SEQ ID NO: 3285342 - DNA, 20 bp, Homo sapiens
acaagccacaagtcttccag

SEQ ID NO: 3285343 - DNA, 12 bp, Homo sapiens
acaagccacccc

SEQ ID NO: 3285344 - DNA, 14 bp, Homo sapiens
acaagcccaaattt

SEQ ID NO: 3285345 - DNA, 19 bp, Homo sapiens
acaagcccaaatttaattt

SEQ ID NO: 3285346 - DNA, 22 bp, Homo sapiens
acaagcccgttagccccaggga

SEQ ID NO: 3285347 - DNA, 19 bp, Homo sapiens
acaagccctgcttttgcat

SEQ ID NO: 3285348 - DNA, 14 bp, Homo sapiens
acaagccctggcaa

SEQ ID NO: 3285349 - DNA, 17 bp, Homo sapiens
acaagcctcctgtacct

SEQ ID NO: 3285350 - DNA, 17 bp, Homo sapiens
acaagcctgagaactga

SEQ ID NO: 3285351 - DNA, 15 bp, Homo sapiens
acaagcgctcccagc

SEQ ID NO: 3285352 - DNA, 18 bp, Homo sapiens
acaagcgctcccagcctg

SEQ ID NO: 3285353 - DNA, 21 bp, Homo sapiens
acaagcgctcccagcctgccc

SEQ ID NO: 3285354 - DNA, 15 bp, Homo sapiens
acacttggtgtactg

SEQ ID NO: 3285355 - DNA, 20 bp, Homo sapiens
acacttggttagacgccttc

SEQ ID NO: 3285356 - DNA, 16 bp, Homo sapiens
acacttgtataaatgt

SEQ ID NO: 3285357 - DNA, 13 bp, Homo sapiens
acacttgtgtgtg

SEQ ID NO: 3285358 - DNA, 18 bp, Homo sapiens
acacttgtgtgtgggctg

SEQ ID NO: 3285359 - DNA, 12 bp, Homo sapiens
acactttctctt

SEQ ID NO: 3285360 - DNA, 17 bp, Homo sapiens
acactttgagcattttt

SEQ ID NO: 3285361 - DNA, 22 bp, Homo sapiens
acactttgccatttgcttgtac

SEQ ID NO: 3285362 - DNA, 16 bp, Homo sapiens
acactttgcctcctgt

SEQ ID NO: 3285363 - DNA, 16 bp, Homo sapiens
acactttggtcatttc

SEQ ID NO: 3285364 - DNA, 12 bp, Homo sapiens
acactttgtatt

SEQ ID NO: 3285365 - DNA, 16 bp, Homo sapiens
acagaaaaagcatgat

SEQ ID NO: 3285366 - DNA, 22 bp, Homo sapiens
acagaaaaataagtcaaaagga

SEQ ID NO: 3285367 - DNA, 22 bp, Homo sapiens
acagaaagtcattccttctttt

SEQ ID NO: 3285368 - DNA, 18 bp, Homo sapiens
acagaaatatatatacat

SEQ ID NO: 3285369 - DNA, 21 bp, Homo sapiens
acagaaatcagaggagagacg

SEQ ID NO: 3285370 - DNA, 22 bp, Homo sapiens
acagaaatggggaattctctaa

SEQ ID NO: 3285371 - DNA, 20 bp, Homo sapiens
acagaacagcttcaggttat

SEQ ID NO: 3285372 - DNA, 14 bp, Homo sapiens
acagaacaggaggt

SEQ ID NO: 3285373 - DNA, 20 bp, Homo sapiens
acagaacaggaggtgtgaat

SEQ ID NO: 3285374 - DNA, 17 bp, Homo sapiens
acagaacatcattagaa

SEQ ID NO: 3285375 - DNA, 20 bp, Homo sapiens
acagaacctactgttccttt

SEQ ID NO: 3285376 - DNA, 21 bp, Homo sapiens
acagaaccttcaacccagtgg

SEQ ID NO: 3285377 - DNA, 14 bp, Homo sapiens
acagaactaaatgt

SEQ ID NO: 3285378 - DNA, 13 bp, Homo sapiens
acagaactccctt

SEQ ID NO: 3285379 - DNA, 15 bp, Homo sapiens
acagaactcccttca

SEQ ID NO: 3285380 - DNA, 14 bp, Homo sapiens
acagaacttcagaa

SEQ ID NO: 3285381 - DNA, 21 bp, Homo sapiens
acagaacttcagaaagacttg

SEQ ID NO: 3285382 - DNA, 19 bp, Homo sapiens
acagaacttgaatgtgtca

SEQ ID NO: 3285383 - DNA, 16 bp, Homo sapiens
acagaactttccccaa

SEQ ID NO: 3285384 - DNA, 15 bp, Homo sapiens
acagaagagaaggaa

SEQ ID NO: 3285385 - DNA, 22 bp, Homo sapiens
acagaagcagttgagtcgtcat

SEQ ID NO: 3285386 - DNA, 12 bp, Homo sapiens
acagaagcattt

SEQ ID NO: 3285387 - DNA, 13 bp, Homo sapiens
acagaagcatttg

SEQ ID NO: 3285388 - DNA, 16 bp, Homo sapiens
acagaagcatttgtat

SEQ ID NO: 3285389 - DNA, 22 bp, Homo sapiens
acagaagcatttgtattttgtg

SEQ ID NO: 3285390 - DNA, 16 bp, Homo sapiens
acagaagcctgtttca

SEQ ID NO: 3285391 - DNA, 13 bp, Homo sapiens
acagaagcttcca

SEQ ID NO: 3285392 - DNA, 13 bp, Homo sapiens
acagaataaagca

SEQ ID NO: 3285393 - DNA, 17 bp, Homo sapiens
acagaataaagcagcct

SEQ ID NO: 3285394 - DNA, 12 bp, Homo sapiens
acagaatatttc

SEQ ID NO: 3285395 - DNA, 19 bp, Homo sapiens
acagaatggctatcaaaag

SEQ ID NO: 3285396 - DNA, 14 bp, Homo sapiens
acagaatgtatctg

SEQ ID NO: 3285397 - DNA, 18 bp, Homo sapiens
acagaatgtatctgtgaa

SEQ ID NO: 3285398 - DNA, 20 bp, Homo sapiens
acagaatgtatctgtgaagt

SEQ ID NO: 3285399 - DNA, 21 bp, Homo sapiens
acagaatgttttactgtgaaa

SEQ ID NO: 3285400 - DNA, 17 bp, Homo sapiens
acagacacaatatgtat

SEQ ID NO: 3285401 - DNA, 23 bp, Homo sapiens
acagacacaatatgtatgctttt

SEQ ID NO: 3285402 - DNA, 11 bp, Homo sapiens
acagacacaca

SEQ ID NO: 3285403 - DNA, 12 bp, Homo sapiens
acagacacacac

SEQ ID NO: 3285404 - DNA, 14 bp, Homo sapiens
acagacacacacac

SEQ ID NO: 3285405 - DNA, 15 bp, Homo sapiens
acagacacacacacg

SEQ ID NO: 3285406 - DNA, 23 bp, Homo sapiens
acagacacacacacgcacgcaca

SEQ ID NO: 3285407 - DNA, 15 bp, Homo sapiens
acagacacaggcccg

SEQ ID NO: 3285408 - DNA, 23 bp, Homo sapiens
acagacacaggcccggctccagg

SEQ ID NO: 3285409 - DNA, 18 bp, Homo sapiens
acagacactaagttatag

SEQ ID NO: 3285410 - DNA, 15 bp, Homo sapiens
acagacactacatat

SEQ ID NO: 3285411 - DNA, 14 bp, Homo sapiens
acagacactggcat

SEQ ID NO: 3285412 - DNA, 15 bp, Homo sapiens
acagacagaagagaa

SEQ ID NO: 3285413 - DNA, 14 bp, Homo sapiens
acagaccacttgcc

SEQ ID NO: 3285414 - DNA, 20 bp, Homo sapiens
acagaccagtgaccccagaa

SEQ ID NO: 3285415 - DNA, 23 bp, Homo sapiens
acagacccaggtcttccagacct

SEQ ID NO: 3285416 - DNA, 15 bp, Homo sapiens
acagacccctgggag

SEQ ID NO: 3285417 - DNA, 15 bp, Homo sapiens
acagacctgcttttt

SEQ ID NO: 3285418 - DNA, 16 bp, Homo sapiens
acagacctgctttttg

SEQ ID NO: 3285419 - DNA, 19 bp, Homo sapiens
acagacctggagcccctgg

SEQ ID NO: 3285420 - DNA, 22 bp, Homo sapiens
acagacctggagcccctgggtg

SEQ ID NO: 3285421 - DNA, 21 bp, Homo sapiens
acagactggaagcacagcttc

SEQ ID NO: 3285422 - DNA, 22 bp, Homo sapiens
acagactggaagcacagcttca

SEQ ID NO: 3285423 - DNA, 18 bp, Homo sapiens
acagactggcaataaact

SEQ ID NO: 3285424 - DNA, 19 bp, Homo sapiens
acagactggcaataaactc

SEQ ID NO: 3285425 - DNA, 21 bp, Homo sapiens
acagacttctggaaggctggc

SEQ ID NO: 3285426 - DNA, 17 bp, Homo sapiens
acagacttgagaacttg

SEQ ID NO: 3285427 - DNA, 12 bp, Homo sapiens
acagactttctg

SEQ ID NO: 3285428 - DNA, 21 bp, Homo sapiens
acagactttctgtgacgcaga

SEQ ID NO: 3285429 - DNA, 11 bp, Homo sapiens
acagagaaagt

SEQ ID NO: 3285430 - DNA, 16 bp, Homo sapiens
acagagaaggcagcag

SEQ ID NO: 3285431 - DNA, 23 bp, Homo sapiens
acagagacaggcccaagagatga

SEQ ID NO: 3285432 - DNA, 19 bp, Homo sapiens
acagagacattcctccgag

SEQ ID NO: 3285433 - DNA, 22 bp, Homo sapiens
acagagactcagcgctcctcct

SEQ ID NO: 3285434 - DNA, 23 bp, Homo sapiens
acagagactcagcgctcctcctg

SEQ ID NO: 3285435 - DNA, 23 bp, Homo sapiens
acagagagacagacttgagaact

SEQ ID NO: 3285436 - DNA, 16 bp, Homo sapiens
acagagagaggggaga

SEQ ID NO: 3285437 - DNA, 16 bp, Homo sapiens
acagagaggactgtag

SEQ ID NO: 3285438 - DNA, 18 bp, Homo sapiens
acagagaggagaaacaca

SEQ ID NO: 3285439 - DNA, 22 bp, Homo sapiens
acagagagtcccactgcctcag

SEQ ID NO: 3285440 - DNA, 22 bp, Homo sapiens
acagagattactttgctgcctt

SEQ ID NO: 3285441 - DNA, 12 bp, Homo sapiens
acagagcacttg

SEQ ID NO: 3285442 - DNA, 18 bp, Homo sapiens
acagagcaggggctccag

SEQ ID NO: 3285443 - DNA, 16 bp, Homo sapiens
acagagccaaaatgcc

SEQ ID NO: 3285444 - DNA, 18 bp, Homo sapiens
acagagccgagcaatatt

SEQ ID NO: 3285445 - DNA, 13 bp, Homo sapiens
acagagcctgcct

SEQ ID NO: 3285446 - DNA, 14 bp, Homo sapiens
acagagcctgccta

SEQ ID NO: 3285447 - DNA, 21 bp, Homo sapiens
acagagcgagagtctgtctca

SEQ ID NO: 3285448 - DNA, 19 bp, Homo sapiens
acagaggaaacaatattta

SEQ ID NO: 3285449 - DNA, 19 bp, Homo sapiens
acagaggaagaatttgtta

SEQ ID NO: 3285450 - DNA, 13 bp, Homo sapiens
acagaggcagccc

SEQ ID NO: 3285451 - DNA, 23 bp, Homo sapiens
acagaggcagccccattctgcct

SEQ ID NO: 3285452 - DNA, 17 bp, Homo sapiens
acagaggccatgggcct

SEQ ID NO: 3285453 - DNA, 20 bp, Homo sapiens
acagagggctagggaggtgg

SEQ ID NO: 3285454 - DNA, 16 bp, Homo sapiens
acagagggctgcattc

SEQ ID NO: 3285455 - DNA, 22 bp, Homo sapiens
acagaggtattaaaactaaatt

SEQ ID NO: 3285456 - DNA, 23 bp, Homo sapiens
acagaggtcaggaagcaggggtg

SEQ ID NO: 3285457 - DNA, 21 bp, Homo sapiens
acagagtgagactctgtctca

SEQ ID NO: 3285458 - DNA, 19 bp, Homo sapiens
acagagtggcctccctgct

SEQ ID NO: 3285459 - DNA, 19 bp, Homo sapiens
acagagtggtctttctgga

SEQ ID NO: 3285460 - DNA, 21 bp, Homo sapiens
acagagtggtctttctggaga

SEQ ID NO: 3285461 - DNA, 16 bp, Homo sapiens
acagagtggtttccaa

SEQ ID NO: 3285462 - DNA, 18 bp, Homo sapiens
acagagtgtggactctgg

SEQ ID NO: 3285463 - DNA, 20 bp, Homo sapiens
acagagttaaatatgcatct

SEQ ID NO: 3285464 - DNA, 13 bp, Homo sapiens
acagagttcacag

SEQ ID NO: 3285465 - DNA, 16 bp, Homo sapiens
acagagttcacaggag

SEQ ID NO: 3285466 - DNA, 16 bp, Homo sapiens
acagagttgatttttt

SEQ ID NO: 3285467 - DNA, 20 bp, Homo sapiens
acagagttttcactcttatt

SEQ ID NO: 3285468 - DNA, 13 bp, Homo sapiens
acagataagcaag

SEQ ID NO: 3285469 - DNA, 19 bp, Homo sapiens
acagataagcaagagagat

SEQ ID NO: 3285470 - DNA, 20 bp, Homo sapiens
acagataagcaagagagatg

SEQ ID NO: 3285471 - DNA, 17 bp, Homo sapiens
acagataattcatttgt

SEQ ID NO: 3285472 - DNA, 15 bp, Homo sapiens
acagatacacacaca

SEQ ID NO: 3285473 - DNA, 19 bp, Homo sapiens
acagataccagacctcttc

SEQ ID NO: 3285474 - DNA, 14 bp, Homo sapiens
acagatagagagtt

SEQ ID NO: 3285475 - DNA, 14 bp, Homo sapiens
acagatataaatgg

SEQ ID NO: 3285476 - DNA, 19 bp, Homo sapiens
acagatatactttgtggac

SEQ ID NO: 3285477 - DNA, 18 bp, Homo sapiens
acagatatctttttcatt

SEQ ID NO: 3285478 - DNA, 18 bp, Homo sapiens
acagatcccactggaaga

SEQ ID NO: 3285479 - DNA, 16 bp, Homo sapiens
acagcttagatttcat

SEQ ID NO: 3285480 - DNA, 17 bp, Homo sapiens
acagcttagatttcata

SEQ ID NO: 3285481 - DNA, 20 bp, Homo sapiens
acagcttcatgcctttgtaa

SEQ ID NO: 3285482 - DNA, 17 bp, Homo sapiens
acagcttcatttcctgt

SEQ ID NO: 3285483 - DNA, 19 bp, Homo sapiens
acagcttcatttcctgtgt

SEQ ID NO: 3285484 - DNA, 12 bp, Homo sapiens
acagcttctctg

SEQ ID NO: 3285485 - DNA, 17 bp, Homo sapiens
acagcttctctgcagta

SEQ ID NO: 3285486 - DNA, 21 bp, Homo sapiens
acagcttgacctgaggctgtg

SEQ ID NO: 3285487 - DNA, 19 bp, Homo sapiens
acagctttgctccgctccc

SEQ ID NO: 3285488 - DNA, 22 bp, Homo sapiens
acagctttgctccgctcccacc

SEQ ID NO: 3285489 - DNA, 14 bp, Homo sapiens
acagcttttgcaac

SEQ ID NO: 3285490 - DNA, 14 bp, Homo sapiens
acaggaaaaacaaa

SEQ ID NO: 3285491 - DNA, 15 bp, Homo sapiens
acaggaaaagctgct

SEQ ID NO: 3285492 - DNA, 17 bp, Homo sapiens
acaggaaagccctcccc

SEQ ID NO: 3285493 - DNA, 18 bp, Homo sapiens
acaggaatgaagaactgt

SEQ ID NO: 3285494 - DNA, 18 bp, Homo sapiens
acaggacagagttcacag

SEQ ID NO: 3285495 - DNA, 22 bp, Homo sapiens
acaggacagagttcacaggagg

SEQ ID NO: 3285496 - DNA, 15 bp, Homo sapiens
acaggaccctcagga

SEQ ID NO: 3285497 - DNA, 15 bp, Homo sapiens
acaggactctgcctc

SEQ ID NO: 3285498 - DNA, 21 bp, Homo sapiens
acaggactgaaaagggaatca

SEQ ID NO: 3285499 - DNA, 16 bp, Homo sapiens
acaggactgattctgg

SEQ ID NO: 3285500 - DNA, 23 bp, Homo sapiens
acaggactgattctgggatgctc

SEQ ID NO: 3285501 - DNA, 17 bp, Homo sapiens
acaggactgtaaagatt

SEQ ID NO: 3285502 - DNA, 14 bp, Homo sapiens
acaggagacctggc

SEQ ID NO: 3285503 - DNA, 14 bp, Homo sapiens
acaggagaggcagc

SEQ ID NO: 3285504 - DNA, 17 bp, Homo sapiens
acaggaggattgcctga

SEQ ID NO: 3285505 - DNA, 16 bp, Homo sapiens
acaggaggcggcccgg

SEQ ID NO: 3285506 - DNA, 17 bp, Homo sapiens
acaggaggcggcccggc

SEQ ID NO: 3285507 - DNA, 20 bp, Homo sapiens
acaggagtcagtgtctggct

SEQ ID NO: 3285508 - DNA, 19 bp, Homo sapiens
acaggataaagatatcaat

SEQ ID NO: 3285509 - DNA, 15 bp, Homo sapiens
acaggatattagaca

SEQ ID NO: 3285510 - DNA, 21 bp, Homo sapiens
acaggatgccagcccctgcct

SEQ ID NO: 3285511 - DNA, 23 bp, Homo sapiens
acaggatgccagcccctgcctgg

SEQ ID NO: 3285512 - DNA, 18 bp, Homo sapiens
acaggattgatcattctt

SEQ ID NO: 3285513 - DNA, 18 bp, Homo sapiens
acaggcaagcacctcctg

SEQ ID NO: 3285514 - DNA, 13 bp, Homo sapiens
acaggcaattccg

SEQ ID NO: 3285515 - DNA, 17 bp, Homo sapiens
acaggcacacagggccc

SEQ ID NO: 3285516 - DNA, 23 bp, Homo sapiens
acaggcacccaccatcatgtctg

SEQ ID NO: 3285517 - DNA, 20 bp, Homo sapiens
acaggcaccgagaatgttgt

SEQ ID NO: 3285518 - DNA, 21 bp, Homo sapiens
acaggcaccgagaatgttgta

SEQ ID NO: 3285519 - DNA, 13 bp, Homo sapiens
acaggcacgggtc

SEQ ID NO: 3285520 - DNA, 21 bp, Homo sapiens
acaggcactccaaacctgtct

SEQ ID NO: 3285521 - DNA, 21 bp, Homo sapiens
acaggcagctggatgagactt

SEQ ID NO: 3285522 - DNA, 19 bp, Homo sapiens
acaggcagctttctagaag

SEQ ID NO: 3285523 - DNA, 14 bp, Homo sapiens
acaggcaggtccag

SEQ ID NO: 3285524 - DNA, 14 bp, Homo sapiens
acaggcagtgcatg

SEQ ID NO: 3285525 - DNA, 15 bp, Homo sapiens
acaggcagtgcatgt

SEQ ID NO: 3285526 - DNA, 18 bp, Homo sapiens
acaggcagtgcatgtgaa

SEQ ID NO: 3285527 - DNA, 21 bp, Homo sapiens
acaggcatgggtgcaaggaaa

SEQ ID NO: 3285528 - DNA, 22 bp, Homo sapiens
acaggcatgggtgcaaggaaaa

SEQ ID NO: 3285529 - DNA, 15 bp, Homo sapiens
acaggcatgttctct

SEQ ID NO: 3285530 - DNA, 18 bp, Homo sapiens
acaggcatgttctctgag

SEQ ID NO: 3285531 - DNA, 19 bp, Homo sapiens
acaggcatgttctctgagg

SEQ ID NO: 3285532 - DNA, 22 bp, Homo sapiens
acaggcatgttctctgaggaca

SEQ ID NO: 3285533 - DNA, 18 bp, Homo sapiens
acaggcccaagagatgaa

SEQ ID NO: 3285534 - DNA, 11 bp, Homo sapiens
acaggcccaga

SEQ ID NO: 3285535 - DNA, 12 bp, Homo sapiens
acaggcccagca

SEQ ID NO: 3285536 - DNA, 20 bp, Homo sapiens
acaggcccagcgcggccagc

SEQ ID NO: 3285537 - DNA, 14 bp, Homo sapiens
acaggcccagggag

SEQ ID NO: 3285538 - DNA, 21 bp, Homo sapiens
acaggccctgctcctgcagca

SEQ ID NO: 3285539 - DNA, 20 bp, Homo sapiens
acaggccctggagaagcagc

SEQ ID NO: 3285540 - DNA, 12 bp, Homo sapiens
acaggccctggc

SEQ ID NO: 3285541 - DNA, 13 bp, Homo sapiens
acaggcctccctg

SEQ ID NO: 3285542 - DNA, 20 bp, Homo sapiens
acaggcctctcttttccccg

SEQ ID NO: 3285543 - DNA, 20 bp, Homo sapiens
acaggcctgaagatattact

SEQ ID NO: 3285544 - DNA, 13 bp, Homo sapiens
acaggcgagagag

SEQ ID NO: 3285545 - DNA, 21 bp, Homo sapiens
acaggcgagagaggagccaga

SEQ ID NO: 3285546 - DNA, 13 bp, Homo sapiens
acaggctcttagc

SEQ ID NO: 3285547 - DNA, 12 bp, Homo sapiens
acaggctgaaga

SEQ ID NO: 3285548 - DNA, 17 bp, Homo sapiens
acaggctgggcttcagt

SEQ ID NO: 3285549 - DNA, 21 bp, Homo sapiens
acaggctgggcttcagtggca

SEQ ID NO: 3285550 - DNA, 12 bp, Homo sapiens
acaggctgtaaa

SEQ ID NO: 3285551 - DNA, 15 bp, Homo sapiens
acaggctgtaaattg

SEQ ID NO: 3285552 - DNA, 20 bp, Homo sapiens
acaggctgtaaattgaactt

SEQ ID NO: 3285553 - DNA, 20 bp, Homo sapiens
acagggaacattggagctga

SEQ ID NO: 3285554 - DNA, 13 bp, Homo sapiens
acagggagcctcc

SEQ ID NO: 3285555 - DNA, 14 bp, Homo sapiens
acagggagcctcct

SEQ ID NO: 3285556 - DNA, 19 bp, Homo sapiens
acagggagcctcctgccca

SEQ ID NO: 3285557 - DNA, 15 bp, Homo sapiens
acagggcaccagagg

SEQ ID NO: 3285558 - DNA, 16 bp, Homo sapiens
acagggcaccagaggc

SEQ ID NO: 3285559 - DNA, 15 bp, Homo sapiens
acagggccagaggga

SEQ ID NO: 3285560 - DNA, 19 bp, Homo sapiens
acagggccagtggggcctg

SEQ ID NO: 3285561 - DNA, 20 bp, Homo sapiens
acagggccagtggggcctgt

SEQ ID NO: 3285562 - DNA, 21 bp, Homo sapiens
acagggcccgcagtgctggga

SEQ ID NO: 3285563 - DNA, 16 bp, Homo sapiens
acaggggcaggcctgg

SEQ ID NO: 3285564 - DNA, 21 bp, Homo sapiens
acagggtccccgagtgcctag

SEQ ID NO: 3285565 - DNA, 17 bp, Homo sapiens
acagggtctcttccttc

SEQ ID NO: 3285566 - DNA, 23 bp, Homo sapiens
acagggtctgctctttctctgcc

SEQ ID NO: 3285567 - DNA, 20 bp, Homo sapiens
acagggtcttttttcatttc

SEQ ID NO: 3285568 - DNA, 16 bp, Homo sapiens
acagggttcaaaatgt

SEQ ID NO: 3285569 - DNA, 14 bp, Homo sapiens
acaggtaaaacagg

SEQ ID NO: 3285570 - DNA, 16 bp, Homo sapiens
acaggtaaaacagggc

SEQ ID NO: 3285571 - DNA, 19 bp, Homo sapiens
acaggtatatactttgaaa

SEQ ID NO: 3285572 - DNA, 18 bp, Homo sapiens
acaggtcccacctccagc

SEQ ID NO: 3285573 - DNA, 15 bp, Homo sapiens
acaggtccctcccct

SEQ ID NO: 3285574 - DNA, 18 bp, Homo sapiens
acaggtgctaatttgttt

SEQ ID NO: 3285575 - DNA, 23 bp, Homo sapiens
acaggtgggatatgctagaaaag

SEQ ID NO: 3285576 - DNA, 19 bp, Homo sapiens
acaggtgtgaaccaccaca

SEQ ID NO: 3285577 - DNA, 23 bp, Homo sapiens
acaggtgtgaaccaccacaccca

SEQ ID NO: 3285578 - DNA, 23 bp, Homo sapiens
acaggtgtgagtcaccaagccca

SEQ ID NO: 3285579 - DNA, 17 bp, Homo sapiens
acaggtgtggtgtaatt

SEQ ID NO: 3285580 - DNA, 18 bp, Homo sapiens
acaggtgtggtgtaattt

SEQ ID NO: 3285581 - DNA, 18 bp, Homo sapiens
acaggtgtttgactttca

SEQ ID NO: 3285582 - DNA, 18 bp, Homo sapiens
acaggttacgaagacaaa

SEQ ID NO: 3285583 - DNA, 18 bp, Homo sapiens
acaggttataacagtgtt

SEQ ID NO: 3285584 - DNA, 20 bp, Homo sapiens
acaggttcttaaaaaggaac

SEQ ID NO: 3285585 - DNA, 22 bp, Homo sapiens
acaggtttggggagggggaaga

SEQ ID NO: 3285586 - DNA, 21 bp, Homo sapiens
acaggttttagcattgtcttg

SEQ ID NO: 3285587 - DNA, 14 bp, Homo sapiens
acaggttttataat

SEQ ID NO: 3285588 - DNA, 20 bp, Homo sapiens
acagtaaaagccttattcta

SEQ ID NO: 3285589 - DNA, 10 bp, Homo sapiens
acagtaactt

SEQ ID NO: 3285590 - DNA, 20 bp, Homo sapiens
acagtaagaacatcataaaa

SEQ ID NO: 3285591 - DNA, 17 bp, Homo sapiens
acagtacagcatgtgcc

SEQ ID NO: 3285592 - DNA, 17 bp, Homo sapiens
acagtacctgattgtat

SEQ ID NO: 3285593 - DNA, 14 bp, Homo sapiens
acagtactttattg

SEQ ID NO: 3285594 - DNA, 15 bp, Homo sapiens
acagtagagccagct

SEQ ID NO: 3285595 - DNA, 23 bp, Homo sapiens
acagtagtcttgatgaccaaagt

SEQ ID NO: 3285596 - DNA, 21 bp, Homo sapiens
acagtatcccacatccaactc

SEQ ID NO: 3285597 - DNA, 15 bp, Homo sapiens
acagtattacttctg

SEQ ID NO: 3285598 - DNA, 17 bp, Homo sapiens
acagtattttggttctt

SEQ ID NO: 3285599 - DNA, 13 bp, Homo sapiens
acagtcaaaataa

SEQ ID NO: 3285600 - DNA, 13 bp, Homo sapiens
acagtcacattcg

SEQ ID NO: 3285601 - DNA, 20 bp, Homo sapiens
acagtcactgccactttgca

SEQ ID NO: 3285602 - DNA, 16 bp, Homo sapiens
acagtcagcatgcttc

SEQ ID NO: 3285603 - DNA, 21 bp, Homo sapiens
acagtcagcatgcttcccaga

SEQ ID NO: 3285604 - DNA, 18 bp, Homo sapiens
acatttataatgtttgct

SEQ ID NO: 3285605 - DNA, 13 bp, Homo sapiens
acatttataattg

SEQ ID NO: 3285606 - DNA, 14 bp, Homo sapiens
acatttataattgc

SEQ ID NO: 3285607 - DNA, 14 bp, Homo sapiens
acatttattctgct

SEQ ID NO: 3285608 - DNA, 13 bp, Homo sapiens
acatttatttcct

SEQ ID NO: 3285609 - DNA, 14 bp, Homo sapiens
acatttcaaagctg

SEQ ID NO: 3285610 - DNA, 18 bp, Homo sapiens
acatttcacattgaatca

SEQ ID NO: 3285611 - DNA, 24 bp, Homo sapiens
acatttcacctactttgtaagtga

SEQ ID NO: 3285612 - DNA, 17 bp, Homo sapiens
acatttcagggagaaac

SEQ ID NO: 3285613 - DNA, 23 bp, Homo sapiens
acatttcagggagaaactccaaa

SEQ ID NO: 3285614 - DNA, 16 bp, Homo sapiens
acatttcatacaacag

SEQ ID NO: 3285615 - DNA, 13 bp, Homo sapiens
acatttcccaggg

SEQ ID NO: 3285616 - DNA, 21 bp, Homo sapiens
acatttctctaactcctgcca

SEQ ID NO: 3285617 - DNA, 15 bp, Homo sapiens
acatttctggacagt

SEQ ID NO: 3285618 - DNA, 13 bp, Homo sapiens
acatttctggatt

SEQ ID NO: 3285619 - DNA, 12 bp, Homo sapiens
acatttctgttc

SEQ ID NO: 3285620 - DNA, 14 bp, Homo sapiens
acatttctgttctc

SEQ ID NO: 3285621 - DNA, 19 bp, Homo sapiens
acatttcttctagtgatga

SEQ ID NO: 3285622 - DNA, 20 bp, Homo sapiens
acatttgagggcccagccag

SEQ ID NO: 3285623 - DNA, 18 bp, Homo sapiens
acatttgatagaaaggaa

SEQ ID NO: 3285624 - DNA, 19 bp, Homo sapiens
acatttgatatttttccat

SEQ ID NO: 3285625 - DNA, 20 bp, Homo sapiens
acatttgatatttttccatt

SEQ ID NO: 3285626 - DNA, 20 bp, Homo sapiens
acatttgatgcatgtctttt

SEQ ID NO: 3285627 - DNA, 22 bp, Homo sapiens
acatttgatgcatgtcttttaa

SEQ ID NO: 3285628 - DNA, 21 bp, Homo sapiens
acatttgccttgcagaactgc

SEQ ID NO: 3285629 - DNA, 17 bp, Homo sapiens
acatttgctactgttgt

SEQ ID NO: 3285630 - DNA, 19 bp, Homo sapiens
acatttgctactgttgtaa

SEQ ID NO: 3285631 - DNA, 21 bp, Homo sapiens
acatttgggagacatgtgaca

SEQ ID NO: 3285632 - DNA, 18 bp, Homo sapiens
acatttgtcacagaaatc

SEQ ID NO: 3285633 - DNA, 17 bp, Homo sapiens
acattttaaaggataat

SEQ ID NO: 3285634 - DNA, 17 bp, Homo sapiens
acattttaaataaaaga

SEQ ID NO: 3285635 - DNA, 13 bp, Homo sapiens
acattttaattca

SEQ ID NO: 3285636 - DNA, 22 bp, Homo sapiens
acattttatttttaaaatatta

SEQ ID NO: 3285637 - DNA, 17 bp, Homo sapiens
acattttcatgcttcca

SEQ ID NO: 3285638 - DNA, 18 bp, Homo sapiens
acattttggtgagaaatg

SEQ ID NO: 3285639 - DNA, 18 bp, Homo sapiens
acattttgttcttacaca

SEQ ID NO: 3285640 - DNA, 19 bp, Homo sapiens
acattttgttcttacacat

SEQ ID NO: 3285641 - DNA, 23 bp, Homo sapiens
acattttgttgtaaaaagaaaaa

SEQ ID NO: 3285642 - DNA, 21 bp, Homo sapiens
acatttttaatttaacaaact

SEQ ID NO: 3285643 - DNA, 22 bp, Homo sapiens
acatttttaatttaacaaacta

SEQ ID NO: 3285644 - DNA, 21 bp, Homo sapiens
acatttttatttagttgaaaa

SEQ ID NO: 3285645 - DNA, 17 bp, Homo sapiens
accaaaaaagtattttt

SEQ ID NO: 3285646 - DNA, 22 bp, Homo sapiens
accaaaaaagtatttttttaag

SEQ ID NO: 3285647 - DNA, 21 bp, Homo sapiens
accaaaaaggctagtttattt

SEQ ID NO: 3285648 - DNA, 15 bp, Homo sapiens
accaaaacttccaag

SEQ ID NO: 3285649 - DNA, 16 bp, Homo sapiens
accaaaatgacaatga

SEQ ID NO: 3285650 - DNA, 14 bp, Homo sapiens
accaaactcacgga

SEQ ID NO: 3285651 - DNA, 17 bp, Homo sapiens
accaaagacatcagtct

SEQ ID NO: 3285652 - DNA, 18 bp, Homo sapiens
accaaagagggcttcctc

SEQ ID NO: 3285653 - DNA, 13 bp, Homo sapiens
accaaagcatcaa

SEQ ID NO: 3285654 - DNA, 24 bp, Homo sapiens
accaaagcatcaatacaaccagcc

SEQ ID NO: 3285655 - DNA, 12 bp, Homo sapiens
accaaagctgcc

SEQ ID NO: 3285656 - DNA, 19 bp, Homo sapiens
accaaagctgcccactgtt

SEQ ID NO: 3285657 - DNA, 17 bp, Homo sapiens
accaaaggacattatgt

SEQ ID NO: 3285658 - DNA, 21 bp, Homo sapiens
accaaaggacattatgtgtgc

SEQ ID NO: 3285659 - DNA, 18 bp, Homo sapiens
accaaagtatttttttat

SEQ ID NO: 3285660 - DNA, 11 bp, Homo sapiens
accaaagttct

SEQ ID NO: 3285661 - DNA, 12 bp, Homo sapiens
accaaagttcta

SEQ ID NO: 3285662 - DNA, 21 bp, Homo sapiens
accaaagttctaataatttct

SEQ ID NO: 3285663 - DNA, 12 bp, Homo sapiens
accaaagtttta

SEQ ID NO: 3285664 - DNA, 16 bp, Homo sapiens
accaaataaaaatatt

SEQ ID NO: 3285665 - DNA, 15 bp, Homo sapiens
accaaatacacattt

SEQ ID NO: 3285666 - DNA, 16 bp, Homo sapiens
accaaatacacatttc

SEQ ID NO: 3285667 - DNA, 16 bp, Homo sapiens
accaaatagtgtgaaa

SEQ ID NO: 3285668 - DNA, 14 bp, Homo sapiens
accaaatatgttaa

SEQ ID NO: 3285669 - DNA, 16 bp, Homo sapiens
accaaatatgttaaag

SEQ ID NO: 3285670 - DNA, 17 bp, Homo sapiens
accaaatattaaagatt

SEQ ID NO: 3285671 - DNA, 15 bp, Homo sapiens
accaaatctggaagc

SEQ ID NO: 3285672 - DNA, 19 bp, Homo sapiens
accaaattgcactgaagtt

SEQ ID NO: 3285673 - DNA, 13 bp, Homo sapiens
accaaattttaat

SEQ ID NO: 3285674 - DNA, 14 bp, Homo sapiens
accaaattttaatt

SEQ ID NO: 3285675 - DNA, 22 bp, Homo sapiens
accaacacccaaagcatggact

SEQ ID NO: 3285676 - DNA, 15 bp, Homo sapiens
accaaccctcagagc

SEQ ID NO: 3285677 - DNA, 19 bp, Homo sapiens
accaacctgaagacaccgt

SEQ ID NO: 3285678 - DNA, 17 bp, Homo sapiens
accaacctttaaaattg

SEQ ID NO: 3285679 - DNA, 23 bp, Homo sapiens
accaacgggaccccctggccctg

SEQ ID NO: 3285680 - DNA, 20 bp, Homo sapiens
accaacgttactcagggctc

SEQ ID NO: 3285681 - DNA, 20 bp, Homo sapiens
accaactagacattctgtcg

SEQ ID NO: 3285682 - DNA, 13 bp, Homo sapiens
accaactctaata

SEQ ID NO: 3285683 - DNA, 16 bp, Homo sapiens
accaactgtgttgtat

SEQ ID NO: 3285684 - DNA, 18 bp, Homo sapiens
accaactgtgttgtatta

SEQ ID NO: 3285685 - DNA, 23 bp, Homo sapiens
accaactgtgttgtattaacaaa

SEQ ID NO: 3285686 - DNA, 13 bp, Homo sapiens
accaactttctgt

SEQ ID NO: 3285687 - DNA, 19 bp, Homo sapiens
accaactttctgtaaactc

SEQ ID NO: 3285688 - DNA, 15 bp, Homo sapiens
accaagagtaacttt

SEQ ID NO: 3285689 - DNA, 15 bp, Homo sapiens
accaagcaggagacg

SEQ ID NO: 3285690 - DNA, 14 bp, Homo sapiens
accaagctgagttt

SEQ ID NO: 3285691 - DNA, 16 bp, Homo sapiens
accaaggcaaggcagg

SEQ ID NO: 3285692 - DNA, 18 bp, Homo sapiens
accaaggcaaggcaggtg

SEQ ID NO: 3285693 - DNA, 20 bp, Homo sapiens
accaaggcaaggcaggtgcc

SEQ ID NO: 3285694 - DNA, 15 bp, Homo sapiens
accaaggcagcctcc

SEQ ID NO: 3285695 - DNA, 22 bp, Homo sapiens
accaaggcagcctccagagcca

SEQ ID NO: 3285696 - DNA, 13 bp, Homo sapiens
accaagtcctggc

SEQ ID NO: 3285697 - DNA, 19 bp, Homo sapiens
accaagtcggaacagcaga

SEQ ID NO: 3285698 - DNA, 16 bp, Homo sapiens
accaagtggaccttga

SEQ ID NO: 3285699 - DNA, 18 bp, Homo sapiens
accaagtgtgctaaaaat

SEQ ID NO: 3285700 - DNA, 13 bp, Homo sapiens
accaagtgtgctc

SEQ ID NO: 3285701 - DNA, 23 bp, Homo sapiens
accaataacaaggagctcaccct

SEQ ID NO: 3285702 - DNA, 20 bp, Homo sapiens
accaatattatactaagaaa

SEQ ID NO: 3285703 - DNA, 20 bp, Homo sapiens
accaatcattttaattatta

SEQ ID NO: 3285704 - DNA, 13 bp, Homo sapiens
accaatctctgct

SEQ ID NO: 3285705 - DNA, 14 bp, Homo sapiens
accaatctctgctc

SEQ ID NO: 3285706 - DNA, 12 bp, Homo sapiens
accaatgattca

SEQ ID NO: 3285707 - DNA, 21 bp, Homo sapiens
accaatgattcataacaatgt

SEQ ID NO: 3285708 - DNA, 22 bp, Homo sapiens
accaatgattcataacaatgta

SEQ ID NO: 3285709 - DNA, 14 bp, Homo sapiens
accaatgcccagca

SEQ ID NO: 3285710 - DNA, 19 bp, Homo sapiens
accaatgcttttatcaaac

SEQ ID NO: 3285711 - DNA, 22 bp, Homo sapiens
accaatggtgatcctctatttt

SEQ ID NO: 3285712 - DNA, 12 bp, Homo sapiens
accaatttcttc

SEQ ID NO: 3285713 - DNA, 14 bp, Homo sapiens
accaatttcttcct

SEQ ID NO: 3285714 - DNA, 15 bp, Homo sapiens
accaatttcttcctt

SEQ ID NO: 3285715 - DNA, 14 bp, Homo sapiens
accacaaaaatgaa

SEQ ID NO: 3285716 - DNA, 20 bp, Homo sapiens
accacaaagcacagtttgaa

SEQ ID NO: 3285717 - DNA, 15 bp, Homo sapiens
accacaactgacaca

SEQ ID NO: 3285718 - DNA, 16 bp, Homo sapiens
accacaactgacacag

SEQ ID NO: 3285719 - DNA, 14 bp, Homo sapiens
accacacaaagaca

SEQ ID NO: 3285720 - DNA, 12 bp, Homo sapiens
accacacagtcc

SEQ ID NO: 3285721 - DNA, 17 bp, Homo sapiens
accacacagtccccaga

SEQ ID NO: 3285722 - DNA, 13 bp, Homo sapiens
accacacccagcc

SEQ ID NO: 3285723 - DNA, 15 bp, Homo sapiens
accacacccagcctc

SEQ ID NO: 3285724 - DNA, 17 bp, Homo sapiens
accacacccagcctcag

SEQ ID NO: 3285725 - DNA, 22 bp, Homo sapiens
accacacccagcctcagtcctc

SEQ ID NO: 3285726 - DNA, 24 bp, Homo sapiens
accacacccagcctcagtcctccc

SEQ ID NO: 3285727 - DNA, 16 bp, Homo sapiens
accacaccgcagaagc

SEQ ID NO: 3285728 - DNA, 16 bp, Homo sapiens
accacactacacagca

SEQ ID NO: 3285729 - DNA, 14 bp, Homo sapiens
accacactttcaaa

SEQ ID NO: 3285730 - DNA, 18 bp, Homo sapiens
acccctcgccacctttca

SEQ ID NO: 3285731 - DNA, 13 bp, Homo sapiens
acccctctggcca

SEQ ID NO: 3285732 - DNA, 15 bp, Homo sapiens
acccctctggccagg

SEQ ID NO: 3285733 - DNA, 13 bp, Homo sapiens
acccctctgtagc

SEQ ID NO: 3285734 - DNA, 16 bp, Homo sapiens
acccctgactcatcat

SEQ ID NO: 3285735 - DNA, 19 bp, Homo sapiens
acccctgaggaagatgggg

SEQ ID NO: 3285736 - DNA, 10 bp, Homo sapiens
acccctgccc

SEQ ID NO: 3285737 - DNA, 12 bp, Homo sapiens
acccctgccccc

SEQ ID NO: 3285738 - DNA, 17 bp, Homo sapiens
acccctgcccccagccc

SEQ ID NO: 3285739 - DNA, 21 bp, Homo sapiens
acccctgcctcccatgcctgg

SEQ ID NO: 3285740 - DNA, 11 bp, Homo sapiens
acccctgcctg

SEQ ID NO: 3285741 - DNA, 15 bp, Homo sapiens
acccctgctcccagc

SEQ ID NO: 3285742 - DNA, 17 bp, Homo sapiens
acccctgctcccagcct

SEQ ID NO: 3285743 - DNA, 21 bp, Homo sapiens
acccctgctcccagcctgctg

SEQ ID NO: 3285744 - DNA, 19 bp, Homo sapiens
acccctgctcccattcctc

SEQ ID NO: 3285745 - DNA, 22 bp, Homo sapiens
acccctgctcccattcctccct

SEQ ID NO: 3285746 - DNA, 17 bp, Homo sapiens
acccctggcttttcact

SEQ ID NO: 3285747 - DNA, 20 bp, Homo sapiens
acccctggcttttcactgct

SEQ ID NO: 3285748 - DNA, 14 bp, Homo sapiens
acccctgggcctca

SEQ ID NO: 3285749 - DNA, 21 bp, Homo sapiens
acccctgggcctcatcacagc

SEQ ID NO: 3285750 - DNA, 22 bp, Homo sapiens
acccctgtgctccgtgcctcca

SEQ ID NO: 3285751 - DNA, 16 bp, Homo sapiens
accccttacttagcat

SEQ ID NO: 3285752 - DNA, 15 bp, Homo sapiens
accccttagcctccc

SEQ ID NO: 3285753 - DNA, 17 bp, Homo sapiens
accccttagcctccctg

SEQ ID NO: 3285754 - DNA, 14 bp, Homo sapiens
accccttaggcccc

SEQ ID NO: 3285755 - DNA, 16 bp, Homo sapiens
accccttccagatcac

SEQ ID NO: 3285756 - DNA, 12 bp, Homo sapiens
accccttcccca

SEQ ID NO: 3285757 - DNA, 23 bp, Homo sapiens
accccttccccaggcccaccatc

SEQ ID NO: 3285758 - DNA, 15 bp, Homo sapiens
accccttctctcctc

SEQ ID NO: 3285759 - DNA, 16 bp, Homo sapiens
accccttgctcccttc

SEQ ID NO: 3285760 - DNA, 18 bp, Homo sapiens
accccttggaggagagag

SEQ ID NO: 3285761 - DNA, 19 bp, Homo sapiens
accccttggaggagagaga

SEQ ID NO: 3285762 - DNA, 22 bp, Homo sapiens
accccttggaggagagagaccc

SEQ ID NO: 3285763 - DNA, 17 bp, Homo sapiens
acccctttctggctctc

SEQ ID NO: 3285764 - DNA, 14 bp, Homo sapiens
acccctttcttctc

SEQ ID NO: 3285765 - DNA, 12 bp, Homo sapiens
acccgatgctgc

SEQ ID NO: 3285766 - DNA, 18 bp, Homo sapiens
acccgcctctcccgtcag

SEQ ID NO: 3285767 - DNA, 16 bp, Homo sapiens
acccgctttcttgctg

SEQ ID NO: 3285768 - DNA, 24 bp, Homo sapiens
acccgggaccaaactcacggacca

SEQ ID NO: 3285769 - DNA, 18 bp, Homo sapiens
acccggggccagagacat

SEQ ID NO: 3285770 - DNA, 19 bp, Homo sapiens
acccggtttctttttaagt

SEQ ID NO: 3285771 - DNA, 16 bp, Homo sapiens
acccgtgagcgcctgt

SEQ ID NO: 3285772 - DNA, 17 bp, Homo sapiens
acccgtggggtgctgcc

SEQ ID NO: 3285773 - DNA, 14 bp, Homo sapiens
accctaaaatttta

SEQ ID NO: 3285774 - DNA, 15 bp, Homo sapiens
accctaaagggagaa

SEQ ID NO: 3285775 - DNA, 21 bp, Homo sapiens
accctaatctttcacttgaaa

SEQ ID NO: 3285776 - DNA, 19 bp, Homo sapiens
accctaccaactttactgt

SEQ ID NO: 3285777 - DNA, 18 bp, Homo sapiens
accctacttcttttgctc

SEQ ID NO: 3285778 - DNA, 19 bp, Homo sapiens
accctagccaatgtctcct

SEQ ID NO: 3285779 - DNA, 16 bp, Homo sapiens
accctagccagagaat

SEQ ID NO: 3285780 - DNA, 17 bp, Homo sapiens
accctagccagagaata

SEQ ID NO: 3285781 - DNA, 17 bp, Homo sapiens
accctagccttgcttgt

SEQ ID NO: 3285782 - DNA, 19 bp, Homo sapiens
accctaggttcccggtccc

SEQ ID NO: 3285783 - DNA, 19 bp, Homo sapiens
accctaggttccctgttct

SEQ ID NO: 3285784 - DNA, 22 bp, Homo sapiens
accctaggttccctgttcttcc

SEQ ID NO: 3285785 - DNA, 22 bp, Homo sapiens
accctagtcccttcccctccct

SEQ ID NO: 3285786 - DNA, 21 bp, Homo sapiens
accctagttagtgttttgcct

SEQ ID NO: 3285787 - DNA, 21 bp, Homo sapiens
accctagttctacctcaggca

SEQ ID NO: 3285788 - DNA, 19 bp, Homo sapiens
accctatgggtctaggaca

SEQ ID NO: 3285789 - DNA, 14 bp, Homo sapiens
accctcaccccctc

SEQ ID NO: 3285790 - DNA, 20 bp, Homo sapiens
accctcaccccctcctggca

SEQ ID NO: 3285791 - DNA, 15 bp, Homo sapiens
accctcactctgcca

SEQ ID NO: 3285792 - DNA, 16 bp, Homo sapiens
accctcactctgccag

SEQ ID NO: 3285793 - DNA, 17 bp, Homo sapiens
accctcactctgccagg

SEQ ID NO: 3285794 - DNA, 23 bp, Homo sapiens
accctcaggcataggcctgggtg

SEQ ID NO: 3285795 - DNA, 19 bp, Homo sapiens
accctcatggcccccaggg

SEQ ID NO: 3285796 - DNA, 16 bp, Homo sapiens
accctcattgtgtttc

SEQ ID NO: 3285797 - DNA, 21 bp, Homo sapiens
accctccaagtctgtacctca

SEQ ID NO: 3285798 - DNA, 14 bp, Homo sapiens
accctccacttccc

SEQ ID NO: 3285799 - DNA, 15 bp, Homo sapiens
accctccagagacaa

SEQ ID NO: 3285800 - DNA, 16 bp, Homo sapiens
accctccagtgctgga

SEQ ID NO: 3285801 - DNA, 13 bp, Homo sapiens
accctcccacccc

SEQ ID NO: 3285802 - DNA, 16 bp, Homo sapiens
accctcccatggcacc

SEQ ID NO: 3285803 - DNA, 10 bp, Homo sapiens
accctccccc

SEQ ID NO: 3285804 - DNA, 18 bp, Homo sapiens
accctcccccagacacag

SEQ ID NO: 3285805 - DNA, 23 bp, Homo sapiens
accctcccccaggaggtcgaccc

SEQ ID NO: 3285806 - DNA, 13 bp, Homo sapiens
accctcccctctc

SEQ ID NO: 3285807 - DNA, 17 bp, Homo sapiens
accctcccgctgcaagt

SEQ ID NO: 3285808 - DNA, 15 bp, Homo sapiens
accctccgccttcac

SEQ ID NO: 3285809 - DNA, 15 bp, Homo sapiens
accctcctcttggaa

SEQ ID NO: 3285810 - DNA, 14 bp, Homo sapiens
accctcctgtaaat

SEQ ID NO: 3285811 - DNA, 17 bp, Homo sapiens
accctcctgtaaatggt

SEQ ID NO: 3285812 - DNA, 17 bp, Homo sapiens
accctccttgagactgg

SEQ ID NO: 3285813 - DNA, 18 bp, Homo sapiens
accctccttgagactgga

SEQ ID NO: 3285814 - DNA, 16 bp, Homo sapiens
accctcgaagcgcgcc

SEQ ID NO: 3285815 - DNA, 16 bp, Homo sapiens
accctcgggcccacct

SEQ ID NO: 3285816 - DNA, 19 bp, Homo sapiens
accctcgggcccacctggc

SEQ ID NO: 3285817 - DNA, 22 bp, Homo sapiens
accctcggggggtcacaggccc

SEQ ID NO: 3285818 - DNA, 23 bp, Homo sapiens
accctcggggggtcacaggccca

SEQ ID NO: 3285819 - DNA, 20 bp, Homo sapiens
accctctcctgggggtggca

SEQ ID NO: 3285820 - DNA, 22 bp, Homo sapiens
accctctcctgggggtggcagg

SEQ ID NO: 3285821 - DNA, 22 bp, Homo sapiens
accctctcctgtctgccctctg

SEQ ID NO: 3285822 - DNA, 15 bp, Homo sapiens
accctctgaccctag

SEQ ID NO: 3285823 - DNA, 14 bp, Homo sapiens
accctctgcagaac

SEQ ID NO: 3285824 - DNA, 19 bp, Homo sapiens
accctctgggaacctccca

SEQ ID NO: 3285825 - DNA, 23 bp, Homo sapiens
accctctgggaacctcccagagg

SEQ ID NO: 3285826 - DNA, 16 bp, Homo sapiens
accctcttcctgtgat

SEQ ID NO: 3285827 - DNA, 17 bp, Homo sapiens
accctgagactccagaa

SEQ ID NO: 3285828 - DNA, 17 bp, Homo sapiens
accctgagagtctgaga

SEQ ID NO: 3285829 - DNA, 14 bp, Homo sapiens
accctgaggtcagg

SEQ ID NO: 3285830 - DNA, 20 bp, Homo sapiens
accctgaggtcagggagtgc

SEQ ID NO: 3285831 - DNA, 23 bp, Homo sapiens
accctgaggtcagggagtgctgg

SEQ ID NO: 3285832 - DNA, 17 bp, Homo sapiens
accctgagttttgtttt

SEQ ID NO: 3285833 - DNA, 16 bp, Homo sapiens
accctgcaaggcccac

SEQ ID NO: 3285834 - DNA, 17 bp, Homo sapiens
accctgcaaggcccaca

SEQ ID NO: 3285835 - DNA, 22 bp, Homo sapiens
accctgccccccctaagagaca

SEQ ID NO: 3285836 - DNA, 14 bp, Homo sapiens
accctgcccctgca

SEQ ID NO: 3285837 - DNA, 22 bp, Homo sapiens
accctgcgaaggggccctggtc

SEQ ID NO: 3285838 - DNA, 13 bp, Homo sapiens
accctgctccctg

SEQ ID NO: 3285839 - DNA, 16 bp, Homo sapiens
accctggaaaggggag

SEQ ID NO: 3285840 - DNA, 19 bp, Homo sapiens
accctggaattcagcaccc

SEQ ID NO: 3285841 - DNA, 16 bp, Homo sapiens
accctggatcagtcct

SEQ ID NO: 3285842 - DNA, 16 bp, Homo sapiens
accctgggagacagac

SEQ ID NO: 3285843 - DNA, 17 bp, Homo sapiens
accctgggagacagacc

SEQ ID NO: 3285844 - DNA, 17 bp, Homo sapiens
accctgggccctgggct

SEQ ID NO: 3285845 - DNA, 20 bp, Homo sapiens
accctgggccctgggctgga

SEQ ID NO: 3285846 - DNA, 19 bp, Homo sapiens
accctggggaaggagccag

SEQ ID NO: 3285847 - DNA, 21 bp, Homo sapiens
accctgggtgccattcccagc

SEQ ID NO: 3285848 - DNA, 18 bp, Homo sapiens
accctgggtgggctctgt

SEQ ID NO: 3285849 - DNA, 19 bp, Homo sapiens
accctgggtgggctctgtg

SEQ ID NO: 3285850 - DNA, 16 bp, Homo sapiens
accctggtgcctggct

SEQ ID NO: 3285851 - DNA, 22 bp, Homo sapiens
accctgtactgttctgtgtctt

SEQ ID NO: 3285852 - DNA, 20 bp, Homo sapiens
accctgtcaagttaacaagg

SEQ ID NO: 3285853 - DNA, 21 bp, Homo sapiens
accctgtcaagttaacaagga

SEQ ID NO: 3285854 - DNA, 16 bp, Homo sapiens
accctgtcccccagct

SEQ ID NO: 3285855 - DNA, 20 bp, Homo sapiens
accctgtcccccagctctgg

SEQ ID NO: 3285856 - DNA, 22 bp, Homo sapiens
accttaagacctactgttctaa

SEQ ID NO: 3285857 - DNA, 19 bp, Homo sapiens
accttaagatttttctttt

SEQ ID NO: 3285858 - DNA, 13 bp, Homo sapiens
accttaatgacaa

SEQ ID NO: 3285859 - DNA, 18 bp, Homo sapiens
accttaatgacaacactt

SEQ ID NO: 3285860 - DNA, 15 bp, Homo sapiens
accttactgtggagg

SEQ ID NO: 3285861 - DNA, 18 bp, Homo sapiens
accttagataatatttct

SEQ ID NO: 3285862 - DNA, 21 bp, Homo sapiens
accttagctggcattacagct

SEQ ID NO: 3285863 - DNA, 22 bp, Homo sapiens
accttagctggcattacagctg

SEQ ID NO: 3285864 - DNA, 13 bp, Homo sapiens
accttaggccttc

SEQ ID NO: 3285865 - DNA, 16 bp, Homo sapiens
accttaggccttcctc

SEQ ID NO: 3285866 - DNA, 21 bp, Homo sapiens
accttaggccttcctctctcc

SEQ ID NO: 3285867 - DNA, 22 bp, Homo sapiens
accttagggtggctttaattgt

SEQ ID NO: 3285868 - DNA, 23 bp, Homo sapiens
accttatctgtgcgtgaaacaca

SEQ ID NO: 3285869 - DNA, 17 bp, Homo sapiens
accttcaattcctgggc

SEQ ID NO: 3285870 - DNA, 18 bp, Homo sapiens
accttcactctccagggt

SEQ ID NO: 3285871 - DNA, 17 bp, Homo sapiens
accttcagactttgctt

SEQ ID NO: 3285872 - DNA, 23 bp, Homo sapiens
accttcatctgaaacccacagat

SEQ ID NO: 3285873 - DNA, 15 bp, Homo sapiens
accttcattttgagg

SEQ ID NO: 3285874 - DNA, 17 bp, Homo sapiens
accttcccatgccctgg

SEQ ID NO: 3285875 - DNA, 21 bp, Homo sapiens
accttccccacccttgagaag

SEQ ID NO: 3285876 - DNA, 13 bp, Homo sapiens
accttccctccaa

SEQ ID NO: 3285877 - DNA, 12 bp, Homo sapiens
accttcctcact

SEQ ID NO: 3285878 - DNA, 17 bp, Homo sapiens
accttcctcctgcagac

SEQ ID NO: 3285879 - DNA, 14 bp, Homo sapiens
accttccttcctgt

SEQ ID NO: 3285880 - DNA, 14 bp, Homo sapiens
accttcgggctgtg

SEQ ID NO: 3285881 - DNA, 18 bp, Homo sapiens
accttcggggcctgtctg

SEQ ID NO: 3285882 - DNA, 19 bp, Homo sapiens
accttcggggcctgtctga

SEQ ID NO: 3285883 - DNA, 16 bp, Homo sapiens
accttctagaattata

SEQ ID NO: 3285884 - DNA, 14 bp, Homo sapiens
accttctccaaatg

SEQ ID NO: 3285885 - DNA, 14 bp, Homo sapiens
accttctgtcccca

SEQ ID NO: 3285886 - DNA, 19 bp, Homo sapiens
accttctgtccccagccct

SEQ ID NO: 3285887 - DNA, 20 bp, Homo sapiens
accttctgtccccagccctg

SEQ ID NO: 3285888 - DNA, 13 bp, Homo sapiens
accttctgtggct

SEQ ID NO: 3285889 - DNA, 15 bp, Homo sapiens
accttctgtggctca

SEQ ID NO: 3285890 - DNA, 16 bp, Homo sapiens
accttctgtggctcac

SEQ ID NO: 3285891 - DNA, 15 bp, Homo sapiens
accttctgtggctgt

SEQ ID NO: 3285892 - DNA, 18 bp, Homo sapiens
accttcttatttaatctt

SEQ ID NO: 3285893 - DNA, 17 bp, Homo sapiens
accttcttggcgctgga

SEQ ID NO: 3285894 - DNA, 17 bp, Homo sapiens
accttctttcactctgt

SEQ ID NO: 3285895 - DNA, 20 bp, Homo sapiens
accttctttctggactggcg

SEQ ID NO: 3285896 - DNA, 23 bp, Homo sapiens
accttgaaaaaaaacagtggatc

SEQ ID NO: 3285897 - DNA, 15 bp, Homo sapiens
accttgacagggcac

SEQ ID NO: 3285898 - DNA, 16 bp, Homo sapiens
accttgacagggcaca

SEQ ID NO: 3285899 - DNA, 22 bp, Homo sapiens
accttgagtcagaaaacagaga

SEQ ID NO: 3285900 - DNA, 22 bp, Homo sapiens
accttgatcccaatccttatcc

SEQ ID NO: 3285901 - DNA, 15 bp, Homo sapiens
accttgcaacttcat

SEQ ID NO: 3285902 - DNA, 18 bp, Homo sapiens
accttgccttagaaacac

SEQ ID NO: 3285903 - DNA, 13 bp, Homo sapiens
accttgctaattt

SEQ ID NO: 3285904 - DNA, 17 bp, Homo sapiens
accttgctgtcctgatc

SEQ ID NO: 3285905 - DNA, 19 bp, Homo sapiens
accttggacatcctcctcc

SEQ ID NO: 3285906 - DNA, 10 bp, Homo sapiens
accttgtaaa

SEQ ID NO: 3285907 - DNA, 23 bp, Homo sapiens
accttgtaaaaaaagcaaaaatg

SEQ ID NO: 3285908 - DNA, 14 bp, Homo sapiens
accttgtagcatgt

SEQ ID NO: 3285909 - DNA, 13 bp, Homo sapiens
accttgtgcccag

SEQ ID NO: 3285910 - DNA, 15 bp, Homo sapiens
accttgtggccgcct

SEQ ID NO: 3285911 - DNA, 21 bp, Homo sapiens
accttgtgtctgtacacgtgt

SEQ ID NO: 3285912 - DNA, 17 bp, Homo sapiens
accttgttctatttttc

SEQ ID NO: 3285913 - DNA, 21 bp, Homo sapiens
accttgtttggggcacagtag

SEQ ID NO: 3285914 - DNA, 14 bp, Homo sapiens
acctttaagaattt

SEQ ID NO: 3285915 - DNA, 21 bp, Homo sapiens
acctttaagaattttaaatat

SEQ ID NO: 3285916 - DNA, 14 bp, Homo sapiens
acctttagggcagc

SEQ ID NO: 3285917 - DNA, 21 bp, Homo sapiens
acctttaggtcaaactcccta

SEQ ID NO: 3285918 - DNA, 14 bp, Homo sapiens
acctttaggttctt

SEQ ID NO: 3285919 - DNA, 16 bp, Homo sapiens
acctttatctttcacc

SEQ ID NO: 3285920 - DNA, 12 bp, Homo sapiens
acctttcacaaa

SEQ ID NO: 3285921 - DNA, 23 bp, Homo sapiens
acctttccaaagttaacagattt

SEQ ID NO: 3285922 - DNA, 21 bp, Homo sapiens
acctttccgctgtcgccccag

SEQ ID NO: 3285923 - DNA, 23 bp, Homo sapiens
acctttgcacaggatgctggcct

SEQ ID NO: 3285924 - DNA, 11 bp, Homo sapiens
acctttgctat

SEQ ID NO: 3285925 - DNA, 16 bp, Homo sapiens
acctttgctatgtaag

SEQ ID NO: 3285926 - DNA, 16 bp, Homo sapiens
acctttgtaagacatt

SEQ ID NO: 3285927 - DNA, 15 bp, Homo sapiens
acctttgtgtatttt

SEQ ID NO: 3285928 - DNA, 16 bp, Homo sapiens
acctttgtgtattttt

SEQ ID NO: 3285929 - DNA, 13 bp, Homo sapiens
acctttgtttcct

SEQ ID NO: 3285930 - DNA, 16 bp, Homo sapiens
accttttattgacaca

SEQ ID NO: 3285931 - DNA, 13 bp, Homo sapiens
accttttcaggaa

SEQ ID NO: 3285932 - DNA, 22 bp, Homo sapiens
accttttcaggaaaataactta

SEQ ID NO: 3285933 - DNA, 16 bp, Homo sapiens
accttttctgttgtac

SEQ ID NO: 3285934 - DNA, 14 bp, Homo sapiens
accttttcttcatt

SEQ ID NO: 3285935 - DNA, 15 bp, Homo sapiens
accttttcttcattt

SEQ ID NO: 3285936 - DNA, 16 bp, Homo sapiens
accttttcttcatttt

SEQ ID NO: 3285937 - DNA, 19 bp, Homo sapiens
acctttttatttgcatgtg

SEQ ID NO: 3285938 - DNA, 22 bp, Homo sapiens
acctttttgcatgatatcttca

SEQ ID NO: 3285939 - DNA, 15 bp, Homo sapiens
acctttttgtaaata

SEQ ID NO: 3285940 - DNA, 24 bp, Homo sapiens
acctttttttatcgtttttgtatt

SEQ ID NO: 3285941 - DNA, 14 bp, Homo sapiens
acgaaagaaatgta

SEQ ID NO: 3285942 - DNA, 17 bp, Homo sapiens
acgaacacaagaaaaag

SEQ ID NO: 3285943 - DNA, 19 bp, Homo sapiens
acgaacctacagttttaac

SEQ ID NO: 3285944 - DNA, 12 bp, Homo sapiens
acgaagaaaaaa

SEQ ID NO: 3285945 - DNA, 19 bp, Homo sapiens
acgaagacaaagtcccaga

SEQ ID NO: 3285946 - DNA, 22 bp, Homo sapiens
acgacaaagccaaactctgcca

SEQ ID NO: 3285947 - DNA, 15 bp, Homo sapiens
acgacaaagctgcta

SEQ ID NO: 3285948 - DNA, 23 bp, Homo sapiens
acgacaaagctgctaaatctcct

SEQ ID NO: 3285949 - DNA, 20 bp, Homo sapiens
acgacaatagctttaccctc

SEQ ID NO: 3285950 - DNA, 14 bp, Homo sapiens
acgaccagcccctt

SEQ ID NO: 3285951 - DNA, 16 bp, Homo sapiens
acgaccagccccttcc

SEQ ID NO: 3285952 - DNA, 18 bp, Homo sapiens
acgaccagccccttcctg

SEQ ID NO: 3285953 - DNA, 19 bp, Homo sapiens
acgacgtgggaatttcaat

SEQ ID NO: 3285954 - DNA, 15 bp, Homo sapiens
acgagaaagatcatt

SEQ ID NO: 3285955 - DNA, 20 bp, Homo sapiens
acgagaccctacaggagagg

SEQ ID NO: 3285956 - DNA, 17 bp, Homo sapiens
acgagagcagaggtctc

SEQ ID NO: 3285957 - DNA, 20 bp, Homo sapiens
acgagatgggaaggcacagg

SEQ ID NO: 3285958 - DNA, 13 bp, Homo sapiens
acgagatttgcca

SEQ ID NO: 3285959 - DNA, 16 bp, Homo sapiens
acgagcactggccaga

SEQ ID NO: 3285960 - DNA, 20 bp, Homo sapiens
acgaggaatctgtgggtctg

SEQ ID NO: 3285961 - DNA, 18 bp, Homo sapiens
acgagggaggaacacctg

SEQ ID NO: 3285962 - DNA, 11 bp, Homo sapiens
acgagggctgg

SEQ ID NO: 3285963 - DNA, 20 bp, Homo sapiens
acgaggggcagggaaggaca

SEQ ID NO: 3285964 - DNA, 20 bp, Homo sapiens
acgaggtcaagagatcgaga

SEQ ID NO: 3285965 - DNA, 20 bp, Homo sapiens
acgaggtcaggagatcgaga

SEQ ID NO: 3285966 - DNA, 12 bp, Homo sapiens
acgagtcacctg

SEQ ID NO: 3285967 - DNA, 14 bp, Homo sapiens
acgagtcacctgca

SEQ ID NO: 3285968 - DNA, 16 bp, Homo sapiens
acgagtcaccttccag

SEQ ID NO: 3285969 - DNA, 21 bp, Homo sapiens
acgagttaatgatggcagagg

SEQ ID NO: 3285970 - DNA, 14 bp, Homo sapiens
acgatgaaaaactt

SEQ ID NO: 3285971 - DNA, 15 bp, Homo sapiens
acgatgatgtacaga

SEQ ID NO: 3285972 - DNA, 19 bp, Homo sapiens
acgatggggggctgatggc

SEQ ID NO: 3285973 - DNA, 13 bp, Homo sapiens
acgattagcttta

SEQ ID NO: 3285974 - DNA, 17 bp, Homo sapiens
acgattagctttattat

SEQ ID NO: 3285975 - DNA, 12 bp, Homo sapiens
acgattggccac

SEQ ID NO: 3285976 - DNA, 18 bp, Homo sapiens
acgatttagaaagaagcc

SEQ ID NO: 3285977 - DNA, 12 bp, Homo sapiens
acgatttgtctt

SEQ ID NO: 3285978 - DNA, 21 bp, Homo sapiens
acgcaattgtgggatgtcctc

SEQ ID NO: 3285979 - DNA, 18 bp, Homo sapiens
acgcaattttacctagtt

SEQ ID NO: 3285980 - DNA, 19 bp, Homo sapiens
acgcaattttacctagttt

SEQ ID NO: 3285981 - DNA, 22 bp, Homo sapiens
acgcacacgtacttaaatgaaa

SEQ ID NO: 3285982 - DNA, 15 bp, Homo sapiens
actcagaggctggga

SEQ ID NO: 3285983 - DNA, 18 bp, Homo sapiens
actcagaggctgggagca

SEQ ID NO: 3285984 - DNA, 15 bp, Homo sapiens
actcagcagaatggt

SEQ ID NO: 3285985 - DNA, 17 bp, Homo sapiens
actcagcagcctgcgct

SEQ ID NO: 3285986 - DNA, 13 bp, Homo sapiens
actcagcagttga

SEQ ID NO: 3285987 - DNA, 16 bp, Homo sapiens
actcagcagttgacat

SEQ ID NO: 3285988 - DNA, 17 bp, Homo sapiens
actcagccacgaccagc

SEQ ID NO: 3285989 - DNA, 19 bp, Homo sapiens
actcagccacgaccagccc

SEQ ID NO: 3285990 - DNA, 21 bp, Homo sapiens
actcagccatttccccctcct

SEQ ID NO: 3285991 - DNA, 14 bp, Homo sapiens
actcagccctgagg

SEQ ID NO: 3285992 - DNA, 23 bp, Homo sapiens
actcagccggcgtggcaaatata

SEQ ID NO: 3285993 - DNA, 12 bp, Homo sapiens
actcagcctgct

SEQ ID NO: 3285994 - DNA, 18 bp, Homo sapiens
actcagcgctcctcctgt

SEQ ID NO: 3285995 - DNA, 19 bp, Homo sapiens
actcagcgctcctcctgtg

SEQ ID NO: 3285996 - DNA, 21 bp, Homo sapiens
actcagctggaagtctacctg

SEQ ID NO: 3285997 - DNA, 18 bp, Homo sapiens
actcagctgtcctgcagc

SEQ ID NO: 3285998 - DNA, 18 bp, Homo sapiens
actcaggatccagtccct

SEQ ID NO: 3285999 - DNA, 20 bp, Homo sapiens
actcagggacagagccatgc

SEQ ID NO: 3286000 - DNA, 22 bp, Homo sapiens
actcagggaccggtgctgcagg

SEQ ID NO: 3286001 - DNA, 20 bp, Homo sapiens
actcagggctcctcccagct

SEQ ID NO: 3286002 - DNA, 20 bp, Homo sapiens
actcagggttcatctgtcca

SEQ ID NO: 3286003 - DNA, 15 bp, Homo sapiens
actcaggtgggccct

SEQ ID NO: 3286004 - DNA, 19 bp, Homo sapiens
actcaggtgggccctctga

SEQ ID NO: 3286005 - DNA, 17 bp, Homo sapiens
actcagtctctcttctc

SEQ ID NO: 3286006 - DNA, 17 bp, Homo sapiens
actcagtgttagagaaa

SEQ ID NO: 3286007 - DNA, 14 bp, Homo sapiens
actcagtttgtcag

SEQ ID NO: 3286008 - DNA, 15 bp, Homo sapiens
actcagtttgtcaga

SEQ ID NO: 3286009 - DNA, 9 bp, Homo sapiens
actcatcat

SEQ ID NO: 3286010 - DNA, 13 bp, Homo sapiens
actcatcataaaa

SEQ ID NO: 3286011 - DNA, 14 bp, Homo sapiens
actcatcataaaat

SEQ ID NO: 3286012 - DNA, 17 bp, Homo sapiens
actcatcataaaataaa

SEQ ID NO: 3286013 - DNA, 13 bp, Homo sapiens
actcatcatttgt

SEQ ID NO: 3286014 - DNA, 13 bp, Homo sapiens
actcattactgca

SEQ ID NO: 3286015 - DNA, 15 bp, Homo sapiens
actcattctgaatta

SEQ ID NO: 3286016 - DNA, 15 bp, Homo sapiens
actcatttctaaaag

SEQ ID NO: 3286017 - DNA, 15 bp, Homo sapiens
actcatttttgccat

SEQ ID NO: 3286018 - DNA, 19 bp, Homo sapiens
actcatttttgccatacat

SEQ ID NO: 3286019 - DNA, 21 bp, Homo sapiens
actcatttttgccatacatca

SEQ ID NO: 3286020 - DNA, 13 bp, Homo sapiens
actccaaaatgtt

SEQ ID NO: 3286021 - DNA, 14 bp, Homo sapiens
actccaaacctgtc

SEQ ID NO: 3286022 - DNA, 23 bp, Homo sapiens
actccaaagtccacacaaagatt

SEQ ID NO: 3286023 - DNA, 19 bp, Homo sapiens
actccaacagaagaactgt

SEQ ID NO: 3286024 - DNA, 17 bp, Homo sapiens
actccaagaacaattgt

SEQ ID NO: 3286025 - DNA, 15 bp, Homo sapiens
actccaatctggtaa

SEQ ID NO: 3286026 - DNA, 21 bp, Homo sapiens
actccaatgtctgctgaggag

SEQ ID NO: 3286027 - DNA, 13 bp, Homo sapiens
actccacatctgc

SEQ ID NO: 3286028 - DNA, 21 bp, Homo sapiens
actccaccgcctatcccaaac

SEQ ID NO: 3286029 - DNA, 13 bp, Homo sapiens
actccaccttccc

SEQ ID NO: 3286030 - DNA, 14 bp, Homo sapiens
actccactctcctt

SEQ ID NO: 3286031 - DNA, 23 bp, Homo sapiens
actccactctccttcgtgtctct

SEQ ID NO: 3286032 - DNA, 14 bp, Homo sapiens
actccactgccctg

SEQ ID NO: 3286033 - DNA, 15 bp, Homo sapiens
actccactgccctgg

SEQ ID NO: 3286034 - DNA, 17 bp, Homo sapiens
actccactgccctggca

SEQ ID NO: 3286035 - DNA, 13 bp, Homo sapiens
actccactggaca

SEQ ID NO: 3286036 - DNA, 18 bp, Homo sapiens
actccactggacagaccc

SEQ ID NO: 3286037 - DNA, 15 bp, Homo sapiens
actccactggctcca

SEQ ID NO: 3286038 - DNA, 22 bp, Homo sapiens
actccagaatctgctgttgcca

SEQ ID NO: 3286039 - DNA, 18 bp, Homo sapiens
actccagacccctggctt

SEQ ID NO: 3286040 - DNA, 21 bp, Homo sapiens
actccagacccctggcttttc

SEQ ID NO: 3286041 - DNA, 16 bp, Homo sapiens
actccagagtctgagc

SEQ ID NO: 3286042 - DNA, 16 bp, Homo sapiens
actccagatagagaaa

SEQ ID NO: 3286043 - DNA, 19 bp, Homo sapiens
actccagcctgagcaacag

SEQ ID NO: 3286044 - DNA, 15 bp, Homo sapiens
actccagcctgggcg

SEQ ID NO: 3286045 - DNA, 18 bp, Homo sapiens
actccagcctgggcgaca

SEQ ID NO: 3286046 - DNA, 20 bp, Homo sapiens
actccagcctgggcgacaga

SEQ ID NO: 3286047 - DNA, 13 bp, Homo sapiens
actccaggcccaa

SEQ ID NO: 3286048 - DNA, 14 bp, Homo sapiens
actccaggcccaag

SEQ ID NO: 3286049 - DNA, 17 bp, Homo sapiens
actccaggcccaaggct

SEQ ID NO: 3286050 - DNA, 14 bp, Homo sapiens
actccagtgccagc

SEQ ID NO: 3286051 - DNA, 19 bp, Homo sapiens
actccagtgccagcaatga

SEQ ID NO: 3286052 - DNA, 21 bp, Homo sapiens
actccatctctcatcctccag

SEQ ID NO: 3286053 - DNA, 13 bp, Homo sapiens
actccatgagcac

SEQ ID NO: 3286054 - DNA, 22 bp, Homo sapiens
actccattcccaactagacatt

SEQ ID NO: 3286055 - DNA, 14 bp, Homo sapiens
actcccaccacagg

SEQ ID NO: 3286056 - DNA, 14 bp, Homo sapiens
actcccacctgaca

SEQ ID NO: 3286057 - DNA, 13 bp, Homo sapiens
actcccagcactc

SEQ ID NO: 3286058 - DNA, 14 bp, Homo sapiens
actccccaaggaag

SEQ ID NO: 3286059 - DNA, 17 bp, Homo sapiens
actccccagagctgtgc

SEQ ID NO: 3286060 - DNA, 19 bp, Homo sapiens
actccccagagctgtgcca

SEQ ID NO: 3286061 - DNA, 15 bp, Homo sapiens
actccccagccccac

SEQ ID NO: 3286062 - DNA, 16 bp, Homo sapiens
actccccgaagtcttt

SEQ ID NO: 3286063 - DNA, 14 bp, Homo sapiens
actcccctgggggt

SEQ ID NO: 3286064 - DNA, 21 bp, Homo sapiens
actcccctgtttcaatcactg

SEQ ID NO: 3286065 - DNA, 13 bp, Homo sapiens
actccccttgcct

SEQ ID NO: 3286066 - DNA, 23 bp, Homo sapiens
actccccttgccttcccctgtct

SEQ ID NO: 3286067 - DNA, 19 bp, Homo sapiens
actcccgggccacgcccca

SEQ ID NO: 3286068 - DNA, 23 bp, Homo sapiens
actcccgggccacgccccagccc

SEQ ID NO: 3286069 - DNA, 19 bp, Homo sapiens
actccctaatttatgtgct

SEQ ID NO: 3286070 - DNA, 22 bp, Homo sapiens
actccctaatttatgtgctata

SEQ ID NO: 3286071 - DNA, 14 bp, Homo sapiens
actccctacactga

SEQ ID NO: 3286072 - DNA, 13 bp, Homo sapiens
actccctcctcac

SEQ ID NO: 3286073 - DNA, 16 bp, Homo sapiens
actccctcctcacctc

SEQ ID NO: 3286074 - DNA, 13 bp, Homo sapiens
actccctctcagg

SEQ ID NO: 3286075 - DNA, 21 bp, Homo sapiens
actccctctcaggatccaagc

SEQ ID NO: 3286076 - DNA, 14 bp, Homo sapiens
actccctcttccaa

SEQ ID NO: 3286077 - DNA, 15 bp, Homo sapiens
actcccttcctggcc

SEQ ID NO: 3286078 - DNA, 22 bp, Homo sapiens
actcccttgctggccccagccc

SEQ ID NO: 3286079 - DNA, 19 bp, Homo sapiens
actcccttggtggcaagag

SEQ ID NO: 3286080 - DNA, 12 bp, Homo sapiens
actccctttcaa

SEQ ID NO: 3286081 - DNA, 13 bp, Homo sapiens
actccctttcaac

SEQ ID NO: 3286082 - DNA, 14 bp, Homo sapiens
actccgaagaaaag

SEQ ID NO: 3286083 - DNA, 23 bp, Homo sapiens
actccgagaggtgggccagtctg

SEQ ID NO: 3286084 - DNA, 22 bp, Homo sapiens
actccgccctcctcgggccgag

SEQ ID NO: 3286085 - DNA, 20 bp, Homo sapiens
actccggattgcgttcctcc

SEQ ID NO: 3286086 - DNA, 15 bp, Homo sapiens
actccggtgtgcctg

SEQ ID NO: 3286087 - DNA, 19 bp, Homo sapiens
actccggtgtgcctgcagc

SEQ ID NO: 3286088 - DNA, 20 bp, Homo sapiens
actccggtgtgcctgcagcc

SEQ ID NO: 3286089 - DNA, 21 bp, Homo sapiens
actccggtgtgcctgcagccc

SEQ ID NO: 3286090 - DNA, 17 bp, Homo sapiens
actccgttggccactcc

SEQ ID NO: 3286091 - DNA, 19 bp, Homo sapiens
actcctaattttaaataat

SEQ ID NO: 3286092 - DNA, 21 bp, Homo sapiens
actcctaattttaaataattt

SEQ ID NO: 3286093 - DNA, 16 bp, Homo sapiens
actcctacctcagcct

SEQ ID NO: 3286094 - DNA, 14 bp, Homo sapiens
actcctacctggta

SEQ ID NO: 3286095 - DNA, 16 bp, Homo sapiens
actcctaggagagcca

SEQ ID NO: 3286096 - DNA, 20 bp, Homo sapiens
actcctaggagagccaacct

SEQ ID NO: 3286097 - DNA, 16 bp, Homo sapiens
actcctatttttgtaa

SEQ ID NO: 3286098 - DNA, 17 bp, Homo sapiens
actcctatttttgtaaa

SEQ ID NO: 3286099 - DNA, 18 bp, Homo sapiens
actcctcagatctgaaca

SEQ ID NO: 3286100 - DNA, 20 bp, Homo sapiens
actcctcatccccacaatct

SEQ ID NO: 3286101 - DNA, 12 bp, Homo sapiens
actcctcccagg

SEQ ID NO: 3286102 - DNA, 12 bp, Homo sapiens
actcctccctcc

SEQ ID NO: 3286103 - DNA, 16 bp, Homo sapiens
actcctcctttttcca

SEQ ID NO: 3286104 - DNA, 14 bp, Homo sapiens
actcctctgtccag

SEQ ID NO: 3286105 - DNA, 23 bp, Homo sapiens
actcctgacgtctgaagcttgac

SEQ ID NO: 3286106 - DNA, 15 bp, Homo sapiens
actcctgcaaaattt

SEQ ID NO: 3286107 - DNA, 21 bp, Homo sapiens
actcctgccattcttctggtg

SEQ ID NO: 3286108 - DNA, 15 bp, Homo sapiens
actcctgctggtacc

SEQ ID NO: 3286109 - DNA, 15 bp, Homo sapiens
actgcttttggtctg

SEQ ID NO: 3286110 - DNA, 20 bp, Homo sapiens
actgcttttggtctgtgtga

SEQ ID NO: 3286111 - DNA, 15 bp, Homo sapiens
actggaaaggggaga

SEQ ID NO: 3286112 - DNA, 17 bp, Homo sapiens
actggaaaggggagagc

SEQ ID NO: 3286113 - DNA, 21 bp, Homo sapiens
actggaaaggggagagcctgc

SEQ ID NO: 3286114 - DNA, 16 bp, Homo sapiens
actggaagacacttca

SEQ ID NO: 3286115 - DNA, 19 bp, Homo sapiens
actggaagcacagcttcat

SEQ ID NO: 3286116 - DNA, 20 bp, Homo sapiens
actggaagctaatttgcatt

SEQ ID NO: 3286117 - DNA, 22 bp, Homo sapiens
actggaagttcatacctaagta

SEQ ID NO: 3286118 - DNA, 13 bp, Homo sapiens
actggaagttttg

SEQ ID NO: 3286119 - DNA, 13 bp, Homo sapiens
actggaattaaaa

SEQ ID NO: 3286120 - DNA, 21 bp, Homo sapiens
actggacacaaacaggaatgt

SEQ ID NO: 3286121 - DNA, 16 bp, Homo sapiens
actggacagacccagg

SEQ ID NO: 3286122 - DNA, 17 bp, Homo sapiens
actggacagacccaggt

SEQ ID NO: 3286123 - DNA, 17 bp, Homo sapiens
actggacctgaaattta

SEQ ID NO: 3286124 - DNA, 14 bp, Homo sapiens
actggagcccagga

SEQ ID NO: 3286125 - DNA, 16 bp, Homo sapiens
actggagcccaggagt

SEQ ID NO: 3286126 - DNA, 15 bp, Homo sapiens
actggaggagcagct

SEQ ID NO: 3286127 - DNA, 15 bp, Homo sapiens
actggaggcccctgg

SEQ ID NO: 3286128 - DNA, 18 bp, Homo sapiens
actggaggcccctggagc

SEQ ID NO: 3286129 - DNA, 14 bp, Homo sapiens
actggaggtgggca

SEQ ID NO: 3286130 - DNA, 15 bp, Homo sapiens
actggaggtgggcat

SEQ ID NO: 3286131 - DNA, 16 bp, Homo sapiens
actggaggttgaagcc

SEQ ID NO: 3286132 - DNA, 19 bp, Homo sapiens
actggagtgaggcttccag

SEQ ID NO: 3286133 - DNA, 22 bp, Homo sapiens
actggagtgaggcttccaggct

SEQ ID NO: 3286134 - DNA, 17 bp, Homo sapiens
actggagtgcagggagg

SEQ ID NO: 3286135 - DNA, 13 bp, Homo sapiens
actggagttctat

SEQ ID NO: 3286136 - DNA, 13 bp, Homo sapiens
actggataaattg

SEQ ID NO: 3286137 - DNA, 14 bp, Homo sapiens
actggataaattgt

SEQ ID NO: 3286138 - DNA, 18 bp, Homo sapiens
actggataaattgtttag

SEQ ID NO: 3286139 - DNA, 13 bp, Homo sapiens
actggatgaagat

SEQ ID NO: 3286140 - DNA, 14 bp, Homo sapiens
actggatgaagatt

SEQ ID NO: 3286141 - DNA, 17 bp, Homo sapiens
actggattaaaacaatt

SEQ ID NO: 3286142 - DNA, 23 bp, Homo sapiens
actggattggccaaacatcagac

SEQ ID NO: 3286143 - DNA, 14 bp, Homo sapiens
actggcacagaggt

SEQ ID NO: 3286144 - DNA, 13 bp, Homo sapiens
actggcagctcct

SEQ ID NO: 3286145 - DNA, 11 bp, Homo sapiens
actggcaggcg

SEQ ID NO: 3286146 - DNA, 21 bp, Homo sapiens
actggcaggggagacaggagc

SEQ ID NO: 3286147 - DNA, 14 bp, Homo sapiens
actggcaggtgcag

SEQ ID NO: 3286148 - DNA, 21 bp, Homo sapiens
actggcagtaacctagtgaat

SEQ ID NO: 3286149 - DNA, 20 bp, Homo sapiens
actggcatctgacacaaaaa

SEQ ID NO: 3286150 - DNA, 19 bp, Homo sapiens
actggccaagaaaattgcc

SEQ ID NO: 3286151 - DNA, 14 bp, Homo sapiens
actggccaccaggc

SEQ ID NO: 3286152 - DNA, 16 bp, Homo sapiens
actggccaccaggctg

SEQ ID NO: 3286153 - DNA, 17 bp, Homo sapiens
actggccaccaggctgg

SEQ ID NO: 3286154 - DNA, 21 bp, Homo sapiens
actggccaccaggctggcgca

SEQ ID NO: 3286155 - DNA, 23 bp, Homo sapiens
actggccaccaggctggcgcagc

SEQ ID NO: 3286156 - DNA, 12 bp, Homo sapiens
actggccagaga

SEQ ID NO: 3286157 - DNA, 13 bp, Homo sapiens
actggccagagag

SEQ ID NO: 3286158 - DNA, 18 bp, Homo sapiens
actggcctttttcattta

SEQ ID NO: 3286159 - DNA, 23 bp, Homo sapiens
actggcgtagaagtttttgtact

SEQ ID NO: 3286160 - DNA, 16 bp, Homo sapiens
actggcgttcacctcc

SEQ ID NO: 3286161 - DNA, 20 bp, Homo sapiens
actggcgttcacctccctgc

SEQ ID NO: 3286162 - DNA, 21 bp, Homo sapiens
actggctccatgattctctga

SEQ ID NO: 3286163 - DNA, 12 bp, Homo sapiens
actggctctcca

SEQ ID NO: 3286164 - DNA, 13 bp, Homo sapiens
actggctctccaa

SEQ ID NO: 3286165 - DNA, 14 bp, Homo sapiens
actggctctccaag

SEQ ID NO: 3286166 - DNA, 16 bp, Homo sapiens
actggctctccaagtg

SEQ ID NO: 3286167 - DNA, 21 bp, Homo sapiens
actggctctccaagtgccaga

SEQ ID NO: 3286168 - DNA, 16 bp, Homo sapiens
actggctctctccagg

SEQ ID NO: 3286169 - DNA, 11 bp, Homo sapiens
actggctctgg

SEQ ID NO: 3286170 - DNA, 14 bp, Homo sapiens
actggctctgggac

SEQ ID NO: 3286171 - DNA, 22 bp, Homo sapiens
actggctgcaaagggtatcagg

SEQ ID NO: 3286172 - DNA, 15 bp, Homo sapiens
actggctggcctgag

SEQ ID NO: 3286173 - DNA, 12 bp, Homo sapiens
actggctggctc

SEQ ID NO: 3286174 - DNA, 13 bp, Homo sapiens
actggctggctcc

SEQ ID NO: 3286175 - DNA, 15 bp, Homo sapiens
actggctggctccta

SEQ ID NO: 3286176 - DNA, 16 bp, Homo sapiens
actggctggctcctag

SEQ ID NO: 3286177 - DNA, 17 bp, Homo sapiens
actggctgtcagtatga

SEQ ID NO: 3286178 - DNA, 21 bp, Homo sapiens
actggctgtcagtatgacatt

SEQ ID NO: 3286179 - DNA, 16 bp, Homo sapiens
actggctgtctgcctg

SEQ ID NO: 3286180 - DNA, 22 bp, Homo sapiens
actggctgtctgcctgtatttt

SEQ ID NO: 3286181 - DNA, 19 bp, Homo sapiens
actgggaagataggctctg

SEQ ID NO: 3286182 - DNA, 23 bp, Homo sapiens
actgggaccaaccctggggaagg

SEQ ID NO: 3286183 - DNA, 22 bp, Homo sapiens
actgggagccacttctccccag

SEQ ID NO: 3286184 - DNA, 15 bp, Homo sapiens
actgggagtcagagc

SEQ ID NO: 3286185 - DNA, 13 bp, Homo sapiens
actgggataactg

SEQ ID NO: 3286186 - DNA, 18 bp, Homo sapiens
actgggcaatgatggcaa

SEQ ID NO: 3286187 - DNA, 16 bp, Homo sapiens
actgggccacggagga

SEQ ID NO: 3286188 - DNA, 20 bp, Homo sapiens
actgggccagccctgcagcc

SEQ ID NO: 3286189 - DNA, 20 bp, Homo sapiens
actgggccttagtgggccag

SEQ ID NO: 3286190 - DNA, 19 bp, Homo sapiens
actggggaaaactccacct

SEQ ID NO: 3286191 - DNA, 13 bp, Homo sapiens
actggggagcccg

SEQ ID NO: 3286192 - DNA, 16 bp, Homo sapiens
actggggatgtgggag

SEQ ID NO: 3286193 - DNA, 17 bp, Homo sapiens
actggggatgtgggagg

SEQ ID NO: 3286194 - DNA, 18 bp, Homo sapiens
actggggatgtgggaggg

SEQ ID NO: 3286195 - DNA, 13 bp, Homo sapiens
actggggctgggg

SEQ ID NO: 3286196 - DNA, 13 bp, Homo sapiens
actggggggcttg

SEQ ID NO: 3286197 - DNA, 21 bp, Homo sapiens
actgggtaaaagcagggcagc

SEQ ID NO: 3286198 - DNA, 21 bp, Homo sapiens
actgggtaaatgcaaagttct

SEQ ID NO: 3286199 - DNA, 15 bp, Homo sapiens
actgggtacttgtgg

SEQ ID NO: 3286200 - DNA, 17 bp, Homo sapiens
actgggtacttgtggac

SEQ ID NO: 3286201 - DNA, 20 bp, Homo sapiens
actgggtacttgtggacaca

SEQ ID NO: 3286202 - DNA, 13 bp, Homo sapiens
actgggtgagaga

SEQ ID NO: 3286203 - DNA, 22 bp, Homo sapiens
actgggtggtggcctggtccct

SEQ ID NO: 3286204 - DNA, 21 bp, Homo sapiens
actgggttcttgttttatata

SEQ ID NO: 3286205 - DNA, 20 bp, Homo sapiens
actgggtttcaagaaaatct

SEQ ID NO: 3286206 - DNA, 21 bp, Homo sapiens
actggtccaaaagattgctga

SEQ ID NO: 3286207 - DNA, 22 bp, Homo sapiens
actggtccaaaagattgctgaa

SEQ ID NO: 3286208 - DNA, 19 bp, Homo sapiens
actggtccagctctgacat

SEQ ID NO: 3286209 - DNA, 21 bp, Homo sapiens
actggtccagctctgacatcc

SEQ ID NO: 3286210 - DNA, 14 bp, Homo sapiens
actggtcctgtgtg

SEQ ID NO: 3286211 - DNA, 18 bp, Homo sapiens
actggtctcgaactcctg

SEQ ID NO: 3286212 - DNA, 22 bp, Homo sapiens
actggtgaactgagctgggcag

SEQ ID NO: 3286213 - DNA, 13 bp, Homo sapiens
actggtgccctcc

SEQ ID NO: 3286214 - DNA, 12 bp, Homo sapiens
actggtggcccg

SEQ ID NO: 3286215 - DNA, 22 bp, Homo sapiens
actggtggcccgacagcctggc

SEQ ID NO: 3286216 - DNA, 23 bp, Homo sapiens
actggtggcccgacagcctggca

SEQ ID NO: 3286217 - DNA, 21 bp, Homo sapiens
actggtggttgattggtttta

SEQ ID NO: 3286218 - DNA, 22 bp, Homo sapiens
actggttggctcccgcggtgcc

SEQ ID NO: 3286219 - DNA, 22 bp, Homo sapiens
actggtttacaggccctgctcc

SEQ ID NO: 3286220 - DNA, 22 bp, Homo sapiens
actggtttgttgcagccaaaga

SEQ ID NO: 3286221 - DNA, 19 bp, Homo sapiens
actggttttctgccaatga

SEQ ID NO: 3286222 - DNA, 17 bp, Homo sapiens
actgtaaagagacctac

SEQ ID NO: 3286223 - DNA, 13 bp, Homo sapiens
actgtaaagatgt

SEQ ID NO: 3286224 - DNA, 17 bp, Homo sapiens
actgtaaataaaatgtg

SEQ ID NO: 3286225 - DNA, 18 bp, Homo sapiens
actgtaaataaaatgtgt

SEQ ID NO: 3286226 - DNA, 19 bp, Homo sapiens
actgtaaataaaatgtgta

SEQ ID NO: 3286227 - DNA, 23 bp, Homo sapiens
actgtaaataaaatgtgtacagt

SEQ ID NO: 3286228 - DNA, 17 bp, Homo sapiens
actgtaacatattctgt

SEQ ID NO: 3286229 - DNA, 15 bp, Homo sapiens
actgtaacattcagg

SEQ ID NO: 3286230 - DNA, 13 bp, Homo sapiens
actgtaagatgtt

SEQ ID NO: 3286231 - DNA, 13 bp, Homo sapiens
actgtaagggatt

SEQ ID NO: 3286232 - DNA, 19 bp, Homo sapiens
actgtaataatacctcaat

SEQ ID NO: 3286233 - DNA, 18 bp, Homo sapiens
actgtaatataaagtatt

SEQ ID NO: 3286234 - DNA, 17 bp, Homo sapiens
actgtacacactttatt

SEQ ID NO: 3286235 - DNA, 22 bp, Homo sapiens
acttgtggacacagctcttctc

SEQ ID NO: 3286236 - DNA, 21 bp, Homo sapiens
acttgtgtactgataaaatac

SEQ ID NO: 3286237 - DNA, 22 bp, Homo sapiens
acttgtgtatattttaatgaat

SEQ ID NO: 3286238 - DNA, 22 bp, Homo sapiens
acttgtgtctctgtgcttttaa

SEQ ID NO: 3286239 - DNA, 20 bp, Homo sapiens
acttgtgtgtgggctgtgag

SEQ ID NO: 3286240 - DNA, 21 bp, Homo sapiens
acttgtgtgtgggctgtgagt

SEQ ID NO: 3286241 - DNA, 22 bp, Homo sapiens
acttgtgtgtgggctgtgagtg

SEQ ID NO: 3286242 - DNA, 13 bp, Homo sapiens
acttgtgtttgct

SEQ ID NO: 3286243 - DNA, 14 bp, Homo sapiens
acttgtgtttgctt

SEQ ID NO: 3286244 - DNA, 19 bp, Homo sapiens
acttgtgtttgcttaaaca

SEQ ID NO: 3286245 - DNA, 13 bp, Homo sapiens
acttgttattgtg

SEQ ID NO: 3286246 - DNA, 13 bp, Homo sapiens
acttgttcattta

SEQ ID NO: 3286247 - DNA, 17 bp, Homo sapiens
acttgtttacaacattt

SEQ ID NO: 3286248 - DNA, 22 bp, Homo sapiens
acttgtttactcattgaagcag

SEQ ID NO: 3286249 - DNA, 17 bp, Homo sapiens
acttgttttatgctcag

SEQ ID NO: 3286250 - DNA, 19 bp, Homo sapiens
acttgttttggatggcttg

SEQ ID NO: 3286251 - DNA, 14 bp, Homo sapiens
actttaaaaaatat

SEQ ID NO: 3286252 - DNA, 14 bp, Homo sapiens
actttaaaaaggaa

SEQ ID NO: 3286253 - DNA, 18 bp, Homo sapiens
actttaaaaaggaaattt

SEQ ID NO: 3286254 - DNA, 20 bp, Homo sapiens
actttaaaaaggaaatttgt

SEQ ID NO: 3286255 - DNA, 15 bp, Homo sapiens
actttaaaagaaaat

SEQ ID NO: 3286256 - DNA, 13 bp, Homo sapiens
actttaaattgtg

SEQ ID NO: 3286257 - DNA, 16 bp, Homo sapiens
actttaagagagaaat

SEQ ID NO: 3286258 - DNA, 13 bp, Homo sapiens
actttaagcacta

SEQ ID NO: 3286259 - DNA, 15 bp, Homo sapiens
actttaagtttcagg

SEQ ID NO: 3286260 - DNA, 19 bp, Homo sapiens
actttaattaccaacctgt

SEQ ID NO: 3286261 - DNA, 20 bp, Homo sapiens
actttaattaccaacctgtt

SEQ ID NO: 3286262 - DNA, 14 bp, Homo sapiens
actttacagaaatg

SEQ ID NO: 3286263 - DNA, 18 bp, Homo sapiens
actttacagaaatggact

SEQ ID NO: 3286264 - DNA, 19 bp, Homo sapiens
actttactctgtgtttaaa

SEQ ID NO: 3286265 - DNA, 12 bp, Homo sapiens
actttagaaata

SEQ ID NO: 3286266 - DNA, 15 bp, Homo sapiens
actttagaagcctgc

SEQ ID NO: 3286267 - DNA, 16 bp, Homo sapiens
actttagaagcctgca

SEQ ID NO: 3286268 - DNA, 19 bp, Homo sapiens
actttagaagtgcatttct

SEQ ID NO: 3286269 - DNA, 15 bp, Homo sapiens
actttagatgctgat

SEQ ID NO: 3286270 - DNA, 22 bp, Homo sapiens
actttagggctgtaaaatgcat

SEQ ID NO: 3286271 - DNA, 19 bp, Homo sapiens
actttagggtaaaaattgc

SEQ ID NO: 3286272 - DNA, 22 bp, Homo sapiens
actttagggtaaaaattgccat

SEQ ID NO: 3286273 - DNA, 23 bp, Homo sapiens
actttagtatgacgctgatacat

SEQ ID NO: 3286274 - DNA, 17 bp, Homo sapiens
actttagtatttttact

SEQ ID NO: 3286275 - DNA, 17 bp, Homo sapiens
actttagtgccctgccc

SEQ ID NO: 3286276 - DNA, 18 bp, Homo sapiens
actttagtgccctgcccc

SEQ ID NO: 3286277 - DNA, 12 bp, Homo sapiens
actttataaatt

SEQ ID NO: 3286278 - DNA, 16 bp, Homo sapiens
actttataactaacat

SEQ ID NO: 3286279 - DNA, 19 bp, Homo sapiens
actttatagttgttttata

SEQ ID NO: 3286280 - DNA, 12 bp, Homo sapiens
actttatatctg

SEQ ID NO: 3286281 - DNA, 13 bp, Homo sapiens
actttatatctgt

SEQ ID NO: 3286282 - DNA, 17 bp, Homo sapiens
actttatatctgtaatg

SEQ ID NO: 3286283 - DNA, 13 bp, Homo sapiens
actttatcacttt

SEQ ID NO: 3286284 - DNA, 13 bp, Homo sapiens
actttatcatgaa

SEQ ID NO: 3286285 - DNA, 18 bp, Homo sapiens
actttatcatgaatgctt

SEQ ID NO: 3286286 - DNA, 23 bp, Homo sapiens
actttatctaatacctctgtgtg

SEQ ID NO: 3286287 - DNA, 16 bp, Homo sapiens
actttatgtgtaaata

SEQ ID NO: 3286288 - DNA, 22 bp, Homo sapiens
actttatgttgtatgattccaa

SEQ ID NO: 3286289 - DNA, 12 bp, Homo sapiens
actttattaaat

SEQ ID NO: 3286290 - DNA, 15 bp, Homo sapiens
actttattaaataca

SEQ ID NO: 3286291 - DNA, 20 bp, Homo sapiens
actttattaaatacaaaact

SEQ ID NO: 3286292 - DNA, 15 bp, Homo sapiens
actttattacaattt

SEQ ID NO: 3286293 - DNA, 19 bp, Homo sapiens
actttattacaatttgtat

SEQ ID NO: 3286294 - DNA, 16 bp, Homo sapiens
actttattcttgctgg

SEQ ID NO: 3286295 - DNA, 21 bp, Homo sapiens
actttattgccttttaatttt

SEQ ID NO: 3286296 - DNA, 21 bp, Homo sapiens
actttattgtacagactgttt

SEQ ID NO: 3286297 - DNA, 18 bp, Homo sapiens
actttatttatttctagt

SEQ ID NO: 3286298 - DNA, 19 bp, Homo sapiens
actttatttgtaaaccatt

SEQ ID NO: 3286299 - DNA, 20 bp, Homo sapiens
actttcaaaatatattttgt

SEQ ID NO: 3286300 - DNA, 13 bp, Homo sapiens
actttcaaaatta

SEQ ID NO: 3286301 - DNA, 18 bp, Homo sapiens
actttcaaaattaaatct

SEQ ID NO: 3286302 - DNA, 20 bp, Homo sapiens
actttcacatagatgtccct

SEQ ID NO: 3286303 - DNA, 13 bp, Homo sapiens
actttcactttga

SEQ ID NO: 3286304 - DNA, 19 bp, Homo sapiens
actttcagaagtgccactt

SEQ ID NO: 3286305 - DNA, 23 bp, Homo sapiens
actttcagagcccccagccctgg

SEQ ID NO: 3286306 - DNA, 18 bp, Homo sapiens
actttcatctggggtggg

SEQ ID NO: 3286307 - DNA, 15 bp, Homo sapiens
actttcattccttca

SEQ ID NO: 3286308 - DNA, 16 bp, Homo sapiens
actttcattgccagtg

SEQ ID NO: 3286309 - DNA, 18 bp, Homo sapiens
actttcattgccagtgtc

SEQ ID NO: 3286310 - DNA, 12 bp, Homo sapiens
actttcattttt

SEQ ID NO: 3286311 - DNA, 22 bp, Homo sapiens
actttccacttcttcctttctc

SEQ ID NO: 3286312 - DNA, 14 bp, Homo sapiens
actttcctgcaact

SEQ ID NO: 3286313 - DNA, 16 bp, Homo sapiens
actttcgaaatttcat

SEQ ID NO: 3286314 - DNA, 21 bp, Homo sapiens
actttcggagaaattctcttt

SEQ ID NO: 3286315 - DNA, 15 bp, Homo sapiens
actttcgtacattgg

SEQ ID NO: 3286316 - DNA, 15 bp, Homo sapiens
actttctaatgtttc

SEQ ID NO: 3286317 - DNA, 17 bp, Homo sapiens
actttctacaatgtgaa

SEQ ID NO: 3286318 - DNA, 21 bp, Homo sapiens
actttctacaatgtgaacttt

SEQ ID NO: 3286319 - DNA, 22 bp, Homo sapiens
actttctatagcagattgtgta

SEQ ID NO: 3286320 - DNA, 14 bp, Homo sapiens
actttctcagtttt

SEQ ID NO: 3286321 - DNA, 16 bp, Homo sapiens
actttctctgtagttc

SEQ ID NO: 3286322 - DNA, 18 bp, Homo sapiens
actttctctgtagttcct

SEQ ID NO: 3286323 - DNA, 20 bp, Homo sapiens
actttctcttaacttaattt

SEQ ID NO: 3286324 - DNA, 19 bp, Homo sapiens
actttctcttcatactttt

SEQ ID NO: 3286325 - DNA, 15 bp, Homo sapiens
actttctcttgtaaa

SEQ ID NO: 3286326 - DNA, 14 bp, Homo sapiens
actttctgcctgga

SEQ ID NO: 3286327 - DNA, 19 bp, Homo sapiens
actttcttttctggaatgt

SEQ ID NO: 3286328 - DNA, 18 bp, Homo sapiens
actttgaaaggagatgtc

SEQ ID NO: 3286329 - DNA, 20 bp, Homo sapiens
actttgaaatacctcatgtt

SEQ ID NO: 3286330 - DNA, 21 bp, Homo sapiens
actttgaaatacctcatgttt

SEQ ID NO: 3286331 - DNA, 16 bp, Homo sapiens
actttgacaattactc

SEQ ID NO: 3286332 - DNA, 18 bp, Homo sapiens
actttgacagtgttttta

SEQ ID NO: 3286333 - DNA, 22 bp, Homo sapiens
actttgacgagtcaccttccag

SEQ ID NO: 3286334 - DNA, 24 bp, Homo sapiens
actttgagatgtgttcctcctgct

SEQ ID NO: 3286335 - DNA, 16 bp, Homo sapiens
actttgaggtgtctca

SEQ ID NO: 3286336 - DNA, 20 bp, Homo sapiens
actttgcaatccaaataaag

SEQ ID NO: 3286337 - DNA, 15 bp, Homo sapiens
actttgcacattttg

SEQ ID NO: 3286338 - DNA, 18 bp, Homo sapiens
actttgcactgatatatc

SEQ ID NO: 3286339 - DNA, 19 bp, Homo sapiens
actttgcactgatatatca

SEQ ID NO: 3286340 - DNA, 21 bp, Homo sapiens
actttgcactgatatatcatg

SEQ ID NO: 3286341 - DNA, 20 bp, Homo sapiens
actttgccaaaaaaaaaaga

SEQ ID NO: 3286342 - DNA, 15 bp, Homo sapiens
actttgccatttttc

SEQ ID NO: 3286343 - DNA, 16 bp, Homo sapiens
actttgccctatgaca

SEQ ID NO: 3286344 - DNA, 23 bp, Homo sapiens
actttgcctcctgtgtactgtgt

SEQ ID NO: 3286345 - DNA, 18 bp, Homo sapiens
actttgctctcaattaaa

SEQ ID NO: 3286346 - DNA, 19 bp, Homo sapiens
actttgctctcaattaaag

SEQ ID NO: 3286347 - DNA, 20 bp, Homo sapiens
actttgctgatttcccctct

SEQ ID NO: 3286348 - DNA, 11 bp, Homo sapiens
actttgcttgc

SEQ ID NO: 3286349 - DNA, 15 bp, Homo sapiens
actttgcttgctttg

SEQ ID NO: 3286350 - DNA, 18 bp, Homo sapiens
actttggaagtttgtgtt

SEQ ID NO: 3286351 - DNA, 17 bp, Homo sapiens
actttggaatgactata

SEQ ID NO: 3286352 - DNA, 23 bp, Homo sapiens
actttggagagtgagctacagag

SEQ ID NO: 3286353 - DNA, 23 bp, Homo sapiens
actttggagtcccctcacctcct

SEQ ID NO: 3286354 - DNA, 19 bp, Homo sapiens
actttggcaatttcctggc

SEQ ID NO: 3286355 - DNA, 22 bp, Homo sapiens
actttggtagctgggaaagcat

SEQ ID NO: 3286356 - DNA, 23 bp, Homo sapiens
actttggtagtggaatagtgaat

SEQ ID NO: 3286357 - DNA, 22 bp, Homo sapiens
actttggtgcgggcacaataaa

SEQ ID NO: 3286358 - DNA, 18 bp, Homo sapiens
actttggtttctgtctgt

SEQ ID NO: 3286359 - DNA, 13 bp, Homo sapiens
actttgtaaatag

SEQ ID NO: 3286360 - DNA, 22 bp, Homo sapiens
agaagatgttgaagaatacagt

SEQ ID NO: 3286361 - DNA, 23 bp, Homo sapiens
agaagatttgatgctggagaggt

SEQ ID NO: 3286362 - DNA, 18 bp, Homo sapiens
agaagattttgaaatttt

SEQ ID NO: 3286363 - DNA, 13 bp, Homo sapiens
agaagcacatgtg

SEQ ID NO: 3286364 - DNA, 12 bp, Homo sapiens
agaagcagcttc

SEQ ID NO: 3286365 - DNA, 15 bp, Homo sapiens
agaagcagcttcttt

SEQ ID NO: 3286366 - DNA, 14 bp, Homo sapiens
agaagcaggctgga

SEQ ID NO: 3286367 - DNA, 19 bp, Homo sapiens
agaagcatattttgctggt

SEQ ID NO: 3286368 - DNA, 15 bp, Homo sapiens
agaagcattccttct

SEQ ID NO: 3286369 - DNA, 15 bp, Homo sapiens
agaagcatttgtatt

SEQ ID NO: 3286370 - DNA, 19 bp, Homo sapiens
agaagcatttgtattttgt

SEQ ID NO: 3286371 - DNA, 23 bp, Homo sapiens
agaagcatttgtattttgtgtga

SEQ ID NO: 3286372 - DNA, 18 bp, Homo sapiens
agaagccaactatgatta

SEQ ID NO: 3286373 - DNA, 21 bp, Homo sapiens
agaagccaagctccctggagc

SEQ ID NO: 3286374 - DNA, 22 bp, Homo sapiens
agaagccaagctccctggagcc

SEQ ID NO: 3286375 - DNA, 23 bp, Homo sapiens
agaagccaagctccctggagccc

SEQ ID NO: 3286376 - DNA, 18 bp, Homo sapiens
agaagccaagggaaaggg

SEQ ID NO: 3286377 - DNA, 19 bp, Homo sapiens
agaagccaagggaaagggg

SEQ ID NO: 3286378 - DNA, 18 bp, Homo sapiens
agaagccacgctgtcctc

SEQ ID NO: 3286379 - DNA, 13 bp, Homo sapiens
agaagccagccac

SEQ ID NO: 3286380 - DNA, 18 bp, Homo sapiens
agaagccagccacagacc

SEQ ID NO: 3286381 - DNA, 19 bp, Homo sapiens
agaagccagccacagaccc

SEQ ID NO: 3286382 - DNA, 13 bp, Homo sapiens
agaagccctgatg

SEQ ID NO: 3286383 - DNA, 20 bp, Homo sapiens
agaagcctcgttttgatgcc

SEQ ID NO: 3286384 - DNA, 14 bp, Homo sapiens
agaagcctctggct

SEQ ID NO: 3286385 - DNA, 23 bp, Homo sapiens
agaagcctctggctagaggccag

SEQ ID NO: 3286386 - DNA, 10 bp, Homo sapiens
agaagcctgc

SEQ ID NO: 3286387 - DNA, 11 bp, Homo sapiens
agaagcctgca

SEQ ID NO: 3286388 - DNA, 21 bp, Homo sapiens
agaagccttaatttgcacagt

SEQ ID NO: 3286389 - DNA, 16 bp, Homo sapiens
agaagcggatttccag

SEQ ID NO: 3286390 - DNA, 23 bp, Homo sapiens
agaagcgggacgagaccctacag

SEQ ID NO: 3286391 - DNA, 14 bp, Homo sapiens
agaagctaatgtag

SEQ ID NO: 3286392 - DNA, 22 bp, Homo sapiens
agaagctaatgtaggactgtat

SEQ ID NO: 3286393 - DNA, 13 bp, Homo sapiens
agaagctattttt

SEQ ID NO: 3286394 - DNA, 16 bp, Homo sapiens
agaagctcgccccacc

SEQ ID NO: 3286395 - DNA, 17 bp, Homo sapiens
agaagctcgccccacct

SEQ ID NO: 3286396 - DNA, 18 bp, Homo sapiens
agaagctcgccccacctc

SEQ ID NO: 3286397 - DNA, 19 bp, Homo sapiens
agaagctctgaagaactct

SEQ ID NO: 3286398 - DNA, 13 bp, Homo sapiens
agaagctgctcca

SEQ ID NO: 3286399 - DNA, 18 bp, Homo sapiens
agaagctgctccaggcct

SEQ ID NO: 3286400 - DNA, 19 bp, Homo sapiens
agaagctgctccaggcctg

SEQ ID NO: 3286401 - DNA, 14 bp, Homo sapiens
agaagctgcttctg

SEQ ID NO: 3286402 - DNA, 23 bp, Homo sapiens
agaagctgttgtacatttatgat

SEQ ID NO: 3286403 - DNA, 16 bp, Homo sapiens
agaagcttcagaagtt

SEQ ID NO: 3286404 - DNA, 22 bp, Homo sapiens
agaagcttctaataaattatac

SEQ ID NO: 3286405 - DNA, 22 bp, Homo sapiens
agaaggaaaaatttgaagtatt

SEQ ID NO: 3286406 - DNA, 16 bp, Homo sapiens
agaaggaagccatagt

SEQ ID NO: 3286407 - DNA, 14 bp, Homo sapiens
agaaggaatcttct

SEQ ID NO: 3286408 - DNA, 14 bp, Homo sapiens
agaaggaatttgta

SEQ ID NO: 3286409 - DNA, 16 bp, Homo sapiens
agaaggaatttgtact

SEQ ID NO: 3286410 - DNA, 13 bp, Homo sapiens
agaaggagagaaa

SEQ ID NO: 3286411 - DNA, 19 bp, Homo sapiens
agaaggagagaaagtgggt

SEQ ID NO: 3286412 - DNA, 14 bp, Homo sapiens
agaaggagccttgt

SEQ ID NO: 3286413 - DNA, 22 bp, Homo sapiens
agaaggaggaatgctggactgg

SEQ ID NO: 3286414 - DNA, 16 bp, Homo sapiens
agaaggagggcagagc

SEQ ID NO: 3286415 - DNA, 17 bp, Homo sapiens
agaaggagggcagagcc

SEQ ID NO: 3286416 - DNA, 19 bp, Homo sapiens
agaaggagggcagagccat

SEQ ID NO: 3286417 - DNA, 21 bp, Homo sapiens
agaaggagggcagagccatgg

SEQ ID NO: 3286418 - DNA, 22 bp, Homo sapiens
agaaggcaagtttctagctaga

SEQ ID NO: 3286419 - DNA, 13 bp, Homo sapiens
agaaggcagcagg

SEQ ID NO: 3286420 - DNA, 15 bp, Homo sapiens
agaaggcagggaaag

SEQ ID NO: 3286421 - DNA, 23 bp, Homo sapiens
agaaggccttcatggccccagca

SEQ ID NO: 3286422 - DNA, 15 bp, Homo sapiens
agaaggcgaggagag

SEQ ID NO: 3286423 - DNA, 17 bp, Homo sapiens
agaaggcgaggagagtg

SEQ ID NO: 3286424 - DNA, 18 bp, Homo sapiens
agaaggcgcttcccaact

SEQ ID NO: 3286425 - DNA, 17 bp, Homo sapiens
agaaggcttaagaactg

SEQ ID NO: 3286426 - DNA, 20 bp, Homo sapiens
agaagggaagaaggggccat

SEQ ID NO: 3286427 - DNA, 14 bp, Homo sapiens
agaagggagaagaa

SEQ ID NO: 3286428 - DNA, 15 bp, Homo sapiens
agaagggagaagaaa

SEQ ID NO: 3286429 - DNA, 19 bp, Homo sapiens
agaagggcataaaacagct

SEQ ID NO: 3286430 - DNA, 19 bp, Homo sapiens
agaagggccagtcctgcct

SEQ ID NO: 3286431 - DNA, 17 bp, Homo sapiens
agaagggctcctgcagg

SEQ ID NO: 3286432 - DNA, 13 bp, Homo sapiens
agaagggggccct

SEQ ID NO: 3286433 - DNA, 15 bp, Homo sapiens
agaagggggccctgc

SEQ ID NO: 3286434 - DNA, 23 bp, Homo sapiens
agaagtaaccaactgaacgacaa

SEQ ID NO: 3286435 - DNA, 20 bp, Homo sapiens
agaagtagattaagagccat

SEQ ID NO: 3286436 - DNA, 17 bp, Homo sapiens
agaagtaggcatgaggg

SEQ ID NO: 3286437 - DNA, 22 bp, Homo sapiens
agaagtctttcagtggaattgt

SEQ ID NO: 3286438 - DNA, 24 bp, Homo sapiens
agaagtgcatttctgaatagaaat

SEQ ID NO: 3286439 - DNA, 22 bp, Homo sapiens
agaagtgtttgatggtgccaga

SEQ ID NO: 3286440 - DNA, 11 bp, Homo sapiens
agaagttactt

SEQ ID NO: 3286441 - DNA, 23 bp, Homo sapiens
agaagttattttctacagtggtt

SEQ ID NO: 3286442 - DNA, 17 bp, Homo sapiens
agaagttcatgtccaaa

SEQ ID NO: 3286443 - DNA, 18 bp, Homo sapiens
agaagttctcaaagttaa

SEQ ID NO: 3286444 - DNA, 18 bp, Homo sapiens
agaagtttgtagccaggt

SEQ ID NO: 3286445 - DNA, 21 bp, Homo sapiens
agaagtttgtccatttgtaaa

SEQ ID NO: 3286446 - DNA, 23 bp, Homo sapiens
agaagttttaacttccagtggct

SEQ ID NO: 3286447 - DNA, 14 bp, Homo sapiens
agaagtttttgtac

SEQ ID NO: 3286448 - DNA, 19 bp, Homo sapiens
agaagtttttgtactgtaa

SEQ ID NO: 3286449 - DNA, 21 bp, Homo sapiens
agaagtttttgtactgtaaag

SEQ ID NO: 3286450 - DNA, 20 bp, Homo sapiens
agaataaaagctataaagta

SEQ ID NO: 3286451 - DNA, 15 bp, Homo sapiens
agaataaagcagcct

SEQ ID NO: 3286452 - DNA, 17 bp, Homo sapiens
agaataaagcagcctga

SEQ ID NO: 3286453 - DNA, 13 bp, Homo sapiens
agaataaaggcag

SEQ ID NO: 3286454 - DNA, 15 bp, Homo sapiens
agaataaaggcagtt

SEQ ID NO: 3286455 - DNA, 20 bp, Homo sapiens
agaataaaggcagttttcta

SEQ ID NO: 3286456 - DNA, 21 bp, Homo sapiens
agaataaagttctgagtgttt

SEQ ID NO: 3286457 - DNA, 15 bp, Homo sapiens
agaataaggcaggca

SEQ ID NO: 3286458 - DNA, 16 bp, Homo sapiens
agaataaggcaggcat

SEQ ID NO: 3286459 - DNA, 17 bp, Homo sapiens
agaataatcacgctttc

SEQ ID NO: 3286460 - DNA, 21 bp, Homo sapiens
agaataatcacgctttcctga

SEQ ID NO: 3286461 - DNA, 13 bp, Homo sapiens
agaataatggaaa

SEQ ID NO: 3286462 - DNA, 21 bp, Homo sapiens
agaatacagaaagatggatgt

SEQ ID NO: 3286463 - DNA, 18 bp, Homo sapiens
agaatacagtaagctgct

SEQ ID NO: 3286464 - DNA, 16 bp, Homo sapiens
agaataccacatcaaa

SEQ ID NO: 3286465 - DNA, 18 bp, Homo sapiens
agaataccacatcaaata

SEQ ID NO: 3286466 - DNA, 19 bp, Homo sapiens
agaatactgcttgcttaca

SEQ ID NO: 3286467 - DNA, 12 bp, Homo sapiens
agaatacttttt

SEQ ID NO: 3286468 - DNA, 19 bp, Homo sapiens
agaatacttttttctagtt

SEQ ID NO: 3286469 - DNA, 23 bp, Homo sapiens
agaatagatctgatggtgagctg

SEQ ID NO: 3286470 - DNA, 16 bp, Homo sapiens
agaatagatgctgact

SEQ ID NO: 3286471 - DNA, 17 bp, Homo sapiens
agaatagccacatttgg

SEQ ID NO: 3286472 - DNA, 19 bp, Homo sapiens
agaatagccacatttggaa

SEQ ID NO: 3286473 - DNA, 19 bp, Homo sapiens
agaataggcattaacacaa

SEQ ID NO: 3286474 - DNA, 14 bp, Homo sapiens
agaatataggtctc

SEQ ID NO: 3286475 - DNA, 13 bp, Homo sapiens
agaatatatacat

SEQ ID NO: 3286476 - DNA, 12 bp, Homo sapiens
agaatatatata

SEQ ID NO: 3286477 - DNA, 20 bp, Homo sapiens
agaatatatttatttaaagc

SEQ ID NO: 3286478 - DNA, 20 bp, Homo sapiens
agaatatcaagatgattctg

SEQ ID NO: 3286479 - DNA, 18 bp, Homo sapiens
agaatatgtttccttgtt

SEQ ID NO: 3286480 - DNA, 21 bp, Homo sapiens
agaatattatagtttaaaagt

SEQ ID NO: 3286481 - DNA, 16 bp, Homo sapiens
agaatatttaagaaaa

SEQ ID NO: 3286482 - DNA, 24 bp, Homo sapiens
agaatatttaagaaaagcactttt

SEQ ID NO: 3286483 - DNA, 19 bp, Homo sapiens
agaatatttattacctctg

SEQ ID NO: 3286484 - DNA, 14 bp, Homo sapiens
agaatcaaaactct

SEQ ID NO: 3286485 - DNA, 12 bp, Homo sapiens
agactttctgtt

SEQ ID NO: 3286486 - DNA, 14 bp, Homo sapiens
agacttttgtacat

SEQ ID NO: 3286487 - DNA, 12 bp, Homo sapiens
agactttttggt

SEQ ID NO: 3286488 - DNA, 19 bp, Homo sapiens
agactttttggtggatgta

SEQ ID NO: 3286489 - DNA, 18 bp, Homo sapiens
agagaaaaaaaaaatagt

SEQ ID NO: 3286490 - DNA, 18 bp, Homo sapiens
agagaaaaaccaatgatt

SEQ ID NO: 3286491 - DNA, 12 bp, Homo sapiens
agagaaaataaa

SEQ ID NO: 3286492 - DNA, 18 bp, Homo sapiens
agagaaaatgtaaaggag

SEQ ID NO: 3286493 - DNA, 20 bp, Homo sapiens
agagaaaatgtaaaggaggg

SEQ ID NO: 3286494 - DNA, 21 bp, Homo sapiens
agagaaaatgtaaaggaggga

SEQ ID NO: 3286495 - DNA, 22 bp, Homo sapiens
agagaaaattgcactaaatgaa

SEQ ID NO: 3286496 - DNA, 22 bp, Homo sapiens
agagaaacactgaaaagaagga

SEQ ID NO: 3286497 - DNA, 16 bp, Homo sapiens
agagaaacagttggta

SEQ ID NO: 3286498 - DNA, 13 bp, Homo sapiens
agagaaagagaac

SEQ ID NO: 3286499 - DNA, 13 bp, Homo sapiens
agagaaagagaga

SEQ ID NO: 3286500 - DNA, 18 bp, Homo sapiens
agagaaagagagaagcca

SEQ ID NO: 3286501 - DNA, 14 bp, Homo sapiens
agagaaagccaggc

SEQ ID NO: 3286502 - DNA, 16 bp, Homo sapiens
agagaaagccaggcag

SEQ ID NO: 3286503 - DNA, 22 bp, Homo sapiens
agagaaagccaggcaggtagcc

SEQ ID NO: 3286504 - DNA, 18 bp, Homo sapiens
agagaaaggcctgcacac

SEQ ID NO: 3286505 - DNA, 20 bp, Homo sapiens
agagaaaggcctgcacacaa

SEQ ID NO: 3286506 - DNA, 12 bp, Homo sapiens
agagaaatcctt

SEQ ID NO: 3286507 - DNA, 13 bp, Homo sapiens
agagaaatccttc

SEQ ID NO: 3286508 - DNA, 18 bp, Homo sapiens
agagaaatgctaaccttg

SEQ ID NO: 3286509 - DNA, 19 bp, Homo sapiens
agagaaatgctaaccttgt

SEQ ID NO: 3286510 - DNA, 13 bp, Homo sapiens
agagaaattagaa

SEQ ID NO: 3286511 - DNA, 21 bp, Homo sapiens
agagaaatttttatttttgaa

SEQ ID NO: 3286512 - DNA, 11 bp, Homo sapiens
agagaacagtt

SEQ ID NO: 3286513 - DNA, 20 bp, Homo sapiens
agagaaccaccactgcctga

SEQ ID NO: 3286514 - DNA, 15 bp, Homo sapiens
agagaaccgagcaaa

SEQ ID NO: 3286515 - DNA, 17 bp, Homo sapiens
agagaaccgagcaaaga

SEQ ID NO: 3286516 - DNA, 13 bp, Homo sapiens
agagaagataatt

SEQ ID NO: 3286517 - DNA, 21 bp, Homo sapiens
agagaagcatcctccacatcc

SEQ ID NO: 3286518 - DNA, 15 bp, Homo sapiens
agagaagccacgctg

SEQ ID NO: 3286519 - DNA, 18 bp, Homo sapiens
agagaagcggatttccag

SEQ ID NO: 3286520 - DNA, 12 bp, Homo sapiens
agagaagctgaa

SEQ ID NO: 3286521 - DNA, 12 bp, Homo sapiens
agagaagctgga

SEQ ID NO: 3286522 - DNA, 13 bp, Homo sapiens
agagaaggaaaag

SEQ ID NO: 3286523 - DNA, 21 bp, Homo sapiens
agagaagggcataaaacagct

SEQ ID NO: 3286524 - DNA, 14 bp, Homo sapiens
agagaagtctcatt

SEQ ID NO: 3286525 - DNA, 23 bp, Homo sapiens
agagaagtttgtagccaggtact

SEQ ID NO: 3286526 - DNA, 18 bp, Homo sapiens
agagaatgaaagggccca

SEQ ID NO: 3286527 - DNA, 22 bp, Homo sapiens
agagaatgaaattgctgaaaga

SEQ ID NO: 3286528 - DNA, 18 bp, Homo sapiens
agagaatgagtccttgat

SEQ ID NO: 3286529 - DNA, 14 bp, Homo sapiens
agagaatgcacaga

SEQ ID NO: 3286530 - DNA, 20 bp, Homo sapiens
agagaatgcacagatatact

SEQ ID NO: 3286531 - DNA, 14 bp, Homo sapiens
agagaatgtatttg

SEQ ID NO: 3286532 - DNA, 16 bp, Homo sapiens
agagaattagattata

SEQ ID NO: 3286533 - DNA, 16 bp, Homo sapiens
agagaattatatattt

SEQ ID NO: 3286534 - DNA, 19 bp, Homo sapiens
agagaattgtttgaacccg

SEQ ID NO: 3286535 - DNA, 23 bp, Homo sapiens
agagaatttctaccatttcagag

SEQ ID NO: 3286536 - DNA, 23 bp, Homo sapiens
agagacacatacagagtgggccc

SEQ ID NO: 3286537 - DNA, 14 bp, Homo sapiens
agagacagaagcag

SEQ ID NO: 3286538 - DNA, 15 bp, Homo sapiens
agagacagaagcagg

SEQ ID NO: 3286539 - DNA, 17 bp, Homo sapiens
agagacagaagcaggct

SEQ ID NO: 3286540 - DNA, 23 bp, Homo sapiens
agagacagaagcaggctggaggt

SEQ ID NO: 3286541 - DNA, 16 bp, Homo sapiens
agagacaggcagctcg

SEQ ID NO: 3286542 - DNA, 15 bp, Homo sapiens
agagacaggcccaag

SEQ ID NO: 3286543 - DNA, 12 bp, Homo sapiens
agagacatatgg

SEQ ID NO: 3286544 - DNA, 17 bp, Homo sapiens
agagacatggaagagag

SEQ ID NO: 3286545 - DNA, 14 bp, Homo sapiens
agagacattcctcc

SEQ ID NO: 3286546 - DNA, 14 bp, Homo sapiens
agagacccccaggc

SEQ ID NO: 3286547 - DNA, 15 bp, Homo sapiens
agagaccccgcaccc

SEQ ID NO: 3286548 - DNA, 23 bp, Homo sapiens
agagaccgtcctcacccctgtcc

SEQ ID NO: 3286549 - DNA, 21 bp, Homo sapiens
agagaccgtcgggggctgagg

SEQ ID NO: 3286550 - DNA, 14 bp, Homo sapiens
agagacggcagaaa

SEQ ID NO: 3286551 - DNA, 15 bp, Homo sapiens
agagacggtgttttg

SEQ ID NO: 3286552 - DNA, 18 bp, Homo sapiens
agagactcagcgctcctc

SEQ ID NO: 3286553 - DNA, 19 bp, Homo sapiens
agagactcagcgctcctcc

SEQ ID NO: 3286554 - DNA, 13 bp, Homo sapiens
agagactgaaagc

SEQ ID NO: 3286555 - DNA, 17 bp, Homo sapiens
agagactgaaagcagca

SEQ ID NO: 3286556 - DNA, 18 bp, Homo sapiens
agagactgaaagcagcag

SEQ ID NO: 3286557 - DNA, 20 bp, Homo sapiens
agagactgaaagcagcagct

SEQ ID NO: 3286558 - DNA, 24 bp, Homo sapiens
agagactgaaagcagcagctagga

SEQ ID NO: 3286559 - DNA, 22 bp, Homo sapiens
agagactgagcagccgccagct

SEQ ID NO: 3286560 - DNA, 17 bp, Homo sapiens
agagactgcgttctgca

SEQ ID NO: 3286561 - DNA, 22 bp, Homo sapiens
agagactgcgttctgcaagcat

SEQ ID NO: 3286562 - DNA, 13 bp, Homo sapiens
agagactgggaag

SEQ ID NO: 3286563 - DNA, 14 bp, Homo sapiens
agagactgtagatt

SEQ ID NO: 3286564 - DNA, 16 bp, Homo sapiens
agagacttttaatcag

SEQ ID NO: 3286565 - DNA, 19 bp, Homo sapiens
agagagaaaaaaaaaatag

SEQ ID NO: 3286566 - DNA, 15 bp, Homo sapiens
agagagaaagccagg

SEQ ID NO: 3286567 - DNA, 22 bp, Homo sapiens
agagagaaagccaggcaggtag

SEQ ID NO: 3286568 - DNA, 19 bp, Homo sapiens
agagagaaattctgttaaa

SEQ ID NO: 3286569 - DNA, 21 bp, Homo sapiens
agagagaaattctgttaaaat

SEQ ID NO: 3286570 - DNA, 14 bp, Homo sapiens
agagagaagccagc

SEQ ID NO: 3286571 - DNA, 17 bp, Homo sapiens
agagagaagccagccac

SEQ ID NO: 3286572 - DNA, 21 bp, Homo sapiens
agagagacatggaaaaggaaa

SEQ ID NO: 3286573 - DNA, 22 bp, Homo sapiens
agagagaccccgcacccggctc

SEQ ID NO: 3286574 - DNA, 10 bp, Homo sapiens
agagagagaa

SEQ ID NO: 3286575 - DNA, 13 bp, Homo sapiens
agagagagaaaga

SEQ ID NO: 3286576 - DNA, 12 bp, Homo sapiens
agagagagagag

SEQ ID NO: 3286577 - DNA, 13 bp, Homo sapiens
agagagagagagg

SEQ ID NO: 3286578 - DNA, 13 bp, Homo sapiens
agagagaggggag

SEQ ID NO: 3286579 - DNA, 13 bp, Homo sapiens
agagagcaaggca

SEQ ID NO: 3286580 - DNA, 19 bp, Homo sapiens
agagagccatgaagcatta

SEQ ID NO: 3286581 - DNA, 18 bp, Homo sapiens
agagagccattttgtgaa

SEQ ID NO: 3286582 - DNA, 19 bp, Homo sapiens
agagagccattttgtgaat

SEQ ID NO: 3286583 - DNA, 16 bp, Homo sapiens
agagagcggtctcagg

SEQ ID NO: 3286584 - DNA, 14 bp, Homo sapiens
agagaggagaaaca

SEQ ID NO: 3286585 - DNA, 18 bp, Homo sapiens
agagaggagaaacacatc

SEQ ID NO: 3286586 - DNA, 15 bp, Homo sapiens
agagaggagaggaga

SEQ ID NO: 3286587 - DNA, 17 bp, Homo sapiens
agagaggagaggagaga

SEQ ID NO: 3286588 - DNA, 15 bp, Homo sapiens
agagaggagcacctg

SEQ ID NO: 3286589 - DNA, 14 bp, Homo sapiens
agagaggcagagag

SEQ ID NO: 3286590 - DNA, 15 bp, Homo sapiens
agagaggcagcaagt

SEQ ID NO: 3286591 - DNA, 16 bp, Homo sapiens
agagagggacaggcac

SEQ ID NO: 3286592 - DNA, 17 bp, Homo sapiens
agagagggaggtatgga

SEQ ID NO: 3286593 - DNA, 15 bp, Homo sapiens
agagagggcccagct

SEQ ID NO: 3286594 - DNA, 12 bp, Homo sapiens
agagagggggct

SEQ ID NO: 3286595 - DNA, 15 bp, Homo sapiens
agagagggggctctc

SEQ ID NO: 3286596 - DNA, 21 bp, Homo sapiens
agagagggtggtgacctctgc

SEQ ID NO: 3286597 - DNA, 22 bp, Homo sapiens
agagagggtggtgacctctgcc

SEQ ID NO: 3286598 - DNA, 16 bp, Homo sapiens
agagagtggctcctcc

SEQ ID NO: 3286599 - DNA, 17 bp, Homo sapiens
agagagtggctcctccc

SEQ ID NO: 3286600 - DNA, 21 bp, Homo sapiens
agagataaaccaataaatcca

SEQ ID NO: 3286601 - DNA, 21 bp, Homo sapiens
agagatattgatattgaagga

SEQ ID NO: 3286602 - DNA, 16 bp, Homo sapiens
agagatccaggaagca

SEQ ID NO: 3286603 - DNA, 12 bp, Homo sapiens
agagatgaatta

SEQ ID NO: 3286604 - DNA, 17 bp, Homo sapiens
agagatgactgagtcct

SEQ ID NO: 3286605 - DNA, 18 bp, Homo sapiens
agagatgactgagtcctc

SEQ ID NO: 3286606 - DNA, 20 bp, Homo sapiens
agagatgcactatatgttta

SEQ ID NO: 3286607 - DNA, 15 bp, Homo sapiens
agagatgccagccct

SEQ ID NO: 3286608 - DNA, 19 bp, Homo sapiens
agagatgggaatgaggtgg

SEQ ID NO: 3286609 - DNA, 12 bp, Homo sapiens
agagatgttttt

SEQ ID NO: 3286610 - DNA, 18 bp, Homo sapiens
agagatttatataaatgt

SEQ ID NO: 3286611 - DNA, 14 bp, Homo sapiens
agagcaaaattgat

SEQ ID NO: 3286612 - DNA, 16 bp, Homo sapiens
agagtaactttactct

SEQ ID NO: 3286613 - DNA, 23 bp, Homo sapiens
agagtaactttactctgtgttta

SEQ ID NO: 3286614 - DNA, 15 bp, Homo sapiens
agagtactgggagaa

SEQ ID NO: 3286615 - DNA, 18 bp, Homo sapiens
agagtagaaagcttgaaa

SEQ ID NO: 3286616 - DNA, 15 bp, Homo sapiens
agagtagaattgcat

SEQ ID NO: 3286617 - DNA, 17 bp, Homo sapiens
agagtagaattgcattg

SEQ ID NO: 3286618 - DNA, 14 bp, Homo sapiens
agagtagcatttca

SEQ ID NO: 3286619 - DNA, 15 bp, Homo sapiens
agagtagccattctt

SEQ ID NO: 3286620 - DNA, 13 bp, Homo sapiens
agagtatatgcac

SEQ ID NO: 3286621 - DNA, 21 bp, Homo sapiens
agagtatccttccttcagggt

SEQ ID NO: 3286622 - DNA, 13 bp, Homo sapiens
agagtatctttac

SEQ ID NO: 3286623 - DNA, 18 bp, Homo sapiens
agagtatgtagtggcttc

SEQ ID NO: 3286624 - DNA, 13 bp, Homo sapiens
agagtcaaagctg

SEQ ID NO: 3286625 - DNA, 22 bp, Homo sapiens
agagtcaactacacaaagcagg

SEQ ID NO: 3286626 - DNA, 22 bp, Homo sapiens
agagtcacagttccctttattt

SEQ ID NO: 3286627 - DNA, 18 bp, Homo sapiens
agagtcatattttgatta

SEQ ID NO: 3286628 - DNA, 13 bp, Homo sapiens
agagtcatctcca

SEQ ID NO: 3286629 - DNA, 19 bp, Homo sapiens
agagtcatctccatcagct

SEQ ID NO: 3286630 - DNA, 21 bp, Homo sapiens
agagtccaaggtttaaagagt

SEQ ID NO: 3286631 - DNA, 16 bp, Homo sapiens
agagtccactgtggca

SEQ ID NO: 3286632 - DNA, 17 bp, Homo sapiens
agagtccatttcccaca

SEQ ID NO: 3286633 - DNA, 21 bp, Homo sapiens
agagtccatttcccacatctt

SEQ ID NO: 3286634 - DNA, 14 bp, Homo sapiens
agagtcccactgcc

SEQ ID NO: 3286635 - DNA, 18 bp, Homo sapiens
agagtcccactgcctcag

SEQ ID NO: 3286636 - DNA, 19 bp, Homo sapiens
agagtcccactgcctcagg

SEQ ID NO: 3286637 - DNA, 22 bp, Homo sapiens
agagtcccactgcctcaggttc

SEQ ID NO: 3286638 - DNA, 17 bp, Homo sapiens
agagtcctgtgctgaat

SEQ ID NO: 3286639 - DNA, 17 bp, Homo sapiens
agagtccttattcttct

SEQ ID NO: 3286640 - DNA, 21 bp, Homo sapiens
agagtccttattcttctcata

SEQ ID NO: 3286641 - DNA, 12 bp, Homo sapiens
agagtctaaaga

SEQ ID NO: 3286642 - DNA, 14 bp, Homo sapiens
agagtctaaagatg

SEQ ID NO: 3286643 - DNA, 12 bp, Homo sapiens
agagtctagatt

SEQ ID NO: 3286644 - DNA, 23 bp, Homo sapiens
agagtctagattcaaaggttcta

SEQ ID NO: 3286645 - DNA, 14 bp, Homo sapiens
agagtctagattct

SEQ ID NO: 3286646 - DNA, 15 bp, Homo sapiens
agagtctagggcaca

SEQ ID NO: 3286647 - DNA, 20 bp, Homo sapiens
agagtctcactgttgcccag

SEQ ID NO: 3286648 - DNA, 13 bp, Homo sapiens
agagtctgaacag

SEQ ID NO: 3286649 - DNA, 12 bp, Homo sapiens
agagtctgagcc

SEQ ID NO: 3286650 - DNA, 18 bp, Homo sapiens
agagtctggtgaagctca

SEQ ID NO: 3286651 - DNA, 12 bp, Homo sapiens
agagtctgtctc

SEQ ID NO: 3286652 - DNA, 18 bp, Homo sapiens
agagtcttacaatcaaat

SEQ ID NO: 3286653 - DNA, 16 bp, Homo sapiens
agagtgaaagggctat

SEQ ID NO: 3286654 - DNA, 17 bp, Homo sapiens
agagtgaaagggctatg

SEQ ID NO: 3286655 - DNA, 18 bp, Homo sapiens
agagtgaaataattaaaa

SEQ ID NO: 3286656 - DNA, 23 bp, Homo sapiens
agagtgaagcgtttttctttttc

SEQ ID NO: 3286657 - DNA, 19 bp, Homo sapiens
agagtgactagtacaaatt

SEQ ID NO: 3286658 - DNA, 16 bp, Homo sapiens
agagtgactccaagaa

SEQ ID NO: 3286659 - DNA, 21 bp, Homo sapiens
agagtgagagggcatgcgcac

SEQ ID NO: 3286660 - DNA, 17 bp, Homo sapiens
agagtgataatacaagt

SEQ ID NO: 3286661 - DNA, 14 bp, Homo sapiens
agagtgccactgcg

SEQ ID NO: 3286662 - DNA, 17 bp, Homo sapiens
agagtggactgcattta

SEQ ID NO: 3286663 - DNA, 17 bp, Homo sapiens
agagtggagtctgagtc

SEQ ID NO: 3286664 - DNA, 15 bp, Homo sapiens
agagtggcctccctg

SEQ ID NO: 3286665 - DNA, 12 bp, Homo sapiens
agagtggctcct

SEQ ID NO: 3286666 - DNA, 14 bp, Homo sapiens
agagtgggccccgg

SEQ ID NO: 3286667 - DNA, 22 bp, Homo sapiens
agagtgggccccgggctggaga

SEQ ID NO: 3286668 - DNA, 22 bp, Homo sapiens
agagtgggggagagcaggctgg

SEQ ID NO: 3286669 - DNA, 18 bp, Homo sapiens
agagtggtctttctggag

SEQ ID NO: 3286670 - DNA, 16 bp, Homo sapiens
agagtgtacatcatgt

SEQ ID NO: 3286671 - DNA, 18 bp, Homo sapiens
agagtgtagaagcattcc

SEQ ID NO: 3286672 - DNA, 13 bp, Homo sapiens
agagtgtagccta

SEQ ID NO: 3286673 - DNA, 21 bp, Homo sapiens
agagtgtagcctaaagggcag

SEQ ID NO: 3286674 - DNA, 23 bp, Homo sapiens
agagtgtagcctaaagggcaggg

SEQ ID NO: 3286675 - DNA, 12 bp, Homo sapiens
agagtgtagctg

SEQ ID NO: 3286676 - DNA, 21 bp, Homo sapiens
agagtgtctcagggtgcagag

SEQ ID NO: 3286677 - DNA, 13 bp, Homo sapiens
agagttaagaagc

SEQ ID NO: 3286678 - DNA, 16 bp, Homo sapiens
agagttaagaagctgt

SEQ ID NO: 3286679 - DNA, 18 bp, Homo sapiens
agagttaagaagctgttg

SEQ ID NO: 3286680 - DNA, 15 bp, Homo sapiens
agagttacagttctg

SEQ ID NO: 3286681 - DNA, 16 bp, Homo sapiens
agagttacagttctgt

SEQ ID NO: 3286682 - DNA, 17 bp, Homo sapiens
agagttacagttctgtg

SEQ ID NO: 3286683 - DNA, 15 bp, Homo sapiens
agagttattgaatct

SEQ ID NO: 3286684 - DNA, 16 bp, Homo sapiens
agagttcaagcctgtg

SEQ ID NO: 3286685 - DNA, 14 bp, Homo sapiens
agagttcatcccag

SEQ ID NO: 3286686 - DNA, 19 bp, Homo sapiens
agagttgaggaactgtaca

SEQ ID NO: 3286687 - DNA, 19 bp, Homo sapiens
agagttgggacaattgctt

SEQ ID NO: 3286688 - DNA, 19 bp, Homo sapiens
agagttgggtgtctcctta

SEQ ID NO: 3286689 - DNA, 20 bp, Homo sapiens
agagtttcagtttgttggaa

SEQ ID NO: 3286690 - DNA, 21 bp, Homo sapiens
agagtttcagtttgttggaaa

SEQ ID NO: 3286691 - DNA, 21 bp, Homo sapiens
agagtttgccttcctttctcc

SEQ ID NO: 3286692 - DNA, 13 bp, Homo sapiens
agagtttgtcatt

SEQ ID NO: 3286693 - DNA, 18 bp, Homo sapiens
agagtttgtgtgttgtct

SEQ ID NO: 3286694 - DNA, 23 bp, Homo sapiens
agagtttgttctgttctggggga

SEQ ID NO: 3286695 - DNA, 16 bp, Homo sapiens
agagttttctttagta

SEQ ID NO: 3286696 - DNA, 13 bp, Homo sapiens
agagttttgtctt

SEQ ID NO: 3286697 - DNA, 14 bp, Homo sapiens
agagttttgtcttg

SEQ ID NO: 3286698 - DNA, 18 bp, Homo sapiens
agataaagaccagaaatt

SEQ ID NO: 3286699 - DNA, 11 bp, Homo sapiens
agataaagatg

SEQ ID NO: 3286700 - DNA, 15 bp, Homo sapiens
agataaagatgatct

SEQ ID NO: 3286701 - DNA, 20 bp, Homo sapiens
agataaatatttgacttgca

SEQ ID NO: 3286702 - DNA, 13 bp, Homo sapiens
agataaattataa

SEQ ID NO: 3286703 - DNA, 13 bp, Homo sapiens
agataacattttc

SEQ ID NO: 3286704 - DNA, 14 bp, Homo sapiens
agataacattttca

SEQ ID NO: 3286705 - DNA, 17 bp, Homo sapiens
agataacccttattcca

SEQ ID NO: 3286706 - DNA, 19 bp, Homo sapiens
agataacttttttgagtca

SEQ ID NO: 3286707 - DNA, 16 bp, Homo sapiens
agataagcaagagaga

SEQ ID NO: 3286708 - DNA, 20 bp, Homo sapiens
agataagcaagagagatgtt

SEQ ID NO: 3286709 - DNA, 22 bp, Homo sapiens
agataagcaagagagatgtttt

SEQ ID NO: 3286710 - DNA, 14 bp, Homo sapiens
agataagcctgagc

SEQ ID NO: 3286711 - DNA, 16 bp, Homo sapiens
agataagtgtattttt

SEQ ID NO: 3286712 - DNA, 14 bp, Homo sapiens
agataatattgttt

SEQ ID NO: 3286713 - DNA, 17 bp, Homo sapiens
agataatattgtttggt

SEQ ID NO: 3286714 - DNA, 20 bp, Homo sapiens
agataatattgtttggtaaa

SEQ ID NO: 3286715 - DNA, 16 bp, Homo sapiens
agataatcagcctctt

SEQ ID NO: 3286716 - DNA, 16 bp, Homo sapiens
agataatctagaacac

SEQ ID NO: 3286717 - DNA, 21 bp, Homo sapiens
agataatgttagaggttttaa

SEQ ID NO: 3286718 - DNA, 17 bp, Homo sapiens
agataatgttctttaat

SEQ ID NO: 3286719 - DNA, 20 bp, Homo sapiens
agataatgttctttaatgtt

SEQ ID NO: 3286720 - DNA, 12 bp, Homo sapiens
agataattataa

SEQ ID NO: 3286721 - DNA, 18 bp, Homo sapiens
agataattcatttgtatt

SEQ ID NO: 3286722 - DNA, 18 bp, Homo sapiens
agataattgctatttatt

SEQ ID NO: 3286723 - DNA, 17 bp, Homo sapiens
agataattgttgaaatt

SEQ ID NO: 3286724 - DNA, 22 bp, Homo sapiens
agataattgttgaaattttgca

SEQ ID NO: 3286725 - DNA, 13 bp, Homo sapiens
agataatttgaaa

SEQ ID NO: 3286726 - DNA, 13 bp, Homo sapiens
agataatttgcat

SEQ ID NO: 3286727 - DNA, 20 bp, Homo sapiens
agataatttgcatattctat

SEQ ID NO: 3286728 - DNA, 15 bp, Homo sapiens
agatacaagtttcag

SEQ ID NO: 3286729 - DNA, 22 bp, Homo sapiens
agatacatatgagtgtggaagc

SEQ ID NO: 3286730 - DNA, 16 bp, Homo sapiens
agatacatcactgctt

SEQ ID NO: 3286731 - DNA, 19 bp, Homo sapiens
agataccaggttgaaagac

SEQ ID NO: 3286732 - DNA, 16 bp, Homo sapiens
agataccatactcatt

SEQ ID NO: 3286733 - DNA, 19 bp, Homo sapiens
agataccatactcatttct

SEQ ID NO: 3286734 - DNA, 19 bp, Homo sapiens
agataccttatcttacaat

SEQ ID NO: 3286735 - DNA, 14 bp, Homo sapiens
agatacgactttat

SEQ ID NO: 3286736 - DNA, 18 bp, Homo sapiens
agatactaaggacgttgt

SEQ ID NO: 3286737 - DNA, 18 bp, Homo sapiens
agatagaaataaatagct

SEQ ID NO: 3286738 - DNA, 22 bp, Homo sapiens
agatagaaataaatagctatat

SEQ ID NO: 3286739 - DNA, 15 bp, Homo sapiens
agattcctctgtatt

SEQ ID NO: 3286740 - DNA, 13 bp, Homo sapiens
agattcctgggcc

SEQ ID NO: 3286741 - DNA, 17 bp, Homo sapiens
agattctaaagattcta

SEQ ID NO: 3286742 - DNA, 12 bp, Homo sapiens
agattctaaagg

SEQ ID NO: 3286743 - DNA, 13 bp, Homo sapiens
agattctaaaggt

SEQ ID NO: 3286744 - DNA, 14 bp, Homo sapiens
agattctagatgat

SEQ ID NO: 3286745 - DNA, 20 bp, Homo sapiens
agattctatagttctagaca

SEQ ID NO: 3286746 - DNA, 21 bp, Homo sapiens
agattctatagttctagacat

SEQ ID NO: 3286747 - DNA, 15 bp, Homo sapiens
agattctgacattta

SEQ ID NO: 3286748 - DNA, 17 bp, Homo sapiens
agattctgacatttata

SEQ ID NO: 3286749 - DNA, 18 bp, Homo sapiens
agattctgacatttatat

SEQ ID NO: 3286750 - DNA, 19 bp, Homo sapiens
agattctgacatttatatt

SEQ ID NO: 3286751 - DNA, 15 bp, Homo sapiens
agattctgtcttata

SEQ ID NO: 3286752 - DNA, 22 bp, Homo sapiens
agattcttgtatttattacaac

SEQ ID NO: 3286753 - DNA, 20 bp, Homo sapiens
agattctttcagttctttgg

SEQ ID NO: 3286754 - DNA, 12 bp, Homo sapiens
agattgagaaat

SEQ ID NO: 3286755 - DNA, 14 bp, Homo sapiens
agattgagaaatgt

SEQ ID NO: 3286756 - DNA, 14 bp, Homo sapiens
agattgagaagcca

SEQ ID NO: 3286757 - DNA, 15 bp, Homo sapiens
agattgagaagccat

SEQ ID NO: 3286758 - DNA, 15 bp, Homo sapiens
agattgagaaggaga

SEQ ID NO: 3286759 - DNA, 18 bp, Homo sapiens
agattgagaaggagagaa

SEQ ID NO: 3286760 - DNA, 19 bp, Homo sapiens
agattgagagaagagacaa

SEQ ID NO: 3286761 - DNA, 22 bp, Homo sapiens
agattgagtataaaaacttgaa

SEQ ID NO: 3286762 - DNA, 21 bp, Homo sapiens
agattgcaacaggctgggctt

SEQ ID NO: 3286763 - DNA, 18 bp, Homo sapiens
agattgcagaaaattctg

SEQ ID NO: 3286764 - DNA, 19 bp, Homo sapiens
agattgcagaaaattctgt

SEQ ID NO: 3286765 - DNA, 16 bp, Homo sapiens
agattgcgccactgca

SEQ ID NO: 3286766 - DNA, 19 bp, Homo sapiens
agattgctgaaaaagtaga

SEQ ID NO: 3286767 - DNA, 13 bp, Homo sapiens
agattgctgaaat

SEQ ID NO: 3286768 - DNA, 17 bp, Homo sapiens
agattgcttctgtagta

SEQ ID NO: 3286769 - DNA, 14 bp, Homo sapiens
agattgggataagg

SEQ ID NO: 3286770 - DNA, 14 bp, Homo sapiens
agattgggtgccag

SEQ ID NO: 3286771 - DNA, 17 bp, Homo sapiens
agattgtattactttaa

SEQ ID NO: 3286772 - DNA, 13 bp, Homo sapiens
agattgtcttgca

SEQ ID NO: 3286773 - DNA, 18 bp, Homo sapiens
agattgtgggggaaaaat

SEQ ID NO: 3286774 - DNA, 20 bp, Homo sapiens
agattgtgggggaaaaataa

SEQ ID NO: 3286775 - DNA, 15 bp, Homo sapiens
agattgtgtaacaat

SEQ ID NO: 3286776 - DNA, 15 bp, Homo sapiens
agattgttgtttgcc

SEQ ID NO: 3286777 - DNA, 23 bp, Homo sapiens
agattgttgtttgccatactttg

SEQ ID NO: 3286778 - DNA, 11 bp, Homo sapiens
agatttaagca

SEQ ID NO: 3286779 - DNA, 20 bp, Homo sapiens
agatttaagcacaaacttta

SEQ ID NO: 3286780 - DNA, 20 bp, Homo sapiens
agatttaccagggatgtaga

SEQ ID NO: 3286781 - DNA, 20 bp, Homo sapiens
agatttaccctttatagaac

SEQ ID NO: 3286782 - DNA, 22 bp, Homo sapiens
agatttaccttttctgttgtac

SEQ ID NO: 3286783 - DNA, 15 bp, Homo sapiens
agatttatataaatg

SEQ ID NO: 3286784 - DNA, 14 bp, Homo sapiens
agatttcaacatat

SEQ ID NO: 3286785 - DNA, 15 bp, Homo sapiens
agatttcaacatatc

SEQ ID NO: 3286786 - DNA, 17 bp, Homo sapiens
agatttcaagaaaaaat

SEQ ID NO: 3286787 - DNA, 19 bp, Homo sapiens
agatttcaagaaaaaataa

SEQ ID NO: 3286788 - DNA, 20 bp, Homo sapiens
agatttccttaaaatctcta

SEQ ID NO: 3286789 - DNA, 10 bp, Homo sapiens
agatttctac

SEQ ID NO: 3286790 - DNA, 12 bp, Homo sapiens
agatttctatga

SEQ ID NO: 3286791 - DNA, 18 bp, Homo sapiens
agatttctcattgacttt

SEQ ID NO: 3286792 - DNA, 18 bp, Homo sapiens
agatttcttaaatctttc

SEQ ID NO: 3286793 - DNA, 15 bp, Homo sapiens
agatttgccagcaca

SEQ ID NO: 3286794 - DNA, 14 bp, Homo sapiens
agatttgcccattt

SEQ ID NO: 3286795 - DNA, 20 bp, Homo sapiens
agatttgcccatttacactt

SEQ ID NO: 3286796 - DNA, 17 bp, Homo sapiens
agatttggcttgacaaa

SEQ ID NO: 3286797 - DNA, 23 bp, Homo sapiens
agatttgtaggaaggtctcattc

SEQ ID NO: 3286798 - DNA, 12 bp, Homo sapiens
agatttgtcctt

SEQ ID NO: 3286799 - DNA, 13 bp, Homo sapiens
agattttaaattc

SEQ ID NO: 3286800 - DNA, 19 bp, Homo sapiens
agattttaaattcacaata

SEQ ID NO: 3286801 - DNA, 16 bp, Homo sapiens
agattttaattgtcat

SEQ ID NO: 3286802 - DNA, 19 bp, Homo sapiens
agattttaatttatttgtt

SEQ ID NO: 3286803 - DNA, 21 bp, Homo sapiens
agattttaatttatttgtttc

SEQ ID NO: 3286804 - DNA, 19 bp, Homo sapiens
agattttagcatgatgaaa

SEQ ID NO: 3286805 - DNA, 21 bp, Homo sapiens
agattttgaaatttttattaa

SEQ ID NO: 3286806 - DNA, 19 bp, Homo sapiens
agattttgaggtaaagata

SEQ ID NO: 3286807 - DNA, 13 bp, Homo sapiens
agatttttacaaa

SEQ ID NO: 3286808 - DNA, 21 bp, Homo sapiens
agatttttcggaggccccact

SEQ ID NO: 3286809 - DNA, 14 bp, Homo sapiens
agatttttttgtgt

SEQ ID NO: 3286810 - DNA, 14 bp, Homo sapiens
agcaaaaaagagtt

SEQ ID NO: 3286811 - DNA, 12 bp, Homo sapiens
agcaaaacaaaa

SEQ ID NO: 3286812 - DNA, 14 bp, Homo sapiens
agcaaaagaaaaag

SEQ ID NO: 3286813 - DNA, 13 bp, Homo sapiens
agcaaaaggcagc

SEQ ID NO: 3286814 - DNA, 17 bp, Homo sapiens
agcaaaaggcagctcac

SEQ ID NO: 3286815 - DNA, 22 bp, Homo sapiens
agcaaaaggcagctcacccctg

SEQ ID NO: 3286816 - DNA, 15 bp, Homo sapiens
agcaaaaggctgaga

SEQ ID NO: 3286817 - DNA, 16 bp, Homo sapiens
agcaaaataaggaaga

SEQ ID NO: 3286818 - DNA, 21 bp, Homo sapiens
agcaaaataaggaagagggct

SEQ ID NO: 3286819 - DNA, 17 bp, Homo sapiens
agcaaaatatgcccctt

SEQ ID NO: 3286820 - DNA, 18 bp, Homo sapiens
agcaaaatatgccccttc

SEQ ID NO: 3286821 - DNA, 23 bp, Homo sapiens
agcaaaattgatgtgtttattta

SEQ ID NO: 3286822 - DNA, 21 bp, Homo sapiens
agcaaacatcaaataaatttc

SEQ ID NO: 3286823 - DNA, 23 bp, Homo sapiens
agcaaaccagcttgttctgggct

SEQ ID NO: 3286824 - DNA, 13 bp, Homo sapiens
agcaaactctttt

SEQ ID NO: 3286825 - DNA, 13 bp, Homo sapiens
agcaaacttggaa

SEQ ID NO: 3286826 - DNA, 12 bp, Homo sapiens
agcaaagaaact

SEQ ID NO: 3286827 - DNA, 20 bp, Homo sapiens
agcaaagcaaaaggctgaga

SEQ ID NO: 3286828 - DNA, 19 bp, Homo sapiens
agcaaagcacccatttcaa

SEQ ID NO: 3286829 - DNA, 22 bp, Homo sapiens
agcaaagcacccatttcaatgt

SEQ ID NO: 3286830 - DNA, 21 bp, Homo sapiens
agcaaagctgatgacaacttc

SEQ ID NO: 3286831 - DNA, 20 bp, Homo sapiens
agcaaatcatctgcattcct

SEQ ID NO: 3286832 - DNA, 14 bp, Homo sapiens
agcaaatttcaaaa

SEQ ID NO: 3286833 - DNA, 19 bp, Homo sapiens
agcaaatttcaaaagacat

SEQ ID NO: 3286834 - DNA, 23 bp, Homo sapiens
agcaacagagtgagaccctgtct

SEQ ID NO: 3286835 - DNA, 18 bp, Homo sapiens
agcaacaggttttataat

SEQ ID NO: 3286836 - DNA, 19 bp, Homo sapiens
agcaacaggttttataatt

SEQ ID NO: 3286837 - DNA, 19 bp, Homo sapiens
agcaacccctgtacccagc

SEQ ID NO: 3286838 - DNA, 15 bp, Homo sapiens
agcaacctacccagc

SEQ ID NO: 3286839 - DNA, 19 bp, Homo sapiens
agcaacctttcacctttgt

SEQ ID NO: 3286840 - DNA, 23 bp, Homo sapiens
agcaacctttcacctttgtgtat

SEQ ID NO: 3286841 - DNA, 23 bp, Homo sapiens
agcaacctttttccctcttccca

SEQ ID NO: 3286842 - DNA, 13 bp, Homo sapiens
agcaactgttatg

SEQ ID NO: 3286843 - DNA, 18 bp, Homo sapiens
agcaactttgatggaaga

SEQ ID NO: 3286844 - DNA, 22 bp, Homo sapiens
agcaagaaggaaagatttgtga

SEQ ID NO: 3286845 - DNA, 15 bp, Homo sapiens
agcaagacagagacg

SEQ ID NO: 3286846 - DNA, 23 bp, Homo sapiens
agcaagacagagacgcaggaatg

SEQ ID NO: 3286847 - DNA, 19 bp, Homo sapiens
agcaagagggaacaaaact

SEQ ID NO: 3286848 - DNA, 18 bp, Homo sapiens
agcaagatattgatcaaa

SEQ ID NO: 3286849 - DNA, 19 bp, Homo sapiens
agcaaggccctgctgccca

SEQ ID NO: 3286850 - DNA, 23 bp, Homo sapiens
agcaagggaccttcatgcccttc

SEQ ID NO: 3286851 - DNA, 12 bp, Homo sapiens
agcaagggagaa

SEQ ID NO: 3286852 - DNA, 14 bp, Homo sapiens
agcaagggagaaaa

SEQ ID NO: 3286853 - DNA, 20 bp, Homo sapiens
agcaagggctccagcatcca

SEQ ID NO: 3286854 - DNA, 18 bp, Homo sapiens
agcaagggggtgatgtag

SEQ ID NO: 3286855 - DNA, 16 bp, Homo sapiens
agcaaggtcatttctt

SEQ ID NO: 3286856 - DNA, 20 bp, Homo sapiens
agcaaggtgggtggaaacta

SEQ ID NO: 3286857 - DNA, 21 bp, Homo sapiens
agcaaggtttaaatttgttat

SEQ ID NO: 3286858 - DNA, 13 bp, Homo sapiens
agcaagtgagagc

SEQ ID NO: 3286859 - DNA, 14 bp, Homo sapiens
agcaagtgagagct

SEQ ID NO: 3286860 - DNA, 18 bp, Homo sapiens
agcaagtgagagctgggt

SEQ ID NO: 3286861 - DNA, 16 bp, Homo sapiens
agcaagttacagtgat

SEQ ID NO: 3286862 - DNA, 14 bp, Homo sapiens
agcaataaatgaat

SEQ ID NO: 3286863 - DNA, 22 bp, Homo sapiens
agcaatatattaccagcaagaa

SEQ ID NO: 3286864 - DNA, 24 bp, Homo sapiens
agcaatatattaccagcaagaata

SEQ ID NO: 3286865 - DNA, 22 bp, Homo sapiens
agccaaagaaacaagctgtgca

SEQ ID NO: 3286866 - DNA, 14 bp, Homo sapiens
agccaaagaaatga

SEQ ID NO: 3286867 - DNA, 15 bp, Homo sapiens
agccaaagagaatgc

SEQ ID NO: 3286868 - DNA, 23 bp, Homo sapiens
agccaaagctaggcctggccaga

SEQ ID NO: 3286869 - DNA, 20 bp, Homo sapiens
agccaaatgcagggagggga

SEQ ID NO: 3286870 - DNA, 21 bp, Homo sapiens
agccaacagtcaaaacagaga

SEQ ID NO: 3286871 - DNA, 18 bp, Homo sapiens
agccaacctcggcttgtg

SEQ ID NO: 3286872 - DNA, 21 bp, Homo sapiens
agccaacgacaaagccaaact

SEQ ID NO: 3286873 - DNA, 19 bp, Homo sapiens
agccaactctaacaggcac

SEQ ID NO: 3286874 - DNA, 20 bp, Homo sapiens
agccaactctaacaggcact

SEQ ID NO: 3286875 - DNA, 13 bp, Homo sapiens
agccaactctggg

SEQ ID NO: 3286876 - DNA, 21 bp, Homo sapiens
agccaactgctaatgcaaatt

SEQ ID NO: 3286877 - DNA, 19 bp, Homo sapiens
agccaacttgtaaatacac

SEQ ID NO: 3286878 - DNA, 15 bp, Homo sapiens
agccaacttttgcat

SEQ ID NO: 3286879 - DNA, 22 bp, Homo sapiens
agccaagattttcctcttgtga

SEQ ID NO: 3286880 - DNA, 18 bp, Homo sapiens
agccaagctccctggagc

SEQ ID NO: 3286881 - DNA, 22 bp, Homo sapiens
agccaagctccctggagccctg

SEQ ID NO: 3286882 - DNA, 17 bp, Homo sapiens
agccaagcttgttatca

SEQ ID NO: 3286883 - DNA, 19 bp, Homo sapiens
agccaaggaggcctgggga

SEQ ID NO: 3286884 - DNA, 14 bp, Homo sapiens
agccaagggaaagg

SEQ ID NO: 3286885 - DNA, 17 bp, Homo sapiens
agccaagggaacctgtg

SEQ ID NO: 3286886 - DNA, 20 bp, Homo sapiens
agccaagggaacctgtgtcc

SEQ ID NO: 3286887 - DNA, 17 bp, Homo sapiens
agccaagggtatccaag

SEQ ID NO: 3286888 - DNA, 22 bp, Homo sapiens
agccaaggttttataaggctga

SEQ ID NO: 3286889 - DNA, 17 bp, Homo sapiens
agccaagtcctccctct

SEQ ID NO: 3286890 - DNA, 12 bp, Homo sapiens
agccaagtgtga

SEQ ID NO: 3286891 - DNA, 14 bp, Homo sapiens
agccaagtgtgacc

SEQ ID NO: 3286892 - DNA, 20 bp, Homo sapiens
agccaatcccctccttgggc

SEQ ID NO: 3286893 - DNA, 22 bp, Homo sapiens
agccaatctacaatctcttttt

SEQ ID NO: 3286894 - DNA, 16 bp, Homo sapiens
agccaatgtctcctcc

SEQ ID NO: 3286895 - DNA, 12 bp, Homo sapiens
agccacaaatgc

SEQ ID NO: 3286896 - DNA, 15 bp, Homo sapiens
agccacaaggctggc

SEQ ID NO: 3286897 - DNA, 18 bp, Homo sapiens
agccacaaggctggccag

SEQ ID NO: 3286898 - DNA, 16 bp, Homo sapiens
agccacaagtcttcca

SEQ ID NO: 3286899 - DNA, 18 bp, Homo sapiens
agccacaagtcttccaga

SEQ ID NO: 3286900 - DNA, 15 bp, Homo sapiens
agccacagacccctg

SEQ ID NO: 3286901 - DNA, 16 bp, Homo sapiens
agccacagacccctgg

SEQ ID NO: 3286902 - DNA, 21 bp, Homo sapiens
agccacatagagtgactccaa

SEQ ID NO: 3286903 - DNA, 12 bp, Homo sapiens
agccacatggcc

SEQ ID NO: 3286904 - DNA, 15 bp, Homo sapiens
agccacatggcccca

SEQ ID NO: 3286905 - DNA, 14 bp, Homo sapiens
agccacattatttc

SEQ ID NO: 3286906 - DNA, 22 bp, Homo sapiens
agccacatttggaatacttttt

SEQ ID NO: 3286907 - DNA, 12 bp, Homo sapiens
agccaccagttc

SEQ ID NO: 3286908 - DNA, 18 bp, Homo sapiens
agccaccatccccaccct

SEQ ID NO: 3286909 - DNA, 18 bp, Homo sapiens
agccacccaagcctgctg

SEQ ID NO: 3286910 - DNA, 20 bp, Homo sapiens
agccacccaagcctgctggc

SEQ ID NO: 3286911 - DNA, 18 bp, Homo sapiens
agccaccccagaaatggt

SEQ ID NO: 3286912 - DNA, 20 bp, Homo sapiens
agccaccccagaaatggtga

SEQ ID NO: 3286913 - DNA, 16 bp, Homo sapiens
agccaccctaccatga

SEQ ID NO: 3286914 - DNA, 15 bp, Homo sapiens
agccaccgaagccgc

SEQ ID NO: 3286915 - DNA, 21 bp, Homo sapiens
agccaccgctgccagcacaga

SEQ ID NO: 3286916 - DNA, 15 bp, Homo sapiens
agccacctctccctc

SEQ ID NO: 3286917 - DNA, 23 bp, Homo sapiens
agccacctctgtcatttgttgtg

SEQ ID NO: 3286918 - DNA, 23 bp, Homo sapiens
agccaccttttgggaatgtttta

SEQ ID NO: 3286919 - DNA, 15 bp, Homo sapiens
agccacgaccagccc

SEQ ID NO: 3286920 - DNA, 19 bp, Homo sapiens
agccacgaccagccccttc

SEQ ID NO: 3286921 - DNA, 19 bp, Homo sapiens
agccactcagtctcttcca

SEQ ID NO: 3286922 - DNA, 14 bp, Homo sapiens
agccactcctgtcc

SEQ ID NO: 3286923 - DNA, 22 bp, Homo sapiens
agccactcctgtcccgccttcc

SEQ ID NO: 3286924 - DNA, 14 bp, Homo sapiens
agccactctatgag

SEQ ID NO: 3286925 - DNA, 21 bp, Homo sapiens
agccactctatgagttggact

SEQ ID NO: 3286926 - DNA, 16 bp, Homo sapiens
agccactctcttccct

SEQ ID NO: 3286927 - DNA, 17 bp, Homo sapiens
agccactctgtcccttc

SEQ ID NO: 3286928 - DNA, 13 bp, Homo sapiens
agccactgaagct

SEQ ID NO: 3286929 - DNA, 16 bp, Homo sapiens
agccactgaagctggg

SEQ ID NO: 3286930 - DNA, 17 bp, Homo sapiens
agccactgagcctggcc

SEQ ID NO: 3286931 - DNA, 21 bp, Homo sapiens
agccactgcaccgggccacag

SEQ ID NO: 3286932 - DNA, 13 bp, Homo sapiens
agccagacagacc

SEQ ID NO: 3286933 - DNA, 15 bp, Homo sapiens
agccagaccagcagg

SEQ ID NO: 3286934 - DNA, 12 bp, Homo sapiens
agccagagagga

SEQ ID NO: 3286935 - DNA, 15 bp, Homo sapiens
agccagagaggagca

SEQ ID NO: 3286936 - DNA, 17 bp, Homo sapiens
agccagagaggagcacc

SEQ ID NO: 3286937 - DNA, 20 bp, Homo sapiens
agccagagaggagcacctga

SEQ ID NO: 3286938 - DNA, 23 bp, Homo sapiens
agccagagcccttcactgccatg

SEQ ID NO: 3286939 - DNA, 13 bp, Homo sapiens
agccagagcctgg

SEQ ID NO: 3286940 - DNA, 14 bp, Homo sapiens
agccagagctgggt

SEQ ID NO: 3286941 - DNA, 11 bp, Homo sapiens
agccagaggct

SEQ ID NO: 3286942 - DNA, 14 bp, Homo sapiens
agccagaggctggg

SEQ ID NO: 3286943 - DNA, 22 bp, Homo sapiens
agccagagggtgggagcctaag

SEQ ID NO: 3286944 - DNA, 19 bp, Homo sapiens
agccagatgcaggacagga

SEQ ID NO: 3286945 - DNA, 22 bp, Homo sapiens
agccagatgcaggacaggaggc

SEQ ID NO: 3286946 - DNA, 22 bp, Homo sapiens
agccagcaagagggaacaaaac

SEQ ID NO: 3286947 - DNA, 13 bp, Homo sapiens
agccagcacctgg

SEQ ID NO: 3286948 - DNA, 18 bp, Homo sapiens
agccagcacctgtaagaa

SEQ ID NO: 3286949 - DNA, 19 bp, Homo sapiens
agccagccaagctttaaat

SEQ ID NO: 3286950 - DNA, 20 bp, Homo sapiens
agccagccaagctttaaatt

SEQ ID NO: 3286951 - DNA, 10 bp, Homo sapiens
agccagccac

SEQ ID NO: 3286952 - DNA, 20 bp, Homo sapiens
agccagccacagacccctgg

SEQ ID NO: 3286953 - DNA, 17 bp, Homo sapiens
agccagcccctcttccc

SEQ ID NO: 3286954 - DNA, 17 bp, Homo sapiens
agccagccgccctgggc

SEQ ID NO: 3286955 - DNA, 21 bp, Homo sapiens
agccagccgccctgggctgtc

SEQ ID NO: 3286956 - DNA, 13 bp, Homo sapiens
agccagcctggga

SEQ ID NO: 3286957 - DNA, 14 bp, Homo sapiens
agccagcctgggac

SEQ ID NO: 3286958 - DNA, 22 bp, Homo sapiens
agccagctccctctatttatgt

SEQ ID NO: 3286959 - DNA, 19 bp, Homo sapiens
agccagctgcagctgggct

SEQ ID NO: 3286960 - DNA, 20 bp, Homo sapiens
agccagctgccgaccagagc

SEQ ID NO: 3286961 - DNA, 12 bp, Homo sapiens
agccagcttggg

SEQ ID NO: 3286962 - DNA, 22 bp, Homo sapiens
agccagctttccctgcctctca

SEQ ID NO: 3286963 - DNA, 14 bp, Homo sapiens
agccaggagtctgt

SEQ ID NO: 3286964 - DNA, 18 bp, Homo sapiens
agccaggagtctgtgctc

SEQ ID NO: 3286965 - DNA, 20 bp, Homo sapiens
agccaggatcatggtgtaat

SEQ ID NO: 3286966 - DNA, 18 bp, Homo sapiens
agccaggatgcccagatg

SEQ ID NO: 3286967 - DNA, 21 bp, Homo sapiens
agccaggcaggtagccagggg

SEQ ID NO: 3286968 - DNA, 12 bp, Homo sapiens
agccaggcctgg

SEQ ID NO: 3286969 - DNA, 13 bp, Homo sapiens
agccaggcgggct

SEQ ID NO: 3286970 - DNA, 21 bp, Homo sapiens
agccaggctgccaaggccaga

SEQ ID NO: 3286971 - DNA, 21 bp, Homo sapiens
agccagggggactagcccctg

SEQ ID NO: 3286972 - DNA, 18 bp, Homo sapiens
agccagggtctctccctc

SEQ ID NO: 3286973 - DNA, 20 bp, Homo sapiens
agccagggtctctccctcag

SEQ ID NO: 3286974 - DNA, 15 bp, Homo sapiens
agccaggtacaggag

SEQ ID NO: 3286975 - DNA, 19 bp, Homo sapiens
agccaggttcacactcaga

SEQ ID NO: 3286976 - DNA, 14 bp, Homo sapiens
agccagtaatcttt

SEQ ID NO: 3286977 - DNA, 15 bp, Homo sapiens
agccagtaatcttta

SEQ ID NO: 3286978 - DNA, 19 bp, Homo sapiens
agccagtgaaatgtgaagg

SEQ ID NO: 3286979 - DNA, 21 bp, Homo sapiens
agccagtgaaatgtgaaggaa

SEQ ID NO: 3286980 - DNA, 18 bp, Homo sapiens
agccagtgaaggagccac

SEQ ID NO: 3286981 - DNA, 13 bp, Homo sapiens
agccagtgacttt

SEQ ID NO: 3286982 - DNA, 16 bp, Homo sapiens
agccagttggtggggc

SEQ ID NO: 3286983 - DNA, 22 bp, Homo sapiens
agccagttggtggggccaggcc

SEQ ID NO: 3286984 - DNA, 23 bp, Homo sapiens
agccagttggtggggccaggcca

SEQ ID NO: 3286985 - DNA, 20 bp, Homo sapiens
agccagttgtcctatggaca

SEQ ID NO: 3286986 - DNA, 21 bp, Homo sapiens
agccagttgtcctatggacaa

SEQ ID NO: 3286987 - DNA, 16 bp, Homo sapiens
agccataaaagcattg

SEQ ID NO: 3286988 - DNA, 17 bp, Homo sapiens
agccataaaagcattgt

SEQ ID NO: 3286989 - DNA, 20 bp, Homo sapiens
agccataaaagcattgtctc

SEQ ID NO: 3286990 - DNA, 12 bp, Homo sapiens
agcctctgaccc

SEQ ID NO: 3286991 - DNA, 15 bp, Homo sapiens
agcctctgacccctc

SEQ ID NO: 3286992 - DNA, 22 bp, Homo sapiens
agcctctgacccctcctcactg

SEQ ID NO: 3286993 - DNA, 13 bp, Homo sapiens
agcctctgctccc

SEQ ID NO: 3286994 - DNA, 16 bp, Homo sapiens
agcctctgctccccag

SEQ ID NO: 3286995 - DNA, 23 bp, Homo sapiens
agcctctggcattagaattattt

SEQ ID NO: 3286996 - DNA, 20 bp, Homo sapiens
agcctctggctagaggccag

SEQ ID NO: 3286997 - DNA, 18 bp, Homo sapiens
agcctctggctccacacc

SEQ ID NO: 3286998 - DNA, 21 bp, Homo sapiens
agcctcttcaaaaagcagagt

SEQ ID NO: 3286999 - DNA, 16 bp, Homo sapiens
agcctcttcagcccct

SEQ ID NO: 3287000 - DNA, 17 bp, Homo sapiens
agcctcttcagcccctt

SEQ ID NO: 3287001 - DNA, 14 bp, Homo sapiens
agcctcttctgcca

SEQ ID NO: 3287002 - DNA, 20 bp, Homo sapiens
agcctcttctgccaagagag

SEQ ID NO: 3287003 - DNA, 16 bp, Homo sapiens
agcctgaaggattctg

SEQ ID NO: 3287004 - DNA, 15 bp, Homo sapiens
agcctgacctgagac

SEQ ID NO: 3287005 - DNA, 16 bp, Homo sapiens
agcctgagcaactctt

SEQ ID NO: 3287006 - DNA, 22 bp, Homo sapiens
agcctgagccttagctcccagc

SEQ ID NO: 3287007 - DNA, 21 bp, Homo sapiens
agcctgagtcagggcccagag

SEQ ID NO: 3287008 - DNA, 16 bp, Homo sapiens
agcctgagtctcctgt

SEQ ID NO: 3287009 - DNA, 17 bp, Homo sapiens
agcctgagtctcctgtg

SEQ ID NO: 3287010 - DNA, 18 bp, Homo sapiens
agcctgatgagattttta

SEQ ID NO: 3287011 - DNA, 16 bp, Homo sapiens
agcctgatggccaagg

SEQ ID NO: 3287012 - DNA, 17 bp, Homo sapiens
agcctgcaaactcactg

SEQ ID NO: 3287013 - DNA, 19 bp, Homo sapiens
agcctgcaaactcactgct

SEQ ID NO: 3287014 - DNA, 19 bp, Homo sapiens
agcctgcaatttcatatgc

SEQ ID NO: 3287015 - DNA, 23 bp, Homo sapiens
agcctgcattgagcttgcatgct

SEQ ID NO: 3287016 - DNA, 21 bp, Homo sapiens
agcctgcccaagcccaggcca

SEQ ID NO: 3287017 - DNA, 21 bp, Homo sapiens
agcctgcccgctgcaatgcct

SEQ ID NO: 3287018 - DNA, 13 bp, Homo sapiens
agcctgcccttgt

SEQ ID NO: 3287019 - DNA, 17 bp, Homo sapiens
agcctgcccttgtctga

SEQ ID NO: 3287020 - DNA, 13 bp, Homo sapiens
agcctgcctaacc

SEQ ID NO: 3287021 - DNA, 19 bp, Homo sapiens
agcctgcctcagtggcagc

SEQ ID NO: 3287022 - DNA, 21 bp, Homo sapiens
agcctgcctcagtggcagcat

SEQ ID NO: 3287023 - DNA, 16 bp, Homo sapiens
agcctgcgctcggcag

SEQ ID NO: 3287024 - DNA, 19 bp, Homo sapiens
agcctgctgagagccccca

SEQ ID NO: 3287025 - DNA, 20 bp, Homo sapiens
agcctgctgcccaggctgtg

SEQ ID NO: 3287026 - DNA, 17 bp, Homo sapiens
agcctgctggcacccac

SEQ ID NO: 3287027 - DNA, 18 bp, Homo sapiens
agcctgctggctgcggcc

SEQ ID NO: 3287028 - DNA, 14 bp, Homo sapiens
agcctgcttcccac

SEQ ID NO: 3287029 - DNA, 13 bp, Homo sapiens
agcctggactctg

SEQ ID NO: 3287030 - DNA, 23 bp, Homo sapiens
agcctggatgccaaggagcccct

SEQ ID NO: 3287031 - DNA, 13 bp, Homo sapiens
agcctggcacagg

SEQ ID NO: 3287032 - DNA, 16 bp, Homo sapiens
agcctggcccatagaa

SEQ ID NO: 3287033 - DNA, 12 bp, Homo sapiens
agcctggctctt

SEQ ID NO: 3287034 - DNA, 14 bp, Homo sapiens
agcctggcttctgg

SEQ ID NO: 3287035 - DNA, 19 bp, Homo sapiens
agcctggcttctggagccc

SEQ ID NO: 3287036 - DNA, 20 bp, Homo sapiens
agcctggcttctggagccct

SEQ ID NO: 3287037 - DNA, 17 bp, Homo sapiens
agcctgggactcccagt

SEQ ID NO: 3287038 - DNA, 19 bp, Homo sapiens
agcctgggactcccagtga

SEQ ID NO: 3287039 - DNA, 19 bp, Homo sapiens
agcctgggagcccagaggg

SEQ ID NO: 3287040 - DNA, 21 bp, Homo sapiens
agcctgggcagccaggctgcc

SEQ ID NO: 3287041 - DNA, 13 bp, Homo sapiens
agcctgggccaga

SEQ ID NO: 3287042 - DNA, 15 bp, Homo sapiens
agcctgggcttgagc

SEQ ID NO: 3287043 - DNA, 18 bp, Homo sapiens
agcctggggcctggcagg

SEQ ID NO: 3287044 - DNA, 17 bp, Homo sapiens
agcctggggctccctct

SEQ ID NO: 3287045 - DNA, 21 bp, Homo sapiens
agcctggggctccctctctgg

SEQ ID NO: 3287046 - DNA, 17 bp, Homo sapiens
agcctgggtgacagagc

SEQ ID NO: 3287047 - DNA, 14 bp, Homo sapiens
agcctggttcagaa

SEQ ID NO: 3287048 - DNA, 24 bp, Homo sapiens
agcctggttcagaataaattgatc

SEQ ID NO: 3287049 - DNA, 21 bp, Homo sapiens
agcctgtcatccttggtcttt

SEQ ID NO: 3287050 - DNA, 19 bp, Homo sapiens
agcctgtgcctctgggact

SEQ ID NO: 3287051 - DNA, 18 bp, Homo sapiens
agcctgtgggagtagaaa

SEQ ID NO: 3287052 - DNA, 14 bp, Homo sapiens
agcctgtgtgttct

SEQ ID NO: 3287053 - DNA, 18 bp, Homo sapiens
agcctgttcccctcactg

SEQ ID NO: 3287054 - DNA, 23 bp, Homo sapiens
agcctgtttcttcctgttaatgt

SEQ ID NO: 3287055 - DNA, 11 bp, Homo sapiens
agccttaaaaa

SEQ ID NO: 3287056 - DNA, 18 bp, Homo sapiens
agccttagctcccagcta

SEQ ID NO: 3287057 - DNA, 20 bp, Homo sapiens
agccttagctgccagtgctg

SEQ ID NO: 3287058 - DNA, 14 bp, Homo sapiens
agccttagggaagc

SEQ ID NO: 3287059 - DNA, 14 bp, Homo sapiens
agccttatcaagtg

SEQ ID NO: 3287060 - DNA, 19 bp, Homo sapiens
agccttatttctagaagca

SEQ ID NO: 3287061 - DNA, 22 bp, Homo sapiens
agccttatttctagaagcacat

SEQ ID NO: 3287062 - DNA, 12 bp, Homo sapiens
agccttcaagtg

SEQ ID NO: 3287063 - DNA, 15 bp, Homo sapiens
agccttcaagtgcca

SEQ ID NO: 3287064 - DNA, 16 bp, Homo sapiens
agccttcaagtgccaa

SEQ ID NO: 3287065 - DNA, 18 bp, Homo sapiens
agccttcaagtgccaaac

SEQ ID NO: 3287066 - DNA, 21 bp, Homo sapiens
agccttcagaatgctcctgag

SEQ ID NO: 3287067 - DNA, 12 bp, Homo sapiens
agccttcggaca

SEQ ID NO: 3287068 - DNA, 12 bp, Homo sapiens
agccttctccct

SEQ ID NO: 3287069 - DNA, 12 bp, Homo sapiens
agccttctgcag

SEQ ID NO: 3287070 - DNA, 13 bp, Homo sapiens
agccttctgcagc

SEQ ID NO: 3287071 - DNA, 18 bp, Homo sapiens
agccttcttccatcccag

SEQ ID NO: 3287072 - DNA, 20 bp, Homo sapiens
agccttcttccatcccagga

SEQ ID NO: 3287073 - DNA, 20 bp, Homo sapiens
agccttgatttgttcttaca

SEQ ID NO: 3287074 - DNA, 12 bp, Homo sapiens
agccttgcttgt

SEQ ID NO: 3287075 - DNA, 19 bp, Homo sapiens
agccttggctcctgagaaa

SEQ ID NO: 3287076 - DNA, 22 bp, Homo sapiens
agccttggctcctgagaaaggt

SEQ ID NO: 3287077 - DNA, 21 bp, Homo sapiens
agccttgtgagatccttcaca

SEQ ID NO: 3287078 - DNA, 16 bp, Homo sapiens
agccttgtgccctgcc

SEQ ID NO: 3287079 - DNA, 18 bp, Homo sapiens
agccttgtgccctgcccc

SEQ ID NO: 3287080 - DNA, 21 bp, Homo sapiens
agccttgtgccctgcccccat

SEQ ID NO: 3287081 - DNA, 20 bp, Homo sapiens
agccttgttttctctgtgtg

SEQ ID NO: 3287082 - DNA, 22 bp, Homo sapiens
agcctttaaatcatttttatat

SEQ ID NO: 3287083 - DNA, 14 bp, Homo sapiens
agcctttaatgcat

SEQ ID NO: 3287084 - DNA, 23 bp, Homo sapiens
agcctttaatggacttatttctt

SEQ ID NO: 3287085 - DNA, 20 bp, Homo sapiens
agcctttactgtttgatata

SEQ ID NO: 3287086 - DNA, 14 bp, Homo sapiens
agcctttccagcct

SEQ ID NO: 3287087 - DNA, 15 bp, Homo sapiens
agcctttccagcctc

SEQ ID NO: 3287088 - DNA, 22 bp, Homo sapiens
agcctttccataaggaatgtag

SEQ ID NO: 3287089 - DNA, 11 bp, Homo sapiens
agcctttgaat

SEQ ID NO: 3287090 - DNA, 19 bp, Homo sapiens
agccttttatctgcagaac

SEQ ID NO: 3287091 - DNA, 22 bp, Homo sapiens
agccttttgtttcccttgcttt

SEQ ID NO: 3287092 - DNA, 18 bp, Homo sapiens
agcctttttgtttcaatg

SEQ ID NO: 3287093 - DNA, 14 bp, Homo sapiens
agcgaccgccccct

SEQ ID NO: 3287094 - DNA, 15 bp, Homo sapiens
agcgaccgccccctc

SEQ ID NO: 3287095 - DNA, 16 bp, Homo sapiens
agcgaccgccccctcc

SEQ ID NO: 3287096 - DNA, 17 bp, Homo sapiens
agcgaccgccccctcct

SEQ ID NO: 3287097 - DNA, 19 bp, Homo sapiens
agcgactccgttggccact

SEQ ID NO: 3287098 - DNA, 13 bp, Homo sapiens
agcgagccctggt

SEQ ID NO: 3287099 - DNA, 20 bp, Homo sapiens
agcgaggaggcgcggcctcc

SEQ ID NO: 3287100 - DNA, 14 bp, Homo sapiens
agcgagttgtggaa

SEQ ID NO: 3287101 - DNA, 18 bp, Homo sapiens
agcgatggtctcagaaac

SEQ ID NO: 3287102 - DNA, 19 bp, Homo sapiens
agcgattattatctaaagt

SEQ ID NO: 3287103 - DNA, 15 bp, Homo sapiens
agcgattcttctgct

SEQ ID NO: 3287104 - DNA, 17 bp, Homo sapiens
agcgcacctgccccctg

SEQ ID NO: 3287105 - DNA, 21 bp, Homo sapiens
agcgcacctgccccctggtgg

SEQ ID NO: 3287106 - DNA, 21 bp, Homo sapiens
agcgcagctggactctgcatc

SEQ ID NO: 3287107 - DNA, 18 bp, Homo sapiens
agcgccaagcaacctggg

SEQ ID NO: 3287108 - DNA, 18 bp, Homo sapiens
agcgccagcctgtcccat

SEQ ID NO: 3287109 - DNA, 17 bp, Homo sapiens
agcgccgtgagttctca

SEQ ID NO: 3287110 - DNA, 24 bp, Homo sapiens
agcgccgtgagttctcagggctcc

SEQ ID NO: 3287111 - DNA, 15 bp, Homo sapiens
agcgccgtgctgtaa

SEQ ID NO: 3287112 - DNA, 18 bp, Homo sapiens
agcgccgtgctgtaaata

SEQ ID NO: 3287113 - DNA, 17 bp, Homo sapiens
agcgcctgtgcacacac

SEQ ID NO: 3287114 - DNA, 17 bp, Homo sapiens
agcgctatcttcacata

SEQ ID NO: 3287115 - DNA, 16 bp, Homo sapiens
agcgctcccagcctgc

SEQ ID NO: 3287116 - DNA, 13 bp, Homo sapiens
agctgtttggaaa

SEQ ID NO: 3287117 - DNA, 16 bp, Homo sapiens
agctgtttggaaaaga

SEQ ID NO: 3287118 - DNA, 16 bp, Homo sapiens
agcttaaataggaaag

SEQ ID NO: 3287119 - DNA, 24 bp, Homo sapiens
agcttaaattgcttttgttgtgac

SEQ ID NO: 3287120 - DNA, 16 bp, Homo sapiens
agcttaacaatgcaac

SEQ ID NO: 3287121 - DNA, 16 bp, Homo sapiens
agcttaactaatttga

SEQ ID NO: 3287122 - DNA, 16 bp, Homo sapiens
agcttacatagtttta

SEQ ID NO: 3287123 - DNA, 21 bp, Homo sapiens
agcttactctgtccatttatc

SEQ ID NO: 3287124 - DNA, 16 bp, Homo sapiens
agcttagatttcatag

SEQ ID NO: 3287125 - DNA, 21 bp, Homo sapiens
agcttagccttgtgccctgcc

SEQ ID NO: 3287126 - DNA, 23 bp, Homo sapiens
agcttataaaaataaagggaaga

SEQ ID NO: 3287127 - DNA, 13 bp, Homo sapiens
agcttatctcttt

SEQ ID NO: 3287128 - DNA, 15 bp, Homo sapiens
agcttatctttcttt

SEQ ID NO: 3287129 - DNA, 16 bp, Homo sapiens
agcttattacagaaaa

SEQ ID NO: 3287130 - DNA, 19 bp, Homo sapiens
agcttcaatatttttctaa

SEQ ID NO: 3287131 - DNA, 15 bp, Homo sapiens
agcttcaccagagca

SEQ ID NO: 3287132 - DNA, 16 bp, Homo sapiens
agcttcagaagtttgg

SEQ ID NO: 3287133 - DNA, 21 bp, Homo sapiens
agcttcagaagtttggcaata

SEQ ID NO: 3287134 - DNA, 21 bp, Homo sapiens
agcttcagatggtgaagcatt

SEQ ID NO: 3287135 - DNA, 14 bp, Homo sapiens
agcttcaggcacca

SEQ ID NO: 3287136 - DNA, 17 bp, Homo sapiens
agcttcaggcaccagca

SEQ ID NO: 3287137 - DNA, 20 bp, Homo sapiens
agcttcaggcaccagcatcc

SEQ ID NO: 3287138 - DNA, 23 bp, Homo sapiens
agcttcaggttatcgaaataaca

SEQ ID NO: 3287139 - DNA, 23 bp, Homo sapiens
agcttcagttgcttgtcttctgg

SEQ ID NO: 3287140 - DNA, 17 bp, Homo sapiens
agcttcatgcctttgta

SEQ ID NO: 3287141 - DNA, 22 bp, Homo sapiens
agcttcatgcctttgtaagtta

SEQ ID NO: 3287142 - DNA, 20 bp, Homo sapiens
agcttcatttgtgtcaatgg

SEQ ID NO: 3287143 - DNA, 22 bp, Homo sapiens
agcttccatgattctatttata

SEQ ID NO: 3287144 - DNA, 15 bp, Homo sapiens
agcttccattttaat

SEQ ID NO: 3287145 - DNA, 20 bp, Homo sapiens
agcttcccagccatgcccag

SEQ ID NO: 3287146 - DNA, 20 bp, Homo sapiens
agcttccgctttgaaagaag

SEQ ID NO: 3287147 - DNA, 14 bp, Homo sapiens
agcttcggagggcc

SEQ ID NO: 3287148 - DNA, 20 bp, Homo sapiens
agcttcggagggcccctgcg

SEQ ID NO: 3287149 - DNA, 23 bp, Homo sapiens
agcttctaataaattatacaaat

SEQ ID NO: 3287150 - DNA, 18 bp, Homo sapiens
agcttctatcccaggagg

SEQ ID NO: 3287151 - DNA, 18 bp, Homo sapiens
agcttctcaaagtactgg

SEQ ID NO: 3287152 - DNA, 12 bp, Homo sapiens
agcttctcctgc

SEQ ID NO: 3287153 - DNA, 18 bp, Homo sapiens
agcttctcctgcgccccg

SEQ ID NO: 3287154 - DNA, 22 bp, Homo sapiens
agcttctctgctagatttctac

SEQ ID NO: 3287155 - DNA, 17 bp, Homo sapiens
agcttctgccacataaa

SEQ ID NO: 3287156 - DNA, 20 bp, Homo sapiens
agcttctgcttttctgccct

SEQ ID NO: 3287157 - DNA, 21 bp, Homo sapiens
agcttctggaatttgttcaag

SEQ ID NO: 3287158 - DNA, 17 bp, Homo sapiens
agcttctggtactctcc

SEQ ID NO: 3287159 - DNA, 13 bp, Homo sapiens
agcttcttaatta

SEQ ID NO: 3287160 - DNA, 22 bp, Homo sapiens
agcttcttcctaggtccaagcc

SEQ ID NO: 3287161 - DNA, 16 bp, Homo sapiens
agcttgaaagttttca

SEQ ID NO: 3287162 - DNA, 12 bp, Homo sapiens
agcttgaagatt

SEQ ID NO: 3287163 - DNA, 15 bp, Homo sapiens
agcttgactcccaag

SEQ ID NO: 3287164 - DNA, 23 bp, Homo sapiens
agcttgagccgggcccctgggct

SEQ ID NO: 3287165 - DNA, 24 bp, Homo sapiens
agcttgagccgggcccctgggctt

SEQ ID NO: 3287166 - DNA, 21 bp, Homo sapiens
agcttgagcctcccccaaagc

SEQ ID NO: 3287167 - DNA, 14 bp, Homo sapiens
agcttgagggttgg

SEQ ID NO: 3287168 - DNA, 22 bp, Homo sapiens
agcttgagggttgggctggtgt

SEQ ID NO: 3287169 - DNA, 23 bp, Homo sapiens
agcttgcttgctttcttttttaa

SEQ ID NO: 3287170 - DNA, 23 bp, Homo sapiens
agcttggagagtcttgggcctgg

SEQ ID NO: 3287171 - DNA, 14 bp, Homo sapiens
agcttgggaatgga

SEQ ID NO: 3287172 - DNA, 22 bp, Homo sapiens
agcttgggagagcccctggggc

SEQ ID NO: 3287173 - DNA, 18 bp, Homo sapiens
agcttggggaacccatga

SEQ ID NO: 3287174 - DNA, 21 bp, Homo sapiens
agcttggggccaccaaagctg

SEQ ID NO: 3287175 - DNA, 18 bp, Homo sapiens
agcttgtatagtgtaaaa

SEQ ID NO: 3287176 - DNA, 15 bp, Homo sapiens
agcttgtcaaagatg

SEQ ID NO: 3287177 - DNA, 11 bp, Homo sapiens
agcttgtgaaa

SEQ ID NO: 3287178 - DNA, 17 bp, Homo sapiens
agcttgttccctgtctt

SEQ ID NO: 3287179 - DNA, 16 bp, Homo sapiens
agcttgttctgggctc

SEQ ID NO: 3287180 - DNA, 19 bp, Homo sapiens
agcttgttctgggctcagg

SEQ ID NO: 3287181 - DNA, 19 bp, Homo sapiens
agctttaaactcagggaca

SEQ ID NO: 3287182 - DNA, 21 bp, Homo sapiens
agctttaaactcagggacaga

SEQ ID NO: 3287183 - DNA, 12 bp, Homo sapiens
agctttaaatta

SEQ ID NO: 3287184 - DNA, 16 bp, Homo sapiens
agctttaatcaatcat

SEQ ID NO: 3287185 - DNA, 20 bp, Homo sapiens
agctttacacacacagatgt

SEQ ID NO: 3287186 - DNA, 18 bp, Homo sapiens
agctttaccctcaggcat

SEQ ID NO: 3287187 - DNA, 13 bp, Homo sapiens
agctttagaccct

SEQ ID NO: 3287188 - DNA, 16 bp, Homo sapiens
agctttagaccctggg

SEQ ID NO: 3287189 - DNA, 18 bp, Homo sapiens
agctttattatggcttgt

SEQ ID NO: 3287190 - DNA, 22 bp, Homo sapiens
agctttattatggcttgtgaac

SEQ ID NO: 3287191 - DNA, 23 bp, Homo sapiens
agctttattatggcttgtgaact

SEQ ID NO: 3287192 - DNA, 22 bp, Homo sapiens
agctttattttttaagtattta

SEQ ID NO: 3287193 - DNA, 13 bp, Homo sapiens
agctttcagagcc

SEQ ID NO: 3287194 - DNA, 15 bp, Homo sapiens
agctttcagagccag

SEQ ID NO: 3287195 - DNA, 17 bp, Homo sapiens
agctttcagagccagtg

SEQ ID NO: 3287196 - DNA, 20 bp, Homo sapiens
agctttccacatttgtcaca

SEQ ID NO: 3287197 - DNA, 16 bp, Homo sapiens
agctttccctgcctct

SEQ ID NO: 3287198 - DNA, 14 bp, Homo sapiens
agctttccctgtgc

SEQ ID NO: 3287199 - DNA, 15 bp, Homo sapiens
agctttccctgtgcc

SEQ ID NO: 3287200 - DNA, 15 bp, Homo sapiens
agctttcctgcccca

SEQ ID NO: 3287201 - DNA, 21 bp, Homo sapiens
agctttcctgccccaggcctg

SEQ ID NO: 3287202 - DNA, 20 bp, Homo sapiens
agctttcctggtccctcacc

SEQ ID NO: 3287203 - DNA, 20 bp, Homo sapiens
agctttcctgtttccagggt

SEQ ID NO: 3287204 - DNA, 23 bp, Homo sapiens
agctttctcagggggtcagcaga

SEQ ID NO: 3287205 - DNA, 15 bp, Homo sapiens
agctttgcccaacac

SEQ ID NO: 3287206 - DNA, 10 bp, Homo sapiens
agctttgcta

SEQ ID NO: 3287207 - DNA, 17 bp, Homo sapiens
agctttgctacaaattt

SEQ ID NO: 3287208 - DNA, 18 bp, Homo sapiens
agctttgctccgctccca

SEQ ID NO: 3287209 - DNA, 19 bp, Homo sapiens
agctttgctccgctcccac

SEQ ID NO: 3287210 - DNA, 21 bp, Homo sapiens
agctttgctccgctcccaccg

SEQ ID NO: 3287211 - DNA, 16 bp, Homo sapiens
agctttggaaacagga

SEQ ID NO: 3287212 - DNA, 23 bp, Homo sapiens
agctttggggtgtctttttttgg

SEQ ID NO: 3287213 - DNA, 20 bp, Homo sapiens
agctttgtaactgttttcaa

SEQ ID NO: 3287214 - DNA, 21 bp, Homo sapiens
agctttgtaggtgagatgcaa

SEQ ID NO: 3287215 - DNA, 12 bp, Homo sapiens
agcttttaaaaa

SEQ ID NO: 3287216 - DNA, 14 bp, Homo sapiens
agcttttactgttt

SEQ ID NO: 3287217 - DNA, 19 bp, Homo sapiens
agcttttattgtataaact

SEQ ID NO: 3287218 - DNA, 12 bp, Homo sapiens
agcttttcaaac

SEQ ID NO: 3287219 - DNA, 20 bp, Homo sapiens
agcttttcaaacaagaatgt

SEQ ID NO: 3287220 - DNA, 16 bp, Homo sapiens
agcttttcatggaagt

SEQ ID NO: 3287221 - DNA, 16 bp, Homo sapiens
agcttttcccttcttt

SEQ ID NO: 3287222 - DNA, 18 bp, Homo sapiens
agcttttctttttctgta

SEQ ID NO: 3287223 - DNA, 19 bp, Homo sapiens
agcttttgaaatccagaag

SEQ ID NO: 3287224 - DNA, 19 bp, Homo sapiens
agcttttgccagtattatg

SEQ ID NO: 3287225 - DNA, 12 bp, Homo sapiens
agcttttggaag

SEQ ID NO: 3287226 - DNA, 23 bp, Homo sapiens
agcttttgtgtgcctggtagaaa

SEQ ID NO: 3287227 - DNA, 15 bp, Homo sapiens
agctttttattccct

SEQ ID NO: 3287228 - DNA, 17 bp, Homo sapiens
agctttttattccctgc

SEQ ID NO: 3287229 - DNA, 18 bp, Homo sapiens
agctttttattccctgcc

SEQ ID NO: 3287230 - DNA, 22 bp, Homo sapiens
agctttttattcctcctgctca

SEQ ID NO: 3287231 - DNA, 23 bp, Homo sapiens
aggaaaaaaactgggataactga

SEQ ID NO: 3287232 - DNA, 15 bp, Homo sapiens
aggaaaaaaatgact

SEQ ID NO: 3287233 - DNA, 19 bp, Homo sapiens
aggaaaaaagaaccaaaac

SEQ ID NO: 3287234 - DNA, 17 bp, Homo sapiens
aggaaaaacacaagcaa

SEQ ID NO: 3287235 - DNA, 19 bp, Homo sapiens
aggaaaaacacaagcaaaa

SEQ ID NO: 3287236 - DNA, 22 bp, Homo sapiens
aggaaaaagcaagttcgtctgt

SEQ ID NO: 3287237 - DNA, 15 bp, Homo sapiens
aggaaaaagcacaag

SEQ ID NO: 3287238 - DNA, 12 bp, Homo sapiens
aggaaaaaggtc

SEQ ID NO: 3287239 - DNA, 13 bp, Homo sapiens
aggaaaaataatc

SEQ ID NO: 3287240 - DNA, 14 bp, Homo sapiens
aggaaaaataatca

SEQ ID NO: 3287241 - DNA, 20 bp, Homo sapiens
aggatgtatattttatataa

SEQ ID NO: 3287242 - DNA, 15 bp, Homo sapiens
aggatgtcacagggc

SEQ ID NO: 3287243 - DNA, 17 bp, Homo sapiens
aggatgtccctgggcca

SEQ ID NO: 3287244 - DNA, 21 bp, Homo sapiens
aggatgtccctgggccagggt

SEQ ID NO: 3287245 - DNA, 17 bp, Homo sapiens
aggatgtctcaaacttc

SEQ ID NO: 3287246 - DNA, 16 bp, Homo sapiens
aggatgtggaaagcac

SEQ ID NO: 3287247 - DNA, 19 bp, Homo sapiens
aggatgtggaaagcacttt

SEQ ID NO: 3287248 - DNA, 16 bp, Homo sapiens
aggatgtggaagagca

SEQ ID NO: 3287249 - DNA, 18 bp, Homo sapiens
aggatgtggaagagcatt

SEQ ID NO: 3287250 - DNA, 14 bp, Homo sapiens
aggatgtgtgcatg

SEQ ID NO: 3287251 - DNA, 18 bp, Homo sapiens
aggatgttctgggacaca

SEQ ID NO: 3287252 - DNA, 17 bp, Homo sapiens
aggattacagaaactga

SEQ ID NO: 3287253 - DNA, 19 bp, Homo sapiens
aggattacagaaactgatg

SEQ ID NO: 3287254 - DNA, 14 bp, Homo sapiens
aggattctaaaatg

SEQ ID NO: 3287255 - DNA, 17 bp, Homo sapiens
aggattgctactgtcct

SEQ ID NO: 3287256 - DNA, 18 bp, Homo sapiens
aggattgctactgtccta

SEQ ID NO: 3287257 - DNA, 13 bp, Homo sapiens
aggattgtggaaa

SEQ ID NO: 3287258 - DNA, 12 bp, Homo sapiens
aggatttcaagc

SEQ ID NO: 3287259 - DNA, 18 bp, Homo sapiens
aggatttctaatcaaaag

SEQ ID NO: 3287260 - DNA, 16 bp, Homo sapiens
aggatttttttctgag

SEQ ID NO: 3287261 - DNA, 15 bp, Homo sapiens
aggcaaaaatgtaaa

SEQ ID NO: 3287262 - DNA, 21 bp, Homo sapiens
aggcaaaacacgcaagggcat

SEQ ID NO: 3287263 - DNA, 19 bp, Homo sapiens
aggcaaaatccttgcttat

SEQ ID NO: 3287264 - DNA, 13 bp, Homo sapiens
aggcaaacaatcc

SEQ ID NO: 3287265 - DNA, 19 bp, Homo sapiens
aggcaaatataagctggga

SEQ ID NO: 3287266 - DNA, 14 bp, Homo sapiens
aggcaaatgtgtac

SEQ ID NO: 3287267 - DNA, 19 bp, Homo sapiens
aggcaacttcagtcctggg

SEQ ID NO: 3287268 - DNA, 13 bp, Homo sapiens
aggcaagaaaagg

SEQ ID NO: 3287269 - DNA, 14 bp, Homo sapiens
aggcaagaaaagga

SEQ ID NO: 3287270 - DNA, 24 bp, Homo sapiens
aggcaagaggggtggagactgctt

SEQ ID NO: 3287271 - DNA, 14 bp, Homo sapiens
aggcaagcaggacc

SEQ ID NO: 3287272 - DNA, 19 bp, Homo sapiens
aggcaagcccctcagccct

SEQ ID NO: 3287273 - DNA, 16 bp, Homo sapiens
aggcaagctgaaattt

SEQ ID NO: 3287274 - DNA, 13 bp, Homo sapiens
aggcaaggcaggt

SEQ ID NO: 3287275 - DNA, 20 bp, Homo sapiens
aggcaaggctatgtgattac

SEQ ID NO: 3287276 - DNA, 17 bp, Homo sapiens
aggcaataaaaatcata

SEQ ID NO: 3287277 - DNA, 22 bp, Homo sapiens
aggcaatgattgttaatttaca

SEQ ID NO: 3287278 - DNA, 16 bp, Homo sapiens
aggcaatgctggctgt

SEQ ID NO: 3287279 - DNA, 19 bp, Homo sapiens
aggcaattcagtcctgggc

SEQ ID NO: 3287280 - DNA, 20 bp, Homo sapiens
aggcacaaaattttgtttaa

SEQ ID NO: 3287281 - DNA, 14 bp, Homo sapiens
aggcacacagcagc

SEQ ID NO: 3287282 - DNA, 16 bp, Homo sapiens
aggcacacagcagccc

SEQ ID NO: 3287283 - DNA, 15 bp, Homo sapiens
aggcacacagctact

SEQ ID NO: 3287284 - DNA, 15 bp, Homo sapiens
aggcacagggagaag

SEQ ID NO: 3287285 - DNA, 22 bp, Homo sapiens
aggcacagtgggagctgagctg

SEQ ID NO: 3287286 - DNA, 13 bp, Homo sapiens
aggcacatggagg

SEQ ID NO: 3287287 - DNA, 12 bp, Homo sapiens
aggcaccagcat

SEQ ID NO: 3287288 - DNA, 15 bp, Homo sapiens
aggcaccagcatcca

SEQ ID NO: 3287289 - DNA, 17 bp, Homo sapiens
aggcaccagctctgtgg

SEQ ID NO: 3287290 - DNA, 19 bp, Homo sapiens
aggcaccagctctgtggcc

SEQ ID NO: 3287291 - DNA, 15 bp, Homo sapiens
aggcacccaccatca

SEQ ID NO: 3287292 - DNA, 20 bp, Homo sapiens
aggcacccaccatcatgtct

SEQ ID NO: 3287293 - DNA, 21 bp, Homo sapiens
aggcacccaccatcatgtctg

SEQ ID NO: 3287294 - DNA, 22 bp, Homo sapiens
aggcacccggggccagagacat

SEQ ID NO: 3287295 - DNA, 16 bp, Homo sapiens
aggcaccgagaatgtt

SEQ ID NO: 3287296 - DNA, 16 bp, Homo sapiens
aggcaccggcgctgca

SEQ ID NO: 3287297 - DNA, 18 bp, Homo sapiens
aggcaccggcgctgcagg

SEQ ID NO: 3287298 - DNA, 21 bp, Homo sapiens
aggcacctacactcacctgca

SEQ ID NO: 3287299 - DNA, 23 bp, Homo sapiens
aggcacctacactcacctgcact

SEQ ID NO: 3287300 - DNA, 19 bp, Homo sapiens
aggcacctggcctgctggg

SEQ ID NO: 3287301 - DNA, 15 bp, Homo sapiens
aggcacgggtccctg

SEQ ID NO: 3287302 - DNA, 14 bp, Homo sapiens
aggcactcttaaat

SEQ ID NO: 3287303 - DNA, 22 bp, Homo sapiens
aggcactgccttctcctctctg

SEQ ID NO: 3287304 - DNA, 23 bp, Homo sapiens
aggcactgccttctcctctctgg

SEQ ID NO: 3287305 - DNA, 16 bp, Homo sapiens
aggcactggtggcatc

SEQ ID NO: 3287306 - DNA, 16 bp, Homo sapiens
aggcactgtagttcta

SEQ ID NO: 3287307 - DNA, 21 bp, Homo sapiens
aggcactgtagttctaagact

SEQ ID NO: 3287308 - DNA, 20 bp, Homo sapiens
aggcactgttcaatactgta

SEQ ID NO: 3287309 - DNA, 16 bp, Homo sapiens
aggcacttattgtaaa

SEQ ID NO: 3287310 - DNA, 18 bp, Homo sapiens
aggcacttattgtaaatt

SEQ ID NO: 3287311 - DNA, 20 bp, Homo sapiens
aggcactttagggctgtaaa

SEQ ID NO: 3287312 - DNA, 22 bp, Homo sapiens
aggcactttagggctgtaaaat

SEQ ID NO: 3287313 - DNA, 13 bp, Homo sapiens
aggcactttgaga

SEQ ID NO: 3287314 - DNA, 20 bp, Homo sapiens
aggcactttgagatgtgttc

SEQ ID NO: 3287315 - DNA, 23 bp, Homo sapiens
aggcactttgggggtttgagggt

SEQ ID NO: 3287316 - DNA, 22 bp, Homo sapiens
aggcagacagcaggcagcgcca

SEQ ID NO: 3287317 - DNA, 13 bp, Homo sapiens
aggcagagaaatc

SEQ ID NO: 3287318 - DNA, 13 bp, Homo sapiens
aggcagagagcgg

SEQ ID NO: 3287319 - DNA, 20 bp, Homo sapiens
aggcagagagcggtctcagg

SEQ ID NO: 3287320 - DNA, 13 bp, Homo sapiens
aggcagatacagg

SEQ ID NO: 3287321 - DNA, 20 bp, Homo sapiens
aggcagatctgtgccccatg

SEQ ID NO: 3287322 - DNA, 22 bp, Homo sapiens
aggcagatctgtgccccatgcc

SEQ ID NO: 3287323 - DNA, 20 bp, Homo sapiens
aggcagcaagtcttaacaaa

SEQ ID NO: 3287324 - DNA, 18 bp, Homo sapiens
aggcagcatgcttgggct

SEQ ID NO: 3287325 - DNA, 16 bp, Homo sapiens
aggcagccccattctg

SEQ ID NO: 3287326 - DNA, 17 bp, Homo sapiens
aggcagccccattctgc

SEQ ID NO: 3287327 - DNA, 13 bp, Homo sapiens
aggcagccccctc

SEQ ID NO: 3287328 - DNA, 21 bp, Homo sapiens
aggcagccccctccacaccag

SEQ ID NO: 3287329 - DNA, 11 bp, Homo sapiens
aggcagcctcc

SEQ ID NO: 3287330 - DNA, 13 bp, Homo sapiens
aggcagcctccag

SEQ ID NO: 3287331 - DNA, 14 bp, Homo sapiens
aggcagcctccaga

SEQ ID NO: 3287332 - DNA, 15 bp, Homo sapiens
aggcagcctccagag

SEQ ID NO: 3287333 - DNA, 23 bp, Homo sapiens
aggcagcctccagagccagcctg

SEQ ID NO: 3287334 - DNA, 19 bp, Homo sapiens
aggcagcgccaagtgcgtg

SEQ ID NO: 3287335 - DNA, 16 bp, Homo sapiens
aggcagctcacccctg

SEQ ID NO: 3287336 - DNA, 17 bp, Homo sapiens
aggcagctcacccctgg

SEQ ID NO: 3287337 - DNA, 16 bp, Homo sapiens
aggcagctgcctctgc

SEQ ID NO: 3287338 - DNA, 19 bp, Homo sapiens
aggcagctgcctctgctcc

SEQ ID NO: 3287339 - DNA, 21 bp, Homo sapiens
aggcagctgcctctgctccct

SEQ ID NO: 3287340 - DNA, 22 bp, Homo sapiens
aggcagctgcctctgctccctc

SEQ ID NO: 3287341 - DNA, 13 bp, Homo sapiens
aggcagctgctct

SEQ ID NO: 3287342 - DNA, 23 bp, Homo sapiens
aggcagctgctcttagtgcccgc

SEQ ID NO: 3287343 - DNA, 18 bp, Homo sapiens
aggcagctggatgagact

SEQ ID NO: 3287344 - DNA, 16 bp, Homo sapiens
aggcaggaagggcagg

SEQ ID NO: 3287345 - DNA, 17 bp, Homo sapiens
aggcaggaagggcagga

SEQ ID NO: 3287346 - DNA, 20 bp, Homo sapiens
aggcaggaagggcaggaagg

SEQ ID NO: 3287347 - DNA, 22 bp, Homo sapiens
aggcaggaccttcgggctgtgc

SEQ ID NO: 3287348 - DNA, 22 bp, Homo sapiens
aggcaggcatagaggcttctcc

SEQ ID NO: 3287349 - DNA, 13 bp, Homo sapiens
aggcaggcattga

SEQ ID NO: 3287350 - DNA, 23 bp, Homo sapiens
aggcaggcattgaggaagagtct

SEQ ID NO: 3287351 - DNA, 14 bp, Homo sapiens
aggcaggccagatg

SEQ ID NO: 3287352 - DNA, 14 bp, Homo sapiens
aggcaggccgactg

SEQ ID NO: 3287353 - DNA, 18 bp, Homo sapiens
aggcagggaaaggaaaag

SEQ ID NO: 3287354 - DNA, 12 bp, Homo sapiens
aggcagggaggg

SEQ ID NO: 3287355 - DNA, 14 bp, Homo sapiens
aggcagggagggga

SEQ ID NO: 3287356 - DNA, 16 bp, Homo sapiens
aggcagggaggggact

SEQ ID NO: 3287357 - DNA, 13 bp, Homo sapiens
aggcagggcagag

SEQ ID NO: 3287358 - DNA, 14 bp, Homo sapiens
aggcagggcagagg

SEQ ID NO: 3287359 - DNA, 16 bp, Homo sapiens
aggcaggggtgggggt

SEQ ID NO: 3287360 - DNA, 15 bp, Homo sapiens
aggcaggtagccagg

SEQ ID NO: 3287361 - DNA, 21 bp, Homo sapiens
aggcaggtcttgaactcctgg

SEQ ID NO: 3287362 - DNA, 22 bp, Homo sapiens
aggcaggtcttgaactcctggc

SEQ ID NO: 3287363 - DNA, 15 bp, Homo sapiens
aggcaggtgcctcca

SEQ ID NO: 3287364 - DNA, 17 bp, Homo sapiens
aggcaggtgcctccagg

SEQ ID NO: 3287365 - DNA, 15 bp, Homo sapiens
aggcaggtgcctgga

SEQ ID NO: 3287366 - DNA, 18 bp, Homo sapiens
aggcagtcgggggctggc

SEQ ID NO: 3287367 - DNA, 20 bp, Homo sapiens
agggagaagacactgcagtg

SEQ ID NO: 3287368 - DNA, 17 bp, Homo sapiens
agggagaaggaagggca

SEQ ID NO: 3287369 - DNA, 18 bp, Homo sapiens
agggagaaggaagggcag

SEQ ID NO: 3287370 - DNA, 20 bp, Homo sapiens
agggagacactggcccctca

SEQ ID NO: 3287371 - DNA, 15 bp, Homo sapiens
agggagacagggtag

SEQ ID NO: 3287372 - DNA, 23 bp, Homo sapiens
agggagagacctcatcaggatga

SEQ ID NO: 3287373 - DNA, 13 bp, Homo sapiens
agggagagggagg

SEQ ID NO: 3287374 - DNA, 19 bp, Homo sapiens
agggagagtcatattttga

SEQ ID NO: 3287375 - DNA, 14 bp, Homo sapiens
agggagattttgag

SEQ ID NO: 3287376 - DNA, 14 bp, Homo sapiens
agggagcagacagg

SEQ ID NO: 3287377 - DNA, 16 bp, Homo sapiens
agggagcagggaaggc

SEQ ID NO: 3287378 - DNA, 19 bp, Homo sapiens
agggagcagggaaggcctg

SEQ ID NO: 3287379 - DNA, 17 bp, Homo sapiens
agggaggaacacctgat

SEQ ID NO: 3287380 - DNA, 19 bp, Homo sapiens
agggaggaagaaggcagtg

SEQ ID NO: 3287381 - DNA, 13 bp, Homo sapiens
agggaggaagata

SEQ ID NO: 3287382 - DNA, 23 bp, Homo sapiens
agggaggagaggaaatgctattg

SEQ ID NO: 3287383 - DNA, 21 bp, Homo sapiens
agggaggaggccacctctcca

SEQ ID NO: 3287384 - DNA, 15 bp, Homo sapiens
agggaggagtggagg

SEQ ID NO: 3287385 - DNA, 17 bp, Homo sapiens
agggaggcagcctccag

SEQ ID NO: 3287386 - DNA, 17 bp, Homo sapiens
agggaggccaggcgggc

SEQ ID NO: 3287387 - DNA, 17 bp, Homo sapiens
agggaggctgggcgggt

SEQ ID NO: 3287388 - DNA, 23 bp, Homo sapiens
agggagggaagtgtgagcgcctt

SEQ ID NO: 3287389 - DNA, 13 bp, Homo sapiens
agggaggggctgt

SEQ ID NO: 3287390 - DNA, 19 bp, Homo sapiens
agggagggggcgctcagga

SEQ ID NO: 3287391 - DNA, 20 bp, Homo sapiens
agggagggggcgctcaggac

SEQ ID NO: 3287392 - DNA, 21 bp, Homo sapiens
agggagggggcgctcaggacc

SEQ ID NO: 3287393 - DNA, 20 bp, Homo sapiens
agggaggtcactggaaaggg

SEQ ID NO: 3287394 - DNA, 18 bp, Homo sapiens
agggaggtcaggccctgg

SEQ ID NO: 3287395 - DNA, 17 bp, Homo sapiens
agggaggtgaccccagg

SEQ ID NO: 3287396 - DNA, 20 bp, Homo sapiens
agggaggtgtttaaagagag

SEQ ID NO: 3287397 - DNA, 17 bp, Homo sapiens
agggagtacctgctgcc

SEQ ID NO: 3287398 - DNA, 23 bp, Homo sapiens
agggagtccgaaagggacttgga

SEQ ID NO: 3287399 - DNA, 20 bp, Homo sapiens
agggagtgacagaggcagcc

SEQ ID NO: 3287400 - DNA, 22 bp, Homo sapiens
agggagtgatgatttgggggag

SEQ ID NO: 3287401 - DNA, 16 bp, Homo sapiens
agggagtgctggctca

SEQ ID NO: 3287402 - DNA, 24 bp, Homo sapiens
agggagtgctggctcacagtacag

SEQ ID NO: 3287403 - DNA, 18 bp, Homo sapiens
agggagtgttcaaaatac

SEQ ID NO: 3287404 - DNA, 14 bp, Homo sapiens
agggagttcatctg

SEQ ID NO: 3287405 - DNA, 20 bp, Homo sapiens
agggagttcatctggagggt

SEQ ID NO: 3287406 - DNA, 16 bp, Homo sapiens
agggatacaagagagg

SEQ ID NO: 3287407 - DNA, 14 bp, Homo sapiens
agggatacactgaa

SEQ ID NO: 3287408 - DNA, 16 bp, Homo sapiens
agggatacccagtgat

SEQ ID NO: 3287409 - DNA, 22 bp, Homo sapiens
agggatcaaccagctaagaaaa

SEQ ID NO: 3287410 - DNA, 15 bp, Homo sapiens
agggatcacagggcc

SEQ ID NO: 3287411 - DNA, 22 bp, Homo sapiens
agggatcacagggccccagaag

SEQ ID NO: 3287412 - DNA, 20 bp, Homo sapiens
agggatctctctacaagagc

SEQ ID NO: 3287413 - DNA, 22 bp, Homo sapiens
agggatgactaaaatatttatt

SEQ ID NO: 3287414 - DNA, 21 bp, Homo sapiens
agggatgcggatcctgctggg

SEQ ID NO: 3287415 - DNA, 19 bp, Homo sapiens
agggatgctgcctgagtca

SEQ ID NO: 3287416 - DNA, 22 bp, Homo sapiens
agggatgctgctccgcccgctc

SEQ ID NO: 3287417 - DNA, 15 bp, Homo sapiens
agggatggaaaagga

SEQ ID NO: 3287418 - DNA, 14 bp, Homo sapiens
agggatggagaaag

SEQ ID NO: 3287419 - DNA, 17 bp, Homo sapiens
agggatggagaaagaag

SEQ ID NO: 3287420 - DNA, 18 bp, Homo sapiens
agggatggagaaagaagt

SEQ ID NO: 3287421 - DNA, 18 bp, Homo sapiens
agggatggagaggcggcc

SEQ ID NO: 3287422 - DNA, 17 bp, Homo sapiens
agggattaacctctgca

SEQ ID NO: 3287423 - DNA, 19 bp, Homo sapiens
agggattcaggctgcttgg

SEQ ID NO: 3287424 - DNA, 23 bp, Homo sapiens
agggattctgggcttggggtgtg

SEQ ID NO: 3287425 - DNA, 14 bp, Homo sapiens
agggatttcttagg

SEQ ID NO: 3287426 - DNA, 21 bp, Homo sapiens
agggcaaatccagtcccaatg

SEQ ID NO: 3287427 - DNA, 13 bp, Homo sapiens
agggcaaatctgc

SEQ ID NO: 3287428 - DNA, 22 bp, Homo sapiens
agggcaacaatacatgctgcta

SEQ ID NO: 3287429 - DNA, 20 bp, Homo sapiens
agggcacaccgggcactcag

SEQ ID NO: 3287430 - DNA, 16 bp, Homo sapiens
agggcacagccctccg

SEQ ID NO: 3287431 - DNA, 18 bp, Homo sapiens
agggcacagccctccgac

SEQ ID NO: 3287432 - DNA, 14 bp, Homo sapiens
agggcaccaggggt

SEQ ID NO: 3287433 - DNA, 21 bp, Homo sapiens
agggcacgcaggaccagtttg

SEQ ID NO: 3287434 - DNA, 15 bp, Homo sapiens
agggcactgggctgt

SEQ ID NO: 3287435 - DNA, 18 bp, Homo sapiens
agggcactgggctgttgt

SEQ ID NO: 3287436 - DNA, 16 bp, Homo sapiens
agggcactggtggccc

SEQ ID NO: 3287437 - DNA, 17 bp, Homo sapiens
agggcacttaatttgta

SEQ ID NO: 3287438 - DNA, 18 bp, Homo sapiens
agggcacttaatttgtaa

SEQ ID NO: 3287439 - DNA, 20 bp, Homo sapiens
agggcacttaatttgtaaac

SEQ ID NO: 3287440 - DNA, 20 bp, Homo sapiens
agggcagaccacattgcttt

SEQ ID NO: 3287441 - DNA, 15 bp, Homo sapiens
agggcagagaatggc

SEQ ID NO: 3287442 - DNA, 18 bp, Homo sapiens
agggcagagaatggctgg

SEQ ID NO: 3287443 - DNA, 15 bp, Homo sapiens
agggcagagccggga

SEQ ID NO: 3287444 - DNA, 13 bp, Homo sapiens
agggcagctgcta

SEQ ID NO: 3287445 - DNA, 13 bp, Homo sapiens
agggcagcttgcc

SEQ ID NO: 3287446 - DNA, 22 bp, Homo sapiens
agggcagggaccacaccctgta

SEQ ID NO: 3287447 - DNA, 13 bp, Homo sapiens
agggcagggcatc

SEQ ID NO: 3287448 - DNA, 17 bp, Homo sapiens
agggcagggcatctcct

SEQ ID NO: 3287449 - DNA, 14 bp, Homo sapiens
agggcagggccacc

SEQ ID NO: 3287450 - DNA, 23 bp, Homo sapiens
agggcagggcccacgtgtatagt

SEQ ID NO: 3287451 - DNA, 16 bp, Homo sapiens
agggcagggctctgat

SEQ ID NO: 3287452 - DNA, 18 bp, Homo sapiens
agggcagggtgggcagcc

SEQ ID NO: 3287453 - DNA, 16 bp, Homo sapiens
agggcaggtcttcata

SEQ ID NO: 3287454 - DNA, 13 bp, Homo sapiens
agggcagttttct

SEQ ID NO: 3287455 - DNA, 16 bp, Homo sapiens
agggcataaaacagct

SEQ ID NO: 3287456 - DNA, 19 bp, Homo sapiens
agggcataaaacagctttg

SEQ ID NO: 3287457 - DNA, 17 bp, Homo sapiens
agggcatcaggcactgg

SEQ ID NO: 3287458 - DNA, 22 bp, Homo sapiens
agggcatcaggcactggtggca

SEQ ID NO: 3287459 - DNA, 21 bp, Homo sapiens
agggcatccataccagctcgc

SEQ ID NO: 3287460 - DNA, 14 bp, Homo sapiens
agggcatctcctgt

SEQ ID NO: 3287461 - DNA, 23 bp, Homo sapiens
agggcatgccccggccacctctg

SEQ ID NO: 3287462 - DNA, 16 bp, Homo sapiens
agggcatgccttgtgc

SEQ ID NO: 3287463 - DNA, 15 bp, Homo sapiens
agggcatgtgtatgt

SEQ ID NO: 3287464 - DNA, 16 bp, Homo sapiens
agggcatgtgtatgtg

SEQ ID NO: 3287465 - DNA, 19 bp, Homo sapiens
agggcattcgggccacagg

SEQ ID NO: 3287466 - DNA, 19 bp, Homo sapiens
agggcattctttcccagtg

SEQ ID NO: 3287467 - DNA, 23 bp, Homo sapiens
agggccaacttgagggcccagag

SEQ ID NO: 3287468 - DNA, 15 bp, Homo sapiens
agggccaccccactc

SEQ ID NO: 3287469 - DNA, 16 bp, Homo sapiens
agggccaccccactct

SEQ ID NO: 3287470 - DNA, 16 bp, Homo sapiens
agggccacgctccagc

SEQ ID NO: 3287471 - DNA, 17 bp, Homo sapiens
agggccacgctccagct

SEQ ID NO: 3287472 - DNA, 20 bp, Homo sapiens
agggccacgctccagctgcc

SEQ ID NO: 3287473 - DNA, 19 bp, Homo sapiens
agggccactttttttttat

SEQ ID NO: 3287474 - DNA, 12 bp, Homo sapiens
agggccagaagg

SEQ ID NO: 3287475 - DNA, 17 bp, Homo sapiens
agggccagaaggagggc

SEQ ID NO: 3287476 - DNA, 18 bp, Homo sapiens
agggccagaaggagggca

SEQ ID NO: 3287477 - DNA, 20 bp, Homo sapiens
agggccagaaggagggcaga

SEQ ID NO: 3287478 - DNA, 13 bp, Homo sapiens
agggccagactgg

SEQ ID NO: 3287479 - DNA, 15 bp, Homo sapiens
agggccagagggagc

SEQ ID NO: 3287480 - DNA, 14 bp, Homo sapiens
agggccaggaagga

SEQ ID NO: 3287481 - DNA, 23 bp, Homo sapiens
agggccaggaaggacagactggc

SEQ ID NO: 3287482 - DNA, 17 bp, Homo sapiens
agggccaggactgagcc

SEQ ID NO: 3287483 - DNA, 19 bp, Homo sapiens
agggccaggactgagcccc

SEQ ID NO: 3287484 - DNA, 21 bp, Homo sapiens
agggccaggactgagccccgc

SEQ ID NO: 3287485 - DNA, 14 bp, Homo sapiens
agggccaggcaggt

SEQ ID NO: 3287486 - DNA, 15 bp, Homo sapiens
agggccagggccctg

SEQ ID NO: 3287487 - DNA, 22 bp, Homo sapiens
agggccagtcctcctgggagcc

SEQ ID NO: 3287488 - DNA, 13 bp, Homo sapiens
agggccagtcctg

SEQ ID NO: 3287489 - DNA, 17 bp, Homo sapiens
agggccagtcctgcctg

SEQ ID NO: 3287490 - DNA, 19 bp, Homo sapiens
agggccagtcctgcctggc

SEQ ID NO: 3287491 - DNA, 22 bp, Homo sapiens
agggccagtcctgcctggccag

SEQ ID NO: 3287492 - DNA, 17 bp, Homo sapiens
aggtctcccacgtggga

SEQ ID NO: 3287493 - DNA, 20 bp, Homo sapiens
aggtctcctcagggtggggg

SEQ ID NO: 3287494 - DNA, 20 bp, Homo sapiens
aggtctccttactctgagcc

SEQ ID NO: 3287495 - DNA, 16 bp, Homo sapiens
aggtctcttctcccag

SEQ ID NO: 3287496 - DNA, 18 bp, Homo sapiens
aggtctcttctcccagaa

SEQ ID NO: 3287497 - DNA, 15 bp, Homo sapiens
aggtctcttgaggga

SEQ ID NO: 3287498 - DNA, 20 bp, Homo sapiens
aggtctgacacgtctgccta

SEQ ID NO: 3287499 - DNA, 12 bp, Homo sapiens
aggtctgagccc

SEQ ID NO: 3287500 - DNA, 15 bp, Homo sapiens
aggtctgagccctgg

SEQ ID NO: 3287501 - DNA, 23 bp, Homo sapiens
aggtctgagccctggtgtgtttc

SEQ ID NO: 3287502 - DNA, 22 bp, Homo sapiens
aggtcttgaactcctggcctca

SEQ ID NO: 3287503 - DNA, 21 bp, Homo sapiens
aggtcttgcagtggcttttca

SEQ ID NO: 3287504 - DNA, 18 bp, Homo sapiens
aggtctttcagtactttt

SEQ ID NO: 3287505 - DNA, 12 bp, Homo sapiens
aggtctttctct

SEQ ID NO: 3287506 - DNA, 13 bp, Homo sapiens
aggtctttctctc

SEQ ID NO: 3287507 - DNA, 18 bp, Homo sapiens
aggtctttggttcagcta

SEQ ID NO: 3287508 - DNA, 15 bp, Homo sapiens
aggtcttttgacatg

SEQ ID NO: 3287509 - DNA, 17 bp, Homo sapiens
aggtgaaaatgaagaag

SEQ ID NO: 3287510 - DNA, 19 bp, Homo sapiens
aggtgaaaatgaagaagga

SEQ ID NO: 3287511 - DNA, 13 bp, Homo sapiens
aggtgaaagaaaa

SEQ ID NO: 3287512 - DNA, 16 bp, Homo sapiens
aggtgaaagggagcta

SEQ ID NO: 3287513 - DNA, 21 bp, Homo sapiens
aggtgaaagggagctatcagg

SEQ ID NO: 3287514 - DNA, 19 bp, Homo sapiens
aggtgacactatagtttaa

SEQ ID NO: 3287515 - DNA, 14 bp, Homo sapiens
aggtgacatgtgaa

SEQ ID NO: 3287516 - DNA, 20 bp, Homo sapiens
aggtgacatgtgaaaccttt

SEQ ID NO: 3287517 - DNA, 19 bp, Homo sapiens
aggtgagagtgggagggag

SEQ ID NO: 3287518 - DNA, 22 bp, Homo sapiens
aggtgagatcacagcctccagg

SEQ ID NO: 3287519 - DNA, 21 bp, Homo sapiens
aggtgagtttgagctgccttc

SEQ ID NO: 3287520 - DNA, 15 bp, Homo sapiens
aggtgataagggaaa

SEQ ID NO: 3287521 - DNA, 21 bp, Homo sapiens
aggtgataagggaaaagataa

SEQ ID NO: 3287522 - DNA, 20 bp, Homo sapiens
aggtgatccacccacctcag

SEQ ID NO: 3287523 - DNA, 21 bp, Homo sapiens
aggtgcaatttcaaggttcta

SEQ ID NO: 3287524 - DNA, 16 bp, Homo sapiens
aggtgcagctcctcag

SEQ ID NO: 3287525 - DNA, 17 bp, Homo sapiens
aggtgcagctcctcagc

SEQ ID NO: 3287526 - DNA, 15 bp, Homo sapiens
aggtgcatttttact

SEQ ID NO: 3287527 - DNA, 12 bp, Homo sapiens
aggtgccactcc

SEQ ID NO: 3287528 - DNA, 21 bp, Homo sapiens
aggtgcctcagactccgccct

SEQ ID NO: 3287529 - DNA, 14 bp, Homo sapiens
aggtgcctccaggt

SEQ ID NO: 3287530 - DNA, 16 bp, Homo sapiens
aggtgcctccaggtgt

SEQ ID NO: 3287531 - DNA, 18 bp, Homo sapiens
aggtgcctccaggtgtgc

SEQ ID NO: 3287532 - DNA, 18 bp, Homo sapiens
aggtgcctgtcccacccc

SEQ ID NO: 3287533 - DNA, 23 bp, Homo sapiens
aggtgctaatttgttttggatat

SEQ ID NO: 3287534 - DNA, 17 bp, Homo sapiens
aggtgctatcctgccca

SEQ ID NO: 3287535 - DNA, 18 bp, Homo sapiens
aggtgctcacaccccatt

SEQ ID NO: 3287536 - DNA, 23 bp, Homo sapiens
aggtgctgatgtcaaagtgtaac

SEQ ID NO: 3287537 - DNA, 17 bp, Homo sapiens
aggtgctgccatccagg

SEQ ID NO: 3287538 - DNA, 23 bp, Homo sapiens
aggtgctggaggtgggagcagga

SEQ ID NO: 3287539 - DNA, 20 bp, Homo sapiens
aggtgcttaagcagaagcat

SEQ ID NO: 3287540 - DNA, 23 bp, Homo sapiens
aggtgcttattctcaaagcagga

SEQ ID NO: 3287541 - DNA, 17 bp, Homo sapiens
aggtggaagaagggaga

SEQ ID NO: 3287542 - DNA, 16 bp, Homo sapiens
aggtggaaggcagaca

SEQ ID NO: 3287543 - DNA, 18 bp, Homo sapiens
aggtggaaggcagacagc

SEQ ID NO: 3287544 - DNA, 15 bp, Homo sapiens
aggtggaataaacat

SEQ ID NO: 3287545 - DNA, 20 bp, Homo sapiens
aggtggagggcacagccctc

SEQ ID NO: 3287546 - DNA, 20 bp, Homo sapiens
aggtggaggttgcagtgagc

SEQ ID NO: 3287547 - DNA, 20 bp, Homo sapiens
aggtggcaatgcttaaacta

SEQ ID NO: 3287548 - DNA, 23 bp, Homo sapiens
aggtggcactttttcatttgcct

SEQ ID NO: 3287549 - DNA, 16 bp, Homo sapiens
aggtgggaaacattag

SEQ ID NO: 3287550 - DNA, 14 bp, Homo sapiens
aggtgggagcagga

SEQ ID NO: 3287551 - DNA, 16 bp, Homo sapiens
aggtgggagcaggaga

SEQ ID NO: 3287552 - DNA, 17 bp, Homo sapiens
aggtgggagcaggagat

SEQ ID NO: 3287553 - DNA, 23 bp, Homo sapiens
aggtgggagcggggctgggagga

SEQ ID NO: 3287554 - DNA, 22 bp, Homo sapiens
aggtgggatatcacttccatga

SEQ ID NO: 3287555 - DNA, 17 bp, Homo sapiens
aggtgggcagctgggcc

SEQ ID NO: 3287556 - DNA, 12 bp, Homo sapiens
aggtgggcatgc

SEQ ID NO: 3287557 - DNA, 14 bp, Homo sapiens
aggtgggcccagga

SEQ ID NO: 3287558 - DNA, 22 bp, Homo sapiens
aggtgggcccaggaccagctgg

SEQ ID NO: 3287559 - DNA, 20 bp, Homo sapiens
aggtgggctgagccctggca

SEQ ID NO: 3287560 - DNA, 21 bp, Homo sapiens
aggtggggtacatttctctga

SEQ ID NO: 3287561 - DNA, 13 bp, Homo sapiens
aggtgggtccagg

SEQ ID NO: 3287562 - DNA, 20 bp, Homo sapiens
aggtgggtgctgccctgtgt

SEQ ID NO: 3287563 - DNA, 14 bp, Homo sapiens
aggtggtctgaatg

SEQ ID NO: 3287564 - DNA, 15 bp, Homo sapiens
aggtggtctgaatgt

SEQ ID NO: 3287565 - DNA, 17 bp, Homo sapiens
aggtggtctgaatgttc

SEQ ID NO: 3287566 - DNA, 21 bp, Homo sapiens
aggtggtgagaaatttctgtg

SEQ ID NO: 3287567 - DNA, 15 bp, Homo sapiens
aggtggtgcttacat

SEQ ID NO: 3287568 - DNA, 16 bp, Homo sapiens
aggtgtccctgcactt

SEQ ID NO: 3287569 - DNA, 17 bp, Homo sapiens
aggtgtcctttcccctc

SEQ ID NO: 3287570 - DNA, 14 bp, Homo sapiens
aggtgtgaatgcac

SEQ ID NO: 3287571 - DNA, 15 bp, Homo sapiens
aggtgtgagactggg

SEQ ID NO: 3287572 - DNA, 15 bp, Homo sapiens
aggtgtgcctggaag

SEQ ID NO: 3287573 - DNA, 23 bp, Homo sapiens
aggtgttaacattccaagactct

SEQ ID NO: 3287574 - DNA, 15 bp, Homo sapiens
aggtgttactgtaat

SEQ ID NO: 3287575 - DNA, 14 bp, Homo sapiens
aggtgttagagagg

SEQ ID NO: 3287576 - DNA, 20 bp, Homo sapiens
aggtgttctacactcatctt

SEQ ID NO: 3287577 - DNA, 22 bp, Homo sapiens
aggtgttgccaaatatgtcctg

SEQ ID NO: 3287578 - DNA, 13 bp, Homo sapiens
aggtgtttaaaga

SEQ ID NO: 3287579 - DNA, 17 bp, Homo sapiens
aggtgtttgactttcaa

SEQ ID NO: 3287580 - DNA, 19 bp, Homo sapiens
aggtgttttttatgaagtg

SEQ ID NO: 3287581 - DNA, 16 bp, Homo sapiens
aggttaaggtgggtcc

SEQ ID NO: 3287582 - DNA, 15 bp, Homo sapiens
aggttaattccaatt

SEQ ID NO: 3287583 - DNA, 20 bp, Homo sapiens
aggttacccgagaagcactt

SEQ ID NO: 3287584 - DNA, 17 bp, Homo sapiens
aggttactaaaacaggg

SEQ ID NO: 3287585 - DNA, 19 bp, Homo sapiens
aggttatacaataacccag

SEQ ID NO: 3287586 - DNA, 22 bp, Homo sapiens
aggttatacaataacccagtta

SEQ ID NO: 3287587 - DNA, 15 bp, Homo sapiens
aggttatctgcctgg

SEQ ID NO: 3287588 - DNA, 20 bp, Homo sapiens
aggttatgttcatttttcaa

SEQ ID NO: 3287589 - DNA, 21 bp, Homo sapiens
aggttattgcaataaagtata

SEQ ID NO: 3287590 - DNA, 15 bp, Homo sapiens
aggttattttgcttt

SEQ ID NO: 3287591 - DNA, 14 bp, Homo sapiens
aggttcacactcag

SEQ ID NO: 3287592 - DNA, 20 bp, Homo sapiens
aggttcacactcagaaagag

SEQ ID NO: 3287593 - DNA, 16 bp, Homo sapiens
aggttcactaaagcag

SEQ ID NO: 3287594 - DNA, 13 bp, Homo sapiens
aggttcagccaag

SEQ ID NO: 3287595 - DNA, 19 bp, Homo sapiens
aggttcagccaaggtttta

SEQ ID NO: 3287596 - DNA, 14 bp, Homo sapiens
aggttccctcccag

SEQ ID NO: 3287597 - DNA, 11 bp, Homo sapiens
aggttccctgt

SEQ ID NO: 3287598 - DNA, 12 bp, Homo sapiens
aggttcctctgc

SEQ ID NO: 3287599 - DNA, 13 bp, Homo sapiens
aggttcctctgcc

SEQ ID NO: 3287600 - DNA, 14 bp, Homo sapiens
aggttcctctgcct

SEQ ID NO: 3287601 - DNA, 19 bp, Homo sapiens
aggttcctctgcctgcccc

SEQ ID NO: 3287602 - DNA, 11 bp, Homo sapiens
aggttctaaag

SEQ ID NO: 3287603 - DNA, 15 bp, Homo sapiens
aggttctaaagttct

SEQ ID NO: 3287604 - DNA, 16 bp, Homo sapiens
aggttctaaagttcta

SEQ ID NO: 3287605 - DNA, 23 bp, Homo sapiens
aggttctaaagttctaagattct

SEQ ID NO: 3287606 - DNA, 13 bp, Homo sapiens
aggttctaaggcc

SEQ ID NO: 3287607 - DNA, 15 bp, Homo sapiens
aggttctaaggccta

SEQ ID NO: 3287608 - DNA, 21 bp, Homo sapiens
aggttctaatattcacatgtt

SEQ ID NO: 3287609 - DNA, 22 bp, Homo sapiens
aggttctccgttagctcctgtg

SEQ ID NO: 3287610 - DNA, 17 bp, Homo sapiens
aggttctgagaccagtg

SEQ ID NO: 3287611 - DNA, 16 bp, Homo sapiens
aggttctggttccatt

SEQ ID NO: 3287612 - DNA, 22 bp, Homo sapiens
aggttctgtttatggccacatt

SEQ ID NO: 3287613 - DNA, 19 bp, Homo sapiens
aggttcttaaaaaggaaca

SEQ ID NO: 3287614 - DNA, 19 bp, Homo sapiens
aggttcttcatccctttcc

SEQ ID NO: 3287615 - DNA, 12 bp, Homo sapiens
aggttgaaagac

SEQ ID NO: 3287616 - DNA, 15 bp, Homo sapiens
aggttgaactttgcc

SEQ ID NO: 3287617 - DNA, 21 bp, Homo sapiens
aggttgacaataaatgtgctt

SEQ ID NO: 3287618 - DNA, 19 bp, Homo sapiens
agtcctgcaggagtgctgg

SEQ ID NO: 3287619 - DNA, 23 bp, Homo sapiens
agtcctgcaggagtgctggcatt

SEQ ID NO: 3287620 - DNA, 14 bp, Homo sapiens
agtcctgcctggcc

SEQ ID NO: 3287621 - DNA, 15 bp, Homo sapiens
agtcctgcctggcca

SEQ ID NO: 3287622 - DNA, 17 bp, Homo sapiens
agtcctgcctggccagg

SEQ ID NO: 3287623 - DNA, 20 bp, Homo sapiens
agtcctgcctggccaggcag

SEQ ID NO: 3287624 - DNA, 21 bp, Homo sapiens
agtcctgcctggccaggcaga

SEQ ID NO: 3287625 - DNA, 23 bp, Homo sapiens
agtcctggaagccagctttccct

SEQ ID NO: 3287626 - DNA, 17 bp, Homo sapiens
agtcctggatgttgtgt

SEQ ID NO: 3287627 - DNA, 13 bp, Homo sapiens
agtcctggctaca

SEQ ID NO: 3287628 - DNA, 19 bp, Homo sapiens
agtcctggctacatcccag

SEQ ID NO: 3287629 - DNA, 22 bp, Homo sapiens
agtcctggctacatcccagcct

SEQ ID NO: 3287630 - DNA, 22 bp, Homo sapiens
agtcctgggagaacctcaggct

SEQ ID NO: 3287631 - DNA, 16 bp, Homo sapiens
agtcctggtccctctg

SEQ ID NO: 3287632 - DNA, 17 bp, Homo sapiens
agtcctggtccctctga

SEQ ID NO: 3287633 - DNA, 18 bp, Homo sapiens
agtcctggtccctctgag

SEQ ID NO: 3287634 - DNA, 14 bp, Homo sapiens
agtcctgtgaattt

SEQ ID NO: 3287635 - DNA, 16 bp, Homo sapiens
agtcctgtgaatttct

SEQ ID NO: 3287636 - DNA, 17 bp, Homo sapiens
agtccttacctcttccg

SEQ ID NO: 3287637 - DNA, 23 bp, Homo sapiens
agtccttacctcttccggagatg

SEQ ID NO: 3287638 - DNA, 16 bp, Homo sapiens
agtccttattcttctc

SEQ ID NO: 3287639 - DNA, 22 bp, Homo sapiens
agtccttgaaaatattttttat

SEQ ID NO: 3287640 - DNA, 20 bp, Homo sapiens
agtcctttcccaccattcct

SEQ ID NO: 3287641 - DNA, 19 bp, Homo sapiens
agtcctttctgccttggcc

SEQ ID NO: 3287642 - DNA, 14 bp, Homo sapiens
agtcgaaggatgct

SEQ ID NO: 3287643 - DNA, 22 bp, Homo sapiens
agtcgcagaccagagctgtctg

SEQ ID NO: 3287644 - DNA, 17 bp, Homo sapiens
agtcgcaggatccgctg

SEQ ID NO: 3287645 - DNA, 19 bp, Homo sapiens
agtcgcatctcagtgcagg

SEQ ID NO: 3287646 - DNA, 12 bp, Homo sapiens
agtcggaaaagc

SEQ ID NO: 3287647 - DNA, 22 bp, Homo sapiens
agtcggaaaagcgtctttaaga

SEQ ID NO: 3287648 - DNA, 15 bp, Homo sapiens
agtcggaacagcaga

SEQ ID NO: 3287649 - DNA, 17 bp, Homo sapiens
agtcgggggctggccta

SEQ ID NO: 3287650 - DNA, 12 bp, Homo sapiens
agtcgtgcctgt

SEQ ID NO: 3287651 - DNA, 21 bp, Homo sapiens
agtcgtggctttggcagtgtt

SEQ ID NO: 3287652 - DNA, 20 bp, Homo sapiens
agtcgtggggtgtgctggga

SEQ ID NO: 3287653 - DNA, 18 bp, Homo sapiens
agtcgttggagactgaag

SEQ ID NO: 3287654 - DNA, 18 bp, Homo sapiens
agtctacctgctggacag

SEQ ID NO: 3287655 - DNA, 18 bp, Homo sapiens
agtctagattcaaaggtt

SEQ ID NO: 3287656 - DNA, 21 bp, Homo sapiens
agtctagattcaaaggttcta

SEQ ID NO: 3287657 - DNA, 16 bp, Homo sapiens
agtctagcactcattt

SEQ ID NO: 3287658 - DNA, 20 bp, Homo sapiens
agtctagcactcattttcta

SEQ ID NO: 3287659 - DNA, 11 bp, Homo sapiens
agtctattttt

SEQ ID NO: 3287660 - DNA, 19 bp, Homo sapiens
agtctcaaaaatacaaaat

SEQ ID NO: 3287661 - DNA, 20 bp, Homo sapiens
agtctcaaaaatacaaaata

SEQ ID NO: 3287662 - DNA, 18 bp, Homo sapiens
agtctcactgcttgaact

SEQ ID NO: 3287663 - DNA, 18 bp, Homo sapiens
agtctcactgttgcccag

SEQ ID NO: 3287664 - DNA, 18 bp, Homo sapiens
agtctcagtttgtgtgtc

SEQ ID NO: 3287665 - DNA, 21 bp, Homo sapiens
agtctcagtttgtgtgtctta

SEQ ID NO: 3287666 - DNA, 20 bp, Homo sapiens
agtctccacctgagaccctg

SEQ ID NO: 3287667 - DNA, 15 bp, Homo sapiens
agtctcccttcctat

SEQ ID NO: 3287668 - DNA, 13 bp, Homo sapiens
agtctcctcactc

SEQ ID NO: 3287669 - DNA, 14 bp, Homo sapiens
agtctcctcactct

SEQ ID NO: 3287670 - DNA, 15 bp, Homo sapiens
agtctcctcactctg

SEQ ID NO: 3287671 - DNA, 18 bp, Homo sapiens
agtctcctttgcactgag

SEQ ID NO: 3287672 - DNA, 14 bp, Homo sapiens
agtctctaattcta

SEQ ID NO: 3287673 - DNA, 15 bp, Homo sapiens
agtctctatttaaat

SEQ ID NO: 3287674 - DNA, 22 bp, Homo sapiens
agtctctatttaaattcttttt

SEQ ID NO: 3287675 - DNA, 20 bp, Homo sapiens
agtctctctctctctctccc

SEQ ID NO: 3287676 - DNA, 16 bp, Homo sapiens
agtctctctgtgaata

SEQ ID NO: 3287677 - DNA, 18 bp, Homo sapiens
agtctctctgtgaataca

SEQ ID NO: 3287678 - DNA, 23 bp, Homo sapiens
agtctctcttaaagttggaattt

SEQ ID NO: 3287679 - DNA, 15 bp, Homo sapiens
agtctctcttctctc

SEQ ID NO: 3287680 - DNA, 18 bp, Homo sapiens
agtctctcttctctccag

SEQ ID NO: 3287681 - DNA, 16 bp, Homo sapiens
agtctctgccacccac

SEQ ID NO: 3287682 - DNA, 17 bp, Homo sapiens
agtctctgccacccact

SEQ ID NO: 3287683 - DNA, 21 bp, Homo sapiens
agtctctggggcaggctgctt

SEQ ID NO: 3287684 - DNA, 20 bp, Homo sapiens
agtctctgttcttcatctgc

SEQ ID NO: 3287685 - DNA, 12 bp, Homo sapiens
agtctcttccac

SEQ ID NO: 3287686 - DNA, 15 bp, Homo sapiens
agtctcttctccact

SEQ ID NO: 3287687 - DNA, 17 bp, Homo sapiens
agtctcttgtattaaac

SEQ ID NO: 3287688 - DNA, 15 bp, Homo sapiens
agtctctttaatctt

SEQ ID NO: 3287689 - DNA, 17 bp, Homo sapiens
agtctctttaatcttca

SEQ ID NO: 3287690 - DNA, 14 bp, Homo sapiens
agtctctttcttcc

SEQ ID NO: 3287691 - DNA, 18 bp, Homo sapiens
agtctctttcttcctttc

SEQ ID NO: 3287692 - DNA, 19 bp, Homo sapiens
agtctctttcttcctttct

SEQ ID NO: 3287693 - DNA, 20 bp, Homo sapiens
agtctctttcttcctttcta

SEQ ID NO: 3287694 - DNA, 22 bp, Homo sapiens
agtctcttttctttagagcatt

SEQ ID NO: 3287695 - DNA, 15 bp, Homo sapiens
agtctgaacagctgt

SEQ ID NO: 3287696 - DNA, 17 bp, Homo sapiens
agtctgaacccttgtgc

SEQ ID NO: 3287697 - DNA, 18 bp, Homo sapiens
agtctgaacccttgtgct

SEQ ID NO: 3287698 - DNA, 19 bp, Homo sapiens
agtctgaacccttgtgctt

SEQ ID NO: 3287699 - DNA, 17 bp, Homo sapiens
agtctgaatgctgccac

SEQ ID NO: 3287700 - DNA, 16 bp, Homo sapiens
agtctgaatttttaaa

SEQ ID NO: 3287701 - DNA, 20 bp, Homo sapiens
agtctgagtcctgtctctgc

SEQ ID NO: 3287702 - DNA, 23 bp, Homo sapiens
agtctgagtcctgtctctgcctg

SEQ ID NO: 3287703 - DNA, 20 bp, Homo sapiens
agtctgattcccaagctctg

SEQ ID NO: 3287704 - DNA, 17 bp, Homo sapiens
agtctggaatgcagtgg

SEQ ID NO: 3287705 - DNA, 14 bp, Homo sapiens
agtctggagaaggt

SEQ ID NO: 3287706 - DNA, 13 bp, Homo sapiens
agtctggctttac

SEQ ID NO: 3287707 - DNA, 22 bp, Homo sapiens
agtctggctttacctttttgta

SEQ ID NO: 3287708 - DNA, 14 bp, Homo sapiens
agtctgggcctctg

SEQ ID NO: 3287709 - DNA, 20 bp, Homo sapiens
agtctgggcctctgactctg

SEQ ID NO: 3287710 - DNA, 23 bp, Homo sapiens
agtctgggcctctgactctgagt

SEQ ID NO: 3287711 - DNA, 14 bp, Homo sapiens
agtctgggctgccg

SEQ ID NO: 3287712 - DNA, 15 bp, Homo sapiens
agtctggtgaagctc

SEQ ID NO: 3287713 - DNA, 13 bp, Homo sapiens
agtctgtcatgaa

SEQ ID NO: 3287714 - DNA, 16 bp, Homo sapiens
agtctgtctactgtgg

SEQ ID NO: 3287715 - DNA, 17 bp, Homo sapiens
agtctgtctactgtggt

SEQ ID NO: 3287716 - DNA, 18 bp, Homo sapiens
agtctgtctactgtggtg

SEQ ID NO: 3287717 - DNA, 13 bp, Homo sapiens
agtctgtgagtgc

SEQ ID NO: 3287718 - DNA, 22 bp, Homo sapiens
agtctgtgagtgcgtctgaggg

SEQ ID NO: 3287719 - DNA, 18 bp, Homo sapiens
agtctgtgtgatgaactt

SEQ ID NO: 3287720 - DNA, 19 bp, Homo sapiens
agtctgtgtgggactgtac

SEQ ID NO: 3287721 - DNA, 23 bp, Homo sapiens
agtctgtgtttacagacagaaga

SEQ ID NO: 3287722 - DNA, 22 bp, Homo sapiens
agtcttaacaaaccaacatctt

SEQ ID NO: 3287723 - DNA, 23 bp, Homo sapiens
agtcttaacaaaccaacatcttt

SEQ ID NO: 3287724 - DNA, 18 bp, Homo sapiens
agtcttaatttatttctt

SEQ ID NO: 3287725 - DNA, 19 bp, Homo sapiens
agtcttacaatcaaatctc

SEQ ID NO: 3287726 - DNA, 21 bp, Homo sapiens
agtcttacaatcaaatctcct

SEQ ID NO: 3287727 - DNA, 22 bp, Homo sapiens
agtcttacataaaccatttttg

SEQ ID NO: 3287728 - DNA, 13 bp, Homo sapiens
agtcttagatgta

SEQ ID NO: 3287729 - DNA, 19 bp, Homo sapiens
agtcttcctgacactttaa

SEQ ID NO: 3287730 - DNA, 18 bp, Homo sapiens
agtcttctgggctgcggg

SEQ ID NO: 3287731 - DNA, 19 bp, Homo sapiens
agtcttctgggctgcggga

SEQ ID NO: 3287732 - DNA, 23 bp, Homo sapiens
agtcttgctctgttacccaggct

SEQ ID NO: 3287733 - DNA, 22 bp, Homo sapiens
agtcttggaagctgtttggaaa

SEQ ID NO: 3287734 - DNA, 19 bp, Homo sapiens
agtcttgggtctgaattta

SEQ ID NO: 3287735 - DNA, 15 bp, Homo sapiens
agtcttgtgcttttc

SEQ ID NO: 3287736 - DNA, 21 bp, Homo sapiens
agtctttaaaggcccagcccc

SEQ ID NO: 3287737 - DNA, 23 bp, Homo sapiens
agtctttaaaggcccagccccta

SEQ ID NO: 3287738 - DNA, 15 bp, Homo sapiens
agtctttcatggctg

SEQ ID NO: 3287739 - DNA, 17 bp, Homo sapiens
agtctttgaagctgaaa

SEQ ID NO: 3287740 - DNA, 15 bp, Homo sapiens
agtctttgccttctc

SEQ ID NO: 3287741 - DNA, 15 bp, Homo sapiens
agtcttttgcatgtc

SEQ ID NO: 3287742 - DNA, 14 bp, Homo sapiens
agtcttttgctttt

SEQ ID NO: 3287743 - DNA, 11 bp, Homo sapiens
agttaataatg

SEQ ID NO: 3287744 - DNA, 13 bp, Homo sapiens
agttaataatgta

SEQ ID NO: 3287745 - DNA, 15 bp, Homo sapiens
agttaatattgtgaa

SEQ ID NO: 3287746 - DNA, 18 bp, Homo sapiens
agttaatgtatataaaaa

SEQ ID NO: 3287747 - DNA, 13 bp, Homo sapiens
agttaatttatct

SEQ ID NO: 3287748 - DNA, 15 bp, Homo sapiens
agttaatttatctaa

SEQ ID NO: 3287749 - DNA, 18 bp, Homo sapiens
agttaatttatctaaatt

SEQ ID NO: 3287750 - DNA, 15 bp, Homo sapiens
agttaatttttccaa

SEQ ID NO: 3287751 - DNA, 15 bp, Homo sapiens
agttacaattacatc

SEQ ID NO: 3287752 - DNA, 18 bp, Homo sapiens
agttacactaaaaggtga

SEQ ID NO: 3287753 - DNA, 13 bp, Homo sapiens
agttacactttta

SEQ ID NO: 3287754 - DNA, 16 bp, Homo sapiens
agttacattaaaataa

SEQ ID NO: 3287755 - DNA, 19 bp, Homo sapiens
agttacattaaaataaacc

SEQ ID NO: 3287756 - DNA, 22 bp, Homo sapiens
agttactaggtaacttcatatt

SEQ ID NO: 3287757 - DNA, 13 bp, Homo sapiens
agttactcaagca

SEQ ID NO: 3287758 - DNA, 18 bp, Homo sapiens
agttactccctacactga

SEQ ID NO: 3287759 - DNA, 20 bp, Homo sapiens
agttactccctacactgatg

SEQ ID NO: 3287760 - DNA, 19 bp, Homo sapiens
agttacttgtctgaggcct

SEQ ID NO: 3287761 - DNA, 20 bp, Homo sapiens
agttacttgtctgaggcctc

SEQ ID NO: 3287762 - DNA, 12 bp, Homo sapiens
agttactttgta

SEQ ID NO: 3287763 - DNA, 14 bp, Homo sapiens
agttactttgtaat

SEQ ID NO: 3287764 - DNA, 21 bp, Homo sapiens
agttagagaactaaactagtt

SEQ ID NO: 3287765 - DNA, 14 bp, Homo sapiens
agttagccctcagt

SEQ ID NO: 3287766 - DNA, 18 bp, Homo sapiens
agttagctgaagaattga

SEQ ID NO: 3287767 - DNA, 13 bp, Homo sapiens
agttaggaaataa

SEQ ID NO: 3287768 - DNA, 14 bp, Homo sapiens
agttaggaaataaa

SEQ ID NO: 3287769 - DNA, 22 bp, Homo sapiens
agttaggaaataaaacctttca

SEQ ID NO: 3287770 - DNA, 21 bp, Homo sapiens
agttaggttgtctccaggcca

SEQ ID NO: 3287771 - DNA, 22 bp, Homo sapiens
agttaggttgtctccaggccat

SEQ ID NO: 3287772 - DNA, 15 bp, Homo sapiens
agttagtagcatgtt

SEQ ID NO: 3287773 - DNA, 16 bp, Homo sapiens
agttagtagcatgttg

SEQ ID NO: 3287774 - DNA, 14 bp, Homo sapiens
agttagtggaaatc

SEQ ID NO: 3287775 - DNA, 17 bp, Homo sapiens
agttagtggaaatctga

SEQ ID NO: 3287776 - DNA, 17 bp, Homo sapiens
agttagtggattactgc

SEQ ID NO: 3287777 - DNA, 18 bp, Homo sapiens
agttataaaattaaaagt

SEQ ID NO: 3287778 - DNA, 20 bp, Homo sapiens
agttataaaattaaaagttt

SEQ ID NO: 3287779 - DNA, 16 bp, Homo sapiens
agttataacagatgtg

SEQ ID NO: 3287780 - DNA, 15 bp, Homo sapiens
agttatagatgtcta

SEQ ID NO: 3287781 - DNA, 17 bp, Homo sapiens
agttatagatgtctagg

SEQ ID NO: 3287782 - DNA, 19 bp, Homo sapiens
agttatagatgtctaggta

SEQ ID NO: 3287783 - DNA, 23 bp, Homo sapiens
agttatagtgaatactgctacag

SEQ ID NO: 3287784 - DNA, 15 bp, Homo sapiens
agttatagtttcaga

SEQ ID NO: 3287785 - DNA, 18 bp, Homo sapiens
agttatagtttcagatat

SEQ ID NO: 3287786 - DNA, 20 bp, Homo sapiens
agttatataattcactcaag

SEQ ID NO: 3287787 - DNA, 15 bp, Homo sapiens
agttatattttgctg

SEQ ID NO: 3287788 - DNA, 16 bp, Homo sapiens
agttatatttttgtgt

SEQ ID NO: 3287789 - DNA, 22 bp, Homo sapiens
agttatcatgaattttaaagta

SEQ ID NO: 3287790 - DNA, 16 bp, Homo sapiens
agttatctttccctct

SEQ ID NO: 3287791 - DNA, 21 bp, Homo sapiens
agttatgacagccatttgtaa

SEQ ID NO: 3287792 - DNA, 20 bp, Homo sapiens
agttatgatttttttttcat

SEQ ID NO: 3287793 - DNA, 15 bp, Homo sapiens
agttatgtgaatgat

SEQ ID NO: 3287794 - DNA, 22 bp, Homo sapiens
agttattaatttttaaggatgt

SEQ ID NO: 3287795 - DNA, 21 bp, Homo sapiens
agttattatgtagctgaaaca

SEQ ID NO: 3287796 - DNA, 11 bp, Homo sapiens
agttattcaaa

SEQ ID NO: 3287797 - DNA, 17 bp, Homo sapiens
agttattcaaatttgta

SEQ ID NO: 3287798 - DNA, 18 bp, Homo sapiens
agttattcaaatttgtac

SEQ ID NO: 3287799 - DNA, 14 bp, Homo sapiens
agttattcataaag

SEQ ID NO: 3287800 - DNA, 17 bp, Homo sapiens
agttattgaatcttaat

SEQ ID NO: 3287801 - DNA, 18 bp, Homo sapiens
agttattgtacagctgtt

SEQ ID NO: 3287802 - DNA, 19 bp, Homo sapiens
agttattgtacagctgttt

SEQ ID NO: 3287803 - DNA, 22 bp, Homo sapiens
agttatttatgcctctgtattt

SEQ ID NO: 3287804 - DNA, 21 bp, Homo sapiens
agttatttatttattggagat

SEQ ID NO: 3287805 - DNA, 18 bp, Homo sapiens
agttatttcttgtttgtt

SEQ ID NO: 3287806 - DNA, 13 bp, Homo sapiens
agttattttatga

SEQ ID NO: 3287807 - DNA, 14 bp, Homo sapiens
agttattttctaca

SEQ ID NO: 3287808 - DNA, 13 bp, Homo sapiens
agttcaaacaaga

SEQ ID NO: 3287809 - DNA, 21 bp, Homo sapiens
agttcaaagtgtatatttatt

SEQ ID NO: 3287810 - DNA, 13 bp, Homo sapiens
agttcaatcctac

SEQ ID NO: 3287811 - DNA, 22 bp, Homo sapiens
agttcacaccctgcaaggccca

SEQ ID NO: 3287812 - DNA, 19 bp, Homo sapiens
agttcacaggaggccagtg

SEQ ID NO: 3287813 - DNA, 14 bp, Homo sapiens
agttcaccatctct

SEQ ID NO: 3287814 - DNA, 22 bp, Homo sapiens
agttcacgtaagatacaagttt

SEQ ID NO: 3287815 - DNA, 16 bp, Homo sapiens
agttcactataaatgg

SEQ ID NO: 3287816 - DNA, 20 bp, Homo sapiens
agttcaggtaacaggcagat

SEQ ID NO: 3287817 - DNA, 13 bp, Homo sapiens
agttcagtggcag

SEQ ID NO: 3287818 - DNA, 15 bp, Homo sapiens
agttcagttctgttt

SEQ ID NO: 3287819 - DNA, 19 bp, Homo sapiens
agttcataacagtgccatt

SEQ ID NO: 3287820 - DNA, 22 bp, Homo sapiens
agttcataacagtgccattgtc

SEQ ID NO: 3287821 - DNA, 15 bp, Homo sapiens
agttcatatatacat

SEQ ID NO: 3287822 - DNA, 20 bp, Homo sapiens
agttcatccaatcctcactg

SEQ ID NO: 3287823 - DNA, 19 bp, Homo sapiens
agttcatcccagccccaat

SEQ ID NO: 3287824 - DNA, 17 bp, Homo sapiens
agttcatcgattttcta

SEQ ID NO: 3287825 - DNA, 18 bp, Homo sapiens
agttcatcgattttctat

SEQ ID NO: 3287826 - DNA, 21 bp, Homo sapiens
agttcatgagaatctatattt

SEQ ID NO: 3287827 - DNA, 17 bp, Homo sapiens
agttcatgtttgcttca

SEQ ID NO: 3287828 - DNA, 15 bp, Homo sapiens
agttcatgtttgtaa

SEQ ID NO: 3287829 - DNA, 16 bp, Homo sapiens
agttcattattttgtg

SEQ ID NO: 3287830 - DNA, 21 bp, Homo sapiens
agttccacagattgtttctat

SEQ ID NO: 3287831 - DNA, 19 bp, Homo sapiens
agttccatggcaattttgt

SEQ ID NO: 3287832 - DNA, 13 bp, Homo sapiens
agttcccagctcc

SEQ ID NO: 3287833 - DNA, 16 bp, Homo sapiens
agttcccagctccccc

SEQ ID NO: 3287834 - DNA, 17 bp, Homo sapiens
agttcccagctcccccc

SEQ ID NO: 3287835 - DNA, 20 bp, Homo sapiens
agttccccatccctgtcatt

SEQ ID NO: 3287836 - DNA, 15 bp, Homo sapiens
agttcccccaacctc

SEQ ID NO: 3287837 - DNA, 15 bp, Homo sapiens
agttcccccagtacc

SEQ ID NO: 3287838 - DNA, 19 bp, Homo sapiens
agttcccccagtacctcca

SEQ ID NO: 3287839 - DNA, 19 bp, Homo sapiens
agttcccggagcacagccc

SEQ ID NO: 3287840 - DNA, 18 bp, Homo sapiens
agttccctctgctcagcc

SEQ ID NO: 3287841 - DNA, 20 bp, Homo sapiens
agttccctctgctcagccaa

SEQ ID NO: 3287842 - DNA, 16 bp, Homo sapiens
agttcccttggcctca

SEQ ID NO: 3287843 - DNA, 20 bp, Homo sapiens
agttcctgtcccttctctta

SEQ ID NO: 3287844 - DNA, 23 bp, Homo sapiens
agttcctgtcccttctcttaatt

SEQ ID NO: 3287845 - DNA, 19 bp, Homo sapiens
agttcctttccttttcttt

SEQ ID NO: 3287846 - DNA, 18 bp, Homo sapiens
agttcctttgtgtgtact

SEQ ID NO: 3287847 - DNA, 14 bp, Homo sapiens
agttcgagaccagc

SEQ ID NO: 3287848 - DNA, 16 bp, Homo sapiens
agttcgagaccagcct

SEQ ID NO: 3287849 - DNA, 21 bp, Homo sapiens
agttcgagaccagcctggcca

SEQ ID NO: 3287850 - DNA, 13 bp, Homo sapiens
agttctaaaattg

SEQ ID NO: 3287851 - DNA, 15 bp, Homo sapiens
agttctaagattcta

SEQ ID NO: 3287852 - DNA, 17 bp, Homo sapiens
agttctaagattctaat

SEQ ID NO: 3287853 - DNA, 19 bp, Homo sapiens
agttctaagattctaatga

SEQ ID NO: 3287854 - DNA, 22 bp, Homo sapiens
agttctaagttcatgtttgtaa

SEQ ID NO: 3287855 - DNA, 17 bp, Homo sapiens
agttctaataatttcta

SEQ ID NO: 3287856 - DNA, 20 bp, Homo sapiens
agttctacctcaggcagctc

SEQ ID NO: 3287857 - DNA, 23 bp, Homo sapiens
agttctacctcaggcagctcaag

SEQ ID NO: 3287858 - DNA, 19 bp, Homo sapiens
agttctagaaccacttcct

SEQ ID NO: 3287859 - DNA, 23 bp, Homo sapiens
agttctagacatggaggttctaa

SEQ ID NO: 3287860 - DNA, 23 bp, Homo sapiens
agttctatttatttgtgagactg

SEQ ID NO: 3287861 - DNA, 18 bp, Homo sapiens
agttctcactgttccctc

SEQ ID NO: 3287862 - DNA, 17 bp, Homo sapiens
agttctcagggctcctg

SEQ ID NO: 3287863 - DNA, 19 bp, Homo sapiens
agttctcagggctcctgcc

SEQ ID NO: 3287864 - DNA, 22 bp, Homo sapiens
agttctccctgtacagtgttac

SEQ ID NO: 3287865 - DNA, 14 bp, Homo sapiens
agttctgagtgttt

SEQ ID NO: 3287866 - DNA, 14 bp, Homo sapiens
agttctgccaggca

SEQ ID NO: 3287867 - DNA, 15 bp, Homo sapiens
agttctgctcctctc

SEQ ID NO: 3287868 - DNA, 16 bp, Homo sapiens
agttctgctcctctcc

SEQ ID NO: 3287869 - DNA, 20 bp, Homo sapiens
ataaatgtataaatatacag

SEQ ID NO: 3287870 - DNA, 14 bp, Homo sapiens
ataaatgtatatac

SEQ ID NO: 3287871 - DNA, 12 bp, Homo sapiens
ataaatgtctgt

SEQ ID NO: 3287872 - DNA, 12 bp, Homo sapiens
ataaatgtttaa

SEQ ID NO: 3287873 - DNA, 15 bp, Homo sapiens
ataaattcaactttg

SEQ ID NO: 3287874 - DNA, 22 bp, Homo sapiens
ataaattcagatatatttttca

SEQ ID NO: 3287875 - DNA, 18 bp, Homo sapiens
ataaattctactaagtta

SEQ ID NO: 3287876 - DNA, 19 bp, Homo sapiens
ataaattctactaagttat

SEQ ID NO: 3287877 - DNA, 21 bp, Homo sapiens
ataaattctactaagttattt

SEQ ID NO: 3287878 - DNA, 16 bp, Homo sapiens
ataaattctataggaa

SEQ ID NO: 3287879 - DNA, 20 bp, Homo sapiens
ataaattggtgataagtgga

SEQ ID NO: 3287880 - DNA, 13 bp, Homo sapiens
ataaattgtcttt

SEQ ID NO: 3287881 - DNA, 17 bp, Homo sapiens
ataaatttaagtttttc

SEQ ID NO: 3287882 - DNA, 17 bp, Homo sapiens
ataaatttcgcttctta

SEQ ID NO: 3287883 - DNA, 16 bp, Homo sapiens
ataaattttttgaaac

SEQ ID NO: 3287884 - DNA, 20 bp, Homo sapiens
ataaattttttgaaacacaa

SEQ ID NO: 3287885 - DNA, 21 bp, Homo sapiens
ataacaactatttttgttgtt

SEQ ID NO: 3287886 - DNA, 12 bp, Homo sapiens
ataacaagaaaa

SEQ ID NO: 3287887 - DNA, 19 bp, Homo sapiens
ataacaagatctttcagga

SEQ ID NO: 3287888 - DNA, 18 bp, Homo sapiens
ataacaatgtatgtgaaa

SEQ ID NO: 3287889 - DNA, 13 bp, Homo sapiens
ataacaatgttaa

SEQ ID NO: 3287890 - DNA, 14 bp, Homo sapiens
ataacacaatatga

SEQ ID NO: 3287891 - DNA, 16 bp, Homo sapiens
ataacacactttttat

SEQ ID NO: 3287892 - DNA, 14 bp, Homo sapiens
ataacacagagaga

SEQ ID NO: 3287893 - DNA, 23 bp, Homo sapiens
ataacactctaggatgtatattt

SEQ ID NO: 3287894 - DNA, 21 bp, Homo sapiens
ataacacttgtcagcctcaga

SEQ ID NO: 3287895 - DNA, 15 bp, Homo sapiens
ataacagatgtgaaa

SEQ ID NO: 3287896 - DNA, 19 bp, Homo sapiens
ataacagtcttactgcagg

SEQ ID NO: 3287897 - DNA, 21 bp, Homo sapiens
ataacagtgccattgtcttta

SEQ ID NO: 3287898 - DNA, 13 bp, Homo sapiens
ataacagttatat

SEQ ID NO: 3287899 - DNA, 20 bp, Homo sapiens
ataacatctttattgaaatt

SEQ ID NO: 3287900 - DNA, 12 bp, Homo sapiens
ataacatgtaat

SEQ ID NO: 3287901 - DNA, 13 bp, Homo sapiens
ataaccacttaaa

SEQ ID NO: 3287902 - DNA, 22 bp, Homo sapiens
ataaccacttaaaaaatgtcca

SEQ ID NO: 3287903 - DNA, 14 bp, Homo sapiens
ataaccagctgtaa

SEQ ID NO: 3287904 - DNA, 15 bp, Homo sapiens
ataacccagttactt

SEQ ID NO: 3287905 - DNA, 18 bp, Homo sapiens
ataacctatatgatttat

SEQ ID NO: 3287906 - DNA, 16 bp, Homo sapiens
ataacctctggccctt

SEQ ID NO: 3287907 - DNA, 15 bp, Homo sapiens
ataaccttaaaaagg

SEQ ID NO: 3287908 - DNA, 13 bp, Homo sapiens
ataacctttctgg

SEQ ID NO: 3287909 - DNA, 16 bp, Homo sapiens
ataacgcttaaaggaa

SEQ ID NO: 3287910 - DNA, 15 bp, Homo sapiens
ataacgtttttcctt

SEQ ID NO: 3287911 - DNA, 14 bp, Homo sapiens
ataactaaatttga

SEQ ID NO: 3287912 - DNA, 15 bp, Homo sapiens
ataactaaatttgat

SEQ ID NO: 3287913 - DNA, 15 bp, Homo sapiens
ataactaacatgtcc

SEQ ID NO: 3287914 - DNA, 15 bp, Homo sapiens
ataactactgtgttc

SEQ ID NO: 3287915 - DNA, 16 bp, Homo sapiens
ataactactgtgttcc

SEQ ID NO: 3287916 - DNA, 18 bp, Homo sapiens
ataactactgtgttcctg

SEQ ID NO: 3287917 - DNA, 15 bp, Homo sapiens
ataactagaaacctg

SEQ ID NO: 3287918 - DNA, 14 bp, Homo sapiens
ataactcagaatat

SEQ ID NO: 3287919 - DNA, 15 bp, Homo sapiens
ataactcatcataaa

SEQ ID NO: 3287920 - DNA, 12 bp, Homo sapiens
ataactctgcaa

SEQ ID NO: 3287921 - DNA, 19 bp, Homo sapiens
ataactctgcactactcct

SEQ ID NO: 3287922 - DNA, 21 bp, Homo sapiens
ataactctgcactactcctct

SEQ ID NO: 3287923 - DNA, 19 bp, Homo sapiens
ataactctgtaaaaacact

SEQ ID NO: 3287924 - DNA, 15 bp, Homo sapiens
ataactgatttctat

SEQ ID NO: 3287925 - DNA, 19 bp, Homo sapiens
ataactgatttctatggct

SEQ ID NO: 3287926 - DNA, 20 bp, Homo sapiens
ataactgtacaaaaattgtt

SEQ ID NO: 3287927 - DNA, 16 bp, Homo sapiens
ataacttaaaaaaatg

SEQ ID NO: 3287928 - DNA, 21 bp, Homo sapiens
ataacttaaaaatgtaaatat

SEQ ID NO: 3287929 - DNA, 14 bp, Homo sapiens
ataacttaaaataa

SEQ ID NO: 3287930 - DNA, 16 bp, Homo sapiens
ataacttaaaatattt

SEQ ID NO: 3287931 - DNA, 15 bp, Homo sapiens
ataacttactgtata

SEQ ID NO: 3287932 - DNA, 20 bp, Homo sapiens
ataacttactgtatatgtat

SEQ ID NO: 3287933 - DNA, 16 bp, Homo sapiens
ataacttattagcagt

SEQ ID NO: 3287934 - DNA, 12 bp, Homo sapiens
ataacttcagtc

SEQ ID NO: 3287935 - DNA, 22 bp, Homo sapiens
ataacttcagtcctgctccaga

SEQ ID NO: 3287936 - DNA, 17 bp, Homo sapiens
ataacttcttaaaagtt

SEQ ID NO: 3287937 - DNA, 17 bp, Homo sapiens
ataacttcttcctgctg

SEQ ID NO: 3287938 - DNA, 22 bp, Homo sapiens
ataacttcttcctgctggacag

SEQ ID NO: 3287939 - DNA, 11 bp, Homo sapiens
ataacttgatg

SEQ ID NO: 3287940 - DNA, 17 bp, Homo sapiens
ataacttgatgcatgtg

SEQ ID NO: 3287941 - DNA, 13 bp, Homo sapiens
ataagaaaatgct

SEQ ID NO: 3287942 - DNA, 13 bp, Homo sapiens
ataagaaggaaaa

SEQ ID NO: 3287943 - DNA, 22 bp, Homo sapiens
ataagacaatagtatttctcct

SEQ ID NO: 3287944 - DNA, 14 bp, Homo sapiens
ataagacataacgt

SEQ ID NO: 3287945 - DNA, 23 bp, Homo sapiens
ataagacataacgtttttccttt

SEQ ID NO: 3287946 - DNA, 17 bp, Homo sapiens
ataagactgtttttaag

SEQ ID NO: 3287947 - DNA, 23 bp, Homo sapiens
ataagactgtttttaagtaactt

SEQ ID NO: 3287948 - DNA, 18 bp, Homo sapiens
ataagagaagtctcattc

SEQ ID NO: 3287949 - DNA, 20 bp, Homo sapiens
ataagagaattatatatttc

SEQ ID NO: 3287950 - DNA, 20 bp, Homo sapiens
ataagagagaacaactactg

SEQ ID NO: 3287951 - DNA, 19 bp, Homo sapiens
ataagatcctagatcctaa

SEQ ID NO: 3287952 - DNA, 16 bp, Homo sapiens
ataagattaaaggaag

SEQ ID NO: 3287953 - DNA, 19 bp, Homo sapiens
ataagattaaaggaaggaa

SEQ ID NO: 3287954 - DNA, 11 bp, Homo sapiens
ataagattcta

SEQ ID NO: 3287955 - DNA, 17 bp, Homo sapiens
ataagattctaacggtc

SEQ ID NO: 3287956 - DNA, 15 bp, Homo sapiens
ataagcaaataaaca

SEQ ID NO: 3287957 - DNA, 18 bp, Homo sapiens
ataagcaaattgcttttt

SEQ ID NO: 3287958 - DNA, 15 bp, Homo sapiens
ataagcaaatttcaa

SEQ ID NO: 3287959 - DNA, 21 bp, Homo sapiens
ataagcaaatttcaaaagaca

SEQ ID NO: 3287960 - DNA, 14 bp, Homo sapiens
ataagcaagagaga

SEQ ID NO: 3287961 - DNA, 17 bp, Homo sapiens
ataagcactgtaaactt

SEQ ID NO: 3287962 - DNA, 17 bp, Homo sapiens
ataagcaggtggatcta

SEQ ID NO: 3287963 - DNA, 22 bp, Homo sapiens
ataagcaggtggatctatttca

SEQ ID NO: 3287964 - DNA, 16 bp, Homo sapiens
ataagcattgaaatta

SEQ ID NO: 3287965 - DNA, 18 bp, Homo sapiens
ataagcattgaaattata

SEQ ID NO: 3287966 - DNA, 23 bp, Homo sapiens
ataagcctgagccttagctccca

SEQ ID NO: 3287967 - DNA, 14 bp, Homo sapiens
ataagctctagttc

SEQ ID NO: 3287968 - DNA, 22 bp, Homo sapiens
ataagcttccattttaatttta

SEQ ID NO: 3287969 - DNA, 16 bp, Homo sapiens
ataagctttctctcag

SEQ ID NO: 3287970 - DNA, 22 bp, Homo sapiens
ataagctttctctcagaaatgc

SEQ ID NO: 3287971 - DNA, 22 bp, Homo sapiens
ataaggacgtgtgtaaatatgt

SEQ ID NO: 3287972 - DNA, 14 bp, Homo sapiens
ataaggaggaggag

SEQ ID NO: 3287973 - DNA, 19 bp, Homo sapiens
ataaggaggaggagggaga

SEQ ID NO: 3287974 - DNA, 23 bp, Homo sapiens
ataaggcccagagcgaggaaagg

SEQ ID NO: 3287975 - DNA, 20 bp, Homo sapiens
ataagggagagctgagccag

SEQ ID NO: 3287976 - DNA, 20 bp, Homo sapiens
ataaggtttcgtttctgtat

SEQ ID NO: 3287977 - DNA, 13 bp, Homo sapiens
ataagtaagtttg

SEQ ID NO: 3287978 - DNA, 14 bp, Homo sapiens
ataagtcaaaagga

SEQ ID NO: 3287979 - DNA, 14 bp, Homo sapiens
ataagtcaagcaca

SEQ ID NO: 3287980 - DNA, 19 bp, Homo sapiens
ataagtcaagcacatgtaa

SEQ ID NO: 3287981 - DNA, 15 bp, Homo sapiens
ataagtgaataataa

SEQ ID NO: 3287982 - DNA, 14 bp, Homo sapiens
ataagtgaatttat

SEQ ID NO: 3287983 - DNA, 19 bp, Homo sapiens
ataagtgcacacagaaata

SEQ ID NO: 3287984 - DNA, 21 bp, Homo sapiens
ataagtgcacacagaaatata

SEQ ID NO: 3287985 - DNA, 11 bp, Homo sapiens
ataagtggaaa

SEQ ID NO: 3287986 - DNA, 15 bp, Homo sapiens
ataagtggaaaaaag

SEQ ID NO: 3287987 - DNA, 14 bp, Homo sapiens
ataagtgtacatat

SEQ ID NO: 3287988 - DNA, 18 bp, Homo sapiens
ataagttatttttgtaca

SEQ ID NO: 3287989 - DNA, 18 bp, Homo sapiens
ataagttcaaattcttct

SEQ ID NO: 3287990 - DNA, 24 bp, Homo sapiens
ataagttcaaattcttctgaactc

SEQ ID NO: 3287991 - DNA, 13 bp, Homo sapiens
ataagttcacaaa

SEQ ID NO: 3287992 - DNA, 16 bp, Homo sapiens
ataagttcacaaaatg

SEQ ID NO: 3287993 - DNA, 16 bp, Homo sapiens
ataagttccatgttaa

SEQ ID NO: 3287994 - DNA, 14 bp, Homo sapiens
ataagttgctgtgt

SEQ ID NO: 3287995 - DNA, 21 bp, Homo sapiens
ataagtttctgggacctcagt

SEQ ID NO: 3287996 - DNA, 12 bp, Homo sapiens
atagattctaaa

SEQ ID NO: 3287997 - DNA, 13 bp, Homo sapiens
atagattctaaag

SEQ ID NO: 3287998 - DNA, 14 bp, Homo sapiens
atagattctaaaga

SEQ ID NO: 3287999 - DNA, 17 bp, Homo sapiens
atagattgtatctctta

SEQ ID NO: 3288000 - DNA, 17 bp, Homo sapiens
atagatttaccctttat

SEQ ID NO: 3288001 - DNA, 21 bp, Homo sapiens
atagatttatttttcagttcc

SEQ ID NO: 3288002 - DNA, 23 bp, Homo sapiens
atagatttatttttcagttccaa

SEQ ID NO: 3288003 - DNA, 14 bp, Homo sapiens
atagcaaatgacat

SEQ ID NO: 3288004 - DNA, 17 bp, Homo sapiens
atagcaacaacaattgg

SEQ ID NO: 3288005 - DNA, 15 bp, Homo sapiens
atagcaacaggaaaa

SEQ ID NO: 3288006 - DNA, 22 bp, Homo sapiens
atagcaacttttgtgtaatgaa

SEQ ID NO: 3288007 - DNA, 16 bp, Homo sapiens
atagcaagatattgat

SEQ ID NO: 3288008 - DNA, 18 bp, Homo sapiens
atagcactttcattgcca

SEQ ID NO: 3288009 - DNA, 17 bp, Homo sapiens
atagcagaggggccagg

SEQ ID NO: 3288010 - DNA, 21 bp, Homo sapiens
atagcagaggggccaggccca

SEQ ID NO: 3288011 - DNA, 15 bp, Homo sapiens
atagcagcaaaaata

SEQ ID NO: 3288012 - DNA, 19 bp, Homo sapiens
atagcagccagttcaaaaa

SEQ ID NO: 3288013 - DNA, 18 bp, Homo sapiens
atagcagtatatgttaat

SEQ ID NO: 3288014 - DNA, 16 bp, Homo sapiens
atagcagttataacag

SEQ ID NO: 3288015 - DNA, 19 bp, Homo sapiens
atagcagttataacagatg

SEQ ID NO: 3288016 - DNA, 18 bp, Homo sapiens
atagcatttttgatttat

SEQ ID NO: 3288017 - DNA, 12 bp, Homo sapiens
atagccaaaaat

SEQ ID NO: 3288018 - DNA, 13 bp, Homo sapiens
atagccacatttg

SEQ ID NO: 3288019 - DNA, 22 bp, Homo sapiens
atagccacatttggaatacttt

SEQ ID NO: 3288020 - DNA, 23 bp, Homo sapiens
atagccacatttggaatactttt

SEQ ID NO: 3288021 - DNA, 18 bp, Homo sapiens
atagcccatccctgcctg

SEQ ID NO: 3288022 - DNA, 22 bp, Homo sapiens
atagcctttaaatcatttttat

SEQ ID NO: 3288023 - DNA, 23 bp, Homo sapiens
atagcgacaggaatagatgtggt

SEQ ID NO: 3288024 - DNA, 22 bp, Homo sapiens
atagctaacattttaaataaaa

SEQ ID NO: 3288025 - DNA, 14 bp, Homo sapiens
atagctaactgtaa

SEQ ID NO: 3288026 - DNA, 18 bp, Homo sapiens
atagctacatcagtttga

SEQ ID NO: 3288027 - DNA, 16 bp, Homo sapiens
atagctacccaaaaga

SEQ ID NO: 3288028 - DNA, 16 bp, Homo sapiens
atagctatatccatgt

SEQ ID NO: 3288029 - DNA, 20 bp, Homo sapiens
atagctatatccatgtactg

SEQ ID NO: 3288030 - DNA, 23 bp, Homo sapiens
atagctatatccatgtactgtag

SEQ ID NO: 3288031 - DNA, 14 bp, Homo sapiens
atagctattactgt

SEQ ID NO: 3288032 - DNA, 21 bp, Homo sapiens
atagctcaggtgtccctgcac

SEQ ID NO: 3288033 - DNA, 19 bp, Homo sapiens
atagctctggggtgggcag

SEQ ID NO: 3288034 - DNA, 21 bp, Homo sapiens
atagctgagattcctggttcg

SEQ ID NO: 3288035 - DNA, 18 bp, Homo sapiens
atagctgcatgtggcttt

SEQ ID NO: 3288036 - DNA, 20 bp, Homo sapiens
atagcttaactaatttgaat

SEQ ID NO: 3288037 - DNA, 16 bp, Homo sapiens
atagcttactgaagaa

SEQ ID NO: 3288038 - DNA, 21 bp, Homo sapiens
atagcttagcggcaagaagcc

SEQ ID NO: 3288039 - DNA, 16 bp, Homo sapiens
atagcttattattgaa

SEQ ID NO: 3288040 - DNA, 14 bp, Homo sapiens
atagcttgaaacat

SEQ ID NO: 3288041 - DNA, 20 bp, Homo sapiens
atagcttgtatagtgtaaaa

SEQ ID NO: 3288042 - DNA, 19 bp, Homo sapiens
ataggaaactaagcattgt

SEQ ID NO: 3288043 - DNA, 21 bp, Homo sapiens
ataggaaagtatttttttaag

SEQ ID NO: 3288044 - DNA, 16 bp, Homo sapiens
ataggaacatatgaaa

SEQ ID NO: 3288045 - DNA, 18 bp, Homo sapiens
ataggaacatatgaaaat

SEQ ID NO: 3288046 - DNA, 16 bp, Homo sapiens
ataggaagcgtctggc

SEQ ID NO: 3288047 - DNA, 21 bp, Homo sapiens
ataggaatcattcagaaatgt

SEQ ID NO: 3288048 - DNA, 19 bp, Homo sapiens
ataggacatactgcatgta

SEQ ID NO: 3288049 - DNA, 20 bp, Homo sapiens
ataggacctttccaccacag

SEQ ID NO: 3288050 - DNA, 23 bp, Homo sapiens
ataggacctttccaccacagcca

SEQ ID NO: 3288051 - DNA, 14 bp, Homo sapiens
ataggagactgcgt

SEQ ID NO: 3288052 - DNA, 20 bp, Homo sapiens
ataggagaggatgagagccc

SEQ ID NO: 3288053 - DNA, 16 bp, Homo sapiens
ataggatttttagaat

SEQ ID NO: 3288054 - DNA, 14 bp, Homo sapiens
ataggcagaatgga

SEQ ID NO: 3288055 - DNA, 13 bp, Homo sapiens
ataggcaggaagc

SEQ ID NO: 3288056 - DNA, 14 bp, Homo sapiens
ataggcccaaggtc

SEQ ID NO: 3288057 - DNA, 23 bp, Homo sapiens
ataggcccaaggtcccctccaca

SEQ ID NO: 3288058 - DNA, 14 bp, Homo sapiens
ataggcctgggtgc

SEQ ID NO: 3288059 - DNA, 19 bp, Homo sapiens
ataggctctgcacagatgg

SEQ ID NO: 3288060 - DNA, 14 bp, Homo sapiens
atagggctgagctc

SEQ ID NO: 3288061 - DNA, 17 bp, Homo sapiens
atagggctgagctctct

SEQ ID NO: 3288062 - DNA, 18 bp, Homo sapiens
ataggggatatttaaggt

SEQ ID NO: 3288063 - DNA, 16 bp, Homo sapiens
ataggtcactcctggg

SEQ ID NO: 3288064 - DNA, 17 bp, Homo sapiens
ataggtcactggctctc

SEQ ID NO: 3288065 - DNA, 19 bp, Homo sapiens
ataggtcactggctctcca

SEQ ID NO: 3288066 - DNA, 14 bp, Homo sapiens
ataggtctcatctc

SEQ ID NO: 3288067 - DNA, 19 bp, Homo sapiens
ataggtctcatctcttcag

SEQ ID NO: 3288068 - DNA, 23 bp, Homo sapiens
ataggttttcccctcttttgtta

SEQ ID NO: 3288069 - DNA, 20 bp, Homo sapiens
atagtaactgacatgattag

SEQ ID NO: 3288070 - DNA, 21 bp, Homo sapiens
atagtaacttcttatggaatt

SEQ ID NO: 3288071 - DNA, 13 bp, Homo sapiens
atagtaagcatag

SEQ ID NO: 3288072 - DNA, 19 bp, Homo sapiens
atagtaccatttatacaaa

SEQ ID NO: 3288073 - DNA, 15 bp, Homo sapiens
atagtagcatacatt

SEQ ID NO: 3288074 - DNA, 15 bp, Homo sapiens
atagtatatctggac

SEQ ID NO: 3288075 - DNA, 16 bp, Homo sapiens
atagtatgtgactttt

SEQ ID NO: 3288076 - DNA, 21 bp, Homo sapiens
atagtatgtgacttttctgat

SEQ ID NO: 3288077 - DNA, 20 bp, Homo sapiens
atagtatttctcctttgcaa

SEQ ID NO: 3288078 - DNA, 21 bp, Homo sapiens
atagtatttgagagttctaaa

SEQ ID NO: 3288079 - DNA, 13 bp, Homo sapiens
atagtcaatgtaa

SEQ ID NO: 3288080 - DNA, 17 bp, Homo sapiens
atagtcaatttctactt

SEQ ID NO: 3288081 - DNA, 16 bp, Homo sapiens
atagtcttttgctttt

SEQ ID NO: 3288082 - DNA, 17 bp, Homo sapiens
atagtcttttgcttttg

SEQ ID NO: 3288083 - DNA, 23 bp, Homo sapiens
atagtgactagcactagacatgt

SEQ ID NO: 3288084 - DNA, 14 bp, Homo sapiens
atagtgctatatat

SEQ ID NO: 3288085 - DNA, 22 bp, Homo sapiens
atagtgctatatatataaatat

SEQ ID NO: 3288086 - DNA, 12 bp, Homo sapiens
atagtgcttttt

SEQ ID NO: 3288087 - DNA, 20 bp, Homo sapiens
atagtgggcaccccactgca

SEQ ID NO: 3288088 - DNA, 21 bp, Homo sapiens
atagtggggttccatgagtta

SEQ ID NO: 3288089 - DNA, 21 bp, Homo sapiens
atagtggtgttttaaagagaa

SEQ ID NO: 3288090 - DNA, 19 bp, Homo sapiens
atagtgtagctgaggaggc

SEQ ID NO: 3288091 - DNA, 14 bp, Homo sapiens
atagttactgtgta

SEQ ID NO: 3288092 - DNA, 14 bp, Homo sapiens
atagttagccctca

SEQ ID NO: 3288093 - DNA, 15 bp, Homo sapiens
atagttatacatcaa

SEQ ID NO: 3288094 - DNA, 17 bp, Homo sapiens
atagttatacatcaatt

SEQ ID NO: 3288095 - DNA, 15 bp, Homo sapiens
atagttcagtagaat

SEQ ID NO: 3288096 - DNA, 14 bp, Homo sapiens
atagttctagacat

SEQ ID NO: 3288097 - DNA, 23 bp, Homo sapiens
atagttctagacatggaggttct

SEQ ID NO: 3288098 - DNA, 12 bp, Homo sapiens
atagttctaggc

SEQ ID NO: 3288099 - DNA, 18 bp, Homo sapiens
atagttgcatagcagtat

SEQ ID NO: 3288100 - DNA, 22 bp, Homo sapiens
atagttggctaggacccctcca

SEQ ID NO: 3288101 - DNA, 15 bp, Homo sapiens
atagtttacaatatt

SEQ ID NO: 3288102 - DNA, 13 bp, Homo sapiens
atagtttctgagg

SEQ ID NO: 3288103 - DNA, 14 bp, Homo sapiens
atagtttctgaggc

SEQ ID NO: 3288104 - DNA, 15 bp, Homo sapiens
atagtttgtacatgc

SEQ ID NO: 3288105 - DNA, 17 bp, Homo sapiens
atagtttgtctatttta

SEQ ID NO: 3288106 - DNA, 20 bp, Homo sapiens
atagttttaaactcattttt

SEQ ID NO: 3288107 - DNA, 21 bp, Homo sapiens
atagttttacttttaaactgt

SEQ ID NO: 3288108 - DNA, 23 bp, Homo sapiens
atagttttacttttaaactgtgt

SEQ ID NO: 3288109 - DNA, 21 bp, Homo sapiens
atagtttttaccttttatgta

SEQ ID NO: 3288110 - DNA, 16 bp, Homo sapiens
atataaaaaatcatgc

SEQ ID NO: 3288111 - DNA, 16 bp, Homo sapiens
atataaaaacatcagt

SEQ ID NO: 3288112 - DNA, 23 bp, Homo sapiens
atataaaaagaaaagataaagat

SEQ ID NO: 3288113 - DNA, 14 bp, Homo sapiens
atataaaaatatat

SEQ ID NO: 3288114 - DNA, 15 bp, Homo sapiens
atataaaagatatat

SEQ ID NO: 3288115 - DNA, 20 bp, Homo sapiens
atataaaaggcaaatgtgta

SEQ ID NO: 3288116 - DNA, 21 bp, Homo sapiens
atataaaaggcaaatgtgtac

SEQ ID NO: 3288117 - DNA, 13 bp, Homo sapiens
atataaaataact

SEQ ID NO: 3288118 - DNA, 12 bp, Homo sapiens
atataaaataat

SEQ ID NO: 3288119 - DNA, 21 bp, Homo sapiens
atataaaatagttgtccatat

SEQ ID NO: 3288120 - DNA, 17 bp, Homo sapiens
atataaaatatctatat

SEQ ID NO: 3288121 - DNA, 12 bp, Homo sapiens
atatttcaagtg

SEQ ID NO: 3288122 - DNA, 15 bp, Homo sapiens
atatttcaagtgcct

SEQ ID NO: 3288123 - DNA, 23 bp, Homo sapiens
atatttcaagtgcctagactgtt

SEQ ID NO: 3288124 - DNA, 15 bp, Homo sapiens
atatttcacttttgt

SEQ ID NO: 3288125 - DNA, 19 bp, Homo sapiens
atatttcacttttgttctg

SEQ ID NO: 3288126 - DNA, 20 bp, Homo sapiens
atatttcacttttgttctgc

SEQ ID NO: 3288127 - DNA, 14 bp, Homo sapiens
atatttcagatatc

SEQ ID NO: 3288128 - DNA, 17 bp, Homo sapiens
atatttcagatatcaaa

SEQ ID NO: 3288129 - DNA, 21 bp, Homo sapiens
atatttccatatggattttct

SEQ ID NO: 3288130 - DNA, 20 bp, Homo sapiens
atatttccctaaaatacatt

SEQ ID NO: 3288131 - DNA, 22 bp, Homo sapiens
atatttccctaaaatacattta

SEQ ID NO: 3288132 - DNA, 17 bp, Homo sapiens
atatttcctgacttgag

SEQ ID NO: 3288133 - DNA, 22 bp, Homo sapiens
atatttcctgacttgagtgttc

SEQ ID NO: 3288134 - DNA, 15 bp, Homo sapiens
atatttctaactata

SEQ ID NO: 3288135 - DNA, 16 bp, Homo sapiens
atatttctaactatat

SEQ ID NO: 3288136 - DNA, 15 bp, Homo sapiens
atatttcttgctttc

SEQ ID NO: 3288137 - DNA, 18 bp, Homo sapiens
atatttgaaaaccatatt

SEQ ID NO: 3288138 - DNA, 17 bp, Homo sapiens
atatttgaatatcatta

SEQ ID NO: 3288139 - DNA, 14 bp, Homo sapiens
atatttgaatgaaa

SEQ ID NO: 3288140 - DNA, 20 bp, Homo sapiens
atatttgacttgcatgaaga

SEQ ID NO: 3288141 - DNA, 22 bp, Homo sapiens
atatttgacttgcatgaagaga

SEQ ID NO: 3288142 - DNA, 17 bp, Homo sapiens
atatttgcacttatgta

SEQ ID NO: 3288143 - DNA, 20 bp, Homo sapiens
atatttgcacttatgtactt

SEQ ID NO: 3288144 - DNA, 23 bp, Homo sapiens
atatttgcattgaggaaatatta

SEQ ID NO: 3288145 - DNA, 16 bp, Homo sapiens
atatttgccaataaag

SEQ ID NO: 3288146 - DNA, 18 bp, Homo sapiens
atatttgccaataaagct

SEQ ID NO: 3288147 - DNA, 15 bp, Homo sapiens
atatttggcttaaat

SEQ ID NO: 3288148 - DNA, 21 bp, Homo sapiens
atatttggcttaaatatagtt

SEQ ID NO: 3288149 - DNA, 13 bp, Homo sapiens
atatttgtacata

SEQ ID NO: 3288150 - DNA, 13 bp, Homo sapiens
atatttgtaggag

SEQ ID NO: 3288151 - DNA, 17 bp, Homo sapiens
atatttgtctttaaaca

SEQ ID NO: 3288152 - DNA, 20 bp, Homo sapiens
atatttgtgatagcactttc

SEQ ID NO: 3288153 - DNA, 14 bp, Homo sapiens
atattttaaaaaca

SEQ ID NO: 3288154 - DNA, 15 bp, Homo sapiens
atattttaatgaata

SEQ ID NO: 3288155 - DNA, 23 bp, Homo sapiens
atattttacctcttattgcaaaa

SEQ ID NO: 3288156 - DNA, 22 bp, Homo sapiens
atattttagcattttaattctc

SEQ ID NO: 3288157 - DNA, 14 bp, Homo sapiens
atattttatattac

SEQ ID NO: 3288158 - DNA, 20 bp, Homo sapiens
atattttatgtgagagaaag

SEQ ID NO: 3288159 - DNA, 24 bp, Homo sapiens
atattttcaaattgtatctagtgc

SEQ ID NO: 3288160 - DNA, 20 bp, Homo sapiens
atattttcatcctataagct

SEQ ID NO: 3288161 - DNA, 12 bp, Homo sapiens
atattttcatgt

SEQ ID NO: 3288162 - DNA, 24 bp, Homo sapiens
atattttcctagtagatctatatt

SEQ ID NO: 3288163 - DNA, 15 bp, Homo sapiens
atattttcctttaga

SEQ ID NO: 3288164 - DNA, 16 bp, Homo sapiens
atattttcgtatgaaa

SEQ ID NO: 3288165 - DNA, 17 bp, Homo sapiens
atattttcgtatgaaaa

SEQ ID NO: 3288166 - DNA, 13 bp, Homo sapiens
atattttctctgt

SEQ ID NO: 3288167 - DNA, 23 bp, Homo sapiens
atattttcttccaagcaaaggtg

SEQ ID NO: 3288168 - DNA, 14 bp, Homo sapiens
atattttgataata

SEQ ID NO: 3288169 - DNA, 17 bp, Homo sapiens
atattttgataataata

SEQ ID NO: 3288170 - DNA, 18 bp, Homo sapiens
atattttgataataatat

SEQ ID NO: 3288171 - DNA, 19 bp, Homo sapiens
atattttggaaactgctaa

SEQ ID NO: 3288172 - DNA, 20 bp, Homo sapiens
atattttggaaactgctaaa

SEQ ID NO: 3288173 - DNA, 13 bp, Homo sapiens
atattttgtatat

SEQ ID NO: 3288174 - DNA, 14 bp, Homo sapiens
atattttgtatata

SEQ ID NO: 3288175 - DNA, 22 bp, Homo sapiens
atattttgtgtgaaattgcata

SEQ ID NO: 3288176 - DNA, 20 bp, Homo sapiens
atatttttaaaatatttatt

SEQ ID NO: 3288177 - DNA, 13 bp, Homo sapiens
atatttttaaaga

SEQ ID NO: 3288178 - DNA, 16 bp, Homo sapiens
atatttttagactcat

SEQ ID NO: 3288179 - DNA, 13 bp, Homo sapiens
atatttttagata

SEQ ID NO: 3288180 - DNA, 14 bp, Homo sapiens
atatttttatattg

SEQ ID NO: 3288181 - DNA, 14 bp, Homo sapiens
atatttttatcttt

SEQ ID NO: 3288182 - DNA, 15 bp, Homo sapiens
atatttttatcttta

SEQ ID NO: 3288183 - DNA, 20 bp, Homo sapiens
atatttttatctttatatga

SEQ ID NO: 3288184 - DNA, 17 bp, Homo sapiens
atatttttccatttatt

SEQ ID NO: 3288185 - DNA, 23 bp, Homo sapiens
atatttttccatttatttatgaa

SEQ ID NO: 3288186 - DNA, 14 bp, Homo sapiens
atatttttgatcat

SEQ ID NO: 3288187 - DNA, 18 bp, Homo sapiens
atatttttggttgtcaat

SEQ ID NO: 3288188 - DNA, 12 bp, Homo sapiens
atatttttgtac

SEQ ID NO: 3288189 - DNA, 21 bp, Homo sapiens
atatttttgtacatattgtta

SEQ ID NO: 3288190 - DNA, 22 bp, Homo sapiens
atatttttgtacatattgttag

SEQ ID NO: 3288191 - DNA, 22 bp, Homo sapiens
atcaaaaatatgtgtttttaag

SEQ ID NO: 3288192 - DNA, 13 bp, Homo sapiens
atcaaaacacact

SEQ ID NO: 3288193 - DNA, 20 bp, Homo sapiens
atcaaaacacactactacct

SEQ ID NO: 3288194 - DNA, 16 bp, Homo sapiens
atcaaaagaaatagaa

SEQ ID NO: 3288195 - DNA, 18 bp, Homo sapiens
atcaaaagaaatagaaaa

SEQ ID NO: 3288196 - DNA, 24 bp, Homo sapiens
atcaaaaggttaataaagtaatta

SEQ ID NO: 3288197 - DNA, 16 bp, Homo sapiens
atcaaaatgcctttca

SEQ ID NO: 3288198 - DNA, 22 bp, Homo sapiens
atcaaaatgctttttatttctg

SEQ ID NO: 3288199 - DNA, 12 bp, Homo sapiens
atcaaaattaca

SEQ ID NO: 3288200 - DNA, 19 bp, Homo sapiens
atcaaagaattacagtaca

SEQ ID NO: 3288201 - DNA, 14 bp, Homo sapiens
atcaaagcaagggc

SEQ ID NO: 3288202 - DNA, 20 bp, Homo sapiens
atcaaagcaagggctccagc

SEQ ID NO: 3288203 - DNA, 13 bp, Homo sapiens
atcaaagccaggg

SEQ ID NO: 3288204 - DNA, 21 bp, Homo sapiens
atcaaaggaaaatagtaatgt

SEQ ID NO: 3288205 - DNA, 20 bp, Homo sapiens
atcaaataagtatttataat

SEQ ID NO: 3288206 - DNA, 14 bp, Homo sapiens
atcaaatatagaaa

SEQ ID NO: 3288207 - DNA, 17 bp, Homo sapiens
atcaaatctgtatatgt

SEQ ID NO: 3288208 - DNA, 23 bp, Homo sapiens
atcaaatgatttcatattgatct

SEQ ID NO: 3288209 - DNA, 13 bp, Homo sapiens
atcaaattgctta

SEQ ID NO: 3288210 - DNA, 22 bp, Homo sapiens
atcaacaataaaatttttttaa

SEQ ID NO: 3288211 - DNA, 17 bp, Homo sapiens
atcaacatgttattcaa

SEQ ID NO: 3288212 - DNA, 23 bp, Homo sapiens
atcaaccaccatggatttttaca

SEQ ID NO: 3288213 - DNA, 12 bp, Homo sapiens
atcaacttaaca

SEQ ID NO: 3288214 - DNA, 19 bp, Homo sapiens
atcaactttactgtaatat

SEQ ID NO: 3288215 - DNA, 13 bp, Homo sapiens
atcaagacatagc

SEQ ID NO: 3288216 - DNA, 13 bp, Homo sapiens
atcaagcccttta

SEQ ID NO: 3288217 - DNA, 16 bp, Homo sapiens
atcaagcttttctgta

SEQ ID NO: 3288218 - DNA, 19 bp, Homo sapiens
atcaaggcaaaaatatcag

SEQ ID NO: 3288219 - DNA, 13 bp, Homo sapiens
atcaagtaatgaa

SEQ ID NO: 3288220 - DNA, 20 bp, Homo sapiens
atcaagtatttgggaagtga

SEQ ID NO: 3288221 - DNA, 15 bp, Homo sapiens
atcaagtcaatcatt

SEQ ID NO: 3288222 - DNA, 17 bp, Homo sapiens
atcaagtggcatgtgct

SEQ ID NO: 3288223 - DNA, 13 bp, Homo sapiens
atcaagtgtcttc

SEQ ID NO: 3288224 - DNA, 16 bp, Homo sapiens
atcaagtgtcttccat

SEQ ID NO: 3288225 - DNA, 15 bp, Homo sapiens
atcaagtgtgcttta

SEQ ID NO: 3288226 - DNA, 15 bp, Homo sapiens
atcaagttgaattga

SEQ ID NO: 3288227 - DNA, 15 bp, Homo sapiens
atcaataaaatgtga

SEQ ID NO: 3288228 - DNA, 13 bp, Homo sapiens
atcaataaatgct

SEQ ID NO: 3288229 - DNA, 13 bp, Homo sapiens
atcaatagttgaa

SEQ ID NO: 3288230 - DNA, 15 bp, Homo sapiens
atcaatatctaatat

SEQ ID NO: 3288231 - DNA, 20 bp, Homo sapiens
atcaatcatctgtgtgaaaa

SEQ ID NO: 3288232 - DNA, 16 bp, Homo sapiens
atcaatgaatattgaa

SEQ ID NO: 3288233 - DNA, 18 bp, Homo sapiens
atcaatgaatattgaagt

SEQ ID NO: 3288234 - DNA, 16 bp, Homo sapiens
atcaatgtgacattta

SEQ ID NO: 3288235 - DNA, 17 bp, Homo sapiens
atcaatgtgacatttac

SEQ ID NO: 3288236 - DNA, 14 bp, Homo sapiens
atcaatgtgtcttt

SEQ ID NO: 3288237 - DNA, 14 bp, Homo sapiens
atcaatgttcattg

SEQ ID NO: 3288238 - DNA, 17 bp, Homo sapiens
atcaatgttcattgtaa

SEQ ID NO: 3288239 - DNA, 18 bp, Homo sapiens
atcaattatagtttctga

SEQ ID NO: 3288240 - DNA, 20 bp, Homo sapiens
atcaattggcagtgactttg

SEQ ID NO: 3288241 - DNA, 12 bp, Homo sapiens
atcaatttaagt

SEQ ID NO: 3288242 - DNA, 20 bp, Homo sapiens
atcaatttgtaattgcttac

SEQ ID NO: 3288243 - DNA, 23 bp, Homo sapiens
atcaattttcattaaacttgaag

SEQ ID NO: 3288244 - DNA, 15 bp, Homo sapiens
atcaatttttaggaa

SEQ ID NO: 3288245 - DNA, 14 bp, Homo sapiens
atcacaaagtggaa

SEQ ID NO: 3288246 - DNA, 21 bp, Homo sapiens
atcacaaccaccgttacaagt

SEQ ID NO: 3288247 - DNA, 13 bp, Homo sapiens
atcccttctcaca

SEQ ID NO: 3288248 - DNA, 16 bp, Homo sapiens
atcccttctcacagca

SEQ ID NO: 3288249 - DNA, 17 bp, Homo sapiens
atcccttctcacagcac

SEQ ID NO: 3288250 - DNA, 14 bp, Homo sapiens
atccctttacaatg

SEQ ID NO: 3288251 - DNA, 17 bp, Homo sapiens
atccctttacaatgtga

SEQ ID NO: 3288252 - DNA, 22 bp, Homo sapiens
atccctttattaccccctcctt

SEQ ID NO: 3288253 - DNA, 23 bp, Homo sapiens
atcccttttcctgtcagtgtttt

SEQ ID NO: 3288254 - DNA, 18 bp, Homo sapiens
atccgactctaagctgtg

SEQ ID NO: 3288255 - DNA, 19 bp, Homo sapiens
atccgactctaagctgtgt

SEQ ID NO: 3288256 - DNA, 22 bp, Homo sapiens
atccgactctaagctgtgtgca

SEQ ID NO: 3288257 - DNA, 15 bp, Homo sapiens
atccgactgcccctg

SEQ ID NO: 3288258 - DNA, 19 bp, Homo sapiens
atccgcctacctcagcctc

SEQ ID NO: 3288259 - DNA, 17 bp, Homo sapiens
atccgcctgcctctgcc

SEQ ID NO: 3288260 - DNA, 14 bp, Homo sapiens
atccgccttttgta

SEQ ID NO: 3288261 - DNA, 14 bp, Homo sapiens
atccgctgccacca

SEQ ID NO: 3288262 - DNA, 20 bp, Homo sapiens
atccgctgccagccttgagc

SEQ ID NO: 3288263 - DNA, 14 bp, Homo sapiens
atccgggcaatgct

SEQ ID NO: 3288264 - DNA, 17 bp, Homo sapiens
atccgtcattgctgctg

SEQ ID NO: 3288265 - DNA, 20 bp, Homo sapiens
atccgtgtatttggctgggc

SEQ ID NO: 3288266 - DNA, 14 bp, Homo sapiens
atcctaaaacaaat

SEQ ID NO: 3288267 - DNA, 18 bp, Homo sapiens
atcctaagggtcgaaagc

SEQ ID NO: 3288268 - DNA, 21 bp, Homo sapiens
atcctaatgacttctaaaaat

SEQ ID NO: 3288269 - DNA, 16 bp, Homo sapiens
atcctaatttctcctc

SEQ ID NO: 3288270 - DNA, 19 bp, Homo sapiens
atcctaatttctcctccct

SEQ ID NO: 3288271 - DNA, 21 bp, Homo sapiens
atcctaccctcgggcccacct

SEQ ID NO: 3288272 - DNA, 22 bp, Homo sapiens
atcctaccctcgggcccacctg

SEQ ID NO: 3288273 - DNA, 16 bp, Homo sapiens
atcctactgagcattt

SEQ ID NO: 3288274 - DNA, 13 bp, Homo sapiens
atcctagattata

SEQ ID NO: 3288275 - DNA, 18 bp, Homo sapiens
atcctagattatatcaaa

SEQ ID NO: 3288276 - DNA, 20 bp, Homo sapiens
atcctagattatatcaaagt

SEQ ID NO: 3288277 - DNA, 15 bp, Homo sapiens
atcctagtttcctct

SEQ ID NO: 3288278 - DNA, 21 bp, Homo sapiens
atcctatctggggagctcctg

SEQ ID NO: 3288279 - DNA, 15 bp, Homo sapiens
atcctcaaagaaagt

SEQ ID NO: 3288280 - DNA, 16 bp, Homo sapiens
atcctcaaagaaagtg

SEQ ID NO: 3288281 - DNA, 14 bp, Homo sapiens
atcctcactgggtg

SEQ ID NO: 3288282 - DNA, 19 bp, Homo sapiens
atcctcagttggaatcatt

SEQ ID NO: 3288283 - DNA, 20 bp, Homo sapiens
atcctcatatggcccagtgt

SEQ ID NO: 3288284 - DNA, 14 bp, Homo sapiens
atcctcatccctga

SEQ ID NO: 3288285 - DNA, 16 bp, Homo sapiens
atcctcatccctgact

SEQ ID NO: 3288286 - DNA, 16 bp, Homo sapiens
atcctcattgcctcct

SEQ ID NO: 3288287 - DNA, 18 bp, Homo sapiens
atcctcattgcctcctgt

SEQ ID NO: 3288288 - DNA, 23 bp, Homo sapiens
atcctccaacttcatttgatgct

SEQ ID NO: 3288289 - DNA, 13 bp, Homo sapiens
atcctccagcttc

SEQ ID NO: 3288290 - DNA, 23 bp, Homo sapiens
atcctccagcttctggtactctc

SEQ ID NO: 3288291 - DNA, 15 bp, Homo sapiens
atcctccctatcaag

SEQ ID NO: 3288292 - DNA, 15 bp, Homo sapiens
atcctccgtccagcc

SEQ ID NO: 3288293 - DNA, 14 bp, Homo sapiens
atcctcctcccacc

SEQ ID NO: 3288294 - DNA, 11 bp, Homo sapiens
atcctcctgca

SEQ ID NO: 3288295 - DNA, 17 bp, Homo sapiens
atcctctactgtgcatc

SEQ ID NO: 3288296 - DNA, 14 bp, Homo sapiens
atcctgaaatttca

SEQ ID NO: 3288297 - DNA, 17 bp, Homo sapiens
atcctgaaatttcagat

SEQ ID NO: 3288298 - DNA, 23 bp, Homo sapiens
atcctgacttctaatatcattca

SEQ ID NO: 3288299 - DNA, 12 bp, Homo sapiens
atcctgagcccc

SEQ ID NO: 3288300 - DNA, 14 bp, Homo sapiens
atcctgagccccgc

SEQ ID NO: 3288301 - DNA, 17 bp, Homo sapiens
atcctgcagcctcctcc

SEQ ID NO: 3288302 - DNA, 23 bp, Homo sapiens
atcctgcaggaacgagcactggc

SEQ ID NO: 3288303 - DNA, 16 bp, Homo sapiens
atcctgccaccctgta

SEQ ID NO: 3288304 - DNA, 13 bp, Homo sapiens
atcctgccagccc

SEQ ID NO: 3288305 - DNA, 16 bp, Homo sapiens
atcctgccatttaaaa

SEQ ID NO: 3288306 - DNA, 14 bp, Homo sapiens
atcctgcccctcca

SEQ ID NO: 3288307 - DNA, 15 bp, Homo sapiens
atcctgccctggagg

SEQ ID NO: 3288308 - DNA, 12 bp, Homo sapiens
atcctgcctgcc

SEQ ID NO: 3288309 - DNA, 14 bp, Homo sapiens
atcctgcctgggtg

SEQ ID NO: 3288310 - DNA, 16 bp, Homo sapiens
atcctgcctgggtggg

SEQ ID NO: 3288311 - DNA, 22 bp, Homo sapiens
atcctgcctgggtgggacagcc

SEQ ID NO: 3288312 - DNA, 13 bp, Homo sapiens
atcctgctaagtt

SEQ ID NO: 3288313 - DNA, 23 bp, Homo sapiens
atcctgctggggccgccacggcc

SEQ ID NO: 3288314 - DNA, 13 bp, Homo sapiens
atcctggcagccc

SEQ ID NO: 3288315 - DNA, 18 bp, Homo sapiens
atcctggcagcccagaga

SEQ ID NO: 3288316 - DNA, 24 bp, Homo sapiens
atcctggcagcccagagactttgt

SEQ ID NO: 3288317 - DNA, 18 bp, Homo sapiens
atcctggctaacatggtg

SEQ ID NO: 3288318 - DNA, 19 bp, Homo sapiens
atcctggctctgtggcttg

SEQ ID NO: 3288319 - DNA, 16 bp, Homo sapiens
atcctggtaaccaaat

SEQ ID NO: 3288320 - DNA, 16 bp, Homo sapiens
atcctgtaccaaatct

SEQ ID NO: 3288321 - DNA, 23 bp, Homo sapiens
atcctgtaccaaatctgacatat

SEQ ID NO: 3288322 - DNA, 16 bp, Homo sapiens
atcctgtataagcact

SEQ ID NO: 3288323 - DNA, 23 bp, Homo sapiens
atcctgtataagcactgaaaaac

SEQ ID NO: 3288324 - DNA, 18 bp, Homo sapiens
atcctgtgacatgtaaca

SEQ ID NO: 3288325 - DNA, 23 bp, Homo sapiens
atcctgtgtcagaaaccctggtc

SEQ ID NO: 3288326 - DNA, 15 bp, Homo sapiens
atcctgttttctctg

SEQ ID NO: 3288327 - DNA, 13 bp, Homo sapiens
atccttacaagtt

SEQ ID NO: 3288328 - DNA, 15 bp, Homo sapiens
atccttatcagagct

SEQ ID NO: 3288329 - DNA, 16 bp, Homo sapiens
atccttatcagagcta

SEQ ID NO: 3288330 - DNA, 20 bp, Homo sapiens
atccttatcagagctaaggg

SEQ ID NO: 3288331 - DNA, 23 bp, Homo sapiens
atccttcacaggcagtgcatgtg

SEQ ID NO: 3288332 - DNA, 19 bp, Homo sapiens
atccttccaaaaaattaaa

SEQ ID NO: 3288333 - DNA, 19 bp, Homo sapiens
atccttccaaaaattatta

SEQ ID NO: 3288334 - DNA, 14 bp, Homo sapiens
atccttccccaact

SEQ ID NO: 3288335 - DNA, 15 bp, Homo sapiens
atccttcctaaaccc

SEQ ID NO: 3288336 - DNA, 17 bp, Homo sapiens
atccttcctataacttg

SEQ ID NO: 3288337 - DNA, 20 bp, Homo sapiens
atccttcctataacttgatg

SEQ ID NO: 3288338 - DNA, 20 bp, Homo sapiens
atccttcgtgaacatcccct

SEQ ID NO: 3288339 - DNA, 16 bp, Homo sapiens
atccttgactggacct

SEQ ID NO: 3288340 - DNA, 14 bp, Homo sapiens
atccttgataatat

SEQ ID NO: 3288341 - DNA, 18 bp, Homo sapiens
atccttggtctttgtatc

SEQ ID NO: 3288342 - DNA, 23 bp, Homo sapiens
atccttgtctttactgacaagaa

SEQ ID NO: 3288343 - DNA, 16 bp, Homo sapiens
atcctttctgccgacc

SEQ ID NO: 3288344 - DNA, 16 bp, Homo sapiens
atcctttgcagggcag

SEQ ID NO: 3288345 - DNA, 17 bp, Homo sapiens
atcctttgttctgagca

SEQ ID NO: 3288346 - DNA, 21 bp, Homo sapiens
atcctttgttttctgactaat

SEQ ID NO: 3288347 - DNA, 19 bp, Homo sapiens
atccttttaaccattttaa

SEQ ID NO: 3288348 - DNA, 15 bp, Homo sapiens
atcctttttccatca

SEQ ID NO: 3288349 - DNA, 15 bp, Homo sapiens
atcctttttctttat

SEQ ID NO: 3288350 - DNA, 16 bp, Homo sapiens
atccttttttgtcatt

SEQ ID NO: 3288351 - DNA, 20 bp, Homo sapiens
atccttttttgtcattttat

SEQ ID NO: 3288352 - DNA, 12 bp, Homo sapiens
atcgaaaattca

SEQ ID NO: 3288353 - DNA, 16 bp, Homo sapiens
atcgaaaattcatttc

SEQ ID NO: 3288354 - DNA, 17 bp, Homo sapiens
atcgaaataacaatgtt

SEQ ID NO: 3288355 - DNA, 18 bp, Homo sapiens
atcgaaataacaatgtta

SEQ ID NO: 3288356 - DNA, 23 bp, Homo sapiens
atcgaaataacaatgttaaggaa

SEQ ID NO: 3288357 - DNA, 17 bp, Homo sapiens
atcgagaactgccattg

SEQ ID NO: 3288358 - DNA, 16 bp, Homo sapiens
atcgagaccatcctgg

SEQ ID NO: 3288359 - DNA, 19 bp, Homo sapiens
atcgagaccatcctggcta

SEQ ID NO: 3288360 - DNA, 13 bp, Homo sapiens
atcgatgcagtgc

SEQ ID NO: 3288361 - DNA, 12 bp, Homo sapiens
atcgattggctt

SEQ ID NO: 3288362 - DNA, 23 bp, Homo sapiens
atcgcaggagtctctgccaccca

SEQ ID NO: 3288363 - DNA, 22 bp, Homo sapiens
atcgcatcattgcactctagcc

SEQ ID NO: 3288364 - DNA, 16 bp, Homo sapiens
atcgctcactgttgtg

SEQ ID NO: 3288365 - DNA, 16 bp, Homo sapiens
atcgcttgagcccagg

SEQ ID NO: 3288366 - DNA, 20 bp, Homo sapiens
atcggactaaactatctgta

SEQ ID NO: 3288367 - DNA, 21 bp, Homo sapiens
atcggactaaactatctgtat

SEQ ID NO: 3288368 - DNA, 13 bp, Homo sapiens
atcggagacagtg

SEQ ID NO: 3288369 - DNA, 22 bp, Homo sapiens
atcggaggctgggcccctggga

SEQ ID NO: 3288370 - DNA, 23 bp, Homo sapiens
atcggccaagaatacttgaagaa

SEQ ID NO: 3288371 - DNA, 21 bp, Homo sapiens
atcggcctcctcttcaccccg

SEQ ID NO: 3288372 - DNA, 13 bp, Homo sapiens
atcgggaaagaag

SEQ ID NO: 3288373 - DNA, 20 bp, Homo sapiens
atgaaagggaaagtcagctt

SEQ ID NO: 3288374 - DNA, 21 bp, Homo sapiens
atgaaagggaaagtcagcttt

SEQ ID NO: 3288375 - DNA, 20 bp, Homo sapiens
atgaaagtctagaaataaaa

SEQ ID NO: 3288376 - DNA, 14 bp, Homo sapiens
atgaaataaagaaa

SEQ ID NO: 3288377 - DNA, 22 bp, Homo sapiens
atgaaataaagacccaggggga

SEQ ID NO: 3288378 - DNA, 20 bp, Homo sapiens
atgaaataaattggtgataa

SEQ ID NO: 3288379 - DNA, 22 bp, Homo sapiens
atgaaataaattggtgataagt

SEQ ID NO: 3288380 - DNA, 20 bp, Homo sapiens
atgaaataactccttcttgt

SEQ ID NO: 3288381 - DNA, 13 bp, Homo sapiens
atgaaatatgcat

SEQ ID NO: 3288382 - DNA, 15 bp, Homo sapiens
atgaaatatgcatct

SEQ ID NO: 3288383 - DNA, 19 bp, Homo sapiens
atgaaatccttgactggac

SEQ ID NO: 3288384 - DNA, 23 bp, Homo sapiens
atgaaatgtcccctcaaactcat

SEQ ID NO: 3288385 - DNA, 21 bp, Homo sapiens
atgaaatttaaacattaaaaa

SEQ ID NO: 3288386 - DNA, 19 bp, Homo sapiens
atgaaattttctagacttt

SEQ ID NO: 3288387 - DNA, 22 bp, Homo sapiens
atgaaattttctagactttctg

SEQ ID NO: 3288388 - DNA, 23 bp, Homo sapiens
atgaaattttctagactttctgt

SEQ ID NO: 3288389 - DNA, 17 bp, Homo sapiens
atgaacaaaattatttg

SEQ ID NO: 3288390 - DNA, 19 bp, Homo sapiens
atgaacaaaattatttgta

SEQ ID NO: 3288391 - DNA, 15 bp, Homo sapiens
atgaacaagttttaa

SEQ ID NO: 3288392 - DNA, 13 bp, Homo sapiens
atgaacagctctg

SEQ ID NO: 3288393 - DNA, 20 bp, Homo sapiens
atgaacagctctgagatcct

SEQ ID NO: 3288394 - DNA, 22 bp, Homo sapiens
atgaacagctctgagatcctgg

SEQ ID NO: 3288395 - DNA, 23 bp, Homo sapiens
atgaacagctctgagatcctgga

SEQ ID NO: 3288396 - DNA, 21 bp, Homo sapiens
atgaacatattgttgaaaggt

SEQ ID NO: 3288397 - DNA, 23 bp, Homo sapiens
atgaaccacatcttgctctgctg

SEQ ID NO: 3288398 - DNA, 17 bp, Homo sapiens
atgaaccctttgtttct

SEQ ID NO: 3288399 - DNA, 14 bp, Homo sapiens
atgaacctattttc

SEQ ID NO: 3288400 - DNA, 18 bp, Homo sapiens
atgaacctattttcattt

SEQ ID NO: 3288401 - DNA, 14 bp, Homo sapiens
atgaactcaacttt

SEQ ID NO: 3288402 - DNA, 16 bp, Homo sapiens
atgaactcttaatcaa

SEQ ID NO: 3288403 - DNA, 20 bp, Homo sapiens
atgaactcttagaaatgaag

SEQ ID NO: 3288404 - DNA, 17 bp, Homo sapiens
atgaactgaagtttcac

SEQ ID NO: 3288405 - DNA, 16 bp, Homo sapiens
atgaactgcttttcct

SEQ ID NO: 3288406 - DNA, 16 bp, Homo sapiens
atgaacttattctgta

SEQ ID NO: 3288407 - DNA, 21 bp, Homo sapiens
atgaacttgttacttgcagca

SEQ ID NO: 3288408 - DNA, 17 bp, Homo sapiens
atgaagaacacagcatg

SEQ ID NO: 3288409 - DNA, 19 bp, Homo sapiens
atgaagaacacagcatgtg

SEQ ID NO: 3288410 - DNA, 16 bp, Homo sapiens
atgaagaagcctttgt

SEQ ID NO: 3288411 - DNA, 12 bp, Homo sapiens
atgaagaatgca

SEQ ID NO: 3288412 - DNA, 22 bp, Homo sapiens
atgaagaatgcattcaaaatat

SEQ ID NO: 3288413 - DNA, 18 bp, Homo sapiens
atgaagagcttgctttga

SEQ ID NO: 3288414 - DNA, 22 bp, Homo sapiens
atgaagatgtttcaaaaaatct

SEQ ID NO: 3288415 - DNA, 19 bp, Homo sapiens
atgaagattctcctgtgct

SEQ ID NO: 3288416 - DNA, 15 bp, Homo sapiens
atgaagcagatttat

SEQ ID NO: 3288417 - DNA, 22 bp, Homo sapiens
atgaagcagctttaaacaaatt

SEQ ID NO: 3288418 - DNA, 12 bp, Homo sapiens
atgaagccagct

SEQ ID NO: 3288419 - DNA, 17 bp, Homo sapiens
atgaaggaatcattcca

SEQ ID NO: 3288420 - DNA, 21 bp, Homo sapiens
atgaaggagaggcaacatcca

SEQ ID NO: 3288421 - DNA, 16 bp, Homo sapiens
atgaaggttaggattt

SEQ ID NO: 3288422 - DNA, 20 bp, Homo sapiens
atgaaggttaggatttaaca

SEQ ID NO: 3288423 - DNA, 22 bp, Homo sapiens
atgaagtaaagccattaaatga

SEQ ID NO: 3288424 - DNA, 15 bp, Homo sapiens
atgaagtatactttt

SEQ ID NO: 3288425 - DNA, 16 bp, Homo sapiens
atgaagtgcgtgaatg

SEQ ID NO: 3288426 - DNA, 18 bp, Homo sapiens
atgaagtgcgtgaatgta

SEQ ID NO: 3288427 - DNA, 15 bp, Homo sapiens
atgaagtgttagata

SEQ ID NO: 3288428 - DNA, 13 bp, Homo sapiens
atgaagttgctgt

SEQ ID NO: 3288429 - DNA, 14 bp, Homo sapiens
atgaagttgctgtt

SEQ ID NO: 3288430 - DNA, 16 bp, Homo sapiens
atgaagttgctgttta

SEQ ID NO: 3288431 - DNA, 17 bp, Homo sapiens
atgaagttgctgtttat

SEQ ID NO: 3288432 - DNA, 21 bp, Homo sapiens
atgaagttggcacatttcatg

SEQ ID NO: 3288433 - DNA, 18 bp, Homo sapiens
atgaagtttgaacttcat

SEQ ID NO: 3288434 - DNA, 16 bp, Homo sapiens
atgaataaaacactca

SEQ ID NO: 3288435 - DNA, 15 bp, Homo sapiens
atgaataaaataatt

SEQ ID NO: 3288436 - DNA, 15 bp, Homo sapiens
atgaataaactgaat

SEQ ID NO: 3288437 - DNA, 18 bp, Homo sapiens
atgaataaactgaatatt

SEQ ID NO: 3288438 - DNA, 13 bp, Homo sapiens
atgaataatggaa

SEQ ID NO: 3288439 - DNA, 20 bp, Homo sapiens
atgaataatggaaaatgcca

SEQ ID NO: 3288440 - DNA, 19 bp, Homo sapiens
atgaatatctattaatata

SEQ ID NO: 3288441 - DNA, 18 bp, Homo sapiens
atgaatatttataacagc

SEQ ID NO: 3288442 - DNA, 15 bp, Homo sapiens
atgaatattttgata

SEQ ID NO: 3288443 - DNA, 22 bp, Homo sapiens
atgaatattttgataataatat

SEQ ID NO: 3288444 - DNA, 17 bp, Homo sapiens
atgaatcaatgaaaaat

SEQ ID NO: 3288445 - DNA, 23 bp, Homo sapiens
atgaatcactgtttttagacacc

SEQ ID NO: 3288446 - DNA, 18 bp, Homo sapiens
atgaatcccacccacatg

SEQ ID NO: 3288447 - DNA, 17 bp, Homo sapiens
atgaatctgatttttat

SEQ ID NO: 3288448 - DNA, 14 bp, Homo sapiens
atgaatctgctcac

SEQ ID NO: 3288449 - DNA, 24 bp, Homo sapiens
atgaatctgtctcccagttatgaa

SEQ ID NO: 3288450 - DNA, 16 bp, Homo sapiens
atgaatgcaaaattgt

SEQ ID NO: 3288451 - DNA, 21 bp, Homo sapiens
atgaatgcaaaattgttttca

SEQ ID NO: 3288452 - DNA, 15 bp, Homo sapiens
atgaatgtatcagga

SEQ ID NO: 3288453 - DNA, 22 bp, Homo sapiens
atgaatgtttacactctttgta

SEQ ID NO: 3288454 - DNA, 16 bp, Homo sapiens
atgaattaaataaacc

SEQ ID NO: 3288455 - DNA, 14 bp, Homo sapiens
atgaattaaatatt

SEQ ID NO: 3288456 - DNA, 18 bp, Homo sapiens
atgaattactgtatataa

SEQ ID NO: 3288457 - DNA, 21 bp, Homo sapiens
atgaattactgtatataaact

SEQ ID NO: 3288458 - DNA, 19 bp, Homo sapiens
atgaattataacagttata

SEQ ID NO: 3288459 - DNA, 20 bp, Homo sapiens
atgaattcaagaaaggaaat

SEQ ID NO: 3288460 - DNA, 13 bp, Homo sapiens
atgaattgtacag

SEQ ID NO: 3288461 - DNA, 13 bp, Homo sapiens
atgaatttaaata

SEQ ID NO: 3288462 - DNA, 14 bp, Homo sapiens
atgaattttaaagt

SEQ ID NO: 3288463 - DNA, 17 bp, Homo sapiens
atgaattttaaagtatg

SEQ ID NO: 3288464 - DNA, 13 bp, Homo sapiens
atgaattttacat

SEQ ID NO: 3288465 - DNA, 14 bp, Homo sapiens
atgacaacacttaa

SEQ ID NO: 3288466 - DNA, 19 bp, Homo sapiens
atgacaacttttaaagaaa

SEQ ID NO: 3288467 - DNA, 22 bp, Homo sapiens
atgacaacttttaaagaaaaat

SEQ ID NO: 3288468 - DNA, 19 bp, Homo sapiens
atgacaagtgagacaaaaa

SEQ ID NO: 3288469 - DNA, 23 bp, Homo sapiens
atgacaccatcttttattctttt

SEQ ID NO: 3288470 - DNA, 14 bp, Homo sapiens
atgacacccaccct

SEQ ID NO: 3288471 - DNA, 19 bp, Homo sapiens
atgacacccaccctgtgcc

SEQ ID NO: 3288472 - DNA, 17 bp, Homo sapiens
atgacaccctggcctga

SEQ ID NO: 3288473 - DNA, 17 bp, Homo sapiens
atgacacgcgctctcca

SEQ ID NO: 3288474 - DNA, 21 bp, Homo sapiens
atgacactagaaaacttgact

SEQ ID NO: 3288475 - DNA, 15 bp, Homo sapiens
atgacactcctagac

SEQ ID NO: 3288476 - DNA, 12 bp, Homo sapiens
atgacactgacc

SEQ ID NO: 3288477 - DNA, 15 bp, Homo sapiens
atgacagatatattt

SEQ ID NO: 3288478 - DNA, 21 bp, Homo sapiens
atgacagatatatttaagcct

SEQ ID NO: 3288479 - DNA, 15 bp, Homo sapiens
atgacagattctgac

SEQ ID NO: 3288480 - DNA, 21 bp, Homo sapiens
atgacaggcgcctgccatcat

SEQ ID NO: 3288481 - DNA, 19 bp, Homo sapiens
atgacatcacttgtacaaa

SEQ ID NO: 3288482 - DNA, 18 bp, Homo sapiens
atgacatctcaggggcca

SEQ ID NO: 3288483 - DNA, 15 bp, Homo sapiens
atgacatgcactgac

SEQ ID NO: 3288484 - DNA, 17 bp, Homo sapiens
atgacatgttatatatt

SEQ ID NO: 3288485 - DNA, 14 bp, Homo sapiens
atgacattccctgc

SEQ ID NO: 3288486 - DNA, 19 bp, Homo sapiens
atgaccaaaccagccttcg

SEQ ID NO: 3288487 - DNA, 18 bp, Homo sapiens
atgaccagggatgctggg

SEQ ID NO: 3288488 - DNA, 19 bp, Homo sapiens
atgaccagggatgctgggc

SEQ ID NO: 3288489 - DNA, 20 bp, Homo sapiens
atgaccagggatgctgggct

SEQ ID NO: 3288490 - DNA, 17 bp, Homo sapiens
atgaccatactgaggga

SEQ ID NO: 3288491 - DNA, 23 bp, Homo sapiens
atgaccatatttactctttctaa

SEQ ID NO: 3288492 - DNA, 16 bp, Homo sapiens
atgacgacaaagctgc

SEQ ID NO: 3288493 - DNA, 21 bp, Homo sapiens
atgacgacaaagctgctaaat

SEQ ID NO: 3288494 - DNA, 23 bp, Homo sapiens
atgacgacaaagctgctaaatct

SEQ ID NO: 3288495 - DNA, 14 bp, Homo sapiens
atgacgcggctcaa

SEQ ID NO: 3288496 - DNA, 16 bp, Homo sapiens
atgacggaagaacata

SEQ ID NO: 3288497 - DNA, 21 bp, Homo sapiens
atgacggaagaacatagaact

SEQ ID NO: 3288498 - DNA, 15 bp, Homo sapiens
atgctctttcccttt

SEQ ID NO: 3288499 - DNA, 20 bp, Homo sapiens
atgctctttcccttttctgt

SEQ ID NO: 3288500 - DNA, 18 bp, Homo sapiens
atgctcttttttactcat

SEQ ID NO: 3288501 - DNA, 20 bp, Homo sapiens
atgctcttttttactcattg

SEQ ID NO: 3288502 - DNA, 17 bp, Homo sapiens
atgctgaaaaaacacct

SEQ ID NO: 3288503 - DNA, 16 bp, Homo sapiens
atgctgaatccacctc

SEQ ID NO: 3288504 - DNA, 14 bp, Homo sapiens
atgctgagattctt

SEQ ID NO: 3288505 - DNA, 17 bp, Homo sapiens
atgctgaggcctgggcc

SEQ ID NO: 3288506 - DNA, 18 bp, Homo sapiens
atgctgaggcctgggccg

SEQ ID NO: 3288507 - DNA, 17 bp, Homo sapiens
atgctgagggtgtttct

SEQ ID NO: 3288508 - DNA, 14 bp, Homo sapiens
atgctgatcatcgc

SEQ ID NO: 3288509 - DNA, 22 bp, Homo sapiens
atgctgatcatcgccagaggtg

SEQ ID NO: 3288510 - DNA, 14 bp, Homo sapiens
atgctgccaaattt

SEQ ID NO: 3288511 - DNA, 12 bp, Homo sapiens
atgctgcctgag

SEQ ID NO: 3288512 - DNA, 19 bp, Homo sapiens
atgctgctaattcaaagct

SEQ ID NO: 3288513 - DNA, 15 bp, Homo sapiens
atgctgcttctcctc

SEQ ID NO: 3288514 - DNA, 18 bp, Homo sapiens
atgctgctttcccctgtg

SEQ ID NO: 3288515 - DNA, 20 bp, Homo sapiens
atgctgctttcccctgtggg

SEQ ID NO: 3288516 - DNA, 12 bp, Homo sapiens
atgctgctttgc

SEQ ID NO: 3288517 - DNA, 19 bp, Homo sapiens
atgctgctttttggcacag

SEQ ID NO: 3288518 - DNA, 20 bp, Homo sapiens
atgctgctttttggcacagt

SEQ ID NO: 3288519 - DNA, 22 bp, Homo sapiens
atgctggacggcattcctgctt

SEQ ID NO: 3288520 - DNA, 20 bp, Homo sapiens
atgctggactggaggcccct

SEQ ID NO: 3288521 - DNA, 14 bp, Homo sapiens
atgctggagaagag

SEQ ID NO: 3288522 - DNA, 16 bp, Homo sapiens
atgctggagaagagag

SEQ ID NO: 3288523 - DNA, 12 bp, Homo sapiens
atgctggagagg

SEQ ID NO: 3288524 - DNA, 13 bp, Homo sapiens
atgctggagaggt

SEQ ID NO: 3288525 - DNA, 14 bp, Homo sapiens
atgctggagaggtt

SEQ ID NO: 3288526 - DNA, 15 bp, Homo sapiens
atgctggagaggtta

SEQ ID NO: 3288527 - DNA, 13 bp, Homo sapiens
atgctggcaaagg

SEQ ID NO: 3288528 - DNA, 14 bp, Homo sapiens
atgctggccagcac

SEQ ID NO: 3288529 - DNA, 17 bp, Homo sapiens
atgctggccagcaccct

SEQ ID NO: 3288530 - DNA, 20 bp, Homo sapiens
atgctggccagcaccctctc

SEQ ID NO: 3288531 - DNA, 21 bp, Homo sapiens
atgctggccagcaccctctcc

SEQ ID NO: 3288532 - DNA, 22 bp, Homo sapiens
atgctggccagcaccctctcct

SEQ ID NO: 3288533 - DNA, 18 bp, Homo sapiens
atgctggccgctcctccc

SEQ ID NO: 3288534 - DNA, 19 bp, Homo sapiens
atgctgggccactggggac

SEQ ID NO: 3288535 - DNA, 13 bp, Homo sapiens
atgctgggctggg

SEQ ID NO: 3288536 - DNA, 17 bp, Homo sapiens
atgctgggctgggccct

SEQ ID NO: 3288537 - DNA, 20 bp, Homo sapiens
atgctgtaacttaaaatagg

SEQ ID NO: 3288538 - DNA, 12 bp, Homo sapiens
atgctgtacatc

SEQ ID NO: 3288539 - DNA, 22 bp, Homo sapiens
atgctgtacatctattttggat

SEQ ID NO: 3288540 - DNA, 18 bp, Homo sapiens
atgctgtaggtggtatgt

SEQ ID NO: 3288541 - DNA, 14 bp, Homo sapiens
atgctgtagtaact

SEQ ID NO: 3288542 - DNA, 19 bp, Homo sapiens
atgctgtatatcctttcta

SEQ ID NO: 3288543 - DNA, 13 bp, Homo sapiens
atgctgtatttta

SEQ ID NO: 3288544 - DNA, 18 bp, Homo sapiens
atgctgtattttaacact

SEQ ID NO: 3288545 - DNA, 20 bp, Homo sapiens
atgctgtcaactatgatatg

SEQ ID NO: 3288546 - DNA, 22 bp, Homo sapiens
atgctgtcaactatgatatggt

SEQ ID NO: 3288547 - DNA, 18 bp, Homo sapiens
atgctgtgctatgaattt

SEQ ID NO: 3288548 - DNA, 15 bp, Homo sapiens
atgctgtgctctttg

SEQ ID NO: 3288549 - DNA, 18 bp, Homo sapiens
atgctgttctcttcttca

SEQ ID NO: 3288550 - DNA, 13 bp, Homo sapiens
atgctgttgctgc

SEQ ID NO: 3288551 - DNA, 14 bp, Homo sapiens
atgctgttgtaaac

SEQ ID NO: 3288552 - DNA, 15 bp, Homo sapiens
atgcttacaaaaaag

SEQ ID NO: 3288553 - DNA, 15 bp, Homo sapiens
atgcttagcttatct

SEQ ID NO: 3288554 - DNA, 16 bp, Homo sapiens
atgcttagcttatctt

SEQ ID NO: 3288555 - DNA, 21 bp, Homo sapiens
atgcttagcttatctttcttt

SEQ ID NO: 3288556 - DNA, 23 bp, Homo sapiens
atgcttagtccctcatgcaaatc

SEQ ID NO: 3288557 - DNA, 22 bp, Homo sapiens
atgcttcatcattccctctcat

SEQ ID NO: 3288558 - DNA, 16 bp, Homo sapiens
atgcttcatttgtatg

SEQ ID NO: 3288559 - DNA, 17 bp, Homo sapiens
atgcttccattaacaaa

SEQ ID NO: 3288560 - DNA, 15 bp, Homo sapiens
atgcttcccagaggg

SEQ ID NO: 3288561 - DNA, 18 bp, Homo sapiens
atgcttcccagagggagc

SEQ ID NO: 3288562 - DNA, 21 bp, Homo sapiens
atgcttcccagagggagcagg

SEQ ID NO: 3288563 - DNA, 15 bp, Homo sapiens
atgcttcctgacaat

SEQ ID NO: 3288564 - DNA, 20 bp, Homo sapiens
atgcttctataattttgcct

SEQ ID NO: 3288565 - DNA, 23 bp, Homo sapiens
atgcttctataattttgccttta

SEQ ID NO: 3288566 - DNA, 16 bp, Homo sapiens
atgcttctcatcttgt

SEQ ID NO: 3288567 - DNA, 12 bp, Homo sapiens
atgcttgattta

SEQ ID NO: 3288568 - DNA, 17 bp, Homo sapiens
atgcttgcataagagct

SEQ ID NO: 3288569 - DNA, 18 bp, Homo sapiens
atgcttgcataagagctt

SEQ ID NO: 3288570 - DNA, 20 bp, Homo sapiens
atgcttgcggcaaaaggaaa

SEQ ID NO: 3288571 - DNA, 18 bp, Homo sapiens
atgcttgtaacaagaaaa

SEQ ID NO: 3288572 - DNA, 20 bp, Homo sapiens
atgcttgtaacaagaaaaca

SEQ ID NO: 3288573 - DNA, 22 bp, Homo sapiens
atgcttgtttatgatatttctt

SEQ ID NO: 3288574 - DNA, 19 bp, Homo sapiens
atgctttattaatgttttc

SEQ ID NO: 3288575 - DNA, 15 bp, Homo sapiens
atgctttggaaaaat

SEQ ID NO: 3288576 - DNA, 22 bp, Homo sapiens
atgctttggaaaaatgggtctt

SEQ ID NO: 3288577 - DNA, 15 bp, Homo sapiens
atgctttgggaggcc

SEQ ID NO: 3288578 - DNA, 19 bp, Homo sapiens
atgctttgggaggccaagg

SEQ ID NO: 3288579 - DNA, 20 bp, Homo sapiens
atgctttgggaggccaaggc

SEQ ID NO: 3288580 - DNA, 16 bp, Homo sapiens
atgctttgtgtgattg

SEQ ID NO: 3288581 - DNA, 15 bp, Homo sapiens
atgcttttaaatgct

SEQ ID NO: 3288582 - DNA, 22 bp, Homo sapiens
atgcttttatatggcccagcct

SEQ ID NO: 3288583 - DNA, 16 bp, Homo sapiens
atgctttttgaatgtt

SEQ ID NO: 3288584 - DNA, 20 bp, Homo sapiens
atggaaaaaaacataaaaag

SEQ ID NO: 3288585 - DNA, 21 bp, Homo sapiens
atggaaaaaaacataaaaagc

SEQ ID NO: 3288586 - DNA, 13 bp, Homo sapiens
atggaaaaataaa

SEQ ID NO: 3288587 - DNA, 17 bp, Homo sapiens
atggaaaaataaaactg

SEQ ID NO: 3288588 - DNA, 19 bp, Homo sapiens
atggaaaactgtgttgcca

SEQ ID NO: 3288589 - DNA, 20 bp, Homo sapiens
atggaaaaggaagactagag

SEQ ID NO: 3288590 - DNA, 17 bp, Homo sapiens
atggaaaatcagctgct

SEQ ID NO: 3288591 - DNA, 20 bp, Homo sapiens
atggaaacactgattttgta

SEQ ID NO: 3288592 - DNA, 17 bp, Homo sapiens
atggaaacctcacgctg

SEQ ID NO: 3288593 - DNA, 16 bp, Homo sapiens
atggaaacctgaaaaa

SEQ ID NO: 3288594 - DNA, 23 bp, Homo sapiens
atggaaagcagagttttcattaa

SEQ ID NO: 3288595 - DNA, 16 bp, Homo sapiens
atggaaagtaactcat

SEQ ID NO: 3288596 - DNA, 13 bp, Homo sapiens
atggaaccttccc

SEQ ID NO: 3288597 - DNA, 14 bp, Homo sapiens
atggaaccttccct

SEQ ID NO: 3288598 - DNA, 17 bp, Homo sapiens
atggaaccttccctcca

SEQ ID NO: 3288599 - DNA, 23 bp, Homo sapiens
atggaactactgtactttgccat

SEQ ID NO: 3288600 - DNA, 17 bp, Homo sapiens
atggaatacagtgttat

SEQ ID NO: 3288601 - DNA, 15 bp, Homo sapiens
atggaatatcatctg

SEQ ID NO: 3288602 - DNA, 21 bp, Homo sapiens
atggaatatttataggccagg

SEQ ID NO: 3288603 - DNA, 24 bp, Homo sapiens
atggaatatttataggccagggca

SEQ ID NO: 3288604 - DNA, 17 bp, Homo sapiens
atggaatcgatttcctc

SEQ ID NO: 3288605 - DNA, 20 bp, Homo sapiens
atggaatcgatttcctccca

SEQ ID NO: 3288606 - DNA, 18 bp, Homo sapiens
atggaatcttctccagta

SEQ ID NO: 3288607 - DNA, 23 bp, Homo sapiens
atggaatggcaggtgtcatatga

SEQ ID NO: 3288608 - DNA, 20 bp, Homo sapiens
atggaattattttgaatgtc

SEQ ID NO: 3288609 - DNA, 16 bp, Homo sapiens
atggaattgatttgca

SEQ ID NO: 3288610 - DNA, 17 bp, Homo sapiens
atggaattgcttaccaa

SEQ ID NO: 3288611 - DNA, 15 bp, Homo sapiens
atggacaacttattt

SEQ ID NO: 3288612 - DNA, 13 bp, Homo sapiens
atggacacaaatt

SEQ ID NO: 3288613 - DNA, 16 bp, Homo sapiens
atggacacaaattttc

SEQ ID NO: 3288614 - DNA, 15 bp, Homo sapiens
atggacactccagtg

SEQ ID NO: 3288615 - DNA, 18 bp, Homo sapiens
atggacagttcacaccct

SEQ ID NO: 3288616 - DNA, 21 bp, Homo sapiens
atggacagttcacaccctgca

SEQ ID NO: 3288617 - DNA, 13 bp, Homo sapiens
atggacatcctgt

SEQ ID NO: 3288618 - DNA, 20 bp, Homo sapiens
atggacatcctgtataagca

SEQ ID NO: 3288619 - DNA, 22 bp, Homo sapiens
atggacatcctgtataagcact

SEQ ID NO: 3288620 - DNA, 20 bp, Homo sapiens
atggacatttagaagaaaga

SEQ ID NO: 3288621 - DNA, 23 bp, Homo sapiens
atggaccgggtgggcctggcctg

SEQ ID NO: 3288622 - DNA, 14 bp, Homo sapiens
atggacctaacatt

SEQ ID NO: 3288623 - DNA, 16 bp, Homo sapiens
atgtctgtagctcctc

SEQ ID NO: 3288624 - DNA, 14 bp, Homo sapiens
atgtctgttctaca

SEQ ID NO: 3288625 - DNA, 18 bp, Homo sapiens
atgtctgtttttgtatct

SEQ ID NO: 3288626 - DNA, 19 bp, Homo sapiens
atgtcttcataaagtactt

SEQ ID NO: 3288627 - DNA, 17 bp, Homo sapiens
atgtcttcatttcattg

SEQ ID NO: 3288628 - DNA, 18 bp, Homo sapiens
atgtcttcatttcattgt

SEQ ID NO: 3288629 - DNA, 13 bp, Homo sapiens
atgtcttggacac

SEQ ID NO: 3288630 - DNA, 16 bp, Homo sapiens
atgtcttggacactgt

SEQ ID NO: 3288631 - DNA, 19 bp, Homo sapiens
atgtcttggacactgtaca

SEQ ID NO: 3288632 - DNA, 14 bp, Homo sapiens
atgtcttgtacatg

SEQ ID NO: 3288633 - DNA, 21 bp, Homo sapiens
atgtctttactggacctgaaa

SEQ ID NO: 3288634 - DNA, 20 bp, Homo sapiens
atgtcttttatatttgtatc

SEQ ID NO: 3288635 - DNA, 16 bp, Homo sapiens
atgtcttttcttggca

SEQ ID NO: 3288636 - DNA, 15 bp, Homo sapiens
atgtcttttgaatat

SEQ ID NO: 3288637 - DNA, 15 bp, Homo sapiens
atgtgaaaaaaatga

SEQ ID NO: 3288638 - DNA, 13 bp, Homo sapiens
atgtgaaaaatct

SEQ ID NO: 3288639 - DNA, 14 bp, Homo sapiens
atgtgaaaaatctg

SEQ ID NO: 3288640 - DNA, 13 bp, Homo sapiens
atgtgaaaagtat

SEQ ID NO: 3288641 - DNA, 22 bp, Homo sapiens
atgtgaaaataaagcagaagca

SEQ ID NO: 3288642 - DNA, 18 bp, Homo sapiens
atgtgaaaatatacttga

SEQ ID NO: 3288643 - DNA, 20 bp, Homo sapiens
atgtgaaaatatacttgact

SEQ ID NO: 3288644 - DNA, 22 bp, Homo sapiens
atgtgaaacactttgcctcctg

SEQ ID NO: 3288645 - DNA, 12 bp, Homo sapiens
atgtgaaacctt

SEQ ID NO: 3288646 - DNA, 19 bp, Homo sapiens
atgtgaaaccttttttaag

SEQ ID NO: 3288647 - DNA, 21 bp, Homo sapiens
atgtgaaaccttttttaagat

SEQ ID NO: 3288648 - DNA, 14 bp, Homo sapiens
atgtgaaagtgtaa

SEQ ID NO: 3288649 - DNA, 15 bp, Homo sapiens
atgtgaaagtgtaaa

SEQ ID NO: 3288650 - DNA, 21 bp, Homo sapiens
atgtgaacaaatcaaattgct

SEQ ID NO: 3288651 - DNA, 13 bp, Homo sapiens
atgtgaacccggg

SEQ ID NO: 3288652 - DNA, 17 bp, Homo sapiens
atgtgaacttgtagctg

SEQ ID NO: 3288653 - DNA, 22 bp, Homo sapiens
atgtgaacttgtagctgtaaaa

SEQ ID NO: 3288654 - DNA, 18 bp, Homo sapiens
atgtgaagataatttgca

SEQ ID NO: 3288655 - DNA, 21 bp, Homo sapiens
atgtgaagcatgctttgctgc

SEQ ID NO: 3288656 - DNA, 21 bp, Homo sapiens
atgtgaataaaattattttgg

SEQ ID NO: 3288657 - DNA, 15 bp, Homo sapiens
atgtgacaataatat

SEQ ID NO: 3288658 - DNA, 21 bp, Homo sapiens
atgtgacaattttgtacaaat

SEQ ID NO: 3288659 - DNA, 19 bp, Homo sapiens
atgtgacatttatatattg

SEQ ID NO: 3288660 - DNA, 14 bp, Homo sapiens
atgtgacccaccag

SEQ ID NO: 3288661 - DNA, 15 bp, Homo sapiens
atgtgacttttctga

SEQ ID NO: 3288662 - DNA, 16 bp, Homo sapiens
atgtgacttttctgat

SEQ ID NO: 3288663 - DNA, 17 bp, Homo sapiens
atgtgacttttctgatt

SEQ ID NO: 3288664 - DNA, 16 bp, Homo sapiens
atgtgactttttttgg

SEQ ID NO: 3288665 - DNA, 18 bp, Homo sapiens
atgtgactttttttggta

SEQ ID NO: 3288666 - DNA, 14 bp, Homo sapiens
atgtgagccccagg

SEQ ID NO: 3288667 - DNA, 16 bp, Homo sapiens
atgtgagccccagggg

SEQ ID NO: 3288668 - DNA, 20 bp, Homo sapiens
atgtgagcctcgtgtcatct

SEQ ID NO: 3288669 - DNA, 15 bp, Homo sapiens
atgtgagctcttcct

SEQ ID NO: 3288670 - DNA, 15 bp, Homo sapiens
atgtgaggaggaaaa

SEQ ID NO: 3288671 - DNA, 17 bp, Homo sapiens
atgtgaggaggaaaagg

SEQ ID NO: 3288672 - DNA, 18 bp, Homo sapiens
atgtgaggaggaaaagga

SEQ ID NO: 3288673 - DNA, 22 bp, Homo sapiens
atgtgagtgccttttgcagaag

SEQ ID NO: 3288674 - DNA, 20 bp, Homo sapiens
atgtgataaggatcagaaca

SEQ ID NO: 3288675 - DNA, 13 bp, Homo sapiens
atgtgatatataa

SEQ ID NO: 3288676 - DNA, 16 bp, Homo sapiens
atgtgatatataagtg

SEQ ID NO: 3288677 - DNA, 17 bp, Homo sapiens
atgtgatatataagtgt

SEQ ID NO: 3288678 - DNA, 21 bp, Homo sapiens
atgtgatatataagtgtacat

SEQ ID NO: 3288679 - DNA, 22 bp, Homo sapiens
atgtgatatataagtgtacata

SEQ ID NO: 3288680 - DNA, 16 bp, Homo sapiens
atgtgatcactgagac

SEQ ID NO: 3288681 - DNA, 19 bp, Homo sapiens
atgtgatcatgtgtggaag

SEQ ID NO: 3288682 - DNA, 16 bp, Homo sapiens
atgtgatgatgtaatt

SEQ ID NO: 3288683 - DNA, 21 bp, Homo sapiens
atgtgatgatgtaattgacgg

SEQ ID NO: 3288684 - DNA, 14 bp, Homo sapiens
atgtgatgttctaa

SEQ ID NO: 3288685 - DNA, 20 bp, Homo sapiens
atgtgatgttctaaggctct

SEQ ID NO: 3288686 - DNA, 21 bp, Homo sapiens
atgtgatgttctaaggctctg

SEQ ID NO: 3288687 - DNA, 18 bp, Homo sapiens
atgtgattaatgttttca

SEQ ID NO: 3288688 - DNA, 23 bp, Homo sapiens
atgtgattaatgttttcattatg

SEQ ID NO: 3288689 - DNA, 14 bp, Homo sapiens
atgtgattgtggaa

SEQ ID NO: 3288690 - DNA, 15 bp, Homo sapiens
atgtgattgtggaat

SEQ ID NO: 3288691 - DNA, 14 bp, Homo sapiens
atgtgatttttctg

SEQ ID NO: 3288692 - DNA, 18 bp, Homo sapiens
atgtgcaatagaaggtga

SEQ ID NO: 3288693 - DNA, 13 bp, Homo sapiens
atgtgcaattgtg

SEQ ID NO: 3288694 - DNA, 23 bp, Homo sapiens
atgtgcacatgcacgtgtgtgca

SEQ ID NO: 3288695 - DNA, 18 bp, Homo sapiens
atgtgcactgtcactttg

SEQ ID NO: 3288696 - DNA, 23 bp, Homo sapiens
atgtgcagtgtagcccacacttg

SEQ ID NO: 3288697 - DNA, 23 bp, Homo sapiens
atgtgcatttcacctgtgacaaa

SEQ ID NO: 3288698 - DNA, 22 bp, Homo sapiens
atgtgccaagattctactcttg

SEQ ID NO: 3288699 - DNA, 14 bp, Homo sapiens
atgtgccatctgta

SEQ ID NO: 3288700 - DNA, 21 bp, Homo sapiens
atgtgccgtgttattgtatta

SEQ ID NO: 3288701 - DNA, 19 bp, Homo sapiens
atgtgcctaatggagaaga

SEQ ID NO: 3288702 - DNA, 22 bp, Homo sapiens
atgtgcctgcaccaggagacag

SEQ ID NO: 3288703 - DNA, 21 bp, Homo sapiens
atgtgccttatgttgaaaaaa

SEQ ID NO: 3288704 - DNA, 14 bp, Homo sapiens
atgtgccttttctg

SEQ ID NO: 3288705 - DNA, 19 bp, Homo sapiens
atgtgctcagaagaggaaa

SEQ ID NO: 3288706 - DNA, 15 bp, Homo sapiens
atgtgctgggtgcct

SEQ ID NO: 3288707 - DNA, 15 bp, Homo sapiens
atgtggaaagtgaat

SEQ ID NO: 3288708 - DNA, 15 bp, Homo sapiens
atgtggaagaaaatg

SEQ ID NO: 3288709 - DNA, 18 bp, Homo sapiens
atgtggcaaggaaaaaca

SEQ ID NO: 3288710 - DNA, 17 bp, Homo sapiens
atgtggccacttatttc

SEQ ID NO: 3288711 - DNA, 19 bp, Homo sapiens
atgtggctgaaaatgcaaa

SEQ ID NO: 3288712 - DNA, 13 bp, Homo sapiens
atgtggctggaag

SEQ ID NO: 3288713 - DNA, 21 bp, Homo sapiens
atgtggcttgagaaatatgga

SEQ ID NO: 3288714 - DNA, 10 bp, Homo sapiens
atgtgggagg

SEQ ID NO: 3288715 - DNA, 17 bp, Homo sapiens
atgtgggatattgaatg

SEQ ID NO: 3288716 - DNA, 13 bp, Homo sapiens
atgtggggccagg

SEQ ID NO: 3288717 - DNA, 15 bp, Homo sapiens
atgtgggtgagccag

SEQ ID NO: 3288718 - DNA, 15 bp, Homo sapiens
atgtggtctcaggat

SEQ ID NO: 3288719 - DNA, 13 bp, Homo sapiens
atgtggtgcctga

SEQ ID NO: 3288720 - DNA, 22 bp, Homo sapiens
atgtggtggcacaggccccctt

SEQ ID NO: 3288721 - DNA, 20 bp, Homo sapiens
atgtggttacttcctactgt

SEQ ID NO: 3288722 - DNA, 23 bp, Homo sapiens
atgtggttacttcctactgtagg

SEQ ID NO: 3288723 - DNA, 13 bp, Homo sapiens
atgtggtttatag

SEQ ID NO: 3288724 - DNA, 19 bp, Homo sapiens
atgtggtttggttcctctc

SEQ ID NO: 3288725 - DNA, 18 bp, Homo sapiens
atgtgtacattctgccta

SEQ ID NO: 3288726 - DNA, 14 bp, Homo sapiens
atgtgtagcctatg

SEQ ID NO: 3288727 - DNA, 14 bp, Homo sapiens
atgtgtagcctgtg

SEQ ID NO: 3288728 - DNA, 22 bp, Homo sapiens
atgtgtagttgtctctcttcag

SEQ ID NO: 3288729 - DNA, 23 bp, Homo sapiens
atgtgtagttgtctctcttcaga

SEQ ID NO: 3288730 - DNA, 14 bp, Homo sapiens
atgtgtataaattg

SEQ ID NO: 3288731 - DNA, 16 bp, Homo sapiens
atgtgtatatatacat

SEQ ID NO: 3288732 - DNA, 17 bp, Homo sapiens
atgtgtatatatacata

SEQ ID NO: 3288733 - DNA, 19 bp, Homo sapiens
atgtgtatatatacataca

SEQ ID NO: 3288734 - DNA, 23 bp, Homo sapiens
atgtgtatatatacatacacttg

SEQ ID NO: 3288735 - DNA, 20 bp, Homo sapiens
atgtgtatgtacgtttgtat

SEQ ID NO: 3288736 - DNA, 20 bp, Homo sapiens
atgtgtatttccagtgcaat

SEQ ID NO: 3288737 - DNA, 14 bp, Homo sapiens
atgtgtatttctta

SEQ ID NO: 3288738 - DNA, 15 bp, Homo sapiens
atgtgtcaaaataaa

SEQ ID NO: 3288739 - DNA, 14 bp, Homo sapiens
atgtgtcacttgtg

SEQ ID NO: 3288740 - DNA, 17 bp, Homo sapiens
atgtgtcacttgtgctt

SEQ ID NO: 3288741 - DNA, 20 bp, Homo sapiens
atgtgtcattggaagccatc

SEQ ID NO: 3288742 - DNA, 14 bp, Homo sapiens
atgtgtcccctcac

SEQ ID NO: 3288743 - DNA, 24 bp, Homo sapiens
atgtgtcccctcactctgtcagcc

SEQ ID NO: 3288744 - DNA, 22 bp, Homo sapiens
atgtgtcctatctatcttccaa

SEQ ID NO: 3288745 - DNA, 17 bp, Homo sapiens
atgtgtcctcagggagc

SEQ ID NO: 3288746 - DNA, 21 bp, Homo sapiens
atgtgtctgctaatgtaaact

SEQ ID NO: 3288747 - DNA, 18 bp, Homo sapiens
atgtgtctgtatttcatg

SEQ ID NO: 3288748 - DNA, 22 bp, Homo sapiens
attagccaggatcatggtgtaa

SEQ ID NO: 3288749 - DNA, 12 bp, Homo sapiens
attagctctggg

SEQ ID NO: 3288750 - DNA, 20 bp, Homo sapiens
attagctttattatggcttg

SEQ ID NO: 3288751 - DNA, 21 bp, Homo sapiens
attagctttattatggcttgt

SEQ ID NO: 3288752 - DNA, 21 bp, Homo sapiens
attaggaagtgtaacagctga

SEQ ID NO: 3288753 - DNA, 22 bp, Homo sapiens
attaggaagtgtaacagctgag

SEQ ID NO: 3288754 - DNA, 23 bp, Homo sapiens
attaggacaatcagtcccctccc

SEQ ID NO: 3288755 - DNA, 17 bp, Homo sapiens
attaggaggctcaacaa

SEQ ID NO: 3288756 - DNA, 22 bp, Homo sapiens
attaggaggctcaacaataaaa

SEQ ID NO: 3288757 - DNA, 21 bp, Homo sapiens
attaggatctgcaaacaatga

SEQ ID NO: 3288758 - DNA, 19 bp, Homo sapiens
attaggatttgccccttcc

SEQ ID NO: 3288759 - DNA, 17 bp, Homo sapiens
attaggctgtaactact

SEQ ID NO: 3288760 - DNA, 16 bp, Homo sapiens
attagggagaaaattc

SEQ ID NO: 3288761 - DNA, 17 bp, Homo sapiens
attagggagaaaattca

SEQ ID NO: 3288762 - DNA, 20 bp, Homo sapiens
attagggagaaaattcaatt

SEQ ID NO: 3288763 - DNA, 22 bp, Homo sapiens
attaggggttaaagcagacagt

SEQ ID NO: 3288764 - DNA, 22 bp, Homo sapiens
attaggggttgctaagaagcga

SEQ ID NO: 3288765 - DNA, 22 bp, Homo sapiens
attagggttgcctcactgtagc

SEQ ID NO: 3288766 - DNA, 18 bp, Homo sapiens
attaggttaacattgttg

SEQ ID NO: 3288767 - DNA, 21 bp, Homo sapiens
attagtatggttcaagattgt

SEQ ID NO: 3288768 - DNA, 22 bp, Homo sapiens
attagtatgtctgtttttgtat

SEQ ID NO: 3288769 - DNA, 18 bp, Homo sapiens
attagtatttatttaatg

SEQ ID NO: 3288770 - DNA, 23 bp, Homo sapiens
attagtccaaatgtgatcaactg

SEQ ID NO: 3288771 - DNA, 13 bp, Homo sapiens
attagtgaagatg

SEQ ID NO: 3288772 - DNA, 19 bp, Homo sapiens
attagtgattctgatttca

SEQ ID NO: 3288773 - DNA, 20 bp, Homo sapiens
attagtgccacttaatgtat

SEQ ID NO: 3288774 - DNA, 16 bp, Homo sapiens
attagtgccagaattt

SEQ ID NO: 3288775 - DNA, 19 bp, Homo sapiens
attagtgccagaattttag

SEQ ID NO: 3288776 - DNA, 21 bp, Homo sapiens
attagtgccagaattttagga

SEQ ID NO: 3288777 - DNA, 18 bp, Homo sapiens
attagttacaaagttata

SEQ ID NO: 3288778 - DNA, 21 bp, Homo sapiens
attagttccctgtctcttgaa

SEQ ID NO: 3288779 - DNA, 21 bp, Homo sapiens
attagttgaatataagaaaat

SEQ ID NO: 3288780 - DNA, 18 bp, Homo sapiens
attagtttcctttttaat

SEQ ID NO: 3288781 - DNA, 20 bp, Homo sapiens
attataaaaaatgtaacatc

SEQ ID NO: 3288782 - DNA, 23 bp, Homo sapiens
attataaaaagccactagactct

SEQ ID NO: 3288783 - DNA, 13 bp, Homo sapiens
attataaaaatat

SEQ ID NO: 3288784 - DNA, 12 bp, Homo sapiens
attataaacttt

SEQ ID NO: 3288785 - DNA, 13 bp, Homo sapiens
attataaactttt

SEQ ID NO: 3288786 - DNA, 14 bp, Homo sapiens
attataaactttta

SEQ ID NO: 3288787 - DNA, 16 bp, Homo sapiens
attataaattctacta

SEQ ID NO: 3288788 - DNA, 20 bp, Homo sapiens
attataaattctactaagtt

SEQ ID NO: 3288789 - DNA, 16 bp, Homo sapiens
attataacagttatat

SEQ ID NO: 3288790 - DNA, 22 bp, Homo sapiens
attataacttaaaaaaatgaca

SEQ ID NO: 3288791 - DNA, 20 bp, Homo sapiens
attataacttaaaatatttt

SEQ ID NO: 3288792 - DNA, 15 bp, Homo sapiens
attataagggagagc

SEQ ID NO: 3288793 - DNA, 18 bp, Homo sapiens
attataatcaaagctcat

SEQ ID NO: 3288794 - DNA, 19 bp, Homo sapiens
attataatctcaaaggaga

SEQ ID NO: 3288795 - DNA, 13 bp, Homo sapiens
attataatgaatt

SEQ ID NO: 3288796 - DNA, 22 bp, Homo sapiens
attataatttttttcaatattt

SEQ ID NO: 3288797 - DNA, 16 bp, Homo sapiens
attatacaaaagagca

SEQ ID NO: 3288798 - DNA, 15 bp, Homo sapiens
attatacatgtgata

SEQ ID NO: 3288799 - DNA, 21 bp, Homo sapiens
attatacatgtgatacatttt

SEQ ID NO: 3288800 - DNA, 15 bp, Homo sapiens
attatactaagaaaa

SEQ ID NO: 3288801 - DNA, 19 bp, Homo sapiens
attatactaagaaaagata

SEQ ID NO: 3288802 - DNA, 23 bp, Homo sapiens
attatactgtagctgatgaaact

SEQ ID NO: 3288803 - DNA, 16 bp, Homo sapiens
attatactttatatct

SEQ ID NO: 3288804 - DNA, 13 bp, Homo sapiens
attatagattcta

SEQ ID NO: 3288805 - DNA, 14 bp, Homo sapiens
attatagattctaa

SEQ ID NO: 3288806 - DNA, 17 bp, Homo sapiens
attatagattctaaaga

SEQ ID NO: 3288807 - DNA, 18 bp, Homo sapiens
attatagattctaaagat

SEQ ID NO: 3288808 - DNA, 17 bp, Homo sapiens
attataggagccttaat

SEQ ID NO: 3288809 - DNA, 21 bp, Homo sapiens
attataggtaatcaatgaata

SEQ ID NO: 3288810 - DNA, 19 bp, Homo sapiens
attatagtttctgaggctt

SEQ ID NO: 3288811 - DNA, 20 bp, Homo sapiens
attatatacatactgcatct

SEQ ID NO: 3288812 - DNA, 23 bp, Homo sapiens
attatatcattggaacaactgat

SEQ ID NO: 3288813 - DNA, 16 bp, Homo sapiens
attatatctaattatt

SEQ ID NO: 3288814 - DNA, 22 bp, Homo sapiens
attatatgtggactaaatatct

SEQ ID NO: 3288815 - DNA, 18 bp, Homo sapiens
attatattctaattaaaa

SEQ ID NO: 3288816 - DNA, 22 bp, Homo sapiens
attatattctaattaaaattgt

SEQ ID NO: 3288817 - DNA, 14 bp, Homo sapiens
attatattctctta

SEQ ID NO: 3288818 - DNA, 22 bp, Homo sapiens
attatattggtgcgtttttaca

SEQ ID NO: 3288819 - DNA, 19 bp, Homo sapiens
attatcaatatctaatata

SEQ ID NO: 3288820 - DNA, 16 bp, Homo sapiens
attatcagcaaagaaa

SEQ ID NO: 3288821 - DNA, 15 bp, Homo sapiens
attatcagttatatt

SEQ ID NO: 3288822 - DNA, 22 bp, Homo sapiens
attatcagttatattttgctgt

SEQ ID NO: 3288823 - DNA, 14 bp, Homo sapiens
attatccatattga

SEQ ID NO: 3288824 - DNA, 21 bp, Homo sapiens
attatcctagattatatcaaa

SEQ ID NO: 3288825 - DNA, 20 bp, Homo sapiens
attatcgggaacagtgtttc

SEQ ID NO: 3288826 - DNA, 16 bp, Homo sapiens
attatcgggagcagtg

SEQ ID NO: 3288827 - DNA, 17 bp, Homo sapiens
attatctaaagtgtgtt

SEQ ID NO: 3288828 - DNA, 14 bp, Homo sapiens
attatctaatttat

SEQ ID NO: 3288829 - DNA, 16 bp, Homo sapiens
attatgacagttatac

SEQ ID NO: 3288830 - DNA, 19 bp, Homo sapiens
attatgacagttatactgt

SEQ ID NO: 3288831 - DNA, 16 bp, Homo sapiens
attatgagtttgctta

SEQ ID NO: 3288832 - DNA, 15 bp, Homo sapiens
attatgcattcttat

SEQ ID NO: 3288833 - DNA, 23 bp, Homo sapiens
attatgcattcttataacataac

SEQ ID NO: 3288834 - DNA, 20 bp, Homo sapiens
attatgcttccacaggcaaa

SEQ ID NO: 3288835 - DNA, 16 bp, Homo sapiens
attatggaagatttta

SEQ ID NO: 3288836 - DNA, 20 bp, Homo sapiens
attatggaagattttaaatt

SEQ ID NO: 3288837 - DNA, 18 bp, Homo sapiens
attatggcttgtgaactg

SEQ ID NO: 3288838 - DNA, 18 bp, Homo sapiens
attatgtaatatattgta

SEQ ID NO: 3288839 - DNA, 19 bp, Homo sapiens
attatgtccactgtgtata

SEQ ID NO: 3288840 - DNA, 12 bp, Homo sapiens
attatgtcttct

SEQ ID NO: 3288841 - DNA, 18 bp, Homo sapiens
attatgtgaagaatttag

SEQ ID NO: 3288842 - DNA, 23 bp, Homo sapiens
attatgtgaagaatttagatctt

SEQ ID NO: 3288843 - DNA, 20 bp, Homo sapiens
attatgtgaccataatgtac

SEQ ID NO: 3288844 - DNA, 11 bp, Homo sapiens
attatgtgtgc

SEQ ID NO: 3288845 - DNA, 20 bp, Homo sapiens
attatgttatacaaggcaag

SEQ ID NO: 3288846 - DNA, 12 bp, Homo sapiens
attatgtttatt

SEQ ID NO: 3288847 - DNA, 16 bp, Homo sapiens
attatgttttttaaaa

SEQ ID NO: 3288848 - DNA, 18 bp, Homo sapiens
attattaaattgtgtaca

SEQ ID NO: 3288849 - DNA, 18 bp, Homo sapiens
attattaactacatttat

SEQ ID NO: 3288850 - DNA, 19 bp, Homo sapiens
attattaactacatttatg

SEQ ID NO: 3288851 - DNA, 14 bp, Homo sapiens
attattaatcagaa

SEQ ID NO: 3288852 - DNA, 12 bp, Homo sapiens
attattaatttt

SEQ ID NO: 3288853 - DNA, 20 bp, Homo sapiens
attattacttatttttgaca

SEQ ID NO: 3288854 - DNA, 12 bp, Homo sapiens
attattagaaat

SEQ ID NO: 3288855 - DNA, 13 bp, Homo sapiens
attattataaaaa

SEQ ID NO: 3288856 - DNA, 14 bp, Homo sapiens
attattattatttg

SEQ ID NO: 3288857 - DNA, 14 bp, Homo sapiens
attattatttgctt

SEQ ID NO: 3288858 - DNA, 13 bp, Homo sapiens
attattcatttaa

SEQ ID NO: 3288859 - DNA, 15 bp, Homo sapiens
attattcatttagtg

SEQ ID NO: 3288860 - DNA, 13 bp, Homo sapiens
attattctgcagc

SEQ ID NO: 3288861 - DNA, 15 bp, Homo sapiens
attattctgttttgc

SEQ ID NO: 3288862 - DNA, 12 bp, Homo sapiens
attattcttcag

SEQ ID NO: 3288863 - DNA, 15 bp, Homo sapiens
attattctttgaaaa

SEQ ID NO: 3288864 - DNA, 20 bp, Homo sapiens
attattgagttccagttgaa

SEQ ID NO: 3288865 - DNA, 17 bp, Homo sapiens
attattgatagtactct

SEQ ID NO: 3288866 - DNA, 13 bp, Homo sapiens
attattgatatat

SEQ ID NO: 3288867 - DNA, 18 bp, Homo sapiens
attattggaattaacctg

SEQ ID NO: 3288868 - DNA, 12 bp, Homo sapiens
attattgtaagt

SEQ ID NO: 3288869 - DNA, 15 bp, Homo sapiens
attattgtaagttgt

SEQ ID NO: 3288870 - DNA, 21 bp, Homo sapiens
attattgtaagttgtacaaat

SEQ ID NO: 3288871 - DNA, 22 bp, Homo sapiens
attattgtaagttgtacaaatg

SEQ ID NO: 3288872 - DNA, 13 bp, Homo sapiens
attattgtattta

SEQ ID NO: 3288873 - DNA, 19 bp, Homo sapiens
attggcagtgactttgtat

SEQ ID NO: 3288874 - DNA, 21 bp, Homo sapiens
attggccacctgtagccatct

SEQ ID NO: 3288875 - DNA, 23 bp, Homo sapiens
attggccacctgtagccatctgc

SEQ ID NO: 3288876 - DNA, 20 bp, Homo sapiens
attggcctgtagagttgctg

SEQ ID NO: 3288877 - DNA, 23 bp, Homo sapiens
attggcctgtagagttgctgaga

SEQ ID NO: 3288878 - DNA, 14 bp, Homo sapiens
attggcttgtagaa

SEQ ID NO: 3288879 - DNA, 15 bp, Homo sapiens
attggcttgtagaat

SEQ ID NO: 3288880 - DNA, 18 bp, Homo sapiens
attggcttgtagaattgt

SEQ ID NO: 3288881 - DNA, 19 bp, Homo sapiens
attggcttgtagaattgtt

SEQ ID NO: 3288882 - DNA, 17 bp, Homo sapiens
attggcttgtgtgtttc

SEQ ID NO: 3288883 - DNA, 16 bp, Homo sapiens
attggcttttcatgcg

SEQ ID NO: 3288884 - DNA, 14 bp, Homo sapiens
attgggagaaatca

SEQ ID NO: 3288885 - DNA, 18 bp, Homo sapiens
attgggatatcattttaa

SEQ ID NO: 3288886 - DNA, 12 bp, Homo sapiens
attggggaggag

SEQ ID NO: 3288887 - DNA, 14 bp, Homo sapiens
attggggaggaggg

SEQ ID NO: 3288888 - DNA, 22 bp, Homo sapiens
attgggtatcaagacatagcat

SEQ ID NO: 3288889 - DNA, 18 bp, Homo sapiens
attgggtttttattgttg

SEQ ID NO: 3288890 - DNA, 19 bp, Homo sapiens
attggtgataagtggaaaa

SEQ ID NO: 3288891 - DNA, 18 bp, Homo sapiens
attggtgttgtcattgta

SEQ ID NO: 3288892 - DNA, 17 bp, Homo sapiens
attggttgttgtattga

SEQ ID NO: 3288893 - DNA, 16 bp, Homo sapiens
attgtaaaaataatca

SEQ ID NO: 3288894 - DNA, 15 bp, Homo sapiens
attgtaaaaatggca

SEQ ID NO: 3288895 - DNA, 14 bp, Homo sapiens
attgtaaaacaggt

SEQ ID NO: 3288896 - DNA, 17 bp, Homo sapiens
attgtaaacaaactctt

SEQ ID NO: 3288897 - DNA, 12 bp, Homo sapiens
attgtaaactgt

SEQ ID NO: 3288898 - DNA, 15 bp, Homo sapiens
attgtaaactgtact

SEQ ID NO: 3288899 - DNA, 14 bp, Homo sapiens
attgtaaatagtat

SEQ ID NO: 3288900 - DNA, 12 bp, Homo sapiens
attgtaacctgc

SEQ ID NO: 3288901 - DNA, 19 bp, Homo sapiens
attgtaactattaaccttt

SEQ ID NO: 3288902 - DNA, 20 bp, Homo sapiens
attgtaactattaacctttt

SEQ ID NO: 3288903 - DNA, 15 bp, Homo sapiens
attgtaagttgtaca

SEQ ID NO: 3288904 - DNA, 16 bp, Homo sapiens
attgtaagttgtacaa

SEQ ID NO: 3288905 - DNA, 17 bp, Homo sapiens
attgtaagttgtacaaa

SEQ ID NO: 3288906 - DNA, 20 bp, Homo sapiens
attgtaagttgtacaaatgt

SEQ ID NO: 3288907 - DNA, 22 bp, Homo sapiens
attgtaagttgtacaaatgtat

SEQ ID NO: 3288908 - DNA, 15 bp, Homo sapiens
attgtaatacagaca

SEQ ID NO: 3288909 - DNA, 16 bp, Homo sapiens
attgtaatctgaataa

SEQ ID NO: 3288910 - DNA, 15 bp, Homo sapiens
attgtaatctttcat

SEQ ID NO: 3288911 - DNA, 18 bp, Homo sapiens
attgtacaaaattaagca

SEQ ID NO: 3288912 - DNA, 21 bp, Homo sapiens
attgtacaaaattaagcaaat

SEQ ID NO: 3288913 - DNA, 22 bp, Homo sapiens
attgtacaagagtccctttgaa

SEQ ID NO: 3288914 - DNA, 14 bp, Homo sapiens
attgtacagactgt

SEQ ID NO: 3288915 - DNA, 14 bp, Homo sapiens
attgtacagctgtt

SEQ ID NO: 3288916 - DNA, 16 bp, Homo sapiens
attgtacagctgttta

SEQ ID NO: 3288917 - DNA, 17 bp, Homo sapiens
attgtacagctgtttaa

SEQ ID NO: 3288918 - DNA, 20 bp, Homo sapiens
attgtacagctgtttaagat

SEQ ID NO: 3288919 - DNA, 15 bp, Homo sapiens
attgtacataaaatt

SEQ ID NO: 3288920 - DNA, 20 bp, Homo sapiens
attgtacatatttgtggaat

SEQ ID NO: 3288921 - DNA, 23 bp, Homo sapiens
attgtacttagccagttcaaagt

SEQ ID NO: 3288922 - DNA, 19 bp, Homo sapiens
attgtagaattgtatatag

SEQ ID NO: 3288923 - DNA, 17 bp, Homo sapiens
attgtagactgatgttt

SEQ ID NO: 3288924 - DNA, 19 bp, Homo sapiens
attgtagactgatgtttta

SEQ ID NO: 3288925 - DNA, 19 bp, Homo sapiens
attgtagggttattagtcc

SEQ ID NO: 3288926 - DNA, 16 bp, Homo sapiens
attgtagttctgtgta

SEQ ID NO: 3288927 - DNA, 19 bp, Homo sapiens
attgtagttctgtgtactt

SEQ ID NO: 3288928 - DNA, 21 bp, Homo sapiens
attgtataaaaagtttcacag

SEQ ID NO: 3288929 - DNA, 18 bp, Homo sapiens
attgtatagatataatga

SEQ ID NO: 3288930 - DNA, 17 bp, Homo sapiens
attgtatattgtgtttg

SEQ ID NO: 3288931 - DNA, 18 bp, Homo sapiens
attgtatatttttatcta

SEQ ID NO: 3288932 - DNA, 19 bp, Homo sapiens
attgtatatttttatctat

SEQ ID NO: 3288933 - DNA, 14 bp, Homo sapiens
attgtatcagaggc

SEQ ID NO: 3288934 - DNA, 20 bp, Homo sapiens
attgtatcagaggcctataa

SEQ ID NO: 3288935 - DNA, 15 bp, Homo sapiens
attgtatctagtgca

SEQ ID NO: 3288936 - DNA, 12 bp, Homo sapiens
attgtatgaaaa

SEQ ID NO: 3288937 - DNA, 13 bp, Homo sapiens
attgtatgaaaat

SEQ ID NO: 3288938 - DNA, 17 bp, Homo sapiens
attgtatgaaaatcctt

SEQ ID NO: 3288939 - DNA, 12 bp, Homo sapiens
attgtatgatgt

SEQ ID NO: 3288940 - DNA, 13 bp, Homo sapiens
attgtatgatgtg

SEQ ID NO: 3288941 - DNA, 15 bp, Homo sapiens
attgtattatttgga

SEQ ID NO: 3288942 - DNA, 14 bp, Homo sapiens
attgtatttattcc

SEQ ID NO: 3288943 - DNA, 18 bp, Homo sapiens
attgtcaaaattaatatg

SEQ ID NO: 3288944 - DNA, 16 bp, Homo sapiens
attgtcacctctgtta

SEQ ID NO: 3288945 - DNA, 16 bp, Homo sapiens
attgtcagacacttat

SEQ ID NO: 3288946 - DNA, 20 bp, Homo sapiens
attgtcatggggatcaattt

SEQ ID NO: 3288947 - DNA, 15 bp, Homo sapiens
attgtcatgtttatt

SEQ ID NO: 3288948 - DNA, 15 bp, Homo sapiens
attgtcgctattgat

SEQ ID NO: 3288949 - DNA, 22 bp, Homo sapiens
attgtcgtataggcatgtaaac

SEQ ID NO: 3288950 - DNA, 17 bp, Homo sapiens
attgtctaaaatgtcag

SEQ ID NO: 3288951 - DNA, 18 bp, Homo sapiens
attgtctcctatatattt

SEQ ID NO: 3288952 - DNA, 20 bp, Homo sapiens
attgtctcctatatatttct

SEQ ID NO: 3288953 - DNA, 23 bp, Homo sapiens
attgtctcctatatatttctatt

SEQ ID NO: 3288954 - DNA, 18 bp, Homo sapiens
attgtctgaacttgcatt

SEQ ID NO: 3288955 - DNA, 15 bp, Homo sapiens
attgtcttgttctgt

SEQ ID NO: 3288956 - DNA, 14 bp, Homo sapiens
attgtctttatatg

SEQ ID NO: 3288957 - DNA, 17 bp, Homo sapiens
attgtctttatatgaac

SEQ ID NO: 3288958 - DNA, 22 bp, Homo sapiens
attgtctttatgagctaaaaat

SEQ ID NO: 3288959 - DNA, 21 bp, Homo sapiens
attgtcttttagacaactaga

SEQ ID NO: 3288960 - DNA, 15 bp, Homo sapiens
attgtgaactcattg

SEQ ID NO: 3288961 - DNA, 14 bp, Homo sapiens
attgtgaagtacat

SEQ ID NO: 3288962 - DNA, 23 bp, Homo sapiens
attgtgaagtgatgttcagattt

SEQ ID NO: 3288963 - DNA, 15 bp, Homo sapiens
attgtgaccaagtta

SEQ ID NO: 3288964 - DNA, 16 bp, Homo sapiens
attgtgagggacatgc

SEQ ID NO: 3288965 - DNA, 18 bp, Homo sapiens
attgtgattctgcctttg

SEQ ID NO: 3288966 - DNA, 16 bp, Homo sapiens
attgtgattggcctgt

SEQ ID NO: 3288967 - DNA, 19 bp, Homo sapiens
attgtgcttctccccagaa

SEQ ID NO: 3288968 - DNA, 22 bp, Homo sapiens
attgtggatgtgttcattcaag

SEQ ID NO: 3288969 - DNA, 23 bp, Homo sapiens
attgtggattataaaaaatgtaa

SEQ ID NO: 3288970 - DNA, 19 bp, Homo sapiens
attgtggctcctatctgtg

SEQ ID NO: 3288971 - DNA, 21 bp, Homo sapiens
attgtgggacttattacaatt

SEQ ID NO: 3288972 - DNA, 19 bp, Homo sapiens
attgtgggcataaactgtt

SEQ ID NO: 3288973 - DNA, 20 bp, Homo sapiens
attgtgtaaaaaatggaaaa

SEQ ID NO: 3288974 - DNA, 16 bp, Homo sapiens
attgtgtagccttttt

SEQ ID NO: 3288975 - DNA, 18 bp, Homo sapiens
attgtgtagcctttttgt

SEQ ID NO: 3288976 - DNA, 16 bp, Homo sapiens
attgtgtatcagtttc

SEQ ID NO: 3288977 - DNA, 18 bp, Homo sapiens
attgtgtatcagtttcca

SEQ ID NO: 3288978 - DNA, 20 bp, Homo sapiens
attgtgtcagaaacatgaaa

SEQ ID NO: 3288979 - DNA, 19 bp, Homo sapiens
attgtgtgaaaaaagaaaa

SEQ ID NO: 3288980 - DNA, 20 bp, Homo sapiens
attgtgttcccatttcagct

SEQ ID NO: 3288981 - DNA, 14 bp, Homo sapiens
attgtgttcctttt

SEQ ID NO: 3288982 - DNA, 12 bp, Homo sapiens
attgtgtttcta

SEQ ID NO: 3288983 - DNA, 22 bp, Homo sapiens
attgtgtttctaccggagagag

SEQ ID NO: 3288984 - DNA, 21 bp, Homo sapiens
attgttaagtctaaatatttc

SEQ ID NO: 3288985 - DNA, 15 bp, Homo sapiens
attgttaatgtgatg

SEQ ID NO: 3288986 - DNA, 17 bp, Homo sapiens
attgttaatttttccta

SEQ ID NO: 3288987 - DNA, 17 bp, Homo sapiens
attgttacacattaagt

SEQ ID NO: 3288988 - DNA, 16 bp, Homo sapiens
attgttagaaaatgac

SEQ ID NO: 3288989 - DNA, 20 bp, Homo sapiens
attgttagaaaatgacttat

SEQ ID NO: 3288990 - DNA, 19 bp, Homo sapiens
attgttagggtcagccatt

SEQ ID NO: 3288991 - DNA, 12 bp, Homo sapiens
attgttagttta

SEQ ID NO: 3288992 - DNA, 14 bp, Homo sapiens
attgttccaagaca

SEQ ID NO: 3288993 - DNA, 17 bp, Homo sapiens
attgttccaagacattg

SEQ ID NO: 3288994 - DNA, 16 bp, Homo sapiens
attgttcccagtgaca

SEQ ID NO: 3288995 - DNA, 19 bp, Homo sapiens
attgttcccagtgacactt

SEQ ID NO: 3288996 - DNA, 19 bp, Homo sapiens
attgttccctatgaaagat

SEQ ID NO: 3288997 - DNA, 18 bp, Homo sapiens
attgttgacaactgtgac

SEQ ID NO: 3288998 - DNA, 21 bp, Homo sapiens
attgttgacagttctgaagaa

SEQ ID NO: 3288999 - DNA, 20 bp, Homo sapiens
atttctgggtcttttgctac

SEQ ID NO: 3289000 - DNA, 16 bp, Homo sapiens
atttctgtaaatacca

SEQ ID NO: 3289001 - DNA, 23 bp, Homo sapiens
atttctgtaaataccattgacac

SEQ ID NO: 3289002 - DNA, 21 bp, Homo sapiens
atttctgtaggagcaacttct

SEQ ID NO: 3289003 - DNA, 23 bp, Homo sapiens
atttctgtcacagtaaaaataaa

SEQ ID NO: 3289004 - DNA, 15 bp, Homo sapiens
atttctgtgttgcca

SEQ ID NO: 3289005 - DNA, 23 bp, Homo sapiens
atttctgtgttgccaagctccaa

SEQ ID NO: 3289006 - DNA, 23 bp, Homo sapiens
atttcttaaataatgcttcagat

SEQ ID NO: 3289007 - DNA, 14 bp, Homo sapiens
atttcttaaatctt

SEQ ID NO: 3289008 - DNA, 23 bp, Homo sapiens
atttcttaattattataaaaata

SEQ ID NO: 3289009 - DNA, 20 bp, Homo sapiens
atttcttactaaacattttg

SEQ ID NO: 3289010 - DNA, 18 bp, Homo sapiens
atttcttagagattaaac

SEQ ID NO: 3289011 - DNA, 16 bp, Homo sapiens
atttcttcaaaatgta

SEQ ID NO: 3289012 - DNA, 14 bp, Homo sapiens
atttcttcagaatt

SEQ ID NO: 3289013 - DNA, 12 bp, Homo sapiens
atttcttccttc

SEQ ID NO: 3289014 - DNA, 16 bp, Homo sapiens
atttcttcgctgctct

SEQ ID NO: 3289015 - DNA, 17 bp, Homo sapiens
atttcttcgctgctcta

SEQ ID NO: 3289016 - DNA, 11 bp, Homo sapiens
atttcttgctt

SEQ ID NO: 3289017 - DNA, 16 bp, Homo sapiens
atttcttggtattatt

SEQ ID NO: 3289018 - DNA, 13 bp, Homo sapiens
atttcttgtttgt

SEQ ID NO: 3289019 - DNA, 14 bp, Homo sapiens
atttcttgtttgtt

SEQ ID NO: 3289020 - DNA, 14 bp, Homo sapiens
atttctttctcgaa

SEQ ID NO: 3289021 - DNA, 22 bp, Homo sapiens
atttctttcttgctggctctga

SEQ ID NO: 3289022 - DNA, 23 bp, Homo sapiens
atttctttctttgcaccaaagac

SEQ ID NO: 3289023 - DNA, 14 bp, Homo sapiens
atttctttttaatt

SEQ ID NO: 3289024 - DNA, 20 bp, Homo sapiens
atttgaaaaatataaaatta

SEQ ID NO: 3289025 - DNA, 17 bp, Homo sapiens
atttgaaaataattgtt

SEQ ID NO: 3289026 - DNA, 16 bp, Homo sapiens
atttgaaatactaaaa

SEQ ID NO: 3289027 - DNA, 17 bp, Homo sapiens
atttgaaatactaaaag

SEQ ID NO: 3289028 - DNA, 22 bp, Homo sapiens
atttgaatatcattaaattgga

SEQ ID NO: 3289029 - DNA, 19 bp, Homo sapiens
atttgaatgaaaaatttaa

SEQ ID NO: 3289030 - DNA, 15 bp, Homo sapiens
atttgaatgaaaaca

SEQ ID NO: 3289031 - DNA, 16 bp, Homo sapiens
atttgacttgaatatg

SEQ ID NO: 3289032 - DNA, 18 bp, Homo sapiens
atttgacttgcatgaaga

SEQ ID NO: 3289033 - DNA, 19 bp, Homo sapiens
atttgacttgcatgaagag

SEQ ID NO: 3289034 - DNA, 23 bp, Homo sapiens
atttgagaatagacccttactag

SEQ ID NO: 3289035 - DNA, 14 bp, Homo sapiens
atttgagactattt

SEQ ID NO: 3289036 - DNA, 15 bp, Homo sapiens
atttgagcagggctc

SEQ ID NO: 3289037 - DNA, 17 bp, Homo sapiens
atttgaggggaaaacac

SEQ ID NO: 3289038 - DNA, 14 bp, Homo sapiens
atttgatacttata

SEQ ID NO: 3289039 - DNA, 15 bp, Homo sapiens
atttgatacttatat

SEQ ID NO: 3289040 - DNA, 16 bp, Homo sapiens
atttgatatttgcatt

SEQ ID NO: 3289041 - DNA, 17 bp, Homo sapiens
atttgatatttttccat

SEQ ID NO: 3289042 - DNA, 17 bp, Homo sapiens
atttgatcgttccagtt

SEQ ID NO: 3289043 - DNA, 16 bp, Homo sapiens
atttgatgaaagctga

SEQ ID NO: 3289044 - DNA, 17 bp, Homo sapiens
atttgatgagttaactg

SEQ ID NO: 3289045 - DNA, 23 bp, Homo sapiens
atttgatgctgtttgacaaagtt

SEQ ID NO: 3289046 - DNA, 13 bp, Homo sapiens
atttgattgattt

SEQ ID NO: 3289047 - DNA, 16 bp, Homo sapiens
atttgattgatttgaa

SEQ ID NO: 3289048 - DNA, 12 bp, Homo sapiens
atttgcaacatt

SEQ ID NO: 3289049 - DNA, 21 bp, Homo sapiens
atttgcaatatggatttctta

SEQ ID NO: 3289050 - DNA, 14 bp, Homo sapiens
atttgcacctctgt

SEQ ID NO: 3289051 - DNA, 21 bp, Homo sapiens
atttgcactggagttctatgc

SEQ ID NO: 3289052 - DNA, 12 bp, Homo sapiens
atttgcacttat

SEQ ID NO: 3289053 - DNA, 15 bp, Homo sapiens
atttgcacttatgta

SEQ ID NO: 3289054 - DNA, 21 bp, Homo sapiens
atttgcacttatgtacttgat

SEQ ID NO: 3289055 - DNA, 18 bp, Homo sapiens
atttgcatattctattgt

SEQ ID NO: 3289056 - DNA, 17 bp, Homo sapiens
atttgcatatttattgc

SEQ ID NO: 3289057 - DNA, 13 bp, Homo sapiens
atttgcatggatt

SEQ ID NO: 3289058 - DNA, 18 bp, Homo sapiens
atttgcatggattttgga

SEQ ID NO: 3289059 - DNA, 18 bp, Homo sapiens
atttgcattaaattcaca

SEQ ID NO: 3289060 - DNA, 23 bp, Homo sapiens
atttgcattaaattcacaaactt

SEQ ID NO: 3289061 - DNA, 15 bp, Homo sapiens
atttgcccatttaca

SEQ ID NO: 3289062 - DNA, 22 bp, Homo sapiens
atttgcctattcccacacctcc

SEQ ID NO: 3289063 - DNA, 15 bp, Homo sapiens
atttgcctgtgccac

SEQ ID NO: 3289064 - DNA, 20 bp, Homo sapiens
atttgcctttctgggagcag

SEQ ID NO: 3289065 - DNA, 23 bp, Homo sapiens
atttgctaatcaaagccagggtc

SEQ ID NO: 3289066 - DNA, 11 bp, Homo sapiens
atttgctcttt

SEQ ID NO: 3289067 - DNA, 23 bp, Homo sapiens
atttgctgggctttttttttctc

SEQ ID NO: 3289068 - DNA, 13 bp, Homo sapiens
atttgctggggaa

SEQ ID NO: 3289069 - DNA, 20 bp, Homo sapiens
atttgctttcttttctccca

SEQ ID NO: 3289070 - DNA, 17 bp, Homo sapiens
atttggaaataaagtca

SEQ ID NO: 3289071 - DNA, 21 bp, Homo sapiens
atttggaaatcctagtttcct

SEQ ID NO: 3289072 - DNA, 17 bp, Homo sapiens
atttggaaccttgtttt

SEQ ID NO: 3289073 - DNA, 14 bp, Homo sapiens
atttggaatatttg

SEQ ID NO: 3289074 - DNA, 17 bp, Homo sapiens
atttggaatatttgaat

SEQ ID NO: 3289075 - DNA, 20 bp, Homo sapiens
atttggagacacaactattt

SEQ ID NO: 3289076 - DNA, 23 bp, Homo sapiens
atttggagggaagctcttggagc

SEQ ID NO: 3289077 - DNA, 16 bp, Homo sapiens
atttggagttaggtcc

SEQ ID NO: 3289078 - DNA, 17 bp, Homo sapiens
atttggattagaaattt

SEQ ID NO: 3289079 - DNA, 18 bp, Homo sapiens
atttggatttaaaagcct

SEQ ID NO: 3289080 - DNA, 16 bp, Homo sapiens
atttggcagtttggta

SEQ ID NO: 3289081 - DNA, 18 bp, Homo sapiens
atttggctcacttgcctt

SEQ ID NO: 3289082 - DNA, 17 bp, Homo sapiens
atttgggaggaggaaaa

SEQ ID NO: 3289083 - DNA, 23 bp, Homo sapiens
atttgggggaggctttgggagca

SEQ ID NO: 3289084 - DNA, 19 bp, Homo sapiens
atttggtaaaaatgctgct

SEQ ID NO: 3289085 - DNA, 21 bp, Homo sapiens
atttggtaaaaatgctgctct

SEQ ID NO: 3289086 - DNA, 21 bp, Homo sapiens
atttggtaaattagtatttat

SEQ ID NO: 3289087 - DNA, 17 bp, Homo sapiens
atttggtccaaaaaaag

SEQ ID NO: 3289088 - DNA, 22 bp, Homo sapiens
atttggtccaaaaaaaggaaaa

SEQ ID NO: 3289089 - DNA, 18 bp, Homo sapiens
atttggtgttcctggaag

SEQ ID NO: 3289090 - DNA, 18 bp, Homo sapiens
atttggtttgttaattct

SEQ ID NO: 3289091 - DNA, 23 bp, Homo sapiens
atttgtaaaagaacagtaaacat

SEQ ID NO: 3289092 - DNA, 18 bp, Homo sapiens
atttgtaaacttctgaag

SEQ ID NO: 3289093 - DNA, 13 bp, Homo sapiens
atttgtaaatgct

SEQ ID NO: 3289094 - DNA, 13 bp, Homo sapiens
atttgtaagatat

SEQ ID NO: 3289095 - DNA, 13 bp, Homo sapiens
atttgtacaaaaa

SEQ ID NO: 3289096 - DNA, 22 bp, Homo sapiens
atttgtacaggactgtaaagat

SEQ ID NO: 3289097 - DNA, 23 bp, Homo sapiens
atttgtacaggactgtaaagatt

SEQ ID NO: 3289098 - DNA, 23 bp, Homo sapiens
atttgtactgaaaaatggtaatt

SEQ ID NO: 3289099 - DNA, 14 bp, Homo sapiens
atttgtacttctta

SEQ ID NO: 3289100 - DNA, 16 bp, Homo sapiens
atttgtacttcttatt

SEQ ID NO: 3289101 - DNA, 9 bp, Homo sapiens
atttgtagc

SEQ ID NO: 3289102 - DNA, 15 bp, Homo sapiens
atttgtagcactgag

SEQ ID NO: 3289103 - DNA, 17 bp, Homo sapiens
atttgtagcataactgt

SEQ ID NO: 3289104 - DNA, 19 bp, Homo sapiens
atttgtagcataactgtag

SEQ ID NO: 3289105 - DNA, 22 bp, Homo sapiens
atttgtaggaaggtctcattct

SEQ ID NO: 3289106 - DNA, 21 bp, Homo sapiens
atttgtatctctgaagcatgt

SEQ ID NO: 3289107 - DNA, 21 bp, Homo sapiens
atttgtatgtattttcagtta

SEQ ID NO: 3289108 - DNA, 13 bp, Homo sapiens
atttgtattaata

SEQ ID NO: 3289109 - DNA, 16 bp, Homo sapiens
atttgtattaataaag

SEQ ID NO: 3289110 - DNA, 14 bp, Homo sapiens
atttgtattgtaca

SEQ ID NO: 3289111 - DNA, 18 bp, Homo sapiens
atttgtattttgtgtgac

SEQ ID NO: 3289112 - DNA, 19 bp, Homo sapiens
atttgtcagtatttttgcc

SEQ ID NO: 3289113 - DNA, 20 bp, Homo sapiens
atttgtcagtatttttgccg

SEQ ID NO: 3289114 - DNA, 13 bp, Homo sapiens
atttgtcccagcc

SEQ ID NO: 3289115 - DNA, 14 bp, Homo sapiens
atttgtctttttgt

SEQ ID NO: 3289116 - DNA, 21 bp, Homo sapiens
atttgtctttttgttgtaaaa

SEQ ID NO: 3289117 - DNA, 23 bp, Homo sapiens
atttgtgaaatgatggtgaaagt

SEQ ID NO: 3289118 - DNA, 20 bp, Homo sapiens
atttgtgaactggaagaaag

SEQ ID NO: 3289119 - DNA, 12 bp, Homo sapiens
atttgtgagact

SEQ ID NO: 3289120 - DNA, 21 bp, Homo sapiens
atttgtgtaataaagtgtttt

SEQ ID NO: 3289121 - DNA, 22 bp, Homo sapiens
atttgtgtaataaagtgttttc

SEQ ID NO: 3289122 - DNA, 13 bp, Homo sapiens
atttgtgtaatag

SEQ ID NO: 3289123 - DNA, 22 bp, Homo sapiens
atttgtgtgtttttagctgtga

SEQ ID NO: 3289124 - DNA, 18 bp, Homo sapiens
caaaacttaaaagtattc

SEQ ID NO: 3289125 - DNA, 11 bp, Homo sapiens
caaaacttctt

SEQ ID NO: 3289126 - DNA, 17 bp, Homo sapiens
caaaacttcttgtcaga

SEQ ID NO: 3289127 - DNA, 20 bp, Homo sapiens
caaaacttcttgtcagacat

SEQ ID NO: 3289128 - DNA, 23 bp, Homo sapiens
caaaactttatcagggaaactaa

SEQ ID NO: 3289129 - DNA, 21 bp, Homo sapiens
caaaagaaaaaaaaaagcacc

SEQ ID NO: 3289130 - DNA, 15 bp, Homo sapiens
caaaagaagtgaaaa

SEQ ID NO: 3289131 - DNA, 15 bp, Homo sapiens
caaaagaatcagaaa

SEQ ID NO: 3289132 - DNA, 12 bp, Homo sapiens
caaaagagaaaa

SEQ ID NO: 3289133 - DNA, 19 bp, Homo sapiens
caaaagagaaaaaaaatta

SEQ ID NO: 3289134 - DNA, 21 bp, Homo sapiens
caaaagagcatggatgcattt

SEQ ID NO: 3289135 - DNA, 22 bp, Homo sapiens
caaaagagcatggatgcatttc

SEQ ID NO: 3289136 - DNA, 23 bp, Homo sapiens
caaaagagcatggatgcatttca

SEQ ID NO: 3289137 - DNA, 12 bp, Homo sapiens
caaaagatgaaa

SEQ ID NO: 3289138 - DNA, 19 bp, Homo sapiens
caaaagattgctgaaattt

SEQ ID NO: 3289139 - DNA, 22 bp, Homo sapiens
caaaagattgctgaaattttat

SEQ ID NO: 3289140 - DNA, 15 bp, Homo sapiens
caaaagcaaatgaga

SEQ ID NO: 3289141 - DNA, 23 bp, Homo sapiens
caaaagcaagactgttgctcaaa

SEQ ID NO: 3289142 - DNA, 15 bp, Homo sapiens
caaaagcacttactt

SEQ ID NO: 3289143 - DNA, 18 bp, Homo sapiens
caaaagccataacttgaa

SEQ ID NO: 3289144 - DNA, 14 bp, Homo sapiens
caaaagccttgtgt

SEQ ID NO: 3289145 - DNA, 23 bp, Homo sapiens
caaaagccttgtgtatatttgta

SEQ ID NO: 3289146 - DNA, 11 bp, Homo sapiens
caaaagctgta

SEQ ID NO: 3289147 - DNA, 16 bp, Homo sapiens
caaaagcttcaaatta

SEQ ID NO: 3289148 - DNA, 20 bp, Homo sapiens
caaaaggaaagctgtgttta

SEQ ID NO: 3289149 - DNA, 16 bp, Homo sapiens
caaaaggcagctcacc

SEQ ID NO: 3289150 - DNA, 19 bp, Homo sapiens
caaaaggcagctcacccct

SEQ ID NO: 3289151 - DNA, 15 bp, Homo sapiens
caaaaggctgagaag

SEQ ID NO: 3289152 - DNA, 14 bp, Homo sapiens
caaaagggaaaaga

SEQ ID NO: 3289153 - DNA, 20 bp, Homo sapiens
caaaagggtttaaactgatt

SEQ ID NO: 3289154 - DNA, 22 bp, Homo sapiens
caaaagggtttaaactgattca

SEQ ID NO: 3289155 - DNA, 19 bp, Homo sapiens
caaaaggttcactaaagca

SEQ ID NO: 3289156 - DNA, 20 bp, Homo sapiens
caaaaggttcactaaagcag

SEQ ID NO: 3289157 - DNA, 14 bp, Homo sapiens
caaaagtctatttt

SEQ ID NO: 3289158 - DNA, 21 bp, Homo sapiens
caaaagttggactaaatgcct

SEQ ID NO: 3289159 - DNA, 15 bp, Homo sapiens
caaaagttttcctga

SEQ ID NO: 3289160 - DNA, 18 bp, Homo sapiens
caaaataaaaagcctcag

SEQ ID NO: 3289161 - DNA, 21 bp, Homo sapiens
caaaataaaaagcctcagtga

SEQ ID NO: 3289162 - DNA, 19 bp, Homo sapiens
caaaataaaaagtgacaca

SEQ ID NO: 3289163 - DNA, 21 bp, Homo sapiens
caaaataaaaagtgacacagc

SEQ ID NO: 3289164 - DNA, 17 bp, Homo sapiens
caaaataaaaatgaggt

SEQ ID NO: 3289165 - DNA, 20 bp, Homo sapiens
caaaataaagcaatgtgttt

SEQ ID NO: 3289166 - DNA, 12 bp, Homo sapiens
caaaatacaatc

SEQ ID NO: 3289167 - DNA, 22 bp, Homo sapiens
caaaataccagagccttcaagt

SEQ ID NO: 3289168 - DNA, 13 bp, Homo sapiens
caaaatagaagct

SEQ ID NO: 3289169 - DNA, 13 bp, Homo sapiens
caaaatagagaat

SEQ ID NO: 3289170 - DNA, 20 bp, Homo sapiens
caaaatatattttgtttaca

SEQ ID NO: 3289171 - DNA, 12 bp, Homo sapiens
caaaatattttc

SEQ ID NO: 3289172 - DNA, 21 bp, Homo sapiens
caaaatattttttgcaagtta

SEQ ID NO: 3289173 - DNA, 18 bp, Homo sapiens
caaaatcgattggcttta

SEQ ID NO: 3289174 - DNA, 20 bp, Homo sapiens
caaaatctaaaacaaaatct

SEQ ID NO: 3289175 - DNA, 19 bp, Homo sapiens
caaaatctttgtataaata

SEQ ID NO: 3289176 - DNA, 15 bp, Homo sapiens
caaaatgacaatgat

SEQ ID NO: 3289177 - DNA, 23 bp, Homo sapiens
caaaatgctttttatttctgcat

SEQ ID NO: 3289178 - DNA, 16 bp, Homo sapiens
caaaatggaataaaag

SEQ ID NO: 3289179 - DNA, 15 bp, Homo sapiens
caaaatgtagggtta

SEQ ID NO: 3289180 - DNA, 15 bp, Homo sapiens
caaaatgtatatatt

SEQ ID NO: 3289181 - DNA, 16 bp, Homo sapiens
caaaatgtatatattt

SEQ ID NO: 3289182 - DNA, 17 bp, Homo sapiens
caaaatgtatatattta

SEQ ID NO: 3289183 - DNA, 18 bp, Homo sapiens
caaaatgtatatatttag

SEQ ID NO: 3289184 - DNA, 16 bp, Homo sapiens
caaaatgtgtatttct

SEQ ID NO: 3289185 - DNA, 20 bp, Homo sapiens
caaaatgtgtatttcttata

SEQ ID NO: 3289186 - DNA, 20 bp, Homo sapiens
caaaatgttatcttctcaag

SEQ ID NO: 3289187 - DNA, 18 bp, Homo sapiens
caaaatgttggtcatttt

SEQ ID NO: 3289188 - DNA, 21 bp, Homo sapiens
caaaatgttggtcattttatg

SEQ ID NO: 3289189 - DNA, 13 bp, Homo sapiens
caaaattatttgt

SEQ ID NO: 3289190 - DNA, 15 bp, Homo sapiens
caaaattcaaagcat

SEQ ID NO: 3289191 - DNA, 17 bp, Homo sapiens
caaaattctagctgtat

SEQ ID NO: 3289192 - DNA, 19 bp, Homo sapiens
caaaattctagctgtatga

SEQ ID NO: 3289193 - DNA, 16 bp, Homo sapiens
caaaattgatgtgttt

SEQ ID NO: 3289194 - DNA, 13 bp, Homo sapiens
caaaattgttttc

SEQ ID NO: 3289195 - DNA, 14 bp, Homo sapiens
caaaattgttttca

SEQ ID NO: 3289196 - DNA, 19 bp, Homo sapiens
caaaattgttttcacttgt

SEQ ID NO: 3289197 - DNA, 22 bp, Homo sapiens
caaaattgttttcacttgtatt

SEQ ID NO: 3289198 - DNA, 23 bp, Homo sapiens
caaaattgttttcacttgtattg

SEQ ID NO: 3289199 - DNA, 20 bp, Homo sapiens
caaaatttagtttttgttct

SEQ ID NO: 3289200 - DNA, 17 bp, Homo sapiens
caaaatttccagtacct

SEQ ID NO: 3289201 - DNA, 18 bp, Homo sapiens
caaaatttccagtacctt

SEQ ID NO: 3289202 - DNA, 23 bp, Homo sapiens
caaaatttgactaattttacatg

SEQ ID NO: 3289203 - DNA, 11 bp, Homo sapiens
caaaatttgtt

SEQ ID NO: 3289204 - DNA, 23 bp, Homo sapiens
caaaattttataagcaaatttca

SEQ ID NO: 3289205 - DNA, 21 bp, Homo sapiens
caaaattttatagctcagttt

SEQ ID NO: 3289206 - DNA, 16 bp, Homo sapiens
caaacaaaaaggttct

SEQ ID NO: 3289207 - DNA, 13 bp, Homo sapiens
caaacaaaagcac

SEQ ID NO: 3289208 - DNA, 15 bp, Homo sapiens
caaacaaaagttctg

SEQ ID NO: 3289209 - DNA, 14 bp, Homo sapiens
caaacaaatatgca

SEQ ID NO: 3289210 - DNA, 23 bp, Homo sapiens
caaacaagtggatgtttttaatg

SEQ ID NO: 3289211 - DNA, 21 bp, Homo sapiens
caaacaatgaagaattatgta

SEQ ID NO: 3289212 - DNA, 15 bp, Homo sapiens
caaacagaacagggt

SEQ ID NO: 3289213 - DNA, 16 bp, Homo sapiens
caaacagaacagggtc

SEQ ID NO: 3289214 - DNA, 14 bp, Homo sapiens
caaacagtaggttg

SEQ ID NO: 3289215 - DNA, 16 bp, Homo sapiens
caaacatcaaataaat

SEQ ID NO: 3289216 - DNA, 22 bp, Homo sapiens
caaacatcaaataaatttctgg

SEQ ID NO: 3289217 - DNA, 21 bp, Homo sapiens
caaacatcactctgctgctta

SEQ ID NO: 3289218 - DNA, 18 bp, Homo sapiens
caaacatcagacctgtct

SEQ ID NO: 3289219 - DNA, 18 bp, Homo sapiens
caaacatcctatcaacaa

SEQ ID NO: 3289220 - DNA, 16 bp, Homo sapiens
caaacatgcagtactt

SEQ ID NO: 3289221 - DNA, 16 bp, Homo sapiens
caaacatgtatttatg

SEQ ID NO: 3289222 - DNA, 22 bp, Homo sapiens
caaacattcgtgagctggggac

SEQ ID NO: 3289223 - DNA, 17 bp, Homo sapiens
caaacattgtgttgaca

SEQ ID NO: 3289224 - DNA, 19 bp, Homo sapiens
caaacattgtgttgacatt

SEQ ID NO: 3289225 - DNA, 16 bp, Homo sapiens
caaaccaacatctttg

SEQ ID NO: 3289226 - DNA, 17 bp, Homo sapiens
caaaccaagtcggaaca

SEQ ID NO: 3289227 - DNA, 22 bp, Homo sapiens
caaaccaatggtgatcctctat

SEQ ID NO: 3289228 - DNA, 14 bp, Homo sapiens
caaaccacaactga

SEQ ID NO: 3289229 - DNA, 15 bp, Homo sapiens
caaaccaccaggcat

SEQ ID NO: 3289230 - DNA, 17 bp, Homo sapiens
caaaccagccttcggag

SEQ ID NO: 3289231 - DNA, 16 bp, Homo sapiens
caaaccatgagaattt

SEQ ID NO: 3289232 - DNA, 22 bp, Homo sapiens
caaacccacgattttctccagc

SEQ ID NO: 3289233 - DNA, 24 bp, Homo sapiens
caaacccacgattttctccagctc

SEQ ID NO: 3289234 - DNA, 17 bp, Homo sapiens
caaaccccctttgtgct

SEQ ID NO: 3289235 - DNA, 21 bp, Homo sapiens
caaaccctaggttcccggtcc

SEQ ID NO: 3289236 - DNA, 23 bp, Homo sapiens
caaacccttaactgacatgggcc

SEQ ID NO: 3289237 - DNA, 16 bp, Homo sapiens
caaacccttgctttcc

SEQ ID NO: 3289238 - DNA, 17 bp, Homo sapiens
caaacctaccaaaatgg

SEQ ID NO: 3289239 - DNA, 17 bp, Homo sapiens
caaacctcactgagagg

SEQ ID NO: 3289240 - DNA, 15 bp, Homo sapiens
caaacctcctcttct

SEQ ID NO: 3289241 - DNA, 13 bp, Homo sapiens
caaacctggttca

SEQ ID NO: 3289242 - DNA, 19 bp, Homo sapiens
caaacctgtcttggggcca

SEQ ID NO: 3289243 - DNA, 14 bp, Homo sapiens
caaaccttaaaaca

SEQ ID NO: 3289244 - DNA, 18 bp, Homo sapiens
caaaccttaaaacagctg

SEQ ID NO: 3289245 - DNA, 12 bp, Homo sapiens
caaaccttcctg

SEQ ID NO: 3289246 - DNA, 19 bp, Homo sapiens
caaaccttcctgggaggac

SEQ ID NO: 3289247 - DNA, 14 bp, Homo sapiens
caaacctttgagta

SEQ ID NO: 3289248 - DNA, 23 bp, Homo sapiens
caaacgccctttcctcctcaggc

SEQ ID NO: 3289249 - DNA, 13 bp, Homo sapiens
caagccctggcaa

SEQ ID NO: 3289250 - DNA, 16 bp, Homo sapiens
caagcccttggggagg

SEQ ID NO: 3289251 - DNA, 21 bp, Homo sapiens
caagccgaccttccctccgcc

SEQ ID NO: 3289252 - DNA, 15 bp, Homo sapiens
caagccgtggcttcc

SEQ ID NO: 3289253 - DNA, 16 bp, Homo sapiens
caagccgtggcttccc

SEQ ID NO: 3289254 - DNA, 13 bp, Homo sapiens
caagcctccacag

SEQ ID NO: 3289255 - DNA, 17 bp, Homo sapiens
caagcctccacagcgag

SEQ ID NO: 3289256 - DNA, 13 bp, Homo sapiens
caagcctcctgta

SEQ ID NO: 3289257 - DNA, 14 bp, Homo sapiens
caagcctcctgtac

SEQ ID NO: 3289258 - DNA, 14 bp, Homo sapiens
caagcctgcctagg

SEQ ID NO: 3289259 - DNA, 14 bp, Homo sapiens
caagcctgtctgag

SEQ ID NO: 3289260 - DNA, 17 bp, Homo sapiens
caagcgattcttctgct

SEQ ID NO: 3289261 - DNA, 18 bp, Homo sapiens
caagcgattcttctgctt

SEQ ID NO: 3289262 - DNA, 23 bp, Homo sapiens
caagcgcatccaatctcaaggaa

SEQ ID NO: 3289263 - DNA, 22 bp, Homo sapiens
caagcgctcccagcctgccctc

SEQ ID NO: 3289264 - DNA, 22 bp, Homo sapiens
caagctagccagagggtgggag

SEQ ID NO: 3289265 - DNA, 15 bp, Homo sapiens
caagctaggccccag

SEQ ID NO: 3289266 - DNA, 16 bp, Homo sapiens
caagctaggccccaga

SEQ ID NO: 3289267 - DNA, 23 bp, Homo sapiens
caagctaggccccagaggccctg

SEQ ID NO: 3289268 - DNA, 15 bp, Homo sapiens
caagctatctaaagt

SEQ ID NO: 3289269 - DNA, 17 bp, Homo sapiens
caagctattctcatgcc

SEQ ID NO: 3289270 - DNA, 13 bp, Homo sapiens
caagctatttaat

SEQ ID NO: 3289271 - DNA, 13 bp, Homo sapiens
caagctccaagcc

SEQ ID NO: 3289272 - DNA, 14 bp, Homo sapiens
caagctccaagccc

SEQ ID NO: 3289273 - DNA, 17 bp, Homo sapiens
caagctccatctccact

SEQ ID NO: 3289274 - DNA, 16 bp, Homo sapiens
caagctccctgcccca

SEQ ID NO: 3289275 - DNA, 19 bp, Homo sapiens
caagctccctgccccaaat

SEQ ID NO: 3289276 - DNA, 13 bp, Homo sapiens
caagctccctgga

SEQ ID NO: 3289277 - DNA, 19 bp, Homo sapiens
caagctccctggagccctg

SEQ ID NO: 3289278 - DNA, 20 bp, Homo sapiens
caagctcctcctcggaaccg

SEQ ID NO: 3289279 - DNA, 20 bp, Homo sapiens
caagctctgcctcccgggtt

SEQ ID NO: 3289280 - DNA, 17 bp, Homo sapiens
caagctgacttggcact

SEQ ID NO: 3289281 - DNA, 23 bp, Homo sapiens
caagctgcgggctccctggcagg

SEQ ID NO: 3289282 - DNA, 13 bp, Homo sapiens
caagctggcctct

SEQ ID NO: 3289283 - DNA, 17 bp, Homo sapiens
caagctggtcccactca

SEQ ID NO: 3289284 - DNA, 20 bp, Homo sapiens
caagctgtcccctctgtcat

SEQ ID NO: 3289285 - DNA, 19 bp, Homo sapiens
caagctgtccctgcagggc

SEQ ID NO: 3289286 - DNA, 14 bp, Homo sapiens
caagctgtgcaggc

SEQ ID NO: 3289287 - DNA, 19 bp, Homo sapiens
caagctgtgcaggcatggt

SEQ ID NO: 3289288 - DNA, 18 bp, Homo sapiens
caagcttaatagccctcc

SEQ ID NO: 3289289 - DNA, 19 bp, Homo sapiens
caagcttaatagccctccc

SEQ ID NO: 3289290 - DNA, 19 bp, Homo sapiens
caagcttcaatatttttct

SEQ ID NO: 3289291 - DNA, 20 bp, Homo sapiens
caagctttgatttagattga

SEQ ID NO: 3289292 - DNA, 15 bp, Homo sapiens
caagcttttctgtag

SEQ ID NO: 3289293 - DNA, 23 bp, Homo sapiens
caaggaaaaatgctgcttctcct

SEQ ID NO: 3289294 - DNA, 22 bp, Homo sapiens
caaggaaaatagtttaggagaa

SEQ ID NO: 3289295 - DNA, 22 bp, Homo sapiens
caaggaaagggggtcccagtgg

SEQ ID NO: 3289296 - DNA, 16 bp, Homo sapiens
caaggaagatatacat

SEQ ID NO: 3289297 - DNA, 17 bp, Homo sapiens
caaggaatgcctgtgcc

SEQ ID NO: 3289298 - DNA, 15 bp, Homo sapiens
caaggaatttcttaa

SEQ ID NO: 3289299 - DNA, 13 bp, Homo sapiens
caaggaccaggac

SEQ ID NO: 3289300 - DNA, 16 bp, Homo sapiens
caaggaccaggactcc

SEQ ID NO: 3289301 - DNA, 18 bp, Homo sapiens
caaggaccaggactccct

SEQ ID NO: 3289302 - DNA, 20 bp, Homo sapiens
caaggaccaggactccctcc

SEQ ID NO: 3289303 - DNA, 19 bp, Homo sapiens
caaggacctcctcttcccc

SEQ ID NO: 3289304 - DNA, 14 bp, Homo sapiens
caaggactgactga

SEQ ID NO: 3289305 - DNA, 15 bp, Homo sapiens
caaggactgactgag

SEQ ID NO: 3289306 - DNA, 15 bp, Homo sapiens
caaggactgcaggga

SEQ ID NO: 3289307 - DNA, 15 bp, Homo sapiens
caaggacttccacat

SEQ ID NO: 3289308 - DNA, 14 bp, Homo sapiens
caaggagaaacaga

SEQ ID NO: 3289309 - DNA, 16 bp, Homo sapiens
caaggagaaacagaga

SEQ ID NO: 3289310 - DNA, 15 bp, Homo sapiens
caaggagcacaagcc

SEQ ID NO: 3289311 - DNA, 16 bp, Homo sapiens
caaggagcacaagcca

SEQ ID NO: 3289312 - DNA, 17 bp, Homo sapiens
caaggagcacaggtccc

SEQ ID NO: 3289313 - DNA, 17 bp, Homo sapiens
caaggagctcaccctgc

SEQ ID NO: 3289314 - DNA, 21 bp, Homo sapiens
caaggagctcaccctgcccgc

SEQ ID NO: 3289315 - DNA, 22 bp, Homo sapiens
caaggagctcaccctgcccgct

SEQ ID NO: 3289316 - DNA, 20 bp, Homo sapiens
caaggagctgatttccaggc

SEQ ID NO: 3289317 - DNA, 23 bp, Homo sapiens
caaggagctgatttccaggcccc

SEQ ID NO: 3289318 - DNA, 15 bp, Homo sapiens
caaggaggtagagag

SEQ ID NO: 3289319 - DNA, 17 bp, Homo sapiens
caaggatagaagtatac

SEQ ID NO: 3289320 - DNA, 16 bp, Homo sapiens
caaggatcctctccac

SEQ ID NO: 3289321 - DNA, 15 bp, Homo sapiens
caaggatccttccct

SEQ ID NO: 3289322 - DNA, 18 bp, Homo sapiens
caaggattacagaaactg

SEQ ID NO: 3289323 - DNA, 15 bp, Homo sapiens
caaggattgctactg

SEQ ID NO: 3289324 - DNA, 23 bp, Homo sapiens
caaggcaaacaatcccaatcttt

SEQ ID NO: 3289325 - DNA, 18 bp, Homo sapiens
caaggcaaggcaggtgcc

SEQ ID NO: 3289326 - DNA, 14 bp, Homo sapiens
caaggcactctaga

SEQ ID NO: 3289327 - DNA, 15 bp, Homo sapiens
caaggcactgtacta

SEQ ID NO: 3289328 - DNA, 12 bp, Homo sapiens
caaggcagcctc

SEQ ID NO: 3289329 - DNA, 21 bp, Homo sapiens
caaggcagcctccagagccag

SEQ ID NO: 3289330 - DNA, 24 bp, Homo sapiens
caaggcagcctccagagccagcct

SEQ ID NO: 3289331 - DNA, 13 bp, Homo sapiens
caaggcaggtgcc

SEQ ID NO: 3289332 - DNA, 14 bp, Homo sapiens
caaggcaggtgcct

SEQ ID NO: 3289333 - DNA, 17 bp, Homo sapiens
caaggcaggtgcctcca

SEQ ID NO: 3289334 - DNA, 18 bp, Homo sapiens
caaggcaggtgcctccag

SEQ ID NO: 3289335 - DNA, 20 bp, Homo sapiens
caaggcaggtgcctccaggt

SEQ ID NO: 3289336 - DNA, 12 bp, Homo sapiens
caaggccctgct

SEQ ID NO: 3289337 - DNA, 20 bp, Homo sapiens
caaggccctgctttttttct

SEQ ID NO: 3289338 - DNA, 24 bp, Homo sapiens
caaggccgagcgttcccagcaggg

SEQ ID NO: 3289339 - DNA, 12 bp, Homo sapiens
caaggccttcca

SEQ ID NO: 3289340 - DNA, 20 bp, Homo sapiens
caaggctaacatcccactta

SEQ ID NO: 3289341 - DNA, 16 bp, Homo sapiens
caaggctaattggaaa

SEQ ID NO: 3289342 - DNA, 19 bp, Homo sapiens
caaggctgaccaagagaga

SEQ ID NO: 3289343 - DNA, 20 bp, Homo sapiens
caaggctgaccaagagagaa

SEQ ID NO: 3289344 - DNA, 17 bp, Homo sapiens
caaggctgcgtctggag

SEQ ID NO: 3289345 - DNA, 15 bp, Homo sapiens
caaggctggccagca

SEQ ID NO: 3289346 - DNA, 14 bp, Homo sapiens
caagggaaaggggt

SEQ ID NO: 3289347 - DNA, 16 bp, Homo sapiens
caagggaaaggggtgc

SEQ ID NO: 3289348 - DNA, 18 bp, Homo sapiens
caagggaagcctgcctgg

SEQ ID NO: 3289349 - DNA, 15 bp, Homo sapiens
caagggaccttcatg

SEQ ID NO: 3289350 - DNA, 18 bp, Homo sapiens
caagggagaaaagagaaa

SEQ ID NO: 3289351 - DNA, 19 bp, Homo sapiens
caagggagaaaagagaaac

SEQ ID NO: 3289352 - DNA, 17 bp, Homo sapiens
caagggagagacctcat

SEQ ID NO: 3289353 - DNA, 20 bp, Homo sapiens
caagggagagacctcatcag

SEQ ID NO: 3289354 - DNA, 15 bp, Homo sapiens
caagggattctggga

SEQ ID NO: 3289355 - DNA, 16 bp, Homo sapiens
caagggattctgggaa

SEQ ID NO: 3289356 - DNA, 14 bp, Homo sapiens
caagggatttgagg

SEQ ID NO: 3289357 - DNA, 20 bp, Homo sapiens
caagggcatcaggcactggt

SEQ ID NO: 3289358 - DNA, 12 bp, Homo sapiens
caagggccctgg

SEQ ID NO: 3289359 - DNA, 14 bp, Homo sapiens
caagggctgtaggt

SEQ ID NO: 3289360 - DNA, 18 bp, Homo sapiens
caaggggcccaaattctt

SEQ ID NO: 3289361 - DNA, 15 bp, Homo sapiens
caagggggactgtct

SEQ ID NO: 3289362 - DNA, 20 bp, Homo sapiens
caagggtttcgactggtcca

SEQ ID NO: 3289363 - DNA, 22 bp, Homo sapiens
caagggtttcgactggtccagc

SEQ ID NO: 3289364 - DNA, 18 bp, Homo sapiens
caaggtccactccctgct

SEQ ID NO: 3289365 - DNA, 22 bp, Homo sapiens
caaggtccactccctgctccac

SEQ ID NO: 3289366 - DNA, 15 bp, Homo sapiens
caaggtcccctccac

SEQ ID NO: 3289367 - DNA, 16 bp, Homo sapiens
caaggtcccctccaca

SEQ ID NO: 3289368 - DNA, 18 bp, Homo sapiens
caaggtcccctccacatc

SEQ ID NO: 3289369 - DNA, 23 bp, Homo sapiens
caaggtgaagatgggaacgcaga

SEQ ID NO: 3289370 - DNA, 21 bp, Homo sapiens
caaggtgacagaaggaccagc

SEQ ID NO: 3289371 - DNA, 17 bp, Homo sapiens
caaggtggccaaattat

SEQ ID NO: 3289372 - DNA, 21 bp, Homo sapiens
caaggtgggctgagccctggc

SEQ ID NO: 3289373 - DNA, 23 bp, Homo sapiens
caaggtgggctgagccctggcag

SEQ ID NO: 3289374 - DNA, 21 bp, Homo sapiens
caaggtgggtggatcacctgt

SEQ ID NO: 3289375 - DNA, 20 bp, Homo sapiens
cacaaaccacaactgacaca

SEQ ID NO: 3289376 - DNA, 15 bp, Homo sapiens
cacaaactacctctg

SEQ ID NO: 3289377 - DNA, 17 bp, Homo sapiens
cacaaagattttctaag

SEQ ID NO: 3289378 - DNA, 22 bp, Homo sapiens
cacaaagcacagtttgaacaaa

SEQ ID NO: 3289379 - DNA, 13 bp, Homo sapiens
cacaaagccttat

SEQ ID NO: 3289380 - DNA, 18 bp, Homo sapiens
cacaaagcggggggaggg

SEQ ID NO: 3289381 - DNA, 11 bp, Homo sapiens
cacaaaggaag

SEQ ID NO: 3289382 - DNA, 18 bp, Homo sapiens
cacaaaggccaaactgct

SEQ ID NO: 3289383 - DNA, 21 bp, Homo sapiens
cacaaaggccaaactgctgga

SEQ ID NO: 3289384 - DNA, 21 bp, Homo sapiens
cacaaaggtggaataaacatt

SEQ ID NO: 3289385 - DNA, 23 bp, Homo sapiens
cacaaatatttattttctttctg

SEQ ID NO: 3289386 - DNA, 15 bp, Homo sapiens
cacaaatctttttct

SEQ ID NO: 3289387 - DNA, 20 bp, Homo sapiens
cacaaatgtgatttttgtaa

SEQ ID NO: 3289388 - DNA, 18 bp, Homo sapiens
cacaaattgaaaacacac

SEQ ID NO: 3289389 - DNA, 13 bp, Homo sapiens
cacaacagcagtc

SEQ ID NO: 3289390 - DNA, 19 bp, Homo sapiens
cacaacatttgcagatgtt

SEQ ID NO: 3289391 - DNA, 18 bp, Homo sapiens
cacaacccaataggagtc

SEQ ID NO: 3289392 - DNA, 16 bp, Homo sapiens
cacaaccttcggctcc

SEQ ID NO: 3289393 - DNA, 18 bp, Homo sapiens
cacaaccttctgtggctc

SEQ ID NO: 3289394 - DNA, 15 bp, Homo sapiens
cacaactatcaaaat

SEQ ID NO: 3289395 - DNA, 16 bp, Homo sapiens
cacaactgacacagga

SEQ ID NO: 3289396 - DNA, 17 bp, Homo sapiens
cacaactgacacaggaa

SEQ ID NO: 3289397 - DNA, 19 bp, Homo sapiens
cacaactgcaataacttct

SEQ ID NO: 3289398 - DNA, 23 bp, Homo sapiens
cacaagaatggatcacaagatgg

SEQ ID NO: 3289399 - DNA, 15 bp, Homo sapiens
cacaagcaatgcaag

SEQ ID NO: 3289400 - DNA, 16 bp, Homo sapiens
cacaagcaatgcaaga

SEQ ID NO: 3289401 - DNA, 21 bp, Homo sapiens
cacaagcagagtgcacagctg

SEQ ID NO: 3289402 - DNA, 15 bp, Homo sapiens
cacaagcccacagca

SEQ ID NO: 3289403 - DNA, 16 bp, Homo sapiens
cacaagcctcctgtac

SEQ ID NO: 3289404 - DNA, 15 bp, Homo sapiens
cacaagcctgagaac

SEQ ID NO: 3289405 - DNA, 16 bp, Homo sapiens
cacaagcgctcccagc

SEQ ID NO: 3289406 - DNA, 19 bp, Homo sapiens
cacaagcgctcccagcctg

SEQ ID NO: 3289407 - DNA, 20 bp, Homo sapiens
cacaagcgctcccagcctgc

SEQ ID NO: 3289408 - DNA, 21 bp, Homo sapiens
cacaagcgctcccagcctgcc

SEQ ID NO: 3289409 - DNA, 16 bp, Homo sapiens
cacaaggattgaaaat

SEQ ID NO: 3289410 - DNA, 18 bp, Homo sapiens
cacaaggctccaagacct

SEQ ID NO: 3289411 - DNA, 14 bp, Homo sapiens
cacaaggctgacca

SEQ ID NO: 3289412 - DNA, 21 bp, Homo sapiens
cacaaggctgaccaagagaga

SEQ ID NO: 3289413 - DNA, 17 bp, Homo sapiens
cacaaggctggccagca

SEQ ID NO: 3289414 - DNA, 22 bp, Homo sapiens
cacaagggaaggacagaaagga

SEQ ID NO: 3289415 - DNA, 12 bp, Homo sapiens
cacaagggctct

SEQ ID NO: 3289416 - DNA, 20 bp, Homo sapiens
cacaataaatgtattcaaat

SEQ ID NO: 3289417 - DNA, 22 bp, Homo sapiens
cacaatacctacaataaactgg

SEQ ID NO: 3289418 - DNA, 20 bp, Homo sapiens
cacaataggtctttctctca

SEQ ID NO: 3289419 - DNA, 12 bp, Homo sapiens
cacaatatgaat

SEQ ID NO: 3289420 - DNA, 11 bp, Homo sapiens
cacaatatttt

SEQ ID NO: 3289421 - DNA, 20 bp, Homo sapiens
cacaatcctaacacattatc

SEQ ID NO: 3289422 - DNA, 17 bp, Homo sapiens
cacaatcctcctgggga

SEQ ID NO: 3289423 - DNA, 15 bp, Homo sapiens
cacaatctcggctca

SEQ ID NO: 3289424 - DNA, 22 bp, Homo sapiens
cacaatgagaatgatgcacact

SEQ ID NO: 3289425 - DNA, 19 bp, Homo sapiens
cacaattaattcatccctt

SEQ ID NO: 3289426 - DNA, 17 bp, Homo sapiens
cacaattcattggctcc

SEQ ID NO: 3289427 - DNA, 16 bp, Homo sapiens
cacacaagcccacagc

SEQ ID NO: 3289428 - DNA, 19 bp, Homo sapiens
cacacaattatttatttca

SEQ ID NO: 3289429 - DNA, 13 bp, Homo sapiens
cacacacaaacct

SEQ ID NO: 3289430 - DNA, 14 bp, Homo sapiens
cacacacaaacctt

SEQ ID NO: 3289431 - DNA, 13 bp, Homo sapiens
cacacacacacac

SEQ ID NO: 3289432 - DNA, 16 bp, Homo sapiens
cacacacacacacaca

SEQ ID NO: 3289433 - DNA, 14 bp, Homo sapiens
cacacacacacatc

SEQ ID NO: 3289434 - DNA, 14 bp, Homo sapiens
cacacacacacatg

SEQ ID NO: 3289435 - DNA, 15 bp, Homo sapiens
cacacacacacgcac

SEQ ID NO: 3289436 - DNA, 11 bp, Homo sapiens
cacacacacga

SEQ ID NO: 3289437 - DNA, 13 bp, Homo sapiens
cacacacagctcc

SEQ ID NO: 3289438 - DNA, 22 bp, Homo sapiens
cacacacagctgggcaaagcca

SEQ ID NO: 3289439 - DNA, 13 bp, Homo sapiens
cacacacatagat

SEQ ID NO: 3289440 - DNA, 13 bp, Homo sapiens
cacacacatgcac

SEQ ID NO: 3289441 - DNA, 13 bp, Homo sapiens
cacacacctccga

SEQ ID NO: 3289442 - DNA, 13 bp, Homo sapiens
cacacacgatgca

SEQ ID NO: 3289443 - DNA, 21 bp, Homo sapiens
cacacacgcgcgcgcacacac

SEQ ID NO: 3289444 - DNA, 17 bp, Homo sapiens
cacacacgcgtgcacac

SEQ ID NO: 3289445 - DNA, 18 bp, Homo sapiens
cacacagaaatatatata

SEQ ID NO: 3289446 - DNA, 12 bp, Homo sapiens
cacacagaggaa

SEQ ID NO: 3289447 - DNA, 20 bp, Homo sapiens
cacacagagtggtctttctg

SEQ ID NO: 3289448 - DNA, 17 bp, Homo sapiens
cacacagatgacaaatt

SEQ ID NO: 3289449 - DNA, 21 bp, Homo sapiens
cacacagcagccccccagcac

SEQ ID NO: 3289450 - DNA, 18 bp, Homo sapiens
cacacagctactctcccc

SEQ ID NO: 3289451 - DNA, 12 bp, Homo sapiens
cacacagctctg

SEQ ID NO: 3289452 - DNA, 16 bp, Homo sapiens
cacacagctgagcact

SEQ ID NO: 3289453 - DNA, 17 bp, Homo sapiens
cacacagctgagcactt

SEQ ID NO: 3289454 - DNA, 22 bp, Homo sapiens
cacacagggcccggccacaccc

SEQ ID NO: 3289455 - DNA, 23 bp, Homo sapiens
cacacaggggtggagtttctgac

SEQ ID NO: 3289456 - DNA, 20 bp, Homo sapiens
cacacagtattacttctgct

SEQ ID NO: 3289457 - DNA, 17 bp, Homo sapiens
cacacagtccccagact

SEQ ID NO: 3289458 - DNA, 19 bp, Homo sapiens
cacacagtccccagactca

SEQ ID NO: 3289459 - DNA, 18 bp, Homo sapiens
cacacatacgtgcacagg

SEQ ID NO: 3289460 - DNA, 23 bp, Homo sapiens
cacacatataaacatcacacaca

SEQ ID NO: 3289461 - DNA, 16 bp, Homo sapiens
cacacatgccctcctg

SEQ ID NO: 3289462 - DNA, 17 bp, Homo sapiens
cacacatgccctcctgg

SEQ ID NO: 3289463 - DNA, 14 bp, Homo sapiens
cacaccaccctccc

SEQ ID NO: 3289464 - DNA, 16 bp, Homo sapiens
cacaccactgccctgc

SEQ ID NO: 3289465 - DNA, 13 bp, Homo sapiens
cacaccagagccc

SEQ ID NO: 3289466 - DNA, 15 bp, Homo sapiens
cacaccagagcccac

SEQ ID NO: 3289467 - DNA, 21 bp, Homo sapiens
cacaccagagcccaccttggc

SEQ ID NO: 3289468 - DNA, 18 bp, Homo sapiens
cacaccaggcgctaattc

SEQ ID NO: 3289469 - DNA, 19 bp, Homo sapiens
cacaccaggctgtgggcct

SEQ ID NO: 3289470 - DNA, 12 bp, Homo sapiens
cacaccagtggc

SEQ ID NO: 3289471 - DNA, 19 bp, Homo sapiens
cacacccaatgctgctcca

SEQ ID NO: 3289472 - DNA, 14 bp, Homo sapiens
cacacccagcccac

SEQ ID NO: 3289473 - DNA, 14 bp, Homo sapiens
cacacccagcctca

SEQ ID NO: 3289474 - DNA, 15 bp, Homo sapiens
cacacccagcctcag

SEQ ID NO: 3289475 - DNA, 19 bp, Homo sapiens
cacacccagcctcagtcct

SEQ ID NO: 3289476 - DNA, 23 bp, Homo sapiens
cacacccaggcacttaagcacaa

SEQ ID NO: 3289477 - DNA, 13 bp, Homo sapiens
cacaccccagccc

SEQ ID NO: 3289478 - DNA, 15 bp, Homo sapiens
cacaccccagcccac

SEQ ID NO: 3289479 - DNA, 20 bp, Homo sapiens
cacaccccagcccaccctgc

SEQ ID NO: 3289480 - DNA, 21 bp, Homo sapiens
cacaccccagcccaccctgct

SEQ ID NO: 3289481 - DNA, 12 bp, Homo sapiens
cacaccctgagg

SEQ ID NO: 3289482 - DNA, 22 bp, Homo sapiens
cacaccctgaggtcagggagtg

SEQ ID NO: 3289483 - DNA, 13 bp, Homo sapiens
cacaccctgcaag

SEQ ID NO: 3289484 - DNA, 12 bp, Homo sapiens
cacaccctgccc

SEQ ID NO: 3289485 - DNA, 16 bp, Homo sapiens
cacaccctgcccctgg

SEQ ID NO: 3289486 - DNA, 22 bp, Homo sapiens
cacacctcagttcccttggcct

SEQ ID NO: 3289487 - DNA, 14 bp, Homo sapiens
cacacctccctgaa

SEQ ID NO: 3289488 - DNA, 21 bp, Homo sapiens
cacacctccgagacagtccag

SEQ ID NO: 3289489 - DNA, 20 bp, Homo sapiens
cacacctgcaatcccagcac

SEQ ID NO: 3289490 - DNA, 21 bp, Homo sapiens
cacacctgcaatcccagcacc

SEQ ID NO: 3289491 - DNA, 12 bp, Homo sapiens
cacacctggcct

SEQ ID NO: 3289492 - DNA, 15 bp, Homo sapiens
cacacctgggcattt

SEQ ID NO: 3289493 - DNA, 15 bp, Homo sapiens
cacaccttccagggc

SEQ ID NO: 3289494 - DNA, 22 bp, Homo sapiens
cacaccttttattgacacagaa

SEQ ID NO: 3289495 - DNA, 23 bp, Homo sapiens
cacaccttttattgacacagaaa

SEQ ID NO: 3289496 - DNA, 11 bp, Homo sapiens
cacacgatgca

SEQ ID NO: 3289497 - DNA, 20 bp, Homo sapiens
cacacgatgcatttaataaa

SEQ ID NO: 3289498 - DNA, 21 bp, Homo sapiens
cacacgatgcatttaataaag

SEQ ID NO: 3289499 - DNA, 13 bp, Homo sapiens
cacacgcacgcac

SEQ ID NO: 3289500 - DNA, 15 bp, Homo sapiens
cacacgcacgcacac

SEQ ID NO: 3289501 - DNA, 17 bp, Homo sapiens
cacccggcccctgctgg

SEQ ID NO: 3289502 - DNA, 17 bp, Homo sapiens
cacccgggggagcccag

SEQ ID NO: 3289503 - DNA, 19 bp, Homo sapiens
cacccgggggagcccagtg

SEQ ID NO: 3289504 - DNA, 15 bp, Homo sapiens
cacccgtctctctgc

SEQ ID NO: 3289505 - DNA, 18 bp, Homo sapiens
cacccgtgagcgcctgtg

SEQ ID NO: 3289506 - DNA, 18 bp, Homo sapiens
cacccgttctgctggcct

SEQ ID NO: 3289507 - DNA, 21 bp, Homo sapiens
cacccgttctgctggcctgga

SEQ ID NO: 3289508 - DNA, 15 bp, Homo sapiens
caccctcacacacac

SEQ ID NO: 3289509 - DNA, 20 bp, Homo sapiens
caccctcacacacacagctg

SEQ ID NO: 3289510 - DNA, 21 bp, Homo sapiens
caccctcaccccctcctggca

SEQ ID NO: 3289511 - DNA, 22 bp, Homo sapiens
caccctcaccccctcctggcaa

SEQ ID NO: 3289512 - DNA, 16 bp, Homo sapiens
caccctcactctgcca

SEQ ID NO: 3289513 - DNA, 22 bp, Homo sapiens
caccctcactctgccagggcag

SEQ ID NO: 3289514 - DNA, 14 bp, Homo sapiens
caccctcatgaaaa

SEQ ID NO: 3289515 - DNA, 18 bp, Homo sapiens
caccctccaccctgtccc

SEQ ID NO: 3289516 - DNA, 17 bp, Homo sapiens
caccctccaccttccat

SEQ ID NO: 3289517 - DNA, 15 bp, Homo sapiens
caccctccactcagc

SEQ ID NO: 3289518 - DNA, 16 bp, Homo sapiens
caccctccagagacaa

SEQ ID NO: 3289519 - DNA, 18 bp, Homo sapiens
caccctccatgctcctca

SEQ ID NO: 3289520 - DNA, 16 bp, Homo sapiens
caccctcccctctctt

SEQ ID NO: 3289521 - DNA, 19 bp, Homo sapiens
caccctcccctctcttgca

SEQ ID NO: 3289522 - DNA, 10 bp, Homo sapiens
caccctcctc

SEQ ID NO: 3289523 - DNA, 15 bp, Homo sapiens
caccctcctcttgga

SEQ ID NO: 3289524 - DNA, 19 bp, Homo sapiens
caccctcgaagcgcgccac

SEQ ID NO: 3289525 - DNA, 24 bp, Homo sapiens
caccctcgaagcgcgccactcgct

SEQ ID NO: 3289526 - DNA, 14 bp, Homo sapiens
caccctcttcctgt

SEQ ID NO: 3289527 - DNA, 23 bp, Homo sapiens
caccctgaagtcagcgggcccag

SEQ ID NO: 3289528 - DNA, 20 bp, Homo sapiens
caccctgaggtcagggagtg

SEQ ID NO: 3289529 - DNA, 13 bp, Homo sapiens
caccctgcacctg

SEQ ID NO: 3289530 - DNA, 12 bp, Homo sapiens
caccctgccccc

SEQ ID NO: 3289531 - DNA, 18 bp, Homo sapiens
caccctgcccctgcaaag

SEQ ID NO: 3289532 - DNA, 12 bp, Homo sapiens
caccctgcctta

SEQ ID NO: 3289533 - DNA, 16 bp, Homo sapiens
caccctggctgggatc

SEQ ID NO: 3289534 - DNA, 21 bp, Homo sapiens
caccctgggccctgggctgga

SEQ ID NO: 3289535 - DNA, 16 bp, Homo sapiens
caccctggggaccccc

SEQ ID NO: 3289536 - DNA, 17 bp, Homo sapiens
caccctggggagaaagt

SEQ ID NO: 3289537 - DNA, 12 bp, Homo sapiens
caccctgggtgc

SEQ ID NO: 3289538 - DNA, 17 bp, Homo sapiens
caccctgtcaagttaac

SEQ ID NO: 3289539 - DNA, 22 bp, Homo sapiens
caccctgtcccccagctctggt

SEQ ID NO: 3289540 - DNA, 23 bp, Homo sapiens
caccctgtcccccagctctggtg

SEQ ID NO: 3289541 - DNA, 17 bp, Homo sapiens
caccctgtctaaaaaac

SEQ ID NO: 3289542 - DNA, 15 bp, Homo sapiens
caccctgtgccatca

SEQ ID NO: 3289543 - DNA, 16 bp, Homo sapiens
caccctgtggccctgg

SEQ ID NO: 3289544 - DNA, 18 bp, Homo sapiens
cacccttaacccaaggag

SEQ ID NO: 3289545 - DNA, 20 bp, Homo sapiens
cacccttaacccaaggagca

SEQ ID NO: 3289546 - DNA, 19 bp, Homo sapiens
cacccttagaaaatgtgtc

SEQ ID NO: 3289547 - DNA, 16 bp, Homo sapiens
cacccttcagacccca

SEQ ID NO: 3289548 - DNA, 22 bp, Homo sapiens
cacccttcccctccttctccct

SEQ ID NO: 3289549 - DNA, 15 bp, Homo sapiens
cacccttctttcctc

SEQ ID NO: 3289550 - DNA, 16 bp, Homo sapiens
cacccttctttcctct

SEQ ID NO: 3289551 - DNA, 20 bp, Homo sapiens
cacccttctttcctcttccc

SEQ ID NO: 3289552 - DNA, 21 bp, Homo sapiens
cacccttctttcctcttcccc

SEQ ID NO: 3289553 - DNA, 19 bp, Homo sapiens
cacccttggacaagacaaa

SEQ ID NO: 3289554 - DNA, 15 bp, Homo sapiens
cacccttggcctgtc

SEQ ID NO: 3289555 - DNA, 23 bp, Homo sapiens
cacccttggcctgtctcatcccc

SEQ ID NO: 3289556 - DNA, 21 bp, Homo sapiens
caccctttccggcacactgcc

SEQ ID NO: 3289557 - DNA, 22 bp, Homo sapiens
caccctttccggcacactgcca

SEQ ID NO: 3289558 - DNA, 18 bp, Homo sapiens
caccgacgcgtctcctgt

SEQ ID NO: 3289559 - DNA, 19 bp, Homo sapiens
caccgacgcgtctcctgtt

SEQ ID NO: 3289560 - DNA, 22 bp, Homo sapiens
caccgagtgatttccatctctg

SEQ ID NO: 3289561 - DNA, 13 bp, Homo sapiens
caccgcagtcgtc

SEQ ID NO: 3289562 - DNA, 16 bp, Homo sapiens
caccgccacgtcccag

SEQ ID NO: 3289563 - DNA, 12 bp, Homo sapiens
caccgcccccac

SEQ ID NO: 3289564 - DNA, 14 bp, Homo sapiens
caccgcccccaccc

SEQ ID NO: 3289565 - DNA, 22 bp, Homo sapiens
caccgccgactttgtacccccc

SEQ ID NO: 3289566 - DNA, 18 bp, Homo sapiens
caccgccgccaccagccc

SEQ ID NO: 3289567 - DNA, 22 bp, Homo sapiens
caccgcctctggccgccacccc

SEQ ID NO: 3289568 - DNA, 20 bp, Homo sapiens
caccgctgggtggttttttc

SEQ ID NO: 3289569 - DNA, 19 bp, Homo sapiens
caccgcttttgttctcgca

SEQ ID NO: 3289570 - DNA, 18 bp, Homo sapiens
caccggccgatggagaca

SEQ ID NO: 3289571 - DNA, 22 bp, Homo sapiens
caccgggcactcagaagacact

SEQ ID NO: 3289572 - DNA, 15 bp, Homo sapiens
caccgggccacagag

SEQ ID NO: 3289573 - DNA, 20 bp, Homo sapiens
caccggggacaggccgcagc

SEQ ID NO: 3289574 - DNA, 15 bp, Homo sapiens
caccggtcagtgcct

SEQ ID NO: 3289575 - DNA, 16 bp, Homo sapiens
caccggtcagtgcctt

SEQ ID NO: 3289576 - DNA, 18 bp, Homo sapiens
caccggtcagtgcctttt

SEQ ID NO: 3289577 - DNA, 15 bp, Homo sapiens
caccggtccagctgg

SEQ ID NO: 3289578 - DNA, 16 bp, Homo sapiens
caccgtccgccctgct

SEQ ID NO: 3289579 - DNA, 19 bp, Homo sapiens
caccgtccgccctgctcct

SEQ ID NO: 3289580 - DNA, 13 bp, Homo sapiens
caccgtcttcctt

SEQ ID NO: 3289581 - DNA, 16 bp, Homo sapiens
caccgtgatggagagg

SEQ ID NO: 3289582 - DNA, 21 bp, Homo sapiens
caccgtgatggagaggacaga

SEQ ID NO: 3289583 - DNA, 14 bp, Homo sapiens
caccgtgcagagct

SEQ ID NO: 3289584 - DNA, 23 bp, Homo sapiens
caccgtgcagagctgcacttggc

SEQ ID NO: 3289585 - DNA, 22 bp, Homo sapiens
caccgtgctgtcttctggtctg

SEQ ID NO: 3289586 - DNA, 21 bp, Homo sapiens
caccgtttgtcccccggggca

SEQ ID NO: 3289587 - DNA, 12 bp, Homo sapiens
cacctaactctt

SEQ ID NO: 3289588 - DNA, 21 bp, Homo sapiens
cacctaactcttttctatttt

SEQ ID NO: 3289589 - DNA, 20 bp, Homo sapiens
cacctaatgtttatgagcca

SEQ ID NO: 3289590 - DNA, 21 bp, Homo sapiens
cacctaatgtttatgagccag

SEQ ID NO: 3289591 - DNA, 22 bp, Homo sapiens
cacctaattcgatgaaggctgc

SEQ ID NO: 3289592 - DNA, 23 bp, Homo sapiens
cacctaattcgatgaaggctgcc

SEQ ID NO: 3289593 - DNA, 17 bp, Homo sapiens
cacctaccatcagggac

SEQ ID NO: 3289594 - DNA, 14 bp, Homo sapiens
cacctagagccaga

SEQ ID NO: 3289595 - DNA, 20 bp, Homo sapiens
cacctagcaattccatcacc

SEQ ID NO: 3289596 - DNA, 16 bp, Homo sapiens
cacctagctttattct

SEQ ID NO: 3289597 - DNA, 16 bp, Homo sapiens
cacctatagtcccagc

SEQ ID NO: 3289598 - DNA, 18 bp, Homo sapiens
cacctatctcgtgggaga

SEQ ID NO: 3289599 - DNA, 21 bp, Homo sapiens
cacctatctcgtgggagagcc

SEQ ID NO: 3289600 - DNA, 15 bp, Homo sapiens
cacctatgttatttt

SEQ ID NO: 3289601 - DNA, 14 bp, Homo sapiens
cacctcactcctgt

SEQ ID NO: 3289602 - DNA, 15 bp, Homo sapiens
cacctcactcctgtt

SEQ ID NO: 3289603 - DNA, 12 bp, Homo sapiens
cacctcagcctc

SEQ ID NO: 3289604 - DNA, 16 bp, Homo sapiens
cacctcagcctcccaa

SEQ ID NO: 3289605 - DNA, 15 bp, Homo sapiens
cacctcaggccaggt

SEQ ID NO: 3289606 - DNA, 11 bp, Homo sapiens
cacctcagggc

SEQ ID NO: 3289607 - DNA, 13 bp, Homo sapiens
cacctcagggcac

SEQ ID NO: 3289608 - DNA, 18 bp, Homo sapiens
cacctcagttcccttggc

SEQ ID NO: 3289609 - DNA, 21 bp, Homo sapiens
cacctcagttcccttggcctc

SEQ ID NO: 3289610 - DNA, 16 bp, Homo sapiens
cacctcatgcccaccc

SEQ ID NO: 3289611 - DNA, 18 bp, Homo sapiens
cacctcatgcccaccccc

SEQ ID NO: 3289612 - DNA, 20 bp, Homo sapiens
cacctccacagttcagtggc

SEQ ID NO: 3289613 - DNA, 12 bp, Homo sapiens
cacctccaccca

SEQ ID NO: 3289614 - DNA, 13 bp, Homo sapiens
cacctccacctgt

SEQ ID NO: 3289615 - DNA, 14 bp, Homo sapiens
cacctccacctgtg

SEQ ID NO: 3289616 - DNA, 17 bp, Homo sapiens
cacctccagcccgggag

SEQ ID NO: 3289617 - DNA, 18 bp, Homo sapiens
cacctccaggcctgttgc

SEQ ID NO: 3289618 - DNA, 13 bp, Homo sapiens
cacctccagtccc

SEQ ID NO: 3289619 - DNA, 17 bp, Homo sapiens
cacctccccacgccctc

SEQ ID NO: 3289620 - DNA, 14 bp, Homo sapiens
cacctccccagcat

SEQ ID NO: 3289621 - DNA, 16 bp, Homo sapiens
cacctccccagcattc

SEQ ID NO: 3289622 - DNA, 14 bp, Homo sapiens
cacctccctgccca

SEQ ID NO: 3289623 - DNA, 18 bp, Homo sapiens
cacctccctgctcagtgc

SEQ ID NO: 3289624 - DNA, 18 bp, Homo sapiens
cacctccgagacagtcca

SEQ ID NO: 3289625 - DNA, 19 bp, Homo sapiens
cacctccgagacagtccag

SEQ ID NO: 3289626 - DNA, 22 bp, Homo sapiens
cacctccgagacagtccagtgt

SEQ ID NO: 3289627 - DNA, 11 bp, Homo sapiens
cactcttaggc

SEQ ID NO: 3289628 - DNA, 19 bp, Homo sapiens
cactcttaggcactttggg

SEQ ID NO: 3289629 - DNA, 17 bp, Homo sapiens
cactcttattgcccacg

SEQ ID NO: 3289630 - DNA, 18 bp, Homo sapiens
cactcttattgcccacgc

SEQ ID NO: 3289631 - DNA, 22 bp, Homo sapiens
cactcttattgcccacgctgga

SEQ ID NO: 3289632 - DNA, 17 bp, Homo sapiens
cactcttcagtgactcc

SEQ ID NO: 3289633 - DNA, 23 bp, Homo sapiens
cactcttgaagaggaggccgcct

SEQ ID NO: 3289634 - DNA, 15 bp, Homo sapiens
cactctttaccttta

SEQ ID NO: 3289635 - DNA, 19 bp, Homo sapiens
cactctttacctttattga

SEQ ID NO: 3289636 - DNA, 23 bp, Homo sapiens
cactcttttgctttattccagaa

SEQ ID NO: 3289637 - DNA, 23 bp, Homo sapiens
cactgaaaaatctaagtgatata

SEQ ID NO: 3289638 - DNA, 11 bp, Homo sapiens
cactgaaacaa

SEQ ID NO: 3289639 - DNA, 23 bp, Homo sapiens
cactgaaacaaaaattgtcttta

SEQ ID NO: 3289640 - DNA, 13 bp, Homo sapiens
cactgaaaccaaa

SEQ ID NO: 3289641 - DNA, 14 bp, Homo sapiens
cactgaaaccaaaa

SEQ ID NO: 3289642 - DNA, 16 bp, Homo sapiens
cactgaaaccaaaaca

SEQ ID NO: 3289643 - DNA, 16 bp, Homo sapiens
cactgaaatgtttgga

SEQ ID NO: 3289644 - DNA, 15 bp, Homo sapiens
cactgaacaaactaa

SEQ ID NO: 3289645 - DNA, 22 bp, Homo sapiens
cactgaacaaactaaaggtgca

SEQ ID NO: 3289646 - DNA, 19 bp, Homo sapiens
cactgaagaaaccttcaga

SEQ ID NO: 3289647 - DNA, 11 bp, Homo sapiens
cactgaagacg

SEQ ID NO: 3289648 - DNA, 14 bp, Homo sapiens
cactgaagcctgcg

SEQ ID NO: 3289649 - DNA, 19 bp, Homo sapiens
cactgaagttaacagagac

SEQ ID NO: 3289650 - DNA, 17 bp, Homo sapiens
cactgaagtttttgaaa

SEQ ID NO: 3289651 - DNA, 13 bp, Homo sapiens
cactgaatattta

SEQ ID NO: 3289652 - DNA, 14 bp, Homo sapiens
cactgaatatttat

SEQ ID NO: 3289653 - DNA, 13 bp, Homo sapiens
cactgacacaaag

SEQ ID NO: 3289654 - DNA, 14 bp, Homo sapiens
cactgacacaaagg

SEQ ID NO: 3289655 - DNA, 17 bp, Homo sapiens
cactgacagcctcccac

SEQ ID NO: 3289656 - DNA, 20 bp, Homo sapiens
cactgacagcctcccacccc

SEQ ID NO: 3289657 - DNA, 14 bp, Homo sapiens
cactgacccttcca

SEQ ID NO: 3289658 - DNA, 15 bp, Homo sapiens
cactgactactggct

SEQ ID NO: 3289659 - DNA, 19 bp, Homo sapiens
cactgagagcgagatggga

SEQ ID NO: 3289660 - DNA, 17 bp, Homo sapiens
cactgagaggcctggag

SEQ ID NO: 3289661 - DNA, 16 bp, Homo sapiens
cactgagcccccccaa

SEQ ID NO: 3289662 - DNA, 14 bp, Homo sapiens
cactgagctcccca

SEQ ID NO: 3289663 - DNA, 15 bp, Homo sapiens
cactgagctccccag

SEQ ID NO: 3289664 - DNA, 18 bp, Homo sapiens
cactgagggccacactat

SEQ ID NO: 3289665 - DNA, 22 bp, Homo sapiens
cactgagtaccaggggctgggc

SEQ ID NO: 3289666 - DNA, 23 bp, Homo sapiens
cactgagtaccaggggctgggct

SEQ ID NO: 3289667 - DNA, 14 bp, Homo sapiens
cactgataagactg

SEQ ID NO: 3289668 - DNA, 19 bp, Homo sapiens
cactgatattttacctctt

SEQ ID NO: 3289669 - DNA, 14 bp, Homo sapiens
cactgatgcaagga

SEQ ID NO: 3289670 - DNA, 17 bp, Homo sapiens
cactgatgctgttctct

SEQ ID NO: 3289671 - DNA, 23 bp, Homo sapiens
cactgatgctgttctcttcttca

SEQ ID NO: 3289672 - DNA, 16 bp, Homo sapiens
cactgatgcttagatg

SEQ ID NO: 3289673 - DNA, 14 bp, Homo sapiens
cactgatgggcaac

SEQ ID NO: 3289674 - DNA, 19 bp, Homo sapiens
cactgatgttgtgttttta

SEQ ID NO: 3289675 - DNA, 21 bp, Homo sapiens
cactgatttcacaacagatca

SEQ ID NO: 3289676 - DNA, 15 bp, Homo sapiens
cactgattttgtaaa

SEQ ID NO: 3289677 - DNA, 16 bp, Homo sapiens
cactgcaacctccgcc

SEQ ID NO: 3289678 - DNA, 16 bp, Homo sapiens
cactgcaatcctgtct

SEQ ID NO: 3289679 - DNA, 19 bp, Homo sapiens
cactgcaatcctgtctttc

SEQ ID NO: 3289680 - DNA, 13 bp, Homo sapiens
cactgcacagagc

SEQ ID NO: 3289681 - DNA, 15 bp, Homo sapiens
cactgcacagagctc

SEQ ID NO: 3289682 - DNA, 23 bp, Homo sapiens
cactgcacagtgcatctcagccc

SEQ ID NO: 3289683 - DNA, 14 bp, Homo sapiens
cactgcactccagc

SEQ ID NO: 3289684 - DNA, 15 bp, Homo sapiens
cactgcactccagcc

SEQ ID NO: 3289685 - DNA, 16 bp, Homo sapiens
cactgcactccagcct

SEQ ID NO: 3289686 - DNA, 18 bp, Homo sapiens
cactgcactccagcctgg

SEQ ID NO: 3289687 - DNA, 16 bp, Homo sapiens
cactgcactgcatgca

SEQ ID NO: 3289688 - DNA, 14 bp, Homo sapiens
cactgcagcagaaa

SEQ ID NO: 3289689 - DNA, 12 bp, Homo sapiens
cactgcagccca

SEQ ID NO: 3289690 - DNA, 13 bp, Homo sapiens
cactgcagtgatg

SEQ ID NO: 3289691 - DNA, 13 bp, Homo sapiens
cactgcatgcaaa

SEQ ID NO: 3289692 - DNA, 17 bp, Homo sapiens
cactgccaaataaacag

SEQ ID NO: 3289693 - DNA, 19 bp, Homo sapiens
cactgccaaataaacagct

SEQ ID NO: 3289694 - DNA, 18 bp, Homo sapiens
cactgccactttgcacat

SEQ ID NO: 3289695 - DNA, 16 bp, Homo sapiens
cactgccagcagcagc

SEQ ID NO: 3289696 - DNA, 21 bp, Homo sapiens
cactgccagcagcagcaggtg

SEQ ID NO: 3289697 - DNA, 12 bp, Homo sapiens
cactgccaggca

SEQ ID NO: 3289698 - DNA, 14 bp, Homo sapiens
cactgccaggcacc

SEQ ID NO: 3289699 - DNA, 18 bp, Homo sapiens
cactgccaggcacctggc

SEQ ID NO: 3289700 - DNA, 20 bp, Homo sapiens
cactgccaggcacctggcct

SEQ ID NO: 3289701 - DNA, 13 bp, Homo sapiens
cactgccaggcca

SEQ ID NO: 3289702 - DNA, 14 bp, Homo sapiens
cactgccaggccag

SEQ ID NO: 3289703 - DNA, 16 bp, Homo sapiens
cactgccaggccagcc

SEQ ID NO: 3289704 - DNA, 20 bp, Homo sapiens
cactgccatcttagtttgga

SEQ ID NO: 3289705 - DNA, 22 bp, Homo sapiens
cactgccatcttagtttggatt

SEQ ID NO: 3289706 - DNA, 11 bp, Homo sapiens
cactgccatga

SEQ ID NO: 3289707 - DNA, 17 bp, Homo sapiens
cactgcccgagctggtg

SEQ ID NO: 3289708 - DNA, 18 bp, Homo sapiens
cactgcccgagctggtgc

SEQ ID NO: 3289709 - DNA, 19 bp, Homo sapiens
cactgcccgagctggtgca

SEQ ID NO: 3289710 - DNA, 13 bp, Homo sapiens
cactgccctgcct

SEQ ID NO: 3289711 - DNA, 16 bp, Homo sapiens
cactgccctgcctgcc

SEQ ID NO: 3289712 - DNA, 18 bp, Homo sapiens
cactgccctggcagcagc

SEQ ID NO: 3289713 - DNA, 14 bp, Homo sapiens
cactgccggcagga

SEQ ID NO: 3289714 - DNA, 12 bp, Homo sapiens
cactgcctcagg

SEQ ID NO: 3289715 - DNA, 13 bp, Homo sapiens
cactgcctctgcc

SEQ ID NO: 3289716 - DNA, 14 bp, Homo sapiens
cactgcctctgcct

SEQ ID NO: 3289717 - DNA, 16 bp, Homo sapiens
cactgcctcttcctcc

SEQ ID NO: 3289718 - DNA, 10 bp, Homo sapiens
cactgcctga

SEQ ID NO: 3289719 - DNA, 23 bp, Homo sapiens
cactgcctgtatactttagtatg

SEQ ID NO: 3289720 - DNA, 20 bp, Homo sapiens
cactgccttcgatacaccgg

SEQ ID NO: 3289721 - DNA, 22 bp, Homo sapiens
cactgccttcgatacaccgggc

SEQ ID NO: 3289722 - DNA, 21 bp, Homo sapiens
cactgccttctcctctctggg

SEQ ID NO: 3289723 - DNA, 17 bp, Homo sapiens
cactgcgggagctctgt

SEQ ID NO: 3289724 - DNA, 20 bp, Homo sapiens
cactgcgggagctctgtatg

SEQ ID NO: 3289725 - DNA, 19 bp, Homo sapiens
cactgctcaagaagacatg

SEQ ID NO: 3289726 - DNA, 22 bp, Homo sapiens
cactgctcaagaagacatggag

SEQ ID NO: 3289727 - DNA, 19 bp, Homo sapiens
cactgctccctgaagccag

SEQ ID NO: 3289728 - DNA, 22 bp, Homo sapiens
cactgctccctgaagccagcct

SEQ ID NO: 3289729 - DNA, 17 bp, Homo sapiens
cactgctcttaagaaac

SEQ ID NO: 3289730 - DNA, 12 bp, Homo sapiens
cactgctgcacc

SEQ ID NO: 3289731 - DNA, 20 bp, Homo sapiens
cactgctgcaccagagtgaa

SEQ ID NO: 3289732 - DNA, 12 bp, Homo sapiens
cactgctggctg

SEQ ID NO: 3289733 - DNA, 15 bp, Homo sapiens
cactgctggctgcct

SEQ ID NO: 3289734 - DNA, 16 bp, Homo sapiens
cactgctggctgcctt

SEQ ID NO: 3289735 - DNA, 21 bp, Homo sapiens
cactgctggctgccttagaac

SEQ ID NO: 3289736 - DNA, 16 bp, Homo sapiens
cactgctgtacccaga

SEQ ID NO: 3289737 - DNA, 20 bp, Homo sapiens
cactgctgtacccagatgcc

SEQ ID NO: 3289738 - DNA, 10 bp, Homo sapiens
cactgctgtc

SEQ ID NO: 3289739 - DNA, 16 bp, Homo sapiens
cactgctgttcctgct

SEQ ID NO: 3289740 - DNA, 21 bp, Homo sapiens
cactgctgttcctgctccatg

SEQ ID NO: 3289741 - DNA, 23 bp, Homo sapiens
cactgcttgatgaagcaaggaag

SEQ ID NO: 3289742 - DNA, 23 bp, Homo sapiens
cactggaaaggggagagcctgct

SEQ ID NO: 3289743 - DNA, 12 bp, Homo sapiens
cactggacagac

SEQ ID NO: 3289744 - DNA, 13 bp, Homo sapiens
cactggacagacc

SEQ ID NO: 3289745 - DNA, 20 bp, Homo sapiens
cactggacagacccaggtct

SEQ ID NO: 3289746 - DNA, 22 bp, Homo sapiens
cactggacagacccaggtcttc

SEQ ID NO: 3289747 - DNA, 16 bp, Homo sapiens
cactggaccactgggc

SEQ ID NO: 3289748 - DNA, 14 bp, Homo sapiens
cactggagcccagg

SEQ ID NO: 3289749 - DNA, 15 bp, Homo sapiens
cactggagcccagga

SEQ ID NO: 3289750 - DNA, 14 bp, Homo sapiens
cactggaggagcag

SEQ ID NO: 3289751 - DNA, 16 bp, Homo sapiens
cactggaggagcagct

SEQ ID NO: 3289752 - DNA, 20 bp, Homo sapiens
cactggaggttgaagccaag

SEQ ID NO: 3289753 - DNA, 18 bp, Homo sapiens
cactggagtgcagggagg

SEQ ID NO: 3289754 - DNA, 21 bp, Homo sapiens
cagacaaagtaattcctctca

SEQ ID NO: 3289755 - DNA, 18 bp, Homo sapiens
cagacaacaccttcctcc

SEQ ID NO: 3289756 - DNA, 21 bp, Homo sapiens
cagacaacaccttcctcctgc

SEQ ID NO: 3289757 - DNA, 18 bp, Homo sapiens
cagacaacagcccaggca

SEQ ID NO: 3289758 - DNA, 16 bp, Homo sapiens
cagacaacctcatcag

SEQ ID NO: 3289759 - DNA, 12 bp, Homo sapiens
cagacaagcagc

SEQ ID NO: 3289760 - DNA, 16 bp, Homo sapiens
cagacacaatatgtat

SEQ ID NO: 3289761 - DNA, 21 bp, Homo sapiens
cagacacacacacgcacgcac

SEQ ID NO: 3289762 - DNA, 15 bp, Homo sapiens
cagacacacagcctc

SEQ ID NO: 3289763 - DNA, 21 bp, Homo sapiens
cagacacaggcccggctccag

SEQ ID NO: 3289764 - DNA, 21 bp, Homo sapiens
cagacaccctcaacctcttct

SEQ ID NO: 3289765 - DNA, 15 bp, Homo sapiens
cagacacctggactg

SEQ ID NO: 3289766 - DNA, 16 bp, Homo sapiens
cagacacctggactga

SEQ ID NO: 3289767 - DNA, 19 bp, Homo sapiens
cagacacctggactgagcc

SEQ ID NO: 3289768 - DNA, 14 bp, Homo sapiens
cagacaccttggac

SEQ ID NO: 3289769 - DNA, 19 bp, Homo sapiens
cagacacgccttcccctca

SEQ ID NO: 3289770 - DNA, 21 bp, Homo sapiens
cagacactaagttatagtata

SEQ ID NO: 3289771 - DNA, 21 bp, Homo sapiens
cagacactgccgacatcagca

SEQ ID NO: 3289772 - DNA, 20 bp, Homo sapiens
cagacacttatttattggga

SEQ ID NO: 3289773 - DNA, 19 bp, Homo sapiens
cagacactttggaagtttg

SEQ ID NO: 3289774 - DNA, 14 bp, Homo sapiens
cagacagaaactgg

SEQ ID NO: 3289775 - DNA, 21 bp, Homo sapiens
cagacagaaactggattaaaa

SEQ ID NO: 3289776 - DNA, 23 bp, Homo sapiens
cagacagaacttgaatgtgtcag

SEQ ID NO: 3289777 - DNA, 13 bp, Homo sapiens
cagacagaagtct

SEQ ID NO: 3289778 - DNA, 14 bp, Homo sapiens
cagacagacacaca

SEQ ID NO: 3289779 - DNA, 16 bp, Homo sapiens
cagacagcacagggca

SEQ ID NO: 3289780 - DNA, 22 bp, Homo sapiens
cagacaggcaagcacctcctgc

SEQ ID NO: 3289781 - DNA, 23 bp, Homo sapiens
cagacaggcaagcacctcctgcc

SEQ ID NO: 3289782 - DNA, 22 bp, Homo sapiens
cagacaggctcttagcagcttc

SEQ ID NO: 3289783 - DNA, 20 bp, Homo sapiens
cagacagggtctgaaggact

SEQ ID NO: 3289784 - DNA, 11 bp, Homo sapiens
cagacataaag

SEQ ID NO: 3289785 - DNA, 13 bp, Homo sapiens
cagacataaagcc

SEQ ID NO: 3289786 - DNA, 18 bp, Homo sapiens
cagacatacgaaacacaa

SEQ ID NO: 3289787 - DNA, 18 bp, Homo sapiens
cagacatatgggatattc

SEQ ID NO: 3289788 - DNA, 19 bp, Homo sapiens
cagacatccatgtttgtaa

SEQ ID NO: 3289789 - DNA, 12 bp, Homo sapiens
cagacatgtttt

SEQ ID NO: 3289790 - DNA, 21 bp, Homo sapiens
cagaccaacgttactcagggc

SEQ ID NO: 3289791 - DNA, 23 bp, Homo sapiens
cagaccaacgttactcagggctc

SEQ ID NO: 3289792 - DNA, 20 bp, Homo sapiens
cagaccaaggcgagtttccc

SEQ ID NO: 3289793 - DNA, 16 bp, Homo sapiens
cagaccacattgcttt

SEQ ID NO: 3289794 - DNA, 16 bp, Homo sapiens
cagaccaccagccgcc

SEQ ID NO: 3289795 - DNA, 24 bp, Homo sapiens
cagaccacgcccgtcctgcctgtg

SEQ ID NO: 3289796 - DNA, 14 bp, Homo sapiens
cagaccacttgcca

SEQ ID NO: 3289797 - DNA, 17 bp, Homo sapiens
cagaccacttgccacgc

SEQ ID NO: 3289798 - DNA, 23 bp, Homo sapiens
cagaccatgaagtaaattatgta

SEQ ID NO: 3289799 - DNA, 23 bp, Homo sapiens
cagacccactcccaaagctcaga

SEQ ID NO: 3289800 - DNA, 14 bp, Homo sapiens
cagacccaggtctt

SEQ ID NO: 3289801 - DNA, 20 bp, Homo sapiens
cagacccaggtcttccagac

SEQ ID NO: 3289802 - DNA, 23 bp, Homo sapiens
cagacccaggtcttccagacctg

SEQ ID NO: 3289803 - DNA, 13 bp, Homo sapiens
cagaccccagggc

SEQ ID NO: 3289804 - DNA, 21 bp, Homo sapiens
cagacccctcccctcgtgtca

SEQ ID NO: 3289805 - DNA, 22 bp, Homo sapiens
cagacccctctggccaggatgg

SEQ ID NO: 3289806 - DNA, 14 bp, Homo sapiens
cagacccctgggag

SEQ ID NO: 3289807 - DNA, 16 bp, Homo sapiens
cagacccctgggagct

SEQ ID NO: 3289808 - DNA, 20 bp, Homo sapiens
cagacccctgggagcttccg

SEQ ID NO: 3289809 - DNA, 16 bp, Homo sapiens
cagacccggctgcgtg

SEQ ID NO: 3289810 - DNA, 12 bp, Homo sapiens
cagacctcccca

SEQ ID NO: 3289811 - DNA, 19 bp, Homo sapiens
cagacctccccagccccta

SEQ ID NO: 3289812 - DNA, 21 bp, Homo sapiens
cagacctccccagcccctagc

SEQ ID NO: 3289813 - DNA, 20 bp, Homo sapiens
cagacctgcttcctgaaata

SEQ ID NO: 3289814 - DNA, 13 bp, Homo sapiens
cagacctgctttt

SEQ ID NO: 3289815 - DNA, 14 bp, Homo sapiens
cagacctggagccc

SEQ ID NO: 3289816 - DNA, 17 bp, Homo sapiens
cagacctggagcccctg

SEQ ID NO: 3289817 - DNA, 18 bp, Homo sapiens
cagacctggagcccctgg

SEQ ID NO: 3289818 - DNA, 23 bp, Homo sapiens
cagacctggagcccctgggtggg

SEQ ID NO: 3289819 - DNA, 22 bp, Homo sapiens
cagaccttcggggcctgtctga

SEQ ID NO: 3289820 - DNA, 13 bp, Homo sapiens
cagacggcggcca

SEQ ID NO: 3289821 - DNA, 20 bp, Homo sapiens
cagacggcggccaggcacag

SEQ ID NO: 3289822 - DNA, 21 bp, Homo sapiens
cagacggcggccaggcacagg

SEQ ID NO: 3289823 - DNA, 20 bp, Homo sapiens
cagacgggcaagaagctgct

SEQ ID NO: 3289824 - DNA, 21 bp, Homo sapiens
cagacgggcaagaagctgctt

SEQ ID NO: 3289825 - DNA, 14 bp, Homo sapiens
cagacgggcacaga

SEQ ID NO: 3289826 - DNA, 17 bp, Homo sapiens
cagacgtaggggagggg

SEQ ID NO: 3289827 - DNA, 16 bp, Homo sapiens
cagacgtggtggctca

SEQ ID NO: 3289828 - DNA, 14 bp, Homo sapiens
cagactacacagga

SEQ ID NO: 3289829 - DNA, 16 bp, Homo sapiens
cagactacacaggatg

SEQ ID NO: 3289830 - DNA, 14 bp, Homo sapiens
cagactagatgtag

SEQ ID NO: 3289831 - DNA, 21 bp, Homo sapiens
cagactccgccctcctcgggc

SEQ ID NO: 3289832 - DNA, 18 bp, Homo sapiens
cagactcctcagatctga

SEQ ID NO: 3289833 - DNA, 21 bp, Homo sapiens
cagactctacagaggccatgg

SEQ ID NO: 3289834 - DNA, 23 bp, Homo sapiens
cagactctacagaggccatgggc

SEQ ID NO: 3289835 - DNA, 21 bp, Homo sapiens
cagactgcaggttggacccca

SEQ ID NO: 3289836 - DNA, 18 bp, Homo sapiens
cagactgcgatttgtccc

SEQ ID NO: 3289837 - DNA, 20 bp, Homo sapiens
cagactgcttccaattttct

SEQ ID NO: 3289838 - DNA, 17 bp, Homo sapiens
cagactggaagacactt

SEQ ID NO: 3289839 - DNA, 13 bp, Homo sapiens
cagactggaagca

SEQ ID NO: 3289840 - DNA, 14 bp, Homo sapiens
cagactggaagcac

SEQ ID NO: 3289841 - DNA, 17 bp, Homo sapiens
cagactggcaataaact

SEQ ID NO: 3289842 - DNA, 20 bp, Homo sapiens
cagactggcaataaactcct

SEQ ID NO: 3289843 - DNA, 18 bp, Homo sapiens
cagactggccgggcaggc

SEQ ID NO: 3289844 - DNA, 20 bp, Homo sapiens
cagactggccgggcaggcgt

SEQ ID NO: 3289845 - DNA, 20 bp, Homo sapiens
cagactggcggagaaggaga

SEQ ID NO: 3289846 - DNA, 21 bp, Homo sapiens
cagactggggcatcctgtgcc

SEQ ID NO: 3289847 - DNA, 22 bp, Homo sapiens
cagactggggcatcctgtgcca

SEQ ID NO: 3289848 - DNA, 20 bp, Homo sapiens
cagactgttttactgtttta

SEQ ID NO: 3289849 - DNA, 14 bp, Homo sapiens
cagacttaccagga

SEQ ID NO: 3289850 - DNA, 18 bp, Homo sapiens
cagacttaccaggaagca

SEQ ID NO: 3289851 - DNA, 20 bp, Homo sapiens
cagacttcccagctaggaag

SEQ ID NO: 3289852 - DNA, 20 bp, Homo sapiens
cagacttctccagacccacc

SEQ ID NO: 3289853 - DNA, 13 bp, Homo sapiens
cagacttgagaac

SEQ ID NO: 3289854 - DNA, 20 bp, Homo sapiens
cagacttgccaggctccctt

SEQ ID NO: 3289855 - DNA, 18 bp, Homo sapiens
cagactttagtgccctgc

SEQ ID NO: 3289856 - DNA, 20 bp, Homo sapiens
cagactttagtgccctgccc

SEQ ID NO: 3289857 - DNA, 15 bp, Homo sapiens
cagacttttgtacat

SEQ ID NO: 3289858 - DNA, 18 bp, Homo sapiens
cagagaaaaatgctcccc

SEQ ID NO: 3289859 - DNA, 20 bp, Homo sapiens
cagagaaaaatgctccccac

SEQ ID NO: 3289860 - DNA, 15 bp, Homo sapiens
cagagaaaagcaggc

SEQ ID NO: 3289861 - DNA, 15 bp, Homo sapiens
cagagaagataatgt

SEQ ID NO: 3289862 - DNA, 19 bp, Homo sapiens
cagagaagataatgttctt

SEQ ID NO: 3289863 - DNA, 13 bp, Homo sapiens
cagagaagctgga

SEQ ID NO: 3289864 - DNA, 18 bp, Homo sapiens
cagagaagctggacttct

SEQ ID NO: 3289865 - DNA, 21 bp, Homo sapiens
cagagaagggaagaaggggcc

SEQ ID NO: 3289866 - DNA, 11 bp, Homo sapiens
cagagaagggc

SEQ ID NO: 3289867 - DNA, 21 bp, Homo sapiens
cagagaagtttgtagccaggt

SEQ ID NO: 3289868 - DNA, 18 bp, Homo sapiens
cagagaatatcaagatga

SEQ ID NO: 3289869 - DNA, 15 bp, Homo sapiens
cagagaattctctta

SEQ ID NO: 3289870 - DNA, 15 bp, Homo sapiens
cagagaatttctacc

SEQ ID NO: 3289871 - DNA, 22 bp, Homo sapiens
cagagaatttctaccatttcag

SEQ ID NO: 3289872 - DNA, 22 bp, Homo sapiens
cagagacaggaagtcttcaggg

SEQ ID NO: 3289873 - DNA, 14 bp, Homo sapiens
cagagacaggccca

SEQ ID NO: 3289874 - DNA, 19 bp, Homo sapiens
cagagacattcctccgagc

SEQ ID NO: 3289875 - DNA, 19 bp, Homo sapiens
cagagaccctctgccacca

SEQ ID NO: 3289876 - DNA, 20 bp, Homo sapiens
cagagaccgtcctcacccct

SEQ ID NO: 3289877 - DNA, 13 bp, Homo sapiens
cagagacgcagga

SEQ ID NO: 3289878 - DNA, 14 bp, Homo sapiens
cagagacgcaggaa

SEQ ID NO: 3289879 - DNA, 12 bp, Homo sapiens
cagcacttccat

SEQ ID NO: 3289880 - DNA, 18 bp, Homo sapiens
cagcactttgggaggccg

SEQ ID NO: 3289881 - DNA, 22 bp, Homo sapiens
cagcactttgggaggctgaggc

SEQ ID NO: 3289882 - DNA, 23 bp, Homo sapiens
cagcactttgggaggctgaggcg

SEQ ID NO: 3289883 - DNA, 23 bp, Homo sapiens
cagcactttgggaggctgaggtg

SEQ ID NO: 3289884 - DNA, 12 bp, Homo sapiens
cagcagaaacac

SEQ ID NO: 3289885 - DNA, 14 bp, Homo sapiens
cagcagaaacacac

SEQ ID NO: 3289886 - DNA, 18 bp, Homo sapiens
cagcagaaacacacagtc

SEQ ID NO: 3289887 - DNA, 22 bp, Homo sapiens
cagcagaaacacacagtcacat

SEQ ID NO: 3289888 - DNA, 24 bp, Homo sapiens
cagcagaactgaagtgtgctgtga

SEQ ID NO: 3289889 - DNA, 14 bp, Homo sapiens
cagcagaggacagt

SEQ ID NO: 3289890 - DNA, 22 bp, Homo sapiens
cagcagaggacagtctggagaa

SEQ ID NO: 3289891 - DNA, 23 bp, Homo sapiens
cagcagagggggagtagccaagc

SEQ ID NO: 3289892 - DNA, 16 bp, Homo sapiens
cagcagagtgagcaag

SEQ ID NO: 3289893 - DNA, 24 bp, Homo sapiens
cagcagataacaatgcagcaaggc

SEQ ID NO: 3289894 - DNA, 14 bp, Homo sapiens
cagcagcaccaacc

SEQ ID NO: 3289895 - DNA, 13 bp, Homo sapiens
cagcagcagcagg

SEQ ID NO: 3289896 - DNA, 13 bp, Homo sapiens
cagcagcaggtga

SEQ ID NO: 3289897 - DNA, 18 bp, Homo sapiens
cagcagccatcataggaa

SEQ ID NO: 3289898 - DNA, 22 bp, Homo sapiens
cagcagccatcataggaaggga

SEQ ID NO: 3289899 - DNA, 12 bp, Homo sapiens
cagcagcccccc

SEQ ID NO: 3289900 - DNA, 15 bp, Homo sapiens
cagcagccccccagc

SEQ ID NO: 3289901 - DNA, 16 bp, Homo sapiens
cagcagccctaaggat

SEQ ID NO: 3289902 - DNA, 13 bp, Homo sapiens
cagcagccctcaa

SEQ ID NO: 3289903 - DNA, 18 bp, Homo sapiens
cagcagccctcaacaggc

SEQ ID NO: 3289904 - DNA, 21 bp, Homo sapiens
cagcagccctcaacaggccca

SEQ ID NO: 3289905 - DNA, 20 bp, Homo sapiens
cagcagcctgcgctcggcag

SEQ ID NO: 3289906 - DNA, 12 bp, Homo sapiens
cagcagcctgct

SEQ ID NO: 3289907 - DNA, 20 bp, Homo sapiens
cagcagcctgcttcccacct

SEQ ID NO: 3289908 - DNA, 22 bp, Homo sapiens
cagcagcctgcttcccacctcc

SEQ ID NO: 3289909 - DNA, 18 bp, Homo sapiens
cagcagctctgagccaga

SEQ ID NO: 3289910 - DNA, 22 bp, Homo sapiens
cagcagctctgagccagattac

SEQ ID NO: 3289911 - DNA, 22 bp, Homo sapiens
cagcagctgcgggtctgaagga

SEQ ID NO: 3289912 - DNA, 23 bp, Homo sapiens
cagcagctgcgggtctgaaggaa

SEQ ID NO: 3289913 - DNA, 23 bp, Homo sapiens
cagcaggacttgctaaagcactt

SEQ ID NO: 3289914 - DNA, 21 bp, Homo sapiens
cagcaggagagactgagcagc

SEQ ID NO: 3289915 - DNA, 15 bp, Homo sapiens
cagcagggaacaaaa

SEQ ID NO: 3289916 - DNA, 17 bp, Homo sapiens
cagcagggcctcaaagt

SEQ ID NO: 3289917 - DNA, 18 bp, Homo sapiens
cagcaggtgattggacca

SEQ ID NO: 3289918 - DNA, 23 bp, Homo sapiens
cagcaggtgattggaccaggcca

SEQ ID NO: 3289919 - DNA, 16 bp, Homo sapiens
cagcaggtgtggccaa

SEQ ID NO: 3289920 - DNA, 18 bp, Homo sapiens
cagcaggtgtggtggctc

SEQ ID NO: 3289921 - DNA, 19 bp, Homo sapiens
cagcagtacctataaagta

SEQ ID NO: 3289922 - DNA, 16 bp, Homo sapiens
cagcagtagtgagcca

SEQ ID NO: 3289923 - DNA, 21 bp, Homo sapiens
cagcagtcccagtattctcag

SEQ ID NO: 3289924 - DNA, 15 bp, Homo sapiens
cagcagtctccttca

SEQ ID NO: 3289925 - DNA, 14 bp, Homo sapiens
cagcagtgaccaca

SEQ ID NO: 3289926 - DNA, 13 bp, Homo sapiens
cagcagtgttccc

SEQ ID NO: 3289927 - DNA, 22 bp, Homo sapiens
cagcagtgttccccatctgggt

SEQ ID NO: 3289928 - DNA, 23 bp, Homo sapiens
cagcagttccggattggcttgtg

SEQ ID NO: 3289929 - DNA, 14 bp, Homo sapiens
cagcagttctgtta

SEQ ID NO: 3289930 - DNA, 19 bp, Homo sapiens
cagcatacattttctggtg

SEQ ID NO: 3289931 - DNA, 19 bp, Homo sapiens
cagcatccaccttggctct

SEQ ID NO: 3289932 - DNA, 16 bp, Homo sapiens
cagcatccagcctgtg

SEQ ID NO: 3289933 - DNA, 18 bp, Homo sapiens
cagcatccagcctgtgtg

SEQ ID NO: 3289934 - DNA, 12 bp, Homo sapiens
cagcatccctgg

SEQ ID NO: 3289935 - DNA, 12 bp, Homo sapiens
cagcatccgcag

SEQ ID NO: 3289936 - DNA, 15 bp, Homo sapiens
cagcatcctggcacc

SEQ ID NO: 3289937 - DNA, 16 bp, Homo sapiens
cagcatcctggcaccc

SEQ ID NO: 3289938 - DNA, 17 bp, Homo sapiens
cagcatcctggcacccg

SEQ ID NO: 3289939 - DNA, 22 bp, Homo sapiens
cagcatcgggagcacccagagc

SEQ ID NO: 3289940 - DNA, 23 bp, Homo sapiens
cagcatcgggagcacccagagca

SEQ ID NO: 3289941 - DNA, 16 bp, Homo sapiens
cagcatctcagcgcca

SEQ ID NO: 3289942 - DNA, 14 bp, Homo sapiens
cagcatcttctggt

SEQ ID NO: 3289943 - DNA, 20 bp, Homo sapiens
cagcatgaataaaacactca

SEQ ID NO: 3289944 - DNA, 22 bp, Homo sapiens
cagcatgaataaaacactcatc

SEQ ID NO: 3289945 - DNA, 22 bp, Homo sapiens
cagcatgaggacagaccacaga

SEQ ID NO: 3289946 - DNA, 13 bp, Homo sapiens
cagcatgattctt

SEQ ID NO: 3289947 - DNA, 15 bp, Homo sapiens
cagcatgccccttgg

SEQ ID NO: 3289948 - DNA, 17 bp, Homo sapiens
cagcatgccccttggct

SEQ ID NO: 3289949 - DNA, 15 bp, Homo sapiens
cagcatgcttcccag

SEQ ID NO: 3289950 - DNA, 18 bp, Homo sapiens
cagcatgcttcccagagg

SEQ ID NO: 3289951 - DNA, 21 bp, Homo sapiens
cagcatgcttcccagagggag

SEQ ID NO: 3289952 - DNA, 14 bp, Homo sapiens
cagcatgcttgggc

SEQ ID NO: 3289953 - DNA, 16 bp, Homo sapiens
cagcatggaaaaatgg

SEQ ID NO: 3289954 - DNA, 17 bp, Homo sapiens
cagcatggaaaaatggt

SEQ ID NO: 3289955 - DNA, 18 bp, Homo sapiens
cagcatggaaaaatggtt

SEQ ID NO: 3289956 - DNA, 13 bp, Homo sapiens
cagcatggaggag

SEQ ID NO: 3289957 - DNA, 21 bp, Homo sapiens
cagcatgtacggattttcagt

SEQ ID NO: 3289958 - DNA, 21 bp, Homo sapiens
cagcattaggcttttaagaaa

SEQ ID NO: 3289959 - DNA, 16 bp, Homo sapiens
cagcattccagacttc

SEQ ID NO: 3289960 - DNA, 16 bp, Homo sapiens
cagcattccagcccct

SEQ ID NO: 3289961 - DNA, 14 bp, Homo sapiens
cagcattccctccc

SEQ ID NO: 3289962 - DNA, 21 bp, Homo sapiens
cagcattcttagcctgtggca

SEQ ID NO: 3289963 - DNA, 19 bp, Homo sapiens
cagcattcttgtcacaata

SEQ ID NO: 3289964 - DNA, 20 bp, Homo sapiens
cagcattcttgtcacaataa

SEQ ID NO: 3289965 - DNA, 21 bp, Homo sapiens
cagcattcttgtcacaataaa

SEQ ID NO: 3289966 - DNA, 22 bp, Homo sapiens
cagcattcttgtcacaataaat

SEQ ID NO: 3289967 - DNA, 14 bp, Homo sapiens
cagcattgctggtt

SEQ ID NO: 3289968 - DNA, 16 bp, Homo sapiens
cagcattgtatatgtg

SEQ ID NO: 3289969 - DNA, 15 bp, Homo sapiens
cagcattgtctttgc

SEQ ID NO: 3289970 - DNA, 19 bp, Homo sapiens
cagcattgtctttgctgta

SEQ ID NO: 3289971 - DNA, 23 bp, Homo sapiens
cagcatttccacaccaagcagca

SEQ ID NO: 3289972 - DNA, 22 bp, Homo sapiens
cagccaaatgtaattgaataaa

SEQ ID NO: 3289973 - DNA, 22 bp, Homo sapiens
cagccaaatttaaaactgttgg

SEQ ID NO: 3289974 - DNA, 17 bp, Homo sapiens
cagccaactagcccctg

SEQ ID NO: 3289975 - DNA, 22 bp, Homo sapiens
cagccaactagcccctggggtg

SEQ ID NO: 3289976 - DNA, 17 bp, Homo sapiens
cagccaagacaaggagg

SEQ ID NO: 3289977 - DNA, 16 bp, Homo sapiens
cagccaagcacctcca

SEQ ID NO: 3289978 - DNA, 23 bp, Homo sapiens
cagccaaggccgaagctctggct

SEQ ID NO: 3289979 - DNA, 15 bp, Homo sapiens
cagccacagacccct

SEQ ID NO: 3289980 - DNA, 13 bp, Homo sapiens
cagccacatggcc

SEQ ID NO: 3289981 - DNA, 11 bp, Homo sapiens
cagccacccaa

SEQ ID NO: 3289982 - DNA, 21 bp, Homo sapiens
cagccacccaagcctgctggc

SEQ ID NO: 3289983 - DNA, 22 bp, Homo sapiens
cagccacccaagcctgctggct

SEQ ID NO: 3289984 - DNA, 16 bp, Homo sapiens
cagccaccgtttcttc

SEQ ID NO: 3289985 - DNA, 17 bp, Homo sapiens
cagccaccgtttcttcc

SEQ ID NO: 3289986 - DNA, 15 bp, Homo sapiens
cagccacgaccagcc

SEQ ID NO: 3289987 - DNA, 16 bp, Homo sapiens
cagccacgaccagccc

SEQ ID NO: 3289988 - DNA, 18 bp, Homo sapiens
cagccacgaccagcccct

SEQ ID NO: 3289989 - DNA, 17 bp, Homo sapiens
cagccacggccaggcca

SEQ ID NO: 3289990 - DNA, 21 bp, Homo sapiens
cagccacggccaggccagagg

SEQ ID NO: 3289991 - DNA, 22 bp, Homo sapiens
cagccacggccaggccagaggg

SEQ ID NO: 3289992 - DNA, 12 bp, Homo sapiens
cagccactggct

SEQ ID NO: 3289993 - DNA, 12 bp, Homo sapiens
cagccagagctg

SEQ ID NO: 3289994 - DNA, 13 bp, Homo sapiens
cagccagagctgg

SEQ ID NO: 3289995 - DNA, 16 bp, Homo sapiens
cagccagagctgggtg

SEQ ID NO: 3289996 - DNA, 20 bp, Homo sapiens
cagccagcaatgatgtccag

SEQ ID NO: 3289997 - DNA, 12 bp, Homo sapiens
cagccagcagag

SEQ ID NO: 3289998 - DNA, 15 bp, Homo sapiens
cagccagcagagggg

SEQ ID NO: 3289999 - DNA, 14 bp, Homo sapiens
cagccagccagtct

SEQ ID NO: 3290000 - DNA, 20 bp, Homo sapiens
cagccagcccatggccccca

SEQ ID NO: 3290001 - DNA, 19 bp, Homo sapiens
cagccagccgccctgggct

SEQ ID NO: 3290002 - DNA, 23 bp, Homo sapiens
cagccagccgccctgggctgtct

SEQ ID NO: 3290003 - DNA, 18 bp, Homo sapiens
cagccagccggtgcctgg

SEQ ID NO: 3290004 - DNA, 15 bp, Homo sapiens
cagctgagagccctg

SEQ ID NO: 3290005 - DNA, 16 bp, Homo sapiens
cagctgagagccctgc

SEQ ID NO: 3290006 - DNA, 11 bp, Homo sapiens
cagctgagccc

SEQ ID NO: 3290007 - DNA, 14 bp, Homo sapiens
cagctgagccctgg

SEQ ID NO: 3290008 - DNA, 22 bp, Homo sapiens
cagctgaggacacaccccacac

SEQ ID NO: 3290009 - DNA, 20 bp, Homo sapiens
cagctgatacttcatttaaa

SEQ ID NO: 3290010 - DNA, 16 bp, Homo sapiens
cagctgcacctgccag

SEQ ID NO: 3290011 - DNA, 18 bp, Homo sapiens
cagctgcacctgccagcc

SEQ ID NO: 3290012 - DNA, 22 bp, Homo sapiens
cagctgcacctgccagcctggc

SEQ ID NO: 3290013 - DNA, 18 bp, Homo sapiens
cagctgcagctgggcccc

SEQ ID NO: 3290014 - DNA, 19 bp, Homo sapiens
cagctgccccggcccctcc

SEQ ID NO: 3290015 - DNA, 18 bp, Homo sapiens
cagctgccgaccagagcc

SEQ ID NO: 3290016 - DNA, 12 bp, Homo sapiens
cagctgcctctg

SEQ ID NO: 3290017 - DNA, 17 bp, Homo sapiens
cagctgcctctgctccc

SEQ ID NO: 3290018 - DNA, 13 bp, Homo sapiens
cagctgcctggag

SEQ ID NO: 3290019 - DNA, 16 bp, Homo sapiens
cagctgcctggagagg

SEQ ID NO: 3290020 - DNA, 21 bp, Homo sapiens
cagctgcctggagagggtctc

SEQ ID NO: 3290021 - DNA, 21 bp, Homo sapiens
cagctgcctgtgcctgccatg

SEQ ID NO: 3290022 - DNA, 10 bp, Homo sapiens
cagctgcctt

SEQ ID NO: 3290023 - DNA, 18 bp, Homo sapiens
cagctgccttcctcatcc

SEQ ID NO: 3290024 - DNA, 17 bp, Homo sapiens
cagctgcgcttgctttt

SEQ ID NO: 3290025 - DNA, 14 bp, Homo sapiens
cagctgcgggtctg

SEQ ID NO: 3290026 - DNA, 19 bp, Homo sapiens
cagctgcggtccacccagg

SEQ ID NO: 3290027 - DNA, 21 bp, Homo sapiens
cagctgcggtccacccaggag

SEQ ID NO: 3290028 - DNA, 17 bp, Homo sapiens
cagctgctactactcct

SEQ ID NO: 3290029 - DNA, 22 bp, Homo sapiens
cagctgctatttattttcctaa

SEQ ID NO: 3290030 - DNA, 13 bp, Homo sapiens
cagctgctcagaa

SEQ ID NO: 3290031 - DNA, 14 bp, Homo sapiens
cagctgctcagaat

SEQ ID NO: 3290032 - DNA, 15 bp, Homo sapiens
cagctgctctgcccc

SEQ ID NO: 3290033 - DNA, 17 bp, Homo sapiens
cagctgctctgcccctt

SEQ ID NO: 3290034 - DNA, 21 bp, Homo sapiens
cagctgctctgccccttgggc

SEQ ID NO: 3290035 - DNA, 16 bp, Homo sapiens
cagctgctcttagtgc

SEQ ID NO: 3290036 - DNA, 14 bp, Homo sapiens
cagctgctttttgt

SEQ ID NO: 3290037 - DNA, 20 bp, Homo sapiens
cagctggaagtctacctgct

SEQ ID NO: 3290038 - DNA, 23 bp, Homo sapiens
cagctggaagtctacctgctgga

SEQ ID NO: 3290039 - DNA, 17 bp, Homo sapiens
cagctggactctgcatc

SEQ ID NO: 3290040 - DNA, 21 bp, Homo sapiens
cagctggatgagacttccaaa

SEQ ID NO: 3290041 - DNA, 13 bp, Homo sapiens
cagctggctgtat

SEQ ID NO: 3290042 - DNA, 16 bp, Homo sapiens
cagctgggaagccctt

SEQ ID NO: 3290043 - DNA, 17 bp, Homo sapiens
cagctgggaagcccttt

SEQ ID NO: 3290044 - DNA, 11 bp, Homo sapiens
cagctgggcaa

SEQ ID NO: 3290045 - DNA, 15 bp, Homo sapiens
cagctgggccccatg

SEQ ID NO: 3290046 - DNA, 22 bp, Homo sapiens
cagctgggccccatgctctgcc

SEQ ID NO: 3290047 - DNA, 18 bp, Homo sapiens
cagctggttactcagggt

SEQ ID NO: 3290048 - DNA, 19 bp, Homo sapiens
cagctgtaagaagagactg

SEQ ID NO: 3290049 - DNA, 22 bp, Homo sapiens
cagctgtaagaagagactggga

SEQ ID NO: 3290050 - DNA, 17 bp, Homo sapiens
cagctgtagccatggct

SEQ ID NO: 3290051 - DNA, 22 bp, Homo sapiens
cagctgtagccatggctcaggc

SEQ ID NO: 3290052 - DNA, 15 bp, Homo sapiens
cagctgtgagccttg

SEQ ID NO: 3290053 - DNA, 20 bp, Homo sapiens
cagctgtgctctggacaggc

SEQ ID NO: 3290054 - DNA, 16 bp, Homo sapiens
cagctgtggcagagtt

SEQ ID NO: 3290055 - DNA, 14 bp, Homo sapiens
cagctgtttgtcat

SEQ ID NO: 3290056 - DNA, 15 bp, Homo sapiens
cagctgtttgtcata

SEQ ID NO: 3290057 - DNA, 14 bp, Homo sapiens
cagcttaagcgttc

SEQ ID NO: 3290058 - DNA, 16 bp, Homo sapiens
cagcttatctctttta

SEQ ID NO: 3290059 - DNA, 15 bp, Homo sapiens
cagcttcaagtgcct

SEQ ID NO: 3290060 - DNA, 14 bp, Homo sapiens
cagcttcaccagag

SEQ ID NO: 3290061 - DNA, 16 bp, Homo sapiens
cagcttcaccagagca

SEQ ID NO: 3290062 - DNA, 17 bp, Homo sapiens
cagcttcaccctgtcaa

SEQ ID NO: 3290063 - DNA, 13 bp, Homo sapiens
cagcttcaggcac

SEQ ID NO: 3290064 - DNA, 22 bp, Homo sapiens
cagcttcaggcaccagcatcca

SEQ ID NO: 3290065 - DNA, 21 bp, Homo sapiens
cagcttcattatctgagttgc

SEQ ID NO: 3290066 - DNA, 23 bp, Homo sapiens
cagcttcattatctgagttgcat

SEQ ID NO: 3290067 - DNA, 18 bp, Homo sapiens
cagcttcatttcctgtgt

SEQ ID NO: 3290068 - DNA, 19 bp, Homo sapiens
cagcttcatttcctgtgtc

SEQ ID NO: 3290069 - DNA, 12 bp, Homo sapiens
cagcttcccagc

SEQ ID NO: 3290070 - DNA, 21 bp, Homo sapiens
cagcttcccagccatgcccag

SEQ ID NO: 3290071 - DNA, 15 bp, Homo sapiens
cagcttcctggtgta

SEQ ID NO: 3290072 - DNA, 20 bp, Homo sapiens
cagcttcggagggcccctgc

SEQ ID NO: 3290073 - DNA, 21 bp, Homo sapiens
cagcttcggagggcccctgcg

SEQ ID NO: 3290074 - DNA, 12 bp, Homo sapiens
cagcttctctgc

SEQ ID NO: 3290075 - DNA, 22 bp, Homo sapiens
cagcttctggtactctcctaga

SEQ ID NO: 3290076 - DNA, 14 bp, Homo sapiens
cagcttcttgcact

SEQ ID NO: 3290077 - DNA, 17 bp, Homo sapiens
cagcttcttttgtctcc

SEQ ID NO: 3290078 - DNA, 23 bp, Homo sapiens
cagcttgacctgaggctgtggtc

SEQ ID NO: 3290079 - DNA, 21 bp, Homo sapiens
cagcttgagccgggcccctgg

SEQ ID NO: 3290080 - DNA, 14 bp, Homo sapiens
cagcttgagggttg

SEQ ID NO: 3290081 - DNA, 19 bp, Homo sapiens
cagcttgagggttgggctg

SEQ ID NO: 3290082 - DNA, 12 bp, Homo sapiens
cagcttgccccg

SEQ ID NO: 3290083 - DNA, 13 bp, Homo sapiens
cagcttgccccgg

SEQ ID NO: 3290084 - DNA, 17 bp, Homo sapiens
cagcttggccctttcct

SEQ ID NO: 3290085 - DNA, 14 bp, Homo sapiens
cagcttgggagagc

SEQ ID NO: 3290086 - DNA, 18 bp, Homo sapiens
cagcttgggagagcccct

SEQ ID NO: 3290087 - DNA, 21 bp, Homo sapiens
cagcttgtaaatagctcaggt

SEQ ID NO: 3290088 - DNA, 15 bp, Homo sapiens
cagcttgtaggagct

SEQ ID NO: 3290089 - DNA, 16 bp, Homo sapiens
cagcttgtaggagctg

SEQ ID NO: 3290090 - DNA, 13 bp, Homo sapiens
cagctttaaacaa

SEQ ID NO: 3290091 - DNA, 19 bp, Homo sapiens
cagctttaaactcagggac

SEQ ID NO: 3290092 - DNA, 17 bp, Homo sapiens
cagctttcaagtgcctt

SEQ ID NO: 3290093 - DNA, 16 bp, Homo sapiens
cagctttcagggccat

SEQ ID NO: 3290094 - DNA, 17 bp, Homo sapiens
cagctttcatgattagc

SEQ ID NO: 3290095 - DNA, 23 bp, Homo sapiens
cagctttcttgctcccttcagcc

SEQ ID NO: 3290096 - DNA, 23 bp, Homo sapiens
cagctttgactttatctcctgct

SEQ ID NO: 3290097 - DNA, 16 bp, Homo sapiens
cagctttgagaagcct

SEQ ID NO: 3290098 - DNA, 18 bp, Homo sapiens
cagctttgagaagccttc

SEQ ID NO: 3290099 - DNA, 19 bp, Homo sapiens
cagctttgagaagccttca

SEQ ID NO: 3290100 - DNA, 17 bp, Homo sapiens
cagctttgatccctgac

SEQ ID NO: 3290101 - DNA, 22 bp, Homo sapiens
cagctttgcccaacaccagccc

SEQ ID NO: 3290102 - DNA, 16 bp, Homo sapiens
cagcttttcctccctt

SEQ ID NO: 3290103 - DNA, 16 bp, Homo sapiens
cagctttttattccct

SEQ ID NO: 3290104 - DNA, 22 bp, Homo sapiens
caggaaaaaaaattctgttgtt

SEQ ID NO: 3290105 - DNA, 23 bp, Homo sapiens
caggaaaaaaaattctgttgttc

SEQ ID NO: 3290106 - DNA, 19 bp, Homo sapiens
caggaaaagctgctgacag

SEQ ID NO: 3290107 - DNA, 13 bp, Homo sapiens
caggaaaccaaca

SEQ ID NO: 3290108 - DNA, 21 bp, Homo sapiens
caggaaactccacatctgcct

SEQ ID NO: 3290109 - DNA, 15 bp, Homo sapiens
caggaaagccctccc

SEQ ID NO: 3290110 - DNA, 19 bp, Homo sapiens
caggaaagccctccccctt

SEQ ID NO: 3290111 - DNA, 19 bp, Homo sapiens
caggaaagctcagctactg

SEQ ID NO: 3290112 - DNA, 18 bp, Homo sapiens
caggaaagtgttattttt

SEQ ID NO: 3290113 - DNA, 23 bp, Homo sapiens
caggaaatatatatgtgtgtgta

SEQ ID NO: 3290114 - DNA, 15 bp, Homo sapiens
caggaacaaacaggg

SEQ ID NO: 3290115 - DNA, 23 bp, Homo sapiens
caggaacagctatgggagcccca

SEQ ID NO: 3290116 - DNA, 14 bp, Homo sapiens
caggaacgagcact

SEQ ID NO: 3290117 - DNA, 15 bp, Homo sapiens
caggaacgagcactg

SEQ ID NO: 3290118 - DNA, 22 bp, Homo sapiens
caggaacgagcactggccagag

SEQ ID NO: 3290119 - DNA, 19 bp, Homo sapiens
caggaactagactgcctgg

SEQ ID NO: 3290120 - DNA, 12 bp, Homo sapiens
caggaactgggc

SEQ ID NO: 3290121 - DNA, 19 bp, Homo sapiens
caggaactgggctgggcct

SEQ ID NO: 3290122 - DNA, 17 bp, Homo sapiens
caggaagcaccccatgc

SEQ ID NO: 3290123 - DNA, 19 bp, Homo sapiens
caggaagcattcagagagc

SEQ ID NO: 3290124 - DNA, 22 bp, Homo sapiens
caggaagcattcagagagcagc

SEQ ID NO: 3290125 - DNA, 15 bp, Homo sapiens
caggaaggaaaacta

SEQ ID NO: 3290126 - DNA, 17 bp, Homo sapiens
caggaaggaaaactatg

SEQ ID NO: 3290127 - DNA, 15 bp, Homo sapiens
caggaaggacagact

SEQ ID NO: 3290128 - DNA, 12 bp, Homo sapiens
caggaaggagag

SEQ ID NO: 3290129 - DNA, 14 bp, Homo sapiens
caggaaggagagcc

SEQ ID NO: 3290130 - DNA, 21 bp, Homo sapiens
caggagttcaataaatgtctg

SEQ ID NO: 3290131 - DNA, 19 bp, Homo sapiens
caggagttggagaccaggc

SEQ ID NO: 3290132 - DNA, 24 bp, Homo sapiens
caggagtttgagacaagccctggc

SEQ ID NO: 3290133 - DNA, 20 bp, Homo sapiens
caggagtttgaggctgcagc

SEQ ID NO: 3290134 - DNA, 18 bp, Homo sapiens
caggataaactgaaaact

SEQ ID NO: 3290135 - DNA, 22 bp, Homo sapiens
caggataaggagactgaggctt

SEQ ID NO: 3290136 - DNA, 23 bp, Homo sapiens
caggatactctgtcagatgggaa

SEQ ID NO: 3290137 - DNA, 17 bp, Homo sapiens
caggatactggcacaga

SEQ ID NO: 3290138 - DNA, 20 bp, Homo sapiens
caggatactggcacagaggt

SEQ ID NO: 3290139 - DNA, 20 bp, Homo sapiens
caggatatccttatcagagc

SEQ ID NO: 3290140 - DNA, 22 bp, Homo sapiens
caggatatccttatcagagcta

SEQ ID NO: 3290141 - DNA, 13 bp, Homo sapiens
caggatattagtt

SEQ ID NO: 3290142 - DNA, 22 bp, Homo sapiens
caggatattagttaatgagcca

SEQ ID NO: 3290143 - DNA, 14 bp, Homo sapiens
caggatcagtctga

SEQ ID NO: 3290144 - DNA, 15 bp, Homo sapiens
caggatcatggtgta

SEQ ID NO: 3290145 - DNA, 15 bp, Homo sapiens
caggatccgctgcca

SEQ ID NO: 3290146 - DNA, 20 bp, Homo sapiens
caggatcctctcctttgaaa

SEQ ID NO: 3290147 - DNA, 16 bp, Homo sapiens
caggatctttgactga

SEQ ID NO: 3290148 - DNA, 15 bp, Homo sapiens
caggatgaacccagg

SEQ ID NO: 3290149 - DNA, 17 bp, Homo sapiens
caggatgaacccaggac

SEQ ID NO: 3290150 - DNA, 15 bp, Homo sapiens
caggatgaccctgcg

SEQ ID NO: 3290151 - DNA, 17 bp, Homo sapiens
caggatgacctggataa

SEQ ID NO: 3290152 - DNA, 16 bp, Homo sapiens
caggatgcacatttct

SEQ ID NO: 3290153 - DNA, 20 bp, Homo sapiens
caggatgcacatttctggat

SEQ ID NO: 3290154 - DNA, 15 bp, Homo sapiens
caggatgccagcccc

SEQ ID NO: 3290155 - DNA, 23 bp, Homo sapiens
caggatgccagcccctgcctggg

SEQ ID NO: 3290156 - DNA, 22 bp, Homo sapiens
caggatgcccagatgaactgac

SEQ ID NO: 3290157 - DNA, 13 bp, Homo sapiens
caggatgctgagc

SEQ ID NO: 3290158 - DNA, 14 bp, Homo sapiens
caggatgctgagct

SEQ ID NO: 3290159 - DNA, 15 bp, Homo sapiens
caggatgctgagctt

SEQ ID NO: 3290160 - DNA, 13 bp, Homo sapiens
caggatgctggcc

SEQ ID NO: 3290161 - DNA, 22 bp, Homo sapiens
caggatggaggggtggtcctga

SEQ ID NO: 3290162 - DNA, 18 bp, Homo sapiens
caggatgggggctggcct

SEQ ID NO: 3290163 - DNA, 22 bp, Homo sapiens
caggatggtctcgatctcctga

SEQ ID NO: 3290164 - DNA, 18 bp, Homo sapiens
caggattacagtgtagct

SEQ ID NO: 3290165 - DNA, 16 bp, Homo sapiens
caggattgatcattct

SEQ ID NO: 3290166 - DNA, 21 bp, Homo sapiens
caggcaaaaaagggacagcat

SEQ ID NO: 3290167 - DNA, 22 bp, Homo sapiens
caggcaacgcacaaaacagaaa

SEQ ID NO: 3290168 - DNA, 19 bp, Homo sapiens
caggcaacttcagtcctgg

SEQ ID NO: 3290169 - DNA, 22 bp, Homo sapiens
caggcaacttcagtcctgggag

SEQ ID NO: 3290170 - DNA, 16 bp, Homo sapiens
caggcaagcacctcct

SEQ ID NO: 3290171 - DNA, 18 bp, Homo sapiens
caggcaagcccctcagcc

SEQ ID NO: 3290172 - DNA, 19 bp, Homo sapiens
caggcaagcccctcagccc

SEQ ID NO: 3290173 - DNA, 22 bp, Homo sapiens
caggcaagcccctcagcccttg

SEQ ID NO: 3290174 - DNA, 21 bp, Homo sapiens
caggcaatgctggctgttggc

SEQ ID NO: 3290175 - DNA, 14 bp, Homo sapiens
caggcaatgctgta

SEQ ID NO: 3290176 - DNA, 12 bp, Homo sapiens
caggcaattccg

SEQ ID NO: 3290177 - DNA, 13 bp, Homo sapiens
caggcacacagct

SEQ ID NO: 3290178 - DNA, 23 bp, Homo sapiens
caggcacacagctactctcccca

SEQ ID NO: 3290179 - DNA, 13 bp, Homo sapiens
caggcacagggcc

SEQ ID NO: 3290180 - DNA, 15 bp, Homo sapiens
caggcacagggcccg

SEQ ID NO: 3290181 - DNA, 17 bp, Homo sapiens
caggcacagggcccgca

SEQ ID NO: 3290182 - DNA, 23 bp, Homo sapiens
caggcacagggcccgcagtgctg

SEQ ID NO: 3290183 - DNA, 16 bp, Homo sapiens
caggcaccagcatcca

SEQ ID NO: 3290184 - DNA, 20 bp, Homo sapiens
caggcacccggggccagaga

SEQ ID NO: 3290185 - DNA, 22 bp, Homo sapiens
caggcaccgccacgtcccagca

SEQ ID NO: 3290186 - DNA, 15 bp, Homo sapiens
caggcacctcttcct

SEQ ID NO: 3290187 - DNA, 14 bp, Homo sapiens
caggcacctggcct

SEQ ID NO: 3290188 - DNA, 19 bp, Homo sapiens
caggcacctggcctgctgg

SEQ ID NO: 3290189 - DNA, 16 bp, Homo sapiens
caggcacgggtggtcc

SEQ ID NO: 3290190 - DNA, 17 bp, Homo sapiens
caggcacgggtggtccc

SEQ ID NO: 3290191 - DNA, 14 bp, Homo sapiens
caggcacggtttgg

SEQ ID NO: 3290192 - DNA, 22 bp, Homo sapiens
caggcactagcctttggctctg

SEQ ID NO: 3290193 - DNA, 16 bp, Homo sapiens
caggcagactacacag

SEQ ID NO: 3290194 - DNA, 18 bp, Homo sapiens
caggcagatacaggaaaa

SEQ ID NO: 3290195 - DNA, 17 bp, Homo sapiens
caggcagatctgtgccc

SEQ ID NO: 3290196 - DNA, 21 bp, Homo sapiens
caggcagatctgtgccccatg

SEQ ID NO: 3290197 - DNA, 22 bp, Homo sapiens
caggcagatctgtgccccatgc

SEQ ID NO: 3290198 - DNA, 14 bp, Homo sapiens
caggcagcgccaag

SEQ ID NO: 3290199 - DNA, 19 bp, Homo sapiens
caggcagcgccaagtgcgt

SEQ ID NO: 3290200 - DNA, 18 bp, Homo sapiens
caggcagctggatgagac

SEQ ID NO: 3290201 - DNA, 13 bp, Homo sapiens
caggcaggaacaa

SEQ ID NO: 3290202 - DNA, 18 bp, Homo sapiens
caggcaggaagggcagga

SEQ ID NO: 3290203 - DNA, 19 bp, Homo sapiens
caggcaggaagggcaggaa

SEQ ID NO: 3290204 - DNA, 23 bp, Homo sapiens
caggcaggggtgggggtggaggc

SEQ ID NO: 3290205 - DNA, 12 bp, Homo sapiens
caggcaggtctt

SEQ ID NO: 3290206 - DNA, 13 bp, Homo sapiens
caggcaggtcttg

SEQ ID NO: 3290207 - DNA, 16 bp, Homo sapiens
caggcaggtgcctgga

SEQ ID NO: 3290208 - DNA, 16 bp, Homo sapiens
caggcagtcgggggct

SEQ ID NO: 3290209 - DNA, 23 bp, Homo sapiens
caggcagtcgggggctggcctag

SEQ ID NO: 3290210 - DNA, 24 bp, Homo sapiens
caggcagtcgggggctggcctagg

SEQ ID NO: 3290211 - DNA, 20 bp, Homo sapiens
caggcagtgtttaaaatgat

SEQ ID NO: 3290212 - DNA, 17 bp, Homo sapiens
caggcatagaggcttct

SEQ ID NO: 3290213 - DNA, 14 bp, Homo sapiens
caggcataggcctg

SEQ ID NO: 3290214 - DNA, 16 bp, Homo sapiens
caggcataggcctggg

SEQ ID NO: 3290215 - DNA, 19 bp, Homo sapiens
caggcataggcctgggtgc

SEQ ID NO: 3290216 - DNA, 14 bp, Homo sapiens
caggcatccggccc

SEQ ID NO: 3290217 - DNA, 13 bp, Homo sapiens
caggcatctcctt

SEQ ID NO: 3290218 - DNA, 16 bp, Homo sapiens
caggcatctccttggg

SEQ ID NO: 3290219 - DNA, 15 bp, Homo sapiens
caggcatgttctctg

SEQ ID NO: 3290220 - DNA, 19 bp, Homo sapiens
caggcatgttctctgagga

SEQ ID NO: 3290221 - DNA, 22 bp, Homo sapiens
caggccaaagagtctccagttt

SEQ ID NO: 3290222 - DNA, 19 bp, Homo sapiens
caggccaagagcagaggca

SEQ ID NO: 3290223 - DNA, 21 bp, Homo sapiens
caggccaagagcagaggcagc

SEQ ID NO: 3290224 - DNA, 11 bp, Homo sapiens
caggccacctc

SEQ ID NO: 3290225 - DNA, 19 bp, Homo sapiens
caggccacctccccagcat

SEQ ID NO: 3290226 - DNA, 20 bp, Homo sapiens
caggccacctccccagcatt

SEQ ID NO: 3290227 - DNA, 13 bp, Homo sapiens
caggccactgtgg

SEQ ID NO: 3290228 - DNA, 15 bp, Homo sapiens
caggccactgtggcc

SEQ ID NO: 3290229 - DNA, 23 bp, Homo sapiens
caggccactgtggccagagctgg

SEQ ID NO: 3290230 - DNA, 15 bp, Homo sapiens
caggccagcccagcc

SEQ ID NO: 3290231 - DNA, 16 bp, Homo sapiens
caggccagcccagcca

SEQ ID NO: 3290232 - DNA, 11 bp, Homo sapiens
caggccagcct

SEQ ID NO: 3290233 - DNA, 13 bp, Homo sapiens
caggccagcctcc

SEQ ID NO: 3290234 - DNA, 21 bp, Homo sapiens
caggccagcctccgagaggga

SEQ ID NO: 3290235 - DNA, 15 bp, Homo sapiens
caggccaggaccaca

SEQ ID NO: 3290236 - DNA, 23 bp, Homo sapiens
caggccaggaccacacagtcccc

SEQ ID NO: 3290237 - DNA, 16 bp, Homo sapiens
caggccaggtgcagtg

SEQ ID NO: 3290238 - DNA, 15 bp, Homo sapiens
caggccagtgtctgg

SEQ ID NO: 3290239 - DNA, 17 bp, Homo sapiens
caggccatgtgagccac

SEQ ID NO: 3290240 - DNA, 15 bp, Homo sapiens
caggcccaactgtga

SEQ ID NO: 3290241 - DNA, 22 bp, Homo sapiens
caggcccacagcgtgggaactc

SEQ ID NO: 3290242 - DNA, 10 bp, Homo sapiens
caggcccacc

SEQ ID NO: 3290243 - DNA, 13 bp, Homo sapiens
caggcccaccatc

SEQ ID NO: 3290244 - DNA, 15 bp, Homo sapiens
caggcccagagaagc

SEQ ID NO: 3290245 - DNA, 19 bp, Homo sapiens
caggcccagcattgctggt

SEQ ID NO: 3290246 - DNA, 20 bp, Homo sapiens
caggcccagcattgctggtt

SEQ ID NO: 3290247 - DNA, 13 bp, Homo sapiens
caggcccagccag

SEQ ID NO: 3290248 - DNA, 11 bp, Homo sapiens
caggcccagcg

SEQ ID NO: 3290249 - DNA, 20 bp, Homo sapiens
caggcccagcgcggccagcg

SEQ ID NO: 3290250 - DNA, 21 bp, Homo sapiens
caggcccagcgcggccagcgt

SEQ ID NO: 3290251 - DNA, 22 bp, Homo sapiens
caggcccagcgcggccagcgtc

SEQ ID NO: 3290252 - DNA, 14 bp, Homo sapiens
caggcccaggcaga

SEQ ID NO: 3290253 - DNA, 22 bp, Homo sapiens
caggcccaggcagagctgacgg

SEQ ID NO: 3290254 - DNA, 18 bp, Homo sapiens
caggcccagtgacaaaga

SEQ ID NO: 3290255 - DNA, 17 bp, Homo sapiens
cagtcacatgacctgat

SEQ ID NO: 3290256 - DNA, 23 bp, Homo sapiens
cagtcaccaccacccgaaatgcc

SEQ ID NO: 3290257 - DNA, 18 bp, Homo sapiens
cagtcactgccactttgc

SEQ ID NO: 3290258 - DNA, 22 bp, Homo sapiens
cagtcactgccactttgcacat

SEQ ID NO: 3290259 - DNA, 23 bp, Homo sapiens
cagtcactggaggttgaagccaa

SEQ ID NO: 3290260 - DNA, 19 bp, Homo sapiens
cagtcagaaaactttaaaa

SEQ ID NO: 3290261 - DNA, 15 bp, Homo sapiens
cagtcagatttttaa

SEQ ID NO: 3290262 - DNA, 23 bp, Homo sapiens
cagtcagttcccggagcacagcc

SEQ ID NO: 3290263 - DNA, 16 bp, Homo sapiens
cagtcatcatcagggc

SEQ ID NO: 3290264 - DNA, 17 bp, Homo sapiens
cagtcatcatcagggcc

SEQ ID NO: 3290265 - DNA, 13 bp, Homo sapiens
cagtcatgcataa

SEQ ID NO: 3290266 - DNA, 17 bp, Homo sapiens
cagtcatgcataaatat

SEQ ID NO: 3290267 - DNA, 18 bp, Homo sapiens
cagtcatgcataaatatg

SEQ ID NO: 3290268 - DNA, 19 bp, Homo sapiens
cagtcatgcataaatatgc

SEQ ID NO: 3290269 - DNA, 23 bp, Homo sapiens
cagtcatgcataaatatgcagtg

SEQ ID NO: 3290270 - DNA, 22 bp, Homo sapiens
cagtcattcagcagcaaatttt

SEQ ID NO: 3290271 - DNA, 12 bp, Homo sapiens
cagtcatttaaa

SEQ ID NO: 3290272 - DNA, 22 bp, Homo sapiens
cagtccaaatgtcctccagaag

SEQ ID NO: 3290273 - DNA, 23 bp, Homo sapiens
cagtccagtgtcacctctctcag

SEQ ID NO: 3290274 - DNA, 21 bp, Homo sapiens
cagtcccagacaattccattc

SEQ ID NO: 3290275 - DNA, 12 bp, Homo sapiens
cagtccccaccc

SEQ ID NO: 3290276 - DNA, 14 bp, Homo sapiens
cagtccccagccct

SEQ ID NO: 3290277 - DNA, 19 bp, Homo sapiens
cagtccccctatccttggc

SEQ ID NO: 3290278 - DNA, 21 bp, Homo sapiens
cagtccccctatccttggcac

SEQ ID NO: 3290279 - DNA, 23 bp, Homo sapiens
cagtccccctatccttggcacca

SEQ ID NO: 3290280 - DNA, 16 bp, Homo sapiens
cagtccccctgcccca

SEQ ID NO: 3290281 - DNA, 12 bp, Homo sapiens
cagtccccgagg

SEQ ID NO: 3290282 - DNA, 22 bp, Homo sapiens
cagtccccgaggagctgggccc

SEQ ID NO: 3290283 - DNA, 19 bp, Homo sapiens
cagtcccctcccatctggg

SEQ ID NO: 3290284 - DNA, 23 bp, Homo sapiens
cagtcctccactcgacccagaat

SEQ ID NO: 3290285 - DNA, 18 bp, Homo sapiens
cagtcctccagaccacca

SEQ ID NO: 3290286 - DNA, 21 bp, Homo sapiens
cagtcctccagaccaccagcc

SEQ ID NO: 3290287 - DNA, 12 bp, Homo sapiens
cagtcctcccct

SEQ ID NO: 3290288 - DNA, 18 bp, Homo sapiens
cagtcctcccctcacagc

SEQ ID NO: 3290289 - DNA, 21 bp, Homo sapiens
cagtcctcccctcacagcctc

SEQ ID NO: 3290290 - DNA, 22 bp, Homo sapiens
cagtcctcccctcacagcctct

SEQ ID NO: 3290291 - DNA, 14 bp, Homo sapiens
cagtcctcctggga

SEQ ID NO: 3290292 - DNA, 15 bp, Homo sapiens
cagtcctcctgggag

SEQ ID NO: 3290293 - DNA, 15 bp, Homo sapiens
cagtcctgaggagag

SEQ ID NO: 3290294 - DNA, 13 bp, Homo sapiens
cagtcctgcagga

SEQ ID NO: 3290295 - DNA, 19 bp, Homo sapiens
cagtcctgcctcagcctcc

SEQ ID NO: 3290296 - DNA, 16 bp, Homo sapiens
cagtcctgcctggcca

SEQ ID NO: 3290297 - DNA, 17 bp, Homo sapiens
cagtcctgcctggccag

SEQ ID NO: 3290298 - DNA, 13 bp, Homo sapiens
cagtcctgctcca

SEQ ID NO: 3290299 - DNA, 12 bp, Homo sapiens
cagtcctgggag

SEQ ID NO: 3290300 - DNA, 13 bp, Homo sapiens
cagtcctgggaga

SEQ ID NO: 3290301 - DNA, 21 bp, Homo sapiens
cagtcctttcccaccattcct

SEQ ID NO: 3290302 - DNA, 22 bp, Homo sapiens
cagtcgaccgcacttatggtaa

SEQ ID NO: 3290303 - DNA, 23 bp, Homo sapiens
cagtcgcaggatccgctgccacc

SEQ ID NO: 3290304 - DNA, 19 bp, Homo sapiens
cagtcgcgagcacatgttc

SEQ ID NO: 3290305 - DNA, 17 bp, Homo sapiens
cagtcgggggctggcct

SEQ ID NO: 3290306 - DNA, 17 bp, Homo sapiens
cagtcgtcgcacagtct

SEQ ID NO: 3290307 - DNA, 18 bp, Homo sapiens
cagtcgtcgcacagtctc

SEQ ID NO: 3290308 - DNA, 20 bp, Homo sapiens
cagtcgtcgcacagtctctc

SEQ ID NO: 3290309 - DNA, 13 bp, Homo sapiens
cagtcgtgcctgt

SEQ ID NO: 3290310 - DNA, 21 bp, Homo sapiens
cagtcgtggctttggcagtgt

SEQ ID NO: 3290311 - DNA, 20 bp, Homo sapiens
cagtcgtgtaattggcccaa

SEQ ID NO: 3290312 - DNA, 22 bp, Homo sapiens
cagtctatccacagagagtccc

SEQ ID NO: 3290313 - DNA, 21 bp, Homo sapiens
cagtctcaagaggcagagttc

SEQ ID NO: 3290314 - DNA, 13 bp, Homo sapiens
cagtctcaggagc

SEQ ID NO: 3290315 - DNA, 14 bp, Homo sapiens
cagtctcaggagca

SEQ ID NO: 3290316 - DNA, 13 bp, Homo sapiens
cagtctcccaggc

SEQ ID NO: 3290317 - DNA, 14 bp, Homo sapiens
cagtctcccaggcc

SEQ ID NO: 3290318 - DNA, 18 bp, Homo sapiens
cagtctcccaggccccct

SEQ ID NO: 3290319 - DNA, 20 bp, Homo sapiens
cagtctcccaggccccctgc

SEQ ID NO: 3290320 - DNA, 11 bp, Homo sapiens
cagtctccctt

SEQ ID NO: 3290321 - DNA, 14 bp, Homo sapiens
cagtctcctcactc

SEQ ID NO: 3290322 - DNA, 21 bp, Homo sapiens
cagtctctctctctctctccc

SEQ ID NO: 3290323 - DNA, 14 bp, Homo sapiens
cagtctctcttaaa

SEQ ID NO: 3290324 - DNA, 19 bp, Homo sapiens
cagtctctttaatcttcag

SEQ ID NO: 3290325 - DNA, 15 bp, Homo sapiens
cagtctctttctgta

SEQ ID NO: 3290326 - DNA, 17 bp, Homo sapiens
cagtctctttcttcctt

SEQ ID NO: 3290327 - DNA, 18 bp, Homo sapiens
cagtctctttcttccttt

SEQ ID NO: 3290328 - DNA, 21 bp, Homo sapiens
cagtctctttcttcctttcta

SEQ ID NO: 3290329 - DNA, 16 bp, Homo sapiens
cagtctgaatgctgcc

SEQ ID NO: 3290330 - DNA, 19 bp, Homo sapiens
cagtctgattcccaagctc

SEQ ID NO: 3290331 - DNA, 21 bp, Homo sapiens
cagtctgattcccaagctctg

SEQ ID NO: 3290332 - DNA, 22 bp, Homo sapiens
cagtctgattcccaagctctgc

SEQ ID NO: 3290333 - DNA, 20 bp, Homo sapiens
cagtctgcccacgcagagga

SEQ ID NO: 3290334 - DNA, 21 bp, Homo sapiens
cagtctgcccacgcagaggac

SEQ ID NO: 3290335 - DNA, 19 bp, Homo sapiens
cagtctggaatgcagtggt

SEQ ID NO: 3290336 - DNA, 18 bp, Homo sapiens
cagtctgtctactgtggt

SEQ ID NO: 3290337 - DNA, 16 bp, Homo sapiens
cagtcttccttgtctc

SEQ ID NO: 3290338 - DNA, 14 bp, Homo sapiens
cagtcttgcctagg

SEQ ID NO: 3290339 - DNA, 15 bp, Homo sapiens
cagtcttgcctaggc

SEQ ID NO: 3290340 - DNA, 17 bp, Homo sapiens
cagtctttaaaggccca

SEQ ID NO: 3290341 - DNA, 21 bp, Homo sapiens
cagtctttaaaggcccagccc

SEQ ID NO: 3290342 - DNA, 22 bp, Homo sapiens
cagtctttaaaggcccagcccc

SEQ ID NO: 3290343 - DNA, 14 bp, Homo sapiens
cagtctttttctgt

SEQ ID NO: 3290344 - DNA, 16 bp, Homo sapiens
cagtctttttctgttg

SEQ ID NO: 3290345 - DNA, 18 bp, Homo sapiens
cagtctttttctgttgta

SEQ ID NO: 3290346 - DNA, 19 bp, Homo sapiens
cagtctttttctgttgtaa

SEQ ID NO: 3290347 - DNA, 15 bp, Homo sapiens
cagtgaaaatgtaag

SEQ ID NO: 3290348 - DNA, 18 bp, Homo sapiens
cagtgaaaatgtaagctg

SEQ ID NO: 3290349 - DNA, 19 bp, Homo sapiens
cagtgaaacgcaattttac

SEQ ID NO: 3290350 - DNA, 13 bp, Homo sapiens
cagtgaaagaagc

SEQ ID NO: 3290351 - DNA, 14 bp, Homo sapiens
cagtgaaatgtgaa

SEQ ID NO: 3290352 - DNA, 15 bp, Homo sapiens
cagtgaaatgtgaag

SEQ ID NO: 3290353 - DNA, 16 bp, Homo sapiens
cagtgaatctgtttca

SEQ ID NO: 3290354 - DNA, 12 bp, Homo sapiens
cagtgaattgtc

SEQ ID NO: 3290355 - DNA, 14 bp, Homo sapiens
cagtgacaaaccat

SEQ ID NO: 3290356 - DNA, 22 bp, Homo sapiens
cagtgacaaagactcctctggg

SEQ ID NO: 3290357 - DNA, 19 bp, Homo sapiens
cagtgacacttcagagagc

SEQ ID NO: 3290358 - DNA, 22 bp, Homo sapiens
cagtgacacttcagagagctgg

SEQ ID NO: 3290359 - DNA, 19 bp, Homo sapiens
cagtgacatcaaagcctgg

SEQ ID NO: 3290360 - DNA, 15 bp, Homo sapiens
cagtgaccacttatt

SEQ ID NO: 3290361 - DNA, 17 bp, Homo sapiens
cagtgaccttttcttca

SEQ ID NO: 3290362 - DNA, 22 bp, Homo sapiens
cagtgacgtgcacctgtactca

SEQ ID NO: 3290363 - DNA, 17 bp, Homo sapiens
cagtgactcctgctggt

SEQ ID NO: 3290364 - DNA, 19 bp, Homo sapiens
cagtgactcctgctggtac

SEQ ID NO: 3290365 - DNA, 18 bp, Homo sapiens
cagtgactggcaggtgca

SEQ ID NO: 3290366 - DNA, 11 bp, Homo sapiens
cagtgactttg

SEQ ID NO: 3290367 - DNA, 22 bp, Homo sapiens
cagtgactttttctgagctttt

SEQ ID NO: 3290368 - DNA, 20 bp, Homo sapiens
cagtgagaaaaagctcctgt

SEQ ID NO: 3290369 - DNA, 19 bp, Homo sapiens
cagtgagacagtctggaaa

SEQ ID NO: 3290370 - DNA, 20 bp, Homo sapiens
cagtgagacagtctggaaag

SEQ ID NO: 3290371 - DNA, 21 bp, Homo sapiens
cagtgagacagtctggaaagt

SEQ ID NO: 3290372 - DNA, 18 bp, Homo sapiens
cagtgagattacagagga

SEQ ID NO: 3290373 - DNA, 20 bp, Homo sapiens
cagtgagattacagaggaag

SEQ ID NO: 3290374 - DNA, 17 bp, Homo sapiens
cagtgagcggagatcgc

SEQ ID NO: 3290375 - DNA, 13 bp, Homo sapiens
cagtgaggagggt

SEQ ID NO: 3290376 - DNA, 14 bp, Homo sapiens
cagtgaggagggtg

SEQ ID NO: 3290377 - DNA, 23 bp, Homo sapiens
cagtgagggtcttcttacatgca

SEQ ID NO: 3290378 - DNA, 22 bp, Homo sapiens
cagtgagtcgaggacagggagg

SEQ ID NO: 3290379 - DNA, 20 bp, Homo sapiens
cagtgagtgagcctggctct

SEQ ID NO: 3290380 - DNA, 18 bp, Homo sapiens
catagtaccaatcatttt

SEQ ID NO: 3290381 - DNA, 17 bp, Homo sapiens
catagtagtttttacag

SEQ ID NO: 3290382 - DNA, 17 bp, Homo sapiens
catagtatggtggctgg

SEQ ID NO: 3290383 - DNA, 19 bp, Homo sapiens
catagtatggtggctgggt

SEQ ID NO: 3290384 - DNA, 13 bp, Homo sapiens
catagtcccagct

SEQ ID NO: 3290385 - DNA, 21 bp, Homo sapiens
catagtgagacccctgtctcc

SEQ ID NO: 3290386 - DNA, 15 bp, Homo sapiens
catagtgagatccca

SEQ ID NO: 3290387 - DNA, 18 bp, Homo sapiens
catagtgatggttcccct

SEQ ID NO: 3290388 - DNA, 19 bp, Homo sapiens
catagtgatggttcccctg

SEQ ID NO: 3290389 - DNA, 22 bp, Homo sapiens
catagtggcttaaaacaacact

SEQ ID NO: 3290390 - DNA, 18 bp, Homo sapiens
catagttctgaggtccct

SEQ ID NO: 3290391 - DNA, 17 bp, Homo sapiens
catagtttgggtatttt

SEQ ID NO: 3290392 - DNA, 12 bp, Homo sapiens
catagtttttcc

SEQ ID NO: 3290393 - DNA, 15 bp, Homo sapiens
catagtttttcctgg

SEQ ID NO: 3290394 - DNA, 17 bp, Homo sapiens
catagtttttcctgggt

SEQ ID NO: 3290395 - DNA, 15 bp, Homo sapiens
catataaatatattt

SEQ ID NO: 3290396 - DNA, 15 bp, Homo sapiens
catataagtttgaag

SEQ ID NO: 3290397 - DNA, 15 bp, Homo sapiens
catatacctataatg

SEQ ID NO: 3290398 - DNA, 19 bp, Homo sapiens
catatacctataatgtgtg

SEQ ID NO: 3290399 - DNA, 20 bp, Homo sapiens
catatacctataatgtgtgt

SEQ ID NO: 3290400 - DNA, 23 bp, Homo sapiens
catatagcattgataatcttcag

SEQ ID NO: 3290401 - DNA, 18 bp, Homo sapiens
catataggtgatgtttgc

SEQ ID NO: 3290402 - DNA, 18 bp, Homo sapiens
catatagtcaatgtaaaa

SEQ ID NO: 3290403 - DNA, 19 bp, Homo sapiens
catatataacagatacatt

SEQ ID NO: 3290404 - DNA, 23 bp, Homo sapiens
catatatatgttttaagaggcag

SEQ ID NO: 3290405 - DNA, 16 bp, Homo sapiens
catatatcttatgtta

SEQ ID NO: 3290406 - DNA, 22 bp, Homo sapiens
catatcaattggcagtgacttt

SEQ ID NO: 3290407 - DNA, 16 bp, Homo sapiens
catatccaccacctcc

SEQ ID NO: 3290408 - DNA, 20 bp, Homo sapiens
catatcccctgtgccctgca

SEQ ID NO: 3290409 - DNA, 15 bp, Homo sapiens
catatcctgagccat

SEQ ID NO: 3290410 - DNA, 17 bp, Homo sapiens
catatcgctgacttcat

SEQ ID NO: 3290411 - DNA, 22 bp, Homo sapiens
catatcgctgacttcatggaat

SEQ ID NO: 3290412 - DNA, 24 bp, Homo sapiens
catatcttctatatctgaagagta

SEQ ID NO: 3290413 - DNA, 14 bp, Homo sapiens
catatcttgccttc

SEQ ID NO: 3290414 - DNA, 21 bp, Homo sapiens
catatcttgcgaatccaagct

SEQ ID NO: 3290415 - DNA, 23 bp, Homo sapiens
catatcttgcgaatccaagctcc

SEQ ID NO: 3290416 - DNA, 16 bp, Homo sapiens
catatctttattaatc

SEQ ID NO: 3290417 - DNA, 17 bp, Homo sapiens
catatgaattgtacaga

SEQ ID NO: 3290418 - DNA, 20 bp, Homo sapiens
catatgatttcactagaaaa

SEQ ID NO: 3290419 - DNA, 13 bp, Homo sapiens
catatgcagaaat

SEQ ID NO: 3290420 - DNA, 21 bp, Homo sapiens
catatgccaccccatgtgcct

SEQ ID NO: 3290421 - DNA, 21 bp, Homo sapiens
catatgcctgaccccttgctc

SEQ ID NO: 3290422 - DNA, 14 bp, Homo sapiens
catatgctccagga

SEQ ID NO: 3290423 - DNA, 13 bp, Homo sapiens
catatgctctgct

SEQ ID NO: 3290424 - DNA, 14 bp, Homo sapiens
catatgctctgctt

SEQ ID NO: 3290425 - DNA, 18 bp, Homo sapiens
catatggactctgcacat

SEQ ID NO: 3290426 - DNA, 20 bp, Homo sapiens
catatggattttctattgtt

SEQ ID NO: 3290427 - DNA, 22 bp, Homo sapiens
catatgggatattcccaagccg

SEQ ID NO: 3290428 - DNA, 19 bp, Homo sapiens
catatgtagactatataca

SEQ ID NO: 3290429 - DNA, 23 bp, Homo sapiens
catatgtagactatatacatgtg

SEQ ID NO: 3290430 - DNA, 17 bp, Homo sapiens
catatgtgttacttcaa

SEQ ID NO: 3290431 - DNA, 15 bp, Homo sapiens
catatgttacactaa

SEQ ID NO: 3290432 - DNA, 16 bp, Homo sapiens
catatgttgaatactt

SEQ ID NO: 3290433 - DNA, 17 bp, Homo sapiens
catatgttgaatacttt

SEQ ID NO: 3290434 - DNA, 14 bp, Homo sapiens
catattaagacagt

SEQ ID NO: 3290435 - DNA, 20 bp, Homo sapiens
catattaagacagtgtacaa

SEQ ID NO: 3290436 - DNA, 14 bp, Homo sapiens
catattatgcctga

SEQ ID NO: 3290437 - DNA, 14 bp, Homo sapiens
catattcaaagcag

SEQ ID NO: 3290438 - DNA, 21 bp, Homo sapiens
catattcaaagcagcagccac

SEQ ID NO: 3290439 - DNA, 15 bp, Homo sapiens
catattctaaaacca

SEQ ID NO: 3290440 - DNA, 21 bp, Homo sapiens
catattctattgtattatttg

SEQ ID NO: 3290441 - DNA, 16 bp, Homo sapiens
catattctgttggaag

SEQ ID NO: 3290442 - DNA, 17 bp, Homo sapiens
catattctgttggccag

SEQ ID NO: 3290443 - DNA, 16 bp, Homo sapiens
catattgaatgtttcc

SEQ ID NO: 3290444 - DNA, 14 bp, Homo sapiens
catattgatgaaaa

SEQ ID NO: 3290445 - DNA, 15 bp, Homo sapiens
catattgatgaaaag

SEQ ID NO: 3290446 - DNA, 19 bp, Homo sapiens
catattgcaggagacattt

SEQ ID NO: 3290447 - DNA, 17 bp, Homo sapiens
catattgctgagagaaa

SEQ ID NO: 3290448 - DNA, 14 bp, Homo sapiens
catattggtattca

SEQ ID NO: 3290449 - DNA, 13 bp, Homo sapiens
catattgtgccaa

SEQ ID NO: 3290450 - DNA, 21 bp, Homo sapiens
catattgtgccaatatgtatt

SEQ ID NO: 3290451 - DNA, 13 bp, Homo sapiens
catattgttgaaa

SEQ ID NO: 3290452 - DNA, 12 bp, Homo sapiens
catattgtttga

SEQ ID NO: 3290453 - DNA, 14 bp, Homo sapiens
catatttaaagaca

SEQ ID NO: 3290454 - DNA, 18 bp, Homo sapiens
catatttactctttctaa

SEQ ID NO: 3290455 - DNA, 14 bp, Homo sapiens
catatttacttctt

SEQ ID NO: 3290456 - DNA, 21 bp, Homo sapiens
catatttattgcattgctggt

SEQ ID NO: 3290457 - DNA, 17 bp, Homo sapiens
catatttcattttaaca

SEQ ID NO: 3290458 - DNA, 21 bp, Homo sapiens
catatttccccttggacactt

SEQ ID NO: 3290459 - DNA, 13 bp, Homo sapiens
catatttgaaaac

SEQ ID NO: 3290460 - DNA, 10 bp, Homo sapiens
catatttgag

SEQ ID NO: 3290461 - DNA, 15 bp, Homo sapiens
catatttgagactag

SEQ ID NO: 3290462 - DNA, 21 bp, Homo sapiens
catatttgccaataaagcttt

SEQ ID NO: 3290463 - DNA, 12 bp, Homo sapiens
catatttggaag

SEQ ID NO: 3290464 - DNA, 13 bp, Homo sapiens
catatttggaaga

SEQ ID NO: 3290465 - DNA, 21 bp, Homo sapiens
catatttgtggcccgtgcagc

SEQ ID NO: 3290466 - DNA, 18 bp, Homo sapiens
catattttattgtatttt

SEQ ID NO: 3290467 - DNA, 23 bp, Homo sapiens
catattttattgtattttgatga

SEQ ID NO: 3290468 - DNA, 16 bp, Homo sapiens
catattttcctttaga

SEQ ID NO: 3290469 - DNA, 20 bp, Homo sapiens
catattttgattattgtatt

SEQ ID NO: 3290470 - DNA, 13 bp, Homo sapiens
catattttgctgg

SEQ ID NO: 3290471 - DNA, 16 bp, Homo sapiens
catcaaaaagaaaaat

SEQ ID NO: 3290472 - DNA, 19 bp, Homo sapiens
catcaaacctactataaaa

SEQ ID NO: 3290473 - DNA, 18 bp, Homo sapiens
catcaaacctttgagtag

SEQ ID NO: 3290474 - DNA, 17 bp, Homo sapiens
catcaaagcctggccta

SEQ ID NO: 3290475 - DNA, 13 bp, Homo sapiens
catcaaataaatt

SEQ ID NO: 3290476 - DNA, 14 bp, Homo sapiens
catcaaataaattt

SEQ ID NO: 3290477 - DNA, 16 bp, Homo sapiens
catcaaataaatttct

SEQ ID NO: 3290478 - DNA, 17 bp, Homo sapiens
catcaagaaatactttc

SEQ ID NO: 3290479 - DNA, 20 bp, Homo sapiens
catcaagcaggaattatgtc

SEQ ID NO: 3290480 - DNA, 11 bp, Homo sapiens
catcaataaat

SEQ ID NO: 3290481 - DNA, 19 bp, Homo sapiens
catcaatatccctcttgta

SEQ ID NO: 3290482 - DNA, 21 bp, Homo sapiens
catcaatcctggtaaccaaat

SEQ ID NO: 3290483 - DNA, 15 bp, Homo sapiens
catcaatgtgacatt

SEQ ID NO: 3290484 - DNA, 11 bp, Homo sapiens
catcaattccc

SEQ ID NO: 3290485 - DNA, 14 bp, Homo sapiens
catcaattcccatt

SEQ ID NO: 3290486 - DNA, 19 bp, Homo sapiens
catcacactgggtggtggc

SEQ ID NO: 3290487 - DNA, 17 bp, Homo sapiens
catcacaggatgccagc

SEQ ID NO: 3290488 - DNA, 18 bp, Homo sapiens
catcacaggatgccagcc

SEQ ID NO: 3290489 - DNA, 19 bp, Homo sapiens
catcacaggatgccagccc

SEQ ID NO: 3290490 - DNA, 23 bp, Homo sapiens
catcacaggatgccagcccctgc

SEQ ID NO: 3290491 - DNA, 19 bp, Homo sapiens
catcaccaccgcctctggc

SEQ ID NO: 3290492 - DNA, 13 bp, Homo sapiens
catcaccgctggg

SEQ ID NO: 3290493 - DNA, 12 bp, Homo sapiens
catcacctcagg

SEQ ID NO: 3290494 - DNA, 13 bp, Homo sapiens
catcacctcaggc

SEQ ID NO: 3290495 - DNA, 13 bp, Homo sapiens
catcacctctgta

SEQ ID NO: 3290496 - DNA, 18 bp, Homo sapiens
catcacgtaccccactgg

SEQ ID NO: 3290497 - DNA, 19 bp, Homo sapiens
catcacgtaccccactggg

SEQ ID NO: 3290498 - DNA, 24 bp, Homo sapiens
catcacgtaccccactgggccagc

SEQ ID NO: 3290499 - DNA, 15 bp, Homo sapiens
catcactagaagaaa

SEQ ID NO: 3290500 - DNA, 23 bp, Homo sapiens
catcactagaagaaaagcccatt

SEQ ID NO: 3290501 - DNA, 16 bp, Homo sapiens
catcactatccatgca

SEQ ID NO: 3290502 - DNA, 13 bp, Homo sapiens
catcactcttgta

SEQ ID NO: 3290503 - DNA, 12 bp, Homo sapiens
catcactgtatc

SEQ ID NO: 3290504 - DNA, 12 bp, Homo sapiens
catcacttccct

SEQ ID NO: 3290505 - DNA, 19 bp, Homo sapiens
catcacttgtacaaaataa

SEQ ID NO: 3290506 - DNA, 17 bp, Homo sapiens
catgcagttcctggccc

SEQ ID NO: 3290507 - DNA, 12 bp, Homo sapiens
catgcataaata

SEQ ID NO: 3290508 - DNA, 19 bp, Homo sapiens
catgcataaatatgcagtg

SEQ ID NO: 3290509 - DNA, 22 bp, Homo sapiens
catgcataaatatgcagtgata

SEQ ID NO: 3290510 - DNA, 15 bp, Homo sapiens
catgcatactttatt

SEQ ID NO: 3290511 - DNA, 18 bp, Homo sapiens
catgcatagtcccagcta

SEQ ID NO: 3290512 - DNA, 17 bp, Homo sapiens
catgcatgtcctgtaaa

SEQ ID NO: 3290513 - DNA, 18 bp, Homo sapiens
catgcatgtcctgtaaag

SEQ ID NO: 3290514 - DNA, 11 bp, Homo sapiens
catgcattgtt

SEQ ID NO: 3290515 - DNA, 12 bp, Homo sapiens
catgcattgttg

SEQ ID NO: 3290516 - DNA, 16 bp, Homo sapiens
catgcattttcttgta

SEQ ID NO: 3290517 - DNA, 19 bp, Homo sapiens
catgccactacactccagc

SEQ ID NO: 3290518 - DNA, 13 bp, Homo sapiens
catgccactgcca

SEQ ID NO: 3290519 - DNA, 20 bp, Homo sapiens
catgccactgccaggcacct

SEQ ID NO: 3290520 - DNA, 21 bp, Homo sapiens
catgccagctacttcctcctc

SEQ ID NO: 3290521 - DNA, 13 bp, Homo sapiens
catgccaggaacc

SEQ ID NO: 3290522 - DNA, 14 bp, Homo sapiens
catgccagtatttt

SEQ ID NO: 3290523 - DNA, 19 bp, Homo sapiens
catgccagtatttttaaag

SEQ ID NO: 3290524 - DNA, 17 bp, Homo sapiens
catgccagtgacacttc

SEQ ID NO: 3290525 - DNA, 13 bp, Homo sapiens
catgcccaccccc

SEQ ID NO: 3290526 - DNA, 20 bp, Homo sapiens
catgcccaccccctgccctg

SEQ ID NO: 3290527 - DNA, 21 bp, Homo sapiens
catgcccaccccctgccctgc

SEQ ID NO: 3290528 - DNA, 21 bp, Homo sapiens
catgcccacctgcccatcaca

SEQ ID NO: 3290529 - DNA, 12 bp, Homo sapiens
catgcccaggac

SEQ ID NO: 3290530 - DNA, 12 bp, Homo sapiens
catgccccagtc

SEQ ID NO: 3290531 - DNA, 14 bp, Homo sapiens
catgccccctgcag

SEQ ID NO: 3290532 - DNA, 15 bp, Homo sapiens
catgccccctttcag

SEQ ID NO: 3290533 - DNA, 16 bp, Homo sapiens
catgccccggccacct

SEQ ID NO: 3290534 - DNA, 17 bp, Homo sapiens
catgccccggccacctc

SEQ ID NO: 3290535 - DNA, 13 bp, Homo sapiens
catgccccttggc

SEQ ID NO: 3290536 - DNA, 16 bp, Homo sapiens
catgccccttggctgg

SEQ ID NO: 3290537 - DNA, 17 bp, Homo sapiens
catgcccggtcccaccc

SEQ ID NO: 3290538 - DNA, 15 bp, Homo sapiens
catgccctcctggac

SEQ ID NO: 3290539 - DNA, 12 bp, Homo sapiens
catgcccttctg

SEQ ID NO: 3290540 - DNA, 23 bp, Homo sapiens
catgccgggcccctccatccacc

SEQ ID NO: 3290541 - DNA, 16 bp, Homo sapiens
catgcctcatgccaca

SEQ ID NO: 3290542 - DNA, 17 bp, Homo sapiens
catgcctcatgccacac

SEQ ID NO: 3290543 - DNA, 22 bp, Homo sapiens
catgcctctgatatgggactga

SEQ ID NO: 3290544 - DNA, 16 bp, Homo sapiens
catgcctctggaggcc

SEQ ID NO: 3290545 - DNA, 21 bp, Homo sapiens
catgcctctggaggcctctgg

SEQ ID NO: 3290546 - DNA, 15 bp, Homo sapiens
catgcctgagggtgg

SEQ ID NO: 3290547 - DNA, 17 bp, Homo sapiens
catgcctgtccagcctg

SEQ ID NO: 3290548 - DNA, 14 bp, Homo sapiens
catgcctgtctctg

SEQ ID NO: 3290549 - DNA, 14 bp, Homo sapiens
catgccttaaattt

SEQ ID NO: 3290550 - DNA, 23 bp, Homo sapiens
catgcgctcagggccatgctgag

SEQ ID NO: 3290551 - DNA, 17 bp, Homo sapiens
catgcgtgtttctgact

SEQ ID NO: 3290552 - DNA, 16 bp, Homo sapiens
catgctatctctgtgt

SEQ ID NO: 3290553 - DNA, 18 bp, Homo sapiens
catgctattcacaattat

SEQ ID NO: 3290554 - DNA, 18 bp, Homo sapiens
catgctcatctgctggtc

SEQ ID NO: 3290555 - DNA, 19 bp, Homo sapiens
catgctcatctgctggtcc

SEQ ID NO: 3290556 - DNA, 20 bp, Homo sapiens
catgctcctcactgcccgca

SEQ ID NO: 3290557 - DNA, 20 bp, Homo sapiens
catgctctcatatatatttt

SEQ ID NO: 3290558 - DNA, 19 bp, Homo sapiens
catgctctgccccaagccc

SEQ ID NO: 3290559 - DNA, 15 bp, Homo sapiens
catgctgaaaaatat

SEQ ID NO: 3290560 - DNA, 15 bp, Homo sapiens
catgctgaggcctgg

SEQ ID NO: 3290561 - DNA, 14 bp, Homo sapiens
catgctgagtctcc

SEQ ID NO: 3290562 - DNA, 19 bp, Homo sapiens
catgctgagtctcccaagg

SEQ ID NO: 3290563 - DNA, 13 bp, Homo sapiens
catgctgcagtgg

SEQ ID NO: 3290564 - DNA, 15 bp, Homo sapiens
catgctgcagtgggt

SEQ ID NO: 3290565 - DNA, 12 bp, Homo sapiens
catgctgctttg

SEQ ID NO: 3290566 - DNA, 21 bp, Homo sapiens
catgctgctttttggcacagt

SEQ ID NO: 3290567 - DNA, 18 bp, Homo sapiens
catgctggagggaggctg

SEQ ID NO: 3290568 - DNA, 20 bp, Homo sapiens
catgctgggaagacgcctga

SEQ ID NO: 3290569 - DNA, 14 bp, Homo sapiens
catgctgggccact

SEQ ID NO: 3290570 - DNA, 19 bp, Homo sapiens
catgctgggccactgggga

SEQ ID NO: 3290571 - DNA, 16 bp, Homo sapiens
catgctggtcagagac

SEQ ID NO: 3290572 - DNA, 13 bp, Homo sapiens
catgcttaaattt

SEQ ID NO: 3290573 - DNA, 14 bp, Homo sapiens
catgcttaaatttt

SEQ ID NO: 3290574 - DNA, 12 bp, Homo sapiens
catgcttagctt

SEQ ID NO: 3290575 - DNA, 16 bp, Homo sapiens
catgcttcacaatgtt

SEQ ID NO: 3290576 - DNA, 16 bp, Homo sapiens
catgcttcccagaggg

SEQ ID NO: 3290577 - DNA, 21 bp, Homo sapiens
catgcttcccagagggagcag

SEQ ID NO: 3290578 - DNA, 15 bp, Homo sapiens
catgcttgggctgac

SEQ ID NO: 3290579 - DNA, 23 bp, Homo sapiens
catgcttgggctgacccagcatc

SEQ ID NO: 3290580 - DNA, 22 bp, Homo sapiens
catgctttgctgctatgaaaat

SEQ ID NO: 3290581 - DNA, 15 bp, Homo sapiens
catgcttttctgcca

SEQ ID NO: 3290582 - DNA, 17 bp, Homo sapiens
catgcttttctgccact

SEQ ID NO: 3290583 - DNA, 15 bp, Homo sapiens
catggaaaaatggtt

SEQ ID NO: 3290584 - DNA, 16 bp, Homo sapiens
catggaaaaatggttg

SEQ ID NO: 3290585 - DNA, 23 bp, Homo sapiens
catggaaaaatggttgatggaaa

SEQ ID NO: 3290586 - DNA, 18 bp, Homo sapiens
catggaaacctgaaaaaa

SEQ ID NO: 3290587 - DNA, 18 bp, Homo sapiens
catggacatgatcttctt

SEQ ID NO: 3290588 - DNA, 21 bp, Homo sapiens
catggacccaagataaaagaa

SEQ ID NO: 3290589 - DNA, 16 bp, Homo sapiens
catggacctaacattc

SEQ ID NO: 3290590 - DNA, 22 bp, Homo sapiens
catggacttgtatatttgtaca

SEQ ID NO: 3290591 - DNA, 16 bp, Homo sapiens
catggagacgcatttc

SEQ ID NO: 3290592 - DNA, 16 bp, Homo sapiens
catggagactcctgcc

SEQ ID NO: 3290593 - DNA, 19 bp, Homo sapiens
catggagactcctgccctg

SEQ ID NO: 3290594 - DNA, 20 bp, Homo sapiens
catggagactcctgccctgt

SEQ ID NO: 3290595 - DNA, 10 bp, Homo sapiens
catggagcca

SEQ ID NO: 3290596 - DNA, 15 bp, Homo sapiens
catggagccccctct

SEQ ID NO: 3290597 - DNA, 19 bp, Homo sapiens
catggagccccctctgccg

SEQ ID NO: 3290598 - DNA, 15 bp, Homo sapiens
catggagctgggcta

SEQ ID NO: 3290599 - DNA, 19 bp, Homo sapiens
catggaggaggagggaggc

SEQ ID NO: 3290600 - DNA, 18 bp, Homo sapiens
catggaggccctcctgtg

SEQ ID NO: 3290601 - DNA, 17 bp, Homo sapiens
catggaggttctaaggc

SEQ ID NO: 3290602 - DNA, 22 bp, Homo sapiens
catggagtgtgtattgttccca

SEQ ID NO: 3290603 - DNA, 18 bp, Homo sapiens
catggatatagttttact

SEQ ID NO: 3290604 - DNA, 22 bp, Homo sapiens
catggatgcatttcaaatgtta

SEQ ID NO: 3290605 - DNA, 17 bp, Homo sapiens
catggatgcgaggacca

SEQ ID NO: 3290606 - DNA, 20 bp, Homo sapiens
catggatgcgaggaccactt

SEQ ID NO: 3290607 - DNA, 23 bp, Homo sapiens
catggattttggataaatcattt

SEQ ID NO: 3290608 - DNA, 12 bp, Homo sapiens
catggcaccagc

SEQ ID NO: 3290609 - DNA, 23 bp, Homo sapiens
catggcaccttcagactttgctt

SEQ ID NO: 3290610 - DNA, 14 bp, Homo sapiens
catggcaggctggg

SEQ ID NO: 3290611 - DNA, 17 bp, Homo sapiens
catggcaggctgggtga

SEQ ID NO: 3290612 - DNA, 17 bp, Homo sapiens
catggcatagccccggc

SEQ ID NO: 3290613 - DNA, 22 bp, Homo sapiens
catggccacttgggtcttccct

SEQ ID NO: 3290614 - DNA, 20 bp, Homo sapiens
catggccccatcccagttgg

SEQ ID NO: 3290615 - DNA, 12 bp, Homo sapiens
catggcccccaa

SEQ ID NO: 3290616 - DNA, 19 bp, Homo sapiens
catggcccccaataaaggc

SEQ ID NO: 3290617 - DNA, 21 bp, Homo sapiens
catggcccccaataaaggcag

SEQ ID NO: 3290618 - DNA, 14 bp, Homo sapiens
catggcccccaggg

SEQ ID NO: 3290619 - DNA, 18 bp, Homo sapiens
catggcccccaggggcag

SEQ ID NO: 3290620 - DNA, 19 bp, Homo sapiens
catggcccccaggggcagg

SEQ ID NO: 3290621 - DNA, 14 bp, Homo sapiens
catggccctggggt

SEQ ID NO: 3290622 - DNA, 14 bp, Homo sapiens
catggccctgtgct

SEQ ID NO: 3290623 - DNA, 17 bp, Homo sapiens
catggcctatgcacata

SEQ ID NO: 3290624 - DNA, 21 bp, Homo sapiens
catggcctattatattaaaat

SEQ ID NO: 3290625 - DNA, 19 bp, Homo sapiens
catggccttatgaggcagg

SEQ ID NO: 3290626 - DNA, 13 bp, Homo sapiens
catggcctttcta

SEQ ID NO: 3290627 - DNA, 21 bp, Homo sapiens
catggcctttctaataaactg

SEQ ID NO: 3290628 - DNA, 18 bp, Homo sapiens
catggcgtaatgggcctg

SEQ ID NO: 3290629 - DNA, 20 bp, Homo sapiens
catggcgtggaggaggaggg

SEQ ID NO: 3290630 - DNA, 18 bp, Homo sapiens
catggctaatttaacacc

SEQ ID NO: 3290631 - DNA, 15 bp, Homo sapiens
catggctcagagctt

SEQ ID NO: 3290632 - DNA, 23 bp, Homo sapiens
cattttcttattgcgctgctacc

SEQ ID NO: 3290633 - DNA, 12 bp, Homo sapiens
cattttgaagtg

SEQ ID NO: 3290634 - DNA, 14 bp, Homo sapiens
cattttgacctact

SEQ ID NO: 3290635 - DNA, 12 bp, Homo sapiens
cattttgcaaaa

SEQ ID NO: 3290636 - DNA, 15 bp, Homo sapiens
cattttgcagcagtg

SEQ ID NO: 3290637 - DNA, 20 bp, Homo sapiens
cattttgcagcagtgagtct

SEQ ID NO: 3290638 - DNA, 21 bp, Homo sapiens
cattttggcgctattacaaat

SEQ ID NO: 3290639 - DNA, 23 bp, Homo sapiens
cattttggtaagagacagaatgt

SEQ ID NO: 3290640 - DNA, 18 bp, Homo sapiens
cattttggtttatttttg

SEQ ID NO: 3290641 - DNA, 19 bp, Homo sapiens
cattttggtttatttttgt

SEQ ID NO: 3290642 - DNA, 15 bp, Homo sapiens
cattttgtgaatgga

SEQ ID NO: 3290643 - DNA, 21 bp, Homo sapiens
cattttgtgaatggattggat

SEQ ID NO: 3290644 - DNA, 17 bp, Homo sapiens
cattttgttatagaata

SEQ ID NO: 3290645 - DNA, 15 bp, Homo sapiens
cattttgttgtaaaa

SEQ ID NO: 3290646 - DNA, 22 bp, Homo sapiens
catttttaatattactgtcttt

SEQ ID NO: 3290647 - DNA, 19 bp, Homo sapiens
catttttaatgatctcgga

SEQ ID NO: 3290648 - DNA, 15 bp, Homo sapiens
catttttacaataaa

SEQ ID NO: 3290649 - DNA, 13 bp, Homo sapiens
catttttcattca

SEQ ID NO: 3290650 - DNA, 17 bp, Homo sapiens
catttttgatttatgca

SEQ ID NO: 3290651 - DNA, 20 bp, Homo sapiens
catttttgtacagtttgctg

SEQ ID NO: 3290652 - DNA, 20 bp, Homo sapiens
catttttgtactaactagca

SEQ ID NO: 3290653 - DNA, 18 bp, Homo sapiens
cattttttaaggaaacaa

SEQ ID NO: 3290654 - DNA, 23 bp, Homo sapiens
cattttttaatttacttgttttg

SEQ ID NO: 3290655 - DNA, 21 bp, Homo sapiens
cattttttttatattgcctta

SEQ ID NO: 3290656 - DNA, 21 bp, Homo sapiens
catttttttttcaatcaactt

SEQ ID NO: 3290657 - DNA, 22 bp, Homo sapiens
catttttttttcaatcaacttt

SEQ ID NO: 3290658 - DNA, 13 bp, Homo sapiens
ccaaaaaaaaaag

SEQ ID NO: 3290659 - DNA, 20 bp, Homo sapiens
ccaaaaaattctacaacaca

SEQ ID NO: 3290660 - DNA, 19 bp, Homo sapiens
ccaaaaagattttcagaaa

SEQ ID NO: 3290661 - DNA, 18 bp, Homo sapiens
ccaaaacatttctggaca

SEQ ID NO: 3290662 - DNA, 16 bp, Homo sapiens
ccaaaagattgctgaa

SEQ ID NO: 3290663 - DNA, 14 bp, Homo sapiens
ccaaaagcacttac

SEQ ID NO: 3290664 - DNA, 17 bp, Homo sapiens
ccaaaataccagagcct

SEQ ID NO: 3290665 - DNA, 23 bp, Homo sapiens
ccaaaatgtaggcttagtttgtg

SEQ ID NO: 3290666 - DNA, 21 bp, Homo sapiens
ccaaaatgttggtcattttat

SEQ ID NO: 3290667 - DNA, 14 bp, Homo sapiens
ccaaacaagcctta

SEQ ID NO: 3290668 - DNA, 19 bp, Homo sapiens
ccaaacaccttccagctcc

SEQ ID NO: 3290669 - DNA, 13 bp, Homo sapiens
ccaaacatcagac

SEQ ID NO: 3290670 - DNA, 15 bp, Homo sapiens
ccaaacatcagacct

SEQ ID NO: 3290671 - DNA, 13 bp, Homo sapiens
ccaaaccagcctt

SEQ ID NO: 3290672 - DNA, 12 bp, Homo sapiens
ccaaaccataaa

SEQ ID NO: 3290673 - DNA, 15 bp, Homo sapiens
ccaaacccagaaaga

SEQ ID NO: 3290674 - DNA, 13 bp, Homo sapiens
ccaaaccctaggt

SEQ ID NO: 3290675 - DNA, 14 bp, Homo sapiens
ccaaaccctcacaa

SEQ ID NO: 3290676 - DNA, 18 bp, Homo sapiens
ccaaacccttaactgaca

SEQ ID NO: 3290677 - DNA, 19 bp, Homo sapiens
ccaaacccttaactgacat

SEQ ID NO: 3290678 - DNA, 18 bp, Homo sapiens
ccaaacctacaagaacta

SEQ ID NO: 3290679 - DNA, 15 bp, Homo sapiens
ccaaacctgacagat

SEQ ID NO: 3290680 - DNA, 14 bp, Homo sapiens
ccaaacctgggacc

SEQ ID NO: 3290681 - DNA, 13 bp, Homo sapiens
ccaaacctggttc

SEQ ID NO: 3290682 - DNA, 13 bp, Homo sapiens
ccaaacctgtctt

SEQ ID NO: 3290683 - DNA, 22 bp, Homo sapiens
ccaaacgccctttcctcctcag

SEQ ID NO: 3290684 - DNA, 21 bp, Homo sapiens
ccaaactgttctgagaaggtg

SEQ ID NO: 3290685 - DNA, 18 bp, Homo sapiens
ccaaacttggatttttga

SEQ ID NO: 3290686 - DNA, 16 bp, Homo sapiens
ccaaacttgttcattt

SEQ ID NO: 3290687 - DNA, 18 bp, Homo sapiens
ccaaagaaacaagctgtg

SEQ ID NO: 3290688 - DNA, 12 bp, Homo sapiens
ccaaagaaagtt

SEQ ID NO: 3290689 - DNA, 17 bp, Homo sapiens
ccaaagaaatgaacatt

SEQ ID NO: 3290690 - DNA, 19 bp, Homo sapiens
ccaaagactgtactggcca

SEQ ID NO: 3290691 - DNA, 17 bp, Homo sapiens
ccaaagaggctgcccct

SEQ ID NO: 3290692 - DNA, 20 bp, Homo sapiens
ccaaagaggctgcccctctc

SEQ ID NO: 3290693 - DNA, 16 bp, Homo sapiens
ccaaagagggcttcct

SEQ ID NO: 3290694 - DNA, 17 bp, Homo sapiens
ccaaagagggcttcctc

SEQ ID NO: 3290695 - DNA, 15 bp, Homo sapiens
ccaaagataaggact

SEQ ID NO: 3290696 - DNA, 16 bp, Homo sapiens
ccaaagatgcagccgc

SEQ ID NO: 3290697 - DNA, 18 bp, Homo sapiens
ccaaagatgcagccgcct

SEQ ID NO: 3290698 - DNA, 23 bp, Homo sapiens
ccaaagcaatgtgagtcccagag

SEQ ID NO: 3290699 - DNA, 22 bp, Homo sapiens
ccaaagcacatgcttagcttat

SEQ ID NO: 3290700 - DNA, 20 bp, Homo sapiens
ccaaagccacctctgtcatt

SEQ ID NO: 3290701 - DNA, 13 bp, Homo sapiens
ccaaagccagtga

SEQ ID NO: 3290702 - DNA, 23 bp, Homo sapiens
ccaaagccccttgctctcccctg

SEQ ID NO: 3290703 - DNA, 13 bp, Homo sapiens
ccaaagccctggt

SEQ ID NO: 3290704 - DNA, 16 bp, Homo sapiens
ccaaagctaggcctgg

SEQ ID NO: 3290705 - DNA, 18 bp, Homo sapiens
ccaaagctagggtggccc

SEQ ID NO: 3290706 - DNA, 19 bp, Homo sapiens
ccaaagctagggtggccct

SEQ ID NO: 3290707 - DNA, 14 bp, Homo sapiens
ccaaaggaaggaac

SEQ ID NO: 3290708 - DNA, 20 bp, Homo sapiens
ccaaaggaataacctttctg

SEQ ID NO: 3290709 - DNA, 16 bp, Homo sapiens
ccaaaggaggctggca

SEQ ID NO: 3290710 - DNA, 18 bp, Homo sapiens
ccaaaggaggctggcagg

SEQ ID NO: 3290711 - DNA, 19 bp, Homo sapiens
ccaaaggatgtgatatata

SEQ ID NO: 3290712 - DNA, 21 bp, Homo sapiens
ccaaaggctggtggcaagtgc

SEQ ID NO: 3290713 - DNA, 15 bp, Homo sapiens
ccaaaggggctgctg

SEQ ID NO: 3290714 - DNA, 21 bp, Homo sapiens
ccaaagggtgaagctatttat

SEQ ID NO: 3290715 - DNA, 13 bp, Homo sapiens
ccaaagtattttt

SEQ ID NO: 3290716 - DNA, 14 bp, Homo sapiens
ccaaagtctccctt

SEQ ID NO: 3290717 - DNA, 15 bp, Homo sapiens
ccaaagtctctaatt

SEQ ID NO: 3290718 - DNA, 15 bp, Homo sapiens
ccaaagtgctgagat

SEQ ID NO: 3290719 - DNA, 12 bp, Homo sapiens
ccaaagttctaa

SEQ ID NO: 3290720 - DNA, 23 bp, Homo sapiens
ccaaagttgttgtaacctgctgt

SEQ ID NO: 3290721 - DNA, 11 bp, Homo sapiens
ccaaataaaaa

SEQ ID NO: 3290722 - DNA, 16 bp, Homo sapiens
ccaaataaaaactaaa

SEQ ID NO: 3290723 - DNA, 12 bp, Homo sapiens
ccaaataaacag

SEQ ID NO: 3290724 - DNA, 14 bp, Homo sapiens
ccaaataaacagct

SEQ ID NO: 3290725 - DNA, 18 bp, Homo sapiens
ccaaataacttcagtcct

SEQ ID NO: 3290726 - DNA, 17 bp, Homo sapiens
ccaaataagaaacctaa

SEQ ID NO: 3290727 - DNA, 13 bp, Homo sapiens
ccaaataataaag

SEQ ID NO: 3290728 - DNA, 16 bp, Homo sapiens
ccaaatacacatttca

SEQ ID NO: 3290729 - DNA, 17 bp, Homo sapiens
ccaaatacacatttcac

SEQ ID NO: 3290730 - DNA, 20 bp, Homo sapiens
ccaaatacacatttcacatt

SEQ ID NO: 3290731 - DNA, 13 bp, Homo sapiens
ccaaatatgtcct

SEQ ID NO: 3290732 - DNA, 15 bp, Homo sapiens
ccaaatatgtcctgg

SEQ ID NO: 3290733 - DNA, 20 bp, Homo sapiens
ccaaatcaataagaaggtag

SEQ ID NO: 3290734 - DNA, 15 bp, Homo sapiens
ccaaatcagctgcta

SEQ ID NO: 3290735 - DNA, 20 bp, Homo sapiens
ccaaatctcttgcttgtcat

SEQ ID NO: 3290736 - DNA, 14 bp, Homo sapiens
ccaaatctggaagc

SEQ ID NO: 3290737 - DNA, 19 bp, Homo sapiens
ccaaatcttgaatttctgc

SEQ ID NO: 3290738 - DNA, 17 bp, Homo sapiens
ccaaatgcacaagctca

SEQ ID NO: 3290739 - DNA, 21 bp, Homo sapiens
ccaaatgcagggaggggaggc

SEQ ID NO: 3290740 - DNA, 23 bp, Homo sapiens
ccaaatggttcttacttttcctg

SEQ ID NO: 3290741 - DNA, 13 bp, Homo sapiens
ccaaattagccag

SEQ ID NO: 3290742 - DNA, 12 bp, Homo sapiens
ccaaattatttg

SEQ ID NO: 3290743 - DNA, 13 bp, Homo sapiens
ccaaattcagttt

SEQ ID NO: 3290744 - DNA, 15 bp, Homo sapiens
ccaaattctttcagt

SEQ ID NO: 3290745 - DNA, 16 bp, Homo sapiens
ccaaattgcactgaag

SEQ ID NO: 3290746 - DNA, 11 bp, Homo sapiens
ccaaatttaaa

SEQ ID NO: 3290747 - DNA, 18 bp, Homo sapiens
ccaaatttaaaactgttg

SEQ ID NO: 3290748 - DNA, 20 bp, Homo sapiens
ccaaatttgattgatttgaa

SEQ ID NO: 3290749 - DNA, 21 bp, Homo sapiens
ccaaatttggctcacttgcct

SEQ ID NO: 3290750 - DNA, 23 bp, Homo sapiens
ccaaattttaatttttgctttta

SEQ ID NO: 3290751 - DNA, 13 bp, Homo sapiens
ccaacaaaccatc

SEQ ID NO: 3290752 - DNA, 22 bp, Homo sapiens
ccaacaaggttggcaccccagc

SEQ ID NO: 3290753 - DNA, 16 bp, Homo sapiens
ccaacaataaacagga

SEQ ID NO: 3290754 - DNA, 22 bp, Homo sapiens
ccaacaataaacaggaatttta

SEQ ID NO: 3290755 - DNA, 14 bp, Homo sapiens
ccaacacacacaac

SEQ ID NO: 3290756 - DNA, 15 bp, Homo sapiens
ccaacaccacagaca

SEQ ID NO: 3290757 - DNA, 18 bp, Homo sapiens
ccaacaccacagacacac

SEQ ID NO: 3290758 - DNA, 15 bp, Homo sapiens
ccacaatcccaccta

SEQ ID NO: 3290759 - DNA, 13 bp, Homo sapiens
ccacaatctggct

SEQ ID NO: 3290760 - DNA, 20 bp, Homo sapiens
ccacacaaagattttctaag

SEQ ID NO: 3290761 - DNA, 13 bp, Homo sapiens
ccacacagtcccc

SEQ ID NO: 3290762 - DNA, 19 bp, Homo sapiens
ccacacagtccccagactc

SEQ ID NO: 3290763 - DNA, 21 bp, Homo sapiens
ccacacagtccccagactcag

SEQ ID NO: 3290764 - DNA, 12 bp, Homo sapiens
ccacacccagcc

SEQ ID NO: 3290765 - DNA, 13 bp, Homo sapiens
ccacacccagccc

SEQ ID NO: 3290766 - DNA, 14 bp, Homo sapiens
ccacacccagcctc

SEQ ID NO: 3290767 - DNA, 17 bp, Homo sapiens
ccacacccagcctcagt

SEQ ID NO: 3290768 - DNA, 16 bp, Homo sapiens
ccacacccagctcagc

SEQ ID NO: 3290769 - DNA, 16 bp, Homo sapiens
ccacaccccagcccac

SEQ ID NO: 3290770 - DNA, 11 bp, Homo sapiens
ccacaccctcc

SEQ ID NO: 3290771 - DNA, 18 bp, Homo sapiens
ccacaccgcagggacaag

SEQ ID NO: 3290772 - DNA, 16 bp, Homo sapiens
ccacaccgtcttcctt

SEQ ID NO: 3290773 - DNA, 17 bp, Homo sapiens
ccacaccgtcttccttc

SEQ ID NO: 3290774 - DNA, 17 bp, Homo sapiens
ccacacctccacagttc

SEQ ID NO: 3290775 - DNA, 23 bp, Homo sapiens
ccacacctccacagttcagtggc

SEQ ID NO: 3290776 - DNA, 13 bp, Homo sapiens
ccacacctccacc

SEQ ID NO: 3290777 - DNA, 14 bp, Homo sapiens
ccacacctccaccg

SEQ ID NO: 3290778 - DNA, 14 bp, Homo sapiens
ccacacctccctac

SEQ ID NO: 3290779 - DNA, 15 bp, Homo sapiens
ccacacctccctact

SEQ ID NO: 3290780 - DNA, 14 bp, Homo sapiens
ccacacctggcctt

SEQ ID NO: 3290781 - DNA, 16 bp, Homo sapiens
ccacaccttccagggc

SEQ ID NO: 3290782 - DNA, 22 bp, Homo sapiens
ccacaccttccagggccctagg

SEQ ID NO: 3290783 - DNA, 18 bp, Homo sapiens
ccacacgattagctttat

SEQ ID NO: 3290784 - DNA, 23 bp, Homo sapiens
ccacacggactcccgggccacgc

SEQ ID NO: 3290785 - DNA, 15 bp, Homo sapiens
ccacactacacagca

SEQ ID NO: 3290786 - DNA, 17 bp, Homo sapiens
ccacactatgcacagag

SEQ ID NO: 3290787 - DNA, 20 bp, Homo sapiens
ccacactatgcacagagccc

SEQ ID NO: 3290788 - DNA, 21 bp, Homo sapiens
ccacactatgcacagagccca

SEQ ID NO: 3290789 - DNA, 16 bp, Homo sapiens
ccacacttcaggctct

SEQ ID NO: 3290790 - DNA, 20 bp, Homo sapiens
ccacacttcaggctcttctc

SEQ ID NO: 3290791 - DNA, 22 bp, Homo sapiens
ccacacttcaggctcttctcct

SEQ ID NO: 3290792 - DNA, 16 bp, Homo sapiens
ccacacttgaaacctt

SEQ ID NO: 3290793 - DNA, 13 bp, Homo sapiens
ccacacttgctgg

SEQ ID NO: 3290794 - DNA, 17 bp, Homo sapiens
ccacacttgctggggct

SEQ ID NO: 3290795 - DNA, 21 bp, Homo sapiens
ccacacttgttccagctcttt

SEQ ID NO: 3290796 - DNA, 22 bp, Homo sapiens
ccacactttgggacttgggagc

SEQ ID NO: 3290797 - DNA, 20 bp, Homo sapiens
ccacagaagacttcccagct

SEQ ID NO: 3290798 - DNA, 15 bp, Homo sapiens
ccacagacacacaca

SEQ ID NO: 3290799 - DNA, 19 bp, Homo sapiens
ccacagactccggcctgta

SEQ ID NO: 3290800 - DNA, 16 bp, Homo sapiens
ccacagactggttttg

SEQ ID NO: 3290801 - DNA, 17 bp, Homo sapiens
ccacagagtgctggact

SEQ ID NO: 3290802 - DNA, 22 bp, Homo sapiens
ccacagataccagacctcttct

SEQ ID NO: 3290803 - DNA, 14 bp, Homo sapiens
ccacagatatcttt

SEQ ID NO: 3290804 - DNA, 20 bp, Homo sapiens
ccacagcacagctccctgcc

SEQ ID NO: 3290805 - DNA, 15 bp, Homo sapiens
ccacagccagcacct

SEQ ID NO: 3290806 - DNA, 17 bp, Homo sapiens
ccacagccagcacctgg

SEQ ID NO: 3290807 - DNA, 16 bp, Homo sapiens
ccacagcctctggctc

SEQ ID NO: 3290808 - DNA, 17 bp, Homo sapiens
ccacagcctctggctcc

SEQ ID NO: 3290809 - DNA, 19 bp, Homo sapiens
ccacagcctctggctccac

SEQ ID NO: 3290810 - DNA, 19 bp, Homo sapiens
ccacagccttcggacagac

SEQ ID NO: 3290811 - DNA, 15 bp, Homo sapiens
ccacagcgagggcag

SEQ ID NO: 3290812 - DNA, 18 bp, Homo sapiens
ccacagcgagggcagctg

SEQ ID NO: 3290813 - DNA, 20 bp, Homo sapiens
ccacagcgagggcagctgct

SEQ ID NO: 3290814 - DNA, 12 bp, Homo sapiens
ccacagcgtccc

SEQ ID NO: 3290815 - DNA, 16 bp, Homo sapiens
ccacagcgtccctggc

SEQ ID NO: 3290816 - DNA, 21 bp, Homo sapiens
ccacagcgtccctggcgcagg

SEQ ID NO: 3290817 - DNA, 16 bp, Homo sapiens
ccacagctgagaatgt

SEQ ID NO: 3290818 - DNA, 13 bp, Homo sapiens
ccacagcttttgc

SEQ ID NO: 3290819 - DNA, 15 bp, Homo sapiens
ccacagcttttgcaa

SEQ ID NO: 3290820 - DNA, 23 bp, Homo sapiens
ccacaggaagcctgcagtcctgg

SEQ ID NO: 3290821 - DNA, 22 bp, Homo sapiens
ccacaggaggcaagcaagctct

SEQ ID NO: 3290822 - DNA, 20 bp, Homo sapiens
ccacaggagtgggaaaacac

SEQ ID NO: 3290823 - DNA, 17 bp, Homo sapiens
ccacaggcaaaactcag

SEQ ID NO: 3290824 - DNA, 19 bp, Homo sapiens
ccacaggcacacaggtctc

SEQ ID NO: 3290825 - DNA, 15 bp, Homo sapiens
ccacaggcccttcct

SEQ ID NO: 3290826 - DNA, 19 bp, Homo sapiens
ccacaggcccttcctctcc

SEQ ID NO: 3290827 - DNA, 15 bp, Homo sapiens
ccacaggcctccctg

SEQ ID NO: 3290828 - DNA, 16 bp, Homo sapiens
ccacaggcctccctgt

SEQ ID NO: 3290829 - DNA, 18 bp, Homo sapiens
ccacaggcctccctgttt

SEQ ID NO: 3290830 - DNA, 16 bp, Homo sapiens
ccacaggctagatccc

SEQ ID NO: 3290831 - DNA, 12 bp, Homo sapiens
ccacagggccag

SEQ ID NO: 3290832 - DNA, 20 bp, Homo sapiens
ccacagggccagagggagct

SEQ ID NO: 3290833 - DNA, 17 bp, Homo sapiens
ccacaggggcaggcctg

SEQ ID NO: 3290834 - DNA, 19 bp, Homo sapiens
ccacaggttttagcattgt

SEQ ID NO: 3290835 - DNA, 14 bp, Homo sapiens
ccacagtcaaagaa

SEQ ID NO: 3290836 - DNA, 16 bp, Homo sapiens
ccacagtcaaagaagg

SEQ ID NO: 3290837 - DNA, 14 bp, Homo sapiens
ccacagtgaaagtt

SEQ ID NO: 3290838 - DNA, 14 bp, Homo sapiens
ccacagtgctgctt

SEQ ID NO: 3290839 - DNA, 14 bp, Homo sapiens
ccacagtgggtggc

SEQ ID NO: 3290840 - DNA, 19 bp, Homo sapiens
ccacagtgggtggcacctc

SEQ ID NO: 3290841 - DNA, 22 bp, Homo sapiens
ccacagtgggtggcacctcctg

SEQ ID NO: 3290842 - DNA, 15 bp, Homo sapiens
ccacagttcagtggc

SEQ ID NO: 3290843 - DNA, 16 bp, Homo sapiens
ccacagttgccaccac

SEQ ID NO: 3290844 - DNA, 23 bp, Homo sapiens
ccacagttgccaccacctctgtg

SEQ ID NO: 3290845 - DNA, 21 bp, Homo sapiens
ccacagttgtgttcatgctga

SEQ ID NO: 3290846 - DNA, 24 bp, Homo sapiens
ccacagttttagttggtgctgatg

SEQ ID NO: 3290847 - DNA, 14 bp, Homo sapiens
ccacatcaaacctt

SEQ ID NO: 3290848 - DNA, 18 bp, Homo sapiens
ccacatccaactccagca

SEQ ID NO: 3290849 - DNA, 12 bp, Homo sapiens
ccacatcccagc

SEQ ID NO: 3290850 - DNA, 14 bp, Homo sapiens
ccacatcccagcag

SEQ ID NO: 3290851 - DNA, 19 bp, Homo sapiens
ccacatcctccgtccagcc

SEQ ID NO: 3290852 - DNA, 16 bp, Homo sapiens
ccacatctgccagacc

SEQ ID NO: 3290853 - DNA, 23 bp, Homo sapiens
ccacatctgccttaaaaccaaag

SEQ ID NO: 3290854 - DNA, 19 bp, Homo sapiens
ccacatcttgctctgctga

SEQ ID NO: 3290855 - DNA, 19 bp, Homo sapiens
ccacatgtgacacatatgc

SEQ ID NO: 3290856 - DNA, 18 bp, Homo sapiens
ccacatttctgatcagag

SEQ ID NO: 3290857 - DNA, 20 bp, Homo sapiens
ccacatttctgatcagaggt

SEQ ID NO: 3290858 - DNA, 16 bp, Homo sapiens
ccaccaaactgcacac

SEQ ID NO: 3290859 - DNA, 24 bp, Homo sapiens
ccaccaaactgcacacacagctcc

SEQ ID NO: 3290860 - DNA, 13 bp, Homo sapiens
ccaccaaagctgc

SEQ ID NO: 3290861 - DNA, 14 bp, Homo sapiens
ccaccaaagctgcc

SEQ ID NO: 3290862 - DNA, 14 bp, Homo sapiens
ccaccacacccagc

SEQ ID NO: 3290863 - DNA, 21 bp, Homo sapiens
ccaccacagccagcacctggc

SEQ ID NO: 3290864 - DNA, 13 bp, Homo sapiens
ccaccacaggcat

SEQ ID NO: 3290865 - DNA, 13 bp, Homo sapiens
ccaccacccaacc

SEQ ID NO: 3290866 - DNA, 14 bp, Homo sapiens
ccaccaccctgccc

SEQ ID NO: 3290867 - DNA, 15 bp, Homo sapiens
ccaccacctctgtgg

SEQ ID NO: 3290868 - DNA, 14 bp, Homo sapiens
ccaccacgtctgcc

SEQ ID NO: 3290869 - DNA, 16 bp, Homo sapiens
ccaccacgtctgccag

SEQ ID NO: 3290870 - DNA, 17 bp, Homo sapiens
ccaccacgtctgccagg

SEQ ID NO: 3290871 - DNA, 15 bp, Homo sapiens
ccaccactggccacc

SEQ ID NO: 3290872 - DNA, 19 bp, Homo sapiens
ccaccactggccaccaggc

SEQ ID NO: 3290873 - DNA, 21 bp, Homo sapiens
ccaccactggccaccaggctg

SEQ ID NO: 3290874 - DNA, 15 bp, Homo sapiens
ccaccacttcagggg

SEQ ID NO: 3290875 - DNA, 22 bp, Homo sapiens
ccaccagagaccgtcctcaccc

SEQ ID NO: 3290876 - DNA, 18 bp, Homo sapiens
ccaccagatagcagaggg

SEQ ID NO: 3290877 - DNA, 15 bp, Homo sapiens
ccaccagatgctgaa

SEQ ID NO: 3290878 - DNA, 12 bp, Homo sapiens
ccaccagcagca

SEQ ID NO: 3290879 - DNA, 19 bp, Homo sapiens
ccaccagcccgcaactctc

SEQ ID NO: 3290880 - DNA, 20 bp, Homo sapiens
ccaccagccgccccagcccc

SEQ ID NO: 3290881 - DNA, 12 bp, Homo sapiens
ccaccaggctgg

SEQ ID NO: 3290882 - DNA, 19 bp, Homo sapiens
ccaccaggctggcgcagcc

SEQ ID NO: 3290883 - DNA, 12 bp, Homo sapiens
ccaccagtgcct

SEQ ID NO: 3290884 - DNA, 13 bp, Homo sapiens
ccaccagtgcctt

SEQ ID NO: 3290885 - DNA, 19 bp, Homo sapiens
ccagagagaggatgtggaa

SEQ ID NO: 3290886 - DNA, 20 bp, Homo sapiens
ccagagagcaactctgagat

SEQ ID NO: 3290887 - DNA, 14 bp, Homo sapiens
ccagagaggagcac

SEQ ID NO: 3290888 - DNA, 19 bp, Homo sapiens
ccagagagggcccagctgt

SEQ ID NO: 3290889 - DNA, 13 bp, Homo sapiens
ccagagagggtgg

SEQ ID NO: 3290890 - DNA, 21 bp, Homo sapiens
ccagagagggtggtgacctct

SEQ ID NO: 3290891 - DNA, 16 bp, Homo sapiens
ccagagagtggctcct

SEQ ID NO: 3290892 - DNA, 14 bp, Homo sapiens
ccagagatgcaata

SEQ ID NO: 3290893 - DNA, 15 bp, Homo sapiens
ccagagcaacctctc

SEQ ID NO: 3290894 - DNA, 16 bp, Homo sapiens
ccagagcaacctctca

SEQ ID NO: 3290895 - DNA, 19 bp, Homo sapiens
ccagagcaacctctcactc

SEQ ID NO: 3290896 - DNA, 22 bp, Homo sapiens
ccagagcacccccaagcctggg

SEQ ID NO: 3290897 - DNA, 16 bp, Homo sapiens
ccagagcagatgcaga

SEQ ID NO: 3290898 - DNA, 23 bp, Homo sapiens
ccagagcagatgcagagagccat

SEQ ID NO: 3290899 - DNA, 14 bp, Homo sapiens
ccagagcagggtgt

SEQ ID NO: 3290900 - DNA, 15 bp, Homo sapiens
ccagagccacctgga

SEQ ID NO: 3290901 - DNA, 16 bp, Homo sapiens
ccagagccagatgcag

SEQ ID NO: 3290902 - DNA, 19 bp, Homo sapiens
ccagagccagatgcaggac

SEQ ID NO: 3290903 - DNA, 21 bp, Homo sapiens
ccagagccagatgcaggacag

SEQ ID NO: 3290904 - DNA, 12 bp, Homo sapiens
ccagagccagcc

SEQ ID NO: 3290905 - DNA, 15 bp, Homo sapiens
ccagagccagcctgg

SEQ ID NO: 3290906 - DNA, 17 bp, Homo sapiens
ccagagccagcctggga

SEQ ID NO: 3290907 - DNA, 21 bp, Homo sapiens
ccagagcccctcctccagccc

SEQ ID NO: 3290908 - DNA, 18 bp, Homo sapiens
ccagagcccttcactgcc

SEQ ID NO: 3290909 - DNA, 20 bp, Homo sapiens
ccagagcccttcactgccat

SEQ ID NO: 3290910 - DNA, 21 bp, Homo sapiens
ccagagcctggctgcccatca

SEQ ID NO: 3290911 - DNA, 17 bp, Homo sapiens
ccagagccttcaagtgc

SEQ ID NO: 3290912 - DNA, 18 bp, Homo sapiens
ccagagccttcaagtgcc

SEQ ID NO: 3290913 - DNA, 12 bp, Homo sapiens
ccagagctagtt

SEQ ID NO: 3290914 - DNA, 23 bp, Homo sapiens
ccagagctgccgacttggagact

SEQ ID NO: 3290915 - DNA, 12 bp, Homo sapiens
ccagagctggaa

SEQ ID NO: 3290916 - DNA, 18 bp, Homo sapiens
ccagagctggaaggcagg

SEQ ID NO: 3290917 - DNA, 19 bp, Homo sapiens
ccagagctggaaggcaggg

SEQ ID NO: 3290918 - DNA, 14 bp, Homo sapiens
ccagagctgggagg

SEQ ID NO: 3290919 - DNA, 23 bp, Homo sapiens
ccagagctgtctgaactcacgtg

SEQ ID NO: 3290920 - DNA, 17 bp, Homo sapiens
ccagagctgtgccagca

SEQ ID NO: 3290921 - DNA, 20 bp, Homo sapiens
ccagagctgtttatggcctc

SEQ ID NO: 3290922 - DNA, 21 bp, Homo sapiens
ccagagctgtttatggcctca

SEQ ID NO: 3290923 - DNA, 22 bp, Homo sapiens
ccagagctgtttatggcctcag

SEQ ID NO: 3290924 - DNA, 23 bp, Homo sapiens
ccagagctgtttatggcctcagc

SEQ ID NO: 3290925 - DNA, 14 bp, Homo sapiens
ccagagcttggaga

SEQ ID NO: 3290926 - DNA, 20 bp, Homo sapiens
ccagaggaactgtccagaga

SEQ ID NO: 3290927 - DNA, 21 bp, Homo sapiens
ccagaggaactgtccagagag

SEQ ID NO: 3290928 - DNA, 22 bp, Homo sapiens
ccagaggaactgtccagagagc

SEQ ID NO: 3290929 - DNA, 17 bp, Homo sapiens
ccagaggaaggaaaagg

SEQ ID NO: 3290930 - DNA, 15 bp, Homo sapiens
ccagaggactcccaa

SEQ ID NO: 3290931 - DNA, 21 bp, Homo sapiens
ccagaggagccaccagttctc

SEQ ID NO: 3290932 - DNA, 16 bp, Homo sapiens
ccagaggcagagcctg

SEQ ID NO: 3290933 - DNA, 15 bp, Homo sapiens
ccagaggcccccagc

SEQ ID NO: 3290934 - DNA, 14 bp, Homo sapiens
ccagaggccctgga

SEQ ID NO: 3290935 - DNA, 20 bp, Homo sapiens
ccagaggccgaaggtgcctc

SEQ ID NO: 3290936 - DNA, 23 bp, Homo sapiens
ccagaggccgaaggtgcctcaga

SEQ ID NO: 3290937 - DNA, 15 bp, Homo sapiens
ccagaggctgggttc

SEQ ID NO: 3290938 - DNA, 16 bp, Homo sapiens
ccagaggctgggttca

SEQ ID NO: 3290939 - DNA, 16 bp, Homo sapiens
ccagagggagtgacag

SEQ ID NO: 3290940 - DNA, 17 bp, Homo sapiens
ccagagggagtgacaga

SEQ ID NO: 3290941 - DNA, 20 bp, Homo sapiens
ccagagggagtgacagaggc

SEQ ID NO: 3290942 - DNA, 21 bp, Homo sapiens
ccagagggagtgacagaggca

SEQ ID NO: 3290943 - DNA, 15 bp, Homo sapiens
ccagagggcccaggc

SEQ ID NO: 3290944 - DNA, 18 bp, Homo sapiens
ccagagggcccaggcagg

SEQ ID NO: 3290945 - DNA, 17 bp, Homo sapiens
ccagagggtagggcaca

SEQ ID NO: 3290946 - DNA, 18 bp, Homo sapiens
ccagaggtaacagaacag

SEQ ID NO: 3290947 - DNA, 19 bp, Homo sapiens
ccagaggtaacagaacagc

SEQ ID NO: 3290948 - DNA, 21 bp, Homo sapiens
ccagaggtaacagaacagctt

SEQ ID NO: 3290949 - DNA, 16 bp, Homo sapiens
ccagaggtccagccca

SEQ ID NO: 3290950 - DNA, 21 bp, Homo sapiens
ccagaggtgggatcctccctc

SEQ ID NO: 3290951 - DNA, 15 bp, Homo sapiens
ccagaggtgggcagg

SEQ ID NO: 3290952 - DNA, 17 bp, Homo sapiens
ccagaggtgggcaggtg

SEQ ID NO: 3290953 - DNA, 18 bp, Homo sapiens
ccagaggtgggcaggtgg

SEQ ID NO: 3290954 - DNA, 20 bp, Homo sapiens
ccagaggttatctgcctggc

SEQ ID NO: 3290955 - DNA, 21 bp, Homo sapiens
ccagaggttatctgcctggcc

SEQ ID NO: 3290956 - DNA, 13 bp, Homo sapiens
ccagagtctgagc

SEQ ID NO: 3290957 - DNA, 19 bp, Homo sapiens
ccagagtgaaagggctatg

SEQ ID NO: 3290958 - DNA, 21 bp, Homo sapiens
ccagagtggagtctgagtctg

SEQ ID NO: 3290959 - DNA, 14 bp, Homo sapiens
ccagagtggcctgg

SEQ ID NO: 3290960 - DNA, 15 bp, Homo sapiens
ccagagtggcctggc

SEQ ID NO: 3290961 - DNA, 18 bp, Homo sapiens
ccagagtggcctggccag

SEQ ID NO: 3290962 - DNA, 19 bp, Homo sapiens
ccagagtggcctggccagg

SEQ ID NO: 3290963 - DNA, 23 bp, Homo sapiens
ccagagtggcctggccaggagct

SEQ ID NO: 3290964 - DNA, 22 bp, Homo sapiens
ccagataaaatgttcagtgcaa

SEQ ID NO: 3290965 - DNA, 20 bp, Homo sapiens
ccagataccagcccctgtat

SEQ ID NO: 3290966 - DNA, 14 bp, Homo sapiens
ccagatagagctgg

SEQ ID NO: 3290967 - DNA, 18 bp, Homo sapiens
ccagatcaccagcccggc

SEQ ID NO: 3290968 - DNA, 13 bp, Homo sapiens
ccagatcagtcag

SEQ ID NO: 3290969 - DNA, 18 bp, Homo sapiens
ccagatccagtatcttgt

SEQ ID NO: 3290970 - DNA, 12 bp, Homo sapiens
ccagatcctggg

SEQ ID NO: 3290971 - DNA, 13 bp, Homo sapiens
ccagatcctgggt

SEQ ID NO: 3290972 - DNA, 12 bp, Homo sapiens
ccagatctccca

SEQ ID NO: 3290973 - DNA, 13 bp, Homo sapiens
ccagatctgcctg

SEQ ID NO: 3290974 - DNA, 21 bp, Homo sapiens
ccagatctgcctgggcctgtg

SEQ ID NO: 3290975 - DNA, 19 bp, Homo sapiens
ccagatctggtcccttgca

SEQ ID NO: 3290976 - DNA, 17 bp, Homo sapiens
ccagatgcaacctcact

SEQ ID NO: 3290977 - DNA, 15 bp, Homo sapiens
ccagatgcaggacag

SEQ ID NO: 3290978 - DNA, 16 bp, Homo sapiens
ccagatgcaggacagg

SEQ ID NO: 3290979 - DNA, 20 bp, Homo sapiens
ccagatgcaggacaggaggc

SEQ ID NO: 3290980 - DNA, 17 bp, Homo sapiens
ccagatggcccctccac

SEQ ID NO: 3290981 - DNA, 23 bp, Homo sapiens
ccagatggcccggatgctgcttc

SEQ ID NO: 3290982 - DNA, 21 bp, Homo sapiens
ccagatggcctgaagcaactg

SEQ ID NO: 3290983 - DNA, 23 bp, Homo sapiens
ccagatgtttccagacttccttg

SEQ ID NO: 3290984 - DNA, 22 bp, Homo sapiens
ccagattacaggaatgaagaac

SEQ ID NO: 3290985 - DNA, 15 bp, Homo sapiens
ccagattctcttgaa

SEQ ID NO: 3290986 - DNA, 13 bp, Homo sapiens
ccagattgacgac

SEQ ID NO: 3290987 - DNA, 18 bp, Homo sapiens
ccagattgcaacaggctg

SEQ ID NO: 3290988 - DNA, 19 bp, Homo sapiens
ccagattgcaacaggctgg

SEQ ID NO: 3290989 - DNA, 20 bp, Homo sapiens
ccagattgcaacaggctggg

SEQ ID NO: 3290990 - DNA, 23 bp, Homo sapiens
ccagatttggggtataggtctca

SEQ ID NO: 3290991 - DNA, 12 bp, Homo sapiens
ccagatttgtct

SEQ ID NO: 3290992 - DNA, 23 bp, Homo sapiens
ccagatttgtctttttgttgtaa

SEQ ID NO: 3290993 - DNA, 14 bp, Homo sapiens
ccagattttattta

SEQ ID NO: 3290994 - DNA, 23 bp, Homo sapiens
ccagattttatttatatctttat

SEQ ID NO: 3290995 - DNA, 18 bp, Homo sapiens
ccagatttttcggaggcc

SEQ ID NO: 3290996 - DNA, 22 bp, Homo sapiens
ccagatttttcggaggccccac

SEQ ID NO: 3290997 - DNA, 23 bp, Homo sapiens
ccagcaacttcttctccatccct

SEQ ID NO: 3290998 - DNA, 19 bp, Homo sapiens
ccagcaagaataaaaaaga

SEQ ID NO: 3290999 - DNA, 14 bp, Homo sapiens
ccagcaagacctca

SEQ ID NO: 3291000 - DNA, 17 bp, Homo sapiens
ccagcaagagaaccccg

SEQ ID NO: 3291001 - DNA, 20 bp, Homo sapiens
ccagcaagagggaacaaaac

SEQ ID NO: 3291002 - DNA, 17 bp, Homo sapiens
ccagcaagcgggagccc

SEQ ID NO: 3291003 - DNA, 14 bp, Homo sapiens
ccagcaaggcaggt

SEQ ID NO: 3291004 - DNA, 15 bp, Homo sapiens
ccagcaaggcaggtt

SEQ ID NO: 3291005 - DNA, 17 bp, Homo sapiens
ccagcaagtgagagctg

SEQ ID NO: 3291006 - DNA, 18 bp, Homo sapiens
ccagcaagtgagagctgg

SEQ ID NO: 3291007 - DNA, 19 bp, Homo sapiens
ccagcaagtgagagctggg

SEQ ID NO: 3291008 - DNA, 17 bp, Homo sapiens
ccagcaatatgtaaata

SEQ ID NO: 3291009 - DNA, 12 bp, Homo sapiens
ccagcaatgaca

SEQ ID NO: 3291010 - DNA, 21 bp, Homo sapiens
ccaggctgctaacctggaaag

SEQ ID NO: 3291011 - DNA, 21 bp, Homo sapiens
ccaggctggacatgctgactg

SEQ ID NO: 3291012 - DNA, 21 bp, Homo sapiens
ccaggctggcgcagccaaggc

SEQ ID NO: 3291013 - DNA, 17 bp, Homo sapiens
ccaggctggcgtgcagt

SEQ ID NO: 3291014 - DNA, 23 bp, Homo sapiens
ccaggctggtccgagctgaggac

SEQ ID NO: 3291015 - DNA, 16 bp, Homo sapiens
ccaggctggtctaaaa

SEQ ID NO: 3291016 - DNA, 17 bp, Homo sapiens
ccaggctggtctaaaac

SEQ ID NO: 3291017 - DNA, 19 bp, Homo sapiens
ccaggctggtctcaaactc

SEQ ID NO: 3291018 - DNA, 20 bp, Homo sapiens
ccaggctgtgcagcgcagct

SEQ ID NO: 3291019 - DNA, 18 bp, Homo sapiens
ccaggctttgtacagagt

SEQ ID NO: 3291020 - DNA, 18 bp, Homo sapiens
ccagggaagctggccgag

SEQ ID NO: 3291021 - DNA, 10 bp, Homo sapiens
ccagggaagg

SEQ ID NO: 3291022 - DNA, 13 bp, Homo sapiens
ccagggaaggaaa

SEQ ID NO: 3291023 - DNA, 14 bp, Homo sapiens
ccagggaaggtggg

SEQ ID NO: 3291024 - DNA, 17 bp, Homo sapiens
ccagggaaggtggggcc

SEQ ID NO: 3291025 - DNA, 15 bp, Homo sapiens
ccagggaatccaagc

SEQ ID NO: 3291026 - DNA, 21 bp, Homo sapiens
ccagggaatccaagcctccac

SEQ ID NO: 3291027 - DNA, 22 bp, Homo sapiens
ccagggaccactgggtgagaga

SEQ ID NO: 3291028 - DNA, 15 bp, Homo sapiens
ccagggagattttga

SEQ ID NO: 3291029 - DNA, 17 bp, Homo sapiens
ccagggagcaagacaga

SEQ ID NO: 3291030 - DNA, 14 bp, Homo sapiens
ccagggagcctaga

SEQ ID NO: 3291031 - DNA, 13 bp, Homo sapiens
ccagggagccttt

SEQ ID NO: 3291032 - DNA, 22 bp, Homo sapiens
ccagggagcctttggttctggc

SEQ ID NO: 3291033 - DNA, 22 bp, Homo sapiens
ccagggagcttgaaagttttca

SEQ ID NO: 3291034 - DNA, 15 bp, Homo sapiens
ccagggatctctcta

SEQ ID NO: 3291035 - DNA, 12 bp, Homo sapiens
ccagggatgctg

SEQ ID NO: 3291036 - DNA, 23 bp, Homo sapiens
ccagggatgctgggctgggccct

SEQ ID NO: 3291037 - DNA, 17 bp, Homo sapiens
ccagggatgggggatgg

SEQ ID NO: 3291038 - DNA, 21 bp, Homo sapiens
ccagggatgggggatgggcca

SEQ ID NO: 3291039 - DNA, 22 bp, Homo sapiens
ccagggcaccctgtggccctgg

SEQ ID NO: 3291040 - DNA, 15 bp, Homo sapiens
ccagggcagggccac

SEQ ID NO: 3291041 - DNA, 22 bp, Homo sapiens
ccagggcattcgggccacaggg

SEQ ID NO: 3291042 - DNA, 14 bp, Homo sapiens
ccagggccacgctc

SEQ ID NO: 3291043 - DNA, 12 bp, Homo sapiens
ccagggcccctc

SEQ ID NO: 3291044 - DNA, 17 bp, Homo sapiens
ccagggcccctccctct

SEQ ID NO: 3291045 - DNA, 18 bp, Homo sapiens
ccagggccctaggcccct

SEQ ID NO: 3291046 - DNA, 14 bp, Homo sapiens
ccagggccctgcag

SEQ ID NO: 3291047 - DNA, 15 bp, Homo sapiens
ccagggccctgcaga

SEQ ID NO: 3291048 - DNA, 14 bp, Homo sapiens
ccagggccctggat

SEQ ID NO: 3291049 - DNA, 15 bp, Homo sapiens
ccagggccctggatg

SEQ ID NO: 3291050 - DNA, 17 bp, Homo sapiens
ccagggcgctgggaagg

SEQ ID NO: 3291051 - DNA, 12 bp, Homo sapiens
ccagggctcctg

SEQ ID NO: 3291052 - DNA, 14 bp, Homo sapiens
ccagggctctgccc

SEQ ID NO: 3291053 - DNA, 17 bp, Homo sapiens
ccagggctctgccccag

SEQ ID NO: 3291054 - DNA, 18 bp, Homo sapiens
ccagggctgccctgagaa

SEQ ID NO: 3291055 - DNA, 12 bp, Homo sapiens
ccagggctggct

SEQ ID NO: 3291056 - DNA, 18 bp, Homo sapiens
ccagggctggctctgcac

SEQ ID NO: 3291057 - DNA, 11 bp, Homo sapiens
ccagggctggg

SEQ ID NO: 3291058 - DNA, 14 bp, Homo sapiens
ccagggctggggac

SEQ ID NO: 3291059 - DNA, 12 bp, Homo sapiens
ccaggggaacct

SEQ ID NO: 3291060 - DNA, 17 bp, Homo sapiens
ccaggggaacctgccat

SEQ ID NO: 3291061 - DNA, 13 bp, Homo sapiens
ccaggggaccaca

SEQ ID NO: 3291062 - DNA, 18 bp, Homo sapiens
ccaggggaccacacctcc

SEQ ID NO: 3291063 - DNA, 16 bp, Homo sapiens
ccaggggaggagcctg

SEQ ID NO: 3291064 - DNA, 17 bp, Homo sapiens
ccaggggaggagcctgt

SEQ ID NO: 3291065 - DNA, 22 bp, Homo sapiens
ccaggggattgtctcagggccg

SEQ ID NO: 3291066 - DNA, 12 bp, Homo sapiens
ccaggggcagga

SEQ ID NO: 3291067 - DNA, 22 bp, Homo sapiens
ccaggggcccttgggacagcca

SEQ ID NO: 3291068 - DNA, 16 bp, Homo sapiens
ccaggggcctgcagaa

SEQ ID NO: 3291069 - DNA, 20 bp, Homo sapiens
ccaggggcctgcagaaggaa

SEQ ID NO: 3291070 - DNA, 22 bp, Homo sapiens
ccaggggctgcttcctcctgga

SEQ ID NO: 3291071 - DNA, 23 bp, Homo sapiens
ccaggggctgcttcctcctggaa

SEQ ID NO: 3291072 - DNA, 21 bp, Homo sapiens
ccaggggctgggctccctgat

SEQ ID NO: 3291073 - DNA, 23 bp, Homo sapiens
ccaggggctgggctccctgatga

SEQ ID NO: 3291074 - DNA, 19 bp, Homo sapiens
ccagggggactagcccctg

SEQ ID NO: 3291075 - DNA, 18 bp, Homo sapiens
ccagggggatgccactcc

SEQ ID NO: 3291076 - DNA, 15 bp, Homo sapiens
ccaggggggcctcct

SEQ ID NO: 3291077 - DNA, 16 bp, Homo sapiens
ccaggggggcctcctc

SEQ ID NO: 3291078 - DNA, 14 bp, Homo sapiens
ccaggggtcccagc

SEQ ID NO: 3291079 - DNA, 18 bp, Homo sapiens
ccaggggtcccagccacc

SEQ ID NO: 3291080 - DNA, 18 bp, Homo sapiens
ccagggtacccgcctgag

SEQ ID NO: 3291081 - DNA, 16 bp, Homo sapiens
ccagggtccctctgtg

SEQ ID NO: 3291082 - DNA, 14 bp, Homo sapiens
ccagggtccgcacc

SEQ ID NO: 3291083 - DNA, 16 bp, Homo sapiens
ccagggtctctccctc

SEQ ID NO: 3291084 - DNA, 20 bp, Homo sapiens
ccagggtctgtgtgaatgtg

SEQ ID NO: 3291085 - DNA, 22 bp, Homo sapiens
ccagggtctgtgtgaatgtggg

SEQ ID NO: 3291086 - DNA, 23 bp, Homo sapiens
ccagggtcttccctacctcaggc

SEQ ID NO: 3291087 - DNA, 17 bp, Homo sapiens
ccagggtcttgggctac

SEQ ID NO: 3291088 - DNA, 21 bp, Homo sapiens
ccagggtcttgggctactggc

SEQ ID NO: 3291089 - DNA, 20 bp, Homo sapiens
ccagggtggacttagaaagc

SEQ ID NO: 3291090 - DNA, 21 bp, Homo sapiens
ccagggtggacttagaaagca

SEQ ID NO: 3291091 - DNA, 21 bp, Homo sapiens
ccagggttttgccccaagtcc

SEQ ID NO: 3291092 - DNA, 19 bp, Homo sapiens
ccaggtaccagctgcgctt

SEQ ID NO: 3291093 - DNA, 22 bp, Homo sapiens
ccaggtactgcattctctccca

SEQ ID NO: 3291094 - DNA, 11 bp, Homo sapiens
ccaggtcagga

SEQ ID NO: 3291095 - DNA, 19 bp, Homo sapiens
ccaggtcaggatgcacatt

SEQ ID NO: 3291096 - DNA, 22 bp, Homo sapiens
ccaggtcaggatgcacatttct

SEQ ID NO: 3291097 - DNA, 17 bp, Homo sapiens
ccaggtccagctctgga

SEQ ID NO: 3291098 - DNA, 18 bp, Homo sapiens
ccaggtccagctctggag

SEQ ID NO: 3291099 - DNA, 15 bp, Homo sapiens
ccaggtccattttgc

SEQ ID NO: 3291100 - DNA, 14 bp, Homo sapiens
ccaggtccttcctt

SEQ ID NO: 3291101 - DNA, 23 bp, Homo sapiens
ccaggtctcacgggcatgggcac

SEQ ID NO: 3291102 - DNA, 13 bp, Homo sapiens
ccaggtcttccag

SEQ ID NO: 3291103 - DNA, 16 bp, Homo sapiens
ccaggtcttccagacc

SEQ ID NO: 3291104 - DNA, 17 bp, Homo sapiens
ccaggtcttccagacct

SEQ ID NO: 3291105 - DNA, 20 bp, Homo sapiens
ccaggtcttccagacctgct

SEQ ID NO: 3291106 - DNA, 20 bp, Homo sapiens
ccaggtgaggcccaagagcc

SEQ ID NO: 3291107 - DNA, 19 bp, Homo sapiens
ccaggtgaggtccaccggc

SEQ ID NO: 3291108 - DNA, 14 bp, Homo sapiens
ccaggtgcagtggc

SEQ ID NO: 3291109 - DNA, 15 bp, Homo sapiens
ccaggtggaaggcag

SEQ ID NO: 3291110 - DNA, 20 bp, Homo sapiens
ccaggtggaaggcagacagc

SEQ ID NO: 3291111 - DNA, 22 bp, Homo sapiens
ccaggtggagggcacagccctc

SEQ ID NO: 3291112 - DNA, 21 bp, Homo sapiens
ccaggtggccactccagaccc

SEQ ID NO: 3291113 - DNA, 23 bp, Homo sapiens
ccaggtgtgcacgtggcatgtgg

SEQ ID NO: 3291114 - DNA, 14 bp, Homo sapiens
ccaggtgtgcctgg

SEQ ID NO: 3291115 - DNA, 23 bp, Homo sapiens
ccaggtgtggctgtcaggacacc

SEQ ID NO: 3291116 - DNA, 19 bp, Homo sapiens
ccaggttcacactcagaaa

SEQ ID NO: 3291117 - DNA, 17 bp, Homo sapiens
ccaggttcccccagcaa

SEQ ID NO: 3291118 - DNA, 19 bp, Homo sapiens
ccaggttcccccagcaagc

SEQ ID NO: 3291119 - DNA, 22 bp, Homo sapiens
ccaggttctccgttagctcctg

SEQ ID NO: 3291120 - DNA, 23 bp, Homo sapiens
ccaggttctccgttagctcctgt

SEQ ID NO: 3291121 - DNA, 16 bp, Homo sapiens
ccaggtttagacagta

SEQ ID NO: 3291122 - DNA, 16 bp, Homo sapiens
ccaggtttctatgtgt

SEQ ID NO: 3291123 - DNA, 20 bp, Homo sapiens
ccagtaacgcgtcttcctga

SEQ ID NO: 3291124 - DNA, 21 bp, Homo sapiens
ccagtaacgcgtcttcctgag

SEQ ID NO: 3291125 - DNA, 16 bp, Homo sapiens
ccagtaacttttttgt

SEQ ID NO: 3291126 - DNA, 23 bp, Homo sapiens
ccagtaacttttttgtgtatgta

SEQ ID NO: 3291127 - DNA, 14 bp, Homo sapiens
ccagtaccttgctt

SEQ ID NO: 3291128 - DNA, 16 bp, Homo sapiens
ccagtacctttgtcac

SEQ ID NO: 3291129 - DNA, 16 bp, Homo sapiens
ccagtacgtgctaaca

SEQ ID NO: 3291130 - DNA, 21 bp, Homo sapiens
ccagtatacctcatttttcat

SEQ ID NO: 3291131 - DNA, 23 bp, Homo sapiens
ccagtatacctcatttttcatac

SEQ ID NO: 3291132 - DNA, 18 bp, Homo sapiens
ccagtatctatatatgtg

SEQ ID NO: 3291133 - DNA, 14 bp, Homo sapiens
ccagtattagactg

SEQ ID NO: 3291134 - DNA, 16 bp, Homo sapiens
ccagtattctcagagc

SEQ ID NO: 3291135 - DNA, 17 bp, Homo sapiens
ccattcccgtggtctcc

SEQ ID NO: 3291136 - DNA, 13 bp, Homo sapiens
ccattcctccctc

SEQ ID NO: 3291137 - DNA, 13 bp, Homo sapiens
ccattcctgcctt

SEQ ID NO: 3291138 - DNA, 17 bp, Homo sapiens
ccattcctggtacccag

SEQ ID NO: 3291139 - DNA, 21 bp, Homo sapiens
ccattcctggtacccagccat

SEQ ID NO: 3291140 - DNA, 24 bp, Homo sapiens
ccattcctggtacccagccatctg

SEQ ID NO: 3291141 - DNA, 17 bp, Homo sapiens
ccattcggggctgacga

SEQ ID NO: 3291142 - DNA, 22 bp, Homo sapiens
ccattctcccaggtaccagctg

SEQ ID NO: 3291143 - DNA, 12 bp, Homo sapiens
ccattctcctgc

SEQ ID NO: 3291144 - DNA, 17 bp, Homo sapiens
ccattctcctgcctcac

SEQ ID NO: 3291145 - DNA, 19 bp, Homo sapiens
ccattctcctgcctcaccc

SEQ ID NO: 3291146 - DNA, 12 bp, Homo sapiens
ccattctgactc

SEQ ID NO: 3291147 - DNA, 22 bp, Homo sapiens
ccattctgccgccccctcctga

SEQ ID NO: 3291148 - DNA, 16 bp, Homo sapiens
ccattctgcctgccca

SEQ ID NO: 3291149 - DNA, 18 bp, Homo sapiens
ccattctgcctgcccagg

SEQ ID NO: 3291150 - DNA, 19 bp, Homo sapiens
ccattctgcctgcccaggc

SEQ ID NO: 3291151 - DNA, 22 bp, Homo sapiens
ccattctgtgaccaaaatacct

SEQ ID NO: 3291152 - DNA, 14 bp, Homo sapiens
ccattcttctggtg

SEQ ID NO: 3291153 - DNA, 15 bp, Homo sapiens
ccattcttctggtgc

SEQ ID NO: 3291154 - DNA, 13 bp, Homo sapiens
ccattctttgctt

SEQ ID NO: 3291155 - DNA, 22 bp, Homo sapiens
ccattctttgcttgaacacagt

SEQ ID NO: 3291156 - DNA, 19 bp, Homo sapiens
ccattctttttttcttggc

SEQ ID NO: 3291157 - DNA, 12 bp, Homo sapiens
ccattgaaggct

SEQ ID NO: 3291158 - DNA, 20 bp, Homo sapiens
ccattgcatcacctctgtaa

SEQ ID NO: 3291159 - DNA, 16 bp, Homo sapiens
ccattgcggccccagg

SEQ ID NO: 3291160 - DNA, 11 bp, Homo sapiens
ccattgggacc

SEQ ID NO: 3291161 - DNA, 17 bp, Homo sapiens
ccattgggaccctccag

SEQ ID NO: 3291162 - DNA, 15 bp, Homo sapiens
ccattgtcttgttct

SEQ ID NO: 3291163 - DNA, 22 bp, Homo sapiens
ccattgtctttatatgaacata

SEQ ID NO: 3291164 - DNA, 23 bp, Homo sapiens
ccattgtctttatatgaacatag

SEQ ID NO: 3291165 - DNA, 19 bp, Homo sapiens
ccattgtgaagcacctact

SEQ ID NO: 3291166 - DNA, 14 bp, Homo sapiens
ccatttaaaaagtt

SEQ ID NO: 3291167 - DNA, 19 bp, Homo sapiens
ccatttaaatttttttcct

SEQ ID NO: 3291168 - DNA, 18 bp, Homo sapiens
ccatttacacttttgaga

SEQ ID NO: 3291169 - DNA, 20 bp, Homo sapiens
ccatttacagtctctttctt

SEQ ID NO: 3291170 - DNA, 22 bp, Homo sapiens
ccatttacagtctctttcttcc

SEQ ID NO: 3291171 - DNA, 18 bp, Homo sapiens
ccatttacgtgtctgaat

SEQ ID NO: 3291172 - DNA, 21 bp, Homo sapiens
ccatttataaccccagcctga

SEQ ID NO: 3291173 - DNA, 13 bp, Homo sapiens
ccatttcagagag

SEQ ID NO: 3291174 - DNA, 20 bp, Homo sapiens
ccatttcaggaatttaaaat

SEQ ID NO: 3291175 - DNA, 14 bp, Homo sapiens
ccatttcccatctg

SEQ ID NO: 3291176 - DNA, 15 bp, Homo sapiens
ccatttcccatctgc

SEQ ID NO: 3291177 - DNA, 19 bp, Homo sapiens
ccatttcctcagcttatct

SEQ ID NO: 3291178 - DNA, 13 bp, Homo sapiens
ccatttctattta

SEQ ID NO: 3291179 - DNA, 14 bp, Homo sapiens
ccatttctctacac

SEQ ID NO: 3291180 - DNA, 17 bp, Homo sapiens
ccatttctctacactaa

SEQ ID NO: 3291181 - DNA, 21 bp, Homo sapiens
ccatttgatacccctggggaa

SEQ ID NO: 3291182 - DNA, 19 bp, Homo sapiens
ccatttgcctttctgggag

SEQ ID NO: 3291183 - DNA, 16 bp, Homo sapiens
ccatttgtaattaaat

SEQ ID NO: 3291184 - DNA, 18 bp, Homo sapiens
ccatttgtgccagaggaa

SEQ ID NO: 3291185 - DNA, 12 bp, Homo sapiens
ccatttgtttat

SEQ ID NO: 3291186 - DNA, 13 bp, Homo sapiens
ccatttgtttatt

SEQ ID NO: 3291187 - DNA, 17 bp, Homo sapiens
ccattttaacgctgcct

SEQ ID NO: 3291188 - DNA, 12 bp, Homo sapiens
ccattttatgca

SEQ ID NO: 3291189 - DNA, 19 bp, Homo sapiens
ccattttcaactgctttga

SEQ ID NO: 3291190 - DNA, 22 bp, Homo sapiens
ccattttcccccactactgcag

SEQ ID NO: 3291191 - DNA, 13 bp, Homo sapiens
ccattttcccctt

SEQ ID NO: 3291192 - DNA, 16 bp, Homo sapiens
ccattttccccttcct

SEQ ID NO: 3291193 - DNA, 10 bp, Homo sapiens
ccattttcta

SEQ ID NO: 3291194 - DNA, 17 bp, Homo sapiens
ccattttctatcatgga

SEQ ID NO: 3291195 - DNA, 21 bp, Homo sapiens
ccattttgcaaaatttccagt

SEQ ID NO: 3291196 - DNA, 22 bp, Homo sapiens
ccattttggggtacccactgct

SEQ ID NO: 3291197 - DNA, 12 bp, Homo sapiens
ccattttgtgaa

SEQ ID NO: 3291198 - DNA, 16 bp, Homo sapiens
ccatttttcctctgtt

SEQ ID NO: 3291199 - DNA, 17 bp, Homo sapiens
ccattttttcttccctt

SEQ ID NO: 3291200 - DNA, 14 bp, Homo sapiens
cccaaaacccaggg

SEQ ID NO: 3291201 - DNA, 19 bp, Homo sapiens
cccaaaacccttacagtga

SEQ ID NO: 3291202 - DNA, 17 bp, Homo sapiens
cccaaacaaatatgcaa

SEQ ID NO: 3291203 - DNA, 22 bp, Homo sapiens
cccaaacaccttccagctcctg

SEQ ID NO: 3291204 - DNA, 14 bp, Homo sapiens
cccaaacatagccc

SEQ ID NO: 3291205 - DNA, 23 bp, Homo sapiens
cccaaactgttgattattagcca

SEQ ID NO: 3291206 - DNA, 16 bp, Homo sapiens
cccaaagctttcctgc

SEQ ID NO: 3291207 - DNA, 17 bp, Homo sapiens
cccaaagctttcctgcc

SEQ ID NO: 3291208 - DNA, 20 bp, Homo sapiens
cccaaagctttcctgcccca

SEQ ID NO: 3291209 - DNA, 17 bp, Homo sapiens
cccaaaggaaaaagcac

SEQ ID NO: 3291210 - DNA, 16 bp, Homo sapiens
cccaaagtctgtgtga

SEQ ID NO: 3291211 - DNA, 20 bp, Homo sapiens
cccaaagtgctaagattaca

SEQ ID NO: 3291212 - DNA, 16 bp, Homo sapiens
cccaaagtgctgggat

SEQ ID NO: 3291213 - DNA, 23 bp, Homo sapiens
cccaaagttgttgtaacctgctg

SEQ ID NO: 3291214 - DNA, 17 bp, Homo sapiens
cccaacaaaccatccag

SEQ ID NO: 3291215 - DNA, 16 bp, Homo sapiens
cccaacaccagcccct

SEQ ID NO: 3291216 - DNA, 17 bp, Homo sapiens
cccaacaccagcccctg

SEQ ID NO: 3291217 - DNA, 20 bp, Homo sapiens
cccaacaccagcccctgccc

SEQ ID NO: 3291218 - DNA, 13 bp, Homo sapiens
cccaacactgtgc

SEQ ID NO: 3291219 - DNA, 18 bp, Homo sapiens
cccaacactgtgccctgg

SEQ ID NO: 3291220 - DNA, 12 bp, Homo sapiens
cccaaccagtgc

SEQ ID NO: 3291221 - DNA, 16 bp, Homo sapiens
cccaaccatcttcact

SEQ ID NO: 3291222 - DNA, 20 bp, Homo sapiens
cccaacccattcactacagg

SEQ ID NO: 3291223 - DNA, 12 bp, Homo sapiens
cccaaccccagc

SEQ ID NO: 3291224 - DNA, 12 bp, Homo sapiens
cccaacccccac

SEQ ID NO: 3291225 - DNA, 14 bp, Homo sapiens
cccaacccccaccc

SEQ ID NO: 3291226 - DNA, 16 bp, Homo sapiens
cccaacccccctcctg

SEQ ID NO: 3291227 - DNA, 21 bp, Homo sapiens
cccaacccccctcctgctcct

SEQ ID NO: 3291228 - DNA, 21 bp, Homo sapiens
cccaaccccgcggtgctctgg

SEQ ID NO: 3291229 - DNA, 13 bp, Homo sapiens
cccaacccctgag

SEQ ID NO: 3291230 - DNA, 20 bp, Homo sapiens
cccaaccctatctcctgaca

SEQ ID NO: 3291231 - DNA, 14 bp, Homo sapiens
cccaacctgctctc

SEQ ID NO: 3291232 - DNA, 15 bp, Homo sapiens
cccaacgcacaggaa

SEQ ID NO: 3291233 - DNA, 16 bp, Homo sapiens
cccaacgcacaggaaa

SEQ ID NO: 3291234 - DNA, 19 bp, Homo sapiens
cccaactactgagctgaga

SEQ ID NO: 3291235 - DNA, 18 bp, Homo sapiens
cccaactctgagcccatg

SEQ ID NO: 3291236 - DNA, 20 bp, Homo sapiens
cccaagaatagatgctgact

SEQ ID NO: 3291237 - DNA, 21 bp, Homo sapiens
cccaagaatagatgctgactg

SEQ ID NO: 3291238 - DNA, 20 bp, Homo sapiens
cccaagacagatgccccaga

SEQ ID NO: 3291239 - DNA, 20 bp, Homo sapiens
cccaagacttcattgtccct

SEQ ID NO: 3291240 - DNA, 17 bp, Homo sapiens
cccaagagatgaagagt

SEQ ID NO: 3291241 - DNA, 22 bp, Homo sapiens
cccaagagcagagtctgggcct

SEQ ID NO: 3291242 - DNA, 17 bp, Homo sapiens
cccaagagccctgtggc

SEQ ID NO: 3291243 - DNA, 21 bp, Homo sapiens
cccaagagccctgtggccgcc

SEQ ID NO: 3291244 - DNA, 18 bp, Homo sapiens
cccaagaggactgagact

SEQ ID NO: 3291245 - DNA, 12 bp, Homo sapiens
cccaagcagcca

SEQ ID NO: 3291246 - DNA, 14 bp, Homo sapiens
cccaagcagccagc

SEQ ID NO: 3291247 - DNA, 15 bp, Homo sapiens
cccaagcagccagcc

SEQ ID NO: 3291248 - DNA, 16 bp, Homo sapiens
cccaagcagccagcca

SEQ ID NO: 3291249 - DNA, 15 bp, Homo sapiens
cccaagccccatctc

SEQ ID NO: 3291250 - DNA, 20 bp, Homo sapiens
cccaagccccatctcatcct

SEQ ID NO: 3291251 - DNA, 15 bp, Homo sapiens
cccaagcctgctggc

SEQ ID NO: 3291252 - DNA, 17 bp, Homo sapiens
cccaagcctgctggctg

SEQ ID NO: 3291253 - DNA, 12 bp, Homo sapiens
cccaagctcctc

SEQ ID NO: 3291254 - DNA, 12 bp, Homo sapiens
cccaagctctgc

SEQ ID NO: 3291255 - DNA, 15 bp, Homo sapiens
cccaagctctgctcc

SEQ ID NO: 3291256 - DNA, 16 bp, Homo sapiens
cccaagctgcctctgg

SEQ ID NO: 3291257 - DNA, 12 bp, Homo sapiens
cccaaggagctg

SEQ ID NO: 3291258 - DNA, 14 bp, Homo sapiens
cccaaggagctgat

SEQ ID NO: 3291259 - DNA, 15 bp, Homo sapiens
cccaaggctgcgtct

SEQ ID NO: 3291260 - DNA, 12 bp, Homo sapiens
cccaagggccct

SEQ ID NO: 3291261 - DNA, 19 bp, Homo sapiens
cccaaggtcccctccacat

SEQ ID NO: 3291262 - DNA, 17 bp, Homo sapiens
cccagggctcccttatg

SEQ ID NO: 3291263 - DNA, 15 bp, Homo sapiens
cccagggctcctgca

SEQ ID NO: 3291264 - DNA, 17 bp, Homo sapiens
cccagggctctgcccca

SEQ ID NO: 3291265 - DNA, 18 bp, Homo sapiens
cccagggctctgccccag

SEQ ID NO: 3291266 - DNA, 13 bp, Homo sapiens
cccaggggcagga

SEQ ID NO: 3291267 - DNA, 13 bp, Homo sapiens
cccaggggggcct

SEQ ID NO: 3291268 - DNA, 15 bp, Homo sapiens
cccaggggggcctcc

SEQ ID NO: 3291269 - DNA, 17 bp, Homo sapiens
cccaggggtctccctgg

SEQ ID NO: 3291270 - DNA, 19 bp, Homo sapiens
cccaggggtctccctggct

SEQ ID NO: 3291271 - DNA, 20 bp, Homo sapiens
cccaggggtctccctggctc

SEQ ID NO: 3291272 - DNA, 22 bp, Homo sapiens
cccaggggtctccctggctccc

SEQ ID NO: 3291273 - DNA, 23 bp, Homo sapiens
cccaggggtctccctggctccct

SEQ ID NO: 3291274 - DNA, 17 bp, Homo sapiens
cccaggggtgccccctc

SEQ ID NO: 3291275 - DNA, 19 bp, Homo sapiens
cccaggggtgccccctcct

SEQ ID NO: 3291276 - DNA, 14 bp, Homo sapiens
cccaggtaccagct

SEQ ID NO: 3291277 - DNA, 16 bp, Homo sapiens
cccaggtaccagctgc

SEQ ID NO: 3291278 - DNA, 14 bp, Homo sapiens
cccaggtccagctc

SEQ ID NO: 3291279 - DNA, 18 bp, Homo sapiens
cccaggtccagctctgga

SEQ ID NO: 3291280 - DNA, 13 bp, Homo sapiens
cccaggtccttcc

SEQ ID NO: 3291281 - DNA, 16 bp, Homo sapiens
cccaggtggagggcac

SEQ ID NO: 3291282 - DNA, 19 bp, Homo sapiens
cccaggttcccccagcaag

SEQ ID NO: 3291283 - DNA, 19 bp, Homo sapiens
cccaggttgacaccattct

SEQ ID NO: 3291284 - DNA, 16 bp, Homo sapiens
cccagtagaccttgtt

SEQ ID NO: 3291285 - DNA, 19 bp, Homo sapiens
cccagtatacctcattttt

SEQ ID NO: 3291286 - DNA, 14 bp, Homo sapiens
cccagtcccaggga

SEQ ID NO: 3291287 - DNA, 13 bp, Homo sapiens
cccagtccccacc

SEQ ID NO: 3291288 - DNA, 15 bp, Homo sapiens
cccagtccccacccc

SEQ ID NO: 3291289 - DNA, 19 bp, Homo sapiens
cccagtccccacccctgcc

SEQ ID NO: 3291290 - DNA, 23 bp, Homo sapiens
cccagtccccacccctgccccca

SEQ ID NO: 3291291 - DNA, 21 bp, Homo sapiens
cccagtctctcttaaagttgg

SEQ ID NO: 3291292 - DNA, 18 bp, Homo sapiens
cccagtgacacttcagag

SEQ ID NO: 3291293 - DNA, 22 bp, Homo sapiens
cccagtgacacttcagagagct

SEQ ID NO: 3291294 - DNA, 13 bp, Homo sapiens
cccagtgctgcca

SEQ ID NO: 3291295 - DNA, 19 bp, Homo sapiens
cccagtgctgccatgccac

SEQ ID NO: 3291296 - DNA, 20 bp, Homo sapiens
cccagtgctgccatgccact

SEQ ID NO: 3291297 - DNA, 21 bp, Homo sapiens
cccagtgctgccatgccactg

SEQ ID NO: 3291298 - DNA, 12 bp, Homo sapiens
cccagtgggagg

SEQ ID NO: 3291299 - DNA, 14 bp, Homo sapiens
cccagtgggagggg

SEQ ID NO: 3291300 - DNA, 16 bp, Homo sapiens
cccagtgggaggggca

SEQ ID NO: 3291301 - DNA, 22 bp, Homo sapiens
cccagtgggaggggcaggctga

SEQ ID NO: 3291302 - DNA, 15 bp, Homo sapiens
cccagttctgctcct

SEQ ID NO: 3291303 - DNA, 22 bp, Homo sapiens
cccagttctgctcctctccagg

SEQ ID NO: 3291304 - DNA, 23 bp, Homo sapiens
cccagttctgctcctctccaggc

SEQ ID NO: 3291305 - DNA, 19 bp, Homo sapiens
cccagttgcactcaggtga

SEQ ID NO: 3291306 - DNA, 17 bp, Homo sapiens
cccagtttcttcttaca

SEQ ID NO: 3291307 - DNA, 23 bp, Homo sapiens
cccataatagttagccctcagtc

SEQ ID NO: 3291308 - DNA, 21 bp, Homo sapiens
cccataattgctttgccaaaa

SEQ ID NO: 3291309 - DNA, 19 bp, Homo sapiens
cccataattttcttcatgc

SEQ ID NO: 3291310 - DNA, 16 bp, Homo sapiens
cccatagatcttctga

SEQ ID NO: 3291311 - DNA, 20 bp, Homo sapiens
cccatagcagccagttcaaa

SEQ ID NO: 3291312 - DNA, 12 bp, Homo sapiens
cccatcatccca

SEQ ID NO: 3291313 - DNA, 15 bp, Homo sapiens
cccatcccacaccct

SEQ ID NO: 3291314 - DNA, 14 bp, Homo sapiens
cccatccccaccag

SEQ ID NO: 3291315 - DNA, 15 bp, Homo sapiens
cccatccccaccagc

SEQ ID NO: 3291316 - DNA, 16 bp, Homo sapiens
cccatccccaccagct

SEQ ID NO: 3291317 - DNA, 15 bp, Homo sapiens
cccatccccctgccc

SEQ ID NO: 3291318 - DNA, 16 bp, Homo sapiens
cccatccctccccagt

SEQ ID NO: 3291319 - DNA, 13 bp, Homo sapiens
cccatccctcggg

SEQ ID NO: 3291320 - DNA, 23 bp, Homo sapiens
cccatccctcgggaagcagccag

SEQ ID NO: 3291321 - DNA, 14 bp, Homo sapiens
cccatccctgcctg

SEQ ID NO: 3291322 - DNA, 17 bp, Homo sapiens
cccatccctgtcatttt

SEQ ID NO: 3291323 - DNA, 12 bp, Homo sapiens
cccatcctaccc

SEQ ID NO: 3291324 - DNA, 13 bp, Homo sapiens
cccatcctaccct

SEQ ID NO: 3291325 - DNA, 18 bp, Homo sapiens
cccatcctcatccctgac

SEQ ID NO: 3291326 - DNA, 15 bp, Homo sapiens
cccatcctccagctt

SEQ ID NO: 3291327 - DNA, 16 bp, Homo sapiens
cccatcctccagcttc

SEQ ID NO: 3291328 - DNA, 14 bp, Homo sapiens
cccatcctggggca

SEQ ID NO: 3291329 - DNA, 14 bp, Homo sapiens
cccatctcagcctc

SEQ ID NO: 3291330 - DNA, 16 bp, Homo sapiens
cccatctcaggtgcca

SEQ ID NO: 3291331 - DNA, 16 bp, Homo sapiens
cccatctccccaggcc

SEQ ID NO: 3291332 - DNA, 17 bp, Homo sapiens
cccatctccccaggcct

SEQ ID NO: 3291333 - DNA, 19 bp, Homo sapiens
cccatctccccaggcctcc

SEQ ID NO: 3291334 - DNA, 15 bp, Homo sapiens
cccatctccctgcct

SEQ ID NO: 3291335 - DNA, 17 bp, Homo sapiens
cccatctccctgcctgg

SEQ ID NO: 3291336 - DNA, 20 bp, Homo sapiens
cccatctccctgcctggccc

SEQ ID NO: 3291337 - DNA, 18 bp, Homo sapiens
cccatctcggagcatccc

SEQ ID NO: 3291338 - DNA, 15 bp, Homo sapiens
cccatcttactggaa

SEQ ID NO: 3291339 - DNA, 15 bp, Homo sapiens
cccatcttccacctg

SEQ ID NO: 3291340 - DNA, 17 bp, Homo sapiens
cccatcttcctgctgct

SEQ ID NO: 3291341 - DNA, 13 bp, Homo sapiens
cccatgacccacc

SEQ ID NO: 3291342 - DNA, 17 bp, Homo sapiens
cccatgacccacccctg

SEQ ID NO: 3291343 - DNA, 21 bp, Homo sapiens
cccatgacccacccctgtgct

SEQ ID NO: 3291344 - DNA, 19 bp, Homo sapiens
cccatgactgcacccagct

SEQ ID NO: 3291345 - DNA, 20 bp, Homo sapiens
cccatgactgcacccagctc

SEQ ID NO: 3291346 - DNA, 22 bp, Homo sapiens
cccatgactttatatggatgat

SEQ ID NO: 3291347 - DNA, 15 bp, Homo sapiens
cccatgagcctgccc

SEQ ID NO: 3291348 - DNA, 16 bp, Homo sapiens
cccatgagcctgcccg

SEQ ID NO: 3291349 - DNA, 14 bp, Homo sapiens
cccatgcaggccct

SEQ ID NO: 3291350 - DNA, 19 bp, Homo sapiens
cccatgcctgtccagcctg

SEQ ID NO: 3291351 - DNA, 20 bp, Homo sapiens
cccatgcctgtccagcctgg

SEQ ID NO: 3291352 - DNA, 13 bp, Homo sapiens
cccatgcctgtct

SEQ ID NO: 3291353 - DNA, 21 bp, Homo sapiens
cccatgcgtgccgcctgctcc

SEQ ID NO: 3291354 - DNA, 17 bp, Homo sapiens
cccatgctctgccccaa

SEQ ID NO: 3291355 - DNA, 20 bp, Homo sapiens
cccatgctctgccccaagcc

SEQ ID NO: 3291356 - DNA, 13 bp, Homo sapiens
cccatggaatatt

SEQ ID NO: 3291357 - DNA, 22 bp, Homo sapiens
cccatggacactccagtgccag

SEQ ID NO: 3291358 - DNA, 22 bp, Homo sapiens
cccatggcccccaataaaggca

SEQ ID NO: 3291359 - DNA, 21 bp, Homo sapiens
cccatgggctgagtggggagc

SEQ ID NO: 3291360 - DNA, 21 bp, Homo sapiens
cccatgggcttggacttcctg

SEQ ID NO: 3291361 - DNA, 15 bp, Homo sapiens
cccatgtaaatacca

SEQ ID NO: 3291362 - DNA, 21 bp, Homo sapiens
cccatgtcaccggtcagtgcc

SEQ ID NO: 3291363 - DNA, 22 bp, Homo sapiens
cccatgtgcctgcaccaggaga

SEQ ID NO: 3291364 - DNA, 16 bp, Homo sapiens
cccatgtggctgaaga

SEQ ID NO: 3291365 - DNA, 17 bp, Homo sapiens
cccatgtggctgaagac

SEQ ID NO: 3291366 - DNA, 22 bp, Homo sapiens
cccatgtgtcccctcactctgt

SEQ ID NO: 3291367 - DNA, 16 bp, Homo sapiens
cccattaggacaatca

SEQ ID NO: 3291368 - DNA, 22 bp, Homo sapiens
cccattcacttctgcattcctg

SEQ ID NO: 3291369 - DNA, 18 bp, Homo sapiens
cccattcagagactgtcc

SEQ ID NO: 3291370 - DNA, 20 bp, Homo sapiens
cccattcatattaagacagt

SEQ ID NO: 3291371 - DNA, 13 bp, Homo sapiens
cccattcccacca

SEQ ID NO: 3291372 - DNA, 14 bp, Homo sapiens
cccattcctccctc

SEQ ID NO: 3291373 - DNA, 21 bp, Homo sapiens
cccattcggtgtggtgcagtg

SEQ ID NO: 3291374 - DNA, 13 bp, Homo sapiens
cccattctgcctg

SEQ ID NO: 3291375 - DNA, 14 bp, Homo sapiens
cccattctgcctgc

SEQ ID NO: 3291376 - DNA, 22 bp, Homo sapiens
cccattctgcctgcccaggccc

SEQ ID NO: 3291377 - DNA, 21 bp, Homo sapiens
cccattgcatcacctctgtaa

SEQ ID NO: 3291378 - DNA, 21 bp, Homo sapiens
cccattggtgttgtcattgta

SEQ ID NO: 3291379 - DNA, 12 bp, Homo sapiens
cccatttcagct

SEQ ID NO: 3291380 - DNA, 13 bp, Homo sapiens
cccatttcaggaa

SEQ ID NO: 3291381 - DNA, 14 bp, Homo sapiens
cccatttcccatct

SEQ ID NO: 3291382 - DNA, 15 bp, Homo sapiens
cccatttcccatctg

SEQ ID NO: 3291383 - DNA, 19 bp, Homo sapiens
cccatttctatttatttac

SEQ ID NO: 3291384 - DNA, 14 bp, Homo sapiens
cccattttcccctt

SEQ ID NO: 3291385 - DNA, 20 bp, Homo sapiens
cccattttccccttcctcat

SEQ ID NO: 3291386 - DNA, 22 bp, Homo sapiens
cccatttttgctctatgggaaa

SEQ ID NO: 3291387 - DNA, 17 bp, Homo sapiens
ccccaaacatagcccct

SEQ ID NO: 3291388 - DNA, 23 bp, Homo sapiens
ccccttgccctccgcctgggatc

SEQ ID NO: 3291389 - DNA, 17 bp, Homo sapiens
ccccttgcccttgccct

SEQ ID NO: 3291390 - DNA, 13 bp, Homo sapiens
ccccttgggcatc

SEQ ID NO: 3291391 - DNA, 24 bp, Homo sapiens
cccctttcagatgtcttctgcctg

SEQ ID NO: 3291392 - DNA, 22 bp, Homo sapiens
cccctttcctaaagccatcatg

SEQ ID NO: 3291393 - DNA, 12 bp, Homo sapiens
cccctttgtgct

SEQ ID NO: 3291394 - DNA, 16 bp, Homo sapiens
cccctttgtgctgtgg

SEQ ID NO: 3291395 - DNA, 15 bp, Homo sapiens
ccccttttcttttct

SEQ ID NO: 3291396 - DNA, 20 bp, Homo sapiens
ccccttttcttttctaccct

SEQ ID NO: 3291397 - DNA, 23 bp, Homo sapiens
ccccttttcttttctaccctagc

SEQ ID NO: 3291398 - DNA, 19 bp, Homo sapiens
cccgaaactccacccgttc

SEQ ID NO: 3291399 - DNA, 19 bp, Homo sapiens
cccgaactgtgccttcgct

SEQ ID NO: 3291400 - DNA, 20 bp, Homo sapiens
cccgaagaatggagaggaac

SEQ ID NO: 3291401 - DNA, 22 bp, Homo sapiens
cccgaaggttatggtcaatccc

SEQ ID NO: 3291402 - DNA, 12 bp, Homo sapiens
cccgaagttcag

SEQ ID NO: 3291403 - DNA, 14 bp, Homo sapiens
cccgactcctcaaa

SEQ ID NO: 3291404 - DNA, 22 bp, Homo sapiens
cccgagatgtgacccaccagtg

SEQ ID NO: 3291405 - DNA, 13 bp, Homo sapiens
cccgagctcttgg

SEQ ID NO: 3291406 - DNA, 16 bp, Homo sapiens
cccgagctcttggcct

SEQ ID NO: 3291407 - DNA, 22 bp, Homo sapiens
cccgagctggtgcattacagag

SEQ ID NO: 3291408 - DNA, 14 bp, Homo sapiens
cccgagctgtcccc

SEQ ID NO: 3291409 - DNA, 15 bp, Homo sapiens
cccgaggagctgggc

SEQ ID NO: 3291410 - DNA, 19 bp, Homo sapiens
cccgaggagctgggcccct

SEQ ID NO: 3291411 - DNA, 19 bp, Homo sapiens
cccgaggccgcgtgcgtga

SEQ ID NO: 3291412 - DNA, 15 bp, Homo sapiens
cccgagtagctggga

SEQ ID NO: 3291413 - DNA, 18 bp, Homo sapiens
cccgagtagctgggacta

SEQ ID NO: 3291414 - DNA, 21 bp, Homo sapiens
cccgagtagctgggactacag

SEQ ID NO: 3291415 - DNA, 18 bp, Homo sapiens
cccgagtgcggcgtggag

SEQ ID NO: 3291416 - DNA, 20 bp, Homo sapiens
cccgatatattttagcattt

SEQ ID NO: 3291417 - DNA, 22 bp, Homo sapiens
cccgatgctgctttcccctgtg

SEQ ID NO: 3291418 - DNA, 15 bp, Homo sapiens
cccgatgtcccctgc

SEQ ID NO: 3291419 - DNA, 16 bp, Homo sapiens
cccgatgtcccctgcg

SEQ ID NO: 3291420 - DNA, 16 bp, Homo sapiens
cccgatgtggacctct

SEQ ID NO: 3291421 - DNA, 19 bp, Homo sapiens
cccgcaaaccccctttgtg

SEQ ID NO: 3291422 - DNA, 16 bp, Homo sapiens
cccgcacagcagcctg

SEQ ID NO: 3291423 - DNA, 15 bp, Homo sapiens
cccgcacagccaccc

SEQ ID NO: 3291424 - DNA, 16 bp, Homo sapiens
cccgcacagccacccg

SEQ ID NO: 3291425 - DNA, 19 bp, Homo sapiens
cccgcaccccccaagctgt

SEQ ID NO: 3291426 - DNA, 12 bp, Homo sapiens
cccgcacccccg

SEQ ID NO: 3291427 - DNA, 18 bp, Homo sapiens
cccgcaccccggcctcag

SEQ ID NO: 3291428 - DNA, 14 bp, Homo sapiens
cccgcagacctccc

SEQ ID NO: 3291429 - DNA, 19 bp, Homo sapiens
cccgcagacctccccagcc

SEQ ID NO: 3291430 - DNA, 18 bp, Homo sapiens
cccgcaggaactgggctg

SEQ ID NO: 3291431 - DNA, 22 bp, Homo sapiens
cccgcaggaactgggctgggcc

SEQ ID NO: 3291432 - DNA, 14 bp, Homo sapiens
cccgcagtccccag

SEQ ID NO: 3291433 - DNA, 21 bp, Homo sapiens
cccgcagtgctgggaccagag

SEQ ID NO: 3291434 - DNA, 22 bp, Homo sapiens
cccgcagtgctgggaccagagc

SEQ ID NO: 3291435 - DNA, 24 bp, Homo sapiens
cccgcagtgctgggaccagagcca

SEQ ID NO: 3291436 - DNA, 15 bp, Homo sapiens
cccgccacctcaggg

SEQ ID NO: 3291437 - DNA, 16 bp, Homo sapiens
cccgccacctcagggc

SEQ ID NO: 3291438 - DNA, 11 bp, Homo sapiens
cccgccagggc

SEQ ID NO: 3291439 - DNA, 12 bp, Homo sapiens
cccgccagggct

SEQ ID NO: 3291440 - DNA, 13 bp, Homo sapiens
cccgcccagctgc

SEQ ID NO: 3291441 - DNA, 15 bp, Homo sapiens
cccgcccctgcagca

SEQ ID NO: 3291442 - DNA, 17 bp, Homo sapiens
cccgcccctgcagcacg

SEQ ID NO: 3291443 - DNA, 13 bp, Homo sapiens
cccgccctcaggc

SEQ ID NO: 3291444 - DNA, 16 bp, Homo sapiens
cccgccgcctcccacg

SEQ ID NO: 3291445 - DNA, 19 bp, Homo sapiens
cccgccgcttttctcctct

SEQ ID NO: 3291446 - DNA, 13 bp, Homo sapiens
cccgcctctcccg

SEQ ID NO: 3291447 - DNA, 21 bp, Homo sapiens
cccgcctctcccgtcagggcc

SEQ ID NO: 3291448 - DNA, 12 bp, Homo sapiens
cccgcctgccct

SEQ ID NO: 3291449 - DNA, 21 bp, Homo sapiens
cccgcctggccagggcagggc

SEQ ID NO: 3291450 - DNA, 16 bp, Homo sapiens
cccgcggtgctctggc

SEQ ID NO: 3291451 - DNA, 13 bp, Homo sapiens
cccgctaaggaag

SEQ ID NO: 3291452 - DNA, 13 bp, Homo sapiens
cccgctcagccct

SEQ ID NO: 3291453 - DNA, 19 bp, Homo sapiens
cccgctcagccctccctgc

SEQ ID NO: 3291454 - DNA, 23 bp, Homo sapiens
cccgctcagccctccctgcccct

SEQ ID NO: 3291455 - DNA, 18 bp, Homo sapiens
cccgctgagctgagtggc

SEQ ID NO: 3291456 - DNA, 19 bp, Homo sapiens
cccgctgcaatgcctagac

SEQ ID NO: 3291457 - DNA, 21 bp, Homo sapiens
cccgctgggatttcttcgctg

SEQ ID NO: 3291458 - DNA, 19 bp, Homo sapiens
cccggagattggacggcct

SEQ ID NO: 3291459 - DNA, 15 bp, Homo sapiens
cccggagcacagccc

SEQ ID NO: 3291460 - DNA, 17 bp, Homo sapiens
cccggagcacagccctg

SEQ ID NO: 3291461 - DNA, 18 bp, Homo sapiens
cccggagcacagccctgg

SEQ ID NO: 3291462 - DNA, 14 bp, Homo sapiens
cccggaggaaatct

SEQ ID NO: 3291463 - DNA, 15 bp, Homo sapiens
cccggaggaaatctg

SEQ ID NO: 3291464 - DNA, 16 bp, Homo sapiens
cccggaggaaatctgc

SEQ ID NO: 3291465 - DNA, 18 bp, Homo sapiens
cccggaggggcctggcag

SEQ ID NO: 3291466 - DNA, 14 bp, Homo sapiens
cccggatcagagca

SEQ ID NO: 3291467 - DNA, 19 bp, Homo sapiens
cccggcaccctctggccgc

SEQ ID NO: 3291468 - DNA, 13 bp, Homo sapiens
cccggcaggccct

SEQ ID NO: 3291469 - DNA, 14 bp, Homo sapiens
cccggcaggccctg

SEQ ID NO: 3291470 - DNA, 15 bp, Homo sapiens
cccggcaggccctgc

SEQ ID NO: 3291471 - DNA, 16 bp, Homo sapiens
cccggcaggccctgca

SEQ ID NO: 3291472 - DNA, 19 bp, Homo sapiens
cccggcaggccctgcagtg

SEQ ID NO: 3291473 - DNA, 14 bp, Homo sapiens
cccggccacctctg

SEQ ID NO: 3291474 - DNA, 21 bp, Homo sapiens
cccggccacctctgcggaccc

SEQ ID NO: 3291475 - DNA, 17 bp, Homo sapiens
cccggccagcgggcaca

SEQ ID NO: 3291476 - DNA, 19 bp, Homo sapiens
cccggccagcgggcacagg

SEQ ID NO: 3291477 - DNA, 14 bp, Homo sapiens
cccggccccagcca

SEQ ID NO: 3291478 - DNA, 15 bp, Homo sapiens
cccggccccagccag

SEQ ID NO: 3291479 - DNA, 16 bp, Homo sapiens
cccggccccagccaga

SEQ ID NO: 3291480 - DNA, 14 bp, Homo sapiens
cccggccggcctgg

SEQ ID NO: 3291481 - DNA, 12 bp, Homo sapiens
cccggcctcagg

SEQ ID NO: 3291482 - DNA, 16 bp, Homo sapiens
cccggcctcagggcgc

SEQ ID NO: 3291483 - DNA, 22 bp, Homo sapiens
cccggcctcctcggagagcagc

SEQ ID NO: 3291484 - DNA, 11 bp, Homo sapiens
cccggcctctt

SEQ ID NO: 3291485 - DNA, 15 bp, Homo sapiens
cccggcctcttccac

SEQ ID NO: 3291486 - DNA, 20 bp, Homo sapiens
cccggcctgctcccagcagc

SEQ ID NO: 3291487 - DNA, 14 bp, Homo sapiens
cccggcgccgggca

SEQ ID NO: 3291488 - DNA, 16 bp, Homo sapiens
cccggcgccgggcacc

SEQ ID NO: 3291489 - DNA, 12 bp, Homo sapiens
cccggctccagg

SEQ ID NO: 3291490 - DNA, 22 bp, Homo sapiens
cccggctcgagcagtcctgcct

SEQ ID NO: 3291491 - DNA, 16 bp, Homo sapiens
cccggctgcagaggcc

SEQ ID NO: 3291492 - DNA, 14 bp, Homo sapiens
cccggctgcctgcc

SEQ ID NO: 3291493 - DNA, 15 bp, Homo sapiens
cccggcttcctgtgc

SEQ ID NO: 3291494 - DNA, 20 bp, Homo sapiens
cccgggacccacggagccct

SEQ ID NO: 3291495 - DNA, 23 bp, Homo sapiens
cccgggacgcaggggttgcagtg

SEQ ID NO: 3291496 - DNA, 16 bp, Homo sapiens
cccgggcaaagggtct

SEQ ID NO: 3291497 - DNA, 22 bp, Homo sapiens
cccggggaaaggcaaggtccgg

SEQ ID NO: 3291498 - DNA, 16 bp, Homo sapiens
cccggggacccccaac

SEQ ID NO: 3291499 - DNA, 16 bp, Homo sapiens
cccggggaccctgtga

SEQ ID NO: 3291500 - DNA, 17 bp, Homo sapiens
cccggggccagagacat

SEQ ID NO: 3291501 - DNA, 17 bp, Homo sapiens
cccggtcccgagtacag

SEQ ID NO: 3291502 - DNA, 13 bp, Homo sapiens
cccggtggcggca

SEQ ID NO: 3291503 - DNA, 18 bp, Homo sapiens
cccggtggcggcagggcc

SEQ ID NO: 3291504 - DNA, 21 bp, Homo sapiens
cccgtacctcttcccatgact

SEQ ID NO: 3291505 - DNA, 15 bp, Homo sapiens
cccgtcctgcctgtg

SEQ ID NO: 3291506 - DNA, 17 bp, Homo sapiens
cccgtcctgcctgtggc

SEQ ID NO: 3291507 - DNA, 17 bp, Homo sapiens
cccgtctggcccaccag

SEQ ID NO: 3291508 - DNA, 14 bp, Homo sapiens
cccgtgaagcagtg

SEQ ID NO: 3291509 - DNA, 18 bp, Homo sapiens
cccgtgaagcagtgcctc

SEQ ID NO: 3291510 - DNA, 19 bp, Homo sapiens
cccgtgaagcagtgcctcg

SEQ ID NO: 3291511 - DNA, 17 bp, Homo sapiens
cccgtgcagtacaggca

SEQ ID NO: 3291512 - DNA, 19 bp, Homo sapiens
cccgtggccatccctgtga

SEQ ID NO: 3291513 - DNA, 12 bp, Homo sapiens
cccgtggtctct

SEQ ID NO: 3291514 - DNA, 16 bp, Homo sapiens
cccgttccctgtcaga

SEQ ID NO: 3291515 - DNA, 20 bp, Homo sapiens
ccctcgacagcgcccctgct

SEQ ID NO: 3291516 - DNA, 17 bp, Homo sapiens
ccctcgatcatatttcc

SEQ ID NO: 3291517 - DNA, 17 bp, Homo sapiens
ccctcggaagccgtctg

SEQ ID NO: 3291518 - DNA, 23 bp, Homo sapiens
ccctcggaagccgtctgactcca

SEQ ID NO: 3291519 - DNA, 17 bp, Homo sapiens
ccctcgggaagcagcca

SEQ ID NO: 3291520 - DNA, 19 bp, Homo sapiens
ccctcgggccccatcctca

SEQ ID NO: 3291521 - DNA, 20 bp, Homo sapiens
ccctcggggggtcacaggcc

SEQ ID NO: 3291522 - DNA, 14 bp, Homo sapiens
ccctcggtggctgc

SEQ ID NO: 3291523 - DNA, 16 bp, Homo sapiens
ccctcggtggctgcac

SEQ ID NO: 3291524 - DNA, 19 bp, Homo sapiens
ccctcgtccacaggggcag

SEQ ID NO: 3291525 - DNA, 23 bp, Homo sapiens
ccctcgtccacaggggcaggcct

SEQ ID NO: 3291526 - DNA, 16 bp, Homo sapiens
ccctcgtcctgtccca

SEQ ID NO: 3291527 - DNA, 20 bp, Homo sapiens
ccctcgtggccagcccggct

SEQ ID NO: 3291528 - DNA, 18 bp, Homo sapiens
ccctcgtggtccccaaca

SEQ ID NO: 3291529 - DNA, 22 bp, Homo sapiens
ccctcgtgtcagctcaggcagc

SEQ ID NO: 3291530 - DNA, 13 bp, Homo sapiens
ccctctatttatt

SEQ ID NO: 3291531 - DNA, 23 bp, Homo sapiens
ccctctcagaggcctgctgccag

SEQ ID NO: 3291532 - DNA, 13 bp, Homo sapiens
ccctctcagctcc

SEQ ID NO: 3291533 - DNA, 12 bp, Homo sapiens
ccctctcctgcc

SEQ ID NO: 3291534 - DNA, 11 bp, Homo sapiens
ccctctcctgt

SEQ ID NO: 3291535 - DNA, 17 bp, Homo sapiens
ccctctctcttctgctc

SEQ ID NO: 3291536 - DNA, 18 bp, Homo sapiens
ccctctctcttctgctcc

SEQ ID NO: 3291537 - DNA, 22 bp, Homo sapiens
ccctctctcttctgctccaccc

SEQ ID NO: 3291538 - DNA, 10 bp, Homo sapiens
ccctctctgc

SEQ ID NO: 3291539 - DNA, 20 bp, Homo sapiens
ccctctctgcagacttccca

SEQ ID NO: 3291540 - DNA, 13 bp, Homo sapiens
ccctctctgctcc

SEQ ID NO: 3291541 - DNA, 14 bp, Homo sapiens
ccctctctgctcct

SEQ ID NO: 3291542 - DNA, 18 bp, Homo sapiens
ccctctctgctccttcac

SEQ ID NO: 3291543 - DNA, 10 bp, Homo sapiens
ccctctgagg

SEQ ID NO: 3291544 - DNA, 12 bp, Homo sapiens
ccctctgcagaa

SEQ ID NO: 3291545 - DNA, 9 bp, Homo sapiens
ccctctgcc

SEQ ID NO: 3291546 - DNA, 19 bp, Homo sapiens
ccctctgccaccagagacc

SEQ ID NO: 3291547 - DNA, 17 bp, Homo sapiens
ccctctgccccaagcag

SEQ ID NO: 3291548 - DNA, 20 bp, Homo sapiens
ccctctgccccaagcagcca

SEQ ID NO: 3291549 - DNA, 20 bp, Homo sapiens
ccctctgccggtcgggcagc

SEQ ID NO: 3291550 - DNA, 22 bp, Homo sapiens
ccctctgccggtcgggcagcca

SEQ ID NO: 3291551 - DNA, 22 bp, Homo sapiens
ccctctggaggggtgtggctcc

SEQ ID NO: 3291552 - DNA, 12 bp, Homo sapiens
ccctctggcttc

SEQ ID NO: 3291553 - DNA, 15 bp, Homo sapiens
ccctctggcttccca

SEQ ID NO: 3291554 - DNA, 18 bp, Homo sapiens
ccctctgtgtatttgctt

SEQ ID NO: 3291555 - DNA, 20 bp, Homo sapiens
ccctctgtgtatttgctttt

SEQ ID NO: 3291556 - DNA, 11 bp, Homo sapiens
ccctcttcctg

SEQ ID NO: 3291557 - DNA, 15 bp, Homo sapiens
ccctcttcctgacga

SEQ ID NO: 3291558 - DNA, 15 bp, Homo sapiens
ccctcttcctgtgat

SEQ ID NO: 3291559 - DNA, 21 bp, Homo sapiens
ccctcttcggtgttcttcttc

SEQ ID NO: 3291560 - DNA, 21 bp, Homo sapiens
ccctcttcttctttccttcca

SEQ ID NO: 3291561 - DNA, 12 bp, Homo sapiens
ccctcttgtaag

SEQ ID NO: 3291562 - DNA, 21 bp, Homo sapiens
ccctcttgtccctttccctac

SEQ ID NO: 3291563 - DNA, 16 bp, Homo sapiens
ccctctttccctgcga

SEQ ID NO: 3291564 - DNA, 18 bp, Homo sapiens
ccctctttccctgcgaga

SEQ ID NO: 3291565 - DNA, 21 bp, Homo sapiens
ccctctttggctcccctgtac

SEQ ID NO: 3291566 - DNA, 12 bp, Homo sapiens
ccctgaaacacg

SEQ ID NO: 3291567 - DNA, 19 bp, Homo sapiens
ccctgaaacacgaaacttg

SEQ ID NO: 3291568 - DNA, 21 bp, Homo sapiens
ccctgaaacctagtactgccc

SEQ ID NO: 3291569 - DNA, 17 bp, Homo sapiens
ccctgaagccagccttc

SEQ ID NO: 3291570 - DNA, 20 bp, Homo sapiens
ccctgaatggttccatgcct

SEQ ID NO: 3291571 - DNA, 22 bp, Homo sapiens
ccctgacctcccagccctatgg

SEQ ID NO: 3291572 - DNA, 15 bp, Homo sapiens
ccctgacctccgccc

SEQ ID NO: 3291573 - DNA, 16 bp, Homo sapiens
ccctgagatcccctga

SEQ ID NO: 3291574 - DNA, 22 bp, Homo sapiens
ccctgagcgcctggatttctgg

SEQ ID NO: 3291575 - DNA, 22 bp, Homo sapiens
ccctgaggaaggaggggaagct

SEQ ID NO: 3291576 - DNA, 14 bp, Homo sapiens
ccctgaggactgga

SEQ ID NO: 3291577 - DNA, 18 bp, Homo sapiens
ccctgaggactggagacc

SEQ ID NO: 3291578 - DNA, 16 bp, Homo sapiens
ccctgaggcctagact

SEQ ID NO: 3291579 - DNA, 17 bp, Homo sapiens
ccctgaggcctgaggcc

SEQ ID NO: 3291580 - DNA, 18 bp, Homo sapiens
ccctgaggcctgaggcct

SEQ ID NO: 3291581 - DNA, 20 bp, Homo sapiens
ccctgaggtgaaagggagct

SEQ ID NO: 3291582 - DNA, 19 bp, Homo sapiens
ccctgaggtgtgggggctg

SEQ ID NO: 3291583 - DNA, 21 bp, Homo sapiens
ccctgaggtgtgggggctgca

SEQ ID NO: 3291584 - DNA, 23 bp, Homo sapiens
ccctgaggtgtgggggctgcagc

SEQ ID NO: 3291585 - DNA, 20 bp, Homo sapiens
ccctgagttcatccaggccc

SEQ ID NO: 3291586 - DNA, 17 bp, Homo sapiens
ccctgatcactcccagc

SEQ ID NO: 3291587 - DNA, 18 bp, Homo sapiens
ccctgatcactcccagca

SEQ ID NO: 3291588 - DNA, 20 bp, Homo sapiens
ccctgatgacacccaccctg

SEQ ID NO: 3291589 - DNA, 19 bp, Homo sapiens
ccctgatgtgacattccat

SEQ ID NO: 3291590 - DNA, 17 bp, Homo sapiens
ccctgattgacctgctc

SEQ ID NO: 3291591 - DNA, 22 bp, Homo sapiens
ccctgattgacctgctccgctg

SEQ ID NO: 3291592 - DNA, 16 bp, Homo sapiens
ccctgatttcttgctt

SEQ ID NO: 3291593 - DNA, 18 bp, Homo sapiens
ccctgcaaacagaacagg

SEQ ID NO: 3291594 - DNA, 22 bp, Homo sapiens
ccctgcaaacagaacagggtca

SEQ ID NO: 3291595 - DNA, 24 bp, Homo sapiens
ccctgcaaacagaacagggtcatg

SEQ ID NO: 3291596 - DNA, 21 bp, Homo sapiens
ccctgcaacttccgctgaggg

SEQ ID NO: 3291597 - DNA, 15 bp, Homo sapiens
ccctgcaaggcccac

SEQ ID NO: 3291598 - DNA, 18 bp, Homo sapiens
ccctgcaaggcccacagg

SEQ ID NO: 3291599 - DNA, 21 bp, Homo sapiens
ccctgcaaggcccacaggagg

SEQ ID NO: 3291600 - DNA, 18 bp, Homo sapiens
ccctgcaccctggaaagg

SEQ ID NO: 3291601 - DNA, 13 bp, Homo sapiens
ccctgcacctgct

SEQ ID NO: 3291602 - DNA, 21 bp, Homo sapiens
ccctgcactaaagccagcctg

SEQ ID NO: 3291603 - DNA, 12 bp, Homo sapiens
ccctgcacttgc

SEQ ID NO: 3291604 - DNA, 22 bp, Homo sapiens
ccctgcagcccaaaacccaggg

SEQ ID NO: 3291605 - DNA, 22 bp, Homo sapiens
ccctgcagggccatctgactgc

SEQ ID NO: 3291606 - DNA, 21 bp, Homo sapiens
ccctgcagggcgcccctggga

SEQ ID NO: 3291607 - DNA, 21 bp, Homo sapiens
ccctgcagtgttcgcttggct

SEQ ID NO: 3291608 - DNA, 18 bp, Homo sapiens
ccctgccaagactcctca

SEQ ID NO: 3291609 - DNA, 20 bp, Homo sapiens
ccctgccacatacaggtgct

SEQ ID NO: 3291610 - DNA, 21 bp, Homo sapiens
ccctgccacatacaggtgctc

SEQ ID NO: 3291611 - DNA, 12 bp, Homo sapiens
ccctgccaccct

SEQ ID NO: 3291612 - DNA, 19 bp, Homo sapiens
ccctgccactcactaggcc

SEQ ID NO: 3291613 - DNA, 10 bp, Homo sapiens
ccctgcccaa

SEQ ID NO: 3291614 - DNA, 20 bp, Homo sapiens
ccctgcccaaacccttaact

SEQ ID NO: 3291615 - DNA, 15 bp, Homo sapiens
ccctgcccaggccgg

SEQ ID NO: 3291616 - DNA, 18 bp, Homo sapiens
ccctgcccaggccggcca

SEQ ID NO: 3291617 - DNA, 13 bp, Homo sapiens
ccctgcccatgct

SEQ ID NO: 3291618 - DNA, 12 bp, Homo sapiens
ccctgccccaaa

SEQ ID NO: 3291619 - DNA, 13 bp, Homo sapiens
ccctgccccaaat

SEQ ID NO: 3291620 - DNA, 17 bp, Homo sapiens
ccctgccccagcccaag

SEQ ID NO: 3291621 - DNA, 18 bp, Homo sapiens
ccctgcccccagccccgg

SEQ ID NO: 3291622 - DNA, 15 bp, Homo sapiens
ccctgcccccatctc

SEQ ID NO: 3291623 - DNA, 16 bp, Homo sapiens
ccctgcccccatctcc

SEQ ID NO: 3291624 - DNA, 20 bp, Homo sapiens
ccctgcccccatctccccag

SEQ ID NO: 3291625 - DNA, 22 bp, Homo sapiens
ccctgccccccaaggttctggt

SEQ ID NO: 3291626 - DNA, 16 bp, Homo sapiens
ccctgccccccagcct

SEQ ID NO: 3291627 - DNA, 19 bp, Homo sapiens
ccctgccccccagcctctg

SEQ ID NO: 3291628 - DNA, 18 bp, Homo sapiens
ccctgccccctcccactc

SEQ ID NO: 3291629 - DNA, 20 bp, Homo sapiens
ccctgccccctggctgactg

SEQ ID NO: 3291630 - DNA, 18 bp, Homo sapiens
ccctgccccggaggaagc

SEQ ID NO: 3291631 - DNA, 11 bp, Homo sapiens
ccctgccccta

SEQ ID NO: 3291632 - DNA, 15 bp, Homo sapiens
ccctgcccctaggat

SEQ ID NO: 3291633 - DNA, 23 bp, Homo sapiens
ccctgcccctaggatgctgcagc

SEQ ID NO: 3291634 - DNA, 23 bp, Homo sapiens
ccctgcccctcccttcaaccatt

SEQ ID NO: 3291635 - DNA, 23 bp, Homo sapiens
ccctgcccggtggtttgccatgt

SEQ ID NO: 3291636 - DNA, 17 bp, Homo sapiens
ccctgccctcgtggcca

SEQ ID NO: 3291637 - DNA, 18 bp, Homo sapiens
ccctgccctcgtggccag

SEQ ID NO: 3291638 - DNA, 20 bp, Homo sapiens
ccctgccctcgtggccagcc

SEQ ID NO: 3291639 - DNA, 21 bp, Homo sapiens
ccctgccctcgtggccagccc

SEQ ID NO: 3291640 - DNA, 14 bp, Homo sapiens
ccgccattgccacc

SEQ ID NO: 3291641 - DNA, 14 bp, Homo sapiens
ccgcccacaccctc

SEQ ID NO: 3291642 - DNA, 22 bp, Homo sapiens
ccgcccagctgcacctgccagc

SEQ ID NO: 3291643 - DNA, 17 bp, Homo sapiens
ccgccccagccccttct

SEQ ID NO: 3291644 - DNA, 13 bp, Homo sapiens
ccgcccccagtcc

SEQ ID NO: 3291645 - DNA, 17 bp, Homo sapiens
ccgcccctgcagcacgg

SEQ ID NO: 3291646 - DNA, 18 bp, Homo sapiens
ccgccccttcccttccct

SEQ ID NO: 3291647 - DNA, 13 bp, Homo sapiens
ccgcccgaccagg

SEQ ID NO: 3291648 - DNA, 13 bp, Homo sapiens
ccgccctcctcgg

SEQ ID NO: 3291649 - DNA, 20 bp, Homo sapiens
ccgccctcctcgggccgagg

SEQ ID NO: 3291650 - DNA, 14 bp, Homo sapiens
ccgccctcttcctg

SEQ ID NO: 3291651 - DNA, 18 bp, Homo sapiens
ccgccctgctcctccctg

SEQ ID NO: 3291652 - DNA, 22 bp, Homo sapiens
ccgccctgctcctccctggctg

SEQ ID NO: 3291653 - DNA, 20 bp, Homo sapiens
ccgccgactttgtacccccc

SEQ ID NO: 3291654 - DNA, 13 bp, Homo sapiens
ccgccgccaccag

SEQ ID NO: 3291655 - DNA, 15 bp, Homo sapiens
ccgccgccaccagcc

SEQ ID NO: 3291656 - DNA, 15 bp, Homo sapiens
ccgccgcctcccacg

SEQ ID NO: 3291657 - DNA, 17 bp, Homo sapiens
ccgcctatcccaaacct

SEQ ID NO: 3291658 - DNA, 21 bp, Homo sapiens
ccgcctccctctcagaggcct

SEQ ID NO: 3291659 - DNA, 20 bp, Homo sapiens
ccgcctctcccgtcagggcc

SEQ ID NO: 3291660 - DNA, 14 bp, Homo sapiens
ccgcctgccctcat

SEQ ID NO: 3291661 - DNA, 16 bp, Homo sapiens
ccgcctgccctcatgg

SEQ ID NO: 3291662 - DNA, 22 bp, Homo sapiens
ccgcctgctccctgcacccatg

SEQ ID NO: 3291663 - DNA, 12 bp, Homo sapiens
ccgcctgctcct

SEQ ID NO: 3291664 - DNA, 18 bp, Homo sapiens
ccgcctgctcctcactgg

SEQ ID NO: 3291665 - DNA, 14 bp, Homo sapiens
ccgcctggccagga

SEQ ID NO: 3291666 - DNA, 23 bp, Homo sapiens
ccgcctggccaggagcaggcacg

SEQ ID NO: 3291667 - DNA, 23 bp, Homo sapiens
ccgcctgtctctttaagggcatg

SEQ ID NO: 3291668 - DNA, 16 bp, Homo sapiens
ccgccttcctcctcca

SEQ ID NO: 3291669 - DNA, 16 bp, Homo sapiens
ccgccttctcccacat

SEQ ID NO: 3291670 - DNA, 22 bp, Homo sapiens
ccgcctttgggttccatcttgc

SEQ ID NO: 3291671 - DNA, 23 bp, Homo sapiens
ccgcgcctacccttcccgcctcc

SEQ ID NO: 3291672 - DNA, 19 bp, Homo sapiens
ccgcgctcgcccagcagga

SEQ ID NO: 3291673 - DNA, 18 bp, Homo sapiens
ccgcgctctttcttccct

SEQ ID NO: 3291674 - DNA, 21 bp, Homo sapiens
ccgcgggagacagcttctctg

SEQ ID NO: 3291675 - DNA, 12 bp, Homo sapiens
ccgcggtgctct

SEQ ID NO: 3291676 - DNA, 15 bp, Homo sapiens
ccgcggtgctctggc

SEQ ID NO: 3291677 - DNA, 16 bp, Homo sapiens
ccgctacctccctccc

SEQ ID NO: 3291678 - DNA, 13 bp, Homo sapiens
ccgctcagccctc

SEQ ID NO: 3291679 - DNA, 16 bp, Homo sapiens
ccgctcccaccgcccc

SEQ ID NO: 3291680 - DNA, 18 bp, Homo sapiens
ccgctcccgctcccaggt

SEQ ID NO: 3291681 - DNA, 18 bp, Homo sapiens
ccgctctacatcttctgc

SEQ ID NO: 3291682 - DNA, 15 bp, Homo sapiens
ccgctgcaccacggc

SEQ ID NO: 3291683 - DNA, 17 bp, Homo sapiens
ccgctgcagggctccca

SEQ ID NO: 3291684 - DNA, 21 bp, Homo sapiens
ccgctgccaccacgtctgcca

SEQ ID NO: 3291685 - DNA, 22 bp, Homo sapiens
ccgctgccaccacgtctgccag

SEQ ID NO: 3291686 - DNA, 23 bp, Homo sapiens
ccgctgccaccacgtctgccagg

SEQ ID NO: 3291687 - DNA, 20 bp, Homo sapiens
ccgctgccacgttggagaag

SEQ ID NO: 3291688 - DNA, 12 bp, Homo sapiens
ccgctgccagca

SEQ ID NO: 3291689 - DNA, 18 bp, Homo sapiens
ccgctgccagcacagagc

SEQ ID NO: 3291690 - DNA, 13 bp, Homo sapiens
ccgctgccagcct

SEQ ID NO: 3291691 - DNA, 16 bp, Homo sapiens
ccgctgccgctgcacc

SEQ ID NO: 3291692 - DNA, 15 bp, Homo sapiens
ccgctgctccacgcg

SEQ ID NO: 3291693 - DNA, 17 bp, Homo sapiens
ccgctgctccacgcgct

SEQ ID NO: 3291694 - DNA, 20 bp, Homo sapiens
ccgctggccgggggaggtgg

SEQ ID NO: 3291695 - DNA, 23 bp, Homo sapiens
ccgctggctttgggaaagcccag

SEQ ID NO: 3291696 - DNA, 20 bp, Homo sapiens
ccgctgtaagctcctttgtg

SEQ ID NO: 3291697 - DNA, 15 bp, Homo sapiens
ccgctgtgagcccct

SEQ ID NO: 3291698 - DNA, 20 bp, Homo sapiens
ccgctgtgagcccctggtcc

SEQ ID NO: 3291699 - DNA, 17 bp, Homo sapiens
ccgcttcacccctgcac

SEQ ID NO: 3291700 - DNA, 16 bp, Homo sapiens
ccgcttccctcctgcc

SEQ ID NO: 3291701 - DNA, 12 bp, Homo sapiens
ccgcttccttag

SEQ ID NO: 3291702 - DNA, 23 bp, Homo sapiens
ccgcttgaaaagctagtgtacct

SEQ ID NO: 3291703 - DNA, 16 bp, Homo sapiens
ccgcttgtggggaccc

SEQ ID NO: 3291704 - DNA, 13 bp, Homo sapiens
ccgcttttgttct

SEQ ID NO: 3291705 - DNA, 17 bp, Homo sapiens
ccggaaccacagggcca

SEQ ID NO: 3291706 - DNA, 21 bp, Homo sapiens
ccggaaggaggccaaccagcc

SEQ ID NO: 3291707 - DNA, 16 bp, Homo sapiens
ccggacttttctgcaa

SEQ ID NO: 3291708 - DNA, 17 bp, Homo sapiens
ccggagatgtagcaaaa

SEQ ID NO: 3291709 - DNA, 15 bp, Homo sapiens
ccggagcacagccct

SEQ ID NO: 3291710 - DNA, 21 bp, Homo sapiens
ccggagctttcaaagaaggaa

SEQ ID NO: 3291711 - DNA, 17 bp, Homo sapiens
ccggagggaagggacgg

SEQ ID NO: 3291712 - DNA, 16 bp, Homo sapiens
ccggaggggcctggca

SEQ ID NO: 3291713 - DNA, 17 bp, Homo sapiens
ccggaggggcctggcag

SEQ ID NO: 3291714 - DNA, 21 bp, Homo sapiens
ccggaggggcctggcagccgt

SEQ ID NO: 3291715 - DNA, 16 bp, Homo sapiens
ccggaggtcactccac

SEQ ID NO: 3291716 - DNA, 20 bp, Homo sapiens
ccggcacagggtctgctctt

SEQ ID NO: 3291717 - DNA, 15 bp, Homo sapiens
ccggcagcgggcgga

SEQ ID NO: 3291718 - DNA, 20 bp, Homo sapiens
ccggcagcgggcggagggga

SEQ ID NO: 3291719 - DNA, 11 bp, Homo sapiens
ccggcaggccc

SEQ ID NO: 3291720 - DNA, 12 bp, Homo sapiens
ccggcaggccct

SEQ ID NO: 3291721 - DNA, 14 bp, Homo sapiens
ccggcaggccctgc

SEQ ID NO: 3291722 - DNA, 15 bp, Homo sapiens
ccggcaggccctgca

SEQ ID NO: 3291723 - DNA, 20 bp, Homo sapiens
ccggcaggccctgcagtgtt

SEQ ID NO: 3291724 - DNA, 14 bp, Homo sapiens
ccggcatgggaaag

SEQ ID NO: 3291725 - DNA, 18 bp, Homo sapiens
ccggcatgtttccagcag

SEQ ID NO: 3291726 - DNA, 16 bp, Homo sapiens
ccggccaatggaaacc

SEQ ID NO: 3291727 - DNA, 18 bp, Homo sapiens
ccggccaccagatgctga

SEQ ID NO: 3291728 - DNA, 12 bp, Homo sapiens
ccggccacctct

SEQ ID NO: 3291729 - DNA, 15 bp, Homo sapiens
ccggccacctctgcg

SEQ ID NO: 3291730 - DNA, 17 bp, Homo sapiens
ccggccagcgggcacag

SEQ ID NO: 3291731 - DNA, 21 bp, Homo sapiens
ccggccagcgggcacagggca

SEQ ID NO: 3291732 - DNA, 16 bp, Homo sapiens
ccggccatactgcctt

SEQ ID NO: 3291733 - DNA, 16 bp, Homo sapiens
ccggcccagtgccact

SEQ ID NO: 3291734 - DNA, 14 bp, Homo sapiens
ccggcccctggcag

SEQ ID NO: 3291735 - DNA, 20 bp, Homo sapiens
ccggcccctggcagcacagc

SEQ ID NO: 3291736 - DNA, 14 bp, Homo sapiens
ccggccctagccca

SEQ ID NO: 3291737 - DNA, 16 bp, Homo sapiens
ccggccggcctggcac

SEQ ID NO: 3291738 - DNA, 11 bp, Homo sapiens
ccggcctcctc

SEQ ID NO: 3291739 - DNA, 16 bp, Homo sapiens
ccggcctctctggcct

SEQ ID NO: 3291740 - DNA, 21 bp, Homo sapiens
ccggcctctctggcctcccac

SEQ ID NO: 3291741 - DNA, 22 bp, Homo sapiens
ccggcctctctggcctcccacc

SEQ ID NO: 3291742 - DNA, 20 bp, Homo sapiens
ccggcctgctcccagcagcc

SEQ ID NO: 3291743 - DNA, 13 bp, Homo sapiens
ccggcctggcacc

SEQ ID NO: 3291744 - DNA, 23 bp, Homo sapiens
ccggcctgtaatcagctctcctg

SEQ ID NO: 3291745 - DNA, 14 bp, Homo sapiens
ccggcgctgcaggt

SEQ ID NO: 3291746 - DNA, 15 bp, Homo sapiens
ccggcgctgcaggta

SEQ ID NO: 3291747 - DNA, 19 bp, Homo sapiens
ccggctcgtgtatttatta

SEQ ID NO: 3291748 - DNA, 22 bp, Homo sapiens
ccggctcgtgtatttattaccg

SEQ ID NO: 3291749 - DNA, 17 bp, Homo sapiens
ccggctctttccttgct

SEQ ID NO: 3291750 - DNA, 15 bp, Homo sapiens
ccggctgcagaggcc

SEQ ID NO: 3291751 - DNA, 11 bp, Homo sapiens
ccggctggtga

SEQ ID NO: 3291752 - DNA, 23 bp, Homo sapiens
ccggctggttttgtaagatgctg

SEQ ID NO: 3291753 - DNA, 14 bp, Homo sapiens
ccggctgtggagca

SEQ ID NO: 3291754 - DNA, 15 bp, Homo sapiens
ccggctgtggagcaa

SEQ ID NO: 3291755 - DNA, 22 bp, Homo sapiens
ccgggaccaaactcacggacca

SEQ ID NO: 3291756 - DNA, 17 bp, Homo sapiens
ccgggagcctaggacca

SEQ ID NO: 3291757 - DNA, 15 bp, Homo sapiens
ccgggagcctccccc

SEQ ID NO: 3291758 - DNA, 19 bp, Homo sapiens
ccgggagcctccccctcag

SEQ ID NO: 3291759 - DNA, 22 bp, Homo sapiens
ccgggagcctccccctcagatg

SEQ ID NO: 3291760 - DNA, 15 bp, Homo sapiens
ccgggcaaagggtct

SEQ ID NO: 3291761 - DNA, 22 bp, Homo sapiens
ccgggcaaatggctgagatgga

SEQ ID NO: 3291762 - DNA, 18 bp, Homo sapiens
ccgggcaggcgtgactca

SEQ ID NO: 3291763 - DNA, 21 bp, Homo sapiens
ccgggccacgccccagcccga

SEQ ID NO: 3291764 - DNA, 16 bp, Homo sapiens
ccgggcccctgggctt

SEQ ID NO: 3291765 - DNA, 21 bp, Homo sapiens
ccgggcccctgggcttggcct

SEQ ID NO: 3291766 - DNA, 22 bp, Homo sapiens
cctagctttagaccctgggtgg

SEQ ID NO: 3291767 - DNA, 23 bp, Homo sapiens
cctagctttagaccctgggtggg

SEQ ID NO: 3291768 - DNA, 19 bp, Homo sapiens
cctaggaccactcagcccc

SEQ ID NO: 3291769 - DNA, 20 bp, Homo sapiens
cctaggaccactcagcccct

SEQ ID NO: 3291770 - DNA, 21 bp, Homo sapiens
cctaggaccactcagccccta

SEQ ID NO: 3291771 - DNA, 14 bp, Homo sapiens
cctaggagagccaa

SEQ ID NO: 3291772 - DNA, 22 bp, Homo sapiens
cctaggagagtttactgatgaa

SEQ ID NO: 3291773 - DNA, 22 bp, Homo sapiens
cctaggagatatctgagggagg

SEQ ID NO: 3291774 - DNA, 22 bp, Homo sapiens
cctaggagttgagtacagtgag

SEQ ID NO: 3291775 - DNA, 15 bp, Homo sapiens
cctaggatgctgcag

SEQ ID NO: 3291776 - DNA, 17 bp, Homo sapiens
cctaggatgctgcagca

SEQ ID NO: 3291777 - DNA, 23 bp, Homo sapiens
cctaggccaaatgcacaagctca

SEQ ID NO: 3291778 - DNA, 23 bp, Homo sapiens
cctaggccacaccatctcctttc

SEQ ID NO: 3291779 - DNA, 17 bp, Homo sapiens
cctaggctccaccccat

SEQ ID NO: 3291780 - DNA, 14 bp, Homo sapiens
cctagggaaaagtt

SEQ ID NO: 3291781 - DNA, 20 bp, Homo sapiens
cctagggtcttgggggtcag

SEQ ID NO: 3291782 - DNA, 15 bp, Homo sapiens
cctaggtgacagagt

SEQ ID NO: 3291783 - DNA, 18 bp, Homo sapiens
cctaggtgacagagtgag

SEQ ID NO: 3291784 - DNA, 15 bp, Homo sapiens
cctaggtgcagctcc

SEQ ID NO: 3291785 - DNA, 21 bp, Homo sapiens
cctaggtgcagctcctcagcg

SEQ ID NO: 3291786 - DNA, 19 bp, Homo sapiens
cctaggttcccggtcccga

SEQ ID NO: 3291787 - DNA, 21 bp, Homo sapiens
cctaggttccctgttcttcct

SEQ ID NO: 3291788 - DNA, 22 bp, Homo sapiens
cctaggtttttcctactgtcct

SEQ ID NO: 3291789 - DNA, 20 bp, Homo sapiens
cctagtaaaaccttgttcta

SEQ ID NO: 3291790 - DNA, 15 bp, Homo sapiens
cctagtactctctgc

SEQ ID NO: 3291791 - DNA, 23 bp, Homo sapiens
cctagtcaaaactatttttgtaa

SEQ ID NO: 3291792 - DNA, 21 bp, Homo sapiens
cctagtcccttcccctccctg

SEQ ID NO: 3291793 - DNA, 20 bp, Homo sapiens
cctagttccctctgctcagc

SEQ ID NO: 3291794 - DNA, 22 bp, Homo sapiens
cctagttccctctgctcagcca

SEQ ID NO: 3291795 - DNA, 13 bp, Homo sapiens
cctagttctctta

SEQ ID NO: 3291796 - DNA, 14 bp, Homo sapiens
cctagttctcttat

SEQ ID NO: 3291797 - DNA, 15 bp, Homo sapiens
cctagttctcttatc

SEQ ID NO: 3291798 - DNA, 16 bp, Homo sapiens
cctagtttcctctcct

SEQ ID NO: 3291799 - DNA, 18 bp, Homo sapiens
cctataaaattaaatgcc

SEQ ID NO: 3291800 - DNA, 17 bp, Homo sapiens
cctataaagtaaagcta

SEQ ID NO: 3291801 - DNA, 18 bp, Homo sapiens
cctataacttcttcctgc

SEQ ID NO: 3291802 - DNA, 20 bp, Homo sapiens
cctataacttcttcctgctg

SEQ ID NO: 3291803 - DNA, 16 bp, Homo sapiens
cctataagaagcctta

SEQ ID NO: 3291804 - DNA, 22 bp, Homo sapiens
cctataaggagagttcaagcct

SEQ ID NO: 3291805 - DNA, 15 bp, Homo sapiens
cctataatacaaata

SEQ ID NO: 3291806 - DNA, 18 bp, Homo sapiens
cctataatccttgataat

SEQ ID NO: 3291807 - DNA, 17 bp, Homo sapiens
cctataatcttatacaa

SEQ ID NO: 3291808 - DNA, 13 bp, Homo sapiens
cctatagagaggg

SEQ ID NO: 3291809 - DNA, 21 bp, Homo sapiens
cctatagagagggggctctcc

SEQ ID NO: 3291810 - DNA, 14 bp, Homo sapiens
cctatagtcccagc

SEQ ID NO: 3291811 - DNA, 18 bp, Homo sapiens
cctatataataaagctac

SEQ ID NO: 3291812 - DNA, 18 bp, Homo sapiens
cctatatgatttatagtt

SEQ ID NO: 3291813 - DNA, 18 bp, Homo sapiens
cctatattgttttcagtg

SEQ ID NO: 3291814 - DNA, 17 bp, Homo sapiens
cctatcacctatttcca

SEQ ID NO: 3291815 - DNA, 20 bp, Homo sapiens
cctatcatttattctgcttc

SEQ ID NO: 3291816 - DNA, 13 bp, Homo sapiens
cctatcccacctc

SEQ ID NO: 3291817 - DNA, 14 bp, Homo sapiens
cctatccctctcct

SEQ ID NO: 3291818 - DNA, 17 bp, Homo sapiens
cctatccgctgccagcc

SEQ ID NO: 3291819 - DNA, 15 bp, Homo sapiens
cctatcctcactgcc

SEQ ID NO: 3291820 - DNA, 13 bp, Homo sapiens
cctatccttggca

SEQ ID NO: 3291821 - DNA, 16 bp, Homo sapiens
cctatccttggcacca

SEQ ID NO: 3291822 - DNA, 19 bp, Homo sapiens
cctatccttggcaccaaag

SEQ ID NO: 3291823 - DNA, 22 bp, Homo sapiens
cctatcgccccctacgcgcctt

SEQ ID NO: 3291824 - DNA, 18 bp, Homo sapiens
cctatctaaccctcccat

SEQ ID NO: 3291825 - DNA, 16 bp, Homo sapiens
cctatctatcttccaa

SEQ ID NO: 3291826 - DNA, 18 bp, Homo sapiens
cctatctcgtgggagagc

SEQ ID NO: 3291827 - DNA, 16 bp, Homo sapiens
cctatctggggagctc

SEQ ID NO: 3291828 - DNA, 21 bp, Homo sapiens
cctatctggggagctcctggc

SEQ ID NO: 3291829 - DNA, 22 bp, Homo sapiens
cctatgaagttggcacatttca

SEQ ID NO: 3291830 - DNA, 17 bp, Homo sapiens
cctatgatattttctgt

SEQ ID NO: 3291831 - DNA, 15 bp, Homo sapiens
cctatgatggatggc

SEQ ID NO: 3291832 - DNA, 20 bp, Homo sapiens
cctatgcacatatggactct

SEQ ID NO: 3291833 - DNA, 16 bp, Homo sapiens
cctatgcccaggtacc

SEQ ID NO: 3291834 - DNA, 13 bp, Homo sapiens
cctatggaaaaaa

SEQ ID NO: 3291835 - DNA, 14 bp, Homo sapiens
cctatggagaattt

SEQ ID NO: 3291836 - DNA, 23 bp, Homo sapiens
cctatggctggccactgcacaga

SEQ ID NO: 3291837 - DNA, 20 bp, Homo sapiens
cctatgtcctaaggacacac

SEQ ID NO: 3291838 - DNA, 23 bp, Homo sapiens
cctatgtttgtctcacttttcat

SEQ ID NO: 3291839 - DNA, 16 bp, Homo sapiens
cctattcaccctccac

SEQ ID NO: 3291840 - DNA, 17 bp, Homo sapiens
cctattcaccctccact

SEQ ID NO: 3291841 - DNA, 22 bp, Homo sapiens
cctattcccacacctccacagt

SEQ ID NO: 3291842 - DNA, 16 bp, Homo sapiens
cctattctataaaact

SEQ ID NO: 3291843 - DNA, 15 bp, Homo sapiens
cctattttcatttgt

SEQ ID NO: 3291844 - DNA, 16 bp, Homo sapiens
cctattttcatttgta

SEQ ID NO: 3291845 - DNA, 14 bp, Homo sapiens
cctatttttgtaaa

SEQ ID NO: 3291846 - DNA, 13 bp, Homo sapiens
cctcaaacctcct

SEQ ID NO: 3291847 - DNA, 18 bp, Homo sapiens
cctcaaacctcctcttct

SEQ ID NO: 3291848 - DNA, 17 bp, Homo sapiens
cctcaaactcattgcag

SEQ ID NO: 3291849 - DNA, 14 bp, Homo sapiens
cctcaaagaaagtg

SEQ ID NO: 3291850 - DNA, 15 bp, Homo sapiens
cctcaacaagggaga

SEQ ID NO: 3291851 - DNA, 18 bp, Homo sapiens
cctcaacaagggagagac

SEQ ID NO: 3291852 - DNA, 19 bp, Homo sapiens
cctcaacagccaagtgtga

SEQ ID NO: 3291853 - DNA, 16 bp, Homo sapiens
cctcaacaggcccagg

SEQ ID NO: 3291854 - DNA, 15 bp, Homo sapiens
cctcaacctcctggg

SEQ ID NO: 3291855 - DNA, 18 bp, Homo sapiens
cctcaagccaatcccctc

SEQ ID NO: 3291856 - DNA, 20 bp, Homo sapiens
cctcaagccccagcagccct

SEQ ID NO: 3291857 - DNA, 13 bp, Homo sapiens
cctcaagccctga

SEQ ID NO: 3291858 - DNA, 13 bp, Homo sapiens
cctcaaggacttg

SEQ ID NO: 3291859 - DNA, 23 bp, Homo sapiens
cctcaaggttttaggttctaaag

SEQ ID NO: 3291860 - DNA, 16 bp, Homo sapiens
cctcaagtaaaagaaa

SEQ ID NO: 3291861 - DNA, 16 bp, Homo sapiens
cctcaagtagcactga

SEQ ID NO: 3291862 - DNA, 23 bp, Homo sapiens
cctcaagtgattctcctgcctca

SEQ ID NO: 3291863 - DNA, 13 bp, Homo sapiens
cctcaatgtttga

SEQ ID NO: 3291864 - DNA, 21 bp, Homo sapiens
cctcaatttttgtctcagaag

SEQ ID NO: 3291865 - DNA, 21 bp, Homo sapiens
cctcacaagcgctcccagcct

SEQ ID NO: 3291866 - DNA, 15 bp, Homo sapiens
cctcacacacacagc

SEQ ID NO: 3291867 - DNA, 15 bp, Homo sapiens
cctcacagcctctga

SEQ ID NO: 3291868 - DNA, 20 bp, Homo sapiens
cctcacagcctctgacccct

SEQ ID NO: 3291869 - DNA, 24 bp, Homo sapiens
cctcacagtgacccttcccaatca

SEQ ID NO: 3291870 - DNA, 21 bp, Homo sapiens
cctcacatagctacccaaaag

SEQ ID NO: 3291871 - DNA, 16 bp, Homo sapiens
cctcacccacccctgc

SEQ ID NO: 3291872 - DNA, 21 bp, Homo sapiens
cctcacccacccctgcacagt

SEQ ID NO: 3291873 - DNA, 17 bp, Homo sapiens
cctcacccccagctttg

SEQ ID NO: 3291874 - DNA, 24 bp, Homo sapiens
cctcaccccctcctggcaatcaat

SEQ ID NO: 3291875 - DNA, 19 bp, Homo sapiens
cctcacccctgtcctcact

SEQ ID NO: 3291876 - DNA, 23 bp, Homo sapiens
cctcacctcatgcccaccccctg

SEQ ID NO: 3291877 - DNA, 13 bp, Homo sapiens
cctcacctctacc

SEQ ID NO: 3291878 - DNA, 14 bp, Homo sapiens
cctcacctctaccc

SEQ ID NO: 3291879 - DNA, 17 bp, Homo sapiens
cctcacctttcccatct

SEQ ID NO: 3291880 - DNA, 13 bp, Homo sapiens
cctcacgctgggt

SEQ ID NO: 3291881 - DNA, 22 bp, Homo sapiens
cctcactactacatctgtgatg

SEQ ID NO: 3291882 - DNA, 21 bp, Homo sapiens
cctcactatggtatgctggcc

SEQ ID NO: 3291883 - DNA, 22 bp, Homo sapiens
cctcactatggtatgctggcca

SEQ ID NO: 3291884 - DNA, 16 bp, Homo sapiens
cctcactccacagagt

SEQ ID NO: 3291885 - DNA, 12 bp, Homo sapiens
cctcactcctgt

SEQ ID NO: 3291886 - DNA, 13 bp, Homo sapiens
cctcactctgcca

SEQ ID NO: 3291887 - DNA, 19 bp, Homo sapiens
cctcactctgtcagccagc

SEQ ID NO: 3291888 - DNA, 22 bp, Homo sapiens
cctcactctgtcagccagccgc

SEQ ID NO: 3291889 - DNA, 18 bp, Homo sapiens
cctcactctgtccctgtc

SEQ ID NO: 3291890 - DNA, 13 bp, Homo sapiens
cctcactgagagg

SEQ ID NO: 3291891 - DNA, 17 bp, Homo sapiens
cctctcaagctagccag

SEQ ID NO: 3291892 - DNA, 13 bp, Homo sapiens
cctctcacacaca

SEQ ID NO: 3291893 - DNA, 14 bp, Homo sapiens
cctctcacacacat

SEQ ID NO: 3291894 - DNA, 16 bp, Homo sapiens
cctctcactaaacttt

SEQ ID NO: 3291895 - DNA, 14 bp, Homo sapiens
cctctcactcccca

SEQ ID NO: 3291896 - DNA, 20 bp, Homo sapiens
cctctcactccccagcccca

SEQ ID NO: 3291897 - DNA, 14 bp, Homo sapiens
cctctcactcctgc

SEQ ID NO: 3291898 - DNA, 19 bp, Homo sapiens
cctctcagaggcctgctgc

SEQ ID NO: 3291899 - DNA, 16 bp, Homo sapiens
cctctcagctccaggt

SEQ ID NO: 3291900 - DNA, 15 bp, Homo sapiens
cctctcagggcctgg

SEQ ID NO: 3291901 - DNA, 17 bp, Homo sapiens
cctctcagggcctggca

SEQ ID NO: 3291902 - DNA, 22 bp, Homo sapiens
cctctcagttctctcccttcct

SEQ ID NO: 3291903 - DNA, 12 bp, Homo sapiens
cctctccactgc

SEQ ID NO: 3291904 - DNA, 14 bp, Homo sapiens
cctctccactgcct

SEQ ID NO: 3291905 - DNA, 16 bp, Homo sapiens
cctctccactgccttc

SEQ ID NO: 3291906 - DNA, 13 bp, Homo sapiens
cctctccaggcac

SEQ ID NO: 3291907 - DNA, 18 bp, Homo sapiens
cctctccagtttgcacct

SEQ ID NO: 3291908 - DNA, 19 bp, Homo sapiens
cctctccagtttgcacctg

SEQ ID NO: 3291909 - DNA, 20 bp, Homo sapiens
cctctccagtttgcacctgt

SEQ ID NO: 3291910 - DNA, 20 bp, Homo sapiens
cctctccatatctccttccc

SEQ ID NO: 3291911 - DNA, 23 bp, Homo sapiens
cctctcccacagagtgctggact

SEQ ID NO: 3291912 - DNA, 18 bp, Homo sapiens
cctctcccaggcccgaga

SEQ ID NO: 3291913 - DNA, 12 bp, Homo sapiens
cctctcccatca

SEQ ID NO: 3291914 - DNA, 18 bp, Homo sapiens
cctctcccatccccctgc

SEQ ID NO: 3291915 - DNA, 19 bp, Homo sapiens
cctctcccatccccctgcc

SEQ ID NO: 3291916 - DNA, 19 bp, Homo sapiens
cctctccccattcggtgtg

SEQ ID NO: 3291917 - DNA, 16 bp, Homo sapiens
cctctcccctccagcc

SEQ ID NO: 3291918 - DNA, 17 bp, Homo sapiens
cctctcccctccagcct

SEQ ID NO: 3291919 - DNA, 12 bp, Homo sapiens
cctctcccggct

SEQ ID NO: 3291920 - DNA, 14 bp, Homo sapiens
cctctcccggctgc

SEQ ID NO: 3291921 - DNA, 18 bp, Homo sapiens
cctctcccggctgcctgc

SEQ ID NO: 3291922 - DNA, 20 bp, Homo sapiens
cctctcccggctgcctgccg

SEQ ID NO: 3291923 - DNA, 22 bp, Homo sapiens
cctctcccgtcagggcccaagt

SEQ ID NO: 3291924 - DNA, 23 bp, Homo sapiens
cctctcccgtcagggcccaagtc

SEQ ID NO: 3291925 - DNA, 11 bp, Homo sapiens
cctctccctca

SEQ ID NO: 3291926 - DNA, 14 bp, Homo sapiens
cctctccctgccaa

SEQ ID NO: 3291927 - DNA, 13 bp, Homo sapiens
cctctcctgccca

SEQ ID NO: 3291928 - DNA, 16 bp, Homo sapiens
cctctcctgcccagat

SEQ ID NO: 3291929 - DNA, 12 bp, Homo sapiens
cctctcctgggg

SEQ ID NO: 3291930 - DNA, 14 bp, Homo sapiens
cctctcctgggggt

SEQ ID NO: 3291931 - DNA, 15 bp, Homo sapiens
cctctcgagcccaga

SEQ ID NO: 3291932 - DNA, 16 bp, Homo sapiens
cctctcgagcccagat

SEQ ID NO: 3291933 - DNA, 20 bp, Homo sapiens
cctctcgctcctcaacccct

SEQ ID NO: 3291934 - DNA, 21 bp, Homo sapiens
cctctcggaaggctggctggg

SEQ ID NO: 3291935 - DNA, 14 bp, Homo sapiens
cctctctagaacct

SEQ ID NO: 3291936 - DNA, 15 bp, Homo sapiens
cctctctcagagcat

SEQ ID NO: 3291937 - DNA, 21 bp, Homo sapiens
cctctctcagagcatctggct

SEQ ID NO: 3291938 - DNA, 22 bp, Homo sapiens
cctctctcagagcatctggctg

SEQ ID NO: 3291939 - DNA, 19 bp, Homo sapiens
cctctctcaggagtatctt

SEQ ID NO: 3291940 - DNA, 22 bp, Homo sapiens
cctctctgatcttgtgctcagc

SEQ ID NO: 3291941 - DNA, 17 bp, Homo sapiens
cctctctgcagacttcc

SEQ ID NO: 3291942 - DNA, 22 bp, Homo sapiens
cctctctgcagacttcccagct

SEQ ID NO: 3291943 - DNA, 13 bp, Homo sapiens
cctctctgcccct

SEQ ID NO: 3291944 - DNA, 13 bp, Homo sapiens
cctctctgctcct

SEQ ID NO: 3291945 - DNA, 13 bp, Homo sapiens
cctctctggcctc

SEQ ID NO: 3291946 - DNA, 16 bp, Homo sapiens
cctctctggcctccca

SEQ ID NO: 3291947 - DNA, 19 bp, Homo sapiens
cctctctggcctcccaccc

SEQ ID NO: 3291948 - DNA, 12 bp, Homo sapiens
cctctctgggcc

SEQ ID NO: 3291949 - DNA, 13 bp, Homo sapiens
cctctctgggcct

SEQ ID NO: 3291950 - DNA, 22 bp, Homo sapiens
cctctctggtttcctatttgca

SEQ ID NO: 3291951 - DNA, 23 bp, Homo sapiens
cctctctggtttcctatttgcag

SEQ ID NO: 3291952 - DNA, 12 bp, Homo sapiens
cctctctgtccc

SEQ ID NO: 3291953 - DNA, 13 bp, Homo sapiens
cctctcttgcacc

SEQ ID NO: 3291954 - DNA, 23 bp, Homo sapiens
cctctcttgcacccgcctctccc

SEQ ID NO: 3291955 - DNA, 18 bp, Homo sapiens
cctctctttgttctcagc

SEQ ID NO: 3291956 - DNA, 20 bp, Homo sapiens
cctctctttgttctcagctc

SEQ ID NO: 3291957 - DNA, 18 bp, Homo sapiens
cctctgaaaagtgtgtat

SEQ ID NO: 3291958 - DNA, 19 bp, Homo sapiens
cctctgacacacagctctg

SEQ ID NO: 3291959 - DNA, 18 bp, Homo sapiens
cctctgacccctcctcac

SEQ ID NO: 3291960 - DNA, 19 bp, Homo sapiens
cctctgacccctcctcact

SEQ ID NO: 3291961 - DNA, 20 bp, Homo sapiens
cctctgacccctcctcactg

SEQ ID NO: 3291962 - DNA, 22 bp, Homo sapiens
cctctgaccctagctctttcct

SEQ ID NO: 3291963 - DNA, 14 bp, Homo sapiens
cctctgacctgcac

SEQ ID NO: 3291964 - DNA, 16 bp, Homo sapiens
cctctgacctgcactg

SEQ ID NO: 3291965 - DNA, 17 bp, Homo sapiens
cctctgacctgcaggcc

SEQ ID NO: 3291966 - DNA, 14 bp, Homo sapiens
cctctgactctgag

SEQ ID NO: 3291967 - DNA, 17 bp, Homo sapiens
cctctgagcccaagcta

SEQ ID NO: 3291968 - DNA, 22 bp, Homo sapiens
cctctgagcccagctgcctgga

SEQ ID NO: 3291969 - DNA, 18 bp, Homo sapiens
cctctgatatgggactga

SEQ ID NO: 3291970 - DNA, 20 bp, Homo sapiens
cctctgcactactgacatgt

SEQ ID NO: 3291971 - DNA, 21 bp, Homo sapiens
cctctgcactactgacatgtg

SEQ ID NO: 3291972 - DNA, 16 bp, Homo sapiens
cctctgcactcccacc

SEQ ID NO: 3291973 - DNA, 19 bp, Homo sapiens
cctctgccaccagagaccg

SEQ ID NO: 3291974 - DNA, 24 bp, Homo sapiens
cctctgccaccagagaccgtcctc

SEQ ID NO: 3291975 - DNA, 20 bp, Homo sapiens
cctctgccccaagcagccag

SEQ ID NO: 3291976 - DNA, 19 bp, Homo sapiens
cctctgcccttcctgcagg

SEQ ID NO: 3291977 - DNA, 20 bp, Homo sapiens
cctctgccggtcgggcagcc

SEQ ID NO: 3291978 - DNA, 23 bp, Homo sapiens
cctctgccggtcgggcagccagc

SEQ ID NO: 3291979 - DNA, 21 bp, Homo sapiens
cctctgcctgaagtcacacag

SEQ ID NO: 3291980 - DNA, 22 bp, Homo sapiens
cctctgcctgaagtcacacagt

SEQ ID NO: 3291981 - DNA, 11 bp, Homo sapiens
cctctgcctgc

SEQ ID NO: 3291982 - DNA, 16 bp, Homo sapiens
cctctgcctgccccgc

SEQ ID NO: 3291983 - DNA, 14 bp, Homo sapiens
cctctgccttcagg

SEQ ID NO: 3291984 - DNA, 17 bp, Homo sapiens
cctctgccttcaggctt

SEQ ID NO: 3291985 - DNA, 19 bp, Homo sapiens
cctctgccttcaggcttct

SEQ ID NO: 3291986 - DNA, 16 bp, Homo sapiens
cctctgcggaccccag

SEQ ID NO: 3291987 - DNA, 17 bp, Homo sapiens
cctctgcggaccccagc

SEQ ID NO: 3291988 - DNA, 18 bp, Homo sapiens
cctctgcggggcagggcc

SEQ ID NO: 3291989 - DNA, 13 bp, Homo sapiens
cctctgctcaccg

SEQ ID NO: 3291990 - DNA, 18 bp, Homo sapiens
cctctgctcaccgcccat

SEQ ID NO: 3291991 - DNA, 12 bp, Homo sapiens
cctctgctcagc

SEQ ID NO: 3291992 - DNA, 14 bp, Homo sapiens
cctctgctccccag

SEQ ID NO: 3291993 - DNA, 13 bp, Homo sapiens
cctctgctccctc

SEQ ID NO: 3291994 - DNA, 18 bp, Homo sapiens
cctctgctcctggagcct

SEQ ID NO: 3291995 - DNA, 14 bp, Homo sapiens
cctctgctgccatg

SEQ ID NO: 3291996 - DNA, 20 bp, Homo sapiens
cctctgctggttcctgactg

SEQ ID NO: 3291997 - DNA, 12 bp, Homo sapiens
cctctggacagt

SEQ ID NO: 3291998 - DNA, 16 bp, Homo sapiens
cctctggacagttgtg

SEQ ID NO: 3291999 - DNA, 22 bp, Homo sapiens
cctctggacggcaggctcactg

SEQ ID NO: 3292000 - DNA, 18 bp, Homo sapiens
cctctggactggctagag

SEQ ID NO: 3292001 - DNA, 15 bp, Homo sapiens
cctctggaggcctct

SEQ ID NO: 3292002 - DNA, 17 bp, Homo sapiens
cctctggaggcctctgg

SEQ ID NO: 3292003 - DNA, 20 bp, Homo sapiens
cctctggaggcctctggccc

SEQ ID NO: 3292004 - DNA, 22 bp, Homo sapiens
cctctggaggcctctggccctc

SEQ ID NO: 3292005 - DNA, 23 bp, Homo sapiens
cctctggcattagaattatttaa

SEQ ID NO: 3292006 - DNA, 15 bp, Homo sapiens
cctctggccaggatg

SEQ ID NO: 3292007 - DNA, 10 bp, Homo sapiens
cctctggccc

SEQ ID NO: 3292008 - DNA, 21 bp, Homo sapiens
cctctggccctcggtggctgc

SEQ ID NO: 3292009 - DNA, 12 bp, Homo sapiens
cctctggccctg

SEQ ID NO: 3292010 - DNA, 14 bp, Homo sapiens
cctctggcccttgg

SEQ ID NO: 3292011 - DNA, 15 bp, Homo sapiens
cctctggcccttgga

SEQ ID NO: 3292012 - DNA, 19 bp, Homo sapiens
cctctggcccttggaataa

SEQ ID NO: 3292013 - DNA, 17 bp, Homo sapiens
cctctggccgcctaggc

SEQ ID NO: 3292014 - DNA, 12 bp, Homo sapiens
cctctggctaga

SEQ ID NO: 3292015 - DNA, 14 bp, Homo sapiens
cctctggcttccca

SEQ ID NO: 3292016 - DNA, 19 bp, Homo sapiens
cctctgggaacctcccaga

SEQ ID NO: 3292017 - DNA, 15 bp, Homo sapiens
cctgctgcccaggct

SEQ ID NO: 3292018 - DNA, 22 bp, Homo sapiens
cctgctgcccaggctgtgcagc

SEQ ID NO: 3292019 - DNA, 17 bp, Homo sapiens
cctgctgccccagctga

SEQ ID NO: 3292020 - DNA, 22 bp, Homo sapiens
cctgctgccccagctgactgtg

SEQ ID NO: 3292021 - DNA, 22 bp, Homo sapiens
cctgctgccgcctcccagcctg

SEQ ID NO: 3292022 - DNA, 23 bp, Homo sapiens
cctgctgccgcctcccagcctgg

SEQ ID NO: 3292023 - DNA, 14 bp, Homo sapiens
cctgctgcgtcccc

SEQ ID NO: 3292024 - DNA, 15 bp, Homo sapiens
cctgctgcgtcccca

SEQ ID NO: 3292025 - DNA, 17 bp, Homo sapiens
cctgctgcgtccccact

SEQ ID NO: 3292026 - DNA, 18 bp, Homo sapiens
cctgctgcgtccccactc

SEQ ID NO: 3292027 - DNA, 19 bp, Homo sapiens
cctgctgcgtccccactcc

SEQ ID NO: 3292028 - DNA, 18 bp, Homo sapiens
cctgctgctgccagggct

SEQ ID NO: 3292029 - DNA, 13 bp, Homo sapiens
cctgctggctgcg

SEQ ID NO: 3292030 - DNA, 18 bp, Homo sapiens
cctgctggctgcggcccc

SEQ ID NO: 3292031 - DNA, 21 bp, Homo sapiens
cctgctggctgcggccccctc

SEQ ID NO: 3292032 - DNA, 20 bp, Homo sapiens
cctgctggggccgccacggc

SEQ ID NO: 3292033 - DNA, 15 bp, Homo sapiens
cctgctgggtaaact

SEQ ID NO: 3292034 - DNA, 17 bp, Homo sapiens
cctgctgggtaaactgt

SEQ ID NO: 3292035 - DNA, 17 bp, Homo sapiens
cctgctggtacctgccc

SEQ ID NO: 3292036 - DNA, 18 bp, Homo sapiens
cctgctggtacctgccct

SEQ ID NO: 3292037 - DNA, 20 bp, Homo sapiens
cctgctggtacctgccctct

SEQ ID NO: 3292038 - DNA, 13 bp, Homo sapiens
cctgctggttcag

SEQ ID NO: 3292039 - DNA, 14 bp, Homo sapiens
cctgctgtagtcct

SEQ ID NO: 3292040 - DNA, 17 bp, Homo sapiens
cctgctgtagtcctttc

SEQ ID NO: 3292041 - DNA, 16 bp, Homo sapiens
cctgctgtcttcccca

SEQ ID NO: 3292042 - DNA, 14 bp, Homo sapiens
cctgctgtgctgct

SEQ ID NO: 3292043 - DNA, 17 bp, Homo sapiens
cctgctgtgctgctcaa

SEQ ID NO: 3292044 - DNA, 23 bp, Homo sapiens
cctgcttaatcttcaaagccttc

SEQ ID NO: 3292045 - DNA, 14 bp, Homo sapiens
cctgcttccaggaa

SEQ ID NO: 3292046 - DNA, 12 bp, Homo sapiens
cctgcttcccac

SEQ ID NO: 3292047 - DNA, 14 bp, Homo sapiens
cctgcttcccacct

SEQ ID NO: 3292048 - DNA, 18 bp, Homo sapiens
cctgcttccccttcctaa

SEQ ID NO: 3292049 - DNA, 19 bp, Homo sapiens
cctgcttccccttcctaag

SEQ ID NO: 3292050 - DNA, 21 bp, Homo sapiens
cctgcttcctgaaataaacac

SEQ ID NO: 3292051 - DNA, 22 bp, Homo sapiens
cctgcttcctgaaataaacact

SEQ ID NO: 3292052 - DNA, 15 bp, Homo sapiens
cctgcttctccagcc

SEQ ID NO: 3292053 - DNA, 16 bp, Homo sapiens
cctgcttctccagcct

SEQ ID NO: 3292054 - DNA, 20 bp, Homo sapiens
cctgcttggcccggccggcc

SEQ ID NO: 3292055 - DNA, 17 bp, Homo sapiens
cctgctttggctgaggg

SEQ ID NO: 3292056 - DNA, 20 bp, Homo sapiens
cctgctttggctgaggggct

SEQ ID NO: 3292057 - DNA, 19 bp, Homo sapiens
cctgctttgggctgccctg

SEQ ID NO: 3292058 - DNA, 22 bp, Homo sapiens
cctgctttgggctgccctggtg

SEQ ID NO: 3292059 - DNA, 18 bp, Homo sapiens
cctgcttttccaggatcc

SEQ ID NO: 3292060 - DNA, 20 bp, Homo sapiens
cctgcttttgcataatgcaa

SEQ ID NO: 3292061 - DNA, 23 bp, Homo sapiens
cctgctttttgaaatgaaattta

SEQ ID NO: 3292062 - DNA, 15 bp, Homo sapiens
cctgctttttttctt

SEQ ID NO: 3292063 - DNA, 19 bp, Homo sapiens
cctgctttttttcttaaaa

SEQ ID NO: 3292064 - DNA, 16 bp, Homo sapiens
cctggaaaccacagtc

SEQ ID NO: 3292065 - DNA, 19 bp, Homo sapiens
cctggaaagcaggatgtag

SEQ ID NO: 3292066 - DNA, 15 bp, Homo sapiens
cctggaaccagggag

SEQ ID NO: 3292067 - DNA, 17 bp, Homo sapiens
cctggaaccttgctgtc

SEQ ID NO: 3292068 - DNA, 16 bp, Homo sapiens
cctggaagcaggtgct

SEQ ID NO: 3292069 - DNA, 17 bp, Homo sapiens
cctggaagccagctttc

SEQ ID NO: 3292070 - DNA, 20 bp, Homo sapiens
cctggaagcgacccagggga

SEQ ID NO: 3292071 - DNA, 17 bp, Homo sapiens
cctggaattcagcaccc

SEQ ID NO: 3292072 - DNA, 22 bp, Homo sapiens
cctggaattcagcaccctgggt

SEQ ID NO: 3292073 - DNA, 23 bp, Homo sapiens
cctggaattcagcaccctgggtg

SEQ ID NO: 3292074 - DNA, 17 bp, Homo sapiens
cctggacacagctcttc

SEQ ID NO: 3292075 - DNA, 19 bp, Homo sapiens
cctggacacagctcttcat

SEQ ID NO: 3292076 - DNA, 20 bp, Homo sapiens
cctggacacccctgctctac

SEQ ID NO: 3292077 - DNA, 17 bp, Homo sapiens
cctggacactcagacct

SEQ ID NO: 3292078 - DNA, 21 bp, Homo sapiens
cctggacatttgccttgctgg

SEQ ID NO: 3292079 - DNA, 12 bp, Homo sapiens
cctggaccccca

SEQ ID NO: 3292080 - DNA, 15 bp, Homo sapiens
cctggacccccagct

SEQ ID NO: 3292081 - DNA, 16 bp, Homo sapiens
cctggacccccagctt

SEQ ID NO: 3292082 - DNA, 17 bp, Homo sapiens
cctggacccccagcttt

SEQ ID NO: 3292083 - DNA, 21 bp, Homo sapiens
cctggacctgccctgggccac

SEQ ID NO: 3292084 - DNA, 14 bp, Homo sapiens
cctggactctgccc

SEQ ID NO: 3292085 - DNA, 17 bp, Homo sapiens
cctggactgagccaagg

SEQ ID NO: 3292086 - DNA, 23 bp, Homo sapiens
cctggactgagccaaggaggcct

SEQ ID NO: 3292087 - DNA, 18 bp, Homo sapiens
cctggactgggaggtaga

SEQ ID NO: 3292088 - DNA, 17 bp, Homo sapiens
cctggactggtggcccc

SEQ ID NO: 3292089 - DNA, 16 bp, Homo sapiens
cctggacttaaagaaa

SEQ ID NO: 3292090 - DNA, 20 bp, Homo sapiens
cctggacttaagcatctggc

SEQ ID NO: 3292091 - DNA, 13 bp, Homo sapiens
cctggacttgcct

SEQ ID NO: 3292092 - DNA, 16 bp, Homo sapiens
cctggacttgcctctg

SEQ ID NO: 3292093 - DNA, 16 bp, Homo sapiens
cctggactttcctgca

SEQ ID NO: 3292094 - DNA, 13 bp, Homo sapiens
cctggagaactag

SEQ ID NO: 3292095 - DNA, 14 bp, Homo sapiens
cctggagaaggaag

SEQ ID NO: 3292096 - DNA, 20 bp, Homo sapiens
cctggagaaggaagctgcct

SEQ ID NO: 3292097 - DNA, 21 bp, Homo sapiens
cctggagacccaccccacctg

SEQ ID NO: 3292098 - DNA, 19 bp, Homo sapiens
cctggagacttagggcacc

SEQ ID NO: 3292099 - DNA, 18 bp, Homo sapiens
cctggagagcgaggaggc

SEQ ID NO: 3292100 - DNA, 14 bp, Homo sapiens
cctggagagggtct

SEQ ID NO: 3292101 - DNA, 17 bp, Homo sapiens
cctggagatcctcctgc

SEQ ID NO: 3292102 - DNA, 18 bp, Homo sapiens
cctggagatcctcctgca

SEQ ID NO: 3292103 - DNA, 17 bp, Homo sapiens
cctggagcaggagcccc

SEQ ID NO: 3292104 - DNA, 18 bp, Homo sapiens
cctggagcaggagccccg

SEQ ID NO: 3292105 - DNA, 23 bp, Homo sapiens
cctggagcaggagccccgccaca

SEQ ID NO: 3292106 - DNA, 17 bp, Homo sapiens
cctggagcccacaacct

SEQ ID NO: 3292107 - DNA, 13 bp, Homo sapiens
cctggagcccctg

SEQ ID NO: 3292108 - DNA, 11 bp, Homo sapiens
cctggagccct

SEQ ID NO: 3292109 - DNA, 14 bp, Homo sapiens
cctggaggcactga

SEQ ID NO: 3292110 - DNA, 22 bp, Homo sapiens
cctggaggcactgaagtgctta

SEQ ID NO: 3292111 - DNA, 23 bp, Homo sapiens
cctggagtcccgtccctgcccag

SEQ ID NO: 3292112 - DNA, 19 bp, Homo sapiens
cctggagtgcccaccctgg

SEQ ID NO: 3292113 - DNA, 19 bp, Homo sapiens
cctggatcacgacgctgca

SEQ ID NO: 3292114 - DNA, 21 bp, Homo sapiens
cctggatccatcaggccactt

SEQ ID NO: 3292115 - DNA, 20 bp, Homo sapiens
cctggatctatccctgcggc

SEQ ID NO: 3292116 - DNA, 21 bp, Homo sapiens
cctggatgatttcatcttctg

SEQ ID NO: 3292117 - DNA, 13 bp, Homo sapiens
cctggatgccaag

SEQ ID NO: 3292118 - DNA, 18 bp, Homo sapiens
cctggatgccaaggagcc

SEQ ID NO: 3292119 - DNA, 20 bp, Homo sapiens
cctggatgggcattgggctg

SEQ ID NO: 3292120 - DNA, 13 bp, Homo sapiens
cctggatttatag

SEQ ID NO: 3292121 - DNA, 21 bp, Homo sapiens
cctggatttatagtatgtgac

SEQ ID NO: 3292122 - DNA, 12 bp, Homo sapiens
cctggcacacat

SEQ ID NO: 3292123 - DNA, 13 bp, Homo sapiens
cctggcacacatc

SEQ ID NO: 3292124 - DNA, 15 bp, Homo sapiens
cctggcacacatcag

SEQ ID NO: 3292125 - DNA, 14 bp, Homo sapiens
cctggcacatttca

SEQ ID NO: 3292126 - DNA, 18 bp, Homo sapiens
cctggcacatttcaggga

SEQ ID NO: 3292127 - DNA, 22 bp, Homo sapiens
cctggcacatttcagggagaaa

SEQ ID NO: 3292128 - DNA, 21 bp, Homo sapiens
cctggcacccggcccctgctg

SEQ ID NO: 3292129 - DNA, 22 bp, Homo sapiens
cctggcactataatgtaagctc

SEQ ID NO: 3292130 - DNA, 13 bp, Homo sapiens
cctggcagacaca

SEQ ID NO: 3292131 - DNA, 14 bp, Homo sapiens
cctggcagcacagc

SEQ ID NO: 3292132 - DNA, 20 bp, Homo sapiens
cctggcagcacagcccaggg

SEQ ID NO: 3292133 - DNA, 18 bp, Homo sapiens
cctggcagccgtgccttc

SEQ ID NO: 3292134 - DNA, 19 bp, Homo sapiens
cctggcagccgtgccttca

SEQ ID NO: 3292135 - DNA, 22 bp, Homo sapiens
cctggcagccgtgccttcagct

SEQ ID NO: 3292136 - DNA, 22 bp, Homo sapiens
cctggcaggatgaccctgcgaa

SEQ ID NO: 3292137 - DNA, 15 bp, Homo sapiens
cctggcaggatgctg

SEQ ID NO: 3292138 - DNA, 18 bp, Homo sapiens
cctggcaggatgctgagc

SEQ ID NO: 3292139 - DNA, 19 bp, Homo sapiens
cctggcaggatgctgagct

SEQ ID NO: 3292140 - DNA, 15 bp, Homo sapiens
cctggcaggccagtg

SEQ ID NO: 3292141 - DNA, 16 bp, Homo sapiens
cctggcaggccagtgt

SEQ ID NO: 3292142 - DNA, 13 bp, Homo sapiens
ccttcctcctgca

SEQ ID NO: 3292143 - DNA, 14 bp, Homo sapiens
ccttcctcctgcag

SEQ ID NO: 3292144 - DNA, 17 bp, Homo sapiens
ccttcctctcactcctg

SEQ ID NO: 3292145 - DNA, 21 bp, Homo sapiens
ccttcctctccactgccttcg

SEQ ID NO: 3292146 - DNA, 16 bp, Homo sapiens
ccttcctggaaacagc

SEQ ID NO: 3292147 - DNA, 17 bp, Homo sapiens
ccttcctggcctcactg

SEQ ID NO: 3292148 - DNA, 22 bp, Homo sapiens
ccttcctggcctcactggctgg

SEQ ID NO: 3292149 - DNA, 21 bp, Homo sapiens
ccttcctgggaggacaggcag

SEQ ID NO: 3292150 - DNA, 19 bp, Homo sapiens
ccttcctggggcatctggc

SEQ ID NO: 3292151 - DNA, 22 bp, Homo sapiens
ccttcctgtttttcacattttc

SEQ ID NO: 3292152 - DNA, 21 bp, Homo sapiens
ccttcctttggtgcctcactg

SEQ ID NO: 3292153 - DNA, 15 bp, Homo sapiens
ccttccttttccctg

SEQ ID NO: 3292154 - DNA, 16 bp, Homo sapiens
ccttccttttccctgc

SEQ ID NO: 3292155 - DNA, 19 bp, Homo sapiens
ccttccttttccctgcttc

SEQ ID NO: 3292156 - DNA, 14 bp, Homo sapiens
ccttcgctcctgtg

SEQ ID NO: 3292157 - DNA, 18 bp, Homo sapiens
ccttcgctcctgtgtctt

SEQ ID NO: 3292158 - DNA, 16 bp, Homo sapiens
ccttcgcttcttgcct

SEQ ID NO: 3292159 - DNA, 17 bp, Homo sapiens
ccttcgcttcttgcctc

SEQ ID NO: 3292160 - DNA, 18 bp, Homo sapiens
ccttcgcttcttgcctct

SEQ ID NO: 3292161 - DNA, 21 bp, Homo sapiens
ccttcgcttcttgcctctgtg

SEQ ID NO: 3292162 - DNA, 20 bp, Homo sapiens
ccttcggggcgatgctccct

SEQ ID NO: 3292163 - DNA, 16 bp, Homo sapiens
ccttcggtcttttgta

SEQ ID NO: 3292164 - DNA, 19 bp, Homo sapiens
ccttcgtccccagttgccg

SEQ ID NO: 3292165 - DNA, 13 bp, Homo sapiens
ccttcgtgtctct

SEQ ID NO: 3292166 - DNA, 17 bp, Homo sapiens
ccttcgtgtctctccca

SEQ ID NO: 3292167 - DNA, 22 bp, Homo sapiens
ccttcgtgtctctcccaccccg

SEQ ID NO: 3292168 - DNA, 17 bp, Homo sapiens
ccttcgttaactgtgta

SEQ ID NO: 3292169 - DNA, 22 bp, Homo sapiens
ccttctagaacctgggctgtgc

SEQ ID NO: 3292170 - DNA, 22 bp, Homo sapiens
ccttctagtcttggccagccaa

SEQ ID NO: 3292171 - DNA, 15 bp, Homo sapiens
ccttctattggtctc

SEQ ID NO: 3292172 - DNA, 20 bp, Homo sapiens
ccttctcccctccccgcctg

SEQ ID NO: 3292173 - DNA, 22 bp, Homo sapiens
ccttctccctagctcctcccct

SEQ ID NO: 3292174 - DNA, 14 bp, Homo sapiens
ccttctcctctctg

SEQ ID NO: 3292175 - DNA, 19 bp, Homo sapiens
ccttctcctctctgggcct

SEQ ID NO: 3292176 - DNA, 14 bp, Homo sapiens
ccttctccttccca

SEQ ID NO: 3292177 - DNA, 18 bp, Homo sapiens
ccttctccttccccagga

SEQ ID NO: 3292178 - DNA, 15 bp, Homo sapiens
ccttctctcctcccc

SEQ ID NO: 3292179 - DNA, 16 bp, Homo sapiens
ccttctctcctcccca

SEQ ID NO: 3292180 - DNA, 20 bp, Homo sapiens
ccttctctcctccccaaatc

SEQ ID NO: 3292181 - DNA, 13 bp, Homo sapiens
ccttctctgaaca

SEQ ID NO: 3292182 - DNA, 18 bp, Homo sapiens
ccttctctgaacacaggc

SEQ ID NO: 3292183 - DNA, 20 bp, Homo sapiens
ccttctctgaacacaggcag

SEQ ID NO: 3292184 - DNA, 14 bp, Homo sapiens
ccttctctgctcca

SEQ ID NO: 3292185 - DNA, 17 bp, Homo sapiens
ccttctctgctccacca

SEQ ID NO: 3292186 - DNA, 14 bp, Homo sapiens
ccttctcttaattt

SEQ ID NO: 3292187 - DNA, 17 bp, Homo sapiens
ccttctgacggccctgc

SEQ ID NO: 3292188 - DNA, 14 bp, Homo sapiens
ccttctgcagcagg

SEQ ID NO: 3292189 - DNA, 18 bp, Homo sapiens
ccttctgctgcccaggcc

SEQ ID NO: 3292190 - DNA, 19 bp, Homo sapiens
ccttctgctgcccaggcca

SEQ ID NO: 3292191 - DNA, 10 bp, Homo sapiens
ccttctggcc

SEQ ID NO: 3292192 - DNA, 16 bp, Homo sapiens
ccttctggccttgtaa

SEQ ID NO: 3292193 - DNA, 19 bp, Homo sapiens
ccttctgggactggacagc

SEQ ID NO: 3292194 - DNA, 22 bp, Homo sapiens
ccttctgggcatctgttctggt

SEQ ID NO: 3292195 - DNA, 13 bp, Homo sapiens
ccttctgggcttt

SEQ ID NO: 3292196 - DNA, 16 bp, Homo sapiens
ccttctgggctttttc

SEQ ID NO: 3292197 - DNA, 17 bp, Homo sapiens
ccttctgggctttttct

SEQ ID NO: 3292198 - DNA, 16 bp, Homo sapiens
ccttctgtccccagcc

SEQ ID NO: 3292199 - DNA, 15 bp, Homo sapiens
ccttctgtcctggtg

SEQ ID NO: 3292200 - DNA, 16 bp, Homo sapiens
ccttctgtcctggtgt

SEQ ID NO: 3292201 - DNA, 15 bp, Homo sapiens
ccttctgtgaaagta

SEQ ID NO: 3292202 - DNA, 14 bp, Homo sapiens
ccttctgtggctca

SEQ ID NO: 3292203 - DNA, 12 bp, Homo sapiens
ccttctgtgtca

SEQ ID NO: 3292204 - DNA, 16 bp, Homo sapiens
ccttcttccatcccag

SEQ ID NO: 3292205 - DNA, 22 bp, Homo sapiens
ccttcttccatcccaggacacc

SEQ ID NO: 3292206 - DNA, 23 bp, Homo sapiens
ccttcttcccaatagcaaggctg

SEQ ID NO: 3292207 - DNA, 20 bp, Homo sapiens
ccttcttctttttgctgttg

SEQ ID NO: 3292208 - DNA, 23 bp, Homo sapiens
ccttctttcactctgtcatcttt

SEQ ID NO: 3292209 - DNA, 17 bp, Homo sapiens
ccttctttcctcttccc

SEQ ID NO: 3292210 - DNA, 14 bp, Homo sapiens
ccttctttctggac

SEQ ID NO: 3292211 - DNA, 18 bp, Homo sapiens
ccttctttgataatgtta

SEQ ID NO: 3292212 - DNA, 20 bp, Homo sapiens
ccttctttgataatgttaaa

SEQ ID NO: 3292213 - DNA, 15 bp, Homo sapiens
ccttctttgcagggc

SEQ ID NO: 3292214 - DNA, 24 bp, Homo sapiens
ccttcttttatgagcagaaggaaa

SEQ ID NO: 3292215 - DNA, 16 bp, Homo sapiens
ccttgaaacagttcca

SEQ ID NO: 3292216 - DNA, 14 bp, Homo sapiens
ccttgaactgggta

SEQ ID NO: 3292217 - DNA, 16 bp, Homo sapiens
ccttgaactgggtact

SEQ ID NO: 3292218 - DNA, 18 bp, Homo sapiens
ccttgaagaacctctcac

SEQ ID NO: 3292219 - DNA, 18 bp, Homo sapiens
ccttgaagaactgcaggc

SEQ ID NO: 3292220 - DNA, 15 bp, Homo sapiens
ccttgacagggcaca

SEQ ID NO: 3292221 - DNA, 17 bp, Homo sapiens
ccttgacagggcacacc

SEQ ID NO: 3292222 - DNA, 22 bp, Homo sapiens
ccttgaccaaaatcagctttgt

SEQ ID NO: 3292223 - DNA, 13 bp, Homo sapiens
ccttgaccttcct

SEQ ID NO: 3292224 - DNA, 22 bp, Homo sapiens
ccttgactgccgcatcatggga

SEQ ID NO: 3292225 - DNA, 13 bp, Homo sapiens
ccttgagactgga

SEQ ID NO: 3292226 - DNA, 14 bp, Homo sapiens
ccttgagactggag

SEQ ID NO: 3292227 - DNA, 16 bp, Homo sapiens
ccttgagccctggctg

SEQ ID NO: 3292228 - DNA, 21 bp, Homo sapiens
ccttgagggtgcttgttccct

SEQ ID NO: 3292229 - DNA, 19 bp, Homo sapiens
ccttgatggagatatttac

SEQ ID NO: 3292230 - DNA, 13 bp, Homo sapiens
ccttgatttcaaa

SEQ ID NO: 3292231 - DNA, 18 bp, Homo sapiens
ccttgatttgttcttaca

SEQ ID NO: 3292232 - DNA, 20 bp, Homo sapiens
ccttgattttgccccctgag

SEQ ID NO: 3292233 - DNA, 13 bp, Homo sapiens
ccttgcagaactg

SEQ ID NO: 3292234 - DNA, 16 bp, Homo sapiens
ccttgcagaactgcca

SEQ ID NO: 3292235 - DNA, 15 bp, Homo sapiens
ccttgcagccacatg

SEQ ID NO: 3292236 - DNA, 18 bp, Homo sapiens
ccttgcagccacatggcc

SEQ ID NO: 3292237 - DNA, 19 bp, Homo sapiens
ccttgcaggggtcccccct

SEQ ID NO: 3292238 - DNA, 20 bp, Homo sapiens
ccttgcagttcagcaccacc

SEQ ID NO: 3292239 - DNA, 23 bp, Homo sapiens
ccttgcagttcagcaccacccta

SEQ ID NO: 3292240 - DNA, 20 bp, Homo sapiens
ccttgcccagactacagggc

SEQ ID NO: 3292241 - DNA, 14 bp, Homo sapiens
ccttgccccacagt

SEQ ID NO: 3292242 - DNA, 19 bp, Homo sapiens
ccttgccccacagttgtgt

SEQ ID NO: 3292243 - DNA, 18 bp, Homo sapiens
ccttgcccggattctggg

SEQ ID NO: 3292244 - DNA, 19 bp, Homo sapiens
ccttgccctgacctcccag

SEQ ID NO: 3292245 - DNA, 16 bp, Homo sapiens
ccttgcccttgccctg

SEQ ID NO: 3292246 - DNA, 22 bp, Homo sapiens
ccttgcctaaatttaatgctgc

SEQ ID NO: 3292247 - DNA, 15 bp, Homo sapiens
ccttgcctcaatgcc

SEQ ID NO: 3292248 - DNA, 20 bp, Homo sapiens
ccttgcctcaatgccagtaa

SEQ ID NO: 3292249 - DNA, 22 bp, Homo sapiens
ccttgcctccccatttcccatc

SEQ ID NO: 3292250 - DNA, 15 bp, Homo sapiens
ccttgccttcccctg

SEQ ID NO: 3292251 - DNA, 16 bp, Homo sapiens
ccttgccttcccctgt

SEQ ID NO: 3292252 - DNA, 15 bp, Homo sapiens
ccttgcctttgtggc

SEQ ID NO: 3292253 - DNA, 11 bp, Homo sapiens
ccttgctacct

SEQ ID NO: 3292254 - DNA, 15 bp, Homo sapiens
ccttgctctccctct

SEQ ID NO: 3292255 - DNA, 17 bp, Homo sapiens
ccttgctctccctcttc

SEQ ID NO: 3292256 - DNA, 19 bp, Homo sapiens
ccttgctctccctcttctc

SEQ ID NO: 3292257 - DNA, 22 bp, Homo sapiens
ccttgctgagtggcgcaaggcc

SEQ ID NO: 3292258 - DNA, 23 bp, Homo sapiens
ccttgctgcccgcgggagacagc

SEQ ID NO: 3292259 - DNA, 20 bp, Homo sapiens
ccttgctgctgctgcaccca

SEQ ID NO: 3292260 - DNA, 22 bp, Homo sapiens
ccttgctggacggggactgggg

SEQ ID NO: 3292261 - DNA, 12 bp, Homo sapiens
ccttgctggccc

SEQ ID NO: 3292262 - DNA, 15 bp, Homo sapiens
ccttgctggccccag

SEQ ID NO: 3292263 - DNA, 16 bp, Homo sapiens
ccttgctggccccagc

SEQ ID NO: 3292264 - DNA, 22 bp, Homo sapiens
ccttgctggccccagccctgct

SEQ ID NO: 3292265 - DNA, 21 bp, Homo sapiens
ccttgctgtatgctgatcatc

SEQ ID NO: 3292266 - DNA, 20 bp, Homo sapiens
ccttgcttcttactgataat

SEQ ID NO: 3292267 - DNA, 21 bp, Homo sapiens
ccttgctttcggagctcctgt

SEQ ID NO: 3292268 - DNA, 15 bp, Homo sapiens
cgcacgcacacacac

SEQ ID NO: 3292269 - DNA, 22 bp, Homo sapiens
cgcactacatgtggtttataga

SEQ ID NO: 3292270 - DNA, 14 bp, Homo sapiens
cgcactctgccccc

SEQ ID NO: 3292271 - DNA, 16 bp, Homo sapiens
cgcactgggccacgga

SEQ ID NO: 3292272 - DNA, 13 bp, Homo sapiens
cgcagaagccctg

SEQ ID NO: 3292273 - DNA, 12 bp, Homo sapiens
cgcagacctccc

SEQ ID NO: 3292274 - DNA, 17 bp, Homo sapiens
cgcagacctccccagcc

SEQ ID NO: 3292275 - DNA, 15 bp, Homo sapiens
cgcagacgggcacag

SEQ ID NO: 3292276 - DNA, 21 bp, Homo sapiens
cgcagacgggcacagacacgc

SEQ ID NO: 3292277 - DNA, 19 bp, Homo sapiens
cgcagaggacgcacgctcg

SEQ ID NO: 3292278 - DNA, 21 bp, Homo sapiens
cgcagccaaggccgaagctct

SEQ ID NO: 3292279 - DNA, 21 bp, Homo sapiens
cgcagcccgtgaagcagtgcc

SEQ ID NO: 3292280 - DNA, 23 bp, Homo sapiens
cgcagcccgtgaagcagtgcctc

SEQ ID NO: 3292281 - DNA, 10 bp, Homo sapiens
cgcagccctg

SEQ ID NO: 3292282 - DNA, 16 bp, Homo sapiens
cgcagcctccctctga

SEQ ID NO: 3292283 - DNA, 13 bp, Homo sapiens
cgcagctcttgcc

SEQ ID NO: 3292284 - DNA, 17 bp, Homo sapiens
cgcagctcttgcccttc

SEQ ID NO: 3292285 - DNA, 11 bp, Homo sapiens
cgcaggaatgg

SEQ ID NO: 3292286 - DNA, 22 bp, Homo sapiens
cgcaggaccagtttgattgagg

SEQ ID NO: 3292287 - DNA, 20 bp, Homo sapiens
cgcaggagaatcactgcagc

SEQ ID NO: 3292288 - DNA, 21 bp, Homo sapiens
cgcaggagtctctgccaccca

SEQ ID NO: 3292289 - DNA, 19 bp, Homo sapiens
cgcaggatccgctgccacc

SEQ ID NO: 3292290 - DNA, 11 bp, Homo sapiens
cgcaggcccag

SEQ ID NO: 3292291 - DNA, 12 bp, Homo sapiens
cgcaggcccagt

SEQ ID NO: 3292292 - DNA, 13 bp, Homo sapiens
cgcaggcccagtg

SEQ ID NO: 3292293 - DNA, 18 bp, Homo sapiens
cgcaggcgaccgggcctc

SEQ ID NO: 3292294 - DNA, 20 bp, Homo sapiens
cgcaggcgaccgggcctccc

SEQ ID NO: 3292295 - DNA, 21 bp, Homo sapiens
cgcaggctatttgttcagaga

SEQ ID NO: 3292296 - DNA, 13 bp, Homo sapiens
cgcaggtgggctg

SEQ ID NO: 3292297 - DNA, 20 bp, Homo sapiens
cgcagtagtttggtttgact

SEQ ID NO: 3292298 - DNA, 16 bp, Homo sapiens
cgcagtccccagccct

SEQ ID NO: 3292299 - DNA, 21 bp, Homo sapiens
cgcagtccccagcccttctgc

SEQ ID NO: 3292300 - DNA, 23 bp, Homo sapiens
cgcagtcgcaggatccgctgcca

SEQ ID NO: 3292301 - DNA, 15 bp, Homo sapiens
cgcagtcgtcgcaca

SEQ ID NO: 3292302 - DNA, 17 bp, Homo sapiens
cgcagtcgtcgcacagt

SEQ ID NO: 3292303 - DNA, 21 bp, Homo sapiens
cgcagtcgtcgcacagtctct

SEQ ID NO: 3292304 - DNA, 13 bp, Homo sapiens
cgcagtctggcct

SEQ ID NO: 3292305 - DNA, 15 bp, Homo sapiens
cgcagtctggcctgg

SEQ ID NO: 3292306 - DNA, 21 bp, Homo sapiens
cgcagtgctgggaccagagcc

SEQ ID NO: 3292307 - DNA, 22 bp, Homo sapiens
cgcatacacacatgccctcctg

SEQ ID NO: 3292308 - DNA, 22 bp, Homo sapiens
cgcatagactgaggtataaaga

SEQ ID NO: 3292309 - DNA, 22 bp, Homo sapiens
cgcatggagtgtgtattgttcc

SEQ ID NO: 3292310 - DNA, 23 bp, Homo sapiens
cgcatggagtgtgtattgttccc

SEQ ID NO: 3292311 - DNA, 19 bp, Homo sapiens
cgcatggtcacacactgat

SEQ ID NO: 3292312 - DNA, 19 bp, Homo sapiens
cgccaacgttcgatttcta

SEQ ID NO: 3292313 - DNA, 15 bp, Homo sapiens
cgccaccagcccgca

SEQ ID NO: 3292314 - DNA, 23 bp, Homo sapiens
cgccaccatcctgcagcctcctc

SEQ ID NO: 3292315 - DNA, 14 bp, Homo sapiens
cgccacccccatct

SEQ ID NO: 3292316 - DNA, 17 bp, Homo sapiens
cgccacccccatcttcc

SEQ ID NO: 3292317 - DNA, 20 bp, Homo sapiens
cgccacccccatcttccacc

SEQ ID NO: 3292318 - DNA, 22 bp, Homo sapiens
cgccacccccatcttccacctg

SEQ ID NO: 3292319 - DNA, 13 bp, Homo sapiens
cgccacctcaggg

SEQ ID NO: 3292320 - DNA, 15 bp, Homo sapiens
cgccacctcagggca

SEQ ID NO: 3292321 - DNA, 16 bp, Homo sapiens
cgccacctcagggcac

SEQ ID NO: 3292322 - DNA, 17 bp, Homo sapiens
cgccacgtcccagcatc

SEQ ID NO: 3292323 - DNA, 21 bp, Homo sapiens
cgccactacactccagcctga

SEQ ID NO: 3292324 - DNA, 22 bp, Homo sapiens
cgccactacactccagcctgag

SEQ ID NO: 3292325 - DNA, 15 bp, Homo sapiens
cgccactcctgaacc

SEQ ID NO: 3292326 - DNA, 15 bp, Homo sapiens
cgccactcgcttccc

SEQ ID NO: 3292327 - DNA, 21 bp, Homo sapiens
cgccactgcactccagcctgg

SEQ ID NO: 3292328 - DNA, 12 bp, Homo sapiens
cgccacttcctt

SEQ ID NO: 3292329 - DNA, 15 bp, Homo sapiens
cgccagcctcctctg

SEQ ID NO: 3292330 - DNA, 17 bp, Homo sapiens
cgccagcctcctctgga

SEQ ID NO: 3292331 - DNA, 14 bp, Homo sapiens
cgccagctgggagc

SEQ ID NO: 3292332 - DNA, 20 bp, Homo sapiens
cgccagctgggagcactggt

SEQ ID NO: 3292333 - DNA, 17 bp, Homo sapiens
cgccagcttctcctgcg

SEQ ID NO: 3292334 - DNA, 12 bp, Homo sapiens
cgccagggctgg

SEQ ID NO: 3292335 - DNA, 13 bp, Homo sapiens
cgccagggctggg

SEQ ID NO: 3292336 - DNA, 21 bp, Homo sapiens
cgccagggctggggacagagg

SEQ ID NO: 3292337 - DNA, 14 bp, Homo sapiens
cgccagtctcccag

SEQ ID NO: 3292338 - DNA, 14 bp, Homo sapiens
cgccatcttccatt

SEQ ID NO: 3292339 - DNA, 21 bp, Homo sapiens
cgccatgttgacgagactggt

SEQ ID NO: 3292340 - DNA, 17 bp, Homo sapiens
cgccattgccaccagga

SEQ ID NO: 3292341 - DNA, 18 bp, Homo sapiens
cgcccacaggaagcctgc

SEQ ID NO: 3292342 - DNA, 23 bp, Homo sapiens
cgcccaccgtgggcagtgccacc

SEQ ID NO: 3292343 - DNA, 12 bp, Homo sapiens
cgcccacctccc

SEQ ID NO: 3292344 - DNA, 22 bp, Homo sapiens
cgcccagagacccaagctgcct

SEQ ID NO: 3292345 - DNA, 20 bp, Homo sapiens
cgcccagctgcacctgccag

SEQ ID NO: 3292346 - DNA, 20 bp, Homo sapiens
cgcccaggctggagtgcagt

SEQ ID NO: 3292347 - DNA, 15 bp, Homo sapiens
cgcccaggggcccgg

SEQ ID NO: 3292348 - DNA, 19 bp, Homo sapiens
cgcccagtctggaatgcag

SEQ ID NO: 3292349 - DNA, 23 bp, Homo sapiens
cgcccagttgggtggatgcctgg

SEQ ID NO: 3292350 - DNA, 20 bp, Homo sapiens
cgccccacctccacctgtga

SEQ ID NO: 3292351 - DNA, 12 bp, Homo sapiens
cgccccaggccc

SEQ ID NO: 3292352 - DNA, 12 bp, Homo sapiens
cgcccccagtgt

SEQ ID NO: 3292353 - DNA, 20 bp, Homo sapiens
cgccccctccgccctgccac

SEQ ID NO: 3292354 - DNA, 19 bp, Homo sapiens
cgccccgggcaaagggtct

SEQ ID NO: 3292355 - DNA, 10 bp, Homo sapiens
cgcccctccc

SEQ ID NO: 3292356 - DNA, 13 bp, Homo sapiens
cgcccctgctgtc

SEQ ID NO: 3292357 - DNA, 15 bp, Homo sapiens
cgcccctgtggccaa

SEQ ID NO: 3292358 - DNA, 14 bp, Homo sapiens
cgcccgtcctgcct

SEQ ID NO: 3292359 - DNA, 11 bp, Homo sapiens
cgccctcaggc

SEQ ID NO: 3292360 - DNA, 14 bp, Homo sapiens
cgccctcccctccc

SEQ ID NO: 3292361 - DNA, 16 bp, Homo sapiens
cgccctcccctcccct

SEQ ID NO: 3292362 - DNA, 18 bp, Homo sapiens
cgccctcccctcccctgc

SEQ ID NO: 3292363 - DNA, 23 bp, Homo sapiens
cgccctccctctcccaggcccga

SEQ ID NO: 3292364 - DNA, 16 bp, Homo sapiens
cgccctcctttctgtg

SEQ ID NO: 3292365 - DNA, 22 bp, Homo sapiens
cgccctctctgctccttcactg

SEQ ID NO: 3292366 - DNA, 13 bp, Homo sapiens
cgccctcttcctg

SEQ ID NO: 3292367 - DNA, 12 bp, Homo sapiens
cgccctgcactc

SEQ ID NO: 3292368 - DNA, 13 bp, Homo sapiens
cgccctgcactcc

SEQ ID NO: 3292369 - DNA, 15 bp, Homo sapiens
cgccctgcagaggga

SEQ ID NO: 3292370 - DNA, 18 bp, Homo sapiens
cgccctgcgttggagcca

SEQ ID NO: 3292371 - DNA, 12 bp, Homo sapiens
cgccctggactt

SEQ ID NO: 3292372 - DNA, 14 bp, Homo sapiens
cgccctgggctgga

SEQ ID NO: 3292373 - DNA, 17 bp, Homo sapiens
cgccctgggctggactg

SEQ ID NO: 3292374 - DNA, 20 bp, Homo sapiens
cgccctttcctcctcaggca

SEQ ID NO: 3292375 - DNA, 12 bp, Homo sapiens
cgccgcctcttt

SEQ ID NO: 3292376 - DNA, 13 bp, Homo sapiens
cgccgggcaccaa

SEQ ID NO: 3292377 - DNA, 20 bp, Homo sapiens
cgcctaaggtcacagctagt

SEQ ID NO: 3292378 - DNA, 21 bp, Homo sapiens
cgcctactcttcagggtctaa

SEQ ID NO: 3292379 - DNA, 16 bp, Homo sapiens
cgcctccatccaaggc

SEQ ID NO: 3292380 - DNA, 24 bp, Homo sapiens
cgcctccccacggccgctccaggg

SEQ ID NO: 3292381 - DNA, 16 bp, Homo sapiens
cgcctcccctgcccca

SEQ ID NO: 3292382 - DNA, 15 bp, Homo sapiens
cgcctccctctcaga

SEQ ID NO: 3292383 - DNA, 13 bp, Homo sapiens
cgcctcctggcca

SEQ ID NO: 3292384 - DNA, 15 bp, Homo sapiens
cgcctcctggccaga

SEQ ID NO: 3292385 - DNA, 16 bp, Homo sapiens
cgcctcctggccagac

SEQ ID NO: 3292386 - DNA, 13 bp, Homo sapiens
cgcctctggccgc

SEQ ID NO: 3292387 - DNA, 19 bp, Homo sapiens
cgcctcttcttcttcagaa

SEQ ID NO: 3292388 - DNA, 16 bp, Homo sapiens
cgcctcttttccctct

SEQ ID NO: 3292389 - DNA, 16 bp, Homo sapiens
cgcctgaaagccacaa

SEQ ID NO: 3292390 - DNA, 20 bp, Homo sapiens
cgcctgacaaccactggtct

SEQ ID NO: 3292391 - DNA, 16 bp, Homo sapiens
cgcctgacagaaacca

SEQ ID NO: 3292392 - DNA, 16 bp, Homo sapiens
cgcctgagctcactcg

SEQ ID NO: 3292393 - DNA, 17 bp, Homo sapiens
cgcctgaggcaattaga

SEQ ID NO: 3292394 - DNA, 14 bp, Homo sapiens
cgcctgagggaaga

SEQ ID NO: 3292395 - DNA, 17 bp, Homo sapiens
cgtctgactccagagtc

SEQ ID NO: 3292396 - DNA, 13 bp, Homo sapiens
cgtctgccaggcc

SEQ ID NO: 3292397 - DNA, 15 bp, Homo sapiens
cgtctgccaggccca

SEQ ID NO: 3292398 - DNA, 14 bp, Homo sapiens
cgtctggaggggcc

SEQ ID NO: 3292399 - DNA, 14 bp, Homo sapiens
cgtctttaagagac

SEQ ID NO: 3292400 - DNA, 15 bp, Homo sapiens
cgtctttaagagact

SEQ ID NO: 3292401 - DNA, 17 bp, Homo sapiens
cgtctttaagagactca

SEQ ID NO: 3292402 - DNA, 18 bp, Homo sapiens
cgtgaaaacggagctgaa

SEQ ID NO: 3292403 - DNA, 16 bp, Homo sapiens
cgtgaaacacaccagg

SEQ ID NO: 3292404 - DNA, 22 bp, Homo sapiens
cgtgaaacacaccaggctgtgg

SEQ ID NO: 3292405 - DNA, 24 bp, Homo sapiens
cgtgaaacacaccaggctgtgggc

SEQ ID NO: 3292406 - DNA, 17 bp, Homo sapiens
cgtgaaaccccgtctct

SEQ ID NO: 3292407 - DNA, 11 bp, Homo sapiens
cgtgaacaaac

SEQ ID NO: 3292408 - DNA, 16 bp, Homo sapiens
cgtgaagcagtgcctc

SEQ ID NO: 3292409 - DNA, 17 bp, Homo sapiens
cgtgaagcagtgcctcg

SEQ ID NO: 3292410 - DNA, 14 bp, Homo sapiens
cgtgaattctcgga

SEQ ID NO: 3292411 - DNA, 14 bp, Homo sapiens
cgtgacaacacttg

SEQ ID NO: 3292412 - DNA, 23 bp, Homo sapiens
cgtgaccaactagacattctgtc

SEQ ID NO: 3292413 - DNA, 14 bp, Homo sapiens
cgtgacccttcagg

SEQ ID NO: 3292414 - DNA, 16 bp, Homo sapiens
cgtgacccttcagggc

SEQ ID NO: 3292415 - DNA, 20 bp, Homo sapiens
cgtgacccttcagggccaga

SEQ ID NO: 3292416 - DNA, 20 bp, Homo sapiens
cgtgacctattcaccctcca

SEQ ID NO: 3292417 - DNA, 22 bp, Homo sapiens
cgtgacggagcccacactgcca

SEQ ID NO: 3292418 - DNA, 14 bp, Homo sapiens
cgtgactcagcagc

SEQ ID NO: 3292419 - DNA, 18 bp, Homo sapiens
cgtgactcagcagcctgc

SEQ ID NO: 3292420 - DNA, 19 bp, Homo sapiens
cgtgagctggggactcagg

SEQ ID NO: 3292421 - DNA, 22 bp, Homo sapiens
cgtgagctggggactcagggac

SEQ ID NO: 3292422 - DNA, 20 bp, Homo sapiens
cgtgaggggcaagctaggcc

SEQ ID NO: 3292423 - DNA, 19 bp, Homo sapiens
cgtgagtgaaccatcatta

SEQ ID NO: 3292424 - DNA, 16 bp, Homo sapiens
cgtgagttctcagggc

SEQ ID NO: 3292425 - DNA, 18 bp, Homo sapiens
cgtgatccacccacctcg

SEQ ID NO: 3292426 - DNA, 22 bp, Homo sapiens
cgtgatccatccatctccaggg

SEQ ID NO: 3292427 - DNA, 17 bp, Homo sapiens
cgtgatccgcctgcctc

SEQ ID NO: 3292428 - DNA, 21 bp, Homo sapiens
cgtgatccgcctgcctctgcc

SEQ ID NO: 3292429 - DNA, 16 bp, Homo sapiens
cgtgcacacaccagag

SEQ ID NO: 3292430 - DNA, 19 bp, Homo sapiens
cgtgcacacaccagagccc

SEQ ID NO: 3292431 - DNA, 20 bp, Homo sapiens
cgtgcacacaccagagccca

SEQ ID NO: 3292432 - DNA, 22 bp, Homo sapiens
cgtgcacacaccagagcccacc

SEQ ID NO: 3292433 - DNA, 10 bp, Homo sapiens
cgtgcacagg

SEQ ID NO: 3292434 - DNA, 17 bp, Homo sapiens
cgtgcactctgctaatc

SEQ ID NO: 3292435 - DNA, 20 bp, Homo sapiens
cgtgcagagctgcacttggc

SEQ ID NO: 3292436 - DNA, 19 bp, Homo sapiens
cgtgcagcgcccctctgca

SEQ ID NO: 3292437 - DNA, 16 bp, Homo sapiens
cgtgcagcttccaaat

SEQ ID NO: 3292438 - DNA, 16 bp, Homo sapiens
cgtgcagtacaggcaa

SEQ ID NO: 3292439 - DNA, 15 bp, Homo sapiens
cgtgccagtcctggg

SEQ ID NO: 3292440 - DNA, 16 bp, Homo sapiens
cgtgccatgatctgta

SEQ ID NO: 3292441 - DNA, 17 bp, Homo sapiens
cgtgccccgcctccccg

SEQ ID NO: 3292442 - DNA, 18 bp, Homo sapiens
cgtgccgcctgctcctca

SEQ ID NO: 3292443 - DNA, 21 bp, Homo sapiens
cgtgcctccaccaccactggc

SEQ ID NO: 3292444 - DNA, 23 bp, Homo sapiens
cgtgcctccaccaccactggcca

SEQ ID NO: 3292445 - DNA, 20 bp, Homo sapiens
cgtgcctccttccacctccc

SEQ ID NO: 3292446 - DNA, 17 bp, Homo sapiens
cgtgcctgggggagaga

SEQ ID NO: 3292447 - DNA, 14 bp, Homo sapiens
cgtgcctgtgtcca

SEQ ID NO: 3292448 - DNA, 16 bp, Homo sapiens
cgtgccttcagctcta

SEQ ID NO: 3292449 - DNA, 19 bp, Homo sapiens
cgtgccttttgcacccctc

SEQ ID NO: 3292450 - DNA, 23 bp, Homo sapiens
cgtgccttttgcacccctcccat

SEQ ID NO: 3292451 - DNA, 15 bp, Homo sapiens
cgtgcgacagagaga

SEQ ID NO: 3292452 - DNA, 19 bp, Homo sapiens
cgtgcgtgtgtgtgtgttt

SEQ ID NO: 3292453 - DNA, 13 bp, Homo sapiens
cgtgctgtaaata

SEQ ID NO: 3292454 - DNA, 16 bp, Homo sapiens
cgtgctgtctcctttg

SEQ ID NO: 3292455 - DNA, 16 bp, Homo sapiens
cgtgctgtcttctggt

SEQ ID NO: 3292456 - DNA, 19 bp, Homo sapiens
cgtggaacctctgtctcat

SEQ ID NO: 3292457 - DNA, 11 bp, Homo sapiens
cgtggacaggc

SEQ ID NO: 3292458 - DNA, 13 bp, Homo sapiens
cgtggacaggccc

SEQ ID NO: 3292459 - DNA, 13 bp, Homo sapiens
cgtggactctgca

SEQ ID NO: 3292460 - DNA, 20 bp, Homo sapiens
cgtggagagctggtgcccgg

SEQ ID NO: 3292461 - DNA, 16 bp, Homo sapiens
cgtggagccagggagc

SEQ ID NO: 3292462 - DNA, 22 bp, Homo sapiens
cgtggagcggggtatgaagagc

SEQ ID NO: 3292463 - DNA, 15 bp, Homo sapiens
cgtggcaaatataaa

SEQ ID NO: 3292464 - DNA, 17 bp, Homo sapiens
cgtggcacctcttccga

SEQ ID NO: 3292465 - DNA, 20 bp, Homo sapiens
cgtggcagataatcagcctc

SEQ ID NO: 3292466 - DNA, 16 bp, Homo sapiens
cgtggcatgtggcctg

SEQ ID NO: 3292467 - DNA, 19 bp, Homo sapiens
cgtggcatgtggcctgtgg

SEQ ID NO: 3292468 - DNA, 16 bp, Homo sapiens
cgtggccatccctgtg

SEQ ID NO: 3292469 - DNA, 21 bp, Homo sapiens
cgtggcctcgtgaggggcaag

SEQ ID NO: 3292470 - DNA, 15 bp, Homo sapiens
cgtggcctcttgagc

SEQ ID NO: 3292471 - DNA, 16 bp, Homo sapiens
cgtggcctcttgagca

SEQ ID NO: 3292472 - DNA, 20 bp, Homo sapiens
cgtggcctgagtcctggtcc

SEQ ID NO: 3292473 - DNA, 22 bp, Homo sapiens
cgtgggagacaagaaatccctg

SEQ ID NO: 3292474 - DNA, 18 bp, Homo sapiens
cgtggtagaggcctgggg

SEQ ID NO: 3292475 - DNA, 20 bp, Homo sapiens
cgtggtagaggcctggggcc

SEQ ID NO: 3292476 - DNA, 18 bp, Homo sapiens
cgtggtcactgtgcactg

SEQ ID NO: 3292477 - DNA, 21 bp, Homo sapiens
cgtggtgatcaattaaatgta

SEQ ID NO: 3292478 - DNA, 20 bp, Homo sapiens
cgtggtgtgtccctggacac

SEQ ID NO: 3292479 - DNA, 22 bp, Homo sapiens
cgtggtgtgtccctggacacag

SEQ ID NO: 3292480 - DNA, 17 bp, Homo sapiens
cgtgtatagtatctgta

SEQ ID NO: 3292481 - DNA, 22 bp, Homo sapiens
cgtgtatagtgcctaaaattgt

SEQ ID NO: 3292482 - DNA, 23 bp, Homo sapiens
cgtgtatagtgcctaaaattgta

SEQ ID NO: 3292483 - DNA, 17 bp, Homo sapiens
cgtgtatttggctgggc

SEQ ID NO: 3292484 - DNA, 18 bp, Homo sapiens
cgtgtatttggctgggct

SEQ ID NO: 3292485 - DNA, 16 bp, Homo sapiens
cgtgtattttcattac

SEQ ID NO: 3292486 - DNA, 16 bp, Homo sapiens
cgtgtcaatttccctc

SEQ ID NO: 3292487 - DNA, 14 bp, Homo sapiens
cgtgtcacacttgt

SEQ ID NO: 3292488 - DNA, 15 bp, Homo sapiens
cgtgtcacacttgtg

SEQ ID NO: 3292489 - DNA, 17 bp, Homo sapiens
cgtgtcacacttgtgac

SEQ ID NO: 3292490 - DNA, 23 bp, Homo sapiens
cgtgtctctcccaccccggcctc

SEQ ID NO: 3292491 - DNA, 22 bp, Homo sapiens
cgtgtctgtatttatgtgtgag

SEQ ID NO: 3292492 - DNA, 20 bp, Homo sapiens
cgtgtcttccactttgcata

SEQ ID NO: 3292493 - DNA, 17 bp, Homo sapiens
cgtgtgagtgtgacagg

SEQ ID NO: 3292494 - DNA, 21 bp, Homo sapiens
cgtgtgagtgtgacagggcca

SEQ ID NO: 3292495 - DNA, 20 bp, Homo sapiens
cgtgtgtaaatatgtacatt

SEQ ID NO: 3292496 - DNA, 16 bp, Homo sapiens
cgtgtgtgttgtctga

SEQ ID NO: 3292497 - DNA, 16 bp, Homo sapiens
cgtgttctccttttcc

SEQ ID NO: 3292498 - DNA, 20 bp, Homo sapiens
cgtgtttctgactctgagct

SEQ ID NO: 3292499 - DNA, 21 bp, Homo sapiens
cgtgttttattcctgtatgtt

SEQ ID NO: 3292500 - DNA, 15 bp, Homo sapiens
cgttaagggcagagt

SEQ ID NO: 3292501 - DNA, 16 bp, Homo sapiens
cgttagaccgctctct

SEQ ID NO: 3292502 - DNA, 13 bp, Homo sapiens
cgttagctcctgt

SEQ ID NO: 3292503 - DNA, 14 bp, Homo sapiens
cgttagctcctgtg

SEQ ID NO: 3292504 - DNA, 14 bp, Homo sapiens
cgttattataattg

SEQ ID NO: 3292505 - DNA, 13 bp, Homo sapiens
cgttatttatgga

SEQ ID NO: 3292506 - DNA, 17 bp, Homo sapiens
cgttcaaaacattccaa

SEQ ID NO: 3292507 - DNA, 12 bp, Homo sapiens
cgttccacagtt

SEQ ID NO: 3292508 - DNA, 14 bp, Homo sapiens
cgttccacagttgc

SEQ ID NO: 3292509 - DNA, 17 bp, Homo sapiens
cgttccacagttgccac

SEQ ID NO: 3292510 - DNA, 19 bp, Homo sapiens
cgttccacagttgccacca

SEQ ID NO: 3292511 - DNA, 21 bp, Homo sapiens
cgttccaccccaagagaactc

SEQ ID NO: 3292512 - DNA, 12 bp, Homo sapiens
cgttcccagcag

SEQ ID NO: 3292513 - DNA, 14 bp, Homo sapiens
cgttcccagcaggg

SEQ ID NO: 3292514 - DNA, 21 bp, Homo sapiens
cgttccccttggcttcctccg

SEQ ID NO: 3292515 - DNA, 18 bp, Homo sapiens
cgttccctgattatttat

SEQ ID NO: 3292516 - DNA, 21 bp, Homo sapiens
cgttcctgacatcacagcagc

SEQ ID NO: 3292517 - DNA, 19 bp, Homo sapiens
cgttcgatttctacctcag

SEQ ID NO: 3292518 - DNA, 22 bp, Homo sapiens
cgttctctgccccgtttcttgc

SEQ ID NO: 3292519 - DNA, 17 bp, Homo sapiens
cgttctctgtcctactt

SEQ ID NO: 3292520 - DNA, 19 bp, Homo sapiens
ctaccaggtgtgcctggaa

SEQ ID NO: 3292521 - DNA, 20 bp, Homo sapiens
ctaccaggtgtgcctggaag

SEQ ID NO: 3292522 - DNA, 14 bp, Homo sapiens
ctaccatcagggac

SEQ ID NO: 3292523 - DNA, 18 bp, Homo sapiens
ctaccatcagggacagga

SEQ ID NO: 3292524 - DNA, 19 bp, Homo sapiens
ctaccatgaacagaaaaca

SEQ ID NO: 3292525 - DNA, 12 bp, Homo sapiens
ctaccatttcag

SEQ ID NO: 3292526 - DNA, 13 bp, Homo sapiens
ctaccatttcaga

SEQ ID NO: 3292527 - DNA, 20 bp, Homo sapiens
ctaccatttgtgttttgaaa

SEQ ID NO: 3292528 - DNA, 14 bp, Homo sapiens
ctacccaaccactc

SEQ ID NO: 3292529 - DNA, 13 bp, Homo sapiens
ctacccaccctcc

SEQ ID NO: 3292530 - DNA, 17 bp, Homo sapiens
ctacccaccctcctttc

SEQ ID NO: 3292531 - DNA, 17 bp, Homo sapiens
ctacccaccgatggagc

SEQ ID NO: 3292532 - DNA, 23 bp, Homo sapiens
ctacccacgttctcacacccacc

SEQ ID NO: 3292533 - DNA, 15 bp, Homo sapiens
ctacccactatcctt

SEQ ID NO: 3292534 - DNA, 21 bp, Homo sapiens
ctacccagagattgcttctca

SEQ ID NO: 3292535 - DNA, 19 bp, Homo sapiens
ctacccagatggaaaaata

SEQ ID NO: 3292536 - DNA, 17 bp, Homo sapiens
ctacccagcgagccctg

SEQ ID NO: 3292537 - DNA, 18 bp, Homo sapiens
ctacccagcgagccctgg

SEQ ID NO: 3292538 - DNA, 19 bp, Homo sapiens
ctacccagcgagccctggt

SEQ ID NO: 3292539 - DNA, 18 bp, Homo sapiens
ctacccagcgtggcctcc

SEQ ID NO: 3292540 - DNA, 19 bp, Homo sapiens
ctacccaggaggctgaggt

SEQ ID NO: 3292541 - DNA, 17 bp, Homo sapiens
ctacccatgagcctgcc

SEQ ID NO: 3292542 - DNA, 13 bp, Homo sapiens
ctaccccagtccc

SEQ ID NO: 3292543 - DNA, 18 bp, Homo sapiens
ctaccccagtcccaggga

SEQ ID NO: 3292544 - DNA, 21 bp, Homo sapiens
ctacccccttttcagctgagc

SEQ ID NO: 3292545 - DNA, 15 bp, Homo sapiens
ctacccctgctccca

SEQ ID NO: 3292546 - DNA, 16 bp, Homo sapiens
ctacccctttcttctc

SEQ ID NO: 3292547 - DNA, 18 bp, Homo sapiens
ctaccctagccattcctg

SEQ ID NO: 3292548 - DNA, 19 bp, Homo sapiens
ctaccctcgggcccacctg

SEQ ID NO: 3292549 - DNA, 20 bp, Homo sapiens
ctaccctcgggcccacctgg

SEQ ID NO: 3292550 - DNA, 16 bp, Homo sapiens
ctaccctttttctcca

SEQ ID NO: 3292551 - DNA, 17 bp, Homo sapiens
ctaccgagtctcttctc

SEQ ID NO: 3292552 - DNA, 22 bp, Homo sapiens
ctaccgagtctcttctccactg

SEQ ID NO: 3292553 - DNA, 14 bp, Homo sapiens
ctaccgagttcaag

SEQ ID NO: 3292554 - DNA, 19 bp, Homo sapiens
ctacctcactactacatct

SEQ ID NO: 3292555 - DNA, 15 bp, Homo sapiens
ctacctcagcctaga

SEQ ID NO: 3292556 - DNA, 20 bp, Homo sapiens
ctacctcaggcaggaagggc

SEQ ID NO: 3292557 - DNA, 22 bp, Homo sapiens
ctacctcaggttgctggttgct

SEQ ID NO: 3292558 - DNA, 23 bp, Homo sapiens
ctacctccctccccgtctcattc

SEQ ID NO: 3292559 - DNA, 14 bp, Homo sapiens
ctacctccttagct

SEQ ID NO: 3292560 - DNA, 13 bp, Homo sapiens
ctacctctctgtc

SEQ ID NO: 3292561 - DNA, 16 bp, Homo sapiens
ctacctctgagaagac

SEQ ID NO: 3292562 - DNA, 16 bp, Homo sapiens
ctacctgccctcaagg

SEQ ID NO: 3292563 - DNA, 11 bp, Homo sapiens
ctacctgctgg

SEQ ID NO: 3292564 - DNA, 14 bp, Homo sapiens
ctacctgctggaca

SEQ ID NO: 3292565 - DNA, 15 bp, Homo sapiens
ctacctgtgtggtac

SEQ ID NO: 3292566 - DNA, 19 bp, Homo sapiens
ctaccttaaaatgtaaaac

SEQ ID NO: 3292567 - DNA, 19 bp, Homo sapiens
ctaccttgaaaataagaat

SEQ ID NO: 3292568 - DNA, 22 bp, Homo sapiens
ctaccttgaggtcttttgacat

SEQ ID NO: 3292569 - DNA, 21 bp, Homo sapiens
ctacgagggaggaacacctga

SEQ ID NO: 3292570 - DNA, 14 bp, Homo sapiens
ctactaaagtgcct

SEQ ID NO: 3292571 - DNA, 20 bp, Homo sapiens
ctactaagttcacattagaa

SEQ ID NO: 3292572 - DNA, 15 bp, Homo sapiens
ctactaattccacac

SEQ ID NO: 3292573 - DNA, 13 bp, Homo sapiens
ctactacatctgt

SEQ ID NO: 3292574 - DNA, 19 bp, Homo sapiens
ctactaccacaaggaaaat

SEQ ID NO: 3292575 - DNA, 22 bp, Homo sapiens
ctactagagtctgaacagctgt

SEQ ID NO: 3292576 - DNA, 14 bp, Homo sapiens
ctactataaagaga

SEQ ID NO: 3292577 - DNA, 13 bp, Homo sapiens
ctactataatcaa

SEQ ID NO: 3292578 - DNA, 17 bp, Homo sapiens
ctactataatcaaatga

SEQ ID NO: 3292579 - DNA, 18 bp, Homo sapiens
ctactatgccagatgcct

SEQ ID NO: 3292580 - DNA, 18 bp, Homo sapiens
ctactattcatgttttga

SEQ ID NO: 3292581 - DNA, 18 bp, Homo sapiens
ctactcacagtctcttta

SEQ ID NO: 3292582 - DNA, 13 bp, Homo sapiens
ctactcagaagcc

SEQ ID NO: 3292583 - DNA, 16 bp, Homo sapiens
ctactcagaagcctga

SEQ ID NO: 3292584 - DNA, 21 bp, Homo sapiens
ctactcagaagcctgaggctg

SEQ ID NO: 3292585 - DNA, 12 bp, Homo sapiens
ctactccactgc

SEQ ID NO: 3292586 - DNA, 11 bp, Homo sapiens
ctactccctct

SEQ ID NO: 3292587 - DNA, 14 bp, Homo sapiens
ctactccctgcaga

SEQ ID NO: 3292588 - DNA, 18 bp, Homo sapiens
ctactccctgcagatgcc

SEQ ID NO: 3292589 - DNA, 11 bp, Homo sapiens
ctactcctgac

SEQ ID NO: 3292590 - DNA, 19 bp, Homo sapiens
ctactctccccacgagggc

SEQ ID NO: 3292591 - DNA, 21 bp, Homo sapiens
ctactctccccacgagggctg

SEQ ID NO: 3292592 - DNA, 17 bp, Homo sapiens
ctactctcctcggcccc

SEQ ID NO: 3292593 - DNA, 14 bp, Homo sapiens
ctactctgtccagg

SEQ ID NO: 3292594 - DNA, 16 bp, Homo sapiens
ctactctgtccaggcc

SEQ ID NO: 3292595 - DNA, 17 bp, Homo sapiens
ctactctgtccaggcca

SEQ ID NO: 3292596 - DNA, 13 bp, Homo sapiens
ctactctgtgtca

SEQ ID NO: 3292597 - DNA, 16 bp, Homo sapiens
ctactctgtgtcaggt

SEQ ID NO: 3292598 - DNA, 14 bp, Homo sapiens
ctactcttgtcatt

SEQ ID NO: 3292599 - DNA, 22 bp, Homo sapiens
ctactgaaacagatttcatacc

SEQ ID NO: 3292600 - DNA, 14 bp, Homo sapiens
ctactgacatgtgg

SEQ ID NO: 3292601 - DNA, 15 bp, Homo sapiens
ctactgacatgtggg

SEQ ID NO: 3292602 - DNA, 20 bp, Homo sapiens
ctactgagctgagaccactg

SEQ ID NO: 3292603 - DNA, 16 bp, Homo sapiens
ctactgattgtttcat

SEQ ID NO: 3292604 - DNA, 20 bp, Homo sapiens
ctactgcactccagcctggg

SEQ ID NO: 3292605 - DNA, 23 bp, Homo sapiens
ctactgcactccagcctggggga

SEQ ID NO: 3292606 - DNA, 13 bp, Homo sapiens
ctactgcagcacc

SEQ ID NO: 3292607 - DNA, 20 bp, Homo sapiens
ctactgcagcacctccaggc

SEQ ID NO: 3292608 - DNA, 22 bp, Homo sapiens
ctactgcagcacctccaggcct

SEQ ID NO: 3292609 - DNA, 14 bp, Homo sapiens
ctactggattctta

SEQ ID NO: 3292610 - DNA, 19 bp, Homo sapiens
ctactgtaattttatatga

SEQ ID NO: 3292611 - DNA, 13 bp, Homo sapiens
ctactgtacataa

SEQ ID NO: 3292612 - DNA, 20 bp, Homo sapiens
ctactgtacataaacaatga

SEQ ID NO: 3292613 - DNA, 17 bp, Homo sapiens
ctactgtactttgccat

SEQ ID NO: 3292614 - DNA, 17 bp, Homo sapiens
ctactgtctttggaaaa

SEQ ID NO: 3292615 - DNA, 16 bp, Homo sapiens
ctactgtgcatctcct

SEQ ID NO: 3292616 - DNA, 13 bp, Homo sapiens
ctactgtgttcct

SEQ ID NO: 3292617 - DNA, 15 bp, Homo sapiens
ctactgtgttcctgg

SEQ ID NO: 3292618 - DNA, 14 bp, Homo sapiens
ctactgttcctttc

SEQ ID NO: 3292619 - DNA, 15 bp, Homo sapiens
ctactgttcctttca

SEQ ID NO: 3292620 - DNA, 14 bp, Homo sapiens
ctactgttctaaag

SEQ ID NO: 3292621 - DNA, 18 bp, Homo sapiens
ctactgttctaaagctct

SEQ ID NO: 3292622 - DNA, 22 bp, Homo sapiens
ctactgttgtaagaattctgat

SEQ ID NO: 3292623 - DNA, 15 bp, Homo sapiens
ctacttaattccttt

SEQ ID NO: 3292624 - DNA, 16 bp, Homo sapiens
ctacttcatagctcct

SEQ ID NO: 3292625 - DNA, 20 bp, Homo sapiens
ctacttcctgtgacttcagc

SEQ ID NO: 3292626 - DNA, 23 bp, Homo sapiens
ctacttgggaggctgaggcagga

SEQ ID NO: 3292627 - DNA, 15 bp, Homo sapiens
ctactttaagcacta

SEQ ID NO: 3292628 - DNA, 18 bp, Homo sapiens
ctactttgactttttgca

SEQ ID NO: 3292629 - DNA, 20 bp, Homo sapiens
ctactttgactttttgcatt

SEQ ID NO: 3292630 - DNA, 21 bp, Homo sapiens
ctactttgactttttgcattt

SEQ ID NO: 3292631 - DNA, 19 bp, Homo sapiens
ctactttgcttccgccact

SEQ ID NO: 3292632 - DNA, 17 bp, Homo sapiens
ctactttgtggcaatct

SEQ ID NO: 3292633 - DNA, 22 bp, Homo sapiens
ctagaaaacttgactccatttc

SEQ ID NO: 3292634 - DNA, 18 bp, Homo sapiens
ctagaaaagctgatcata

SEQ ID NO: 3292635 - DNA, 17 bp, Homo sapiens
ctagaaacccaagctcc

SEQ ID NO: 3292636 - DNA, 23 bp, Homo sapiens
ctagaaacccaagctcctcctcg

SEQ ID NO: 3292637 - DNA, 14 bp, Homo sapiens
ctagaaagaaaaga

SEQ ID NO: 3292638 - DNA, 20 bp, Homo sapiens
ctagaaagaagctcgcccca

SEQ ID NO: 3292639 - DNA, 22 bp, Homo sapiens
ctagaaagcctgttcccctcac

SEQ ID NO: 3292640 - DNA, 16 bp, Homo sapiens
ctagaaattgacacaa

SEQ ID NO: 3292641 - DNA, 13 bp, Homo sapiens
ctagaaattttca

SEQ ID NO: 3292642 - DNA, 21 bp, Homo sapiens
ctagaacacaggcaaaatcct

SEQ ID NO: 3292643 - DNA, 22 bp, Homo sapiens
ctagaacactaactcaccagcc

SEQ ID NO: 3292644 - DNA, 13 bp, Homo sapiens
ctagaacctgggc

SEQ ID NO: 3292645 - DNA, 16 bp, Homo sapiens
ctagaactccctttca

SEQ ID NO: 3292646 - DNA, 16 bp, Homo sapiens
ctatataatttatttc

SEQ ID NO: 3292647 - DNA, 20 bp, Homo sapiens
ctatataatttatttccact

SEQ ID NO: 3292648 - DNA, 17 bp, Homo sapiens
ctatatacatgtgtgta

SEQ ID NO: 3292649 - DNA, 14 bp, Homo sapiens
ctatatagagatgt

SEQ ID NO: 3292650 - DNA, 16 bp, Homo sapiens
ctatatataattctgt

SEQ ID NO: 3292651 - DNA, 21 bp, Homo sapiens
ctatatataattctgtacata

SEQ ID NO: 3292652 - DNA, 17 bp, Homo sapiens
ctatatatataaatgta

SEQ ID NO: 3292653 - DNA, 13 bp, Homo sapiens
ctatatatttcta

SEQ ID NO: 3292654 - DNA, 16 bp, Homo sapiens
ctatatattttatgat

SEQ ID NO: 3292655 - DNA, 14 bp, Homo sapiens
ctatatcatgcttt

SEQ ID NO: 3292656 - DNA, 12 bp, Homo sapiens
ctatatccatgt

SEQ ID NO: 3292657 - DNA, 13 bp, Homo sapiens
ctatatccatgta

SEQ ID NO: 3292658 - DNA, 13 bp, Homo sapiens
ctatatctatata

SEQ ID NO: 3292659 - DNA, 15 bp, Homo sapiens
ctatatgaaaaacaa

SEQ ID NO: 3292660 - DNA, 23 bp, Homo sapiens
ctatatgaatttaaatataattc

SEQ ID NO: 3292661 - DNA, 13 bp, Homo sapiens
ctatatgatttat

SEQ ID NO: 3292662 - DNA, 19 bp, Homo sapiens
ctatatggcaagaaagctg

SEQ ID NO: 3292663 - DNA, 21 bp, Homo sapiens
ctatatgtacagctctcccct

SEQ ID NO: 3292664 - DNA, 12 bp, Homo sapiens
ctatatgtgaat

SEQ ID NO: 3292665 - DNA, 17 bp, Homo sapiens
ctatattagatcaaata

SEQ ID NO: 3292666 - DNA, 20 bp, Homo sapiens
ctatattatgtcttcttttg

SEQ ID NO: 3292667 - DNA, 16 bp, Homo sapiens
ctatattattatatat

SEQ ID NO: 3292668 - DNA, 11 bp, Homo sapiens
ctatattctat

SEQ ID NO: 3292669 - DNA, 12 bp, Homo sapiens
ctatattctata

SEQ ID NO: 3292670 - DNA, 16 bp, Homo sapiens
ctatatttaacaagat

SEQ ID NO: 3292671 - DNA, 13 bp, Homo sapiens
ctatatttacaaa

SEQ ID NO: 3292672 - DNA, 16 bp, Homo sapiens
ctatatttacagtgaa

SEQ ID NO: 3292673 - DNA, 15 bp, Homo sapiens
ctatcaaaagaaata

SEQ ID NO: 3292674 - DNA, 18 bp, Homo sapiens
ctatcaaaagaaatagaa

SEQ ID NO: 3292675 - DNA, 20 bp, Homo sapiens
ctatcaaaagaaatagaaaa

SEQ ID NO: 3292676 - DNA, 15 bp, Homo sapiens
ctatcaacaataaaa

SEQ ID NO: 3292677 - DNA, 19 bp, Homo sapiens
ctatcaacaataaaatttt

SEQ ID NO: 3292678 - DNA, 14 bp, Homo sapiens
ctatcaagcactaa

SEQ ID NO: 3292679 - DNA, 15 bp, Homo sapiens
ctatcaagtcaatca

SEQ ID NO: 3292680 - DNA, 19 bp, Homo sapiens
ctatcaagtcaatcatttc

SEQ ID NO: 3292681 - DNA, 19 bp, Homo sapiens
ctatcagcaatactcatca

SEQ ID NO: 3292682 - DNA, 22 bp, Homo sapiens
ctatcagcaatactcatcagag

SEQ ID NO: 3292683 - DNA, 14 bp, Homo sapiens
ctatcattctcagt

SEQ ID NO: 3292684 - DNA, 15 bp, Homo sapiens
ctatcattctcagtg

SEQ ID NO: 3292685 - DNA, 19 bp, Homo sapiens
ctatcattgcttcctcctc

SEQ ID NO: 3292686 - DNA, 20 bp, Homo sapiens
ctatcatttccgttttgcct

SEQ ID NO: 3292687 - DNA, 22 bp, Homo sapiens
ctatcatttttgtacagtttgc

SEQ ID NO: 3292688 - DNA, 23 bp, Homo sapiens
ctatcatttttgtacagtttgct

SEQ ID NO: 3292689 - DNA, 19 bp, Homo sapiens
ctatccaaacatgtattta

SEQ ID NO: 3292690 - DNA, 15 bp, Homo sapiens
ctatccacagagagt

SEQ ID NO: 3292691 - DNA, 14 bp, Homo sapiens
ctatcccaaaccta

SEQ ID NO: 3292692 - DNA, 14 bp, Homo sapiens
ctatcccattctgc

SEQ ID NO: 3292693 - DNA, 19 bp, Homo sapiens
ctatccccatctccctgcc

SEQ ID NO: 3292694 - DNA, 22 bp, Homo sapiens
ctatccccatctccctgcctgg

SEQ ID NO: 3292695 - DNA, 14 bp, Homo sapiens
ctatccctcacaca

SEQ ID NO: 3292696 - DNA, 17 bp, Homo sapiens
ctatccgctgccagcct

SEQ ID NO: 3292697 - DNA, 17 bp, Homo sapiens
ctatcctgcgggtttta

SEQ ID NO: 3292698 - DNA, 19 bp, Homo sapiens
ctatccttccagtggctcg

SEQ ID NO: 3292699 - DNA, 12 bp, Homo sapiens
ctatccttggca

SEQ ID NO: 3292700 - DNA, 17 bp, Homo sapiens
ctatccttggcaccaaa

SEQ ID NO: 3292701 - DNA, 20 bp, Homo sapiens
ctatccttggcaccaaagat

SEQ ID NO: 3292702 - DNA, 20 bp, Homo sapiens
ctatcgagtttgcaatgtca

SEQ ID NO: 3292703 - DNA, 14 bp, Homo sapiens
ctatctaaagtttg

SEQ ID NO: 3292704 - DNA, 15 bp, Homo sapiens
ctatctatcttccaa

SEQ ID NO: 3292705 - DNA, 19 bp, Homo sapiens
ctatctcctgacagaaggt

SEQ ID NO: 3292706 - DNA, 17 bp, Homo sapiens
ctatctcgtgggagagc

SEQ ID NO: 3292707 - DNA, 17 bp, Homo sapiens
ctatctgattttgtgca

SEQ ID NO: 3292708 - DNA, 12 bp, Homo sapiens
ctatctgggcct

SEQ ID NO: 3292709 - DNA, 15 bp, Homo sapiens
ctatctgggcctggg

SEQ ID NO: 3292710 - DNA, 21 bp, Homo sapiens
ctatctgggcctgggctaggg

SEQ ID NO: 3292711 - DNA, 16 bp, Homo sapiens
ctatctggggagctcc

SEQ ID NO: 3292712 - DNA, 19 bp, Homo sapiens
ctatctggggagctcctgg

SEQ ID NO: 3292713 - DNA, 20 bp, Homo sapiens
ctatctggggagctcctggc

SEQ ID NO: 3292714 - DNA, 12 bp, Homo sapiens
ctatctgtattc

SEQ ID NO: 3292715 - DNA, 16 bp, Homo sapiens
ctatctgtatttatta

SEQ ID NO: 3292716 - DNA, 14 bp, Homo sapiens
ctatctgtctggtg

SEQ ID NO: 3292717 - DNA, 17 bp, Homo sapiens
ctatctgtctggtggcc

SEQ ID NO: 3292718 - DNA, 21 bp, Homo sapiens
ctatctgtctggtggccccgt

SEQ ID NO: 3292719 - DNA, 17 bp, Homo sapiens
ctatgaacttctctcag

SEQ ID NO: 3292720 - DNA, 16 bp, Homo sapiens
ctatgaagttgctgtt

SEQ ID NO: 3292721 - DNA, 22 bp, Homo sapiens
ctatgaagttgctgtttatttt

SEQ ID NO: 3292722 - DNA, 19 bp, Homo sapiens
ctatgaagttggcacattt

SEQ ID NO: 3292723 - DNA, 14 bp, Homo sapiens
ctatgacatttcta

SEQ ID NO: 3292724 - DNA, 15 bp, Homo sapiens
ctatgactgctcccc

SEQ ID NO: 3292725 - DNA, 16 bp, Homo sapiens
ctatgactgtatcttg

SEQ ID NO: 3292726 - DNA, 22 bp, Homo sapiens
ctatgagcatcctgagccccgc

SEQ ID NO: 3292727 - DNA, 14 bp, Homo sapiens
ctatgaggaaaggt

SEQ ID NO: 3292728 - DNA, 22 bp, Homo sapiens
ctatgaggaataattatttatt

SEQ ID NO: 3292729 - DNA, 22 bp, Homo sapiens
ctatgagggccttgtaataaat

SEQ ID NO: 3292730 - DNA, 17 bp, Homo sapiens
ctatgagggtgtttcct

SEQ ID NO: 3292731 - DNA, 20 bp, Homo sapiens
ctatgagggtgtttcctcta

SEQ ID NO: 3292732 - DNA, 14 bp, Homo sapiens
ctatgagtctagat

SEQ ID NO: 3292733 - DNA, 19 bp, Homo sapiens
ctatgagtctagatgttta

SEQ ID NO: 3292734 - DNA, 15 bp, Homo sapiens
ctatgagttggactt

SEQ ID NO: 3292735 - DNA, 17 bp, Homo sapiens
ctatgataaattatgat

SEQ ID NO: 3292736 - DNA, 18 bp, Homo sapiens
ctatgattatgccactgc

SEQ ID NO: 3292737 - DNA, 18 bp, Homo sapiens
ctatgatttttttttcca

SEQ ID NO: 3292738 - DNA, 19 bp, Homo sapiens
ctatgcacagagcccaatg

SEQ ID NO: 3292739 - DNA, 21 bp, Homo sapiens
ctatgcacatatggactctgc

SEQ ID NO: 3292740 - DNA, 15 bp, Homo sapiens
ctatgcccaggtacc

SEQ ID NO: 3292741 - DNA, 20 bp, Homo sapiens
ctatgcccaggtaccaccct

SEQ ID NO: 3292742 - DNA, 23 bp, Homo sapiens
ctatgcgcaaaactgcctgaaag

SEQ ID NO: 3292743 - DNA, 16 bp, Homo sapiens
ctatggaagtggttct

SEQ ID NO: 3292744 - DNA, 14 bp, Homo sapiens
ctatggacaactta

SEQ ID NO: 3292745 - DNA, 23 bp, Homo sapiens
ctatggagcctggcacaggactg

SEQ ID NO: 3292746 - DNA, 15 bp, Homo sapiens
ctatggatggcttct

SEQ ID NO: 3292747 - DNA, 16 bp, Homo sapiens
ctatggatggcttcta

SEQ ID NO: 3292748 - DNA, 11 bp, Homo sapiens
ctatggatgtg

SEQ ID NO: 3292749 - DNA, 17 bp, Homo sapiens
ctatggctggccactgc

SEQ ID NO: 3292750 - DNA, 14 bp, Homo sapiens
ctatggctttcaaa

SEQ ID NO: 3292751 - DNA, 13 bp, Homo sapiens
ctatgggaacaat

SEQ ID NO: 3292752 - DNA, 22 bp, Homo sapiens
ctatgggactcaatgcactgac

SEQ ID NO: 3292753 - DNA, 14 bp, Homo sapiens
ctatgggagcccca

SEQ ID NO: 3292754 - DNA, 15 bp, Homo sapiens
ctatgggagccccag

SEQ ID NO: 3292755 - DNA, 16 bp, Homo sapiens
ctatgggagccccagg

SEQ ID NO: 3292756 - DNA, 22 bp, Homo sapiens
ctatggggagaggaactccttg

SEQ ID NO: 3292757 - DNA, 19 bp, Homo sapiens
ctatgggtctaggacacag

SEQ ID NO: 3292758 - DNA, 17 bp, Homo sapiens
ctatggtatgctggcca

SEQ ID NO: 3292759 - DNA, 18 bp, Homo sapiens
ctatggtatgctggccag

SEQ ID NO: 3292760 - DNA, 21 bp, Homo sapiens
ctatggtcgggagacagcatc

SEQ ID NO: 3292761 - DNA, 14 bp, Homo sapiens
ctatggttatgaaa

SEQ ID NO: 3292762 - DNA, 16 bp, Homo sapiens
ctatggttatgaaaga

SEQ ID NO: 3292763 - DNA, 20 bp, Homo sapiens
ctatggttgccaccccaacc

SEQ ID NO: 3292764 - DNA, 19 bp, Homo sapiens
ctatggtttgccattattt

SEQ ID NO: 3292765 - DNA, 23 bp, Homo sapiens
ctatggtttgccattatttaata

SEQ ID NO: 3292766 - DNA, 13 bp, Homo sapiens
ctatgtatcaatg

SEQ ID NO: 3292767 - DNA, 16 bp, Homo sapiens
ctatgtatcaatgagt

SEQ ID NO: 3292768 - DNA, 19 bp, Homo sapiens
ctatgtatcaatgagtaac

SEQ ID NO: 3292769 - DNA, 13 bp, Homo sapiens
ctatgtatttgca

SEQ ID NO: 3292770 - DNA, 18 bp, Homo sapiens
ctatgtcctaaggacaca

SEQ ID NO: 3292771 - DNA, 20 bp, Homo sapiens
ctatgtcctaaggacacact

SEQ ID NO: 3292772 - DNA, 19 bp, Homo sapiens
ctatgtgccttatgttgaa

SEQ ID NO: 3292773 - DNA, 16 bp, Homo sapiens
ctcagggccaggaagg

SEQ ID NO: 3292774 - DNA, 15 bp, Homo sapiens
ctcagggccatgctg

SEQ ID NO: 3292775 - DNA, 17 bp, Homo sapiens
ctcagggccatgctgag

SEQ ID NO: 3292776 - DNA, 16 bp, Homo sapiens
ctcagggcctggcagg

SEQ ID NO: 3292777 - DNA, 19 bp, Homo sapiens
ctcagggcctggcaggcca

SEQ ID NO: 3292778 - DNA, 20 bp, Homo sapiens
ctcagggcctggcaggccag

SEQ ID NO: 3292779 - DNA, 16 bp, Homo sapiens
ctcagggctcctccca

SEQ ID NO: 3292780 - DNA, 18 bp, Homo sapiens
ctcagggctcctcccagc

SEQ ID NO: 3292781 - DNA, 16 bp, Homo sapiens
ctcagggctcctgcct

SEQ ID NO: 3292782 - DNA, 13 bp, Homo sapiens
ctcaggggcagct

SEQ ID NO: 3292783 - DNA, 20 bp, Homo sapiens
ctcaggggccagaggaactg

SEQ ID NO: 3292784 - DNA, 19 bp, Homo sapiens
ctcagggggtcagcagagt

SEQ ID NO: 3292785 - DNA, 20 bp, Homo sapiens
ctcagggggtcagcagagtt

SEQ ID NO: 3292786 - DNA, 16 bp, Homo sapiens
ctcagggtgcagaggt

SEQ ID NO: 3292787 - DNA, 17 bp, Homo sapiens
ctcagggttcatctgtc

SEQ ID NO: 3292788 - DNA, 20 bp, Homo sapiens
ctcagggttcatctgtccat

SEQ ID NO: 3292789 - DNA, 21 bp, Homo sapiens
ctcaggtacggagaagaatag

SEQ ID NO: 3292790 - DNA, 18 bp, Homo sapiens
ctcaggtgatccacccac

SEQ ID NO: 3292791 - DNA, 22 bp, Homo sapiens
ctcaggtgatccacccacctca

SEQ ID NO: 3292792 - DNA, 23 bp, Homo sapiens
ctcaggtgatccacccacctcag

SEQ ID NO: 3292793 - DNA, 23 bp, Homo sapiens
ctcaggtgccactccctgagctt

SEQ ID NO: 3292794 - DNA, 21 bp, Homo sapiens
ctcaggtggccagcctggatc

SEQ ID NO: 3292795 - DNA, 15 bp, Homo sapiens
ctcaggtgtccctgc

SEQ ID NO: 3292796 - DNA, 17 bp, Homo sapiens
ctcaggtgtccctgcac

SEQ ID NO: 3292797 - DNA, 14 bp, Homo sapiens
ctcaggttctattt

SEQ ID NO: 3292798 - DNA, 20 bp, Homo sapiens
ctcaggttgctggttgctgt

SEQ ID NO: 3292799 - DNA, 21 bp, Homo sapiens
ctcaggttgctggttgctgtg

SEQ ID NO: 3292800 - DNA, 22 bp, Homo sapiens
ctcaggttgctggttgctgtgt

SEQ ID NO: 3292801 - DNA, 18 bp, Homo sapiens
ctcagtcatgcataaata

SEQ ID NO: 3292802 - DNA, 17 bp, Homo sapiens
ctcagtcctcccctcac

SEQ ID NO: 3292803 - DNA, 21 bp, Homo sapiens
ctcagtcctcccctcacagcc

SEQ ID NO: 3292804 - DNA, 14 bp, Homo sapiens
ctcagtctcccttt

SEQ ID NO: 3292805 - DNA, 17 bp, Homo sapiens
ctcagtctctcttctct

SEQ ID NO: 3292806 - DNA, 20 bp, Homo sapiens
ctcagtgttagagaaatcct

SEQ ID NO: 3292807 - DNA, 19 bp, Homo sapiens
ctcagtgttggtatatttt

SEQ ID NO: 3292808 - DNA, 23 bp, Homo sapiens
ctcagtgttttggactccatctc

SEQ ID NO: 3292809 - DNA, 18 bp, Homo sapiens
ctcagttcaacctggtgg

SEQ ID NO: 3292810 - DNA, 17 bp, Homo sapiens
ctcagttcccagctccc

SEQ ID NO: 3292811 - DNA, 14 bp, Homo sapiens
ctcagttcccttgg

SEQ ID NO: 3292812 - DNA, 15 bp, Homo sapiens
ctcagttcccttggc

SEQ ID NO: 3292813 - DNA, 16 bp, Homo sapiens
ctcagttcccttggcc

SEQ ID NO: 3292814 - DNA, 18 bp, Homo sapiens
ctcagttcccttggcctc

SEQ ID NO: 3292815 - DNA, 21 bp, Homo sapiens
ctcagttcccttggcctcaga

SEQ ID NO: 3292816 - DNA, 22 bp, Homo sapiens
ctcagttcccttggcctcagaa

SEQ ID NO: 3292817 - DNA, 22 bp, Homo sapiens
ctcagttctctcccttcctctc

SEQ ID NO: 3292818 - DNA, 23 bp, Homo sapiens
ctcagttctctcccttcctctct

SEQ ID NO: 3292819 - DNA, 18 bp, Homo sapiens
ctcagttttatcattttc

SEQ ID NO: 3292820 - DNA, 14 bp, Homo sapiens
ctcataaaaagcaa

SEQ ID NO: 3292821 - DNA, 21 bp, Homo sapiens
ctcataaaaagcctgcaattt

SEQ ID NO: 3292822 - DNA, 15 bp, Homo sapiens
ctcataaaaataaaa

SEQ ID NO: 3292823 - DNA, 16 bp, Homo sapiens
ctcataaaaataaaag

SEQ ID NO: 3292824 - DNA, 18 bp, Homo sapiens
ctcataagtttgtttaaa

SEQ ID NO: 3292825 - DNA, 15 bp, Homo sapiens
ctcataatgctttgt

SEQ ID NO: 3292826 - DNA, 15 bp, Homo sapiens
ctcatacctctgacc

SEQ ID NO: 3292827 - DNA, 16 bp, Homo sapiens
ctcatacctttaaagg

SEQ ID NO: 3292828 - DNA, 14 bp, Homo sapiens
ctcatactgtctgg

SEQ ID NO: 3292829 - DNA, 21 bp, Homo sapiens
ctcataggaaaagtacattta

SEQ ID NO: 3292830 - DNA, 16 bp, Homo sapiens
ctcataggagactgcg

SEQ ID NO: 3292831 - DNA, 20 bp, Homo sapiens
ctcatagtatggtggctggg

SEQ ID NO: 3292832 - DNA, 19 bp, Homo sapiens
ctcatatatattttaaaaa

SEQ ID NO: 3292833 - DNA, 23 bp, Homo sapiens
ctcatatatattttaaaaacact

SEQ ID NO: 3292834 - DNA, 15 bp, Homo sapiens
ctcatatcagtttgc

SEQ ID NO: 3292835 - DNA, 19 bp, Homo sapiens
ctcatattgtgattctgcc

SEQ ID NO: 3292836 - DNA, 21 bp, Homo sapiens
ctcatattgtgattctgcctt

SEQ ID NO: 3292837 - DNA, 13 bp, Homo sapiens
ctcatatttaaag

SEQ ID NO: 3292838 - DNA, 13 bp, Homo sapiens
ctcatattttgta

SEQ ID NO: 3292839 - DNA, 13 bp, Homo sapiens
ctcatcaactgaa

SEQ ID NO: 3292840 - DNA, 14 bp, Homo sapiens
ctcatcaactgaat

SEQ ID NO: 3292841 - DNA, 21 bp, Homo sapiens
ctcatcaatcaaataagtatt

SEQ ID NO: 3292842 - DNA, 15 bp, Homo sapiens
ctcatcactggatga

SEQ ID NO: 3292843 - DNA, 20 bp, Homo sapiens
ctcatcaggatgaacccagg

SEQ ID NO: 3292844 - DNA, 13 bp, Homo sapiens
ctcatccacccca

SEQ ID NO: 3292845 - DNA, 16 bp, Homo sapiens
ctcatccaccccatcc

SEQ ID NO: 3292846 - DNA, 19 bp, Homo sapiens
ctcatcccacgcactccat

SEQ ID NO: 3292847 - DNA, 17 bp, Homo sapiens
ctcatcccctcgtcctg

SEQ ID NO: 3292848 - DNA, 15 bp, Homo sapiens
ctcatcctcctggaa

SEQ ID NO: 3292849 - DNA, 23 bp, Homo sapiens
ctcatcctcctggaaccttgctg

SEQ ID NO: 3292850 - DNA, 16 bp, Homo sapiens
ctcatcgcgtcctcct

SEQ ID NO: 3292851 - DNA, 15 bp, Homo sapiens
ctcatctatgaggaa

SEQ ID NO: 3292852 - DNA, 23 bp, Homo sapiens
ctcatctccaaggatcctctcca

SEQ ID NO: 3292853 - DNA, 17 bp, Homo sapiens
ctcatctgtggagctgc

SEQ ID NO: 3292854 - DNA, 21 bp, Homo sapiens
ctcatctgtggagctgccaca

SEQ ID NO: 3292855 - DNA, 12 bp, Homo sapiens
ctcatctttaaa

SEQ ID NO: 3292856 - DNA, 21 bp, Homo sapiens
ctcatgataccacctttactg

SEQ ID NO: 3292857 - DNA, 19 bp, Homo sapiens
ctcatgcaaatcaattact

SEQ ID NO: 3292858 - DNA, 20 bp, Homo sapiens
ctcatgcaaatcaattactg

SEQ ID NO: 3292859 - DNA, 19 bp, Homo sapiens
ctcatgcatagtcccagct

SEQ ID NO: 3292860 - DNA, 20 bp, Homo sapiens
ctcatgcatagtcccagcta

SEQ ID NO: 3292861 - DNA, 17 bp, Homo sapiens
ctcatgcccaccccctg

SEQ ID NO: 3292862 - DNA, 19 bp, Homo sapiens
ctcatgcccaccccctgcc

SEQ ID NO: 3292863 - DNA, 20 bp, Homo sapiens
ctcatgcccaccccctgccc

SEQ ID NO: 3292864 - DNA, 12 bp, Homo sapiens
ctcatgcctcag

SEQ ID NO: 3292865 - DNA, 14 bp, Homo sapiens
ctcatgcctgctga

SEQ ID NO: 3292866 - DNA, 15 bp, Homo sapiens
ctcatgcctgctgag

SEQ ID NO: 3292867 - DNA, 14 bp, Homo sapiens
ctcatgctgttgct

SEQ ID NO: 3292868 - DNA, 14 bp, Homo sapiens
ctcatggcccctct

SEQ ID NO: 3292869 - DNA, 17 bp, Homo sapiens
ctcatggcccctctgac

SEQ ID NO: 3292870 - DNA, 19 bp, Homo sapiens
ctcatggcgtaatgggcct

SEQ ID NO: 3292871 - DNA, 21 bp, Homo sapiens
ctcatggcgtaatgggcctgc

SEQ ID NO: 3292872 - DNA, 22 bp, Homo sapiens
ctcatggcgtaatgggcctgcc

SEQ ID NO: 3292873 - DNA, 16 bp, Homo sapiens
ctcatggggtccaagt

SEQ ID NO: 3292874 - DNA, 14 bp, Homo sapiens
ctcatgggtggcac

SEQ ID NO: 3292875 - DNA, 19 bp, Homo sapiens
ctcatggtgcatataaata

SEQ ID NO: 3292876 - DNA, 20 bp, Homo sapiens
ctcatggtgcatataaatat

SEQ ID NO: 3292877 - DNA, 13 bp, Homo sapiens
ctcatgtaacatt

SEQ ID NO: 3292878 - DNA, 17 bp, Homo sapiens
ctcatgtaacattggtg

SEQ ID NO: 3292879 - DNA, 16 bp, Homo sapiens
ctcatgtacataccct

SEQ ID NO: 3292880 - DNA, 16 bp, Homo sapiens
ctcatgtcctgctggc

SEQ ID NO: 3292881 - DNA, 17 bp, Homo sapiens
ctcatgtcctgctggct

SEQ ID NO: 3292882 - DNA, 18 bp, Homo sapiens
ctcatgtcctgctggctt

SEQ ID NO: 3292883 - DNA, 13 bp, Homo sapiens
ctcatgtggctgg

SEQ ID NO: 3292884 - DNA, 13 bp, Homo sapiens
ctcatgttggcca

SEQ ID NO: 3292885 - DNA, 13 bp, Homo sapiens
ctcatgtttatga

SEQ ID NO: 3292886 - DNA, 17 bp, Homo sapiens
ctcatgtttatgaaaat

SEQ ID NO: 3292887 - DNA, 15 bp, Homo sapiens
ctcattactgggcct

SEQ ID NO: 3292888 - DNA, 16 bp, Homo sapiens
ctcattactgggcctt

SEQ ID NO: 3292889 - DNA, 14 bp, Homo sapiens
ctcattcagtatta

SEQ ID NO: 3292890 - DNA, 17 bp, Homo sapiens
ctcattcagtattaaag

SEQ ID NO: 3292891 - DNA, 18 bp, Homo sapiens
ctcattccaccttcccat

SEQ ID NO: 3292892 - DNA, 17 bp, Homo sapiens
ctcattctatccccaat

SEQ ID NO: 3292893 - DNA, 18 bp, Homo sapiens
ctcattctgaattaatta

SEQ ID NO: 3292894 - DNA, 18 bp, Homo sapiens
ctcattgcccccacctct

SEQ ID NO: 3292895 - DNA, 20 bp, Homo sapiens
ctcattgcccccacctctgg

SEQ ID NO: 3292896 - DNA, 15 bp, Homo sapiens
ctcattgcctcctgt

SEQ ID NO: 3292897 - DNA, 18 bp, Homo sapiens
ctcattgcctcctgttct

SEQ ID NO: 3292898 - DNA, 14 bp, Homo sapiens
ctcctccctggctg

SEQ ID NO: 3292899 - DNA, 17 bp, Homo sapiens
ctcctccctggctgccc

SEQ ID NO: 3292900 - DNA, 21 bp, Homo sapiens
ctcctccctggctgccctggc

SEQ ID NO: 3292901 - DNA, 22 bp, Homo sapiens
ctcctccctggctgccctggcc

SEQ ID NO: 3292902 - DNA, 14 bp, Homo sapiens
ctcctcccttcctt

SEQ ID NO: 3292903 - DNA, 15 bp, Homo sapiens
ctcctcccttccttt

SEQ ID NO: 3292904 - DNA, 22 bp, Homo sapiens
ctcctcccttccttttccctgc

SEQ ID NO: 3292905 - DNA, 18 bp, Homo sapiens
ctcctccctttccttcct

SEQ ID NO: 3292906 - DNA, 22 bp, Homo sapiens
ctcctccgaggtggttttaaag

SEQ ID NO: 3292907 - DNA, 15 bp, Homo sapiens
ctcctcctcccccag

SEQ ID NO: 3292908 - DNA, 14 bp, Homo sapiens
ctcctcctgccctg

SEQ ID NO: 3292909 - DNA, 19 bp, Homo sapiens
ctcctccttggtgcctggc

SEQ ID NO: 3292910 - DNA, 23 bp, Homo sapiens
ctcctcggaaccgctcacctaga

SEQ ID NO: 3292911 - DNA, 23 bp, Homo sapiens
ctcctcggagagcagcagcacca

SEQ ID NO: 3292912 - DNA, 18 bp, Homo sapiens
ctcctcggccccctccat

SEQ ID NO: 3292913 - DNA, 20 bp, Homo sapiens
ctcctcggccccctccatcg

SEQ ID NO: 3292914 - DNA, 15 bp, Homo sapiens
ctcctcgggccgagg

SEQ ID NO: 3292915 - DNA, 18 bp, Homo sapiens
ctcctctagctgtggggg

SEQ ID NO: 3292916 - DNA, 12 bp, Homo sapiens
ctcctctccagg

SEQ ID NO: 3292917 - DNA, 15 bp, Homo sapiens
ctcctctccaggcac

SEQ ID NO: 3292918 - DNA, 15 bp, Homo sapiens
ctcctctcccatccc

SEQ ID NO: 3292919 - DNA, 21 bp, Homo sapiens
ctcctctcccatccccctgcc

SEQ ID NO: 3292920 - DNA, 15 bp, Homo sapiens
ctcctctccccagca

SEQ ID NO: 3292921 - DNA, 23 bp, Homo sapiens
ctcctctccttgggctcctggct

SEQ ID NO: 3292922 - DNA, 13 bp, Homo sapiens
ctcctctctagaa

SEQ ID NO: 3292923 - DNA, 12 bp, Homo sapiens
ctcctctctggg

SEQ ID NO: 3292924 - DNA, 13 bp, Homo sapiens
ctcctctctgggc

SEQ ID NO: 3292925 - DNA, 14 bp, Homo sapiens
ctcctctctgggcc

SEQ ID NO: 3292926 - DNA, 16 bp, Homo sapiens
ctcctctgcagtgcct

SEQ ID NO: 3292927 - DNA, 15 bp, Homo sapiens
ctcctctgggcctgg

SEQ ID NO: 3292928 - DNA, 22 bp, Homo sapiens
ctcctctgggcctggggtgcat

SEQ ID NO: 3292929 - DNA, 16 bp, Homo sapiens
ctcctctgtcctgctt

SEQ ID NO: 3292930 - DNA, 18 bp, Homo sapiens
ctcctcttcaactgacca

SEQ ID NO: 3292931 - DNA, 19 bp, Homo sapiens
ctcctcttcaccccggcag

SEQ ID NO: 3292932 - DNA, 20 bp, Homo sapiens
ctcctcttcaccccggcagg

SEQ ID NO: 3292933 - DNA, 19 bp, Homo sapiens
ctcctcttctgacgtgcct

SEQ ID NO: 3292934 - DNA, 18 bp, Homo sapiens
ctcctcttgccactgcct

SEQ ID NO: 3292935 - DNA, 19 bp, Homo sapiens
ctcctcttgccactgcctc

SEQ ID NO: 3292936 - DNA, 12 bp, Homo sapiens
ctcctcttggaa

SEQ ID NO: 3292937 - DNA, 17 bp, Homo sapiens
ctcctctttcctctctt

SEQ ID NO: 3292938 - DNA, 22 bp, Homo sapiens
ctcctctttcctctctttgttc

SEQ ID NO: 3292939 - DNA, 18 bp, Homo sapiens
ctcctgaaccgcacagct

SEQ ID NO: 3292940 - DNA, 19 bp, Homo sapiens
ctcctgacctcaggtgatt

SEQ ID NO: 3292941 - DNA, 16 bp, Homo sapiens
ctcctgacctgtcacc

SEQ ID NO: 3292942 - DNA, 16 bp, Homo sapiens
ctcctgagaaatgtta

SEQ ID NO: 3292943 - DNA, 20 bp, Homo sapiens
ctcctgagaaggcgaggaga

SEQ ID NO: 3292944 - DNA, 21 bp, Homo sapiens
ctcctgagaaggcgaggagag

SEQ ID NO: 3292945 - DNA, 22 bp, Homo sapiens
ctcctgagaaggcgaggagagt

SEQ ID NO: 3292946 - DNA, 16 bp, Homo sapiens
ctcctgaggctttgga

SEQ ID NO: 3292947 - DNA, 20 bp, Homo sapiens
ctcctgaggggcatctgccc

SEQ ID NO: 3292948 - DNA, 23 bp, Homo sapiens
ctcctgaggggcatctgcccctc

SEQ ID NO: 3292949 - DNA, 13 bp, Homo sapiens
ctcctgatggcca

SEQ ID NO: 3292950 - DNA, 19 bp, Homo sapiens
ctcctgatggccaagagca

SEQ ID NO: 3292951 - DNA, 18 bp, Homo sapiens
ctcctgcacttacttgct

SEQ ID NO: 3292952 - DNA, 20 bp, Homo sapiens
ctcctgcacttacttgctta

SEQ ID NO: 3292953 - DNA, 18 bp, Homo sapiens
ctcctgccacatggagcc

SEQ ID NO: 3292954 - DNA, 13 bp, Homo sapiens
ctcctgcccacgg

SEQ ID NO: 3292955 - DNA, 13 bp, Homo sapiens
ctcctgcccagat

SEQ ID NO: 3292956 - DNA, 14 bp, Homo sapiens
ctcctgcccagtcc

SEQ ID NO: 3292957 - DNA, 17 bp, Homo sapiens
ctcctgcccagtccccc

SEQ ID NO: 3292958 - DNA, 18 bp, Homo sapiens
ctcctgcccagtccccca

SEQ ID NO: 3292959 - DNA, 21 bp, Homo sapiens
ctcctgccgcagacgggcaca

SEQ ID NO: 3292960 - DNA, 23 bp, Homo sapiens
ctcctgccgcagacgggcacaga

SEQ ID NO: 3292961 - DNA, 14 bp, Homo sapiens
ctcctgcctcagcc

SEQ ID NO: 3292962 - DNA, 16 bp, Homo sapiens
ctcctgcctcagcctc

SEQ ID NO: 3292963 - DNA, 14 bp, Homo sapiens
ctcctgcctgtagc

SEQ ID NO: 3292964 - DNA, 15 bp, Homo sapiens
ctcctgcctgtagca

SEQ ID NO: 3292965 - DNA, 16 bp, Homo sapiens
ctcctgcctgtagcag

SEQ ID NO: 3292966 - DNA, 16 bp, Homo sapiens
ctcctgccttctgtcc

SEQ ID NO: 3292967 - DNA, 17 bp, Homo sapiens
ctcctgcgccccgccca

SEQ ID NO: 3292968 - DNA, 16 bp, Homo sapiens
ctcctgctcctccctg

SEQ ID NO: 3292969 - DNA, 18 bp, Homo sapiens
ctcctgctcctccctgcc

SEQ ID NO: 3292970 - DNA, 21 bp, Homo sapiens
ctcctgctcctccctgccccc

SEQ ID NO: 3292971 - DNA, 23 bp, Homo sapiens
ctcctgctcctccctgcccccca

SEQ ID NO: 3292972 - DNA, 14 bp, Homo sapiens
ctcctgctggctct

SEQ ID NO: 3292973 - DNA, 14 bp, Homo sapiens
ctcctgctggtacc

SEQ ID NO: 3292974 - DNA, 15 bp, Homo sapiens
ctcctgctggtacct

SEQ ID NO: 3292975 - DNA, 20 bp, Homo sapiens
ctcctgctggtacctgccct

SEQ ID NO: 3292976 - DNA, 18 bp, Homo sapiens
ctcctggaaaggctcagt

SEQ ID NO: 3292977 - DNA, 19 bp, Homo sapiens
ctcctggaaaggctcagtc

SEQ ID NO: 3292978 - DNA, 20 bp, Homo sapiens
ctcctggaaaggctcagtct

SEQ ID NO: 3292979 - DNA, 23 bp, Homo sapiens
ctcctggaaaggctcagtctcag

SEQ ID NO: 3292980 - DNA, 18 bp, Homo sapiens
ctcctggaaccttgctgt

SEQ ID NO: 3292981 - DNA, 21 bp, Homo sapiens
ctcctggcaatcaatacagct

SEQ ID NO: 3292982 - DNA, 13 bp, Homo sapiens
ctcctggcctatc

SEQ ID NO: 3292983 - DNA, 18 bp, Homo sapiens
ctcctggcctatccgctg

SEQ ID NO: 3292984 - DNA, 14 bp, Homo sapiens
ctcctggcctcaag

SEQ ID NO: 3292985 - DNA, 16 bp, Homo sapiens
ctcctggctaagcctc

SEQ ID NO: 3292986 - DNA, 14 bp, Homo sapiens
ctcctggctccctc

SEQ ID NO: 3292987 - DNA, 22 bp, Homo sapiens
ctcctggctcttgatacccccc

SEQ ID NO: 3292988 - DNA, 17 bp, Homo sapiens
ctcctgggaagatgagg

SEQ ID NO: 3292989 - DNA, 20 bp, Homo sapiens
ctcctgggaagatgaggttc

SEQ ID NO: 3292990 - DNA, 18 bp, Homo sapiens
ctcctgggctaagtgatc

SEQ ID NO: 3292991 - DNA, 15 bp, Homo sapiens
ctcctgggggtggca

SEQ ID NO: 3292992 - DNA, 20 bp, Homo sapiens
ctcctgggggttctttcttc

SEQ ID NO: 3292993 - DNA, 22 bp, Homo sapiens
ctcctgggggttctttcttcct

SEQ ID NO: 3292994 - DNA, 21 bp, Homo sapiens
ctcctgggtgtgtttggcttg

SEQ ID NO: 3292995 - DNA, 23 bp, Homo sapiens
ctcctggtcttgagatgtcttct

SEQ ID NO: 3292996 - DNA, 21 bp, Homo sapiens
ctcctggtgcccctcgccagc

SEQ ID NO: 3292997 - DNA, 22 bp, Homo sapiens
ctcctggtgcccctcgccagct

SEQ ID NO: 3292998 - DNA, 21 bp, Homo sapiens
ctcctggtggccttctgctgc

SEQ ID NO: 3292999 - DNA, 20 bp, Homo sapiens
ctcctgtaagccaaagaaat

SEQ ID NO: 3293000 - DNA, 21 bp, Homo sapiens
ctcctgtcctcccatcccctg

SEQ ID NO: 3293001 - DNA, 11 bp, Homo sapiens
ctcctgtctgc

SEQ ID NO: 3293002 - DNA, 19 bp, Homo sapiens
ctcctgtctgccctctggg

SEQ ID NO: 3293003 - DNA, 16 bp, Homo sapiens
ctcctgtgaatggagg

SEQ ID NO: 3293004 - DNA, 20 bp, Homo sapiens
ctcctgtgaatggaggcaga

SEQ ID NO: 3293005 - DNA, 16 bp, Homo sapiens
ctcctgtgcatgggtg

SEQ ID NO: 3293006 - DNA, 17 bp, Homo sapiens
ctcctgtgcatgggtga

SEQ ID NO: 3293007 - DNA, 11 bp, Homo sapiens
ctcctgtgcta

SEQ ID NO: 3293008 - DNA, 19 bp, Homo sapiens
ctcctgtggccccaccctg

SEQ ID NO: 3293009 - DNA, 11 bp, Homo sapiens
ctcctgtgtgt

SEQ ID NO: 3293010 - DNA, 19 bp, Homo sapiens
ctcctgtgtgtgcgcctac

SEQ ID NO: 3293011 - DNA, 16 bp, Homo sapiens
ctcctgttctgcccac

SEQ ID NO: 3293012 - DNA, 20 bp, Homo sapiens
ctcctgtttcccttcccttc

SEQ ID NO: 3293013 - DNA, 23 bp, Homo sapiens
ctccttaagctgcagagatttct

SEQ ID NO: 3293014 - DNA, 23 bp, Homo sapiens
ctccttactctgagcccaggccg

SEQ ID NO: 3293015 - DNA, 14 bp, Homo sapiens
ctccttactgtgtt

SEQ ID NO: 3293016 - DNA, 22 bp, Homo sapiens
ctccttagccctgtctgctagg

SEQ ID NO: 3293017 - DNA, 21 bp, Homo sapiens
ctccttagctttccctgtgcc

SEQ ID NO: 3293018 - DNA, 22 bp, Homo sapiens
ctccttagctttccctgtgcca

SEQ ID NO: 3293019 - DNA, 15 bp, Homo sapiens
ctccttcactgttcc

SEQ ID NO: 3293020 - DNA, 17 bp, Homo sapiens
ctccttcactgttccct

SEQ ID NO: 3293021 - DNA, 12 bp, Homo sapiens
ctccttcagcac

SEQ ID NO: 3293022 - DNA, 13 bp, Homo sapiens
ctccttcagcacg

SEQ ID NO: 3293023 - DNA, 22 bp, Homo sapiens
ctctgagcccatgttctgcccc

SEQ ID NO: 3293024 - DNA, 13 bp, Homo sapiens
ctctgagcgcctc

SEQ ID NO: 3293025 - DNA, 15 bp, Homo sapiens
ctctgagcgggaggc

SEQ ID NO: 3293026 - DNA, 17 bp, Homo sapiens
ctctgagcgggaggcag

SEQ ID NO: 3293027 - DNA, 17 bp, Homo sapiens
ctctgagctgctcaccg

SEQ ID NO: 3293028 - DNA, 12 bp, Homo sapiens
ctctgaggacac

SEQ ID NO: 3293029 - DNA, 19 bp, Homo sapiens
ctctgaggctctttctggg

SEQ ID NO: 3293030 - DNA, 17 bp, Homo sapiens
ctctgagtccactgctc

SEQ ID NO: 3293031 - DNA, 15 bp, Homo sapiens
ctctgagtcctttgc

SEQ ID NO: 3293032 - DNA, 16 bp, Homo sapiens
ctctgagtctctgaat

SEQ ID NO: 3293033 - DNA, 12 bp, Homo sapiens
ctctgagtgtga

SEQ ID NO: 3293034 - DNA, 17 bp, Homo sapiens
ctctgagtttaccattt

SEQ ID NO: 3293035 - DNA, 18 bp, Homo sapiens
ctctgagtttaccatttg

SEQ ID NO: 3293036 - DNA, 20 bp, Homo sapiens
ctctgagtttaccatttgta

SEQ ID NO: 3293037 - DNA, 21 bp, Homo sapiens
ctctgagtttaccatttgtaa

SEQ ID NO: 3293038 - DNA, 15 bp, Homo sapiens
ctctgatatgggact

SEQ ID NO: 3293039 - DNA, 16 bp, Homo sapiens
ctctgatatgggactg

SEQ ID NO: 3293040 - DNA, 21 bp, Homo sapiens
ctctgatatgggactgagcct

SEQ ID NO: 3293041 - DNA, 15 bp, Homo sapiens
ctctgatcaaaatta

SEQ ID NO: 3293042 - DNA, 16 bp, Homo sapiens
ctctgatcttgtgctc

SEQ ID NO: 3293043 - DNA, 16 bp, Homo sapiens
ctctgatgcaatagtg

SEQ ID NO: 3293044 - DNA, 22 bp, Homo sapiens
ctctgatggttcttcacctcct

SEQ ID NO: 3293045 - DNA, 15 bp, Homo sapiens
ctctgcaaaggcctg

SEQ ID NO: 3293046 - DNA, 12 bp, Homo sapiens
ctctgcaatgct

SEQ ID NO: 3293047 - DNA, 15 bp, Homo sapiens
ctctgcaattcccct

SEQ ID NO: 3293048 - DNA, 19 bp, Homo sapiens
ctctgcaattcccctctgc

SEQ ID NO: 3293049 - DNA, 22 bp, Homo sapiens
ctctgcaattcccctctgctgc

SEQ ID NO: 3293050 - DNA, 13 bp, Homo sapiens
ctctgcacatgtc

SEQ ID NO: 3293051 - DNA, 15 bp, Homo sapiens
ctctgcacccctctg

SEQ ID NO: 3293052 - DNA, 23 bp, Homo sapiens
ctctgcactactcctctgcagtg

SEQ ID NO: 3293053 - DNA, 20 bp, Homo sapiens
ctctgcactactgacatgtg

SEQ ID NO: 3293054 - DNA, 19 bp, Homo sapiens
ctctgcactcccacctgac

SEQ ID NO: 3293055 - DNA, 20 bp, Homo sapiens
ctctgcactcccacctgaca

SEQ ID NO: 3293056 - DNA, 14 bp, Homo sapiens
ctctgcagaacagt

SEQ ID NO: 3293057 - DNA, 16 bp, Homo sapiens
ctctgcagactgctag

SEQ ID NO: 3293058 - DNA, 18 bp, Homo sapiens
ctctgcagacttcccagc

SEQ ID NO: 3293059 - DNA, 23 bp, Homo sapiens
ctctgcaggcttaataaaaatga

SEQ ID NO: 3293060 - DNA, 13 bp, Homo sapiens
ctctgcagtaaaa

SEQ ID NO: 3293061 - DNA, 19 bp, Homo sapiens
ctctgcatcccagcacctg

SEQ ID NO: 3293062 - DNA, 14 bp, Homo sapiens
ctctgcattctagt

SEQ ID NO: 3293063 - DNA, 15 bp, Homo sapiens
ctctgcattctagta

SEQ ID NO: 3293064 - DNA, 14 bp, Homo sapiens
ctctgccaaaggat

SEQ ID NO: 3293065 - DNA, 11 bp, Homo sapiens
ctctgccacca

SEQ ID NO: 3293066 - DNA, 23 bp, Homo sapiens
ctctgccaccagagaccgtcctc

SEQ ID NO: 3293067 - DNA, 16 bp, Homo sapiens
ctctgccacccactca

SEQ ID NO: 3293068 - DNA, 16 bp, Homo sapiens
ctctgccagcaaagag

SEQ ID NO: 3293069 - DNA, 22 bp, Homo sapiens
ctctgccagggcagtgctagtg

SEQ ID NO: 3293070 - DNA, 21 bp, Homo sapiens
ctctgccagtggatcccctgc

SEQ ID NO: 3293071 - DNA, 21 bp, Homo sapiens
ctctgccccaagcagccagcc

SEQ ID NO: 3293072 - DNA, 15 bp, Homo sapiens
ctctgccccaagccc

SEQ ID NO: 3293073 - DNA, 16 bp, Homo sapiens
ctctgccccaagcccc

SEQ ID NO: 3293074 - DNA, 18 bp, Homo sapiens
ctctgccccaagccccca

SEQ ID NO: 3293075 - DNA, 19 bp, Homo sapiens
ctctgccccagctctggct

SEQ ID NO: 3293076 - DNA, 19 bp, Homo sapiens
ctctgccccgtttcttgcc

SEQ ID NO: 3293077 - DNA, 10 bp, Homo sapiens
ctctgcccct

SEQ ID NO: 3293078 - DNA, 21 bp, Homo sapiens
ctctgcccctattgggagagg

SEQ ID NO: 3293079 - DNA, 18 bp, Homo sapiens
ctctgcccctcccaaccc

SEQ ID NO: 3293080 - DNA, 20 bp, Homo sapiens
ctctgcccctcccaacccag

SEQ ID NO: 3293081 - DNA, 11 bp, Homo sapiens
ctctgcccctg

SEQ ID NO: 3293082 - DNA, 12 bp, Homo sapiens
ctctgcccctga

SEQ ID NO: 3293083 - DNA, 22 bp, Homo sapiens
ctctgccctcattactgggcct

SEQ ID NO: 3293084 - DNA, 20 bp, Homo sapiens
ctctgccctccctccttcct

SEQ ID NO: 3293085 - DNA, 15 bp, Homo sapiens
ctctgccgctacctc

SEQ ID NO: 3293086 - DNA, 20 bp, Homo sapiens
ctctgccggctctttccttg

SEQ ID NO: 3293087 - DNA, 23 bp, Homo sapiens
ctctgccggctctttccttgctc

SEQ ID NO: 3293088 - DNA, 18 bp, Homo sapiens
ctctgccggtcgggcagc

SEQ ID NO: 3293089 - DNA, 20 bp, Homo sapiens
ctctgccggtcgggcagcca

SEQ ID NO: 3293090 - DNA, 13 bp, Homo sapiens
ctctgcctccctc

SEQ ID NO: 3293091 - DNA, 12 bp, Homo sapiens
ctctgcctgccc

SEQ ID NO: 3293092 - DNA, 15 bp, Homo sapiens
ctctgcctgccccgc

SEQ ID NO: 3293093 - DNA, 20 bp, Homo sapiens
ctctgcctgccccgccccca

SEQ ID NO: 3293094 - DNA, 23 bp, Homo sapiens
ctctgcctggtggtcagatgcag

SEQ ID NO: 3293095 - DNA, 23 bp, Homo sapiens
ctctgcctttgacatttaattta

SEQ ID NO: 3293096 - DNA, 15 bp, Homo sapiens
ctctgcggaccccag

SEQ ID NO: 3293097 - DNA, 19 bp, Homo sapiens
ctctgcggaccccagctgt

SEQ ID NO: 3293098 - DNA, 20 bp, Homo sapiens
ctctgcggaccccagctgtg

SEQ ID NO: 3293099 - DNA, 16 bp, Homo sapiens
ctctgctaatcatgtg

SEQ ID NO: 3293100 - DNA, 14 bp, Homo sapiens
ctctgctagatttc

SEQ ID NO: 3293101 - DNA, 20 bp, Homo sapiens
ctctgctatttctcttgctg

SEQ ID NO: 3293102 - DNA, 22 bp, Homo sapiens
ctctgctatttctcttgctgga

SEQ ID NO: 3293103 - DNA, 14 bp, Homo sapiens
ctctgctccaccac

SEQ ID NO: 3293104 - DNA, 15 bp, Homo sapiens
ctctgctccaccaca

SEQ ID NO: 3293105 - DNA, 13 bp, Homo sapiens
ctctgctccccag

SEQ ID NO: 3293106 - DNA, 17 bp, Homo sapiens
ctctgctcctggagcct

SEQ ID NO: 3293107 - DNA, 17 bp, Homo sapiens
ctctgctcgccctcctt

SEQ ID NO: 3293108 - DNA, 15 bp, Homo sapiens
ctctgctctagccag

SEQ ID NO: 3293109 - DNA, 19 bp, Homo sapiens
ctctgctctagccaggagt

SEQ ID NO: 3293110 - DNA, 23 bp, Homo sapiens
ctctgctctagccaggagtctgt

SEQ ID NO: 3293111 - DNA, 14 bp, Homo sapiens
ctctgctctctatg

SEQ ID NO: 3293112 - DNA, 15 bp, Homo sapiens
ctctgctctctatgt

SEQ ID NO: 3293113 - DNA, 14 bp, Homo sapiens
ctctgctgacagac

SEQ ID NO: 3293114 - DNA, 15 bp, Homo sapiens
ctctgctgagctggg

SEQ ID NO: 3293115 - DNA, 16 bp, Homo sapiens
ctctgctgagctgggc

SEQ ID NO: 3293116 - DNA, 19 bp, Homo sapiens
ctctgctgagctgggccca

SEQ ID NO: 3293117 - DNA, 13 bp, Homo sapiens
ctctgctgccatg

SEQ ID NO: 3293118 - DNA, 14 bp, Homo sapiens
ctctgctggcccag

SEQ ID NO: 3293119 - DNA, 21 bp, Homo sapiens
ctctgctggcctggccggcaa

SEQ ID NO: 3293120 - DNA, 17 bp, Homo sapiens
ctctgcttctctcacct

SEQ ID NO: 3293121 - DNA, 13 bp, Homo sapiens
ctctgcttctctg

SEQ ID NO: 3293122 - DNA, 14 bp, Homo sapiens
ctctgcttctctga

SEQ ID NO: 3293123 - DNA, 16 bp, Homo sapiens
ctctgcttctctgact

SEQ ID NO: 3293124 - DNA, 18 bp, Homo sapiens
ctctgcttgcctggagac

SEQ ID NO: 3293125 - DNA, 22 bp, Homo sapiens
ctctggaataaagttgcagatg

SEQ ID NO: 3293126 - DNA, 14 bp, Homo sapiens
ctctggacaggcat

SEQ ID NO: 3293127 - DNA, 16 bp, Homo sapiens
ctctggacaggcatgt

SEQ ID NO: 3293128 - DNA, 16 bp, Homo sapiens
ctctggacggcaggct

SEQ ID NO: 3293129 - DNA, 17 bp, Homo sapiens
ctctggacggcaggctc

SEQ ID NO: 3293130 - DNA, 15 bp, Homo sapiens
ctctggactggctag

SEQ ID NO: 3293131 - DNA, 13 bp, Homo sapiens
ctctggagaacag

SEQ ID NO: 3293132 - DNA, 18 bp, Homo sapiens
ctctggagaacagtggtt

SEQ ID NO: 3293133 - DNA, 15 bp, Homo sapiens
ctctggagacagccc

SEQ ID NO: 3293134 - DNA, 20 bp, Homo sapiens
ctctggaggcctctggccct

SEQ ID NO: 3293135 - DNA, 21 bp, Homo sapiens
ctctggaggcctctggccctc

SEQ ID NO: 3293136 - DNA, 18 bp, Homo sapiens
ctctggcattagaattat

SEQ ID NO: 3293137 - DNA, 20 bp, Homo sapiens
ctctggcattagaattattt

SEQ ID NO: 3293138 - DNA, 13 bp, Homo sapiens
ctctggcatttgt

SEQ ID NO: 3293139 - DNA, 14 bp, Homo sapiens
ctctggccacaaca

SEQ ID NO: 3293140 - DNA, 16 bp, Homo sapiens
ctctggccctggccct

SEQ ID NO: 3293141 - DNA, 14 bp, Homo sapiens
ctctggcccttgcc

SEQ ID NO: 3293142 - DNA, 14 bp, Homo sapiens
ctctggcccttgga

SEQ ID NO: 3293143 - DNA, 19 bp, Homo sapiens
ctctggccttcggcctcca

SEQ ID NO: 3293144 - DNA, 16 bp, Homo sapiens
ctctggcggcttcctg

SEQ ID NO: 3293145 - DNA, 20 bp, Homo sapiens
ctctggctagaggccagccc

SEQ ID NO: 3293146 - DNA, 14 bp, Homo sapiens
ctctggctccacac

SEQ ID NO: 3293147 - DNA, 16 bp, Homo sapiens
ctctggctctcatggg

SEQ ID NO: 3293148 - DNA, 17 bp, Homo sapiens
ctctggctgaaccctgt

SEQ ID NO: 3293149 - DNA, 18 bp, Homo sapiens
ctctggctgaaccctgtg

SEQ ID NO: 3293150 - DNA, 23 bp, Homo sapiens
ctgaaagggcacttaatttgtaa

SEQ ID NO: 3293151 - DNA, 23 bp, Homo sapiens
ctgaaagtgttttactctttttc

SEQ ID NO: 3293152 - DNA, 13 bp, Homo sapiens
ctgaaagttaccc

SEQ ID NO: 3293153 - DNA, 17 bp, Homo sapiens
ctgaaataaaatgccat

SEQ ID NO: 3293154 - DNA, 13 bp, Homo sapiens
ctgaaataaacac

SEQ ID NO: 3293155 - DNA, 17 bp, Homo sapiens
ctgaaataaacactggt

SEQ ID NO: 3293156 - DNA, 21 bp, Homo sapiens
ctgaaatcttcccatgcattc

SEQ ID NO: 3293157 - DNA, 23 bp, Homo sapiens
ctgaaatcttcccatgcattctg

SEQ ID NO: 3293158 - DNA, 22 bp, Homo sapiens
ctgaaatgagcatgcattttct

SEQ ID NO: 3293159 - DNA, 17 bp, Homo sapiens
ctgaaattacatattgc

SEQ ID NO: 3293160 - DNA, 13 bp, Homo sapiens
ctgaaattatttt

SEQ ID NO: 3293161 - DNA, 15 bp, Homo sapiens
ctgaaattattttct

SEQ ID NO: 3293162 - DNA, 14 bp, Homo sapiens
ctgaaattccaaag

SEQ ID NO: 3293163 - DNA, 15 bp, Homo sapiens
ctgaaattccaaagt

SEQ ID NO: 3293164 - DNA, 14 bp, Homo sapiens
ctgaaattctaaag

SEQ ID NO: 3293165 - DNA, 20 bp, Homo sapiens
ctgaaattctcctggaggtc

SEQ ID NO: 3293166 - DNA, 23 bp, Homo sapiens
ctgaaatttgttatacttcaaaa

SEQ ID NO: 3293167 - DNA, 13 bp, Homo sapiens
ctgaaattttata

SEQ ID NO: 3293168 - DNA, 19 bp, Homo sapiens
ctgaaattttatatgctta

SEQ ID NO: 3293169 - DNA, 18 bp, Homo sapiens
ctgaaatttttttcctaa

SEQ ID NO: 3293170 - DNA, 19 bp, Homo sapiens
ctgaaatttttttcctaag

SEQ ID NO: 3293171 - DNA, 16 bp, Homo sapiens
ctgaacaaaaaataaa

SEQ ID NO: 3293172 - DNA, 20 bp, Homo sapiens
ctgaacaaatcttgggtggg

SEQ ID NO: 3293173 - DNA, 13 bp, Homo sapiens
ctgaacaagaatt

SEQ ID NO: 3293174 - DNA, 16 bp, Homo sapiens
ctgaacacaggcagct

SEQ ID NO: 3293175 - DNA, 19 bp, Homo sapiens
ctgaacaccattgaaggct

SEQ ID NO: 3293176 - DNA, 12 bp, Homo sapiens
ctgaacagtgga

SEQ ID NO: 3293177 - DNA, 12 bp, Homo sapiens
ctgaacatgttt

SEQ ID NO: 3293178 - DNA, 15 bp, Homo sapiens
ctgaacatgtttaca

SEQ ID NO: 3293179 - DNA, 16 bp, Homo sapiens
ctgaaccaaagcctct

SEQ ID NO: 3293180 - DNA, 12 bp, Homo sapiens
ctgaaccaaatt

SEQ ID NO: 3293181 - DNA, 19 bp, Homo sapiens
ctgaaccaaattgcactga

SEQ ID NO: 3293182 - DNA, 14 bp, Homo sapiens
ctgaaccatccctg

SEQ ID NO: 3293183 - DNA, 14 bp, Homo sapiens
ctgaaccccatggg

SEQ ID NO: 3293184 - DNA, 14 bp, Homo sapiens
ctgaaccctgtgct

SEQ ID NO: 3293185 - DNA, 15 bp, Homo sapiens
ctgaaccctgtgctg

SEQ ID NO: 3293186 - DNA, 18 bp, Homo sapiens
ctgaaccctgtgctggtg

SEQ ID NO: 3293187 - DNA, 23 bp, Homo sapiens
ctgaaccctgtgctggtgtcctg

SEQ ID NO: 3293188 - DNA, 15 bp, Homo sapiens
ctgaaccgcacagct

SEQ ID NO: 3293189 - DNA, 17 bp, Homo sapiens
ctgaaccgcacagctca

SEQ ID NO: 3293190 - DNA, 18 bp, Homo sapiens
ctgaaccgcacagctcag

SEQ ID NO: 3293191 - DNA, 20 bp, Homo sapiens
ctgaaccgcacagctcagga

SEQ ID NO: 3293192 - DNA, 21 bp, Homo sapiens
ctgaaccgcacagctcaggag

SEQ ID NO: 3293193 - DNA, 14 bp, Homo sapiens
ctgaacgcagaaga

SEQ ID NO: 3293194 - DNA, 15 bp, Homo sapiens
ctgaactcaaactga

SEQ ID NO: 3293195 - DNA, 13 bp, Homo sapiens
ctgaactcacttt

SEQ ID NO: 3293196 - DNA, 12 bp, Homo sapiens
ctgaactctcaa

SEQ ID NO: 3293197 - DNA, 13 bp, Homo sapiens
ctgaactctcaaa

SEQ ID NO: 3293198 - DNA, 12 bp, Homo sapiens
ctgaactgagga

SEQ ID NO: 3293199 - DNA, 16 bp, Homo sapiens
ctgaacttcagagcat

SEQ ID NO: 3293200 - DNA, 17 bp, Homo sapiens
ctgaacttgcattgtga

SEQ ID NO: 3293201 - DNA, 13 bp, Homo sapiens
ctgaactttcatt

SEQ ID NO: 3293202 - DNA, 18 bp, Homo sapiens
ctgaactttcattggatt

SEQ ID NO: 3293203 - DNA, 15 bp, Homo sapiens
ctgaactttctccct

SEQ ID NO: 3293204 - DNA, 13 bp, Homo sapiens
ctgaactttggag

SEQ ID NO: 3293205 - DNA, 17 bp, Homo sapiens
ctgaagaattaagatac

SEQ ID NO: 3293206 - DNA, 20 bp, Homo sapiens
ctgaagaattaagatacaaa

SEQ ID NO: 3293207 - DNA, 19 bp, Homo sapiens
ctgaagactcattcttctg

SEQ ID NO: 3293208 - DNA, 17 bp, Homo sapiens
ctgaagactgagaactt

SEQ ID NO: 3293209 - DNA, 21 bp, Homo sapiens
ctgaagactgagaactttttt

SEQ ID NO: 3293210 - DNA, 14 bp, Homo sapiens
ctgaagactgagga

SEQ ID NO: 3293211 - DNA, 22 bp, Homo sapiens
ctgaagagacagttatttatag

SEQ ID NO: 3293212 - DNA, 19 bp, Homo sapiens
ctgaagaggaactgggcct

SEQ ID NO: 3293213 - DNA, 19 bp, Homo sapiens
ctgaagaggaagaggagga

SEQ ID NO: 3293214 - DNA, 18 bp, Homo sapiens
ctgaagaggcgggccagc

SEQ ID NO: 3293215 - DNA, 20 bp, Homo sapiens
ctgaagaggcgggccagcca

SEQ ID NO: 3293216 - DNA, 22 bp, Homo sapiens
ctgaagaggcgggccagccagg

SEQ ID NO: 3293217 - DNA, 14 bp, Homo sapiens
ctgaagaggcttct

SEQ ID NO: 3293218 - DNA, 16 bp, Homo sapiens
ctgaagcagcctctcc

SEQ ID NO: 3293219 - DNA, 13 bp, Homo sapiens
ctgaagcatgttt

SEQ ID NO: 3293220 - DNA, 23 bp, Homo sapiens
ctgaagcatgtttcatgttttgt

SEQ ID NO: 3293221 - DNA, 15 bp, Homo sapiens
ctgaagccaaatgaa

SEQ ID NO: 3293222 - DNA, 13 bp, Homo sapiens
ctgaagccagcct

SEQ ID NO: 3293223 - DNA, 13 bp, Homo sapiens
ctgaagcctgcag

SEQ ID NO: 3293224 - DNA, 15 bp, Homo sapiens
ctgaagcctgcagga

SEQ ID NO: 3293225 - DNA, 14 bp, Homo sapiens
ctgaagcttgactc

SEQ ID NO: 3293226 - DNA, 20 bp, Homo sapiens
ctgaagcttgactcccaagt

SEQ ID NO: 3293227 - DNA, 14 bp, Homo sapiens
ctgaaggaaaaaca

SEQ ID NO: 3293228 - DNA, 16 bp, Homo sapiens
ctgaaggaaaaacaca

SEQ ID NO: 3293229 - DNA, 18 bp, Homo sapiens
ctgaaggaaaaacacaag

SEQ ID NO: 3293230 - DNA, 22 bp, Homo sapiens
ctgaaggaaaagcaagaaacag

SEQ ID NO: 3293231 - DNA, 15 bp, Homo sapiens
ctgaaggaagagaag

SEQ ID NO: 3293232 - DNA, 17 bp, Homo sapiens
ctgaaggaatagccaga

SEQ ID NO: 3293233 - DNA, 18 bp, Homo sapiens
ctgaaggaatagccagag

SEQ ID NO: 3293234 - DNA, 19 bp, Homo sapiens
ctgaaggaatagccagaga

SEQ ID NO: 3293235 - DNA, 23 bp, Homo sapiens
ctgaaggaatagccagagaggag

SEQ ID NO: 3293236 - DNA, 12 bp, Homo sapiens
ctgaaggactgg

SEQ ID NO: 3293237 - DNA, 11 bp, Homo sapiens
ctgaaggcagt

SEQ ID NO: 3293238 - DNA, 15 bp, Homo sapiens
ctgaaggcagtggca

SEQ ID NO: 3293239 - DNA, 16 bp, Homo sapiens
ctgaaggcagtggcag

SEQ ID NO: 3293240 - DNA, 20 bp, Homo sapiens
ctgaaggggcacaccactgc

SEQ ID NO: 3293241 - DNA, 21 bp, Homo sapiens
ctgaaggggcacaccactgcc

SEQ ID NO: 3293242 - DNA, 22 bp, Homo sapiens
ctgaaggtggccactttaagag

SEQ ID NO: 3293243 - DNA, 12 bp, Homo sapiens
ctgaataaatgg

SEQ ID NO: 3293244 - DNA, 14 bp, Homo sapiens
ctgaataacttgaa

SEQ ID NO: 3293245 - DNA, 13 bp, Homo sapiens
ctgaataatttct

SEQ ID NO: 3293246 - DNA, 15 bp, Homo sapiens
ctgaatagaaatggg

SEQ ID NO: 3293247 - DNA, 15 bp, Homo sapiens
ctgaatatctgttca

SEQ ID NO: 3293248 - DNA, 16 bp, Homo sapiens
ctgaatatttatattt

SEQ ID NO: 3293249 - DNA, 20 bp, Homo sapiens
ctgaatatttatatttcact

SEQ ID NO: 3293250 - DNA, 21 bp, Homo sapiens
ctgaatatttatatttcacta

SEQ ID NO: 3293251 - DNA, 14 bp, Homo sapiens
ctgaatattttgga

SEQ ID NO: 3293252 - DNA, 18 bp, Homo sapiens
ctgaatattttggaaact

SEQ ID NO: 3293253 - DNA, 20 bp, Homo sapiens
ctgaatattttttatttcta

SEQ ID NO: 3293254 - DNA, 17 bp, Homo sapiens
ctgaatccacctcggag

SEQ ID NO: 3293255 - DNA, 22 bp, Homo sapiens
ctgaatccacctcggagcatgg

SEQ ID NO: 3293256 - DNA, 23 bp, Homo sapiens
ctgaatccacctcggagcatggt

SEQ ID NO: 3293257 - DNA, 17 bp, Homo sapiens
ctgaatctgctaccaaa

SEQ ID NO: 3293258 - DNA, 22 bp, Homo sapiens
ctgaatgaaaataactgaacca

SEQ ID NO: 3293259 - DNA, 16 bp, Homo sapiens
ctgaatgcagaacggt

SEQ ID NO: 3293260 - DNA, 18 bp, Homo sapiens
ctgaatgcataaataaat

SEQ ID NO: 3293261 - DNA, 17 bp, Homo sapiens
ctgaatgcctcctgtgg

SEQ ID NO: 3293262 - DNA, 19 bp, Homo sapiens
ctgaatgcctcgctccctt

SEQ ID NO: 3293263 - DNA, 12 bp, Homo sapiens
ctgaatgctctg

SEQ ID NO: 3293264 - DNA, 22 bp, Homo sapiens
ctgaatggttccatgcctgagg

SEQ ID NO: 3293265 - DNA, 16 bp, Homo sapiens
ctgaatgtaaaagaaa

SEQ ID NO: 3293266 - DNA, 17 bp, Homo sapiens
ctgaatgtaaaagaaaa

SEQ ID NO: 3293267 - DNA, 16 bp, Homo sapiens
ctgaatgtaatttgtg

SEQ ID NO: 3293268 - DNA, 18 bp, Homo sapiens
ctgaatgtaatttgtgta

SEQ ID NO: 3293269 - DNA, 21 bp, Homo sapiens
ctgaatgtatttatgtgtata

SEQ ID NO: 3293270 - DNA, 23 bp, Homo sapiens
ctgaatgtatttatgtgtatatt

SEQ ID NO: 3293271 - DNA, 13 bp, Homo sapiens
ctgaatgtgccta

SEQ ID NO: 3293272 - DNA, 11 bp, Homo sapiens
ctgaatgttct

SEQ ID NO: 3293273 - DNA, 20 bp, Homo sapiens
ctgaatgttctgacattaac

SEQ ID NO: 3293274 - DNA, 16 bp, Homo sapiens
ctgaatgtttattcct

SEQ ID NO: 3293275 - DNA, 18 bp, Homo sapiens
ctgaatgtttattccttg

SEQ ID NO: 3293276 - DNA, 18 bp, Homo sapiens
ctgaattaaacatgaaag

SEQ ID NO: 3293277 - DNA, 20 bp, Homo sapiens
ctgcagaaggaaagaagggg

SEQ ID NO: 3293278 - DNA, 18 bp, Homo sapiens
ctgcagaatgactccacc

SEQ ID NO: 3293279 - DNA, 15 bp, Homo sapiens
ctgcagacttcccag

SEQ ID NO: 3293280 - DNA, 14 bp, Homo sapiens
ctgcagagatttct

SEQ ID NO: 3293281 - DNA, 15 bp, Homo sapiens
ctgcagagcaccttt

SEQ ID NO: 3293282 - DNA, 20 bp, Homo sapiens
ctgcagagcaggaaacatga

SEQ ID NO: 3293283 - DNA, 13 bp, Homo sapiens
ctgcagaggccag

SEQ ID NO: 3293284 - DNA, 13 bp, Homo sapiens
ctgcagagggacc

SEQ ID NO: 3293285 - DNA, 19 bp, Homo sapiens
ctgcagaggggctttctgg

SEQ ID NO: 3293286 - DNA, 20 bp, Homo sapiens
ctgcagaggggctttctgga

SEQ ID NO: 3293287 - DNA, 22 bp, Homo sapiens
ctgcagaggggctttctggaga

SEQ ID NO: 3293288 - DNA, 22 bp, Homo sapiens
ctgcagagggttaggagtgggt

SEQ ID NO: 3293289 - DNA, 17 bp, Homo sapiens
ctgcagatcttccgtgg

SEQ ID NO: 3293290 - DNA, 21 bp, Homo sapiens
ctgcagatgccaccctagcca

SEQ ID NO: 3293291 - DNA, 14 bp, Homo sapiens
ctgcagcacctcca

SEQ ID NO: 3293292 - DNA, 17 bp, Homo sapiens
ctgcagcacctccaggc

SEQ ID NO: 3293293 - DNA, 14 bp, Homo sapiens
ctgcagcagagtga

SEQ ID NO: 3293294 - DNA, 21 bp, Homo sapiens
ctgcagcaggaactctggacc

SEQ ID NO: 3293295 - DNA, 11 bp, Homo sapiens
ctgcagcatga

SEQ ID NO: 3293296 - DNA, 17 bp, Homo sapiens
ctgcagcatgacctgtg

SEQ ID NO: 3293297 - DNA, 18 bp, Homo sapiens
ctgcagcatgttgctgag

SEQ ID NO: 3293298 - DNA, 12 bp, Homo sapiens
ctgcagccagct

SEQ ID NO: 3293299 - DNA, 22 bp, Homo sapiens
ctgcagccagctcacgtccagg

SEQ ID NO: 3293300 - DNA, 21 bp, Homo sapiens
ctgcagcccaaaacccagggc

SEQ ID NO: 3293301 - DNA, 23 bp, Homo sapiens
ctgcagcccaaaacccagggcaa

SEQ ID NO: 3293302 - DNA, 16 bp, Homo sapiens
ctgcagcccaggaggc

SEQ ID NO: 3293303 - DNA, 13 bp, Homo sapiens
ctgcagcccttgg

SEQ ID NO: 3293304 - DNA, 17 bp, Homo sapiens
ctgcagcccttgggcag

SEQ ID NO: 3293305 - DNA, 20 bp, Homo sapiens
ctgcagcccttgggcagttc

SEQ ID NO: 3293306 - DNA, 11 bp, Homo sapiens
ctgcagcctca

SEQ ID NO: 3293307 - DNA, 23 bp, Homo sapiens
ctgcagcctcaacctcctgggct

SEQ ID NO: 3293308 - DNA, 16 bp, Homo sapiens
ctgcagcctcctcctg

SEQ ID NO: 3293309 - DNA, 22 bp, Homo sapiens
ctgcagctatgcgcaatgtggc

SEQ ID NO: 3293310 - DNA, 14 bp, Homo sapiens
ctgcagctgggccc

SEQ ID NO: 3293311 - DNA, 21 bp, Homo sapiens
ctgcagctttacatgcaattt

SEQ ID NO: 3293312 - DNA, 22 bp, Homo sapiens
ctgcaggaacgagcactggcca

SEQ ID NO: 3293313 - DNA, 16 bp, Homo sapiens
ctgcaggagtgctggc

SEQ ID NO: 3293314 - DNA, 20 bp, Homo sapiens
ctgcaggagtgtcctgccca

SEQ ID NO: 3293315 - DNA, 24 bp, Homo sapiens
ctgcaggccaagagcagaggcagc

SEQ ID NO: 3293316 - DNA, 14 bp, Homo sapiens
ctgcaggccctggc

SEQ ID NO: 3293317 - DNA, 17 bp, Homo sapiens
ctgcaggccctggcctc

SEQ ID NO: 3293318 - DNA, 15 bp, Homo sapiens
ctgcaggcttaataa

SEQ ID NO: 3293319 - DNA, 16 bp, Homo sapiens
ctgcagggccaagcac

SEQ ID NO: 3293320 - DNA, 19 bp, Homo sapiens
ctgcagggcgcccctggga

SEQ ID NO: 3293321 - DNA, 15 bp, Homo sapiens
ctgcaggggctctgg

SEQ ID NO: 3293322 - DNA, 22 bp, Homo sapiens
ctgcaggggctctggagagaaa

SEQ ID NO: 3293323 - DNA, 17 bp, Homo sapiens
ctgcagggggtgtgtct

SEQ ID NO: 3293324 - DNA, 19 bp, Homo sapiens
ctgcaggtacttcctcctg

SEQ ID NO: 3293325 - DNA, 23 bp, Homo sapiens
ctgcaggtacttcctcctgatgg

SEQ ID NO: 3293326 - DNA, 19 bp, Homo sapiens
ctgcaggttggaccccaga

SEQ ID NO: 3293327 - DNA, 14 bp, Homo sapiens
ctgcagtccgcagt

SEQ ID NO: 3293328 - DNA, 21 bp, Homo sapiens
ctgcagtccgcagtctggcct

SEQ ID NO: 3293329 - DNA, 13 bp, Homo sapiens
ctgcagtcctgga

SEQ ID NO: 3293330 - DNA, 17 bp, Homo sapiens
ctgcagtcttatttcca

SEQ ID NO: 3293331 - DNA, 15 bp, Homo sapiens
ctgcagtgagctgtg

SEQ ID NO: 3293332 - DNA, 17 bp, Homo sapiens
ctgcagttctttttgta

SEQ ID NO: 3293333 - DNA, 21 bp, Homo sapiens
ctgcagttctttttgtacact

SEQ ID NO: 3293334 - DNA, 17 bp, Homo sapiens
ctgcagttgactttctc

SEQ ID NO: 3293335 - DNA, 19 bp, Homo sapiens
ctgcagtttgagacaggag

SEQ ID NO: 3293336 - DNA, 21 bp, Homo sapiens
ctgcagtttgagacaggagac

SEQ ID NO: 3293337 - DNA, 21 bp, Homo sapiens
ctgcagttttgctatctgggc

SEQ ID NO: 3293338 - DNA, 22 bp, Homo sapiens
ctgcagttttgctatctgggct

SEQ ID NO: 3293339 - DNA, 15 bp, Homo sapiens
ctgcataatgtttct

SEQ ID NO: 3293340 - DNA, 22 bp, Homo sapiens
ctgcataatgtttctggatttc

SEQ ID NO: 3293341 - DNA, 14 bp, Homo sapiens
ctgcatacttttta

SEQ ID NO: 3293342 - DNA, 20 bp, Homo sapiens
ctgcatactttttaaatgta

SEQ ID NO: 3293343 - DNA, 15 bp, Homo sapiens
ctgcatatgaaagga

SEQ ID NO: 3293344 - DNA, 16 bp, Homo sapiens
ctgcatcccagcacct

SEQ ID NO: 3293345 - DNA, 15 bp, Homo sapiens
ctgcatccccttggc

SEQ ID NO: 3293346 - DNA, 16 bp, Homo sapiens
ctgcatccccttggct

SEQ ID NO: 3293347 - DNA, 18 bp, Homo sapiens
ctgcatctggggcccata

SEQ ID NO: 3293348 - DNA, 22 bp, Homo sapiens
ctgcatcttatagcactttgaa

SEQ ID NO: 3293349 - DNA, 23 bp, Homo sapiens
ctgcatcttatagcactttgaaa

SEQ ID NO: 3293350 - DNA, 13 bp, Homo sapiens
ctgcatgaaaaat

SEQ ID NO: 3293351 - DNA, 16 bp, Homo sapiens
ctgcatgaatatcata

SEQ ID NO: 3293352 - DNA, 18 bp, Homo sapiens
ctgcatgcaaacaagaaa

SEQ ID NO: 3293353 - DNA, 17 bp, Homo sapiens
ctgcatggacctaacat

SEQ ID NO: 3293354 - DNA, 19 bp, Homo sapiens
ctgcatggacctaacattc

SEQ ID NO: 3293355 - DNA, 13 bp, Homo sapiens
ctgcattagaaaa

SEQ ID NO: 3293356 - DNA, 16 bp, Homo sapiens
ctgcattcatttttat

SEQ ID NO: 3293357 - DNA, 21 bp, Homo sapiens
ctgcattcctgtaacttttaa

SEQ ID NO: 3293358 - DNA, 13 bp, Homo sapiens
ctgcattctctcc

SEQ ID NO: 3293359 - DNA, 19 bp, Homo sapiens
ctgcattctctcccatcct

SEQ ID NO: 3293360 - DNA, 20 bp, Homo sapiens
ctgcattctctcccatcctg

SEQ ID NO: 3293361 - DNA, 21 bp, Homo sapiens
ctgcattctctcccatcctgg

SEQ ID NO: 3293362 - DNA, 21 bp, Homo sapiens
ctgcattctgcctctctagga

SEQ ID NO: 3293363 - DNA, 23 bp, Homo sapiens
ctgcattgagcttgcatgcttgc

SEQ ID NO: 3293364 - DNA, 19 bp, Homo sapiens
ctgcattgttattgtggaa

SEQ ID NO: 3293365 - DNA, 17 bp, Homo sapiens
ctgcatttagcacaaaa

SEQ ID NO: 3293366 - DNA, 14 bp, Homo sapiens
ctgcatttctgagt

SEQ ID NO: 3293367 - DNA, 14 bp, Homo sapiens
ctgcatttgtgaaa

SEQ ID NO: 3293368 - DNA, 17 bp, Homo sapiens
ctgcatttgtgaaatga

SEQ ID NO: 3293369 - DNA, 17 bp, Homo sapiens
ctgcattttcaccccac

SEQ ID NO: 3293370 - DNA, 22 bp, Homo sapiens
ctgcatttttcactttgctctc

SEQ ID NO: 3293371 - DNA, 23 bp, Homo sapiens
ctgcatttttcactttgctctca

SEQ ID NO: 3293372 - DNA, 21 bp, Homo sapiens
ctgccaaagggaaatatcatt

SEQ ID NO: 3293373 - DNA, 19 bp, Homo sapiens
ctgccaaataaacagctat

SEQ ID NO: 3293374 - DNA, 17 bp, Homo sapiens
ctgccaagccagattct

SEQ ID NO: 3293375 - DNA, 22 bp, Homo sapiens
ctgccaagccagattctcttga

SEQ ID NO: 3293376 - DNA, 23 bp, Homo sapiens
ctgccaagccagattctcttgaa

SEQ ID NO: 3293377 - DNA, 15 bp, Homo sapiens
ctgccaaggccagag

SEQ ID NO: 3293378 - DNA, 18 bp, Homo sapiens
ctgccaaggccagagtgg

SEQ ID NO: 3293379 - DNA, 19 bp, Homo sapiens
ctgccaagtctcagaagag

SEQ ID NO: 3293380 - DNA, 23 bp, Homo sapiens
ctgccaagtggggatggggcctc

SEQ ID NO: 3293381 - DNA, 23 bp, Homo sapiens
ctgccaattgctaccgagaaggt

SEQ ID NO: 3293382 - DNA, 17 bp, Homo sapiens
ctgccacaacagaataa

SEQ ID NO: 3293383 - DNA, 18 bp, Homo sapiens
ctgccacaacagaataaa

SEQ ID NO: 3293384 - DNA, 18 bp, Homo sapiens
ctgccacactctgacgca

SEQ ID NO: 3293385 - DNA, 13 bp, Homo sapiens
ctgccacagagaa

SEQ ID NO: 3293386 - DNA, 17 bp, Homo sapiens
ctgccacatacaggtgc

SEQ ID NO: 3293387 - DNA, 23 bp, Homo sapiens
ctgccacatggagccccctctgc

SEQ ID NO: 3293388 - DNA, 14 bp, Homo sapiens
ctgccaccacgtct

SEQ ID NO: 3293389 - DNA, 18 bp, Homo sapiens
ctgccaccacgtctgcca

SEQ ID NO: 3293390 - DNA, 15 bp, Homo sapiens
ctgccaccaggccac

SEQ ID NO: 3293391 - DNA, 18 bp, Homo sapiens
ctgccacccactcaggat

SEQ ID NO: 3293392 - DNA, 23 bp, Homo sapiens
ctgccacccgcttcctgtttctt

SEQ ID NO: 3293393 - DNA, 14 bp, Homo sapiens
ctgccaccctgggg

SEQ ID NO: 3293394 - DNA, 15 bp, Homo sapiens
ctgccaccctgggga

SEQ ID NO: 3293395 - DNA, 15 bp, Homo sapiens
ctgccaccctgtagc

SEQ ID NO: 3293396 - DNA, 23 bp, Homo sapiens
ctgccaccggaggtcactccacc

SEQ ID NO: 3293397 - DNA, 15 bp, Homo sapiens
ctgccaccttgtggc

SEQ ID NO: 3293398 - DNA, 16 bp, Homo sapiens
ctgccactcactaggc

SEQ ID NO: 3293399 - DNA, 14 bp, Homo sapiens
ctgccagcacagag

SEQ ID NO: 3293400 - DNA, 17 bp, Homo sapiens
ctgccagcagcagcagg

SEQ ID NO: 3293401 - DNA, 19 bp, Homo sapiens
ctgccagcagcagcaggtg

SEQ ID NO: 3293402 - DNA, 19 bp, Homo sapiens
ctgcctgttcagctccagc

SEQ ID NO: 3293403 - DNA, 20 bp, Homo sapiens
ctgcctgttcagctccagct

SEQ ID NO: 3293404 - DNA, 19 bp, Homo sapiens
ctgcctgttcccattcttg

SEQ ID NO: 3293405 - DNA, 18 bp, Homo sapiens
ctgcctgttctgaggatt

SEQ ID NO: 3293406 - DNA, 19 bp, Homo sapiens
ctgccttaaaaccaaagag

SEQ ID NO: 3293407 - DNA, 22 bp, Homo sapiens
ctgccttaaaaccaaagagggc

SEQ ID NO: 3293408 - DNA, 20 bp, Homo sapiens
ctgccttactggtttcccca

SEQ ID NO: 3293409 - DNA, 16 bp, Homo sapiens
ctgccttagaggagcc

SEQ ID NO: 3293410 - DNA, 19 bp, Homo sapiens
ctgccttaggcctacctga

SEQ ID NO: 3293411 - DNA, 12 bp, Homo sapiens
ctgccttcccta

SEQ ID NO: 3293412 - DNA, 16 bp, Homo sapiens
ctgccttccctagctt

SEQ ID NO: 3293413 - DNA, 17 bp, Homo sapiens
ctgccttccctagcttt

SEQ ID NO: 3293414 - DNA, 16 bp, Homo sapiens
ctgccttcctcatccc

SEQ ID NO: 3293415 - DNA, 14 bp, Homo sapiens
ctgccttcctcctt

SEQ ID NO: 3293416 - DNA, 20 bp, Homo sapiens
ctgccttcgcttcttgcctc

SEQ ID NO: 3293417 - DNA, 13 bp, Homo sapiens
ctgccttcgttaa

SEQ ID NO: 3293418 - DNA, 19 bp, Homo sapiens
ctgccttcgttaactgtgt

SEQ ID NO: 3293419 - DNA, 17 bp, Homo sapiens
ctgccttctcctctctg

SEQ ID NO: 3293420 - DNA, 22 bp, Homo sapiens
ctgccttctcctctctgggcct

SEQ ID NO: 3293421 - DNA, 20 bp, Homo sapiens
ctgccttctgacggccctgc

SEQ ID NO: 3293422 - DNA, 15 bp, Homo sapiens
ctgccttctgtcctg

SEQ ID NO: 3293423 - DNA, 22 bp, Homo sapiens
ctgccttcttctttttgctgtt

SEQ ID NO: 3293424 - DNA, 20 bp, Homo sapiens
ctgccttgaagccactgaag

SEQ ID NO: 3293425 - DNA, 13 bp, Homo sapiens
ctgccttgagcta

SEQ ID NO: 3293426 - DNA, 21 bp, Homo sapiens
ctgccttgagctaaccccaag

SEQ ID NO: 3293427 - DNA, 12 bp, Homo sapiens
ctgccttgctcc

SEQ ID NO: 3293428 - DNA, 17 bp, Homo sapiens
ctgccttggcctcccaa

SEQ ID NO: 3293429 - DNA, 20 bp, Homo sapiens
ctgccttgggccttgctgct

SEQ ID NO: 3293430 - DNA, 16 bp, Homo sapiens
ctgcctttaagccaaa

SEQ ID NO: 3293431 - DNA, 23 bp, Homo sapiens
ctgcctttctcccccgacactgc

SEQ ID NO: 3293432 - DNA, 21 bp, Homo sapiens
ctgcctttgacatttaattta

SEQ ID NO: 3293433 - DNA, 17 bp, Homo sapiens
ctgcgaaggggccctgg

SEQ ID NO: 3293434 - DNA, 18 bp, Homo sapiens
ctgcgaaggggccctggt

SEQ ID NO: 3293435 - DNA, 16 bp, Homo sapiens
ctgcgactttctgcct

SEQ ID NO: 3293436 - DNA, 22 bp, Homo sapiens
ctgcgagacgcacacagctgag

SEQ ID NO: 3293437 - DNA, 18 bp, Homo sapiens
ctgcgcaccaatgcccag

SEQ ID NO: 3293438 - DNA, 15 bp, Homo sapiens
ctgcgccacttcctt

SEQ ID NO: 3293439 - DNA, 17 bp, Homo sapiens
ctgcgccccgcccacac

SEQ ID NO: 3293440 - DNA, 18 bp, Homo sapiens
ctgcgccccgcccacacc

SEQ ID NO: 3293441 - DNA, 12 bp, Homo sapiens
ctgcgcctcagg

SEQ ID NO: 3293442 - DNA, 20 bp, Homo sapiens
ctgcgctggacgatagcttg

SEQ ID NO: 3293443 - DNA, 13 bp, Homo sapiens
ctgcgcttgcttt

SEQ ID NO: 3293444 - DNA, 20 bp, Homo sapiens
ctgcggaatgaaccacatct

SEQ ID NO: 3293445 - DNA, 21 bp, Homo sapiens
ctgcggaatgaaccacatctt

SEQ ID NO: 3293446 - DNA, 15 bp, Homo sapiens
ctgcggaccaaggga

SEQ ID NO: 3293447 - DNA, 20 bp, Homo sapiens
ctgcggaccaagggactcca

SEQ ID NO: 3293448 - DNA, 21 bp, Homo sapiens
ctgcggagtgaagaggggcag

SEQ ID NO: 3293449 - DNA, 14 bp, Homo sapiens
ctgcggctgtctcc

SEQ ID NO: 3293450 - DNA, 14 bp, Homo sapiens
ctgcgggaggccct

SEQ ID NO: 3293451 - DNA, 17 bp, Homo sapiens
ctgcgggaggccctggc

SEQ ID NO: 3293452 - DNA, 19 bp, Homo sapiens
ctgcgggaggccctggccc

SEQ ID NO: 3293453 - DNA, 20 bp, Homo sapiens
ctgcgggaggccctggccct

SEQ ID NO: 3293454 - DNA, 18 bp, Homo sapiens
ctgcgggatggtcctggg

SEQ ID NO: 3293455 - DNA, 19 bp, Homo sapiens
ctgcgggatggtcctgggg

SEQ ID NO: 3293456 - DNA, 20 bp, Homo sapiens
ctgcgggcgcgggcagccac

SEQ ID NO: 3293457 - DNA, 18 bp, Homo sapiens
ctgcgggctccctggcag

SEQ ID NO: 3293458 - DNA, 20 bp, Homo sapiens
ctgcgggctccctggcagga

SEQ ID NO: 3293459 - DNA, 14 bp, Homo sapiens
ctgcggggagacag

SEQ ID NO: 3293460 - DNA, 19 bp, Homo sapiens
ctgcggggagacagaagcc

SEQ ID NO: 3293461 - DNA, 14 bp, Homo sapiens
ctgcgggttttaat

SEQ ID NO: 3293462 - DNA, 14 bp, Homo sapiens
ctgcggtcaggctg

SEQ ID NO: 3293463 - DNA, 19 bp, Homo sapiens
ctgcggtccacccaggagc

SEQ ID NO: 3293464 - DNA, 23 bp, Homo sapiens
ctgcggtccacccaggagccccg

SEQ ID NO: 3293465 - DNA, 22 bp, Homo sapiens
ctgcggtttgttggatcttcaa

SEQ ID NO: 3293466 - DNA, 15 bp, Homo sapiens
ctgcgtccccactcc

SEQ ID NO: 3293467 - DNA, 17 bp, Homo sapiens
ctgcgtccccactccct

SEQ ID NO: 3293468 - DNA, 22 bp, Homo sapiens
ctgcgtctggaggggcccctgc

SEQ ID NO: 3293469 - DNA, 21 bp, Homo sapiens
ctgcgtggcctgagtcctggt

SEQ ID NO: 3293470 - DNA, 17 bp, Homo sapiens
ctgcgttggtccagagc

SEQ ID NO: 3293471 - DNA, 19 bp, Homo sapiens
ctgctaaatctcctatttt

SEQ ID NO: 3293472 - DNA, 20 bp, Homo sapiens
ctgctaaatctcctattttt

SEQ ID NO: 3293473 - DNA, 16 bp, Homo sapiens
ctgctaacctggaaag

SEQ ID NO: 3293474 - DNA, 20 bp, Homo sapiens
ctgctacagcaatttctaat

SEQ ID NO: 3293475 - DNA, 17 bp, Homo sapiens
ctgctaccgccctgggc

SEQ ID NO: 3293476 - DNA, 20 bp, Homo sapiens
ctgctacctctgagaagaca

SEQ ID NO: 3293477 - DNA, 15 bp, Homo sapiens
ctgctacctgttctt

SEQ ID NO: 3293478 - DNA, 17 bp, Homo sapiens
ctgctactcctgtgctc

SEQ ID NO: 3293479 - DNA, 22 bp, Homo sapiens
ctgctagaacttttttaaataa

SEQ ID NO: 3293480 - DNA, 14 bp, Homo sapiens
ctgctagagcaacc

SEQ ID NO: 3293481 - DNA, 14 bp, Homo sapiens
ctgctagatttcta

SEQ ID NO: 3293482 - DNA, 17 bp, Homo sapiens
ctgctagatttctacat

SEQ ID NO: 3293483 - DNA, 14 bp, Homo sapiens
ctgctagattttaa

SEQ ID NO: 3293484 - DNA, 16 bp, Homo sapiens
ctgctagattttaatt

SEQ ID NO: 3293485 - DNA, 21 bp, Homo sapiens
ctgctagattttaatttattt

SEQ ID NO: 3293486 - DNA, 22 bp, Homo sapiens
ctgctagattttaatttatttg

SEQ ID NO: 3293487 - DNA, 13 bp, Homo sapiens
ctgctatacacaa

SEQ ID NO: 3293488 - DNA, 16 bp, Homo sapiens
ctgctatcctgccaaa

SEQ ID NO: 3293489 - DNA, 23 bp, Homo sapiens
ctgctatgcagatgtctaagaca

SEQ ID NO: 3293490 - DNA, 14 bp, Homo sapiens
ctgctattaacctt

SEQ ID NO: 3293491 - DNA, 15 bp, Homo sapiens
ctgctattaaccttg

SEQ ID NO: 3293492 - DNA, 16 bp, Homo sapiens
ctgctcacatatctgt

SEQ ID NO: 3293493 - DNA, 19 bp, Homo sapiens
ctgctcacatatctgtcat

SEQ ID NO: 3293494 - DNA, 18 bp, Homo sapiens
ctgctcacgtcaaatgca

SEQ ID NO: 3293495 - DNA, 12 bp, Homo sapiens
ctgctcacttta

SEQ ID NO: 3293496 - DNA, 18 bp, Homo sapiens
ctgctcactttaaacctg

SEQ ID NO: 3293497 - DNA, 13 bp, Homo sapiens
ctgctcagaattc

SEQ ID NO: 3293498 - DNA, 15 bp, Homo sapiens
ctgctcagccaagct

SEQ ID NO: 3293499 - DNA, 16 bp, Homo sapiens
ctgctcagccaagctt

SEQ ID NO: 3293500 - DNA, 23 bp, Homo sapiens
ctgctcagtgcttgggctccacg

SEQ ID NO: 3293501 - DNA, 23 bp, Homo sapiens
ctgctccaacccccgccacctca

SEQ ID NO: 3293502 - DNA, 13 bp, Homo sapiens
ctgctccaccaca

SEQ ID NO: 3293503 - DNA, 16 bp, Homo sapiens
ctgctccaccacatcc

SEQ ID NO: 3293504 - DNA, 15 bp, Homo sapiens
ctgctccaccagcag

SEQ ID NO: 3293505 - DNA, 16 bp, Homo sapiens
ctgctccaccagcagc

SEQ ID NO: 3293506 - DNA, 14 bp, Homo sapiens
ctgctccacccttg

SEQ ID NO: 3293507 - DNA, 16 bp, Homo sapiens
ctgctccacccttggc

SEQ ID NO: 3293508 - DNA, 18 bp, Homo sapiens
ctgctccacccttggcct

SEQ ID NO: 3293509 - DNA, 20 bp, Homo sapiens
ctgctccacccttggcctgt

SEQ ID NO: 3293510 - DNA, 21 bp, Homo sapiens
ctgctccacccttggcctgtc

SEQ ID NO: 3293511 - DNA, 16 bp, Homo sapiens
ctgctccacgaagcct

SEQ ID NO: 3293512 - DNA, 12 bp, Homo sapiens
ctgctccacgcg

SEQ ID NO: 3293513 - DNA, 14 bp, Homo sapiens
ctgctccacgcgct

SEQ ID NO: 3293514 - DNA, 14 bp, Homo sapiens
ctgctccaggcctg

SEQ ID NO: 3293515 - DNA, 21 bp, Homo sapiens
ctgctccatttataaccccag

SEQ ID NO: 3293516 - DNA, 17 bp, Homo sapiens
ctgctcccagcagccct

SEQ ID NO: 3293517 - DNA, 18 bp, Homo sapiens
ctgctcccagcctgctga

SEQ ID NO: 3293518 - DNA, 14 bp, Homo sapiens
ctgctcccattcct

SEQ ID NO: 3293519 - DNA, 17 bp, Homo sapiens
ctgctccccagccctgg

SEQ ID NO: 3293520 - DNA, 16 bp, Homo sapiens
ctgctccccaggggag

SEQ ID NO: 3293521 - DNA, 14 bp, Homo sapiens
ctgctcccctaacc

SEQ ID NO: 3293522 - DNA, 16 bp, Homo sapiens
ctgctccctgaagcca

SEQ ID NO: 3293523 - DNA, 19 bp, Homo sapiens
ctgctccctgaagccagcc

SEQ ID NO: 3293524 - DNA, 20 bp, Homo sapiens
ctgctccctgaagccagcct

SEQ ID NO: 3293525 - DNA, 22 bp, Homo sapiens
ctgctccctgaagccagccttc

SEQ ID NO: 3293526 - DNA, 21 bp, Homo sapiens
ctgctccgctgctccttggct

SEQ ID NO: 3293527 - DNA, 20 bp, Homo sapiens
ctgtggccgtctcctccctc

SEQ ID NO: 3293528 - DNA, 20 bp, Homo sapiens
ctgtggccgttatctggaag

SEQ ID NO: 3293529 - DNA, 14 bp, Homo sapiens
ctgtggcctcaccc

SEQ ID NO: 3293530 - DNA, 17 bp, Homo sapiens
ctgtggcctcaccctga

SEQ ID NO: 3293531 - DNA, 16 bp, Homo sapiens
ctgtggcctgggcaag

SEQ ID NO: 3293532 - DNA, 15 bp, Homo sapiens
ctgtggcctgtgtcc

SEQ ID NO: 3293533 - DNA, 16 bp, Homo sapiens
ctgtggcctgtgtcca

SEQ ID NO: 3293534 - DNA, 19 bp, Homo sapiens
ctgtggcctgtgtccagca

SEQ ID NO: 3293535 - DNA, 20 bp, Homo sapiens
ctgtggcctgtgtccagcag

SEQ ID NO: 3293536 - DNA, 21 bp, Homo sapiens
ctgtggcctgtgtccagcagc

SEQ ID NO: 3293537 - DNA, 16 bp, Homo sapiens
ctgtgggaaggccagc

SEQ ID NO: 3293538 - DNA, 15 bp, Homo sapiens
ctgtgggattctgat

SEQ ID NO: 3293539 - DNA, 20 bp, Homo sapiens
ctgtgggattctgatttgta

SEQ ID NO: 3293540 - DNA, 15 bp, Homo sapiens
ctgtgggcagcaccc

SEQ ID NO: 3293541 - DNA, 14 bp, Homo sapiens
ctgtgggcctcaag

SEQ ID NO: 3293542 - DNA, 14 bp, Homo sapiens
ctgtggggaaaggg

SEQ ID NO: 3293543 - DNA, 21 bp, Homo sapiens
ctgtggggaggggttgttttg

SEQ ID NO: 3293544 - DNA, 14 bp, Homo sapiens
ctgtggggctggta

SEQ ID NO: 3293545 - DNA, 23 bp, Homo sapiens
ctgtgggggtgagggtcccatgt

SEQ ID NO: 3293546 - DNA, 24 bp, Homo sapiens
ctgtgggggtgagggtcccatgtg
